United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 60

SEQ ID NO: 2134377 - RNA, 11 nt, Staphylococcus aureus subsp. aureus N315
aaauucuuuuu

SEQ ID NO: 2134378 - RNA, 14 nt, Staphylococcus aureus subsp. aureus N315
aaauucuuuuguaa

SEQ ID NO: 2134379 - RNA, 13 nt, Staphylococcus aureus subsp. aureus N315
aaauugaaauuau

SEQ ID NO: 2134380 - RNA, 22 nt, Staphylococcus aureus subsp. aureus N315
aaauugaauaucacuuuagaua

SEQ ID NO: 2134381 - RNA, 22 nt, Staphylococcus aureus subsp. aureus N315
aaauugaaauguuuaucaauuc

SEQ ID NO: 2134382 - RNA, 18 nt, Staphylococcus aureus subsp. aureus N315
aaauugaacuuuguaucu

SEQ ID NO: 2134383 - RNA, 23 nt, Staphylococcus aureus subsp. aureus N315
aagaauuaauucgccuaaauggu

SEQ ID NO: 2134384 - RNA, 14 nt, Staphylococcus aureus subsp. aureus N315
aagaauuaaguagu

SEQ ID NO: 2134385 - RNA, 20 nt, Staphylococcus aureus subsp. aureus N315
aagaaugccuuuuauuuauc

SEQ ID NO: 2134386 - RNA, 16 nt, Staphylococcus aureus subsp. aureus N315
aagaaugauuuauaaa

SEQ ID NO: 2134387 - RNA, 17 nt, Staphylococcus aureus subsp. aureus N315
aagaaugauuuauaaaa

SEQ ID NO: 2134388 - RNA, 16 nt, Staphylococcus aureus subsp. aureus N315
aagaauauaagugauu

SEQ ID NO: 2134389 - RNA, 22 nt, Staphylococcus aureus subsp. aureus N315
aagaaucagcuaaauauuuuac

SEQ ID NO: 2134390 - RNA, 14 nt, Staphylococcus aureus subsp. aureus N315
aagaaucauuuaaa

SEQ ID NO: 2134391 - RNA, 21 nt, Staphylococcus aureus subsp. aureus N315
aagaauccuaugccaaauaac

SEQ ID NO: 2134392 - RNA, 12 nt, Staphylococcus aureus subsp. aureus N315
aagaauuuaaaa

SEQ ID NO: 2134393 - RNA, 17 nt, Staphylococcus aureus subsp. aureus N315
aagaauuucgaaaagaa

SEQ ID NO: 2134394 - RNA, 20 nt, Staphylococcus aureus subsp. aureus N315
aagaauuucgaaaagaaauu

SEQ ID NO: 2134395 - RNA, 21 nt, Staphylococcus aureus subsp. aureus N315
aagaccauuuuauauuuuagu

SEQ ID NO: 2134396 - RNA, 15 nt, Staphylococcus aureus subsp. aureus N315
aagaccauuuuauau

SEQ ID NO: 2134397 - RNA, 16 nt, Staphylococcus aureus subsp. aureus N315
aagaccccgaaaagag

SEQ ID NO: 2134398 - RNA, 12 nt, Staphylococcus aureus subsp. aureus N315
aagacauaugca

SEQ ID NO: 2134399 - RNA, 15 nt, Staphylococcus aureus subsp. aureus N315
aagacaugagauuau

SEQ ID NO: 2134400 - RNA, 19 nt, Staphylococcus aureus subsp. aureus N315
aagacauacagucaauaca

SEQ ID NO: 2134401 - RNA, 21 nt, Staphylococcus aureus subsp. aureus N315
aagacauacucacaaaaaaca

SEQ ID NO: 2134402 - RNA, 20 nt, Staphylococcus aureus subsp. aureus N315
aagacauacagucaauacaa

SEQ ID NO: 2134403 - RNA, 13 nt, Staphylococcus aureus subsp. aureus N315
aagaccauuuuau

SEQ ID NO: 2134404 - RNA, 22 nt, Staphylococcus aureus subsp. aureus N315
aagaccaaauauuuuaucugua

SEQ ID NO: 2134405 - RNA, 18 nt, Staphylococcus aureus subsp. aureus N315
aaugucgaucuaacaauu

SEQ ID NO: 2134406 - RNA, 18 nt, Staphylococcus aureus subsp. aureus N315
aauguccgacuugauaaa

SEQ ID NO: 2134407 - RNA, 22 nt, Staphylococcus aureus subsp. aureus N315
aaugucccaagcccugacaauu

SEQ ID NO: 2134408 - RNA, 21 nt, Staphylococcus aureus subsp. aureus N315
aauguauugcuauaagaacua

SEQ ID NO: 2134409 - RNA, 20 nt, Staphylococcus aureus subsp. aureus N315
aauguauuuuuacuuuuaua

SEQ ID NO: 2134410 - RNA, 23 nt, Staphylococcus aureus subsp. aureus N315
aaugucauagccuauuuaaaaga

SEQ ID NO: 2134411 - RNA, 22 nt, Staphylococcus aureus subsp. aureus N315
aaugugagauacguuauuucaa

SEQ ID NO: 2134412 - RNA, 19 nt, Staphylococcus aureus subsp. aureus N315
aaugucucuuuucacgaau

SEQ ID NO: 2134413 - RNA, 14 nt, Staphylococcus aureus subsp. aureus N315
aaugucuucauaau

SEQ ID NO: 2134414 - RNA, 21 nt, Staphylococcus aureus subsp. aureus N315
aaugucguauauguaaucaga

SEQ ID NO: 2134415 - RNA, 16 nt, Staphylococcus aureus subsp. aureus N315
aaugucucuuuucacg

SEQ ID NO: 2134416 - RNA, 15 nt, Staphylococcus aureus subsp. aureus N315
aaugucguauaugua

SEQ ID NO: 2134417 - RNA, 22 nt, Staphylococcus aureus subsp. aureus N315
aaugucgcacuauaaaauucac

SEQ ID NO: 2134418 - RNA, 14 nt, Staphylococcus aureus subsp. aureus N315
aaugguaaguaugg

SEQ ID NO: 2134419 - RNA, 15 nt, Staphylococcus aureus subsp. aureus N315
aaugggcgugccauu

SEQ ID NO: 2134420 - RNA, 20 nt, Staphylococcus aureus subsp. aureus N315
aauggcuaauacaaaacaaa

SEQ ID NO: 2134421 - RNA, 23 nt, Staphylococcus aureus subsp. aureus N315
aauguauuauucucucauuugua

SEQ ID NO: 2134422 - RNA, 22 nt, Staphylococcus aureus subsp. aureus N315
aauguauucuucuaauucugaa

SEQ ID NO: 2134423 - RNA, 13 nt, Staphylococcus aureus subsp. aureus N315
aauguaugauaua

SEQ ID NO: 2134424 - RNA, 15 nt, Staphylococcus aureus subsp. aureus N315
aauguaugauauaaa

SEQ ID NO: 2134425 - RNA, 13 nt, Staphylococcus aureus subsp. aureus N315
aauguaucaccua

SEQ ID NO: 2134426 - RNA, 17 nt, Staphylococcus aureus subsp. aureus N315
aauguauauuuaacauc

SEQ ID NO: 2134427 - RNA, 17 nt, Staphylococcus aureus subsp. aureus N315
aauguauaaauaauaaa

SEQ ID NO: 2134428 - RNA, 21 nt, Staphylococcus aureus subsp. aureus N315
aauguaguuaagauaccuuuu

SEQ ID NO: 2134429 - RNA, 18 nt, Staphylococcus aureus subsp. aureus N315
aauggucuaauaucaauu

SEQ ID NO: 2134430 - RNA, 20 nt, Staphylococcus aureus subsp. aureus N315
aauggauuuggucaaguuuu

SEQ ID NO: 2134431 - RNA, 19 nt, Staphylococcus aureus subsp. aureus N315
aaugcucuauauauccauu

SEQ ID NO: 2134432 - RNA, 15 nt, Staphylococcus aureus subsp. aureus N315
aaugcucuauauauc

SEQ ID NO: 2134433 - RNA, 16 nt, Staphylococcus aureus subsp. aureus N315
aauggcacuuaauaua

SEQ ID NO: 2134434 - RNA, 22 nt, Staphylococcus aureus subsp. aureus N315
aauggcacuuaauauaaggaag

SEQ ID NO: 2134435 - RNA, 19 nt, Staphylococcus aureus subsp. aureus N315
aauggcagaugauuauguu

SEQ ID NO: 2134436 - RNA, 13 nt, Staphylococcus aureus subsp. aureus N315
aaugccauaccug

SEQ ID NO: 2134437 - RNA, 23 nt, Staphylococcus aureus subsp. aureus N315
aaugccauuguuauccaaaacau

SEQ ID NO: 2134438 - RNA, 20 nt, Staphylococcus aureus subsp. aureus N315
aaugcacgagcaacaucuuu

SEQ ID NO: 2134439 - RNA, 16 nt, Staphylococcus aureus subsp. aureus N315
aaugcuaauuuaacug

SEQ ID NO: 2134440 - RNA, 15 nt, Staphylococcus aureus subsp. aureus N315
aaugcuacaauuucc

SEQ ID NO: 2134441 - RNA, 19 nt, Staphylococcus aureus subsp. aureus N315
aaugcuaauacuaaucaaa

SEQ ID NO: 2134442 - RNA, 13 nt, Staphylococcus aureus subsp. aureus N315
aaugcuaucaugc

SEQ ID NO: 2134443 - RNA, 14 nt, Staphylococcus aureus subsp. aureus N315
aaugcuauauuuag

SEQ ID NO: 2134444 - RNA, 22 nt, Staphylococcus aureus subsp. aureus N315
aaugcuauauuuagaaugauga

SEQ ID NO: 2134445 - RNA, 19 nt, Staphylococcus aureus subsp. aureus N315
aauguuacacaaauuaaaa

SEQ ID NO: 2134446 - RNA, 14 nt, Staphylococcus aureus subsp. aureus N315
aauguuaauaauga

SEQ ID NO: 2134447 - RNA, 18 nt, Staphylococcus aureus subsp. aureus N315
aauguuacacaaauuaaa

SEQ ID NO: 2134448 - RNA, 16 nt, Staphylococcus aureus subsp. aureus N315
aauguuaaauucuaaa

SEQ ID NO: 2134449 - RNA, 24 nt, Staphylococcus aureus subsp. aureus N315
aauguuaucuugcuuauugauaua

SEQ ID NO: 2134450 - RNA, 17 nt, Staphylococcus aureus subsp. aureus N315
aauguuaucuugcuuau

SEQ ID NO: 2134451 - RNA, 14 nt, Staphylococcus aureus subsp. aureus N315
aauguuauuagaua

SEQ ID NO: 2134452 - RNA, 19 nt, Staphylococcus aureus subsp. aureus N315
aauguucagguucaaaauu

SEQ ID NO: 2134453 - RNA, 20 nt, Staphylococcus aureus subsp. aureus N315
aauguucagguucaaaauug

SEQ ID NO: 2134454 - RNA, 14 nt, Staphylococcus aureus subsp. aureus N315
aauguuaaagauua

SEQ ID NO: 2134455 - RNA, 19 nt, Staphylococcus aureus subsp. aureus N315
aauguuaaacacucaaaau

SEQ ID NO: 2134456 - RNA, 23 nt, Staphylococcus aureus subsp. aureus N315
aauguguuaauacuucauauccu

SEQ ID NO: 2134457 - RNA, 23 nt, Staphylococcus aureus subsp. aureus N315
aauguguaugguuuuguacauau

SEQ ID NO: 2134458 - RNA, 23 nt, Staphylococcus aureus subsp. aureus N315
aauguguuaaucaacguauauaa

SEQ ID NO: 2134459 - RNA, 18 nt, Staphylococcus aureus subsp. aureus N315
aauguguuaauacuucau

SEQ ID NO: 2134460 - RNA, 18 nt, Staphylococcus aureus subsp. aureus N315
aaugugauuuucuuucau

SEQ ID NO: 2134461 - RNA, 15 nt, Staphylococcus aureus subsp. aureus N315
aaugugaugauuaau

SEQ ID NO: 2134462 - RNA, 21 nt, Staphylococcus aureus subsp. aureus N315
aauguggaacaugauucauga

SEQ ID NO: 2134463 - RNA, 20 nt, Staphylococcus aureus subsp. aureus N315
aauguuuaauuuucuaaaua

SEQ ID NO: 2134464 - RNA, 11 nt, Staphylococcus aureus subsp. aureus N315
aauguugaaug

SEQ ID NO: 2134465 - RNA, 22 nt, Staphylococcus aureus subsp. aureus N315
aauguuuaauuuucuaaauaua

SEQ ID NO: 2134466 - RNA, 20 nt, Staphylococcus aureus subsp. aureus N315
aauuaaaacagcaaauaaaa

SEQ ID NO: 2134467 - RNA, 20 nt, Staphylococcus aureus subsp. aureus N315
aauuaaaacuuucagagaua

SEQ ID NO: 2134468 - RNA, 18 nt, Staphylococcus aureus subsp. aureus N315
aauuaaaacuauaauaaa

SEQ ID NO: 2134469 - RNA, 16 nt, Staphylococcus aureus subsp. aureus N315
aauguuuuauguauuu

SEQ ID NO: 2134470 - RNA, 18 nt, Staphylococcus aureus subsp. aureus N315
aauguuuuauguauuuau

SEQ ID NO: 2134471 - RNA, 14 nt, Staphylococcus aureus subsp. aureus N315
aauuaaaaaacaaa

SEQ ID NO: 2134472 - RNA, 18 nt, Staphylococcus aureus subsp. aureus N315
aauguuuuugauaguaau

SEQ ID NO: 2134473 - RNA, 13 nt, Staphylococcus aureus subsp. aureus N315
aauguuucuccua

SEQ ID NO: 2134474 - RNA, 16 nt, Staphylococcus aureus subsp. aureus N315
aauuaauauccaaaau

SEQ ID NO: 2134475 - RNA, 21 nt, Staphylococcus aureus subsp. aureus N315
aauuacagcgugauucaucua

SEQ ID NO: 2134476 - RNA, 17 nt, Staphylococcus aureus subsp. aureus N315
aauuacaggaauugcuu

SEQ ID NO: 2134477 - RNA, 20 nt, Staphylococcus aureus subsp. aureus N315
aauuacauaagaugauuuag

SEQ ID NO: 2134478 - RNA, 15 nt, Staphylococcus aureus subsp. aureus N315
aauuacagguuuaau

SEQ ID NO: 2134479 - RNA, 22 nt, Staphylococcus aureus subsp. aureus N315
aauuaccaaugaauaaauugau

SEQ ID NO: 2134480 - RNA, 14 nt, Staphylococcus aureus subsp. aureus N315
aauuaccaaugaau

SEQ ID NO: 2134481 - RNA, 21 nt, Staphylococcus aureus subsp. aureus N315
aauuacauuacgcucaucacc

SEQ ID NO: 2134482 - RNA, 18 nt, Staphylococcus aureus subsp. aureus N315
aauuaaucggaucauuau

SEQ ID NO: 2134483 - RNA, 22 nt, Staphylococcus aureus subsp. aureus N315
aauuaauaacauccccaaaaau

SEQ ID NO: 2134484 - RNA, 15 nt, Staphylococcus aureus subsp. aureus N315
aauuaauaauuuuuu

SEQ ID NO: 2134485 - RNA, 17 nt, Staphylococcus aureus subsp. aureus N315
aauuacuuagcaaacaa

SEQ ID NO: 2134486 - RNA, 14 nt, Staphylococcus aureus subsp. aureus N315
aauuacgacaagaa

SEQ ID NO: 2134487 - RNA, 21 nt, Staphylococcus aureus subsp. aureus N315
aauuacuugcacaccagugcc

SEQ ID NO: 2134488 - RNA, 18 nt, Staphylococcus aureus subsp. aureus N315
aauuacuuucauuguaaa

SEQ ID NO: 2134489 - RNA, 12 nt, Staphylococcus aureus subsp. aureus N315
aauuagaaaaua

SEQ ID NO: 2134490 - RNA, 13 nt, Staphylococcus aureus subsp. aureus N315
aauuagaaaauau

SEQ ID NO: 2134491 - RNA, 12 nt, Staphylococcus aureus subsp. aureus N315
aauuaauaaaaa

SEQ ID NO: 2134492 - RNA, 11 nt, Staphylococcus aureus subsp. aureus N315
aauuaauaauu

SEQ ID NO: 2134493 - RNA, 14 nt, Staphylococcus aureus subsp. aureus N315
aauuaacuugauau

SEQ ID NO: 2134494 - RNA, 19 nt, Staphylococcus aureus subsp. aureus N315
aauuaacuauacuuuuaua

SEQ ID NO: 2134495 - RNA, 22 nt, Staphylococcus aureus subsp. aureus N315
aauuaagaaaaucauucauuug

SEQ ID NO: 2134496 - RNA, 20 nt, Staphylococcus aureus subsp. aureus N315
aauuaacuagugccucuuuu

SEQ ID NO: 2134497 - RNA, 22 nt, Staphylococcus aureus subsp. aureus N315
aauuaacuuaaaauuuaaauau

SEQ ID NO: 2134498 - RNA, 13 nt, Staphylococcus aureus subsp. aureus N315
aauuaaaauguua

SEQ ID NO: 2134499 - RNA, 15 nt, Staphylococcus aureus subsp. aureus N315
aauuaaaauguuaau

SEQ ID NO: 2134500 - RNA, 15 nt, Staphylococcus aureus subsp. aureus N315
aauuaaaauuuguua

SEQ ID NO: 2134501 - RNA, 14 nt, Staphylococcus aureus subsp. aureus N315
aauuaaaauucucu

SEQ ID NO: 2134502 - RNA, 15 nt, Staphylococcus aureus subsp. aureus N315
aauuaaaauucucuu

SEQ ID NO: 2134503 - RNA, 12 nt, Staphylococcus aureus subsp. aureus N315
aauuaaaauaca

SEQ ID NO: 2134504 - RNA, 12 nt, Staphylococcus aureus subsp. aureus N315
aauuaaaauaac

SEQ ID NO: 2134505 - RNA, 15 nt, Staphylococcus aureus subsp. aureus N315
aauuaaauaaugaua

SEQ ID NO: 2134506 - RNA, 17 nt, Staphylococcus aureus subsp. aureus N315
aauuaaacuuaagaaua

SEQ ID NO: 2134507 - RNA, 17 nt, Staphylococcus aureus subsp. aureus N315
aauuaaagauuaaaaua

SEQ ID NO: 2134508 - RNA, 20 nt, Staphylococcus aureus subsp. aureus N315
aaucgauauaaugaaguuau

SEQ ID NO: 2134509 - RNA, 18 nt, Staphylococcus aureus subsp. aureus N315
aaucggaauaaaauaaau

SEQ ID NO: 2134510 - RNA, 16 nt, Staphylococcus aureus subsp. aureus N315
aaucggaauaaaauaa

SEQ ID NO: 2134511 - RNA, 15 nt, Staphylococcus aureus subsp. aureus N315
aaucguugaaaaaua

SEQ ID NO: 2134512 - RNA, 14 nt, Staphylococcus aureus subsp. aureus N315
aaucguuaaggaaa

SEQ ID NO: 2134513 - RNA, 20 nt, Staphylococcus aureus subsp. aureus N315
aaucggaucauuauuuagaa

SEQ ID NO: 2134514 - RNA, 19 nt, Staphylococcus aureus subsp. aureus N315
aaucaucgaacaugaauga

SEQ ID NO: 2134515 - RNA, 15 nt, Staphylococcus aureus subsp. aureus N315
aauccuuuauauuua

SEQ ID NO: 2134516 - RNA, 14 nt, Staphylococcus aureus subsp. aureus N315
aaucauccauauau

SEQ ID NO: 2134517 - RNA, 12 nt, Staphylococcus aureus subsp. aureus N315
aaucgaaaauau

SEQ ID NO: 2134518 - RNA, 15 nt, Staphylococcus aureus subsp. aureus N315
aaucgaacagaaaau

SEQ ID NO: 2134519 - RNA, 17 nt, Staphylococcus aureus subsp. aureus N315
aauccuuuguuuguaag

SEQ ID NO: 2134520 - RNA, 15 nt, Staphylococcus aureus subsp. aureus N315
aaucgaguuugaaau

SEQ ID NO: 2134521 - RNA, 17 nt, Staphylococcus aureus subsp. aureus N315
aaucgaguuugaaauaa

SEQ ID NO: 2134522 - RNA, 17 nt, Staphylococcus aureus subsp. aureus N315
aaucgagugauucagga

SEQ ID NO: 2134523 - RNA, 14 nt, Staphylococcus aureus subsp. aureus N315
aaucgauaaaaugu

SEQ ID NO: 2134524 - RNA, 14 nt, Staphylococcus aureus subsp. aureus N315
aaucgaacauaaau

SEQ ID NO: 2134525 - RNA, 21 nt, Staphylococcus aureus subsp. aureus N315
aaucgacuuuuacaaucauca

SEQ ID NO: 2134526 - RNA, 20 nt, Staphylococcus aureus subsp. aureus N315
aaucucgucacauauaaaua

SEQ ID NO: 2134527 - RNA, 16 nt, Staphylococcus aureus subsp. aureus N315
aaucugauucauuaaa

SEQ ID NO: 2134528 - RNA, 15 nt, Staphylococcus aureus subsp. aureus N315
aaucugcaaaugccu

SEQ ID NO: 2134529 - RNA, 16 nt, Staphylococcus aureus subsp. aureus N315
aaucucuuuacaccau

SEQ ID NO: 2134530 - RNA, 19 nt, Staphylococcus aureus subsp. aureus N315
aaucucuuuagaugagauu

SEQ ID NO: 2134531 - RNA, 21 nt, Staphylococcus aureus subsp. aureus N315
aaucuaauacuuucaaacaaa

SEQ ID NO: 2134532 - RNA, 18 nt, Staphylococcus aureus subsp. aureus N315
aaucuaauccugguauaa

SEQ ID NO: 2134533 - RNA, 16 nt, Staphylococcus aureus subsp. aureus N315
aaucuaaacuauaaua

SEQ ID NO: 2134534 - RNA, 17 nt, Staphylococcus aureus subsp. aureus N315
aaucguuuuuacuguaa

SEQ ID NO: 2134535 - RNA, 12 nt, Staphylococcus aureus subsp. aureus N315
aaucucaaaauu

SEQ ID NO: 2134536 - RNA, 14 nt, Staphylococcus aureus subsp. aureus N315
aaucuaauacauac

SEQ ID NO: 2134537 - RNA, 22 nt, Staphylococcus aureus subsp. aureus N315
aaucuccauuuaaggauuuccu

SEQ ID NO: 2134538 - RNA, 20 nt, Staphylococcus aureus subsp. aureus N315
aaucucauucuuuaauauaa

SEQ ID NO: 2134539 - RNA, 17 nt, Staphylococcus aureus subsp. aureus N315
aaucucauucuuuaaua

SEQ ID NO: 2134540 - RNA, 18 nt, Staphylococcus aureus subsp. aureus N315
aaugacuaugcaaaugaa

SEQ ID NO: 2134541 - RNA, 20 nt, Staphylococcus aureus subsp. aureus N315
aaugaccauugucaugccuu

SEQ ID NO: 2134542 - RNA, 19 nt, Staphylococcus aureus subsp. aureus N315
aaugacuucuuuauauuua

SEQ ID NO: 2134543 - RNA, 20 nt, Staphylococcus aureus subsp. aureus N315
aaugacuucacauuuauccu

SEQ ID NO: 2134544 - RNA, 20 nt, Staphylococcus aureus subsp. aureus N315
aaugacuguugguuugauca

SEQ ID NO: 2134545 - RNA, 21 nt, Staphylococcus aureus subsp. aureus N315
aaugacugaauuaauauccaa

SEQ ID NO: 2134546 - RNA, 14 nt, Staphylococcus aureus subsp. aureus N315
aaugaguacaacau

SEQ ID NO: 2134547 - RNA, 15 nt, Staphylococcus aureus subsp. aureus N315
aaugcaacuugauca

SEQ ID NO: 2134548 - RNA, 16 nt, Staphylococcus aureus subsp. aureus N315
aaugcaacuaaaacua

SEQ ID NO: 2134549 - RNA, 12 nt, Staphylococcus aureus subsp. aureus N315
aaugauuauaaa

SEQ ID NO: 2134550 - RNA, 21 nt, Staphylococcus aureus subsp. aureus N315
aaugauucuuaucuuuaauca

SEQ ID NO: 2134551 - RNA, 17 nt, Staphylococcus aureus subsp. aureus N315
aaugauuauaaauacau

SEQ ID NO: 2134552 - RNA, 18 nt, Staphylococcus aureus subsp. aureus N315
aaugauugacgauuuaau

SEQ ID NO: 2134553 - RNA, 19 nt, Staphylococcus aureus subsp. aureus N315
aaugauggguauuuuguuc

SEQ ID NO: 2134554 - RNA, 20 nt, Staphylococcus aureus subsp. aureus N315
aaugauauacuugaagaaaa

SEQ ID NO: 2134555 - RNA, 23 nt, Staphylococcus aureus subsp. aureus N315
aaugauauacuugaagaaaagua

SEQ ID NO: 2134556 - RNA, 12 nt, Staphylococcus aureus subsp. aureus N315
aaugauaucuuu

SEQ ID NO: 2134557 - RNA, 15 nt, Staphylococcus aureus subsp. aureus N315
aaugauagugaauaa

SEQ ID NO: 2134558 - RNA, 20 nt, Staphylococcus aureus subsp. aureus N315
aaugauagcuaaacauuuua

SEQ ID NO: 2134559 - RNA, 19 nt, Staphylococcus aureus subsp. aureus N315
aaugauagaugcuggcuua

SEQ ID NO: 2134560 - RNA, 17 nt, Staphylococcus aureus subsp. aureus N315
aaugauaccuuuaaauc

SEQ ID NO: 2134561 - RNA, 12 nt, Staphylococcus aureus subsp. aureus N315
aaugaauugcuu

SEQ ID NO: 2134562 - RNA, 12 nt, Staphylococcus aureus subsp. aureus N315
aaugaagaauac

SEQ ID NO: 2134563 - RNA, 14 nt, Staphylococcus aureus subsp. aureus N315
aaucuuuaucaguu

SEQ ID NO: 2134564 - RNA, 19 nt, Staphylococcus aureus subsp. aureus N315
aaucuuguugaacucugau

SEQ ID NO: 2134565 - RNA, 19 nt, Staphylococcus aureus subsp. aureus N315
aaucuuuacuuguaauuaa

SEQ ID NO: 2134566 - RNA, 12 nt, Staphylococcus aureus subsp. aureus N315
aaucuucaucau

SEQ ID NO: 2134567 - RNA, 16 nt, Staphylococcus aureus subsp. aureus N315
aaucuugauuauauuu

SEQ ID NO: 2134568 - RNA, 15 nt, Staphylococcus aureus subsp. aureus N315
aaucuucuauuuuca

SEQ ID NO: 2134569 - RNA, 19 nt, Staphylococcus aureus subsp. aureus N315
aaucugcaacgauuuuaaa

SEQ ID NO: 2134570 - RNA, 21 nt, Staphylococcus aureus subsp. aureus N315
aaucugcuuuauuuuaucauc

SEQ ID NO: 2134571 - RNA, 15 nt, Staphylococcus aureus subsp. aureus N315
aaucacaguuauaua

SEQ ID NO: 2134572 - RNA, 13 nt, Staphylococcus aureus subsp. aureus N315
aaucacaauauaa

SEQ ID NO: 2134573 - RNA, 18 nt, Staphylococcus aureus subsp. aureus N315
aaucacaaauucaacuuu

SEQ ID NO: 2134574 - RNA, 22 nt, Staphylococcus aureus subsp. aureus N315
aaucacauuaauuggauuaaau

SEQ ID NO: 2134575 - RNA, 18 nt, Staphylococcus aureus subsp. aureus N315
aaucaauugcauacguaa

SEQ ID NO: 2134576 - RNA, 19 nt, Staphylococcus aureus subsp. aureus N315
aaucaagcaaugcaugcuu

SEQ ID NO: 2134577 - RNA, 22 nt, Staphylococcus aureus subsp. aureus N315
aaucaacuuagaauuuacaagu

SEQ ID NO: 2134578 - RNA, 22 nt, Staphylococcus aureus subsp. aureus N315
aaucaacguauauaaguuaaaa

SEQ ID NO: 2134579 - RNA, 23 nt, Staphylococcus aureus subsp. aureus N315
aaucaacuuuuuguuaauuuuuu

SEQ ID NO: 2134580 - RNA, 17 nt, Staphylococcus aureus subsp. aureus N315
aaucaguuuuuaaauca

SEQ ID NO: 2134581 - RNA, 15 nt, Staphylococcus aureus subsp. aureus N315
aaucaguuuuugaau

SEQ ID NO: 2134582 - RNA, 21 nt, Staphylococcus aureus subsp. aureus N315
aaucaguuucaucaaguauaa

SEQ ID NO: 2134583 - RNA, 21 nt, Staphylococcus aureus subsp. aureus N315
aaucaguauaaucagcaaugu

SEQ ID NO: 2134584 - RNA, 16 nt, Staphylococcus aureus subsp. aureus N315
aaucagcuauaaaagu

SEQ ID NO: 2134585 - RNA, 20 nt, Staphylococcus aureus subsp. aureus N315
aaucagugaaauaucaagau

SEQ ID NO: 2134586 - RNA, 16 nt, Staphylococcus aureus subsp. aureus N315
aaucagugaaauauca

SEQ ID NO: 2134587 - RNA, 21 nt, Staphylococcus aureus subsp. aureus N315
aaucacuuggcgacauuugua

SEQ ID NO: 2134588 - RNA, 18 nt, Staphylococcus aureus subsp. aureus N315
aaucagaugauuuaauuc

SEQ ID NO: 2134589 - RNA, 15 nt, Staphylococcus aureus subsp. aureus N315
aaucacgcuaacauu

SEQ ID NO: 2134590 - RNA, 17 nt, Staphylococcus aureus subsp. aureus N315
aaucacgauuuucaagu

SEQ ID NO: 2134591 - RNA, 17 nt, Staphylococcus aureus subsp. aureus N315
aauauuuuacaaaauau

SEQ ID NO: 2134592 - RNA, 19 nt, Staphylococcus aureus subsp. aureus N315
aauauuuuucaauuaaaug

SEQ ID NO: 2134593 - RNA, 16 nt, Staphylococcus aureus subsp. aureus N315
aauauuuuuuaaaaug

SEQ ID NO: 2134594 - RNA, 13 nt, Staphylococcus aureus subsp. aureus N315
aauauuuuuuaaa

SEQ ID NO: 2134595 - RNA, 23 nt, Staphylococcus aureus subsp. aureus N315
aauauuuuuguugcaauugccuu

SEQ ID NO: 2134596 - RNA, 23 nt, Staphylococcus aureus subsp. aureus N315
aauauuuuucaauuaaauguuua

SEQ ID NO: 2134597 - RNA, 19 nt, Staphylococcus aureus subsp. aureus N315
aauauuucccuaugaaaua

SEQ ID NO: 2134598 - RNA, 21 nt, Staphylococcus aureus subsp. aureus N315
aauauuuauuguuuuuaaaau

SEQ ID NO: 2134599 - RNA, 15 nt, Staphylococcus aureus subsp. aureus N315
aauauuuauauuaaa

SEQ ID NO: 2134600 - RNA, 17 nt, Staphylococcus aureus subsp. aureus N315
aauauuuauauuaaaua

SEQ ID NO: 2134601 - RNA, 19 nt, Staphylococcus aureus subsp. aureus N315
aauauuuauauuaaauacu

SEQ ID NO: 2134602 - RNA, 22 nt, Staphylococcus aureus subsp. aureus N315
aauauuuauauuaaauacuaua

SEQ ID NO: 2134603 - RNA, 21 nt, Staphylococcus aureus subsp. aureus N315
aauauuucuuagauacucacu

SEQ ID NO: 2134604 - RNA, 20 nt, Staphylococcus aureus subsp. aureus N315
aauauuucccuaugaaauaa

SEQ ID NO: 2134605 - RNA, 20 nt, Staphylococcus aureus subsp. aureus N315
aauauuuggaaguuuucaga

SEQ ID NO: 2134606 - RNA, 12 nt, Staphylococcus aureus subsp. aureus N315
aauauuugauaa

SEQ ID NO: 2134607 - RNA, 15 nt, Staphylococcus aureus subsp. aureus N315
aauauuugaaaauuu

SEQ ID NO: 2134608 - RNA, 16 nt, Staphylococcus aureus subsp. aureus N315
aaucaaaauuaugacu

SEQ ID NO: 2134609 - RNA, 21 nt, Staphylococcus aureus subsp. aureus N315
aaucaaagaggaacagcggaa

SEQ ID NO: 2134610 - RNA, 21 nt, Staphylococcus aureus subsp. aureus N315
aaucaaagaggcuuuaaaauu

SEQ ID NO: 2134611 - RNA, 12 nt, Staphylococcus aureus subsp. aureus N315
aaucaacaucau

SEQ ID NO: 2134612 - RNA, 14 nt, Staphylococcus aureus subsp. aureus N315
aaucaaauacauca

SEQ ID NO: 2134613 - RNA, 22 nt, Staphylococcus aureus subsp. aureus N315
aaucaaaguucguaauugucuu

SEQ ID NO: 2134614 - RNA, 16 nt, Staphylococcus aureus subsp. aureus N315
aaucaacaauuuaaac

SEQ ID NO: 2134615 - RNA, 13 nt, Staphylococcus aureus subsp. aureus N315
aauauugaacaau

SEQ ID NO: 2134616 - RNA, 14 nt, Staphylococcus aureus subsp. aureus N315
aauauugaugaaua

SEQ ID NO: 2134617 - RNA, 17 nt, Staphylococcus aureus subsp. aureus N315
aauauugaauaaucauc

SEQ ID NO: 2134618 - RNA, 19 nt, Staphylococcus aureus subsp. aureus N315
aauauugaauauaaaaaac

SEQ ID NO: 2134619 - RNA, 14 nt, Staphylococcus aureus subsp. aureus N315
aauauugacauuua

SEQ ID NO: 2134620 - RNA, 16 nt, Staphylococcus aureus subsp. aureus N315
aauauucaauaauuca

SEQ ID NO: 2134621 - RNA, 19 nt, Staphylococcus aureus subsp. aureus N315
aauauuggaauacucuuca

SEQ ID NO: 2134622 - RNA, 16 nt, Staphylococcus aureus subsp. aureus N315
aauauugcguuuaauu

SEQ ID NO: 2134623 - RNA, 14 nt, Staphylococcus aureus subsp. aureus N315
aauauuuaaguuuc

SEQ ID NO: 2134624 - RNA, 14 nt, Staphylococcus aureus subsp. aureus N315
aauauuuaccacaa

SEQ ID NO: 2134625 - RNA, 17 nt, Staphylococcus aureus subsp. aureus N315
aauauuuaaaauauuau

SEQ ID NO: 2134626 - RNA, 17 nt, Staphylococcus aureus subsp. aureus N315
aauauuuaaacuaguaa

SEQ ID NO: 2134627 - RNA, 14 nt, Staphylococcus aureus subsp. aureus N315
aauauuacuuuauc

SEQ ID NO: 2134628 - RNA, 19 nt, Staphylococcus aureus subsp. aureus N315
aauauuacuuuaucucauu

SEQ ID NO: 2134629 - RNA, 17 nt, Staphylococcus aureus subsp. aureus N315
aauauuagaacauuuau

SEQ ID NO: 2134630 - RNA, 22 nt, Staphylococcus aureus subsp. aureus N315
aauauuaagauguauaugaauu

SEQ ID NO: 2134631 - RNA, 15 nt, Staphylococcus aureus subsp. aureus N315
aauauuaagauguau

SEQ ID NO: 2134632 - RNA, 18 nt, Staphylococcus aureus subsp. aureus N315
aauauuaauauaaaauaa

SEQ ID NO: 2134633 - RNA, 18 nt, Staphylococcus aureus subsp. aureus N315
aauauuauuaaaucaaag

SEQ ID NO: 2134634 - RNA, 13 nt, Staphylococcus aureus subsp. aureus N315
aauauuauuuuua

SEQ ID NO: 2134635 - RNA, 21 nt, Staphylococcus aureus subsp. aureus N315
aauauuauuuuuaagugauga

SEQ ID NO: 2134636 - RNA, 12 nt, Staphylococcus aureus subsp. aureus N315
aauauuauaagu

SEQ ID NO: 2134637 - RNA, 21 nt, Staphylococcus aureus subsp. aureus N315
aauauuaaauuucugaacaua

SEQ ID NO: 2134638 - RNA, 14 nt, Staphylococcus aureus subsp. aureus N315
aauauuaacaccag

SEQ ID NO: 2134639 - RNA, 17 nt, Staphylococcus aureus subsp. aureus N315
aauaugauuaauaaagu

SEQ ID NO: 2134640 - RNA, 14 nt, Staphylococcus aureus subsp. aureus N315
aauaugauguuaaa

SEQ ID NO: 2134641 - RNA, 21 nt, Staphylococcus aureus subsp. aureus N315
aauaugauccuuuaaugcuuu

SEQ ID NO: 2134642 - RNA, 18 nt, Staphylococcus aureus subsp. aureus N315
aauaugauaacucguaau

SEQ ID NO: 2134643 - RNA, 22 nt, Staphylococcus aureus subsp. aureus N315
aauaugagugaaaguuugaagg

SEQ ID NO: 2134644 - RNA, 22 nt, Staphylococcus aureus subsp. aureus N315
aauaugaaucuagaauauaaca

SEQ ID NO: 2134645 - RNA, 16 nt, Staphylococcus aureus subsp. aureus N315
aauaugaauaaugcaa

SEQ ID NO: 2134646 - RNA, 13 nt, Staphylococcus aureus subsp. aureus N315
aauaucaaaauau

SEQ ID NO: 2134647 - RNA, 14 nt, Staphylococcus aureus subsp. aureus N315
aauaucaaaauaua

SEQ ID NO: 2134648 - RNA, 16 nt, Staphylococcus aureus subsp. aureus N315
aauauauuuauuuuug

SEQ ID NO: 2134649 - RNA, 12 nt, Staphylococcus aureus subsp. aureus N315
aauauauuuaau

SEQ ID NO: 2134650 - RNA, 16 nt, Staphylococcus aureus subsp. aureus N315
aauauauuuaauuaca

SEQ ID NO: 2134651 - RNA, 14 nt, Staphylococcus aureus subsp. aureus N315
aauauauuuuaugu

SEQ ID NO: 2134652 - RNA, 20 nt, Staphylococcus aureus subsp. aureus N315
aauauauguauaacauuauu

SEQ ID NO: 2134653 - RNA, 19 nt, Staphylococcus aureus subsp. aureus N315
aauauauguauaacauuau

SEQ ID NO: 2134654 - RNA, 16 nt, Staphylococcus aureus subsp. aureus N315
aauauauguauaacau

SEQ ID NO: 2134655 - RNA, 22 nt, Staphylococcus aureus subsp. aureus N315
aauauauucggcaaaagauguu

SEQ ID NO: 2134656 - RNA, 18 nt, Staphylococcus aureus subsp. aureus N315
aauauaacaucaaauaga

SEQ ID NO: 2134657 - RNA, 17 nt, Staphylococcus aureus subsp. aureus N315
aauauaacaucaaauag

SEQ ID NO: 2134658 - RNA, 16 nt, Staphylococcus aureus subsp. aureus N315
aauauaacaucaaaua

SEQ ID NO: 2134659 - RNA, 18 nt, Staphylococcus aureus subsp. aureus N315
aauauaacaaguauaaau

SEQ ID NO: 2134660 - RNA, 15 nt, Staphylococcus aureus subsp. aureus N315
aauauaaauuuugaa

SEQ ID NO: 2134661 - RNA, 16 nt, Staphylococcus aureus subsp. aureus N315
aauauaaguaaucaua

SEQ ID NO: 2134662 - RNA, 23 nt, Staphylococcus aureus subsp. aureus N315
aauauaacuucuauuaagaaaua

SEQ ID NO: 2134663 - RNA, 19 nt, Staphylococcus aureus subsp. aureus N315
aauauaaaacgauaagaau

SEQ ID NO: 2134664 - RNA, 19 nt, Staphylococcus aureus subsp. aureus N315
aauauaaaaaagaucacug

SEQ ID NO: 2134665 - RNA, 14 nt, Staphylococcus aureus subsp. aureus N315
aauaguuuuucaua

SEQ ID NO: 2134666 - RNA, 12 nt, Staphylococcus aureus subsp. aureus N315
aauauaaaaaac

SEQ ID NO: 2134667 - RNA, 13 nt, Staphylococcus aureus subsp. aureus N315
aauauaaaaaaca

SEQ ID NO: 2134668 - RNA, 14 nt, Staphylococcus aureus subsp. aureus N315
aauauaaaaaagau

SEQ ID NO: 2134669 - RNA, 20 nt, Staphylococcus aureus subsp. aureus N315
aauauaaaaagugaagauau

SEQ ID NO: 2134670 - RNA, 15 nt, Staphylococcus aureus subsp. aureus N315
aauauaaaauaaagu

SEQ ID NO: 2134671 - RNA, 18 nt, Staphylococcus aureus subsp. aureus N315
aauauccugcaguugauu

SEQ ID NO: 2134672 - RNA, 20 nt, Staphylococcus aureus subsp. aureus N315
aauaucgauuuuggcacaua

SEQ ID NO: 2134673 - RNA, 18 nt, Staphylococcus aureus subsp. aureus N315
aauaucaaaauauaaaau

SEQ ID NO: 2134674 - RNA, 14 nt, Staphylococcus aureus subsp. aureus N315
aauaucaauuuuua

SEQ ID NO: 2134675 - RNA, 22 nt, Staphylococcus aureus subsp. aureus N315
aauaucuucuucuaaccacuuc

SEQ ID NO: 2134676 - RNA, 18 nt, Staphylococcus aureus subsp. aureus N315
aauaugaacaaaaaauaa

SEQ ID NO: 2134677 - RNA, 23 nt, Staphylococcus aureus subsp. aureus N315
aauaugaacaaaaaauaaaaacu

SEQ ID NO: 2134678 - RNA, 14 nt, Staphylococcus aureus subsp. aureus N315
aauaucuuacugcu

SEQ ID NO: 2134679 - RNA, 13 nt, Staphylococcus aureus subsp. aureus N315
aauaucuugucau

SEQ ID NO: 2134680 - RNA, 16 nt, Staphylococcus aureus subsp. aureus N315
aauaucuaaacaauuc

SEQ ID NO: 2134681 - RNA, 17 nt, Staphylococcus aureus subsp. aureus N315
aauaguaaagugaaaua

SEQ ID NO: 2134682 - RNA, 14 nt, Staphylococcus aureus subsp. aureus N315
aauaguaaagugaa

SEQ ID NO: 2134683 - RNA, 20 nt, Staphylococcus aureus subsp. aureus N315
aauagguucauuauuuaaau

SEQ ID NO: 2134684 - RNA, 18 nt, Staphylococcus aureus subsp. aureus N315
aauaggauaugcuaaaca

SEQ ID NO: 2134685 - RNA, 13 nt, Staphylococcus aureus subsp. aureus N315
aauaggaauacca

SEQ ID NO: 2134686 - RNA, 19 nt, Staphylococcus aureus subsp. aureus N315
aauagcuuucguuucuuuu

SEQ ID NO: 2134687 - RNA, 19 nt, Staphylococcus aureus subsp. aureus N315
aauaguuuucuucacugcu

SEQ ID NO: 2134688 - RNA, 21 nt, Staphylococcus aureus subsp. aureus N315
aauaguucuuuaaauuauaua

SEQ ID NO: 2134689 - RNA, 18 nt, Staphylococcus aureus subsp. aureus N315
aauaguaaagugaaauaa

SEQ ID NO: 2134690 - RNA, 22 nt, Staphylococcus aureus subsp. aureus N315
aauagacugccaauaaaaugca

SEQ ID NO: 2134691 - RNA, 14 nt, Staphylococcus aureus subsp. aureus N315
aauagagaaagaau

SEQ ID NO: 2134692 - RNA, 20 nt, Staphylococcus aureus subsp. aureus N315
aauagacugccaauaaaaug

SEQ ID NO: 2134693 - RNA, 17 nt, Staphylococcus aureus subsp. aureus N315
aauagcgguuuaaaaau

SEQ ID NO: 2134694 - RNA, 21 nt, Staphylococcus aureus subsp. aureus N315
aauagcuauaacucuaaauau

SEQ ID NO: 2134695 - RNA, 18 nt, Staphylococcus aureus subsp. aureus N315
aauagcuauaacucuaaa

SEQ ID NO: 2134696 - RNA, 15 nt, Staphylococcus aureus subsp. aureus N315
aauagcuauuaaaau

SEQ ID NO: 2134697 - RNA, 17 nt, Staphylococcus aureus subsp. aureus N315
aauagcuauuaaaauag

SEQ ID NO: 2134698 - RNA, 23 nt, Staphylococcus aureus subsp. aureus N315
aauagcuauauuuuuguauuuau

SEQ ID NO: 2134699 - RNA, 14 nt, Staphylococcus aureus subsp. aureus N315
aauagcuauauuuu

SEQ ID NO: 2134700 - RNA, 22 nt, Staphylococcus aureus subsp. aureus N315
aauagcuauauuuuuguauuua

SEQ ID NO: 2134701 - RNA, 19 nt, Staphylococcus aureus subsp. aureus N315
aauaccauugugaugauaa

SEQ ID NO: 2134702 - RNA, 13 nt, Staphylococcus aureus subsp. aureus N315
aauaccuuuuucu

SEQ ID NO: 2134703 - RNA, 23 nt, Staphylococcus aureus subsp. aureus N315
aauaccuuugccguauuucaaau

SEQ ID NO: 2134704 - RNA, 20 nt, Staphylococcus aureus subsp. aureus N315
aauaccuuugccguauuuca

SEQ ID NO: 2134705 - RNA, 19 nt, Staphylococcus aureus subsp. aureus N315
aauacguuuaauaaugguu

SEQ ID NO: 2134706 - RNA, 22 nt, Staphylococcus aureus subsp. aureus N315
aauacguaucaagaaaaaguuu

SEQ ID NO: 2134707 - RNA, 16 nt, Staphylococcus aureus subsp. aureus N315
aauacgauaauaacua

SEQ ID NO: 2134708 - RNA, 13 nt, Staphylococcus aureus subsp. aureus N315
aauacgaaguuuc

SEQ ID NO: 2134709 - RNA, 22 nt, Staphylococcus aureus subsp. aureus N315
aauacgacaccaacauauuuua

SEQ ID NO: 2134710 - RNA, 19 nt, Staphylococcus aureus subsp. aureus N315
aauagaagguuauuuuuua

SEQ ID NO: 2134711 - RNA, 21 nt, Staphylococcus aureus subsp. aureus N315
aauagaacgaaauaguucaaa

SEQ ID NO: 2134712 - RNA, 16 nt, Staphylococcus aureus subsp. aureus N315
aauacuucauauccuu

SEQ ID NO: 2134713 - RNA, 20 nt, Staphylococcus aureus subsp. aureus N315
aauacuugaaagauuuguag

SEQ ID NO: 2134714 - RNA, 19 nt, Staphylococcus aureus subsp. aureus N315
aauacuguuuaaauaaaau

SEQ ID NO: 2134715 - RNA, 12 nt, Staphylococcus aureus subsp. aureus N315
aauacucacauu

SEQ ID NO: 2134716 - RNA, 18 nt, Staphylococcus aureus subsp. aureus N315
aauacuauacugaugaaa

SEQ ID NO: 2134717 - RNA, 14 nt, Staphylococcus aureus subsp. aureus N315
aauacuauacugau

SEQ ID NO: 2134718 - RNA, 14 nt, Staphylococcus aureus subsp. aureus N315
aauacuauauauaa

SEQ ID NO: 2134719 - RNA, 19 nt, Staphylococcus aureus subsp. aureus N315
aauacuauacugaugaaaa

SEQ ID NO: 2134720 - RNA, 19 nt, Staphylococcus aureus subsp. aureus N315
aauacuauaugaaaagaga

SEQ ID NO: 2134721 - RNA, 21 nt, Staphylococcus aureus subsp. aureus N315
aauacucaacacgauagucau

SEQ ID NO: 2134722 - RNA, 20 nt, Staphylococcus aureus subsp. aureus N315
aauacuaauuucuauagaaa

SEQ ID NO: 2134723 - RNA, 21 nt, Staphylococcus aureus subsp. aureus N315
aauacuacacuccccuuauca

SEQ ID NO: 2134724 - RNA, 20 nt, Staphylococcus aureus subsp. aureus N315
aauacuaccguuuuuauaua

SEQ ID NO: 2134725 - RNA, 24 nt, Staphylococcus aureus subsp. aureus N315
aauacuacuuaaugacuucuuuau

SEQ ID NO: 2134726 - RNA, 16 nt, Staphylococcus aureus subsp. aureus N315
aauacguuuaauguau

SEQ ID NO: 2134727 - RNA, 17 nt, Staphylococcus aureus subsp. aureus N315
aauacauuucaaaaaaa

SEQ ID NO: 2134728 - RNA, 15 nt, Staphylococcus aureus subsp. aureus N315
aauacauuuugcucu

SEQ ID NO: 2134729 - RNA, 17 nt, Staphylococcus aureus subsp. aureus N315
aauacauuauguucuuc

SEQ ID NO: 2134730 - RNA, 17 nt, Staphylococcus aureus subsp. aureus N315
aauacauuaauauaaau

SEQ ID NO: 2134731 - RNA, 15 nt, Staphylococcus aureus subsp. aureus N315
aauacaugaguaaaa

SEQ ID NO: 2134732 - RNA, 15 nt, Staphylococcus aureus subsp. aureus N315
aauacauaaugguuc

SEQ ID NO: 2134733 - RNA, 18 nt, Staphylococcus aureus subsp. aureus N315
aauacauagguucaucuu

SEQ ID NO: 2134734 - RNA, 13 nt, Staphylococcus aureus subsp. aureus N315
aauacauacugau

SEQ ID NO: 2134735 - RNA, 11 nt, Staphylococcus aureus subsp. aureus N315
aauacagauga

SEQ ID NO: 2134736 - RNA, 23 nt, Staphylococcus aureus subsp. aureus N315
aauacacuugauaaaacuaauga

SEQ ID NO: 2134737 - RNA, 19 nt, Staphylococcus aureus subsp. aureus N315
aauacacuugauaaaacua

SEQ ID NO: 2134738 - RNA, 18 nt, Staphylococcus aureus subsp. aureus N315
aauacacuugauaaaacu

SEQ ID NO: 2134739 - RNA, 16 nt, Staphylococcus aureus subsp. aureus N315
aauacaagucuuuacu

SEQ ID NO: 2134740 - RNA, 21 nt, Staphylococcus aureus subsp. aureus N315
aauacacgaucaguugaguca

SEQ ID NO: 2134741 - RNA, 20 nt, Staphylococcus aureus subsp. aureus N315
aauacaauuucuucauuuuc

SEQ ID NO: 2134742 - RNA, 21 nt, Staphylococcus aureus subsp. aureus N315
aauacaauuucuucauuuuca

SEQ ID NO: 2134743 - RNA, 19 nt, Staphylococcus aureus subsp. aureus N315
aauacaauuucuucauuuu

SEQ ID NO: 2134744 - RNA, 17 nt, Staphylococcus aureus subsp. aureus N315
aauaaaggcaacaaaua

SEQ ID NO: 2134745 - RNA, 13 nt, Staphylococcus aureus subsp. aureus N315
aaauuauuugaua

SEQ ID NO: 2134746 - RNA, 23 nt, Staphylococcus aureus subsp. aureus N315
aaauuauuuauucauuauagucu

SEQ ID NO: 2134747 - RNA, 17 nt, Staphylococcus aureus subsp. aureus N315
aaauuauuuaauuuuuc

SEQ ID NO: 2134748 - RNA, 19 nt, Staphylococcus aureus subsp. aureus N315
aaauuauuuaauuuuucua

SEQ ID NO: 2134749 - RNA, 20 nt, Staphylococcus aureus subsp. aureus N315
aaauuauugaauuugaauaa

SEQ ID NO: 2134750 - RNA, 19 nt, Staphylococcus aureus subsp. aureus N315
aaauuauugaauuugaaua

SEQ ID NO: 2134751 - RNA, 13 nt, Staphylococcus aureus subsp. aureus N315
aaauuaugacuaa

SEQ ID NO: 2134752 - RNA, 13 nt, Staphylococcus aureus subsp. aureus N315
aaauuauuauuua

SEQ ID NO: 2134753 - RNA, 16 nt, Staphylococcus aureus subsp. aureus N315
aaauuauguaaaaaau

SEQ ID NO: 2134754 - RNA, 20 nt, Staphylococcus aureus subsp. aureus N315
aaauuaugacuuauuuuuca

SEQ ID NO: 2134755 - RNA, 18 nt, Staphylococcus aureus subsp. aureus N315
aaauuaggcauucaucua

SEQ ID NO: 2134756 - RNA, 14 nt, Staphylococcus aureus subsp. aureus N315
aaauuaguuauacu

SEQ ID NO: 2134757 - RNA, 20 nt, Staphylococcus aureus subsp. aureus N315
aaauuagauuuuaugcuuua

SEQ ID NO: 2134758 - RNA, 14 nt, Staphylococcus aureus subsp. aureus N315
aaauuagaugaaau

SEQ ID NO: 2134759 - RNA, 23 nt, Staphylococcus aureus subsp. aureus N315
aaauuagcaagugaguaacauuu

SEQ ID NO: 2134760 - RNA, 15 nt, Staphylococcus aureus subsp. aureus N315
aaauuauauagaaaa

SEQ ID NO: 2134761 - RNA, 20 nt, Staphylococcus aureus subsp. aureus N315
aaauuauagccuucauuugc

SEQ ID NO: 2134762 - RNA, 14 nt, Staphylococcus aureus subsp. aureus N315
aaauuaguuugaua

SEQ ID NO: 2134763 - RNA, 23 nt, Staphylococcus aureus subsp. aureus N315
uuuuuuuauaaguuaaaaaugua

SEQ ID NO: 2134764 - RNA, 21 nt, Staphylococcus aureus subsp. aureus N315
aaauuacaacuuuuagaguuu

SEQ ID NO: 2134765 - RNA, 13 nt, Staphylococcus aureus subsp. aureus N315
uuuuuuccuuucu

SEQ ID NO: 2134766 - RNA, 12 nt, Staphylococcus aureus subsp. aureus N315
aaauuacuaacg

SEQ ID NO: 2134767 - RNA, 20 nt, Staphylococcus aureus subsp. aureus N315
aaauuacuuaauaguaacau

SEQ ID NO: 2134768 - RNA, 22 nt, Staphylococcus aureus subsp. aureus N315
aaauuacuuaauaguaacauaa

SEQ ID NO: 2134769 - RNA, 19 nt, Staphylococcus aureus subsp. aureus N315
aaauuacuuagcaaacaau

SEQ ID NO: 2134770 - RNA, 12 nt, Staphylococcus aureus subsp. aureus N315
aaauuagaauua

SEQ ID NO: 2134771 - RNA, 21 nt, Staphylococcus aureus subsp. aureus N315
aaauuagaaccaucauucaua

SEQ ID NO: 2134772 - RNA, 14 nt, Staphylococcus aureus subsp. aureus N315
aaauucucaauuaa

SEQ ID NO: 2134773 - RNA, 21 nt, Staphylococcus aureus subsp. aureus N315
aaauucucuuuuaaauucuua

SEQ ID NO: 2134774 - RNA, 17 nt, Staphylococcus aureus subsp. aureus N315
aaauucuacaggcaaug

SEQ ID NO: 2134775 - RNA, 21 nt, Staphylococcus aureus subsp. aureus N315
aaauucuaaucgcauuuuuua

SEQ ID NO: 2134776 - RNA, 21 nt, Staphylococcus aureus subsp. aureus N315
aaauucuauaauuuuaauuau

SEQ ID NO: 2134777 - RNA, 16 nt, Staphylococcus aureus subsp. aureus N315
aaauucgcaagccuuc

SEQ ID NO: 2134778 - RNA, 18 nt, Staphylococcus aureus subsp. aureus N315
aaauucgcuuguaacaag

SEQ ID NO: 2134779 - RNA, 19 nt, Staphylococcus aureus subsp. aureus N315
aaauucgacucaaacaaua

SEQ ID NO: 2134780 - RNA, 15 nt, Staphylococcus aureus subsp. aureus N315
aaauucgaaaagaaa

SEQ ID NO: 2134781 - RNA, 21 nt, Staphylococcus aureus subsp. aureus N315
aaauucaacuuuaaucaaaaa

SEQ ID NO: 2134782 - RNA, 15 nt, Staphylococcus aureus subsp. aureus N315
aaauucaacuuuaau

SEQ ID NO: 2134783 - RNA, 21 nt, Staphylococcus aureus subsp. aureus N315
uuuuugauaguaauaguuaac

SEQ ID NO: 2134784 - RNA, 17 nt, Staphylococcus aureus subsp. aureus N315
uuuuugagcacuuaaua

SEQ ID NO: 2134785 - RNA, 19 nt, Staphylococcus aureus subsp. aureus N315
uuuuuggagcguaaaguuu

SEQ ID NO: 2134786 - RNA, 15 nt, Staphylococcus aureus subsp. aureus N315
uuuuuggcuuaucaa

SEQ ID NO: 2134787 - RNA, 14 nt, Staphylococcus aureus subsp. aureus N315
uuuuuguugcaauu

SEQ ID NO: 2134788 - RNA, 13 nt, Staphylococcus aureus subsp. aureus N315
uuuuuguuuucaa

SEQ ID NO: 2134789 - RNA, 13 nt, Staphylococcus aureus subsp. aureus N315
uuuuuuaaaauga

SEQ ID NO: 2134790 - RNA, 13 nt, Staphylococcus aureus subsp. aureus N315
uuuuugucaguaa

SEQ ID NO: 2134791 - RNA, 15 nt, Staphylococcus aureus subsp. aureus N315
uuuuugugccuuucu

SEQ ID NO: 2134792 - RNA, 13 nt, Staphylococcus aureus subsp. aureus N315
uuuuuguauuuau

SEQ ID NO: 2134793 - RNA, 14 nt, Staphylococcus aureus subsp. aureus N315
uuuuucuaaauaaa

SEQ ID NO: 2134794 - RNA, 15 nt, Staphylococcus aureus subsp. aureus N315
uuuuucguaacauuu

SEQ ID NO: 2134795 - RNA, 17 nt, Staphylococcus aureus subsp. aureus N315
uuuuucgaaguggcaaa

SEQ ID NO: 2134796 - RNA, 19 nt, Staphylococcus aureus subsp. aureus N315
uuuuucuccuuuguauaag

SEQ ID NO: 2134797 - RNA, 22 nt, Staphylococcus aureus subsp. aureus N315
uuuuucuaaaugauuuauucua

SEQ ID NO: 2134798 - RNA, 16 nt, Staphylococcus aureus subsp. aureus N315
uuuuugaauaucuaau

SEQ ID NO: 2134799 - RNA, 17 nt, Staphylococcus aureus subsp. aureus N315
uuuuugaauaucuaaug

SEQ ID NO: 2134800 - RNA, 17 nt, Staphylococcus aureus subsp. aureus N315
uuuuugacauauuuuuu

SEQ ID NO: 2134801 - RNA, 12 nt, Staphylococcus aureus subsp. aureus N315
uuuuucuuucau

SEQ ID NO: 2134802 - RNA, 14 nt, Staphylococcus aureus subsp. aureus N315
uuuuucuuuuguuu

SEQ ID NO: 2134803 - RNA, 14 nt, Staphylococcus aureus subsp. aureus N315
aaauuaacuuaaaa

SEQ ID NO: 2134804 - RNA, 22 nt, Staphylococcus aureus subsp. aureus N315
aaauuaacuuagguuauuauaa

SEQ ID NO: 2134805 - RNA, 18 nt, Staphylococcus aureus subsp. aureus N315
aaauuaagaagaaauacu

SEQ ID NO: 2134806 - RNA, 24 nt, Staphylococcus aureus subsp. aureus N315
aaauuaacuuagguuauuauaaaa

SEQ ID NO: 2134807 - RNA, 19 nt, Staphylococcus aureus subsp. aureus N315
aaauuaauaugaacaaaaa

SEQ ID NO: 2134808 - RNA, 21 nt, Staphylococcus aureus subsp. aureus N315
aaauuaauaugaacaaaaaau

SEQ ID NO: 2134809 - RNA, 17 nt, Staphylococcus aureus subsp. aureus N315
aaauuaauaugaacaaa

SEQ ID NO: 2134810 - RNA, 12 nt, Staphylococcus aureus subsp. aureus N315
aaauuaauaauu

SEQ ID NO: 2134811 - RNA, 15 nt, Staphylococcus aureus subsp. aureus N315
aaauuaaauuuguua

SEQ ID NO: 2134812 - RNA, 13 nt, Staphylococcus aureus subsp. aureus N315
aaauuaacuagug

SEQ ID NO: 2134813 - RNA, 15 nt, Staphylococcus aureus subsp. aureus N315
aaauuaaaacuuuca

SEQ ID NO: 2134814 - RNA, 20 nt, Staphylococcus aureus subsp. aureus N315
aaauuaaagcuagaaacaau

SEQ ID NO: 2134815 - RNA, 17 nt, Staphylococcus aureus subsp. aureus N315
aaauuaaagcaaauuau

SEQ ID NO: 2134816 - RNA, 12 nt, Staphylococcus aureus subsp. aureus N315
uuuuuuauuaau

SEQ ID NO: 2134817 - RNA, 21 nt, Staphylococcus aureus subsp. aureus N315
uuuuuuaugcacaaaaaaauc

SEQ ID NO: 2134818 - RNA, 14 nt, Staphylococcus aureus subsp. aureus N315
uuuuuuauucuaau

SEQ ID NO: 2134819 - RNA, 21 nt, Staphylococcus aureus subsp. aureus N315
uuuuuuauauguuauauuaaa

SEQ ID NO: 2134820 - RNA, 22 nt, Staphylococcus aureus subsp. aureus N315
aaaugugcaauuagaauauaug

SEQ ID NO: 2134821 - RNA, 14 nt, Staphylococcus aureus subsp. aureus N315
uuuuuuauuugucu

SEQ ID NO: 2134822 - RNA, 15 nt, Staphylococcus aureus subsp. aureus N315
aaauguuacacaaau

SEQ ID NO: 2134823 - RNA, 19 nt, Staphylococcus aureus subsp. aureus N315
aaauguuauuaaccaucau

SEQ ID NO: 2134824 - RNA, 21 nt, Staphylococcus aureus subsp. aureus N315
aaauguuaaagauuauuauua

SEQ ID NO: 2134825 - RNA, 20 nt, Staphylococcus aureus subsp. aureus N315
aaauguuuaucaauucccug

SEQ ID NO: 2134826 - RNA, 17 nt, Staphylococcus aureus subsp. aureus N315
aaauguugaauguggaa

SEQ ID NO: 2134827 - RNA, 16 nt, Staphylococcus aureus subsp. aureus N315
aaauguuuaacaauaa

SEQ ID NO: 2134828 - RNA, 16 nt, Staphylococcus aureus subsp. aureus N315
aaauuaaaaaacaaaa

SEQ ID NO: 2134829 - RNA, 18 nt, Staphylococcus aureus subsp. aureus N315
uuuuguugcucagugcau

SEQ ID NO: 2134830 - RNA, 20 nt, Staphylococcus aureus subsp. aureus N315
uuuuguucuaaguguuuuau

SEQ ID NO: 2134831 - RNA, 22 nt, Staphylococcus aureus subsp. aureus N315
uuuuguugcucagugcauuuuu

SEQ ID NO: 2134832 - RNA, 14 nt, Staphylococcus aureus subsp. aureus N315
uuuuguuaauuuuu

SEQ ID NO: 2134833 - RNA, 15 nt, Staphylococcus aureus subsp. aureus N315
uuuuguuaauuuuuu

SEQ ID NO: 2134834 - RNA, 13 nt, Staphylococcus aureus subsp. aureus N315
uuuugugauuuuu

SEQ ID NO: 2134835 - RNA, 19 nt, Staphylococcus aureus subsp. aureus N315
uuuugugggcguucugcua

SEQ ID NO: 2134836 - RNA, 23 nt, Staphylococcus aureus subsp. aureus N315
uuuugugccucuuguguuucagc

SEQ ID NO: 2134837 - RNA, 17 nt, Staphylococcus aureus subsp. aureus N315
uuuuggucaaguaaaug

SEQ ID NO: 2134838 - RNA, 23 nt, Staphylococcus aureus subsp. aureus N315
uuuuguuucaaacgugauuuuau

SEQ ID NO: 2134839 - RNA, 12 nt, Staphylococcus aureus subsp. aureus N315
uuuuguuuugcu

SEQ ID NO: 2134840 - RNA, 19 nt, Staphylococcus aureus subsp. aureus N315
uuuuuaaaauuaucaauug

SEQ ID NO: 2134841 - RNA, 12 nt, Staphylococcus aureus subsp. aureus N315
uuuuuaaaauac

SEQ ID NO: 2134842 - RNA, 14 nt, Staphylococcus aureus subsp. aureus N315
uuuuuaaaaauaca

SEQ ID NO: 2134843 - RNA, 22 nt, Staphylococcus aureus subsp. aureus N315
uuuuuaaaaaauuuaaauaaua

SEQ ID NO: 2134844 - RNA, 14 nt, Staphylococcus aureus subsp. aureus N315
uuuuuaaaucuaca

SEQ ID NO: 2134845 - RNA, 12 nt, Staphylococcus aureus subsp. aureus N315
uuuuuaacaaaa

SEQ ID NO: 2134846 - RNA, 23 nt, Staphylococcus aureus subsp. aureus N315
uuuuuaacauagcuuaauaauua

SEQ ID NO: 2134847 - RNA, 18 nt, Staphylococcus aureus subsp. aureus N315
uuuuuaacagcuuuuucu

SEQ ID NO: 2134848 - RNA, 17 nt, Staphylococcus aureus subsp. aureus N315
uuuuuaaagcuggggaa

SEQ ID NO: 2134849 - RNA, 16 nt, Staphylococcus aureus subsp. aureus N315
uuuuuaauuauuuccc

SEQ ID NO: 2134850 - RNA, 18 nt, Staphylococcus aureus subsp. aureus N315
uuuuuaauguauucuucu

SEQ ID NO: 2134851 - RNA, 14 nt, Staphylococcus aureus subsp. aureus N315
uuuuuaauaaugca

SEQ ID NO: 2134852 - RNA, 23 nt, Staphylococcus aureus subsp. aureus N315
uuuuuaacuuuaacaucugaauc

SEQ ID NO: 2134853 - RNA, 17 nt, Staphylococcus aureus subsp. aureus N315
uuuuuauuaguauucaa

SEQ ID NO: 2134854 - RNA, 20 nt, Staphylococcus aureus subsp. aureus N315
uuuuuaugcacaaaaaaauc

SEQ ID NO: 2134855 - RNA, 13 nt, Staphylococcus aureus subsp. aureus N315
uuuuuauuaugaa

SEQ ID NO: 2134856 - RNA, 13 nt, Staphylococcus aureus subsp. aureus N315
uuuuuauuuacuc

SEQ ID NO: 2134857 - RNA, 13 nt, Staphylococcus aureus subsp. aureus N315
uuuuuauuauaau

SEQ ID NO: 2134858 - RNA, 15 nt, Staphylococcus aureus subsp. aureus N315
uuuuuaucaucuucu

SEQ ID NO: 2134859 - RNA, 11 nt, Staphylococcus aureus subsp. aureus N315
uuuuuauauug

SEQ ID NO: 2134860 - RNA, 23 nt, Staphylococcus aureus subsp. aureus N315
uuuuuauauuauuucaauacccu

SEQ ID NO: 2134861 - RNA, 18 nt, Staphylococcus aureus subsp. aureus N315
uuuuuagcauuaucauca

SEQ ID NO: 2134862 - RNA, 15 nt, Staphylococcus aureus subsp. aureus N315
uuuuuaguaauaaca

SEQ ID NO: 2134863 - RNA, 13 nt, Staphylococcus aureus subsp. aureus N315
uuuuuaguaguuu

SEQ ID NO: 2134864 - RNA, 15 nt, Staphylococcus aureus subsp. aureus N315
uuuuuaguuaaagua

SEQ ID NO: 2134865 - RNA, 19 nt, Staphylococcus aureus subsp. aureus N315
uuuuuacuaggaauauaaa

SEQ ID NO: 2134866 - RNA, 22 nt, Staphylococcus aureus subsp. aureus N315
uuuuucagcuguccgauuuuuu

SEQ ID NO: 2134867 - RNA, 14 nt, Staphylococcus aureus subsp. aureus N315
uuuuucaaugucua

SEQ ID NO: 2134868 - RNA, 16 nt, Staphylococcus aureus subsp. aureus N315
uuuuucaaauauauca

SEQ ID NO: 2134869 - RNA, 14 nt, Staphylococcus aureus subsp. aureus N315
uuuuucaaauaaua

SEQ ID NO: 2134870 - RNA, 15 nt, Staphylococcus aureus subsp. aureus N315
uuuuuauuuuacuua

SEQ ID NO: 2134871 - RNA, 16 nt, Staphylococcus aureus subsp. aureus N315
uuuuucaucauuaaaa

SEQ ID NO: 2134872 - RNA, 15 nt, Staphylococcus aureus subsp. aureus N315
uuuucugcuuucgcu

SEQ ID NO: 2134873 - RNA, 19 nt, Staphylococcus aureus subsp. aureus N315
uuuucucgauuaauuuucu

SEQ ID NO: 2134874 - RNA, 23 nt, Staphylococcus aureus subsp. aureus N315
uuuucucaacaguuucuuggucu

SEQ ID NO: 2134875 - RNA, 19 nt, Staphylococcus aureus subsp. aureus N315
uuuucuccaacgucauaac

SEQ ID NO: 2134876 - RNA, 14 nt, Staphylococcus aureus subsp. aureus N315
uuuucuaauuguuu

SEQ ID NO: 2134877 - RNA, 14 nt, Staphylococcus aureus subsp. aureus N315
uuuucuaaacaacu

SEQ ID NO: 2134878 - RNA, 14 nt, Staphylococcus aureus subsp. aureus N315
uuuucuuucucuaa

SEQ ID NO: 2134879 - RNA, 14 nt, Staphylococcus aureus subsp. aureus N315
uuuucuuuucaaaa

SEQ ID NO: 2134880 - RNA, 14 nt, Staphylococcus aureus subsp. aureus N315
uuuucuuuuuuaau

SEQ ID NO: 2134881 - RNA, 22 nt, Staphylococcus aureus subsp. aureus N315
uuuugaaacaucuaaauaguuu

SEQ ID NO: 2134882 - RNA, 13 nt, Staphylococcus aureus subsp. aureus N315
uuuucuuauuuau

SEQ ID NO: 2134883 - RNA, 20 nt, Staphylococcus aureus subsp. aureus N315
uuuucuuaguuugacaucua

SEQ ID NO: 2134884 - RNA, 19 nt, Staphylococcus aureus subsp. aureus N315
uuuucuguccaaaaagguu

SEQ ID NO: 2134885 - RNA, 22 nt, Staphylococcus aureus subsp. aureus N315
uuuucuugcauacgaauuaaaa

SEQ ID NO: 2134886 - RNA, 19 nt, Staphylococcus aureus subsp. aureus N315
uuuugagagauuauuuaaa

SEQ ID NO: 2134887 - RNA, 13 nt, Staphylococcus aureus subsp. aureus N315
uuuugaauuacag

SEQ ID NO: 2134888 - RNA, 19 nt, Staphylococcus aureus subsp. aureus N315
uuuugacaaauccuaauuu

SEQ ID NO: 2134889 - RNA, 23 nt, Staphylococcus aureus subsp. aureus N315
uuuugauauaaaaagugaaagua

SEQ ID NO: 2134890 - RNA, 16 nt, Staphylococcus aureus subsp. aureus N315
uuuugaguuauauuuu

SEQ ID NO: 2134891 - RNA, 18 nt, Staphylococcus aureus subsp. aureus N315
uuuugauuuacgugcauu

SEQ ID NO: 2134892 - RNA, 14 nt, Staphylococcus aureus subsp. aureus N315
uuuugcaucacaga

SEQ ID NO: 2134893 - RNA, 21 nt, Staphylococcus aureus subsp. aureus N315
uuuugcccaugucaugaauuu

SEQ ID NO: 2134894 - RNA, 15 nt, Staphylococcus aureus subsp. aureus N315
uuuugcuaaccauca

SEQ ID NO: 2134895 - RNA, 14 nt, Staphylococcus aureus subsp. aureus N315
uuuugcuguauaua

SEQ ID NO: 2134896 - RNA, 15 nt, Staphylococcus aureus subsp. aureus N315
uuuugcuauuucaac

SEQ ID NO: 2134897 - RNA, 22 nt, Staphylococcus aureus subsp. aureus N315
uuuuggcuuaucaagcaccuua

SEQ ID NO: 2134898 - RNA, 22 nt, Staphylococcus aureus subsp. aureus N315
uuuuaaauuacuauauuuaaau

SEQ ID NO: 2134899 - RNA, 13 nt, Staphylococcus aureus subsp. aureus N315
uuuuaaauuacua

SEQ ID NO: 2134900 - RNA, 23 nt, Staphylococcus aureus subsp. aureus N315
uuuuaaauaaucgaaaauuucag

SEQ ID NO: 2134901 - RNA, 18 nt, Staphylococcus aureus subsp. aureus N315
uuuuaaaucuacaauauu

SEQ ID NO: 2134902 - RNA, 16 nt, Staphylococcus aureus subsp. aureus N315
uuuuaaagaaaaguuu

SEQ ID NO: 2134903 - RNA, 19 nt, Staphylococcus aureus subsp. aureus N315
uuuuaaacguacauuuuua

SEQ ID NO: 2134904 - RNA, 20 nt, Staphylococcus aureus subsp. aureus N315
uuuuaaaggaccacuuagau

SEQ ID NO: 2134905 - RNA, 22 nt, Staphylococcus aureus subsp. aureus N315
uuuuaaagguuaaauauuuaau

SEQ ID NO: 2134906 - RNA, 12 nt, Staphylococcus aureus subsp. aureus N315
uuuuaaaguuua

SEQ ID NO: 2134907 - RNA, 22 nt, Staphylococcus aureus subsp. aureus N315
uuuuaaacaugaacaaucagau

SEQ ID NO: 2134908 - RNA, 14 nt, Staphylococcus aureus subsp. aureus N315
uuuuaaaaugauag

SEQ ID NO: 2134909 - RNA, 21 nt, Staphylococcus aureus subsp. aureus N315
uuuuaaaaucucauaauaauu

SEQ ID NO: 2134910 - RNA, 16 nt, Staphylococcus aureus subsp. aureus N315
uuuuaaaaauacagcu

SEQ ID NO: 2134911 - RNA, 15 nt, Staphylococcus aureus subsp. aureus N315
uuuuaaaaauucaua

SEQ ID NO: 2134912 - RNA, 14 nt, Staphylococcus aureus subsp. aureus N315
uuuguuuuaaaaaa

SEQ ID NO: 2134913 - RNA, 12 nt, Staphylococcus aureus subsp. aureus N315
uuuguuuuaaau

SEQ ID NO: 2134914 - RNA, 13 nt, Staphylococcus aureus subsp. aureus N315
uuuguuuugaaug

SEQ ID NO: 2134915 - RNA, 15 nt, Staphylococcus aureus subsp. aureus N315
uuuguuacuucuaau

SEQ ID NO: 2134916 - RNA, 15 nt, Staphylococcus aureus subsp. aureus N315
uuuguugguguuuag

SEQ ID NO: 2134917 - RNA, 19 nt, Staphylococcus aureus subsp. aureus N315
uuuguucuuggcucaacaa

SEQ ID NO: 2134918 - RNA, 17 nt, Staphylococcus aureus subsp. aureus N315
uuuuaauauauuuauuu

SEQ ID NO: 2134919 - RNA, 12 nt, Staphylococcus aureus subsp. aureus N315
uuuuaagugaug

SEQ ID NO: 2134920 - RNA, 24 nt, Staphylococcus aureus subsp. aureus N315
uuuuaaggcagcuaaaaaguauac

SEQ ID NO: 2134921 - RNA, 21 nt, Staphylococcus aureus subsp. aureus N315
uuuuaacuauguuacuuauau

SEQ ID NO: 2134922 - RNA, 21 nt, Staphylococcus aureus subsp. aureus N315
uuuuaaauucuuauaaaauaa

SEQ ID NO: 2134923 - RNA, 12 nt, Staphylococcus aureus subsp. aureus N315
uuuuaaauuuag

SEQ ID NO: 2134924 - RNA, 15 nt, Staphylococcus aureus subsp. aureus N315
uuuuaacaaaauaua

SEQ ID NO: 2134925 - RNA, 21 nt, Staphylococcus aureus subsp. aureus N315
uuuuaacaaaauauacuaaau

SEQ ID NO: 2134926 - RNA, 20 nt, Staphylococcus aureus subsp. aureus N315
uuuuaacagcgugaauauaa

SEQ ID NO: 2134927 - RNA, 20 nt, Staphylococcus aureus subsp. aureus N315
uuuuacaaucaucacacaua

SEQ ID NO: 2134928 - RNA, 21 nt, Staphylococcus aureus subsp. aureus N315
uuuuacaaagugauuuaaaaa

SEQ ID NO: 2134929 - RNA, 13 nt, Staphylococcus aureus subsp. aureus N315
uuuuaauuuucag

SEQ ID NO: 2134930 - RNA, 18 nt, Staphylococcus aureus subsp. aureus N315
uuuuaauuuguauuuaaa

SEQ ID NO: 2134931 - RNA, 19 nt, Staphylococcus aureus subsp. aureus N315
uuuuaaugggcgauaaaag

SEQ ID NO: 2134932 - RNA, 12 nt, Staphylococcus aureus subsp. aureus N315
uuuuaaugauuu

SEQ ID NO: 2134933 - RNA, 11 nt, Staphylococcus aureus subsp. aureus N315
uuuuaauuauu

SEQ ID NO: 2134934 - RNA, 13 nt, Staphylococcus aureus subsp. aureus N315
uuuuaauucuauu

SEQ ID NO: 2134935 - RNA, 18 nt, Staphylococcus aureus subsp. aureus N315
uuuuaauuauuuuaaaaa

SEQ ID NO: 2134936 - RNA, 20 nt, Staphylococcus aureus subsp. aureus N315
uuuuacagucaacugcugcu

SEQ ID NO: 2134937 - RNA, 21 nt, Staphylococcus aureus subsp. aureus N315
uuuuaccuaguaacucaacau

SEQ ID NO: 2134938 - RNA, 18 nt, Staphylococcus aureus subsp. aureus N315
uuuuaccucugauaaaug

SEQ ID NO: 2134939 - RNA, 21 nt, Staphylococcus aureus subsp. aureus N315
uuuuaccauugugaauaauuu

SEQ ID NO: 2134940 - RNA, 23 nt, Staphylococcus aureus subsp. aureus N315
uuuggcaaguuaugaaaugucug

SEQ ID NO: 2134941 - RNA, 15 nt, Staphylococcus aureus subsp. aureus N315
uuugguggcuugcau

SEQ ID NO: 2134942 - RNA, 22 nt, Staphylococcus aureus subsp. aureus N315
uuugguucaaucauucacuuca

SEQ ID NO: 2134943 - RNA, 20 nt, Staphylococcus aureus subsp. aureus N315
uuugguaagcuaauuucuaa

SEQ ID NO: 2134944 - RNA, 18 nt, Staphylococcus aureus subsp. aureus N315
uuuggucaaguuuugguc

SEQ ID NO: 2134945 - RNA, 21 nt, Staphylococcus aureus subsp. aureus N315
uuuggauuucuuuuuaaaauc

SEQ ID NO: 2134946 - RNA, 18 nt, Staphylococcus aureus subsp. aureus N315
uuugcuuuauuuucuugu

SEQ ID NO: 2134947 - RNA, 23 nt, Staphylococcus aureus subsp. aureus N315
uuugcuuuagcucuuuuuugauu

SEQ ID NO: 2134948 - RNA, 17 nt, Staphylococcus aureus subsp. aureus N315
uuugcuggcgcaaugau

SEQ ID NO: 2134949 - RNA, 17 nt, Staphylococcus aureus subsp. aureus N315
uuugcuguuuaguuaau

SEQ ID NO: 2134950 - RNA, 17 nt, Staphylococcus aureus subsp. aureus N315
uuuguauaccuauuccu

SEQ ID NO: 2134951 - RNA, 19 nt, Staphylococcus aureus subsp. aureus N315
uuuguauaccuauuccuau

SEQ ID NO: 2134952 - RNA, 20 nt, Staphylococcus aureus subsp. aureus N315
uuuguauauucuuuuuaacu

SEQ ID NO: 2134953 - RNA, 16 nt, Staphylococcus aureus subsp. aureus N315
uuuguaugauaaccau

SEQ ID NO: 2134954 - RNA, 15 nt, Staphylococcus aureus subsp. aureus N315
uuuguauuguuugaa

SEQ ID NO: 2134955 - RNA, 14 nt, Staphylococcus aureus subsp. aureus N315
uuuguauuuaaaau

SEQ ID NO: 2134956 - RNA, 14 nt, Staphylococcus aureus subsp. aureus N315
uuuguacauuucua

SEQ ID NO: 2134957 - RNA, 15 nt, Staphylococcus aureus subsp. aureus N315
uuuguacauuucuau

SEQ ID NO: 2134958 - RNA, 20 nt, Staphylococcus aureus subsp. aureus N315
uuuguaagcucaugaaucag

SEQ ID NO: 2134959 - RNA, 19 nt, Staphylococcus aureus subsp. aureus N315
uuuguaauacaagcaauac

SEQ ID NO: 2134960 - RNA, 23 nt, Staphylococcus aureus subsp. aureus N315
uuuguaaucccauuuuaaaguca

SEQ ID NO: 2134961 - RNA, 22 nt, Staphylococcus aureus subsp. aureus N315
uuuguaaagcuuuaguuaaaua

SEQ ID NO: 2134962 - RNA, 15 nt, Staphylococcus aureus subsp. aureus N315
uuugguuugcuuuaa

SEQ ID NO: 2134963 - RNA, 15 nt, Staphylococcus aureus subsp. aureus N315
uuuguaaccuaaaaa

SEQ ID NO: 2134964 - RNA, 18 nt, Staphylococcus aureus subsp. aureus N315
uuuguaaccuaaaaacaa

SEQ ID NO: 2134965 - RNA, 14 nt, Staphylococcus aureus subsp. aureus N315
uuugugggcguucu

SEQ ID NO: 2134966 - RNA, 11 nt, Staphylococcus aureus subsp. aureus N315
uuugugguaau

SEQ ID NO: 2134967 - RNA, 15 nt, Staphylococcus aureus subsp. aureus N315
uuugucuuacuaauu

SEQ ID NO: 2134968 - RNA, 15 nt, Staphylococcus aureus subsp. aureus N315
uuugucucucaacau

SEQ ID NO: 2134969 - RNA, 19 nt, Staphylococcus aureus subsp. aureus N315
uuuguccagacaaccccca

SEQ ID NO: 2134970 - RNA, 17 nt, Staphylococcus aureus subsp. aureus N315
uuugucaguaacuuugu

SEQ ID NO: 2134971 - RNA, 12 nt, Staphylococcus aureus subsp. aureus N315
uuuguauuuaug

SEQ ID NO: 2134972 - RNA, 18 nt, Staphylococcus aureus subsp. aureus N315
uuuuauguuuaaacauuu

SEQ ID NO: 2134973 - RNA, 19 nt, Staphylococcus aureus subsp. aureus N315
uuuuauguuuaauuugauu

SEQ ID NO: 2134974 - RNA, 20 nt, Staphylococcus aureus subsp. aureus N315
uuuuaugucuaguucuugag

SEQ ID NO: 2134975 - RNA, 23 nt, Staphylococcus aureus subsp. aureus N315
uuuuaugucaauagcgguuuaaa

SEQ ID NO: 2134976 - RNA, 18 nt, Staphylococcus aureus subsp. aureus N315
uuuuaugguuuaauuuag

SEQ ID NO: 2134977 - RNA, 18 nt, Staphylococcus aureus subsp. aureus N315
uuuuauggcgguuugaaa

SEQ ID NO: 2134978 - RNA, 22 nt, Staphylococcus aureus subsp. aureus N315
uuuuauuauacacuuuuugaca

SEQ ID NO: 2134979 - RNA, 16 nt, Staphylococcus aureus subsp. aureus N315
uuuuauuaucuuuaau

SEQ ID NO: 2134980 - RNA, 17 nt, Staphylococcus aureus subsp. aureus N315
uuuuauuuauacuaaau

SEQ ID NO: 2134981 - RNA, 17 nt, Staphylococcus aureus subsp. aureus N315
uuuuauuuuaauauuuu

SEQ ID NO: 2134982 - RNA, 18 nt, Staphylococcus aureus subsp. aureus N315
uuuuauuugauuauucuu

SEQ ID NO: 2134983 - RNA, 16 nt, Staphylococcus aureus subsp. aureus N315
uuuuauuguuuuggcu

SEQ ID NO: 2134984 - RNA, 13 nt, Staphylococcus aureus subsp. aureus N315
uuuuauuaauuaa

SEQ ID NO: 2134985 - RNA, 13 nt, Staphylococcus aureus subsp. aureus N315
uuuuauucuaaua

SEQ ID NO: 2134986 - RNA, 13 nt, Staphylococcus aureus subsp. aureus N315
uuuuaucugaauc

SEQ ID NO: 2134987 - RNA, 16 nt, Staphylococcus aureus subsp. aureus N315
uuuuaucuaaacauuu

SEQ ID NO: 2134988 - RNA, 14 nt, Staphylococcus aureus subsp. aureus N315
uuuuaucugaaucu

SEQ ID NO: 2134989 - RNA, 22 nt, Staphylococcus aureus subsp. aureus N315
uuuuaugaauugaguauuaaau

SEQ ID NO: 2134990 - RNA, 19 nt, Staphylococcus aureus subsp. aureus N315
uuuuaugauuuucuuuaau

SEQ ID NO: 2134991 - RNA, 15 nt, Staphylococcus aureus subsp. aureus N315
uuuuaugauuugauu

SEQ ID NO: 2134992 - RNA, 18 nt, Staphylococcus aureus subsp. aureus N315
uuuuaucgaaauauuuau

SEQ ID NO: 2134993 - RNA, 19 nt, Staphylococcus aureus subsp. aureus N315
uuuuaucaucuauucaacu

SEQ ID NO: 2134994 - RNA, 14 nt, Staphylococcus aureus subsp. aureus N315
uuuuauauuuauuu

SEQ ID NO: 2134995 - RNA, 18 nt, Staphylococcus aureus subsp. aureus N315
uuuuaucaauauuaguuu

SEQ ID NO: 2134996 - RNA, 17 nt, Staphylococcus aureus subsp. aureus N315
uuuuauauuuaaacucu

SEQ ID NO: 2134997 - RNA, 18 nt, Staphylococcus aureus subsp. aureus N315
uuuuauaugcaacuuaua

SEQ ID NO: 2134998 - RNA, 19 nt, Staphylococcus aureus subsp. aureus N315
uuuuauagugguaaaaagu

SEQ ID NO: 2134999 - RNA, 21 nt, Staphylococcus aureus subsp. aureus N315
uuuuacguaaucuaauacaua

SEQ ID NO: 2135000 - RNA, 16 nt, Staphylococcus aureus subsp. aureus N315
uuuuacuaaaucauuu

SEQ ID NO: 2135001 - RNA, 20 nt, Staphylococcus aureus subsp. aureus N315
uuuuacuuucaccauuuacu

SEQ ID NO: 2135002 - RNA, 15 nt, Staphylococcus aureus subsp. aureus N315
uuuuagauuugaaau

SEQ ID NO: 2135003 - RNA, 19 nt, Staphylococcus aureus subsp. aureus N315
uuuuagccccagcaaauac

SEQ ID NO: 2135004 - RNA, 21 nt, Staphylococcus aureus subsp. aureus N315
uuuuagccccagcaaauacuu

SEQ ID NO: 2135005 - RNA, 13 nt, Staphylococcus aureus subsp. aureus N315
uuuuagaaaagga

SEQ ID NO: 2135006 - RNA, 15 nt, Staphylococcus aureus subsp. aureus N315
uuuuacuuuuauaau

SEQ ID NO: 2135007 - RNA, 16 nt, Staphylococcus aureus subsp. aureus N315
uuuuagugacaaacau

SEQ ID NO: 2135008 - RNA, 18 nt, Staphylococcus aureus subsp. aureus N315
uuuuagguaauaauucag

SEQ ID NO: 2135009 - RNA, 15 nt, Staphylococcus aureus subsp. aureus N315
uuuuagcuauagaaa

SEQ ID NO: 2135010 - RNA, 22 nt, Staphylococcus aureus subsp. aureus N315
uuuuagcuaaacgacauuguuu

SEQ ID NO: 2135011 - RNA, 14 nt, Staphylococcus aureus subsp. aureus N315
uuuuagcuuuugua

SEQ ID NO: 2135012 - RNA, 14 nt, Staphylococcus aureus subsp. aureus N315
uuuuauaaauuuug

SEQ ID NO: 2135013 - RNA, 14 nt, Staphylococcus aureus subsp. aureus N315
uuuuauaaaauaua

SEQ ID NO: 2135014 - RNA, 16 nt, Staphylococcus aureus subsp. aureus N315
uuuuauaguaauagcu

SEQ ID NO: 2135015 - RNA, 21 nt, Staphylococcus aureus subsp. aureus N315
uuuucgaggucaucaaaaguu

SEQ ID NO: 2135016 - RNA, 18 nt, Staphylococcus aureus subsp. aureus N315
uuuucgaggucaucaaaa

SEQ ID NO: 2135017 - RNA, 19 nt, Staphylococcus aureus subsp. aureus N315
uuuucgaaaaucucuguau

SEQ ID NO: 2135018 - RNA, 18 nt, Staphylococcus aureus subsp. aureus N315
uuuucguauaauuuuaau

SEQ ID NO: 2135019 - RNA, 19 nt, Staphylococcus aureus subsp. aureus N315
uuuuccauucauaaaagca

SEQ ID NO: 2135020 - RNA, 13 nt, Staphylococcus aureus subsp. aureus N315
uuuuccaauaaua

SEQ ID NO: 2135021 - RNA, 19 nt, Staphylococcus aureus subsp. aureus N315
uuuuccuaaaccucuaaau

SEQ ID NO: 2135022 - RNA, 20 nt, Staphylococcus aureus subsp. aureus N315
uuuuauuuuuuucacuaauu

SEQ ID NO: 2135023 - RNA, 13 nt, Staphylococcus aureus subsp. aureus N315
uuuucaaaaauag

SEQ ID NO: 2135024 - RNA, 21 nt, Staphylococcus aureus subsp. aureus N315
uuuucaaacauauucauucua

SEQ ID NO: 2135025 - RNA, 20 nt, Staphylococcus aureus subsp. aureus N315
uuuucaaacauauucauucu

SEQ ID NO: 2135026 - RNA, 20 nt, Staphylococcus aureus subsp. aureus N315
uuuucaaaaucuuuaucagu

SEQ ID NO: 2135027 - RNA, 22 nt, Staphylococcus aureus subsp. aureus N315
uuuucaagaccaaauauuuuau

SEQ ID NO: 2135028 - RNA, 12 nt, Staphylococcus aureus subsp. aureus N315
uuuucaacugua

SEQ ID NO: 2135029 - RNA, 19 nt, Staphylococcus aureus subsp. aureus N315
uuuucaacauaauauuucu

SEQ ID NO: 2135030 - RNA, 14 nt, Staphylococcus aureus subsp. aureus N315
uuuucaaaugaaaa

SEQ ID NO: 2135031 - RNA, 19 nt, Staphylococcus aureus subsp. aureus N315
uuuucaaguuuaaaauacg

SEQ ID NO: 2135032 - RNA, 22 nt, Staphylococcus aureus subsp. aureus N315
uuuucaauucgcucacauguga

SEQ ID NO: 2135033 - RNA, 15 nt, Staphylococcus aureus subsp. aureus N315
uuuucaauauuugau

SEQ ID NO: 2135034 - RNA, 20 nt, Staphylococcus aureus subsp. aureus N315
uuuucauagaacaaaaugua

SEQ ID NO: 2135035 - RNA, 21 nt, Staphylococcus aureus subsp. aureus N315
uuuucauagaacaaaauguag

SEQ ID NO: 2135036 - RNA, 17 nt, Staphylococcus aureus subsp. aureus N315
uuuucaucaguugagug

SEQ ID NO: 2135037 - RNA, 22 nt, Staphylococcus aureus subsp. aureus N315
uuuucacgaauaucuuaaagaa

SEQ ID NO: 2135038 - RNA, 15 nt, Staphylococcus aureus subsp. aureus N315
uuuucagaaucagaa

SEQ ID NO: 2135039 - RNA, 22 nt, Staphylococcus aureus subsp. aureus N315
uuuucacuucgccaagccaucu

SEQ ID NO: 2135040 - RNA, 17 nt, Staphylococcus aureus subsp. aureus N315
uuuucagagauucuguu

SEQ ID NO: 2135041 - RNA, 22 nt, Staphylococcus aureus subsp. aureus N315
uuucugaucgacuaauuuuucu

SEQ ID NO: 2135042 - RNA, 18 nt, Staphylococcus aureus subsp. aureus N315
uuucugacuuuuaaaaaa

SEQ ID NO: 2135043 - RNA, 16 nt, Staphylococcus aureus subsp. aureus N315
uuucugagaagaaaua

SEQ ID NO: 2135044 - RNA, 21 nt, Staphylococcus aureus subsp. aureus N315
uuucugagaagaaauauauug

SEQ ID NO: 2135045 - RNA, 21 nt, Staphylococcus aureus subsp. aureus N315
uuucugacaacuuaauagaaa

SEQ ID NO: 2135046 - RNA, 13 nt, Staphylococcus aureus subsp. aureus N315
uuucucuaaauaa

SEQ ID NO: 2135047 - RNA, 17 nt, Staphylococcus aureus subsp. aureus N315
uuucuccuuuguauaag

SEQ ID NO: 2135048 - RNA, 20 nt, Staphylococcus aureus subsp. aureus N315
uuucucaaguaacucaagug

SEQ ID NO: 2135049 - RNA, 19 nt, Staphylococcus aureus subsp. aureus N315
uuucucaaacguucaucua

SEQ ID NO: 2135050 - RNA, 23 nt, Staphylococcus aureus subsp. aureus N315
uuucucaaacguucaucuaauuu

SEQ ID NO: 2135051 - RNA, 15 nt, Staphylococcus aureus subsp. aureus N315
uuucuaaguuuguug

SEQ ID NO: 2135052 - RNA, 21 nt, Staphylococcus aureus subsp. aureus N315
uuucuacucugauuacauaua

SEQ ID NO: 2135053 - RNA, 18 nt, Staphylococcus aureus subsp. aureus N315
uuucuauuaauauagaag

SEQ ID NO: 2135054 - RNA, 12 nt, Staphylococcus aureus subsp. aureus N315
uuucuaucaaau

SEQ ID NO: 2135055 - RNA, 18 nt, Staphylococcus aureus subsp. aureus N315
uuucuauagaauuuuuca

SEQ ID NO: 2135056 - RNA, 17 nt, Staphylococcus aureus subsp. aureus N315
uuucguguuccaauuuu

SEQ ID NO: 2135057 - RNA, 21 nt, Staphylococcus aureus subsp. aureus N315
uuucgucuuguaaacuucuuu

SEQ ID NO: 2135058 - RNA, 23 nt, Staphylococcus aureus subsp. aureus N315
uuucguuagacucacuucuuaaa

SEQ ID NO: 2135059 - RNA, 20 nt, Staphylococcus aureus subsp. aureus N315
uuucuaaaucuaacuggaaa

SEQ ID NO: 2135060 - RNA, 19 nt, Staphylococcus aureus subsp. aureus N315
uuucggcuagauuuuaaac

SEQ ID NO: 2135061 - RNA, 18 nt, Staphylococcus aureus subsp. aureus N315
uuucggacgauugaacau

SEQ ID NO: 2135062 - RNA, 19 nt, Staphylococcus aureus subsp. aureus N315
uuucgcuuuuuuuauuuuu

SEQ ID NO: 2135063 - RNA, 14 nt, Staphylococcus aureus subsp. aureus N315
uuucguauuuuucu

SEQ ID NO: 2135064 - RNA, 15 nt, Staphylococcus aureus subsp. aureus N315
uuucguauuuuucuu

SEQ ID NO: 2135065 - RNA, 17 nt, Staphylococcus aureus subsp. aureus N315
uuucguauuuuucuugg

SEQ ID NO: 2135066 - RNA, 21 nt, Staphylococcus aureus subsp. aureus N315
uuucgaacuuuuguucuaagu

SEQ ID NO: 2135067 - RNA, 21 nt, Staphylococcus aureus subsp. aureus N315
uuucgaguaugguugauuaca

SEQ ID NO: 2135068 - RNA, 18 nt, Staphylococcus aureus subsp. aureus N315
uuucgauaccuaaaauac

SEQ ID NO: 2135069 - RNA, 18 nt, Staphylococcus aureus subsp. aureus N315
uuuccuacacuguuuuau

SEQ ID NO: 2135070 - RNA, 19 nt, Staphylococcus aureus subsp. aureus N315
uuuccuaauucuugagcaa

SEQ ID NO: 2135071 - RNA, 13 nt, Staphylococcus aureus subsp. aureus N315
uuuccguguuuau

SEQ ID NO: 2135072 - RNA, 17 nt, Staphylococcus aureus subsp. aureus N315
uuuccguguuuauuuuu

SEQ ID NO: 2135073 - RNA, 19 nt, Staphylococcus aureus subsp. aureus N315
uuuccucgguuuuauuuuu

SEQ ID NO: 2135074 - RNA, 21 nt, Staphylococcus aureus subsp. aureus N315
uuuccucgguuuuauuuuuau

SEQ ID NO: 2135075 - RNA, 11 nt, Staphylococcus aureus subsp. aureus N315
uuuccucuuua

SEQ ID NO: 2135076 - RNA, 22 nt, Staphylococcus aureus subsp. aureus N315
uuuccucuuuaaagcuaaaugu

SEQ ID NO: 2135077 - RNA, 20 nt, Staphylococcus aureus subsp. aureus N315
uuuccauaaauaaaaugcua

SEQ ID NO: 2135078 - RNA, 22 nt, Staphylococcus aureus subsp. aureus N315
uuuccauaaauauuuaaaauau

SEQ ID NO: 2135079 - RNA, 19 nt, Staphylococcus aureus subsp. aureus N315
uuuccauaaauaaaaugcu

SEQ ID NO: 2135080 - RNA, 23 nt, Staphylococcus aureus subsp. aureus N315
uuucccuacugcuugugugaaau

SEQ ID NO: 2135081 - RNA, 13 nt, Staphylococcus aureus subsp. aureus N315
uuugaaauauacc

SEQ ID NO: 2135082 - RNA, 23 nt, Staphylococcus aureus subsp. aureus N315
uuugaaaaaguguuuaaaugcua

SEQ ID NO: 2135083 - RNA, 19 nt, Staphylococcus aureus subsp. aureus N315
uuugaaaaaguguuuaaau

SEQ ID NO: 2135084 - RNA, 18 nt, Staphylococcus aureus subsp. aureus N315
uuugaaaauuucaccgcu

SEQ ID NO: 2135085 - RNA, 20 nt, Staphylococcus aureus subsp. aureus N315
uuucuuuugaacguuguaug

SEQ ID NO: 2135086 - RNA, 22 nt, Staphylococcus aureus subsp. aureus N315
uuucuuuuuuuauggauuucuu

SEQ ID NO: 2135087 - RNA, 20 nt, Staphylococcus aureus subsp. aureus N315
uuucuuuuguuuuuauauua

SEQ ID NO: 2135088 - RNA, 18 nt, Staphylococcus aureus subsp. aureus N315
uuucuuuuuuaauucuau

SEQ ID NO: 2135089 - RNA, 16 nt, Staphylococcus aureus subsp. aureus N315
uuugaaucuuguugaa

SEQ ID NO: 2135090 - RNA, 20 nt, Staphylococcus aureus subsp. aureus N315
uuugaaggagauauuuucuu

SEQ ID NO: 2135091 - RNA, 13 nt, Staphylococcus aureus subsp. aureus N315
uuugaauaaaaaa

SEQ ID NO: 2135092 - RNA, 19 nt, Staphylococcus aureus subsp. aureus N315
uuugaaauuucgacaucua

SEQ ID NO: 2135093 - RNA, 16 nt, Staphylococcus aureus subsp. aureus N315
uuugaaccuaaauucc

SEQ ID NO: 2135094 - RNA, 17 nt, Staphylococcus aureus subsp. aureus N315
uuugaagaauaaaaaag

SEQ ID NO: 2135095 - RNA, 16 nt, Staphylococcus aureus subsp. aureus N315
uuugacaguuuuaaau

SEQ ID NO: 2135096 - RNA, 17 nt, Staphylococcus aureus subsp. aureus N315
uuugaauugacuuacau

SEQ ID NO: 2135097 - RNA, 17 nt, Staphylococcus aureus subsp. aureus N315
uuugacaaauccuaauu

SEQ ID NO: 2135098 - RNA, 12 nt, Staphylococcus aureus subsp. aureus N315
uuugaauuuuau

SEQ ID NO: 2135099 - RNA, 21 nt, Staphylococcus aureus subsp. aureus N315
uuugaaugcaaaucaaauaca

SEQ ID NO: 2135100 - RNA, 17 nt, Staphylococcus aureus subsp. aureus N315
uuugagcauuuuuauau

SEQ ID NO: 2135101 - RNA, 18 nt, Staphylococcus aureus subsp. aureus N315
uuucuuaguuugacaucu

SEQ ID NO: 2135102 - RNA, 19 nt, Staphylococcus aureus subsp. aureus N315
uuucugugaccaauagaau

SEQ ID NO: 2135103 - RNA, 14 nt, Staphylococcus aureus subsp. aureus N315
uuucugugaccaau

SEQ ID NO: 2135104 - RNA, 19 nt, Staphylococcus aureus subsp. aureus N315
uuucuguuuaauuaaaaua

SEQ ID NO: 2135105 - RNA, 12 nt, Staphylococcus aureus subsp. aureus N315
uuucuucauuuu

SEQ ID NO: 2135106 - RNA, 15 nt, Staphylococcus aureus subsp. aureus N315
uuucuucauuaucaa

SEQ ID NO: 2135107 - RNA, 13 nt, Staphylococcus aureus subsp. aureus N315
uuucuuauguaua

SEQ ID NO: 2135108 - RNA, 16 nt, Staphylococcus aureus subsp. aureus N315
uuucuuauuuguaauu

SEQ ID NO: 2135109 - RNA, 22 nt, Staphylococcus aureus subsp. aureus N315
uuucuucagaaccuugaaugau

SEQ ID NO: 2135110 - RNA, 22 nt, Staphylococcus aureus subsp. aureus N315
uuucuuugauaacaauuuuaaa

SEQ ID NO: 2135111 - RNA, 17 nt, Staphylococcus aureus subsp. aureus N315
uuucuuuguguuugcuu

SEQ ID NO: 2135112 - RNA, 16 nt, Staphylococcus aureus subsp. aureus N315
uuucuuuucaaaauaa

SEQ ID NO: 2135113 - RNA, 12 nt, Staphylococcus aureus subsp. aureus N315
uuucuucugcua

SEQ ID NO: 2135114 - RNA, 11 nt, Staphylococcus aureus subsp. aureus N315
uuucuucuucu

SEQ ID NO: 2135115 - RNA, 15 nt, Staphylococcus aureus subsp. aureus N315
uuucuugaucuaaug

SEQ ID NO: 2135116 - RNA, 14 nt, Staphylococcus aureus subsp. aureus N315
uuucuuguucuaaa

SEQ ID NO: 2135117 - RNA, 18 nt, Staphylococcus aureus subsp. aureus N315
uuugaguauccaauacua

SEQ ID NO: 2135118 - RNA, 14 nt, Staphylococcus aureus subsp. aureus N315
uuugaguaaauuaa

SEQ ID NO: 2135119 - RNA, 21 nt, Staphylococcus aureus subsp. aureus N315
uuugagguguggaguaaagau

SEQ ID NO: 2135120 - RNA, 17 nt, Staphylococcus aureus subsp. aureus N315
uuugauaaauaaaauuu

SEQ ID NO: 2135121 - RNA, 17 nt, Staphylococcus aureus subsp. aureus N315
uuugaucaacuauauau

SEQ ID NO: 2135122 - RNA, 24 nt, Staphylococcus aureus subsp. aureus N315
uuugaugaucauuaguguagaaaa

SEQ ID NO: 2135123 - RNA, 13 nt, Staphylococcus aureus subsp. aureus N315
uuugauuguuuaa

SEQ ID NO: 2135124 - RNA, 17 nt, Staphylococcus aureus subsp. aureus N315
uuugauuaguaaauaua

SEQ ID NO: 2135125 - RNA, 16 nt, Staphylococcus aureus subsp. aureus N315
uuugauucuaaauaau

SEQ ID NO: 2135126 - RNA, 13 nt, Staphylococcus aureus subsp. aureus N315
uuugauuuugaau

SEQ ID NO: 2135127 - RNA, 16 nt, Staphylococcus aureus subsp. aureus N315
uuugauuuugaauaaa

SEQ ID NO: 2135128 - RNA, 17 nt, Staphylococcus aureus subsp. aureus N315
uuugauuuuacuugaau

SEQ ID NO: 2135129 - RNA, 19 nt, Staphylococcus aureus subsp. aureus N315
uuugcaacauauuuucaca

SEQ ID NO: 2135130 - RNA, 21 nt, Staphylococcus aureus subsp. aureus N315
uuugcacgggugguuuuuaau

SEQ ID NO: 2135131 - RNA, 21 nt, Staphylococcus aureus subsp. aureus N315
uuugcaauugcaaugaauaac

SEQ ID NO: 2135132 - RNA, 18 nt, Staphylococcus aureus subsp. aureus N315
uuugcaccuauaccucgu

SEQ ID NO: 2135133 - RNA, 18 nt, Staphylococcus aureus subsp. aureus N315
uuugcgguuuuuuugauu

SEQ ID NO: 2135134 - RNA, 20 nt, Staphylococcus aureus subsp. aureus N315
uuugcguuuguguguuuuaa

SEQ ID NO: 2135135 - RNA, 18 nt, Staphylococcus aureus subsp. aureus N315
uuugcuaaccaucauaaa

SEQ ID NO: 2135136 - RNA, 23 nt, Staphylococcus aureus subsp. aureus N315
uuugcauaccuauaaacauaucu

SEQ ID NO: 2135137 - RNA, 21 nt, Staphylococcus aureus subsp. aureus N315
uuugccagucauuguauaaaa

SEQ ID NO: 2135138 - RNA, 19 nt, Staphylococcus aureus subsp. aureus N315
uuucagcgauaacguacaa

SEQ ID NO: 2135139 - RNA, 18 nt, Staphylococcus aureus subsp. aureus N315
uuucagccacugucaugu

SEQ ID NO: 2135140 - RNA, 16 nt, Staphylococcus aureus subsp. aureus N315
uuucagcaguugcaca

SEQ ID NO: 2135141 - RNA, 21 nt, Staphylococcus aureus subsp. aureus N315
uuucagagauucuguuuggug

SEQ ID NO: 2135142 - RNA, 18 nt, Staphylococcus aureus subsp. aureus N315
uuucacuuuaacuucuuu

SEQ ID NO: 2135143 - RNA, 14 nt, Staphylococcus aureus subsp. aureus N315
uuucaguucuuaga

SEQ ID NO: 2135144 - RNA, 15 nt, Staphylococcus aureus subsp. aureus N315
uuucaguuaaaauaa

SEQ ID NO: 2135145 - RNA, 19 nt, Staphylococcus aureus subsp. aureus N315
uuucauaugcaucaacaga

SEQ ID NO: 2135146 - RNA, 23 nt, Staphylococcus aureus subsp. aureus N315
uuucauagaugcauaaaaaccua

SEQ ID NO: 2135147 - RNA, 19 nt, Staphylococcus aureus subsp. aureus N315
uuucauaauuaauaacauc

SEQ ID NO: 2135148 - RNA, 14 nt, Staphylococcus aureus subsp. aureus N315
uuucaguagaugcu

SEQ ID NO: 2135149 - RNA, 19 nt, Staphylococcus aureus subsp. aureus N315
uuucaggcuuuguuuuuca

SEQ ID NO: 2135150 - RNA, 17 nt, Staphylococcus aureus subsp. aureus N315
uuucauuuaauccuucu

SEQ ID NO: 2135151 - RNA, 17 nt, Staphylococcus aureus subsp. aureus N315
uuucauuuacuucuucu

SEQ ID NO: 2135152 - RNA, 13 nt, Staphylococcus aureus subsp. aureus N315
uuucauuuuuuca

SEQ ID NO: 2135153 - RNA, 22 nt, Staphylococcus aureus subsp. aureus N315
uuuccaccggacaauguagaua

SEQ ID NO: 2135154 - RNA, 13 nt, Staphylococcus aureus subsp. aureus N315
uuuccacugcaac

SEQ ID NO: 2135155 - RNA, 22 nt, Staphylococcus aureus subsp. aureus N315
uuucauguuugauucuaaauaa

SEQ ID NO: 2135156 - RNA, 18 nt, Staphylococcus aureus subsp. aureus N315
uuucaucuuucaaaugcu

SEQ ID NO: 2135157 - RNA, 20 nt, Staphylococcus aureus subsp. aureus N315
uuucaugcacuuuaacauaa

SEQ ID NO: 2135158 - RNA, 22 nt, Staphylococcus aureus subsp. aureus N315
uuucauuggauagguaacuaaa

SEQ ID NO: 2135159 - RNA, 20 nt, Staphylococcus aureus subsp. aureus N315
uuucauuguaacucaauaug

SEQ ID NO: 2135160 - RNA, 14 nt, Staphylococcus aureus subsp. aureus N315
uuucauuguaauaa

SEQ ID NO: 2135161 - RNA, 14 nt, Staphylococcus aureus subsp. aureus N315
uuucaucaauauca

SEQ ID NO: 2135162 - RNA, 13 nt, Staphylococcus aureus subsp. aureus N315
uuucaucaauauc

SEQ ID NO: 2135163 - RNA, 17 nt, Staphylococcus aureus subsp. aureus N315
uuuauacuauaaauaca

SEQ ID NO: 2135164 - RNA, 13 nt, Staphylococcus aureus subsp. aureus N315
uuuauacuuaaua

SEQ ID NO: 2135165 - RNA, 18 nt, Staphylococcus aureus subsp. aureus N315
uuuauagaaaccaaaaaa

SEQ ID NO: 2135166 - RNA, 23 nt, Staphylococcus aureus subsp. aureus N315
uuuauauaaaaaagaaauaucua

SEQ ID NO: 2135167 - RNA, 23 nt, Staphylococcus aureus subsp. aureus N315
uuuauuaguuauguuagucuuuu

SEQ ID NO: 2135168 - RNA, 14 nt, Staphylococcus aureus subsp. aureus N315
uuuauuagaaugaa

SEQ ID NO: 2135169 - RNA, 15 nt, Staphylococcus aureus subsp. aureus N315
uuuauaguaauagcu

SEQ ID NO: 2135170 - RNA, 15 nt, Staphylococcus aureus subsp. aureus N315
uuuauucgcuuguuc

SEQ ID NO: 2135171 - RNA, 16 nt, Staphylococcus aureus subsp. aureus N315
uuuauucuaaguuaaa

SEQ ID NO: 2135172 - RNA, 14 nt, Staphylococcus aureus subsp. aureus N315
uuuauuuauucuaa

SEQ ID NO: 2135173 - RNA, 22 nt, Staphylococcus aureus subsp. aureus N315
uuuauuuauaaaauaaaaugca

SEQ ID NO: 2135174 - RNA, 12 nt, Staphylococcus aureus subsp. aureus N315
uuuauuaucagc

SEQ ID NO: 2135175 - RNA, 22 nt, Staphylococcus aureus subsp. aureus N315
uuucaaauaauauaaaacgaua

SEQ ID NO: 2135176 - RNA, 13 nt, Staphylococcus aureus subsp. aureus N315
uuucaaacauauu

SEQ ID NO: 2135177 - RNA, 16 nt, Staphylococcus aureus subsp. aureus N315
uuuauuugucuuugaa

SEQ ID NO: 2135178 - RNA, 23 nt, Staphylococcus aureus subsp. aureus N315
uuucaaauuaauuaaaccaauac

SEQ ID NO: 2135179 - RNA, 15 nt, Staphylococcus aureus subsp. aureus N315
uuucaacauauuaua

SEQ ID NO: 2135180 - RNA, 15 nt, Staphylococcus aureus subsp. aureus N315
uuucaacauaauauu

SEQ ID NO: 2135181 - RNA, 13 nt, Staphylococcus aureus subsp. aureus N315
uuucaacauuacu

SEQ ID NO: 2135182 - RNA, 17 nt, Staphylococcus aureus subsp. aureus N315
uuucaauauuaaaauac

SEQ ID NO: 2135183 - RNA, 16 nt, Staphylococcus aureus subsp. aureus N315
uuucaauccuuuguuu

SEQ ID NO: 2135184 - RNA, 14 nt, Staphylococcus aureus subsp. aureus N315
uuucaauuaaaugu

SEQ ID NO: 2135185 - RNA, 23 nt, Staphylococcus aureus subsp. aureus N315
uuucaagugcuugguuaaaguua

SEQ ID NO: 2135186 - RNA, 15 nt, Staphylococcus aureus subsp. aureus N315
uuucaauaaauuuua

SEQ ID NO: 2135187 - RNA, 23 nt, Staphylococcus aureus subsp. aureus N315
uuucaacuuuugaggagauagua

SEQ ID NO: 2135188 - RNA, 21 nt, Staphylococcus aureus subsp. aureus N315
uuucacgauuuuuaaaaugcu

SEQ ID NO: 2135189 - RNA, 21 nt, Staphylococcus aureus subsp. aureus N315
uuucacgaauaucuuaaagaa

SEQ ID NO: 2135190 - RNA, 21 nt, Staphylococcus aureus subsp. aureus N315
uuucacguagcuuuucauuua

SEQ ID NO: 2135191 - RNA, 17 nt, Staphylococcus aureus subsp. aureus N315
uuucacaaauucuuuua

SEQ ID NO: 2135192 - RNA, 12 nt, Staphylococcus aureus subsp. aureus N315
uuucaauuugga

SEQ ID NO: 2135193 - RNA, 18 nt, Staphylococcus aureus subsp. aureus N315
uuuaaaauuugugcauuc

SEQ ID NO: 2135194 - RNA, 19 nt, Staphylococcus aureus subsp. aureus N315
uuuaaaauuugugcauuca

SEQ ID NO: 2135195 - RNA, 21 nt, Staphylococcus aureus subsp. aureus N315
uuuaaaauaguucuuuaaauu

SEQ ID NO: 2135196 - RNA, 11 nt, Staphylococcus aureus subsp. aureus N315
uuuaaaauacg

SEQ ID NO: 2135197 - RNA, 14 nt, Staphylococcus aureus subsp. aureus N315
uuuaaaauaauaga

SEQ ID NO: 2135198 - RNA, 18 nt, Staphylococcus aureus subsp. aureus N315
uuuaaaaucucauaauaa

SEQ ID NO: 2135199 - RNA, 11 nt, Staphylococcus aureus subsp. aureus N315
uuuaaaaugcu

SEQ ID NO: 2135200 - RNA, 21 nt, Staphylococcus aureus subsp. aureus N315
uuuaaacguacauuuuuauga

SEQ ID NO: 2135201 - RNA, 15 nt, Staphylococcus aureus subsp. aureus N315
uuuaaagaaaaguuu

SEQ ID NO: 2135202 - RNA, 15 nt, Staphylococcus aureus subsp. aureus N315
uuuaaagaaaauuuc

SEQ ID NO: 2135203 - RNA, 18 nt, Staphylococcus aureus subsp. aureus N315
uuuaaagcaucauauaca

SEQ ID NO: 2135204 - RNA, 16 nt, Staphylococcus aureus subsp. aureus N315
uuuaaaggcauaauaa

SEQ ID NO: 2135205 - RNA, 22 nt, Staphylococcus aureus subsp. aureus N315
uuuaaauaaaugacuucacauu

SEQ ID NO: 2135206 - RNA, 15 nt, Staphylococcus aureus subsp. aureus N315
uuuaaauaaaugacu

SEQ ID NO: 2135207 - RNA, 14 nt, Staphylococcus aureus subsp. aureus N315
uuuaaauuuaagaa

SEQ ID NO: 2135208 - RNA, 13 nt, Staphylococcus aureus subsp. aureus N315
uuuaaauuuaaga

SEQ ID NO: 2135209 - RNA, 18 nt, Staphylococcus aureus subsp. aureus N315
uuuaacaaaauuaagaag

SEQ ID NO: 2135210 - RNA, 13 nt, Staphylococcus aureus subsp. aureus N315
uuuaacaaaauua

SEQ ID NO: 2135211 - RNA, 19 nt, Staphylococcus aureus subsp. aureus N315
uuuaacagcgugaauauaa

SEQ ID NO: 2135212 - RNA, 10 nt, Staphylococcus aureus subsp. aureus N315
uuuaacauag

SEQ ID NO: 2135213 - RNA, 14 nt, Staphylococcus aureus subsp. aureus N315
uuuaacauuucuga

SEQ ID NO: 2135214 - RNA, 22 nt, Staphylococcus aureus subsp. aureus N315
uuuaaauaaucgaaaauuucag

SEQ ID NO: 2135215 - RNA, 22 nt, Staphylococcus aureus subsp. aureus N315
uuuaaauuggaaucccaaugcu

SEQ ID NO: 2135216 - RNA, 23 nt, Staphylococcus aureus subsp. aureus N315
uuuaaauugacuuuaauugcucu

SEQ ID NO: 2135217 - RNA, 23 nt, Staphylococcus aureus subsp. aureus N315
uuuaaaugauuucacuucauaaa

SEQ ID NO: 2135218 - RNA, 19 nt, Staphylococcus aureus subsp. aureus N315
uuuaaaugauuucacuuca

SEQ ID NO: 2135219 - RNA, 23 nt, Staphylococcus aureus subsp. aureus N315
uuguuuuuuauaagaacaugaua

SEQ ID NO: 2135220 - RNA, 12 nt, Staphylococcus aureus subsp. aureus N315
uuguuuuuauau

SEQ ID NO: 2135221 - RNA, 18 nt, Staphylococcus aureus subsp. aureus N315
uuuaaaaguaagcaccug

SEQ ID NO: 2135222 - RNA, 22 nt, Staphylococcus aureus subsp. aureus N315
uuuaaaaggcgaaacauuaaaa

SEQ ID NO: 2135223 - RNA, 11 nt, Staphylococcus aureus subsp. aureus N315
uuuaaaaaacu

SEQ ID NO: 2135224 - RNA, 16 nt, Staphylococcus aureus subsp. aureus N315
uuuaaaaaauuuaaau

SEQ ID NO: 2135225 - RNA, 18 nt, Staphylococcus aureus subsp. aureus N315
uuuaaaaaauuuaaauaa

SEQ ID NO: 2135226 - RNA, 21 nt, Staphylococcus aureus subsp. aureus N315
uuguuuagaagcuucugcaug

SEQ ID NO: 2135227 - RNA, 14 nt, Staphylococcus aureus subsp. aureus N315
uuguuucuaaugcu

SEQ ID NO: 2135228 - RNA, 17 nt, Staphylococcus aureus subsp. aureus N315
uuguuuaccuaaaucuu

SEQ ID NO: 2135229 - RNA, 18 nt, Staphylococcus aureus subsp. aureus N315
uugcugccaaaaaguauu

SEQ ID NO: 2135230 - RNA, 14 nt, Staphylococcus aureus subsp. aureus N315
uuguuacauauugc

SEQ ID NO: 2135231 - RNA, 15 nt, Staphylococcus aureus subsp. aureus N315
uuguuauaucuaauu

SEQ ID NO: 2135232 - RNA, 18 nt, Staphylococcus aureus subsp. aureus N315
uuguuauaaguaaauaau

SEQ ID NO: 2135233 - RNA, 16 nt, Staphylococcus aureus subsp. aureus N315
uuguucaacuaaauuu

SEQ ID NO: 2135234 - RNA, 14 nt, Staphylococcus aureus subsp. aureus N315
uuguugguuuugca

SEQ ID NO: 2135235 - RNA, 18 nt, Staphylococcus aureus subsp. aureus N315
uuuaguaucucauuuuuu

SEQ ID NO: 2135236 - RNA, 21 nt, Staphylococcus aureus subsp. aureus N315
uuuaguaucuauacaauuaug

SEQ ID NO: 2135237 - RNA, 21 nt, Staphylococcus aureus subsp. aureus N315
uuuaguauguuuuauuuucuu

SEQ ID NO: 2135238 - RNA, 19 nt, Staphylococcus aureus subsp. aureus N315
uuuaguacauauguuguuu

SEQ ID NO: 2135239 - RNA, 14 nt, Staphylococcus aureus subsp. aureus N315
uuuagugacaaaca

SEQ ID NO: 2135240 - RNA, 20 nt, Staphylococcus aureus subsp. aureus N315
uuuaguccuucuuuacuaaa

SEQ ID NO: 2135241 - RNA, 14 nt, Staphylococcus aureus subsp. aureus N315
uuuaguuaaaguga

SEQ ID NO: 2135242 - RNA, 22 nt, Staphylococcus aureus subsp. aureus N315
uuuaguuagcccuauucaacua

SEQ ID NO: 2135243 - RNA, 18 nt, Staphylococcus aureus subsp. aureus N315
uuuaguuauacuacuauu

SEQ ID NO: 2135244 - RNA, 15 nt, Staphylococcus aureus subsp. aureus N315
uuuaguuaaauagua

SEQ ID NO: 2135245 - RNA, 18 nt, Staphylococcus aureus subsp. aureus N315
uuuauaaacaauaaaaaa

SEQ ID NO: 2135246 - RNA, 19 nt, Staphylococcus aureus subsp. aureus N315
uuuauaaacaauuacaaaa

SEQ ID NO: 2135247 - RNA, 21 nt, Staphylococcus aureus subsp. aureus N315
uuuauaaauuaaaugcaauac

SEQ ID NO: 2135248 - RNA, 15 nt, Staphylococcus aureus subsp. aureus N315
uuuauaaaucaaaga

SEQ ID NO: 2135249 - RNA, 15 nt, Staphylococcus aureus subsp. aureus N315
uuuauaaauuaaaug

SEQ ID NO: 2135250 - RNA, 14 nt, Staphylococcus aureus subsp. aureus N315
uuuauaaaaacuua

SEQ ID NO: 2135251 - RNA, 13 nt, Staphylococcus aureus subsp. aureus N315
uuuauaaaaagag

SEQ ID NO: 2135252 - RNA, 21 nt, Staphylococcus aureus subsp. aureus N315
uuuaguucaaagcgauaaagu

SEQ ID NO: 2135253 - RNA, 21 nt, Staphylococcus aureus subsp. aureus N315
uuuaguucacaugaauuuuaa

SEQ ID NO: 2135254 - RNA, 16 nt, Staphylococcus aureus subsp. aureus N315
uuuacucuacacucaa

SEQ ID NO: 2135255 - RNA, 15 nt, Staphylococcus aureus subsp. aureus N315
uuuacuauuaaagga

SEQ ID NO: 2135256 - RNA, 15 nt, Staphylococcus aureus subsp. aureus N315
uuuacugcuucaauc

SEQ ID NO: 2135257 - RNA, 18 nt, Staphylococcus aureus subsp. aureus N315
uuuacugcuucgacauug

SEQ ID NO: 2135258 - RNA, 17 nt, Staphylococcus aureus subsp. aureus N315
uuuacucaaaccaucuu

SEQ ID NO: 2135259 - RNA, 17 nt, Staphylococcus aureus subsp. aureus N315
uuuagccccagcaaaua

SEQ ID NO: 2135260 - RNA, 23 nt, Staphylococcus aureus subsp. aureus N315
uuuaggacgugccuuaacuucau

SEQ ID NO: 2135261 - RNA, 23 nt, Staphylococcus aureus subsp. aureus N315
uuuaacucuugaaacacaaaaag

SEQ ID NO: 2135262 - RNA, 13 nt, Staphylococcus aureus subsp. aureus N315
uuuaacuaaacca

SEQ ID NO: 2135263 - RNA, 17 nt, Staphylococcus aureus subsp. aureus N315
uuuaauuaauuaucaua

SEQ ID NO: 2135264 - RNA, 14 nt, Staphylococcus aureus subsp. aureus N315
uuuaauuaauuauu

SEQ ID NO: 2135265 - RNA, 23 nt, Staphylococcus aureus subsp. aureus N315
uuuaauuacagguuuaaacaucu

SEQ ID NO: 2135266 - RNA, 17 nt, Staphylococcus aureus subsp. aureus N315
uuuaauuauuuuaaaaa

SEQ ID NO: 2135267 - RNA, 11 nt, Staphylococcus aureus subsp. aureus N315
uuuaauuauuu

SEQ ID NO: 2135268 - RNA, 15 nt, Staphylococcus aureus subsp. aureus N315
uuuaauuauuucccu

SEQ ID NO: 2135269 - RNA, 16 nt, Staphylococcus aureus subsp. aureus N315
uuuaauuaaaauacaa

SEQ ID NO: 2135270 - RNA, 17 nt, Staphylococcus aureus subsp. aureus N315
uuuaauuagaaauucuc

SEQ ID NO: 2135271 - RNA, 16 nt, Staphylococcus aureus subsp. aureus N315
uuuaauugaaauagaa

SEQ ID NO: 2135272 - RNA, 21 nt, Staphylococcus aureus subsp. aureus N315
uuuaauuguuuaauaacaaaa

SEQ ID NO: 2135273 - RNA, 18 nt, Staphylococcus aureus subsp. aureus N315
uuuaauuuacaauuaauu

SEQ ID NO: 2135274 - RNA, 19 nt, Staphylococcus aureus subsp. aureus N315
uuuaauugguucuucuuuc

SEQ ID NO: 2135275 - RNA, 13 nt, Staphylococcus aureus subsp. aureus N315
uuuaauugucuca

SEQ ID NO: 2135276 - RNA, 22 nt, Staphylococcus aureus subsp. aureus N315
uuuaauucugguuuaaugagcu

SEQ ID NO: 2135277 - RNA, 21 nt, Staphylococcus aureus subsp. aureus N315
uuuaauuccaaagaaagcuaa

SEQ ID NO: 2135278 - RNA, 14 nt, Staphylococcus aureus subsp. aureus N315
uuuaauucaucaau

SEQ ID NO: 2135279 - RNA, 15 nt, Staphylococcus aureus subsp. aureus N315
uuuaauuuucagaau

SEQ ID NO: 2135280 - RNA, 17 nt, Staphylococcus aureus subsp. aureus N315
uuuaauuuucuaaauau

SEQ ID NO: 2135281 - RNA, 16 nt, Staphylococcus aureus subsp. aureus N315
uuuaauuuucuaaaua

SEQ ID NO: 2135282 - RNA, 18 nt, Staphylococcus aureus subsp. aureus N315
uuuaauuuucuaaauaua

SEQ ID NO: 2135283 - RNA, 23 nt, Staphylococcus aureus subsp. aureus N315
uuuaauuucugguaaaaaaauaa

SEQ ID NO: 2135284 - RNA, 20 nt, Staphylococcus aureus subsp. aureus N315
uuuaauuugauuaaauucuu

SEQ ID NO: 2135285 - RNA, 14 nt, Staphylococcus aureus subsp. aureus N315
uuuaauuucacuuu

SEQ ID NO: 2135286 - RNA, 22 nt, Staphylococcus aureus subsp. aureus N315
uuuacaaucaucacacauaaau

SEQ ID NO: 2135287 - RNA, 20 nt, Staphylococcus aureus subsp. aureus N315
uuuacaagucuuauuuguuu

SEQ ID NO: 2135288 - RNA, 19 nt, Staphylococcus aureus subsp. aureus N315
uuuaauuuugacauaaaaa

SEQ ID NO: 2135289 - RNA, 17 nt, Staphylococcus aureus subsp. aureus N315
uuuaauuuuucauuaau

SEQ ID NO: 2135290 - RNA, 22 nt, Staphylococcus aureus subsp. aureus N315
uuuacaaauguauaaauaauaa

SEQ ID NO: 2135291 - RNA, 19 nt, Staphylococcus aureus subsp. aureus N315
uuuacaaauguauaaauaa

SEQ ID NO: 2135292 - RNA, 20 nt, Staphylococcus aureus subsp. aureus N315
uuuacaaacuucacaucaug

SEQ ID NO: 2135293 - RNA, 18 nt, Staphylococcus aureus subsp. aureus N315
uuuacgauaaacuaaaaa

SEQ ID NO: 2135294 - RNA, 13 nt, Staphylococcus aureus subsp. aureus N315
uuuacgauaaaua

SEQ ID NO: 2135295 - RNA, 14 nt, Staphylococcus aureus subsp. aureus N315
uuuaccacuuauaa

SEQ ID NO: 2135296 - RNA, 23 nt, Staphylococcus aureus subsp. aureus N315
uugacauaauccagccacaccaa

SEQ ID NO: 2135297 - RNA, 15 nt, Staphylococcus aureus subsp. aureus N315
uugacauauuuuuua

SEQ ID NO: 2135298 - RNA, 14 nt, Staphylococcus aureus subsp. aureus N315
uugacauuuacauc

SEQ ID NO: 2135299 - RNA, 14 nt, Staphylococcus aureus subsp. aureus N315
uugacauuugacca

SEQ ID NO: 2135300 - RNA, 21 nt, Staphylococcus aureus subsp. aureus N315
uugaauuuaauacuauaguaa

SEQ ID NO: 2135301 - RNA, 17 nt, Staphylococcus aureus subsp. aureus N315
uugaauugaaaaauuaa

SEQ ID NO: 2135302 - RNA, 19 nt, Staphylococcus aureus subsp. aureus N315
uugacaaguugcugaauaa

SEQ ID NO: 2135303 - RNA, 13 nt, Staphylococcus aureus subsp. aureus N315
uugacaauacaaa

SEQ ID NO: 2135304 - RNA, 19 nt, Staphylococcus aureus subsp. aureus N315
uugacacacccaaauuuag

SEQ ID NO: 2135305 - RNA, 21 nt, Staphylococcus aureus subsp. aureus N315
uugaccgccuaugauauaugu

SEQ ID NO: 2135306 - RNA, 20 nt, Staphylococcus aureus subsp. aureus N315
uugacuaaguuuguuuucuu

SEQ ID NO: 2135307 - RNA, 14 nt, Staphylococcus aureus subsp. aureus N315
uugacuaaguuugu

SEQ ID NO: 2135308 - RNA, 14 nt, Staphylococcus aureus subsp. aureus N315
uugacguucugauc

SEQ ID NO: 2135309 - RNA, 18 nt, Staphylococcus aureus subsp. aureus N315
uugaaugaaccuuuacuc

SEQ ID NO: 2135310 - RNA, 17 nt, Staphylococcus aureus subsp. aureus N315
uugaaugguauaauucc

SEQ ID NO: 2135311 - RNA, 18 nt, Staphylococcus aureus subsp. aureus N315
uugaaugguauaauuccu

SEQ ID NO: 2135312 - RNA, 11 nt, Staphylococcus aureus subsp. aureus N315
uugaauauuuu

SEQ ID NO: 2135313 - RNA, 16 nt, Staphylococcus aureus subsp. aureus N315
uugaaucaacaguuuu

SEQ ID NO: 2135314 - RNA, 20 nt, Staphylococcus aureus subsp. aureus N315
uugaaucaacaguuuuauua

SEQ ID NO: 2135315 - RNA, 19 nt, Staphylococcus aureus subsp. aureus N315
uugaauacuuuauuugaua

SEQ ID NO: 2135316 - RNA, 22 nt, Staphylococcus aureus subsp. aureus N315
uugaauacuuuuuaacugguug

SEQ ID NO: 2135317 - RNA, 18 nt, Staphylococcus aureus subsp. aureus N315
uugaauauaguccuuccc

SEQ ID NO: 2135318 - RNA, 20 nt, Staphylococcus aureus subsp. aureus N315
uugaauaucacuuuagauaa

SEQ ID NO: 2135319 - RNA, 21 nt, Staphylococcus aureus subsp. aureus N315
uugaauagugagcguauuauu

SEQ ID NO: 2135320 - RNA, 13 nt, Staphylococcus aureus subsp. aureus N315
uugaauauaaaaa

SEQ ID NO: 2135321 - RNA, 14 nt, Staphylococcus aureus subsp. aureus N315
uugaauauaaaaaa

SEQ ID NO: 2135322 - RNA, 15 nt, Staphylococcus aureus subsp. aureus N315
uugaauauaaaaaag

SEQ ID NO: 2135323 - RNA, 19 nt, Staphylococcus aureus subsp. aureus N315
uugaauauuguuguaaaug

SEQ ID NO: 2135324 - RNA, 17 nt, Staphylococcus aureus subsp. aureus N315
uugaauaaauuuuauuc

SEQ ID NO: 2135325 - RNA, 22 nt, Staphylococcus aureus subsp. aureus N315
uugaagugaguuuaucuacauu

SEQ ID NO: 2135326 - RNA, 22 nt, Staphylococcus aureus subsp. aureus N315
uugaagaauguuucauaugcau

SEQ ID NO: 2135327 - RNA, 20 nt, Staphylococcus aureus subsp. aureus N315
uugaagaugcuuuaauuaaa

SEQ ID NO: 2135328 - RNA, 15 nt, Staphylococcus aureus subsp. aureus N315
uugaagggagcauuu

SEQ ID NO: 2135329 - RNA, 20 nt, Staphylococcus aureus subsp. aureus N315
uugaagggagcauuucauua

SEQ ID NO: 2135330 - RNA, 15 nt, Staphylococcus aureus subsp. aureus N315
uugaacgauaacaau

SEQ ID NO: 2135331 - RNA, 13 nt, Staphylococcus aureus subsp. aureus N315
uugaacuucuuuu

SEQ ID NO: 2135332 - RNA, 19 nt, Staphylococcus aureus subsp. aureus N315
uucuugagcuguuacacuu

SEQ ID NO: 2135333 - RNA, 21 nt, Staphylococcus aureus subsp. aureus N315
uucuuuaauauaaauuuugaa

SEQ ID NO: 2135334 - RNA, 22 nt, Staphylococcus aureus subsp. aureus N315
uucuuuaacaauugauugcucu

SEQ ID NO: 2135335 - RNA, 15 nt, Staphylococcus aureus subsp. aureus N315
uucuuuaaauacauc

SEQ ID NO: 2135336 - RNA, 13 nt, Staphylococcus aureus subsp. aureus N315
uucuuuaacaauu

SEQ ID NO: 2135337 - RNA, 12 nt, Staphylococcus aureus subsp. aureus N315
uucuugaauaaa

SEQ ID NO: 2135338 - RNA, 19 nt, Staphylococcus aureus subsp. aureus N315
uucugcaugggcuucugcu

SEQ ID NO: 2135339 - RNA, 20 nt, Staphylococcus aureus subsp. aureus N315
uucuuuauuagaaugaaacc

SEQ ID NO: 2135340 - RNA, 16 nt, Staphylococcus aureus subsp. aureus N315
uucuuuauuagaauga

SEQ ID NO: 2135341 - RNA, 23 nt, Staphylococcus aureus subsp. aureus N315
uucuuuaugauaauaagaauauu

SEQ ID NO: 2135342 - RNA, 14 nt, Staphylococcus aureus subsp. aureus N315
uucuuucaggcuuu

SEQ ID NO: 2135343 - RNA, 12 nt, Staphylococcus aureus subsp. aureus N315
uucuuucauaau

SEQ ID NO: 2135344 - RNA, 12 nt, Staphylococcus aureus subsp. aureus N315
uucuuucauaaa

SEQ ID NO: 2135345 - RNA, 21 nt, Staphylococcus aureus subsp. aureus N315
uucuuuacuucuuucaaaaac

SEQ ID NO: 2135346 - RNA, 20 nt, Staphylococcus aureus subsp. aureus N315
uucuuuauagaaaccaaaaa

SEQ ID NO: 2135347 - RNA, 17 nt, Staphylococcus aureus subsp. aureus N315
uucuuuguguuugcuuu

SEQ ID NO: 2135348 - RNA, 15 nt, Staphylococcus aureus subsp. aureus N315
uucuuugucaucuuu

SEQ ID NO: 2135349 - RNA, 11 nt, Staphylococcus aureus subsp. aureus N315
uucuuucucua

SEQ ID NO: 2135350 - RNA, 23 nt, Staphylococcus aureus subsp. aureus N315
uucuuuucgaaaaucucuguauu

SEQ ID NO: 2135351 - RNA, 13 nt, Staphylococcus aureus subsp. aureus N315
uucuuuuugcuuu

SEQ ID NO: 2135352 - RNA, 15 nt, Staphylococcus aureus subsp. aureus N315
uucuuuuguuuuuau

SEQ ID NO: 2135353 - RNA, 11 nt, Staphylococcus aureus subsp. aureus N315
uucuuuuuaaa

SEQ ID NO: 2135354 - RNA, 11 nt, Staphylococcus aureus subsp. aureus N315
uucuuuuuaac

SEQ ID NO: 2135355 - RNA, 13 nt, Staphylococcus aureus subsp. aureus N315
uucuuuuguaauu

SEQ ID NO: 2135356 - RNA, 14 nt, Staphylococcus aureus subsp. aureus N315
uucuuuuguuuuac

SEQ ID NO: 2135357 - RNA, 19 nt, Staphylococcus aureus subsp. aureus N315
uucuuuuguaauugaaaug

SEQ ID NO: 2135358 - RNA, 19 nt, Staphylococcus aureus subsp. aureus N315
uugaaaaauuaaaaaacaa

SEQ ID NO: 2135359 - RNA, 16 nt, Staphylococcus aureus subsp. aureus N315
uugaaaaauuaaaaaa

SEQ ID NO: 2135360 - RNA, 20 nt, Staphylococcus aureus subsp. aureus N315
uugaaaacaauaaauuucaa

SEQ ID NO: 2135361 - RNA, 16 nt, Staphylococcus aureus subsp. aureus N315
uugaaaaucuaauccu

SEQ ID NO: 2135362 - RNA, 19 nt, Staphylococcus aureus subsp. aureus N315
uugaaaaguaauuaaauac

SEQ ID NO: 2135363 - RNA, 13 nt, Staphylococcus aureus subsp. aureus N315
uugaaaaagacua

SEQ ID NO: 2135364 - RNA, 18 nt, Staphylococcus aureus subsp. aureus N315
uucuuuuuguucggcuuu

SEQ ID NO: 2135365 - RNA, 23 nt, Staphylococcus aureus subsp. aureus N315
uucuuuuuuaauucuauuuuuga

SEQ ID NO: 2135366 - RNA, 22 nt, Staphylococcus aureus subsp. aureus N315
uugaaaggaauguuuaaaaaac

SEQ ID NO: 2135367 - RNA, 20 nt, Staphylococcus aureus subsp. aureus N315
uugaaacugaguucaauuaa

SEQ ID NO: 2135368 - RNA, 23 nt, Staphylococcus aureus subsp. aureus N315
uugaacauauuauaaaaguguaa

SEQ ID NO: 2135369 - RNA, 15 nt, Staphylococcus aureus subsp. aureus N315
uugaaauuaauuauc

SEQ ID NO: 2135370 - RNA, 20 nt, Staphylococcus aureus subsp. aureus N315
uugaaauuauuauuuaaauu

SEQ ID NO: 2135371 - RNA, 19 nt, Staphylococcus aureus subsp. aureus N315
uugaaauuauuauuuaaau

SEQ ID NO: 2135372 - RNA, 17 nt, Staphylococcus aureus subsp. aureus N315
uugaaauuuauuauaau

SEQ ID NO: 2135373 - RNA, 16 nt, Staphylococcus aureus subsp. aureus N315
uugaaauugacaguuu

SEQ ID NO: 2135374 - RNA, 18 nt, Staphylococcus aureus subsp. aureus N315
uugauauauauuuugcaa

SEQ ID NO: 2135375 - RNA, 19 nt, Staphylococcus aureus subsp. aureus N315
uugauaugguuagagaaaa

SEQ ID NO: 2135376 - RNA, 21 nt, Staphylococcus aureus subsp. aureus N315
uugauaugguuagagaaaaau

SEQ ID NO: 2135377 - RNA, 22 nt, Staphylococcus aureus subsp. aureus N315
uugauaugguuagagaaaaauc

SEQ ID NO: 2135378 - RNA, 19 nt, Staphylococcus aureus subsp. aureus N315
uugauaugcucucuucaaa

SEQ ID NO: 2135379 - RNA, 18 nt, Staphylococcus aureus subsp. aureus N315
uugauaugcucucuucaa

SEQ ID NO: 2135380 - RNA, 13 nt, Staphylococcus aureus subsp. aureus N315
uugauauuucauc

SEQ ID NO: 2135381 - RNA, 11 nt, Staphylococcus aureus subsp. aureus N315
uugauauguuu

SEQ ID NO: 2135382 - RNA, 20 nt, Staphylococcus aureus subsp. aureus N315
uugauauguuuccucuuuaa

SEQ ID NO: 2135383 - RNA, 12 nt, Staphylococcus aureus subsp. aureus N315
uugaugaaaaca

SEQ ID NO: 2135384 - RNA, 12 nt, Staphylococcus aureus subsp. aureus N315
uugaugaauaaa

SEQ ID NO: 2135385 - RNA, 24 nt, Staphylococcus aureus subsp. aureus N315
uugauccaaaguacucaaguaauc

SEQ ID NO: 2135386 - RNA, 11 nt, Staphylococcus aureus subsp. aureus N315
uugaucaaccu

SEQ ID NO: 2135387 - RNA, 17 nt, Staphylococcus aureus subsp. aureus N315
uugaucaaaaauguuau

SEQ ID NO: 2135388 - RNA, 17 nt, Staphylococcus aureus subsp. aureus N315
uugacuuuaauugcucu

SEQ ID NO: 2135389 - RNA, 19 nt, Staphylococcus aureus subsp. aureus N315
uugagacaaaaauaaacca

SEQ ID NO: 2135390 - RNA, 14 nt, Staphylococcus aureus subsp. aureus N315
uugagaauauuaag

SEQ ID NO: 2135391 - RNA, 19 nt, Staphylococcus aureus subsp. aureus N315
uugauaaaaaaugaauguu

SEQ ID NO: 2135392 - RNA, 21 nt, Staphylococcus aureus subsp. aureus N315
uugauaaaaaaugaauguuaa

SEQ ID NO: 2135393 - RNA, 16 nt, Staphylococcus aureus subsp. aureus N315
uugauaacaauuuuaa

SEQ ID NO: 2135394 - RNA, 14 nt, Staphylococcus aureus subsp. aureus N315
uugauaaaauaaau

SEQ ID NO: 2135395 - RNA, 17 nt, Staphylococcus aureus subsp. aureus N315
uugauaaauauugaaca

SEQ ID NO: 2135396 - RNA, 22 nt, Staphylococcus aureus subsp. aureus N315
uugagcaauucuugaaaaguuu

SEQ ID NO: 2135397 - RNA, 15 nt, Staphylococcus aureus subsp. aureus N315
uugagcaaugucuuu

SEQ ID NO: 2135398 - RNA, 16 nt, Staphylococcus aureus subsp. aureus N315
uugcaauugcaaugaa

SEQ ID NO: 2135399 - RNA, 13 nt, Staphylococcus aureus subsp. aureus N315
uugcaaguauuuu

SEQ ID NO: 2135400 - RNA, 13 nt, Staphylococcus aureus subsp. aureus N315
uugcaauaaaauu

SEQ ID NO: 2135401 - RNA, 22 nt, Staphylococcus aureus subsp. aureus N315
uugcaauaaaauuagccuaauu

SEQ ID NO: 2135402 - RNA, 18 nt, Staphylococcus aureus subsp. aureus N315
uugcaauaauucaucuug

SEQ ID NO: 2135403 - RNA, 16 nt, Staphylococcus aureus subsp. aureus N315
uugcaaucguauguaa

SEQ ID NO: 2135404 - RNA, 21 nt, Staphylococcus aureus subsp. aureus N315
uugcaaauauaucaucucuau

SEQ ID NO: 2135405 - RNA, 15 nt, Staphylococcus aureus subsp. aureus N315
uugcaaauuaucauu

SEQ ID NO: 2135406 - RNA, 16 nt, Staphylococcus aureus subsp. aureus N315
uugauucuacuucacc

SEQ ID NO: 2135407 - RNA, 18 nt, Staphylococcus aureus subsp. aureus N315
uugauucuagugaaauac

SEQ ID NO: 2135408 - RNA, 13 nt, Staphylococcus aureus subsp. aureus N315
uugauucuaaaua

SEQ ID NO: 2135409 - RNA, 14 nt, Staphylococcus aureus subsp. aureus N315
uugcaaaauacgau

SEQ ID NO: 2135410 - RNA, 14 nt, Staphylococcus aureus subsp. aureus N315
uugcaaaaaaacaa

SEQ ID NO: 2135411 - RNA, 20 nt, Staphylococcus aureus subsp. aureus N315
uugcaaaaaaacaaauauua

SEQ ID NO: 2135412 - RNA, 14 nt, Staphylococcus aureus subsp. aureus N315
uugauucuuauaug

SEQ ID NO: 2135413 - RNA, 17 nt, Staphylococcus aureus subsp. aureus N315
uugauuguauuuuucaa

SEQ ID NO: 2135414 - RNA, 18 nt, Staphylococcus aureus subsp. aureus N315
uugauuuugaauaaaaaa

SEQ ID NO: 2135415 - RNA, 17 nt, Staphylococcus aureus subsp. aureus N315
uugcacuaugcauaaua

SEQ ID NO: 2135416 - RNA, 22 nt, Staphylococcus aureus subsp. aureus N315
uugcacgggugguuuuuaauuu

SEQ ID NO: 2135417 - RNA, 22 nt, Staphylococcus aureus subsp. aureus N315
uugcacgucuuguaucaacauu

SEQ ID NO: 2135418 - RNA, 15 nt, Staphylococcus aureus subsp. aureus N315
uugcucuuuaacaau

SEQ ID NO: 2135419 - RNA, 14 nt, Staphylococcus aureus subsp. aureus N315
uugcugaauaaaau

SEQ ID NO: 2135420 - RNA, 19 nt, Staphylococcus aureus subsp. aureus N315
uugcucgcgcucuucuuca

SEQ ID NO: 2135421 - RNA, 20 nt, Staphylococcus aureus subsp. aureus N315
uugcguuuaauaacauugaa

SEQ ID NO: 2135422 - RNA, 23 nt, Staphylococcus aureus subsp. aureus N315
uugcguuuguguguuuuaaaauu

SEQ ID NO: 2135423 - RNA, 12 nt, Staphylococcus aureus subsp. aureus N315
uugcuaaaauau

SEQ ID NO: 2135424 - RNA, 21 nt, Staphylococcus aureus subsp. aureus N315
uugcuaaaauaucaaaauaua

SEQ ID NO: 2135425 - RNA, 22 nt, Staphylococcus aureus subsp. aureus N315
uugcuaaacgcuaaaauuuccu

SEQ ID NO: 2135426 - RNA, 20 nt, Staphylococcus aureus subsp. aureus N315
uugcuaaaguguagccaaau

SEQ ID NO: 2135427 - RNA, 22 nt, Staphylococcus aureus subsp. aureus N315
uugcucaccuuuagacaauauu

SEQ ID NO: 2135428 - RNA, 18 nt, Staphylococcus aureus subsp. aureus N315
uugccuguagaauuucuu

SEQ ID NO: 2135429 - RNA, 21 nt, Staphylococcus aureus subsp. aureus N315
uugccuggcaacguucuacuc

SEQ ID NO: 2135430 - RNA, 12 nt, Staphylococcus aureus subsp. aureus N315
uucccacuuauc

SEQ ID NO: 2135431 - RNA, 22 nt, Staphylococcus aureus subsp. aureus N315
uucccaucuuuuagguaauaau

SEQ ID NO: 2135432 - RNA, 22 nt, Staphylococcus aureus subsp. aureus N315
uucccagucaugucccauaaca

SEQ ID NO: 2135433 - RNA, 11 nt, Staphylococcus aureus subsp. aureus N315
uuccauuuuuu

SEQ ID NO: 2135434 - RNA, 21 nt, Staphylococcus aureus subsp. aureus N315
uuccugauauuucaacuuuuu

SEQ ID NO: 2135435 - RNA, 15 nt, Staphylococcus aureus subsp. aureus N315
uuccugcuacaacuu

SEQ ID NO: 2135436 - RNA, 19 nt, Staphylococcus aureus subsp. aureus N315
uuccuaauggucgugcuug

SEQ ID NO: 2135437 - RNA, 18 nt, Staphylococcus aureus subsp. aureus N315
uuccuaccccgugaaucu

SEQ ID NO: 2135438 - RNA, 23 nt, Staphylococcus aureus subsp. aureus N315
uuccuacacuguuuuauaaauga

SEQ ID NO: 2135439 - RNA, 16 nt, Staphylococcus aureus subsp. aureus N315
uuccuauuaggaucca

SEQ ID NO: 2135440 - RNA, 19 nt, Staphylococcus aureus subsp. aureus N315
uuccacuucaucuaaauga

SEQ ID NO: 2135441 - RNA, 15 nt, Staphylococcus aureus subsp. aureus N315
uuccaccagccucug

SEQ ID NO: 2135442 - RNA, 16 nt, Staphylococcus aureus subsp. aureus N315
uuccaauuuaaaauga

SEQ ID NO: 2135443 - RNA, 19 nt, Staphylococcus aureus subsp. aureus N315
uuccauaaauaaaaugcua

SEQ ID NO: 2135444 - RNA, 14 nt, Staphylococcus aureus subsp. aureus N315
uuccauaaauauuu

SEQ ID NO: 2135445 - RNA, 17 nt, Staphylococcus aureus subsp. aureus N315
uuccauaaauaaaaugc

SEQ ID NO: 2135446 - RNA, 18 nt, Staphylococcus aureus subsp. aureus N315
uuccaugaguuuacuaaa

SEQ ID NO: 2135447 - RNA, 12 nt, Staphylococcus aureus subsp. aureus N315
uuccaucuuaaa

SEQ ID NO: 2135448 - RNA, 15 nt, Staphylococcus aureus subsp. aureus N315
uuccauucauaaaag

SEQ ID NO: 2135449 - RNA, 22 nt, Staphylococcus aureus subsp. aureus N315
uuccauuucgauaccuaaaaua

SEQ ID NO: 2135450 - RNA, 18 nt, Staphylococcus aureus subsp. aureus N315
uuccauauuuuuuaguaa

SEQ ID NO: 2135451 - RNA, 16 nt, Staphylococcus aureus subsp. aureus N315
uucgcagcuuuauaau

SEQ ID NO: 2135452 - RNA, 14 nt, Staphylococcus aureus subsp. aureus N315
uucgcauacuuuuu

SEQ ID NO: 2135453 - RNA, 15 nt, Staphylococcus aureus subsp. aureus N315
uucgaaaagaaauuc

SEQ ID NO: 2135454 - RNA, 17 nt, Staphylococcus aureus subsp. aureus N315
uucgaaaagaaauucua

SEQ ID NO: 2135455 - RNA, 13 nt, Staphylococcus aureus subsp. aureus N315
uucgaaaucaaau

SEQ ID NO: 2135456 - RNA, 19 nt, Staphylococcus aureus subsp. aureus N315
uuccuuuagcaaaaauauu

SEQ ID NO: 2135457 - RNA, 15 nt, Staphylococcus aureus subsp. aureus N315
uuccuuguuggucug

SEQ ID NO: 2135458 - RNA, 22 nt, Staphylococcus aureus subsp. aureus N315
uuccuuguuuuaaacuuauuaa

SEQ ID NO: 2135459 - RNA, 19 nt, Staphylococcus aureus subsp. aureus N315
uucgcugcuacaccaccug

SEQ ID NO: 2135460 - RNA, 23 nt, Staphylococcus aureus subsp. aureus N315
uucgcuaauaauacgucguaaug

SEQ ID NO: 2135461 - RNA, 17 nt, Staphylococcus aureus subsp. aureus N315
uucgcaucguucccugc

SEQ ID NO: 2135462 - RNA, 17 nt, Staphylococcus aureus subsp. aureus N315
uucgcaucacugcauau

SEQ ID NO: 2135463 - RNA, 14 nt, Staphylococcus aureus subsp. aureus N315
uucgccuaaauggu

SEQ ID NO: 2135464 - RNA, 22 nt, Staphylococcus aureus subsp. aureus N315
uucuaaauuauuuauucauuau

SEQ ID NO: 2135465 - RNA, 22 nt, Staphylococcus aureus subsp. aureus N315
uucuaacggcguuuguuucuua

SEQ ID NO: 2135466 - RNA, 22 nt, Staphylococcus aureus subsp. aureus N315
uucuaacuugaacagauucacc

SEQ ID NO: 2135467 - RNA, 13 nt, Staphylococcus aureus subsp. aureus N315
uucuaaaucuugu

SEQ ID NO: 2135468 - RNA, 16 nt, Staphylococcus aureus subsp. aureus N315
uucuaaaucaauauaa

SEQ ID NO: 2135469 - RNA, 15 nt, Staphylococcus aureus subsp. aureus N315
uucguucuaaaagga

SEQ ID NO: 2135470 - RNA, 15 nt, Staphylococcus aureus subsp. aureus N315
uucguauguuucuuu

SEQ ID NO: 2135471 - RNA, 20 nt, Staphylococcus aureus subsp. aureus N315
uucguauguuucuuuauuau

SEQ ID NO: 2135472 - RNA, 21 nt, Staphylococcus aureus subsp. aureus N315
uucgugauuacauucuauacu

SEQ ID NO: 2135473 - RNA, 21 nt, Staphylococcus aureus subsp. aureus N315
uucguuauagacuaacuguac

SEQ ID NO: 2135474 - RNA, 17 nt, Staphylococcus aureus subsp. aureus N315
uucguaacauuuaaaaa

SEQ ID NO: 2135475 - RNA, 13 nt, Staphylococcus aureus subsp. aureus N315
uucguaauaaaca

SEQ ID NO: 2135476 - RNA, 14 nt, Staphylococcus aureus subsp. aureus N315
uucguaauaaacau

SEQ ID NO: 2135477 - RNA, 17 nt, Staphylococcus aureus subsp. aureus N315
uucguaauguguuaaua

SEQ ID NO: 2135478 - RNA, 19 nt, Staphylococcus aureus subsp. aureus N315
uucggaauuugcacaaaga

SEQ ID NO: 2135479 - RNA, 15 nt, Staphylococcus aureus subsp. aureus N315
uucucugcuucuaaa

SEQ ID NO: 2135480 - RNA, 19 nt, Staphylococcus aureus subsp. aureus N315
uucucuguagauaucaaag

SEQ ID NO: 2135481 - RNA, 13 nt, Staphylococcus aureus subsp. aureus N315
uucucuuaaauau

SEQ ID NO: 2135482 - RNA, 16 nt, Staphylococcus aureus subsp. aureus N315
uucugauucuucacua

SEQ ID NO: 2135483 - RNA, 12 nt, Staphylococcus aureus subsp. aureus N315
uucucguguaaa

SEQ ID NO: 2135484 - RNA, 23 nt, Staphylococcus aureus subsp. aureus N315
uucucuauugauuguaccaguaa

SEQ ID NO: 2135485 - RNA, 20 nt, Staphylococcus aureus subsp. aureus N315
uucucuaucaguaugaaguu

SEQ ID NO: 2135486 - RNA, 16 nt, Staphylococcus aureus subsp. aureus N315
uucucaauuaauuuag

SEQ ID NO: 2135487 - RNA, 18 nt, Staphylococcus aureus subsp. aureus N315
uucuacaggcaaugcaag

SEQ ID NO: 2135488 - RNA, 19 nt, Staphylococcus aureus subsp. aureus N315
uucuacaggcaaugcaagu

SEQ ID NO: 2135489 - RNA, 21 nt, Staphylococcus aureus subsp. aureus N315
uucuacaggcaaugcaaguug

SEQ ID NO: 2135490 - RNA, 16 nt, Staphylococcus aureus subsp. aureus N315
uucuaccaauaauucc

SEQ ID NO: 2135491 - RNA, 21 nt, Staphylococcus aureus subsp. aureus N315
uucuacagguaaugcaaguug

SEQ ID NO: 2135492 - RNA, 20 nt, Staphylococcus aureus subsp. aureus N315
uucuacagguaaugcaaguu

SEQ ID NO: 2135493 - RNA, 19 nt, Staphylococcus aureus subsp. aureus N315
uucuacagguaaugcaagu

SEQ ID NO: 2135494 - RNA, 17 nt, Staphylococcus aureus subsp. aureus N315
uucuacagguaaugcaa

SEQ ID NO: 2135495 - RNA, 17 nt, Staphylococcus aureus subsp. aureus N315
uucuaaguguugaccau

SEQ ID NO: 2135496 - RNA, 16 nt, Staphylococcus aureus subsp. aureus N315
uucuaaguguuuuaua

SEQ ID NO: 2135497 - RNA, 20 nt, Staphylococcus aureus subsp. aureus N315
uucuaaguuugcguuuuaau

SEQ ID NO: 2135498 - RNA, 19 nt, Staphylococcus aureus subsp. aureus N315
uucuaagucucuugucauu

SEQ ID NO: 2135499 - RNA, 13 nt, Staphylococcus aureus subsp. aureus N315
uucuaauuugcaa

SEQ ID NO: 2135500 - RNA, 13 nt, Staphylococcus aureus subsp. aureus N315
uucuaauuguuuu

SEQ ID NO: 2135501 - RNA, 16 nt, Staphylococcus aureus subsp. aureus N315
uucuaaugcuaauuua

SEQ ID NO: 2135502 - RNA, 20 nt, Staphylococcus aureus subsp. aureus N315
uucuaauugaaaucaucuua

SEQ ID NO: 2135503 - RNA, 17 nt, Staphylococcus aureus subsp. aureus N315
uucuauaaauagaauuu

SEQ ID NO: 2135504 - RNA, 17 nt, Staphylococcus aureus subsp. aureus N315
uucuauggcacaaauga

SEQ ID NO: 2135505 - RNA, 16 nt, Staphylococcus aureus subsp. aureus N315
uucuauacuuuuaauu

SEQ ID NO: 2135506 - RNA, 13 nt, Staphylococcus aureus subsp. aureus N315
uucuauuaauaau

SEQ ID NO: 2135507 - RNA, 19 nt, Staphylococcus aureus subsp. aureus N315
uucuauuaagaaauacuca

SEQ ID NO: 2135508 - RNA, 16 nt, Staphylococcus aureus subsp. aureus N315
uuaucagcuuuaauaa

SEQ ID NO: 2135509 - RNA, 20 nt, Staphylococcus aureus subsp. aureus N315
uuaucacgugcuucguuuuu

SEQ ID NO: 2135510 - RNA, 13 nt, Staphylococcus aureus subsp. aureus N315
uuaucauuauucg

SEQ ID NO: 2135511 - RNA, 14 nt, Staphylococcus aureus subsp. aureus N315
uuaucauuaaauug

SEQ ID NO: 2135512 - RNA, 20 nt, Staphylococcus aureus subsp. aureus N315
uuaucauuuuuaauuuugac

SEQ ID NO: 2135513 - RNA, 21 nt, Staphylococcus aureus subsp. aureus N315
uuauccaaggauguuauaaaa

SEQ ID NO: 2135514 - RNA, 18 nt, Staphylococcus aureus subsp. aureus N315
uuauccaaaacauuuugu

SEQ ID NO: 2135515 - RNA, 22 nt, Staphylococcus aureus subsp. aureus N315
uuaucgacuuugucauuuugau

SEQ ID NO: 2135516 - RNA, 15 nt, Staphylococcus aureus subsp. aureus N315
uuaucgaagaaacau

SEQ ID NO: 2135517 - RNA, 14 nt, Staphylococcus aureus subsp. aureus N315
uuaucaaauugacc

SEQ ID NO: 2135518 - RNA, 15 nt, Staphylococcus aureus subsp. aureus N315
uuaucaacaaauuua

SEQ ID NO: 2135519 - RNA, 14 nt, Staphylococcus aureus subsp. aureus N315
uuauauuguauuuu

SEQ ID NO: 2135520 - RNA, 18 nt, Staphylococcus aureus subsp. aureus N315
uuauauuuuauuuaaaaa

SEQ ID NO: 2135521 - RNA, 15 nt, Staphylococcus aureus subsp. aureus N315
uuauauuuucucaua

SEQ ID NO: 2135522 - RNA, 13 nt, Staphylococcus aureus subsp. aureus N315
uuauauuuuauuu

SEQ ID NO: 2135523 - RNA, 14 nt, Staphylococcus aureus subsp. aureus N315
uuauaugcaacuua

SEQ ID NO: 2135524 - RNA, 23 nt, Staphylococcus aureus subsp. aureus N315
uuauaugcuguuggcaaaacaau

SEQ ID NO: 2135525 - RNA, 12 nt, Staphylococcus aureus subsp. aureus N315
uuauauguuaua

SEQ ID NO: 2135526 - RNA, 15 nt, Staphylococcus aureus subsp. aureus N315
uuauauguuauauua

SEQ ID NO: 2135527 - RNA, 20 nt, Staphylococcus aureus subsp. aureus N315
uuauaugaagcguuuuuauu

SEQ ID NO: 2135528 - RNA, 21 nt, Staphylococcus aureus subsp. aureus N315
uuauaucauucuguguaaaua

SEQ ID NO: 2135529 - RNA, 16 nt, Staphylococcus aureus subsp. aureus N315
uuauauugcaaaaaua

SEQ ID NO: 2135530 - RNA, 22 nt, Staphylococcus aureus subsp. aureus N315
uuauauugcaaaaauaauauga

SEQ ID NO: 2135531 - RNA, 18 nt, Staphylococcus aureus subsp. aureus N315
uuauauugcgaaaaauaa

SEQ ID NO: 2135532 - RNA, 19 nt, Staphylococcus aureus subsp. aureus N315
uuauauucaacuuauuauu

SEQ ID NO: 2135533 - RNA, 14 nt, Staphylococcus aureus subsp. aureus N315
uuauauaucacaua

SEQ ID NO: 2135534 - RNA, 16 nt, Staphylococcus aureus subsp. aureus N315
uuauauauucaauaau

SEQ ID NO: 2135535 - RNA, 17 nt, Staphylococcus aureus subsp. aureus N315
uuauauauauuaaagua

SEQ ID NO: 2135536 - RNA, 13 nt, Staphylococcus aureus subsp. aureus N315
uuauauagaaaac

SEQ ID NO: 2135537 - RNA, 17 nt, Staphylococcus aureus subsp. aureus N315
uuauauagacaguaguu

SEQ ID NO: 2135538 - RNA, 23 nt, Staphylococcus aureus subsp. aureus N315
uuauauaagugaccgauugcacg

SEQ ID NO: 2135539 - RNA, 19 nt, Staphylococcus aureus subsp. aureus N315
uuauauacuaguucaacuc

SEQ ID NO: 2135540 - RNA, 17 nt, Staphylococcus aureus subsp. aureus N315
uuauauaauucuucaaa

SEQ ID NO: 2135541 - RNA, 14 nt, Staphylococcus aureus subsp. aureus N315
uuauauaaaauuuc

SEQ ID NO: 2135542 - RNA, 23 nt, Staphylococcus aureus subsp. aureus N315
uuauauaaaauuucauauuguuu

SEQ ID NO: 2135543 - RNA, 15 nt, Staphylococcus aureus subsp. aureus N315
uuauauaaauaggca

SEQ ID NO: 2135544 - RNA, 22 nt, Staphylococcus aureus subsp. aureus N315
uuauauaacacgauaauuauac

SEQ ID NO: 2135545 - RNA, 21 nt, Staphylococcus aureus subsp. aureus N315
uuauagaugacuguagaaaac

SEQ ID NO: 2135546 - RNA, 17 nt, Staphylococcus aureus subsp. aureus N315
uuauagcauuucuuuau

SEQ ID NO: 2135547 - RNA, 14 nt, Staphylococcus aureus subsp. aureus N315
uuauauaaaaagaa

SEQ ID NO: 2135548 - RNA, 15 nt, Staphylococcus aureus subsp. aureus N315
uuauagugguaaaaa

SEQ ID NO: 2135549 - RNA, 22 nt, Staphylococcus aureus subsp. aureus N315
uuauagugguaaaaaguuuaaa

SEQ ID NO: 2135550 - RNA, 16 nt, Staphylococcus aureus subsp. aureus N315
uuauagguauaagaau

SEQ ID NO: 2135551 - RNA, 17 nt, Staphylococcus aureus subsp. aureus N315
uuauagucuuaaacaua

SEQ ID NO: 2135552 - RNA, 19 nt, Staphylococcus aureus subsp. aureus N315
uuaugacuaacauugguac

SEQ ID NO: 2135553 - RNA, 21 nt, Staphylococcus aureus subsp. aureus N315
uuaugauauacgagcuuugcu

SEQ ID NO: 2135554 - RNA, 14 nt, Staphylococcus aureus subsp. aureus N315
uuaugauuauauuu

SEQ ID NO: 2135555 - RNA, 19 nt, Staphylococcus aureus subsp. aureus N315
uuaugauugcuuauuuauu

SEQ ID NO: 2135556 - RNA, 15 nt, Staphylococcus aureus subsp. aureus N315
uuaugaauugaguau

SEQ ID NO: 2135557 - RNA, 19 nt, Staphylococcus aureus subsp. aureus N315
uuaucuguagaaacacuuu

SEQ ID NO: 2135558 - RNA, 16 nt, Staphylococcus aureus subsp. aureus N315
uuaucugcaaaaugca

SEQ ID NO: 2135559 - RNA, 15 nt, Staphylococcus aureus subsp. aureus N315
uuaucuaaacauuuu

SEQ ID NO: 2135560 - RNA, 17 nt, Staphylococcus aureus subsp. aureus N315
uuaucguaaaaaaacgu

SEQ ID NO: 2135561 - RNA, 16 nt, Staphylococcus aureus subsp. aureus N315
uuaucugaaaauauca

SEQ ID NO: 2135562 - RNA, 17 nt, Staphylococcus aureus subsp. aureus N315
uuaucuauauaugaaga

SEQ ID NO: 2135563 - RNA, 19 nt, Staphylococcus aureus subsp. aureus N315
uuaucuagacucaaggaaa

SEQ ID NO: 2135564 - RNA, 20 nt, Staphylococcus aureus subsp. aureus N315
uuaucuaaagcuauaaaaaa

SEQ ID NO: 2135565 - RNA, 15 nt, Staphylococcus aureus subsp. aureus N315
uuaucuaaagcuaua

SEQ ID NO: 2135566 - RNA, 22 nt, Staphylococcus aureus subsp. aureus N315
uuauuacaaacauuccucuauu

SEQ ID NO: 2135567 - RNA, 21 nt, Staphylococcus aureus subsp. aureus N315
uuauuacaaugaaaaaacgag

SEQ ID NO: 2135568 - RNA, 18 nt, Staphylococcus aureus subsp. aureus N315
uuauuacauaauuuaucu

SEQ ID NO: 2135569 - RNA, 21 nt, Staphylococcus aureus subsp. aureus N315
uuauuaccauaacuuuauaua

SEQ ID NO: 2135570 - RNA, 12 nt, Staphylococcus aureus subsp. aureus N315
uuauuaacugua

SEQ ID NO: 2135571 - RNA, 23 nt, Staphylococcus aureus subsp. aureus N315
uuauuaauaaauucucuuggaua

SEQ ID NO: 2135572 - RNA, 22 nt, Staphylococcus aureus subsp. aureus N315
uuauuaaggggguaauacuaua

SEQ ID NO: 2135573 - RNA, 12 nt, Staphylococcus aureus subsp. aureus N315
uuauuaacuuua

SEQ ID NO: 2135574 - RNA, 20 nt, Staphylococcus aureus subsp. aureus N315
uuauuaaaucuuuuacuaaa

SEQ ID NO: 2135575 - RNA, 23 nt, Staphylococcus aureus subsp. aureus N315
uuauuaaacacgcgguaaaacga

SEQ ID NO: 2135576 - RNA, 17 nt, Staphylococcus aureus subsp. aureus N315
uuauuaaaauuaaauaa

SEQ ID NO: 2135577 - RNA, 18 nt, Staphylococcus aureus subsp. aureus N315
uuaugugcuaaucuauuu

SEQ ID NO: 2135578 - RNA, 12 nt, Staphylococcus aureus subsp. aureus N315
uuaugugcauca

SEQ ID NO: 2135579 - RNA, 17 nt, Staphylococcus aureus subsp. aureus N315
uuaugcccgauaauucu

SEQ ID NO: 2135580 - RNA, 23 nt, Staphylococcus aureus subsp. aureus N315
uuaugccaacacguuuuaagcca

SEQ ID NO: 2135581 - RNA, 19 nt, Staphylococcus aureus subsp. aureus N315
uuaugguauuuacccaaca

SEQ ID NO: 2135582 - RNA, 22 nt, Staphylococcus aureus subsp. aureus N315
uuauggcagauccauaaggauu

SEQ ID NO: 2135583 - RNA, 14 nt, Staphylococcus aureus subsp. aureus N315
uuauguaaaaaaua

SEQ ID NO: 2135584 - RNA, 18 nt, Staphylococcus aureus subsp. aureus N315
uuauguagauuuuaauau

SEQ ID NO: 2135585 - RNA, 23 nt, Staphylococcus aureus subsp. aureus N315
uuauguauuuuuauuuauacuaa

SEQ ID NO: 2135586 - RNA, 20 nt, Staphylococcus aureus subsp. aureus N315
uuauguaucuauacaacagu

SEQ ID NO: 2135587 - RNA, 15 nt, Staphylococcus aureus subsp. aureus N315
uuaugucccaaugcu

SEQ ID NO: 2135588 - RNA, 12 nt, Staphylococcus aureus subsp. aureus N315
uuauguauuuau

SEQ ID NO: 2135589 - RNA, 21 nt, Staphylococcus aureus subsp. aureus N315
uucaggaauaucuuucaaauu

SEQ ID NO: 2135590 - RNA, 19 nt, Staphylococcus aureus subsp. aureus N315
uucagcuucuaaguaauau

SEQ ID NO: 2135591 - RNA, 16 nt, Staphylococcus aureus subsp. aureus N315
uucacuaaaaauauau

SEQ ID NO: 2135592 - RNA, 21 nt, Staphylococcus aureus subsp. aureus N315
uucacuaaauucaauaaucuu

SEQ ID NO: 2135593 - RNA, 23 nt, Staphylococcus aureus subsp. aureus N315
uucacuaauauuucuuagauacu

SEQ ID NO: 2135594 - RNA, 13 nt, Staphylococcus aureus subsp. aureus N315
uucacuaauauuu

SEQ ID NO: 2135595 - RNA, 17 nt, Staphylococcus aureus subsp. aureus N315
uucacuaauauuucuua

SEQ ID NO: 2135596 - RNA, 22 nt, Staphylococcus aureus subsp. aureus N315
uucagcaccagaacaauucaau

SEQ ID NO: 2135597 - RNA, 14 nt, Staphylococcus aureus subsp. aureus N315
uucaccguaaucuu

SEQ ID NO: 2135598 - RNA, 18 nt, Staphylococcus aureus subsp. aureus N315
uucaccguaaucuuuuaa

SEQ ID NO: 2135599 - RNA, 24 nt, Staphylococcus aureus subsp. aureus N315
uucacgauuucuuuaugauaauaa

SEQ ID NO: 2135600 - RNA, 13 nt, Staphylococcus aureus subsp. aureus N315
uucaccuaaucuu

SEQ ID NO: 2135601 - RNA, 23 nt, Staphylococcus aureus subsp. aureus N315
uucaauacuucuuguucgauaau

SEQ ID NO: 2135602 - RNA, 20 nt, Staphylococcus aureus subsp. aureus N315
uucaauauucuuaucauuca

SEQ ID NO: 2135603 - RNA, 15 nt, Staphylococcus aureus subsp. aureus N315
uucaauauuaaaaua

SEQ ID NO: 2135604 - RNA, 21 nt, Staphylococcus aureus subsp. aureus N315
uucaauauuacuuuaucucau

SEQ ID NO: 2135605 - RNA, 12 nt, Staphylococcus aureus subsp. aureus N315
uucaauccuuug

SEQ ID NO: 2135606 - RNA, 12 nt, Staphylococcus aureus subsp. aureus N315
uucaaucauuca

SEQ ID NO: 2135607 - RNA, 22 nt, Staphylococcus aureus subsp. aureus N315
uucaauccaagcaaucuuagua

SEQ ID NO: 2135608 - RNA, 24 nt, Staphylococcus aureus subsp. aureus N315
uucaaucauucacuucaaguuaug

SEQ ID NO: 2135609 - RNA, 15 nt, Staphylococcus aureus subsp. aureus N315
uuauuuaaaaauagc

SEQ ID NO: 2135610 - RNA, 13 nt, Staphylococcus aureus subsp. aureus N315
uuauuuaaaacuu

SEQ ID NO: 2135611 - RNA, 22 nt, Staphylococcus aureus subsp. aureus N315
uuauuuaaaacuuguaaauuua

SEQ ID NO: 2135612 - RNA, 16 nt, Staphylococcus aureus subsp. aureus N315
uuauuuaaaacuugua

SEQ ID NO: 2135613 - RNA, 20 nt, Staphylococcus aureus subsp. aureus N315
uuauugaaaagauaaacaag

SEQ ID NO: 2135614 - RNA, 13 nt, Staphylococcus aureus subsp. aureus N315
uuauugaaacuaa

SEQ ID NO: 2135615 - RNA, 12 nt, Staphylococcus aureus subsp. aureus N315
uuauucuuucuc

SEQ ID NO: 2135616 - RNA, 23 nt, Staphylococcus aureus subsp. aureus N315
uuauugaauuugaauaagugguu

SEQ ID NO: 2135617 - RNA, 20 nt, Staphylococcus aureus subsp. aureus N315
uuauugaguaucaugcuuuu

SEQ ID NO: 2135618 - RNA, 22 nt, Staphylococcus aureus subsp. aureus N315
uuauugagaauauuuauuguuu

SEQ ID NO: 2135619 - RNA, 12 nt, Staphylococcus aureus subsp. aureus N315
uuauuauacaua

SEQ ID NO: 2135620 - RNA, 22 nt, Staphylococcus aureus subsp. aureus N315
uuauucuucacuuucaguagau

SEQ ID NO: 2135621 - RNA, 22 nt, Staphylococcus aureus subsp. aureus N315
uuauucuuuauauuugugaaug

SEQ ID NO: 2135622 - RNA, 17 nt, Staphylococcus aureus subsp. aureus N315
uuauuaggauucaauaa

SEQ ID NO: 2135623 - RNA, 23 nt, Staphylococcus aureus subsp. aureus N315
uuauuaggggagauuagagaaga

SEQ ID NO: 2135624 - RNA, 15 nt, Staphylococcus aureus subsp. aureus N315
uuauuaguauucaaa

SEQ ID NO: 2135625 - RNA, 21 nt, Staphylococcus aureus subsp. aureus N315
uuauuaguauucaaaaaauau

SEQ ID NO: 2135626 - RNA, 14 nt, Staphylococcus aureus subsp. aureus N315
uuauuauaaaauaa

SEQ ID NO: 2135627 - RNA, 12 nt, Staphylococcus aureus subsp. aureus N315
uuauuauaaaau

SEQ ID NO: 2135628 - RNA, 17 nt, Staphylococcus aureus subsp. aureus N315
uuauuagauacuucuuu

SEQ ID NO: 2135629 - RNA, 15 nt, Staphylococcus aureus subsp. aureus N315
uuauuagaaugaaac

SEQ ID NO: 2135630 - RNA, 17 nt, Staphylococcus aureus subsp. aureus N315
uuauuagaauauucaga

SEQ ID NO: 2135631 - RNA, 15 nt, Staphylococcus aureus subsp. aureus N315
uuauuuaauaacgaa

SEQ ID NO: 2135632 - RNA, 13 nt, Staphylococcus aureus subsp. aureus N315
uuauuuaacacuu

SEQ ID NO: 2135633 - RNA, 14 nt, Staphylococcus aureus subsp. aureus N315
uuauuuaaaaugcu

SEQ ID NO: 2135634 - RNA, 20 nt, Staphylococcus aureus subsp. aureus N315
uuauuuggcucuauaucaaa

SEQ ID NO: 2135635 - RNA, 17 nt, Staphylococcus aureus subsp. aureus N315
uuauuugaaugcaaauc

SEQ ID NO: 2135636 - RNA, 15 nt, Staphylococcus aureus subsp. aureus N315
uuauuugauuauucu

SEQ ID NO: 2135637 - RNA, 19 nt, Staphylococcus aureus subsp. aureus N315
uuauuugauucuauuucuu

SEQ ID NO: 2135638 - RNA, 19 nt, Staphylococcus aureus subsp. aureus N315
uucaaaaaucauaccacgg

SEQ ID NO: 2135639 - RNA, 22 nt, Staphylococcus aureus subsp. aureus N315
uucaaaaagguauucaaauaaa

SEQ ID NO: 2135640 - RNA, 13 nt, Staphylococcus aureus subsp. aureus N315
uucaaaaaauauu

SEQ ID NO: 2135641 - RNA, 12 nt, Staphylococcus aureus subsp. aureus N315
uucaaaaaauau

SEQ ID NO: 2135642 - RNA, 11 nt, Staphylococcus aureus subsp. aureus N315
uuauuuuuaag

SEQ ID NO: 2135643 - RNA, 13 nt, Staphylococcus aureus subsp. aureus N315
uuauuuuuuuaaa

SEQ ID NO: 2135644 - RNA, 17 nt, Staphylococcus aureus subsp. aureus N315
uuauuuuuuucuuucuu

SEQ ID NO: 2135645 - RNA, 20 nt, Staphylococcus aureus subsp. aureus N315
uucaaaacuagcaguaauau

SEQ ID NO: 2135646 - RNA, 14 nt, Staphylococcus aureus subsp. aureus N315
uucaaaacugccaa

SEQ ID NO: 2135647 - RNA, 15 nt, Staphylococcus aureus subsp. aureus N315
uucaaaaguaaaagc

SEQ ID NO: 2135648 - RNA, 15 nt, Staphylococcus aureus subsp. aureus N315
uucaaaauuuugacu

SEQ ID NO: 2135649 - RNA, 19 nt, Staphylococcus aureus subsp. aureus N315
uucaaaaugccaagaagac

SEQ ID NO: 2135650 - RNA, 17 nt, Staphylococcus aureus subsp. aureus N315
uucaaaaucuuuaucag

SEQ ID NO: 2135651 - RNA, 14 nt, Staphylococcus aureus subsp. aureus N315
uucaaaaucaaauu

SEQ ID NO: 2135652 - RNA, 22 nt, Staphylococcus aureus subsp. aureus N315
uucaaaauaguaaagugaaaua

SEQ ID NO: 2135653 - RNA, 14 nt, Staphylococcus aureus subsp. aureus N315
uucaacauauuaua

SEQ ID NO: 2135654 - RNA, 13 nt, Staphylococcus aureus subsp. aureus N315
uucaaacagaaau

SEQ ID NO: 2135655 - RNA, 13 nt, Staphylococcus aureus subsp. aureus N315
uucaaacaauaca

SEQ ID NO: 2135656 - RNA, 12 nt, Staphylococcus aureus subsp. aureus N315
uucaauaauuca

SEQ ID NO: 2135657 - RNA, 16 nt, Staphylococcus aureus subsp. aureus N315
uucaauaaauuuuaua

SEQ ID NO: 2135658 - RNA, 15 nt, Staphylococcus aureus subsp. aureus N315
uucaauaaauaaaca

SEQ ID NO: 2135659 - RNA, 16 nt, Staphylococcus aureus subsp. aureus N315
uucaauaacaaugcag

SEQ ID NO: 2135660 - RNA, 17 nt, Staphylococcus aureus subsp. aureus N315
uucaagagguuuuauuu

SEQ ID NO: 2135661 - RNA, 16 nt, Staphylococcus aureus subsp. aureus N315
uucaacuuuuuaauaa

SEQ ID NO: 2135662 - RNA, 19 nt, Staphylococcus aureus subsp. aureus N315
uucaacuuuaguuguuagg

SEQ ID NO: 2135663 - RNA, 14 nt, Staphylococcus aureus subsp. aureus N315
uuagcauacauuaa

SEQ ID NO: 2135664 - RNA, 19 nt, Staphylococcus aureus subsp. aureus N315
uuagcauaccuuuauuauu

SEQ ID NO: 2135665 - RNA, 23 nt, Staphylococcus aureus subsp. aureus N315
uuagaagaugauuauucucuuua

SEQ ID NO: 2135666 - RNA, 18 nt, Staphylococcus aureus subsp. aureus N315
uuagaagaugauuauucu

SEQ ID NO: 2135667 - RNA, 22 nt, Staphylococcus aureus subsp. aureus N315
uuagaauaagaaauaaaaggaa

SEQ ID NO: 2135668 - RNA, 21 nt, Staphylococcus aureus subsp. aureus N315
uuagacucuccuuuuuuaaag

SEQ ID NO: 2135669 - RNA, 20 nt, Staphylococcus aureus subsp. aureus N315
uuagagaaaaaucuguuucu

SEQ ID NO: 2135670 - RNA, 18 nt, Staphylococcus aureus subsp. aureus N315
uuagccaauaaaauguca

SEQ ID NO: 2135671 - RNA, 14 nt, Staphylococcus aureus subsp. aureus N315
uuagcccuccuaag

SEQ ID NO: 2135672 - RNA, 23 nt, Staphylococcus aureus subsp. aureus N315
uuagccccagcaaauacuucaag

SEQ ID NO: 2135673 - RNA, 18 nt, Staphylococcus aureus subsp. aureus N315
uuagcaugacuguaagua

SEQ ID NO: 2135674 - RNA, 19 nt, Staphylococcus aureus subsp. aureus N315
uuagcaucuuuaccauaua

SEQ ID NO: 2135675 - RNA, 14 nt, Staphylococcus aureus subsp. aureus N315
uuagcaucugcaug

SEQ ID NO: 2135676 - RNA, 13 nt, Staphylococcus aureus subsp. aureus N315
uuagcaucaaaaa

SEQ ID NO: 2135677 - RNA, 17 nt, Staphylococcus aureus subsp. aureus N315
uuagccaaaucuuuaau

SEQ ID NO: 2135678 - RNA, 16 nt, Staphylococcus aureus subsp. aureus N315
uuaggggcuuuuaugc

SEQ ID NO: 2135679 - RNA, 20 nt, Staphylococcus aureus subsp. aureus N315
uuaggaaugauagauuuagg

SEQ ID NO: 2135680 - RNA, 18 nt, Staphylococcus aureus subsp. aureus N315
uuaggaaugauagauuua

SEQ ID NO: 2135681 - RNA, 15 nt, Staphylococcus aureus subsp. aureus N315
uuaggaaugauagau

SEQ ID NO: 2135682 - RNA, 21 nt, Staphylococcus aureus subsp. aureus N315
uuacugcuuuuuuaaauuuaa

SEQ ID NO: 2135683 - RNA, 18 nt, Staphylococcus aureus subsp. aureus N315
uuacugcgcuuuuaauuu

SEQ ID NO: 2135684 - RNA, 19 nt, Staphylococcus aureus subsp. aureus N315
uuacugcaauuauuuuuca

SEQ ID NO: 2135685 - RNA, 16 nt, Staphylococcus aureus subsp. aureus N315
uuacuuucgcuugcaa

SEQ ID NO: 2135686 - RNA, 11 nt, Staphylococcus aureus subsp. aureus N315
uuacuuugaaa

SEQ ID NO: 2135687 - RNA, 12 nt, Staphylococcus aureus subsp. aureus N315
uuagaaccauca

SEQ ID NO: 2135688 - RNA, 20 nt, Staphylococcus aureus subsp. aureus N315
uuacuguaaucaauccucua

SEQ ID NO: 2135689 - RNA, 15 nt, Staphylococcus aureus subsp. aureus N315
uuacuguaaauauga

SEQ ID NO: 2135690 - RNA, 22 nt, Staphylococcus aureus subsp. aureus N315
uuacuugcuuuuucaaauaaua

SEQ ID NO: 2135691 - RNA, 14 nt, Staphylococcus aureus subsp. aureus N315
uuacccuuuaaacu

SEQ ID NO: 2135692 - RNA, 12 nt, Staphylococcus aureus subsp. aureus N315
uuacuaaaacaa

SEQ ID NO: 2135693 - RNA, 20 nt, Staphylococcus aureus subsp. aureus N315
uuacuaaaugaauugcuugu

SEQ ID NO: 2135694 - RNA, 18 nt, Staphylococcus aureus subsp. aureus N315
uuacucauauugaauacu

SEQ ID NO: 2135695 - RNA, 14 nt, Staphylococcus aureus subsp. aureus N315
uuacucauuuuucu

SEQ ID NO: 2135696 - RNA, 19 nt, Staphylococcus aureus subsp. aureus N315
uuauacagugaaucuaaac

SEQ ID NO: 2135697 - RNA, 19 nt, Staphylococcus aureus subsp. aureus N315
uuauacuaaauugagaagu

SEQ ID NO: 2135698 - RNA, 23 nt, Staphylococcus aureus subsp. aureus N315
uuauacuauaaauacaaauauau

SEQ ID NO: 2135699 - RNA, 23 nt, Staphylococcus aureus subsp. aureus N315
uuauacgugcuuuaaaguuguug

SEQ ID NO: 2135700 - RNA, 19 nt, Staphylococcus aureus subsp. aureus N315
uuauacuuuuggucuguug

SEQ ID NO: 2135701 - RNA, 17 nt, Staphylococcus aureus subsp. aureus N315
uuauaauggcaguaguu

SEQ ID NO: 2135702 - RNA, 22 nt, Staphylococcus aureus subsp. aureus N315
uuauaaguuaaaaauguaaaua

SEQ ID NO: 2135703 - RNA, 22 nt, Staphylococcus aureus subsp. aureus N315
uuauaaguaucgccaucauuca

SEQ ID NO: 2135704 - RNA, 13 nt, Staphylococcus aureus subsp. aureus N315
uuauaaguauuca

SEQ ID NO: 2135705 - RNA, 15 nt, Staphylococcus aureus subsp. aureus N315
uuauaauagagaaac

SEQ ID NO: 2135706 - RNA, 14 nt, Staphylococcus aureus subsp. aureus N315
uuauaaguugcaua

SEQ ID NO: 2135707 - RNA, 13 nt, Staphylococcus aureus subsp. aureus N315
uuauacaauacuu

SEQ ID NO: 2135708 - RNA, 23 nt, Staphylococcus aureus subsp. aureus N315
uuauaauuucaguaggacauaua

SEQ ID NO: 2135709 - RNA, 22 nt, Staphylococcus aureus subsp. aureus N315
uuauaaagacaccuucaauauc

SEQ ID NO: 2135710 - RNA, 17 nt, Staphylococcus aureus subsp. aureus N315
uuauaaaaugaauaauu

SEQ ID NO: 2135711 - RNA, 21 nt, Staphylococcus aureus subsp. aureus N315
uuauaaagcugcgaaacuugu

SEQ ID NO: 2135712 - RNA, 13 nt, Staphylococcus aureus subsp. aureus N315
uuauaaaucaaag

SEQ ID NO: 2135713 - RNA, 15 nt, Staphylococcus aureus subsp. aureus N315
uuauaaaucaaagag

SEQ ID NO: 2135714 - RNA, 21 nt, Staphylococcus aureus subsp. aureus N315
uuauaaaugaauuauuuaaaa

SEQ ID NO: 2135715 - RNA, 14 nt, Staphylococcus aureus subsp. aureus N315
uuauaaaugauuaa

SEQ ID NO: 2135716 - RNA, 18 nt, Staphylococcus aureus subsp. aureus N315
uuauaaaucauucuuuau

SEQ ID NO: 2135717 - RNA, 15 nt, Staphylococcus aureus subsp. aureus N315
uuauaaaucauagag

SEQ ID NO: 2135718 - RNA, 19 nt, Staphylococcus aureus subsp. aureus N315
uuauaacgcuuuaauauaa

SEQ ID NO: 2135719 - RNA, 12 nt, Staphylococcus aureus subsp. aureus N315
uuauaacauuua

SEQ ID NO: 2135720 - RNA, 16 nt, Staphylococcus aureus subsp. aureus N315
uuauaacauucuucaa

SEQ ID NO: 2135721 - RNA, 16 nt, Staphylococcus aureus subsp. aureus N315
uuauaacaaaaauugc

SEQ ID NO: 2135722 - RNA, 23 nt, Staphylococcus aureus subsp. aureus N315
uuauaaauuucgauuaauugaau

SEQ ID NO: 2135723 - RNA, 17 nt, Staphylococcus aureus subsp. aureus N315
uuauaaguaaauaauag

SEQ ID NO: 2135724 - RNA, 16 nt, Staphylococcus aureus subsp. aureus N315
uuauaaguaaauaaua

SEQ ID NO: 2135725 - RNA, 21 nt, Staphylococcus aureus subsp. aureus N315
uuauaagaauuuaaaagagaa

SEQ ID NO: 2135726 - RNA, 15 nt, Staphylococcus aureus subsp. aureus N315
uuaguguagaaaaua

SEQ ID NO: 2135727 - RNA, 17 nt, Staphylococcus aureus subsp. aureus N315
uuagucuuuuuaaguau

SEQ ID NO: 2135728 - RNA, 16 nt, Staphylococcus aureus subsp. aureus N315
uuaguuugacaucuau

SEQ ID NO: 2135729 - RNA, 14 nt, Staphylococcus aureus subsp. aureus N315
uuaguuuucuuaaa

SEQ ID NO: 2135730 - RNA, 14 nt, Staphylococcus aureus subsp. aureus N315
uuauaaaaagagau

SEQ ID NO: 2135731 - RNA, 20 nt, Staphylococcus aureus subsp. aureus N315
uuauaaaaacagcagugaag

SEQ ID NO: 2135732 - RNA, 12 nt, Staphylococcus aureus subsp. aureus N315
uuauaaaaaacg

SEQ ID NO: 2135733 - RNA, 14 nt, Staphylococcus aureus subsp. aureus N315
uuauaaaaaacggu

SEQ ID NO: 2135734 - RNA, 13 nt, Staphylococcus aureus subsp. aureus N315
uuaguuuuuaaaa

SEQ ID NO: 2135735 - RNA, 21 nt, Staphylococcus aureus subsp. aureus N315
uuauaaaaaggccucuugaaa

SEQ ID NO: 2135736 - RNA, 17 nt, Staphylococcus aureus subsp. aureus N315
uuauaaaaguguaaugu

SEQ ID NO: 2135737 - RNA, 13 nt, Staphylococcus aureus subsp. aureus N315
uuaguaaauauag

SEQ ID NO: 2135738 - RNA, 15 nt, Staphylococcus aureus subsp. aureus N315
uuaguaaggaauauu

SEQ ID NO: 2135739 - RNA, 19 nt, Staphylococcus aureus subsp. aureus N315
uuaguaaggaauauuuccc

SEQ ID NO: 2135740 - RNA, 12 nt, Staphylococcus aureus subsp. aureus N315
uuaguaauaaca

SEQ ID NO: 2135741 - RNA, 21 nt, Staphylococcus aureus subsp. aureus N315
uuaguacggcugcuuuaacug

SEQ ID NO: 2135742 - RNA, 20 nt, Staphylococcus aureus subsp. aureus N315
uuaguacauauguuguuucu

SEQ ID NO: 2135743 - RNA, 15 nt, Staphylococcus aureus subsp. aureus N315
uuaguacaaaauugu

SEQ ID NO: 2135744 - RNA, 14 nt, Staphylococcus aureus subsp. aureus N315
uuagguuacuuauu

SEQ ID NO: 2135745 - RNA, 19 nt, Staphylococcus aureus subsp. aureus N315
uuaguauggaauaaauggu

SEQ ID NO: 2135746 - RNA, 22 nt, Staphylococcus aureus subsp. aureus N315
uuagucaauguauauuuaacau

SEQ ID NO: 2135747 - RNA, 21 nt, Staphylococcus aureus subsp. aureus N315
uuaguauaauuuaucuuaauc

SEQ ID NO: 2135748 - RNA, 18 nt, Staphylococcus aureus subsp. aureus N315
uuaguauaaauaaaaaua

SEQ ID NO: 2135749 - RNA, 20 nt, Staphylococcus aureus subsp. aureus N315
uuaguaguuuauaucaaaaa

SEQ ID NO: 2135750 - RNA, 17 nt, Staphylococcus aureus subsp. aureus N315
uuaguaguuguacuucu

SEQ ID NO: 2135751 - RNA, 19 nt, Staphylococcus aureus subsp. aureus N315
uuaguaucgauaguucuau

SEQ ID NO: 2135752 - RNA, 14 nt, Staphylococcus aureus subsp. aureus N315
uuaguaucuauaca

SEQ ID NO: 2135753 - RNA, 18 nt, Staphylococcus aureus subsp. aureus N315
uuaguacuuugauaucua

SEQ ID NO: 2135754 - RNA, 14 nt, Staphylococcus aureus subsp. aureus N315
uuaguacuaaaccg

SEQ ID NO: 2135755 - RNA, 24 nt, Staphylococcus aureus subsp. aureus N315
uuaguacuaaaccgauuaauauaa

SEQ ID NO: 2135756 - RNA, 22 nt, Staphylococcus aureus subsp. aureus N315
uuacaugcaccuuuacaacaua

SEQ ID NO: 2135757 - RNA, 21 nt, Staphylococcus aureus subsp. aureus N315
uuacaugcaccuuuacaacau

SEQ ID NO: 2135758 - RNA, 20 nt, Staphylococcus aureus subsp. aureus N315
uuacagguuuuaaaauuaaa

SEQ ID NO: 2135759 - RNA, 19 nt, Staphylococcus aureus subsp. aureus N315
uuacagguuuuaaaauuaa

SEQ ID NO: 2135760 - RNA, 16 nt, Staphylococcus aureus subsp. aureus N315
uuacagguugaauaaa

SEQ ID NO: 2135761 - RNA, 21 nt, Staphylococcus aureus subsp. aureus N315
uuacauuacgcucaucaccuu

SEQ ID NO: 2135762 - RNA, 18 nt, Staphylococcus aureus subsp. aureus N315
uuacauuuuaauaaaauc

SEQ ID NO: 2135763 - RNA, 19 nt, Staphylococcus aureus subsp. aureus N315
uuacauuuuaauaaaauca

SEQ ID NO: 2135764 - RNA, 14 nt, Staphylococcus aureus subsp. aureus N315
uuacauuuucaaaa

SEQ ID NO: 2135765 - RNA, 12 nt, Staphylococcus aureus subsp. aureus N315
uuaccaaaauuu

SEQ ID NO: 2135766 - RNA, 11 nt, Staphylococcus aureus subsp. aureus N315
uuaccaaaauu

SEQ ID NO: 2135767 - RNA, 16 nt, Staphylococcus aureus subsp. aureus N315
uuaccaauaucaugca

SEQ ID NO: 2135768 - RNA, 23 nt, Staphylococcus aureus subsp. aureus N315
uuaccaauaucaugcaaaauaau

SEQ ID NO: 2135769 - RNA, 14 nt, Staphylococcus aureus subsp. aureus N315
uuaccaaugaauaa

SEQ ID NO: 2135770 - RNA, 23 nt, Staphylococcus aureus subsp. aureus N315
uuaccacaaccagucagaaagaa

SEQ ID NO: 2135771 - RNA, 13 nt, Staphylococcus aureus subsp. aureus N315
uuaauuucuggua

SEQ ID NO: 2135772 - RNA, 19 nt, Staphylococcus aureus subsp. aureus N315
uuaauuucugguaaaaaaa

SEQ ID NO: 2135773 - RNA, 23 nt, Staphylococcus aureus subsp. aureus N315
uuaauuucugguaaaaaaauaac

SEQ ID NO: 2135774 - RNA, 14 nt, Staphylococcus aureus subsp. aureus N315
uuaauuuguauuua

SEQ ID NO: 2135775 - RNA, 12 nt, Staphylococcus aureus subsp. aureus N315
uuacaaguuguu

SEQ ID NO: 2135776 - RNA, 17 nt, Staphylococcus aureus subsp. aureus N315
uuacaaguuguucaauu

SEQ ID NO: 2135777 - RNA, 17 nt, Staphylococcus aureus subsp. aureus N315
uuacaauaaagacauau

SEQ ID NO: 2135778 - RNA, 18 nt, Staphylococcus aureus subsp. aureus N315
uuaauuuguauuuaaaau

SEQ ID NO: 2135779 - RNA, 17 nt, Staphylococcus aureus subsp. aureus N315
uuaauuuguuuuaaaua

SEQ ID NO: 2135780 - RNA, 18 nt, Staphylococcus aureus subsp. aureus N315
uuaauuuguuuuaaauac

SEQ ID NO: 2135781 - RNA, 13 nt, Staphylococcus aureus subsp. aureus N315
uuaauuuuauuuu

SEQ ID NO: 2135782 - RNA, 14 nt, Staphylococcus aureus subsp. aureus N315
uuacaauuguucuc

SEQ ID NO: 2135783 - RNA, 15 nt, Staphylococcus aureus subsp. aureus N315
uuacaauaugauuaa

SEQ ID NO: 2135784 - RNA, 17 nt, Staphylococcus aureus subsp. aureus N315
uuacaauauaauuuccu

SEQ ID NO: 2135785 - RNA, 21 nt, Staphylococcus aureus subsp. aureus N315
uuacaaugcgguauugcaugu

SEQ ID NO: 2135786 - RNA, 13 nt, Staphylococcus aureus subsp. aureus N315
uuacaaugaaaaa

SEQ ID NO: 2135787 - RNA, 20 nt, Staphylococcus aureus subsp. aureus N315
uuacaaugcgcaaugaaaac

SEQ ID NO: 2135788 - RNA, 16 nt, Staphylococcus aureus subsp. aureus N315
uuacagacaaacauua

SEQ ID NO: 2135789 - RNA, 22 nt, Staphylococcus aureus subsp. aureus N315
uuacaggagcgagccauuauua

SEQ ID NO: 2135790 - RNA, 15 nt, Staphylococcus aureus subsp. aureus N315
uuaauguguaaauuu

SEQ ID NO: 2135791 - RNA, 14 nt, Staphylococcus aureus subsp. aureus N315
uuaauguuaaacaa

SEQ ID NO: 2135792 - RNA, 17 nt, Staphylococcus aureus subsp. aureus N315
uuaaugucuuaaaauug

SEQ ID NO: 2135793 - RNA, 16 nt, Staphylococcus aureus subsp. aureus N315
uuaauguauucuucua

SEQ ID NO: 2135794 - RNA, 18 nt, Staphylococcus aureus subsp. aureus N315
uuaauguacuuuucuguc

SEQ ID NO: 2135795 - RNA, 23 nt, Staphylococcus aureus subsp. aureus N315
uuaaugggcgugccauuaaaauu

SEQ ID NO: 2135796 - RNA, 22 nt, Staphylococcus aureus subsp. aureus N315
uuaauggcagcgaucuuuuuua

SEQ ID NO: 2135797 - RNA, 19 nt, Staphylococcus aureus subsp. aureus N315
uuaauggcaacuaagauga

SEQ ID NO: 2135798 - RNA, 13 nt, Staphylococcus aureus subsp. aureus N315
uuaaugcuuuagc

SEQ ID NO: 2135799 - RNA, 16 nt, Staphylococcus aureus subsp. aureus N315
uuaaugcucuauauau

SEQ ID NO: 2135800 - RNA, 14 nt, Staphylococcus aureus subsp. aureus N315
uuaaucuauauaua

SEQ ID NO: 2135801 - RNA, 18 nt, Staphylococcus aureus subsp. aureus N315
uuaaugaguaguuucucu

SEQ ID NO: 2135802 - RNA, 15 nt, Staphylococcus aureus subsp. aureus N315
uuaaugauuuuucau

SEQ ID NO: 2135803 - RNA, 19 nt, Staphylococcus aureus subsp. aureus N315
uuaaugauuuuucaucaau

SEQ ID NO: 2135804 - RNA, 19 nt, Staphylococcus aureus subsp. aureus N315
uuaaugauucuacagcacu

SEQ ID NO: 2135805 - RNA, 19 nt, Staphylococcus aureus subsp. aureus N315
uuaauuaucauaaagauaa

SEQ ID NO: 2135806 - RNA, 13 nt, Staphylococcus aureus subsp. aureus N315
uuaauuauaauaa

SEQ ID NO: 2135807 - RNA, 14 nt, Staphylococcus aureus subsp. aureus N315
uuaauuauuucccu

SEQ ID NO: 2135808 - RNA, 19 nt, Staphylococcus aureus subsp. aureus N315
uuaauuacuguaaauauga

SEQ ID NO: 2135809 - RNA, 14 nt, Staphylococcus aureus subsp. aureus N315
uuaauuaaaacaug

SEQ ID NO: 2135810 - RNA, 21 nt, Staphylococcus aureus subsp. aureus N315
uuaauuaaaauucucuuuuaa

SEQ ID NO: 2135811 - RNA, 23 nt, Staphylococcus aureus subsp. aureus N315
uuaauuaaagcaucuucaauauu

SEQ ID NO: 2135812 - RNA, 20 nt, Staphylococcus aureus subsp. aureus N315
uuaauuaaagcaucuucaau

SEQ ID NO: 2135813 - RNA, 19 nt, Staphylococcus aureus subsp. aureus N315
uuaauuaaagcaucuucaa

SEQ ID NO: 2135814 - RNA, 13 nt, Staphylococcus aureus subsp. aureus N315
uuaauuaaagauu

SEQ ID NO: 2135815 - RNA, 12 nt, Staphylococcus aureus subsp. aureus N315
uuaauuaacaaa

SEQ ID NO: 2135816 - RNA, 15 nt, Staphylococcus aureus subsp. aureus N315
uuaauuaauaauuua

SEQ ID NO: 2135817 - RNA, 20 nt, Staphylococcus aureus subsp. aureus N315
uuaauuaauaauuuaacuaa

SEQ ID NO: 2135818 - RNA, 16 nt, Staphylococcus aureus subsp. aureus N315
uuaauucguuuuacua

SEQ ID NO: 2135819 - RNA, 22 nt, Staphylococcus aureus subsp. aureus N315
uuaauucuauuuuugauuuaau

SEQ ID NO: 2135820 - RNA, 18 nt, Staphylococcus aureus subsp. aureus N315
uuaauugaaaaaccaagu

SEQ ID NO: 2135821 - RNA, 16 nt, Staphylococcus aureus subsp. aureus N315
uuaauugaaguaugca

SEQ ID NO: 2135822 - RNA, 18 nt, Staphylococcus aureus subsp. aureus N315
uuaauugaaugaaaauaa

SEQ ID NO: 2135823 - RNA, 16 nt, Staphylococcus aureus subsp. aureus N315
uuaauuucaugugcaa

SEQ ID NO: 2135824 - RNA, 16 nt, Staphylococcus aureus subsp. aureus N315
uuaauaaccuuuaaaa

SEQ ID NO: 2135825 - RNA, 23 nt, Staphylococcus aureus subsp. aureus N315
uuaauaaccuuuaaaacaucauu

SEQ ID NO: 2135826 - RNA, 20 nt, Staphylococcus aureus subsp. aureus N315
uuaauaacaaaauuaaauau

SEQ ID NO: 2135827 - RNA, 22 nt, Staphylococcus aureus subsp. aureus N315
uuaauaacauccccaaaaauag

SEQ ID NO: 2135828 - RNA, 19 nt, Staphylococcus aureus subsp. aureus N315
uuaauaaccauguaaaauu

SEQ ID NO: 2135829 - RNA, 20 nt, Staphylococcus aureus subsp. aureus N315
uuaauaacccauuuucaaaa

SEQ ID NO: 2135830 - RNA, 13 nt, Staphylococcus aureus subsp. aureus N315
uuaauaauaagua

SEQ ID NO: 2135831 - RNA, 20 nt, Staphylococcus aureus subsp. aureus N315
uuaauacuauaguaagaaaa

SEQ ID NO: 2135832 - RNA, 18 nt, Staphylococcus aureus subsp. aureus N315
uuaauacuaccguuuuua

SEQ ID NO: 2135833 - RNA, 23 nt, Staphylococcus aureus subsp. aureus N315
uuaagugaugaccaauauucugg

SEQ ID NO: 2135834 - RNA, 23 nt, Staphylococcus aureus subsp. aureus N315
uuaagugccuugccaugauuuaa

SEQ ID NO: 2135835 - RNA, 18 nt, Staphylococcus aureus subsp. aureus N315
uuaagugaguuuuauuua

SEQ ID NO: 2135836 - RNA, 17 nt, Staphylococcus aureus subsp. aureus N315
uuaagugaguuuuauuu

SEQ ID NO: 2135837 - RNA, 13 nt, Staphylococcus aureus subsp. aureus N315
uuaagcuuuaauc

SEQ ID NO: 2135838 - RNA, 20 nt, Staphylococcus aureus subsp. aureus N315
uuaagcuuacgacauacuug

SEQ ID NO: 2135839 - RNA, 14 nt, Staphylococcus aureus subsp. aureus N315
uuaauauugauuaa

SEQ ID NO: 2135840 - RNA, 12 nt, Staphylococcus aureus subsp. aureus N315
uuaauauuuucu

SEQ ID NO: 2135841 - RNA, 13 nt, Staphylococcus aureus subsp. aureus N315
uuaauauaaauau

SEQ ID NO: 2135842 - RNA, 13 nt, Staphylococcus aureus subsp. aureus N315
uuaauaugcaaug

SEQ ID NO: 2135843 - RNA, 22 nt, Staphylococcus aureus subsp. aureus N315
uuaauaugcaaugcaccuauaa

SEQ ID NO: 2135844 - RNA, 21 nt, Staphylococcus aureus subsp. aureus N315
uuaauagugucaucaccuugu

SEQ ID NO: 2135845 - RNA, 14 nt, Staphylococcus aureus subsp. aureus N315
uuaauauaaaauaa

SEQ ID NO: 2135846 - RNA, 20 nt, Staphylococcus aureus subsp. aureus N315
uuaauagagacauuuuaucu

SEQ ID NO: 2135847 - RNA, 22 nt, Staphylococcus aureus subsp. aureus N315
uuaauagagacauuuuaucuga

SEQ ID NO: 2135848 - RNA, 15 nt, Staphylococcus aureus subsp. aureus N315
uuaauagagaaagaa

SEQ ID NO: 2135849 - RNA, 20 nt, Staphylococcus aureus subsp. aureus N315
uuaauacuaccguuuuuaua

SEQ ID NO: 2135850 - RNA, 23 nt, Staphylococcus aureus subsp. aureus N315
uuaauacuuuucucgauuaauuu

SEQ ID NO: 2135851 - RNA, 17 nt, Staphylococcus aureus subsp. aureus N315
uuaauagaaagagguuu

SEQ ID NO: 2135852 - RNA, 16 nt, Staphylococcus aureus subsp. aureus N315
uuaauagaaagugcgg

SEQ ID NO: 2135853 - RNA, 18 nt, Staphylococcus aureus subsp. aureus N315
uuaaucggaucauuauuu

SEQ ID NO: 2135854 - RNA, 16 nt, Staphylococcus aureus subsp. aureus N315
uuaauccuucuccaaa

SEQ ID NO: 2135855 - RNA, 23 nt, Staphylococcus aureus subsp. aureus N315
uuaaucaacguauauaaguuaaa

SEQ ID NO: 2135856 - RNA, 17 nt, Staphylococcus aureus subsp. aureus N315
uuaaccauuuaaaaauu

SEQ ID NO: 2135857 - RNA, 21 nt, Staphylococcus aureus subsp. aureus N315
uuaaccucuaagguuaaauua

SEQ ID NO: 2135858 - RNA, 19 nt, Staphylococcus aureus subsp. aureus N315
ugugcuuuuccauaaauau

SEQ ID NO: 2135859 - RNA, 14 nt, Staphylococcus aureus subsp. aureus N315
uguggauacaaacc

SEQ ID NO: 2135860 - RNA, 15 nt, Staphylococcus aureus subsp. aureus N315
uuaagcuaucuaaac

SEQ ID NO: 2135861 - RNA, 19 nt, Staphylococcus aureus subsp. aureus N315
uuaagcuaucuaaaccuuu

SEQ ID NO: 2135862 - RNA, 14 nt, Staphylococcus aureus subsp. aureus N315
uuaacucaaagaaa

SEQ ID NO: 2135863 - RNA, 24 nt, Staphylococcus aureus subsp. aureus N315
uuaacuauguuacuuauauauuca

SEQ ID NO: 2135864 - RNA, 17 nt, Staphylococcus aureus subsp. aureus N315
uuaacuauguuacuuau

SEQ ID NO: 2135865 - RNA, 12 nt, Staphylococcus aureus subsp. aureus N315
uuaacuaaacca

SEQ ID NO: 2135866 - RNA, 18 nt, Staphylococcus aureus subsp. aureus N315
uuaacuauaaauagaaga

SEQ ID NO: 2135867 - RNA, 23 nt, Staphylococcus aureus subsp. aureus N315
uuaagaauaaucgaacauaaaua

SEQ ID NO: 2135868 - RNA, 16 nt, Staphylococcus aureus subsp. aureus N315
uggcauaaccuguaau

SEQ ID NO: 2135869 - RNA, 19 nt, Staphylococcus aureus subsp. aureus N315
uggcauuauugccuaaccu

SEQ ID NO: 2135870 - RNA, 18 nt, Staphylococcus aureus subsp. aureus N315
uggccacuaaugcauaau

SEQ ID NO: 2135871 - RNA, 19 nt, Staphylococcus aureus subsp. aureus N315
uggccauuggauucuuuug

SEQ ID NO: 2135872 - RNA, 23 nt, Staphylococcus aureus subsp. aureus N315
uggcaacggcacauucauaccga

SEQ ID NO: 2135873 - RNA, 20 nt, Staphylococcus aureus subsp. aureus N315
uggcaaccuuuugauguuua

SEQ ID NO: 2135874 - RNA, 13 nt, Staphylococcus aureus subsp. aureus N315
uggauuuuuuggu

SEQ ID NO: 2135875 - RNA, 13 nt, Staphylococcus aureus subsp. aureus N315
uggauuuuucuua

SEQ ID NO: 2135876 - RNA, 18 nt, Staphylococcus aureus subsp. aureus N315
uggauuuuaacaagauaa

SEQ ID NO: 2135877 - RNA, 17 nt, Staphylococcus aureus subsp. aureus N315
uggauuaccguuaaaaa

SEQ ID NO: 2135878 - RNA, 14 nt, Staphylococcus aureus subsp. aureus N315
uggauuacagauga

SEQ ID NO: 2135879 - RNA, 22 nt, Staphylococcus aureus subsp. aureus N315
uggauucaaaugacauuuuaaa

SEQ ID NO: 2135880 - RNA, 17 nt, Staphylococcus aureus subsp. aureus N315
uggauucaaaugacauu

SEQ ID NO: 2135881 - RNA, 18 nt, Staphylococcus aureus subsp. aureus N315
uggaugucaugucuagau

SEQ ID NO: 2135882 - RNA, 14 nt, Staphylococcus aureus subsp. aureus N315
uggauguguuuuaa

SEQ ID NO: 2135883 - RNA, 20 nt, Staphylococcus aureus subsp. aureus N315
uggauguguuuuaauaauau

SEQ ID NO: 2135884 - RNA, 22 nt, Staphylococcus aureus subsp. aureus N315
uggauguaggcuuuuuuauuau

SEQ ID NO: 2135885 - RNA, 15 nt, Staphylococcus aureus subsp. aureus N315
uggcacugcaaucag

SEQ ID NO: 2135886 - RNA, 21 nt, Staphylococcus aureus subsp. aureus N315
uggaguaaagaucacacgaca

SEQ ID NO: 2135887 - RNA, 17 nt, Staphylococcus aureus subsp. aureus N315
uggaguauaucagcuug

SEQ ID NO: 2135888 - RNA, 18 nt, Staphylococcus aureus subsp. aureus N315
uggauauuuauuuuaaua

SEQ ID NO: 2135889 - RNA, 13 nt, Staphylococcus aureus subsp. aureus N315
uggauaauugcau

SEQ ID NO: 2135890 - RNA, 16 nt, Staphylococcus aureus subsp. aureus N315
uggauaauugcauuac

SEQ ID NO: 2135891 - RNA, 14 nt, Staphylococcus aureus subsp. aureus N315
uggauacaaaccua

SEQ ID NO: 2135892 - RNA, 13 nt, Staphylococcus aureus subsp. aureus N315
uggaucuguuaca

SEQ ID NO: 2135893 - RNA, 18 nt, Staphylococcus aureus subsp. aureus N315
uggagguccauaaucuuu

SEQ ID NO: 2135894 - RNA, 16 nt, Staphylococcus aureus subsp. aureus N315
uggacugaugcauuca

SEQ ID NO: 2135895 - RNA, 23 nt, Staphylococcus aureus subsp. aureus N315
uggacuuugcuguccaucgucau

SEQ ID NO: 2135896 - RNA, 16 nt, Staphylococcus aureus subsp. aureus N315
uggacuuuaaaguuaa

SEQ ID NO: 2135897 - RNA, 14 nt, Staphylococcus aureus subsp. aureus N315
uggacuucuaucuu

SEQ ID NO: 2135898 - RNA, 17 nt, Staphylococcus aureus subsp. aureus N315
uggacuucuaucuucac

SEQ ID NO: 2135899 - RNA, 20 nt, Staphylococcus aureus subsp. aureus N315
uggacuuauggguucaauau

SEQ ID NO: 2135900 - RNA, 22 nt, Staphylococcus aureus subsp. aureus N315
uggacuaauaauuguccaugcc

SEQ ID NO: 2135901 - RNA, 19 nt, Staphylococcus aureus subsp. aureus N315
uggacgcggguucaaaucc

SEQ ID NO: 2135902 - RNA, 22 nt, Staphylococcus aureus subsp. aureus N315
uggcgcaaugauaucuuuucca

SEQ ID NO: 2135903 - RNA, 21 nt, Staphylococcus aureus subsp. aureus N315
uggcgacauuuguaaauauuu

SEQ ID NO: 2135904 - RNA, 18 nt, Staphylococcus aureus subsp. aureus N315
uggcuacuugaauaccuu

SEQ ID NO: 2135905 - RNA, 22 nt, Staphylococcus aureus subsp. aureus N315
uggcuagucuuuaacuuuaauu

SEQ ID NO: 2135906 - RNA, 18 nt, Staphylococcus aureus subsp. aureus N315
ugggacagaaaacaaagc

SEQ ID NO: 2135907 - RNA, 14 nt, Staphylococcus aureus subsp. aureus N315
ugggaagguaaaac

SEQ ID NO: 2135908 - RNA, 17 nt, Staphylococcus aureus subsp. aureus N315
uggcugcaacaauuugc

SEQ ID NO: 2135909 - RNA, 15 nt, Staphylococcus aureus subsp. aureus N315
uggguaauguuuuua

SEQ ID NO: 2135910 - RNA, 12 nt, Staphylococcus aureus subsp. aureus N315
uggguaaucuuu

SEQ ID NO: 2135911 - RNA, 23 nt, Staphylococcus aureus subsp. aureus N315
ugugauuuuuaauaauuugaaua

SEQ ID NO: 2135912 - RNA, 14 nt, Staphylococcus aureus subsp. aureus N315
ugugcaaaaguuug

SEQ ID NO: 2135913 - RNA, 18 nt, Staphylococcus aureus subsp. aureus N315
ugugauuuguuacuucua

SEQ ID NO: 2135914 - RNA, 13 nt, Staphylococcus aureus subsp. aureus N315
ugugauuauaaau

SEQ ID NO: 2135915 - RNA, 17 nt, Staphylococcus aureus subsp. aureus N315
ugugauguacuacuuua

SEQ ID NO: 2135916 - RNA, 19 nt, Staphylococcus aureus subsp. aureus N315
ugugcaacgguuugaaaaa

SEQ ID NO: 2135917 - RNA, 15 nt, Staphylococcus aureus subsp. aureus N315
ugugcaauaccuguu

SEQ ID NO: 2135918 - RNA, 20 nt, Staphylococcus aureus subsp. aureus N315
ugugccggcuuuuucuuuug

SEQ ID NO: 2135919 - RNA, 18 nt, Staphylococcus aureus subsp. aureus N315
ugugauauaugaaauauu

SEQ ID NO: 2135920 - RNA, 13 nt, Staphylococcus aureus subsp. aureus N315
ugucuucuuuuuu

SEQ ID NO: 2135921 - RNA, 19 nt, Staphylococcus aureus subsp. aureus N315
ugucuuccaaucaacuuca

SEQ ID NO: 2135922 - RNA, 17 nt, Staphylococcus aureus subsp. aureus N315
ugucuuuuauauuuuua

SEQ ID NO: 2135923 - RNA, 19 nt, Staphylococcus aureus subsp. aureus N315
ugucuuucaaauacacaga

SEQ ID NO: 2135924 - RNA, 18 nt, Staphylococcus aureus subsp. aureus N315
ugucuaaaaacauaaaaa

SEQ ID NO: 2135925 - RNA, 14 nt, Staphylococcus aureus subsp. aureus N315
ugucucaucauuua

SEQ ID NO: 2135926 - RNA, 17 nt, Staphylococcus aureus subsp. aureus N315
ugucucaucauuuaaaa

SEQ ID NO: 2135927 - RNA, 14 nt, Staphylococcus aureus subsp. aureus N315
ugucuaaaaauguc

SEQ ID NO: 2135928 - RNA, 17 nt, Staphylococcus aureus subsp. aureus N315
ugucucuuuucacgaau

SEQ ID NO: 2135929 - RNA, 17 nt, Staphylococcus aureus subsp. aureus N315
ugucucucuuucuuauu

SEQ ID NO: 2135930 - RNA, 18 nt, Staphylococcus aureus subsp. aureus N315
ugucucgacuucagauac

SEQ ID NO: 2135931 - RNA, 23 nt, Staphylococcus aureus subsp. aureus N315
ugucgaaaauagcuauuaaaaua

SEQ ID NO: 2135932 - RNA, 19 nt, Staphylococcus aureus subsp. aureus N315
ugucgaaauuguucuaaua

SEQ ID NO: 2135933 - RNA, 18 nt, Staphylococcus aureus subsp. aureus N315
ugucggaauugguuuuua

SEQ ID NO: 2135934 - RNA, 16 nt, Staphylococcus aureus subsp. aureus N315
ugucgcuuucauaccu

SEQ ID NO: 2135935 - RNA, 14 nt, Staphylococcus aureus subsp. aureus N315
ugucgauauuucua

SEQ ID NO: 2135936 - RNA, 17 nt, Staphylococcus aureus subsp. aureus N315
uguccuaauaaguuacc

SEQ ID NO: 2135937 - RNA, 22 nt, Staphylococcus aureus subsp. aureus N315
uguccucuaaaacauguugaua

SEQ ID NO: 2135938 - RNA, 13 nt, Staphylococcus aureus subsp. aureus N315
uguccucuaaaac

SEQ ID NO: 2135939 - RNA, 18 nt, Staphylococcus aureus subsp. aureus N315
ugucccaagcccugacaa

SEQ ID NO: 2135940 - RNA, 16 nt, Staphylococcus aureus subsp. aureus N315
ugucaguaacuuuguc

SEQ ID NO: 2135941 - RNA, 18 nt, Staphylococcus aureus subsp. aureus N315
uguagcaggcaacuuuua

SEQ ID NO: 2135942 - RNA, 21 nt, Staphylococcus aureus subsp. aureus N315
uguagcaggcaacuuuuauua

SEQ ID NO: 2135943 - RNA, 21 nt, Staphylococcus aureus subsp. aureus N315
uguagcacaagauucaacuug

SEQ ID NO: 2135944 - RNA, 16 nt, Staphylococcus aureus subsp. aureus N315
uguagauuuuaauauu

SEQ ID NO: 2135945 - RNA, 21 nt, Staphylococcus aureus subsp. aureus N315
uguaucucugaaaaacuucuu

SEQ ID NO: 2135946 - RNA, 17 nt, Staphylococcus aureus subsp. aureus N315
uguauucagucaguaaa

SEQ ID NO: 2135947 - RNA, 23 nt, Staphylococcus aureus subsp. aureus N315
uguauuauucucucauuuguaua

SEQ ID NO: 2135948 - RNA, 18 nt, Staphylococcus aureus subsp. aureus N315
uguaucucugaaaaacuu

SEQ ID NO: 2135949 - RNA, 16 nt, Staphylococcus aureus subsp. aureus N315
uguauucugaaacuuu

SEQ ID NO: 2135950 - RNA, 19 nt, Staphylococcus aureus subsp. aureus N315
uguauucuucuaauucuga

SEQ ID NO: 2135951 - RNA, 19 nt, Staphylococcus aureus subsp. aureus N315
uguauucuuggcguauuuu

SEQ ID NO: 2135952 - RNA, 16 nt, Staphylococcus aureus subsp. aureus N315
uguauugcuauaagaa

SEQ ID NO: 2135953 - RNA, 23 nt, Staphylococcus aureus subsp. aureus N315
uguauugagaaagacuauauaac

SEQ ID NO: 2135954 - RNA, 14 nt, Staphylococcus aureus subsp. aureus N315
uguauuuaauaagu

SEQ ID NO: 2135955 - RNA, 18 nt, Staphylococcus aureus subsp. aureus N315
uguauuuauuuuuuuaaa

SEQ ID NO: 2135956 - RNA, 19 nt, Staphylococcus aureus subsp. aureus N315
uguauuguuugaaaauuaa

SEQ ID NO: 2135957 - RNA, 16 nt, Staphylococcus aureus subsp. aureus N315
uguauuguauuuuaau

SEQ ID NO: 2135958 - RNA, 18 nt, Staphylococcus aureus subsp. aureus N315
ugucaauauaacauugca

SEQ ID NO: 2135959 - RNA, 18 nt, Staphylococcus aureus subsp. aureus N315
ugucaauagcgguuuaaa

SEQ ID NO: 2135960 - RNA, 15 nt, Staphylococcus aureus subsp. aureus N315
uggugcccaaguuuc

SEQ ID NO: 2135961 - RNA, 24 nt, Staphylococcus aureus subsp. aureus N315
uggugaguguuucauaaucucuuu

SEQ ID NO: 2135962 - RNA, 15 nt, Staphylococcus aureus subsp. aureus N315
ugguuaacauccugc

SEQ ID NO: 2135963 - RNA, 19 nt, Staphylococcus aureus subsp. aureus N315
ugguuagagaaaaaucugu

SEQ ID NO: 2135964 - RNA, 14 nt, Staphylococcus aureus subsp. aureus N315
ugguucaaaaauca

SEQ ID NO: 2135965 - RNA, 14 nt, Staphylococcus aureus subsp. aureus N315
ugguucauaaugau

SEQ ID NO: 2135966 - RNA, 20 nt, Staphylococcus aureus subsp. aureus N315
uggugugccggcuuuuucuu

SEQ ID NO: 2135967 - RNA, 20 nt, Staphylococcus aureus subsp. aureus N315
ugguggagaaccuuuaaaag

SEQ ID NO: 2135968 - RNA, 21 nt, Staphylococcus aureus subsp. aureus N315
uguaagucgaaaguacccaga

SEQ ID NO: 2135969 - RNA, 16 nt, Staphylococcus aureus subsp. aureus N315
uguaauaauaaucuuu

SEQ ID NO: 2135970 - RNA, 18 nt, Staphylococcus aureus subsp. aureus N315
uguaauaaagaauaaaca

SEQ ID NO: 2135971 - RNA, 17 nt, Staphylococcus aureus subsp. aureus N315
uguaauaccuuuacuuu

SEQ ID NO: 2135972 - RNA, 19 nt, Staphylococcus aureus subsp. aureus N315
uguaauacaugacauucau

SEQ ID NO: 2135973 - RNA, 18 nt, Staphylococcus aureus subsp. aureus N315
uguaauaauaaucuuuaa

SEQ ID NO: 2135974 - RNA, 13 nt, Staphylococcus aureus subsp. aureus N315
uguaauaauuauu

SEQ ID NO: 2135975 - RNA, 16 nt, Staphylococcus aureus subsp. aureus N315
uguaauaauuauuaau

SEQ ID NO: 2135976 - RNA, 15 nt, Staphylococcus aureus subsp. aureus N315
uguaagacaacaaau

SEQ ID NO: 2135977 - RNA, 14 nt, Staphylococcus aureus subsp. aureus N315
uguaaauuacaaaa

SEQ ID NO: 2135978 - RNA, 22 nt, Staphylococcus aureus subsp. aureus N315
uguaagcuaucguaaacaacau

SEQ ID NO: 2135979 - RNA, 16 nt, Staphylococcus aureus subsp. aureus N315
uguacauuguaaauau

SEQ ID NO: 2135980 - RNA, 19 nt, Staphylococcus aureus subsp. aureus N315
uguacauugguuuuuacua

SEQ ID NO: 2135981 - RNA, 16 nt, Staphylococcus aureus subsp. aureus N315
uguacauugguuuuua

SEQ ID NO: 2135982 - RNA, 17 nt, Staphylococcus aureus subsp. aureus N315
uguacaucauuaaauau

SEQ ID NO: 2135983 - RNA, 19 nt, Staphylococcus aureus subsp. aureus N315
uguacauccacuuuauaau

SEQ ID NO: 2135984 - RNA, 16 nt, Staphylococcus aureus subsp. aureus N315
uguacguuuuuuuaaa

SEQ ID NO: 2135985 - RNA, 16 nt, Staphylococcus aureus subsp. aureus N315
uguacaguaauauuca

SEQ ID NO: 2135986 - RNA, 14 nt, Staphylococcus aureus subsp. aureus N315
uguacaucauuaaa

SEQ ID NO: 2135987 - RNA, 15 nt, Staphylococcus aureus subsp. aureus N315
uguaauugaaaugau

SEQ ID NO: 2135988 - RNA, 22 nt, Staphylococcus aureus subsp. aureus N315
uguaauuuaaaauaguucuuua

SEQ ID NO: 2135989 - RNA, 18 nt, Staphylococcus aureus subsp. aureus N315
uguaauuguuuuuucuua

SEQ ID NO: 2135990 - RNA, 12 nt, Staphylococcus aureus subsp. aureus N315
uguaauuuaaaa

SEQ ID NO: 2135991 - RNA, 14 nt, Staphylococcus aureus subsp. aureus N315
ugguugaaauuaau

SEQ ID NO: 2135992 - RNA, 19 nt, Staphylococcus aureus subsp. aureus N315
ugguucaucaaacaacauc

SEQ ID NO: 2135993 - RNA, 11 nt, Staphylococcus aureus subsp. aureus N315
ugguucccaau

SEQ ID NO: 2135994 - RNA, 19 nt, Staphylococcus aureus subsp. aureus N315
ugguugauucgauaugaau

SEQ ID NO: 2135995 - RNA, 22 nt, Staphylococcus aureus subsp. aureus N315
ugguuguuuaucacuuuucaug

SEQ ID NO: 2135996 - RNA, 20 nt, Staphylococcus aureus subsp. aureus N315
ugguuucuuaacauaaaaug

SEQ ID NO: 2135997 - RNA, 23 nt, Staphylococcus aureus subsp. aureus N315
uguaaaugaaaguaccuaaaaua

SEQ ID NO: 2135998 - RNA, 14 nt, Staphylococcus aureus subsp. aureus N315
uguaaauaugaacu

SEQ ID NO: 2135999 - RNA, 19 nt, Staphylococcus aureus subsp. aureus N315
uguaaauauaguaauaaaa

SEQ ID NO: 2136000 - RNA, 14 nt, Staphylococcus aureus subsp. aureus N315
uguaaauauaaaua

SEQ ID NO: 2136001 - RNA, 16 nt, Staphylococcus aureus subsp. aureus N315
uguaaauauaaauaug

SEQ ID NO: 2136002 - RNA, 14 nt, Staphylococcus aureus subsp. aureus N315
uguaaauaaaaauu

SEQ ID NO: 2136003 - RNA, 15 nt, Staphylococcus aureus subsp. aureus N315
uguaaauaacaguua

SEQ ID NO: 2136004 - RNA, 19 nt, Staphylococcus aureus subsp. aureus N315
uguaaauaacaguuaauua

SEQ ID NO: 2136005 - RNA, 16 nt, Staphylococcus aureus subsp. aureus N315
uguaaauaguuaguuu

SEQ ID NO: 2136006 - RNA, 22 nt, Staphylococcus aureus subsp. aureus N315
uguaaagcuuuaguuaaauagu

SEQ ID NO: 2136007 - RNA, 20 nt, Staphylococcus aureus subsp. aureus N315
uguaaagcuuuaguuaaaua

SEQ ID NO: 2136008 - RNA, 15 nt, Staphylococcus aureus subsp. aureus N315
uguaaaguugauaau

SEQ ID NO: 2136009 - RNA, 12 nt, Staphylococcus aureus subsp. aureus N315
ugguuuuacugc

SEQ ID NO: 2136010 - RNA, 22 nt, Staphylococcus aureus subsp. aureus N315
ugguuugcuuuaaaauucucua

SEQ ID NO: 2136011 - RNA, 17 nt, Staphylococcus aureus subsp. aureus N315
uguaaagccaccuaaau

SEQ ID NO: 2136012 - RNA, 14 nt, Staphylococcus aureus subsp. aureus N315
ugccggucauaaca

SEQ ID NO: 2136013 - RNA, 14 nt, Staphylococcus aureus subsp. aureus N315
ugcgaauaauaaua

SEQ ID NO: 2136014 - RNA, 20 nt, Staphylococcus aureus subsp. aureus N315
ugccuuuuuguaauuguaau

SEQ ID NO: 2136015 - RNA, 22 nt, Staphylococcus aureus subsp. aureus N315
ugcgaacucguuauagauaagu

SEQ ID NO: 2136016 - RNA, 23 nt, Staphylococcus aureus subsp. aureus N315
ugcgaagaaaccuuuuuucucuu

SEQ ID NO: 2136017 - RNA, 12 nt, Staphylococcus aureus subsp. aureus N315
ugccuuucuaau

SEQ ID NO: 2136018 - RNA, 17 nt, Staphylococcus aureus subsp. aureus N315
ugccuuuuacauuugua

SEQ ID NO: 2136019 - RNA, 16 nt, Staphylococcus aureus subsp. aureus N315
ugccuugucuauugua

SEQ ID NO: 2136020 - RNA, 17 nt, Staphylococcus aureus subsp. aureus N315
ugcucaugagcacaaac

SEQ ID NO: 2136021 - RNA, 14 nt, Staphylococcus aureus subsp. aureus N315
ugcuauuuuggaua

SEQ ID NO: 2136022 - RNA, 13 nt, Staphylococcus aureus subsp. aureus N315
ugcuagugcucuu

SEQ ID NO: 2136023 - RNA, 19 nt, Staphylococcus aureus subsp. aureus N315
ugcuagcuuucuuuuucau

SEQ ID NO: 2136024 - RNA, 18 nt, Staphylococcus aureus subsp. aureus N315
ugcuauccuugcuaucaa

SEQ ID NO: 2136025 - RNA, 17 nt, Staphylococcus aureus subsp. aureus N315
ugcuacaauuuccuacc

SEQ ID NO: 2136026 - RNA, 15 nt, Staphylococcus aureus subsp. aureus N315
ugcuaauuuauaaac

SEQ ID NO: 2136027 - RNA, 20 nt, Staphylococcus aureus subsp. aureus N315
ugcuaaucuucucauaaaau

SEQ ID NO: 2136028 - RNA, 20 nt, Staphylococcus aureus subsp. aureus N315
ugcuacagcacgagacaaua

SEQ ID NO: 2136029 - RNA, 23 nt, Staphylococcus aureus subsp. aureus N315
ugcuaaaaaaauuaaaauguuaa

SEQ ID NO: 2136030 - RNA, 16 nt, Staphylococcus aureus subsp. aureus N315
ugcuaaaaauauugaa

SEQ ID NO: 2136031 - RNA, 16 nt, Staphylococcus aureus subsp. aureus N315
ugcuaaaauaucaaaa

SEQ ID NO: 2136032 - RNA, 16 nt, Staphylococcus aureus subsp. aureus N315
ugcgcuuuuaauuuuu

SEQ ID NO: 2136033 - RNA, 14 nt, Staphylococcus aureus subsp. aureus N315
ugcguuuaauuuac

SEQ ID NO: 2136034 - RNA, 16 nt, Staphylococcus aureus subsp. aureus N315
ugcguugguauucauc

SEQ ID NO: 2136035 - RNA, 14 nt, Staphylococcus aureus subsp. aureus N315
ugcgucguuuauua

SEQ ID NO: 2136036 - RNA, 17 nt, Staphylococcus aureus subsp. aureus N315
ugcgguuuaaucuauau

SEQ ID NO: 2136037 - RNA, 14 nt, Staphylococcus aureus subsp. aureus N315
uggaauuucauaua

SEQ ID NO: 2136038 - RNA, 11 nt, Staphylococcus aureus subsp. aureus N315
uggaaugacua

SEQ ID NO: 2136039 - RNA, 19 nt, Staphylococcus aureus subsp. aureus N315
uggaauacuugucaaaauu

SEQ ID NO: 2136040 - RNA, 23 nt, Staphylococcus aureus subsp. aureus N315
uggaauacucuucaaucuaccaa

SEQ ID NO: 2136041 - RNA, 21 nt, Staphylococcus aureus subsp. aureus N315
uggaauaccuaaccauaacaa

SEQ ID NO: 2136042 - RNA, 19 nt, Staphylococcus aureus subsp. aureus N315
uggacauuguaaaaugcuc

SEQ ID NO: 2136043 - RNA, 21 nt, Staphylococcus aureus subsp. aureus N315
uggacauauacucuaaaaaag

SEQ ID NO: 2136044 - RNA, 18 nt, Staphylococcus aureus subsp. aureus N315
uggacauuguaaaaugcu

SEQ ID NO: 2136045 - RNA, 22 nt, Staphylococcus aureus subsp. aureus N315
uggacaaucuuaucauaaucuu

SEQ ID NO: 2136046 - RNA, 20 nt, Staphylococcus aureus subsp. aureus N315
uggaagaaugccuuuuauuu

SEQ ID NO: 2136047 - RNA, 23 nt, Staphylococcus aureus subsp. aureus N315
uggaaauuuauuauaaaauagaa

SEQ ID NO: 2136048 - RNA, 22 nt, Staphylococcus aureus subsp. aureus N315
uggaaauuuauuauaaaauaga

SEQ ID NO: 2136049 - RNA, 15 nt, Staphylococcus aureus subsp. aureus N315
uggaaauuuauuaua

SEQ ID NO: 2136050 - RNA, 18 nt, Staphylococcus aureus subsp. aureus N315
uggaaauuuauuauaaaa

SEQ ID NO: 2136051 - RNA, 23 nt, Staphylococcus aureus subsp. aureus N315
uggaaagacguuuuuuuauaaau

SEQ ID NO: 2136052 - RNA, 16 nt, Staphylococcus aureus subsp. aureus N315
uggaaaguaauaagua

SEQ ID NO: 2136053 - RNA, 22 nt, Staphylococcus aureus subsp. aureus N315
uggaaaguaauaaguaauaauu

SEQ ID NO: 2136054 - RNA, 15 nt, Staphylococcus aureus subsp. aureus N315
uggaaagucagcuua

SEQ ID NO: 2136055 - RNA, 22 nt, Staphylococcus aureus subsp. aureus N315
ugcuuuuuuauucuaauacaaa

SEQ ID NO: 2136056 - RNA, 18 nt, Staphylococcus aureus subsp. aureus N315
uggaaaaggucaaaaaau

SEQ ID NO: 2136057 - RNA, 18 nt, Staphylococcus aureus subsp. aureus N315
uggaaaauuacaauaagg

SEQ ID NO: 2136058 - RNA, 17 nt, Staphylococcus aureus subsp. aureus N315
ugcuuuuucaaaaucuu

SEQ ID NO: 2136059 - RNA, 13 nt, Staphylococcus aureus subsp. aureus N315
ugcuuuuaauauu

SEQ ID NO: 2136060 - RNA, 22 nt, Staphylococcus aureus subsp. aureus N315
ugcuuuuaaauguauuuuuacu

SEQ ID NO: 2136061 - RNA, 12 nt, Staphylococcus aureus subsp. aureus N315
ugcuuuaauaaa

SEQ ID NO: 2136062 - RNA, 13 nt, Staphylococcus aureus subsp. aureus N315
ugcuuuaauaaau

SEQ ID NO: 2136063 - RNA, 14 nt, Staphylococcus aureus subsp. aureus N315
ugcuuuaauaaauc

SEQ ID NO: 2136064 - RNA, 20 nt, Staphylococcus aureus subsp. aureus N315
ugcuuuaauauaauuauuaa

SEQ ID NO: 2136065 - RNA, 12 nt, Staphylococcus aureus subsp. aureus N315
ugcuuuaaaucg

SEQ ID NO: 2136066 - RNA, 14 nt, Staphylococcus aureus subsp. aureus N315
ugcuuguuuuaaau

SEQ ID NO: 2136067 - RNA, 16 nt, Staphylococcus aureus subsp. aureus N315
ugcuuuaauuaaaguu

SEQ ID NO: 2136068 - RNA, 17 nt, Staphylococcus aureus subsp. aureus N315
ugcuuuagcucuuuuuu

SEQ ID NO: 2136069 - RNA, 15 nt, Staphylococcus aureus subsp. aureus N315
ugcuuuauuuuauca

SEQ ID NO: 2136070 - RNA, 13 nt, Staphylococcus aureus subsp. aureus N315
ugcuuguaacaag

SEQ ID NO: 2136071 - RNA, 17 nt, Staphylococcus aureus subsp. aureus N315
ugcuuguccucuaaaac

SEQ ID NO: 2136072 - RNA, 24 nt, Staphylococcus aureus subsp. aureus N315
ugcuucuacccuugcaaauauauc

SEQ ID NO: 2136073 - RNA, 21 nt, Staphylococcus aureus subsp. aureus N315
ugcuucguuuuuaguguuaau

SEQ ID NO: 2136074 - RNA, 15 nt, Staphylococcus aureus subsp. aureus N315
ugcuucgucauuagg

SEQ ID NO: 2136075 - RNA, 15 nt, Staphylococcus aureus subsp. aureus N315
ugcuucgaauuuaac

SEQ ID NO: 2136076 - RNA, 21 nt, Staphylococcus aureus subsp. aureus N315
ugcuucuucagguguuuuacc

SEQ ID NO: 2136077 - RNA, 12 nt, Staphylococcus aureus subsp. aureus N315
ugcuucuuauca

SEQ ID NO: 2136078 - RNA, 13 nt, Staphylococcus aureus subsp. aureus N315
ugcuucugcugua

SEQ ID NO: 2136079 - RNA, 17 nt, Staphylococcus aureus subsp. aureus N315
ugcuucugguucuucaa

SEQ ID NO: 2136080 - RNA, 17 nt, Staphylococcus aureus subsp. aureus N315
ugcuugaccuucaguuu

SEQ ID NO: 2136081 - RNA, 15 nt, Staphylococcus aureus subsp. aureus N315
ugcuucuuuuaagua

SEQ ID NO: 2136082 - RNA, 16 nt, Staphylococcus aureus subsp. aureus N315
ugcuucacuguuuuau

SEQ ID NO: 2136083 - RNA, 13 nt, Staphylococcus aureus subsp. aureus N315
ugcuucacugaaa

SEQ ID NO: 2136084 - RNA, 18 nt, Staphylococcus aureus subsp. aureus N315
ugcuucaaauguaacauu

SEQ ID NO: 2136085 - RNA, 19 nt, Staphylococcus aureus subsp. aureus N315
ugcuuauuuuuguauucuu

SEQ ID NO: 2136086 - RNA, 12 nt, Staphylococcus aureus subsp. aureus N315
ugcuucaacuac

SEQ ID NO: 2136087 - RNA, 13 nt, Staphylococcus aureus subsp. aureus N315
ugcuucaaagccu

SEQ ID NO: 2136088 - RNA, 22 nt, Staphylococcus aureus subsp. aureus N315
ugcuucaaauguaacauuaaaa

SEQ ID NO: 2136089 - RNA, 13 nt, Staphylococcus aureus subsp. aureus N315
ugcuuaucuguaa

SEQ ID NO: 2136090 - RNA, 15 nt, Staphylococcus aureus subsp. aureus N315
ugcuuaucaacagcu

SEQ ID NO: 2136091 - RNA, 15 nt, Staphylococcus aureus subsp. aureus N315
ugcuuacuuuuaaaa

SEQ ID NO: 2136092 - RNA, 16 nt, Staphylococcus aureus subsp. aureus N315
ugcuuauguuuuuaac

SEQ ID NO: 2136093 - RNA, 17 nt, Staphylococcus aureus subsp. aureus N315
ugcuuauuuguuuauua

SEQ ID NO: 2136094 - RNA, 12 nt, Staphylococcus aureus subsp. aureus N315
ugcuuacaauaa

SEQ ID NO: 2136095 - RNA, 14 nt, Staphylococcus aureus subsp. aureus N315
ugcuuaguacacgu

SEQ ID NO: 2136096 - RNA, 18 nt, Staphylococcus aureus subsp. aureus N315
ugcuuaauuuguuuuaaa

SEQ ID NO: 2136097 - RNA, 18 nt, Staphylococcus aureus subsp. aureus N315
ugcuguuuuuauuauaau

SEQ ID NO: 2136098 - RNA, 14 nt, Staphylococcus aureus subsp. aureus N315
ugcuguuacuucuc

SEQ ID NO: 2136099 - RNA, 19 nt, Staphylococcus aureus subsp. aureus N315
ugcuguugcaauaaaauca

SEQ ID NO: 2136100 - RNA, 13 nt, Staphylococcus aureus subsp. aureus N315
ugcuguucuuuuu

SEQ ID NO: 2136101 - RNA, 17 nt, Staphylococcus aureus subsp. aureus N315
aaaugucguauauguaa

SEQ ID NO: 2136102 - RNA, 21 nt, Staphylococcus aureus subsp. aureus N315
aaauguccgacuugauaaaaa

SEQ ID NO: 2136103 - RNA, 14 nt, Staphylococcus aureus subsp. aureus N315
aaaugucauaguau

SEQ ID NO: 2136104 - RNA, 15 nt, Staphylococcus aureus subsp. aureus N315
ugcugguaacucuuc

SEQ ID NO: 2136105 - RNA, 23 nt, Staphylococcus aureus subsp. aureus N315
ugcuguacguuuaauaccuauga

SEQ ID NO: 2136106 - RNA, 18 nt, Staphylococcus aureus subsp. aureus N315
ugcuguacuauauucaau

SEQ ID NO: 2136107 - RNA, 19 nt, Staphylococcus aureus subsp. aureus N315
ugcugucaaacaacaauca

SEQ ID NO: 2136108 - RNA, 12 nt, Staphylococcus aureus subsp. aureus N315
ugcuguaucuuc

SEQ ID NO: 2136109 - RNA, 12 nt, Staphylococcus aureus subsp. aureus N315
aaauguagauua

SEQ ID NO: 2136110 - RNA, 15 nt, Staphylococcus aureus subsp. aureus N315
aaauguaacauuaaa

SEQ ID NO: 2136111 - RNA, 19 nt, Staphylococcus aureus subsp. aureus N315
aaauguaaauaaaaauuau

SEQ ID NO: 2136112 - RNA, 19 nt, Staphylococcus aureus subsp. aureus N315
aaaugucaguuuugaagaa

SEQ ID NO: 2136113 - RNA, 15 nt, Staphylococcus aureus subsp. aureus N315
aaauguauuuuuacu

SEQ ID NO: 2136114 - RNA, 19 nt, Staphylococcus aureus subsp. aureus N315
ugcugccaaauauaauuuc

SEQ ID NO: 2136115 - RNA, 19 nt, Staphylococcus aureus subsp. aureus N315
ugcugauaccuaagcugau

SEQ ID NO: 2136116 - RNA, 20 nt, Staphylococcus aureus subsp. aureus N315
ugcucuauuuacggcauaau

SEQ ID NO: 2136117 - RNA, 14 nt, Staphylococcus aureus subsp. aureus N315
ugcucuacaaaguu

SEQ ID NO: 2136118 - RNA, 13 nt, Staphylococcus aureus subsp. aureus N315
ugcucuaagcauu

SEQ ID NO: 2136119 - RNA, 17 nt, Staphylococcus aureus subsp. aureus N315
ugcucuaauucaaugau

SEQ ID NO: 2136120 - RNA, 20 nt, Staphylococcus aureus subsp. aureus N315
ugcucuaauccaaaauaauc

SEQ ID NO: 2136121 - RNA, 22 nt, Staphylococcus aureus subsp. aureus N315
ugcucuaaacuucuauuaauaa

SEQ ID NO: 2136122 - RNA, 22 nt, Staphylococcus aureus subsp. aureus N315
ugaaaaucuuuaacucuugaaa

SEQ ID NO: 2136123 - RNA, 20 nt, Staphylococcus aureus subsp. aureus N315
ugaaaauuuguauaaagauu

SEQ ID NO: 2136124 - RNA, 22 nt, Staphylococcus aureus subsp. aureus N315
ugaaaauuucaccgcuuucaau

SEQ ID NO: 2136125 - RNA, 23 nt, Staphylococcus aureus subsp. aureus N315
ugaaaaucuaauccugguauaau

SEQ ID NO: 2136126 - RNA, 16 nt, Staphylococcus aureus subsp. aureus N315
ugaaaauagccauauu

SEQ ID NO: 2136127 - RNA, 18 nt, Staphylococcus aureus subsp. aureus N315
ugaaaauaccaagugcuu

SEQ ID NO: 2136128 - RNA, 17 nt, Staphylococcus aureus subsp. aureus N315
ugaaaucauuuaaauua

SEQ ID NO: 2136129 - RNA, 19 nt, Staphylococcus aureus subsp. aureus N315
ugaaauaauauaaaaacaa

SEQ ID NO: 2136130 - RNA, 23 nt, Staphylococcus aureus subsp. aureus N315
ugaaaggaguauuuuugcguuaa

SEQ ID NO: 2136131 - RNA, 18 nt, Staphylococcus aureus subsp. aureus N315
ugaaacugaguucaauua

SEQ ID NO: 2136132 - RNA, 22 nt, Staphylococcus aureus subsp. aureus N315
ugaaacugauugggcugauaau

SEQ ID NO: 2136133 - RNA, 21 nt, Staphylococcus aureus subsp. aureus N315
ugaaagcaucuugcaagccau

SEQ ID NO: 2136134 - RNA, 15 nt, Staphylococcus aureus subsp. aureus N315
ugaaaaauuaaaaaa

SEQ ID NO: 2136135 - RNA, 23 nt, Staphylococcus aureus subsp. aureus N315
ugaaaaauauccuggaauauuaa

SEQ ID NO: 2136136 - RNA, 14 nt, Staphylococcus aureus subsp. aureus N315
ugaaaacauuauua

SEQ ID NO: 2136137 - RNA, 12 nt, Staphylococcus aureus subsp. aureus N315
ugaaaauaauac

SEQ ID NO: 2136138 - RNA, 13 nt, Staphylococcus aureus subsp. aureus N315
ugaaaauaaucuu

SEQ ID NO: 2136139 - RNA, 23 nt, Staphylococcus aureus subsp. aureus N315
ugaaaauaagcuuguaacaagca

SEQ ID NO: 2136140 - RNA, 17 nt, Staphylococcus aureus subsp. aureus N315
ugaaaaguaauuaaaua

SEQ ID NO: 2136141 - RNA, 15 nt, Staphylococcus aureus subsp. aureus N315
ugaaaaguaaauuga

SEQ ID NO: 2136142 - RNA, 11 nt, Staphylococcus aureus subsp. aureus N315
ugaaaacuucu

SEQ ID NO: 2136143 - RNA, 12 nt, Staphylococcus aureus subsp. aureus N315
ugaaaacuucuc

SEQ ID NO: 2136144 - RNA, 13 nt, Staphylococcus aureus subsp. aureus N315
ugaaaagauaaac

SEQ ID NO: 2136145 - RNA, 20 nt, Staphylococcus aureus subsp. aureus N315
ugaaaaggacuuaguagauu

SEQ ID NO: 2136146 - RNA, 15 nt, Staphylococcus aureus subsp. aureus N315
ugaaaagaauaaguu

SEQ ID NO: 2136147 - RNA, 18 nt, Staphylococcus aureus subsp. aureus N315
ugaaaaaacgagcuggug

SEQ ID NO: 2136148 - RNA, 18 nt, Staphylococcus aureus subsp. aureus N315
ucuuuuuugcuguauaua

SEQ ID NO: 2136149 - RNA, 22 nt, Staphylococcus aureus subsp. aureus N315
ucuuuuuuuaauguguaaauuu

SEQ ID NO: 2136150 - RNA, 16 nt, Staphylococcus aureus subsp. aureus N315
ucuuuuuuacuaaaau

SEQ ID NO: 2136151 - RNA, 18 nt, Staphylococcus aureus subsp. aureus N315
ucuuuuuuacuaaaauca

SEQ ID NO: 2136152 - RNA, 12 nt, Staphylococcus aureus subsp. aureus N315
ucuuuuuuauua

SEQ ID NO: 2136153 - RNA, 19 nt, Staphylococcus aureus subsp. aureus N315
ucuuuuuuauuaaguauau

SEQ ID NO: 2136154 - RNA, 15 nt, Staphylococcus aureus subsp. aureus N315
ucuuuuuuauuuaau

SEQ ID NO: 2136155 - RNA, 17 nt, Staphylococcus aureus subsp. aureus N315
ucuuuuuuauuuaauua

SEQ ID NO: 2136156 - RNA, 15 nt, Staphylococcus aureus subsp. aureus N315
ugaaaaacuucuuaa

SEQ ID NO: 2136157 - RNA, 22 nt, Staphylococcus aureus subsp. aureus N315
ugaaaaaauaacuguaaaacau

SEQ ID NO: 2136158 - RNA, 14 nt, Staphylococcus aureus subsp. aureus N315
ugaaaaaauaacug

SEQ ID NO: 2136159 - RNA, 17 nt, Staphylococcus aureus subsp. aureus N315
ugaaaaaguuucggaaa

SEQ ID NO: 2136160 - RNA, 17 nt, Staphylococcus aureus subsp. aureus N315
ugaaaaagcuaauucuu

SEQ ID NO: 2136161 - RNA, 19 nt, Staphylococcus aureus subsp. aureus N315
ugaagaauacaaauauuaa

SEQ ID NO: 2136162 - RNA, 24 nt, Staphylococcus aureus subsp. aureus N315
ugaaggccauuuuuauuuaacacu

SEQ ID NO: 2136163 - RNA, 17 nt, Staphylococcus aureus subsp. aureus N315
ugaauaaaauauaucuu

SEQ ID NO: 2136164 - RNA, 14 nt, Staphylococcus aureus subsp. aureus N315
ugaauaaaauauau

SEQ ID NO: 2136165 - RNA, 13 nt, Staphylococcus aureus subsp. aureus N315
ugaauaaauaacu

SEQ ID NO: 2136166 - RNA, 23 nt, Staphylococcus aureus subsp. aureus N315
ugaagucuguuuagaagaaacuu

SEQ ID NO: 2136167 - RNA, 22 nt, Staphylococcus aureus subsp. aureus N315
ugaacuaaaacgauaauaauaa

SEQ ID NO: 2136168 - RNA, 13 nt, Staphylococcus aureus subsp. aureus N315
ugaacuaaauuga

SEQ ID NO: 2136169 - RNA, 14 nt, Staphylococcus aureus subsp. aureus N315
ugaacuauuaaaac

SEQ ID NO: 2136170 - RNA, 19 nt, Staphylococcus aureus subsp. aureus N315
ugaacuauuaaaaccaaaa

SEQ ID NO: 2136171 - RNA, 11 nt, Staphylococcus aureus subsp. aureus N315
ugaacuaaaac

SEQ ID NO: 2136172 - RNA, 22 nt, Staphylococcus aureus subsp. aureus N315
ugaaaugaaguauggaaguugu

SEQ ID NO: 2136173 - RNA, 15 nt, Staphylococcus aureus subsp. aureus N315
ugaaaugaaguuuuu

SEQ ID NO: 2136174 - RNA, 19 nt, Staphylococcus aureus subsp. aureus N315
ugaaaucuauugugauaua

SEQ ID NO: 2136175 - RNA, 17 nt, Staphylococcus aureus subsp. aureus N315
ugaacaguuagugcuug

SEQ ID NO: 2136176 - RNA, 21 nt, Staphylococcus aureus subsp. aureus N315
ugaacauaccugcauaugugu

SEQ ID NO: 2136177 - RNA, 13 nt, Staphylococcus aureus subsp. aureus N315
ugaacauaaaaaa

SEQ ID NO: 2136178 - RNA, 17 nt, Staphylococcus aureus subsp. aureus N315
ugaaccccauucacuac

SEQ ID NO: 2136179 - RNA, 22 nt, Staphylococcus aureus subsp. aureus N315
ucuuuuuauuuauaacuuuaaa

SEQ ID NO: 2136180 - RNA, 13 nt, Staphylococcus aureus subsp. aureus N315
ucuuuuucuaaau

SEQ ID NO: 2136181 - RNA, 17 nt, Staphylococcus aureus subsp. aureus N315
ucuuuuucuaaauaaac

SEQ ID NO: 2136182 - RNA, 19 nt, Staphylococcus aureus subsp. aureus N315
ucuuuuugaucaacuauau

SEQ ID NO: 2136183 - RNA, 18 nt, Staphylococcus aureus subsp. aureus N315
ucuuuuugcguuuuuaaa

SEQ ID NO: 2136184 - RNA, 21 nt, Staphylococcus aureus subsp. aureus N315
ucuuuuugcguuuuuaaauaa

SEQ ID NO: 2136185 - RNA, 23 nt, Staphylococcus aureus subsp. aureus N315
ucuuuuuuaagcuuaucaacgau

SEQ ID NO: 2136186 - RNA, 11 nt, Staphylococcus aureus subsp. aureus N315
ucuuuuuguuu

SEQ ID NO: 2136187 - RNA, 23 nt, Staphylococcus aureus subsp. aureus N315
ucuuuugcaaauuggaaaaauaa

SEQ ID NO: 2136188 - RNA, 15 nt, Staphylococcus aureus subsp. aureus N315
ucuuuuguuuuuaua

SEQ ID NO: 2136189 - RNA, 14 nt, Staphylococcus aureus subsp. aureus N315
ucuuuuguaauaau

SEQ ID NO: 2136190 - RNA, 15 nt, Staphylococcus aureus subsp. aureus N315
ucuuugucaucuuuu

SEQ ID NO: 2136191 - RNA, 17 nt, Staphylococcus aureus subsp. aureus N315
ucuuuggucuaaagcuu

SEQ ID NO: 2136192 - RNA, 22 nt, Staphylococcus aureus subsp. aureus N315
ucuuuggucuaaagcuuauuaa

SEQ ID NO: 2136193 - RNA, 18 nt, Staphylococcus aureus subsp. aureus N315
ucuuuggucuaaagcuua

SEQ ID NO: 2136194 - RNA, 17 nt, Staphylococcus aureus subsp. aureus N315
ucuuuguauaccuauuc

SEQ ID NO: 2136195 - RNA, 14 nt, Staphylococcus aureus subsp. aureus N315
ucuuuguaaauuuu

SEQ ID NO: 2136196 - RNA, 18 nt, Staphylococcus aureus subsp. aureus N315
ucuuuguuuuuaauuuuu

SEQ ID NO: 2136197 - RNA, 19 nt, Staphylococcus aureus subsp. aureus N315
ucuuuguuuuuaauuuuua

SEQ ID NO: 2136198 - RNA, 18 nt, Staphylococcus aureus subsp. aureus N315
ucuuuguugcaaugcaua

SEQ ID NO: 2136199 - RNA, 16 nt, Staphylococcus aureus subsp. aureus N315
ucuuuuaaauucuuau

SEQ ID NO: 2136200 - RNA, 18 nt, Staphylococcus aureus subsp. aureus N315
ucuuuuaacccacauuaa

SEQ ID NO: 2136201 - RNA, 22 nt, Staphylococcus aureus subsp. aureus N315
ucuuuuaaauucuuauaaaaua

SEQ ID NO: 2136202 - RNA, 12 nt, Staphylococcus aureus subsp. aureus N315
ucuuuuaauucu

SEQ ID NO: 2136203 - RNA, 13 nt, Staphylococcus aureus subsp. aureus N315
ucuuuuauauuuu

SEQ ID NO: 2136204 - RNA, 22 nt, Staphylococcus aureus subsp. aureus N315
ucuuuuauauuuuuaucaucuu

SEQ ID NO: 2136205 - RNA, 17 nt, Staphylococcus aureus subsp. aureus N315
ucuuuucaaaaauaguc

SEQ ID NO: 2136206 - RNA, 18 nt, Staphylococcus aureus subsp. aureus N315
ucuuuucacgaauaucuu

SEQ ID NO: 2136207 - RNA, 15 nt, Staphylococcus aureus subsp. aureus N315
ucuuuuauuuucaua

SEQ ID NO: 2136208 - RNA, 21 nt, Staphylococcus aureus subsp. aureus N315
ucuuuuauuaugauauacgag

SEQ ID NO: 2136209 - RNA, 13 nt, Staphylococcus aureus subsp. aureus N315
ucuuuucgaaaau

SEQ ID NO: 2136210 - RNA, 20 nt, Staphylococcus aureus subsp. aureus N315
ucuuuucgaaaaucucugua

SEQ ID NO: 2136211 - RNA, 20 nt, Staphylococcus aureus subsp. aureus N315
ucuuuuccaaaacaaaaaua

SEQ ID NO: 2136212 - RNA, 14 nt, Staphylococcus aureus subsp. aureus N315
ucuuucauaaauug

SEQ ID NO: 2136213 - RNA, 20 nt, Staphylococcus aureus subsp. aureus N315
ucuuucauagagguuaaccu

SEQ ID NO: 2136214 - RNA, 18 nt, Staphylococcus aureus subsp. aureus N315
ucuuuccucguauuuuau

SEQ ID NO: 2136215 - RNA, 15 nt, Staphylococcus aureus subsp. aureus N315
ucuuuccucacuaga

SEQ ID NO: 2136216 - RNA, 16 nt, Staphylococcus aureus subsp. aureus N315
ucuuucuaaguuugaa

SEQ ID NO: 2136217 - RNA, 17 nt, Staphylococcus aureus subsp. aureus N315
ucuuucuaaaauaacua

SEQ ID NO: 2136218 - RNA, 19 nt, Staphylococcus aureus subsp. aureus N315
ucuuucgagguaauuucac

SEQ ID NO: 2136219 - RNA, 16 nt, Staphylococcus aureus subsp. aureus N315
ucuuucucuauuaauu

SEQ ID NO: 2136220 - RNA, 14 nt, Staphylococcus aureus subsp. aureus N315
ucuuucucuaacau

SEQ ID NO: 2136221 - RNA, 16 nt, Staphylococcus aureus subsp. aureus N315
ucuuucucuaacauuu

SEQ ID NO: 2136222 - RNA, 17 nt, Staphylococcus aureus subsp. aureus N315
ucuuucucuaacauuuu

SEQ ID NO: 2136223 - RNA, 19 nt, Staphylococcus aureus subsp. aureus N315
ucuuucucuaacauuuucu

SEQ ID NO: 2136224 - RNA, 20 nt, Staphylococcus aureus subsp. aureus N315
ucuuucuuguucuaaaauaa

SEQ ID NO: 2136225 - RNA, 19 nt, Staphylococcus aureus subsp. aureus N315
ucuuucuuguucuaaaaua

SEQ ID NO: 2136226 - RNA, 22 nt, Staphylococcus aureus subsp. aureus N315
ucuuucuuagugaaucuucuaa

SEQ ID NO: 2136227 - RNA, 20 nt, Staphylococcus aureus subsp. aureus N315
ucuuucuuagugaaucuucu

SEQ ID NO: 2136228 - RNA, 13 nt, Staphylococcus aureus subsp. aureus N315
ucuuugacaugug

SEQ ID NO: 2136229 - RNA, 19 nt, Staphylococcus aureus subsp. aureus N315
ucuuugaacauauuauaaa

SEQ ID NO: 2136230 - RNA, 21 nt, Staphylococcus aureus subsp. aureus N315
ucuuggacauuguaaaaugcu

SEQ ID NO: 2136231 - RNA, 17 nt, Staphylococcus aureus subsp. aureus N315
ucuuggauguuuucguu

SEQ ID NO: 2136232 - RNA, 15 nt, Staphylococcus aureus subsp. aureus N315
ucuuguaaacuucuu

SEQ ID NO: 2136233 - RNA, 22 nt, Staphylococcus aureus subsp. aureus N315
ucuugucauuugaacaucauuu

SEQ ID NO: 2136234 - RNA, 18 nt, Staphylococcus aureus subsp. aureus N315
ucuuuaaagcuaaauguu

SEQ ID NO: 2136235 - RNA, 17 nt, Staphylococcus aureus subsp. aureus N315
ucuuuaaagucuuuaau

SEQ ID NO: 2136236 - RNA, 16 nt, Staphylococcus aureus subsp. aureus N315
ucuuuaagcuuaaaua

SEQ ID NO: 2136237 - RNA, 17 nt, Staphylococcus aureus subsp. aureus N315
ucuuuaacuuuaauuaa

SEQ ID NO: 2136238 - RNA, 21 nt, Staphylococcus aureus subsp. aureus N315
ucuuguuuagggaaucccaua

SEQ ID NO: 2136239 - RNA, 17 nt, Staphylococcus aureus subsp. aureus N315
ucuuguuucaaacaaag

SEQ ID NO: 2136240 - RNA, 13 nt, Staphylococcus aureus subsp. aureus N315
ucuuguuuuaaau

SEQ ID NO: 2136241 - RNA, 18 nt, Staphylococcus aureus subsp. aureus N315
ucuugugauaauucuuca

SEQ ID NO: 2136242 - RNA, 13 nt, Staphylococcus aureus subsp. aureus N315
ucuugugaaauua

SEQ ID NO: 2136243 - RNA, 14 nt, Staphylococcus aureus subsp. aureus N315
ucuuguauuuccuu

SEQ ID NO: 2136244 - RNA, 14 nt, Staphylococcus aureus subsp. aureus N315
ucuuuauauuuauc

SEQ ID NO: 2136245 - RNA, 15 nt, Staphylococcus aureus subsp. aureus N315
ucuuuauuaauaaau

SEQ ID NO: 2136246 - RNA, 17 nt, Staphylococcus aureus subsp. aureus N315
ucuuuaugauaauuaau

SEQ ID NO: 2136247 - RNA, 13 nt, Staphylococcus aureus subsp. aureus N315
ucuuuauuuacaa

SEQ ID NO: 2136248 - RNA, 23 nt, Staphylococcus aureus subsp. aureus N315
ucuuuauugggagcaaucaauac

SEQ ID NO: 2136249 - RNA, 17 nt, Staphylococcus aureus subsp. aureus N315
ucuuuauuaauaaauuc

SEQ ID NO: 2136250 - RNA, 22 nt, Staphylococcus aureus subsp. aureus N315
ucuuucaauuaauuuaaaugcu

SEQ ID NO: 2136251 - RNA, 15 nt, Staphylococcus aureus subsp. aureus N315
ucuuucaauuaauuu

SEQ ID NO: 2136252 - RNA, 18 nt, Staphylococcus aureus subsp. aureus N315
ucuuucaauuaauuuaaa

SEQ ID NO: 2136253 - RNA, 15 nt, Staphylococcus aureus subsp. aureus N315
ucuuucaaaugcuua

SEQ ID NO: 2136254 - RNA, 18 nt, Staphylococcus aureus subsp. aureus N315
ucuuucaaauacacagau

SEQ ID NO: 2136255 - RNA, 16 nt, Staphylococcus aureus subsp. aureus N315
ucuuuauuuuaaacau

SEQ ID NO: 2136256 - RNA, 13 nt, Staphylococcus aureus subsp. aureus N315
ucuuuauuuaaag

SEQ ID NO: 2136257 - RNA, 21 nt, Staphylococcus aureus subsp. aureus N315
ucuuuauuugauucuucacca

SEQ ID NO: 2136258 - RNA, 18 nt, Staphylococcus aureus subsp. aureus N315
ucuuuauuuuuuaucauu

SEQ ID NO: 2136259 - RNA, 20 nt, Staphylococcus aureus subsp. aureus N315
ucuuuacuuguaauuaauac

SEQ ID NO: 2136260 - RNA, 23 nt, Staphylococcus aureus subsp. aureus N315
ucuuuacuaaagauagcugcuau

SEQ ID NO: 2136261 - RNA, 15 nt, Staphylococcus aureus subsp. aureus N315
ucuuuacuaaagaua

SEQ ID NO: 2136262 - RNA, 18 nt, Staphylococcus aureus subsp. aureus N315
ucuuuagcuauguaaaau

SEQ ID NO: 2136263 - RNA, 13 nt, Staphylococcus aureus subsp. aureus N315
ucuuuauaacuuu

SEQ ID NO: 2136264 - RNA, 19 nt, Staphylococcus aureus subsp. aureus N315
ucuuuauaagcuuuuucuu

SEQ ID NO: 2136265 - RNA, 22 nt, Staphylococcus aureus subsp. aureus N315
ucuuuauaagcuuuuucuuucu

SEQ ID NO: 2136266 - RNA, 22 nt, Staphylococcus aureus subsp. aureus N315
ucuuuauaacgcuuuaauauaa

SEQ ID NO: 2136267 - RNA, 16 nt, Staphylococcus aureus subsp. aureus N315
ucuuuauaaaaaaauc

SEQ ID NO: 2136268 - RNA, 17 nt, Staphylococcus aureus subsp. aureus N315
ucuuuacgauaaacuaa

SEQ ID NO: 2136269 - RNA, 20 nt, Staphylococcus aureus subsp. aureus N315
ucuuuacgauaaacuaaaaa

SEQ ID NO: 2136270 - RNA, 15 nt, Staphylococcus aureus subsp. aureus N315
ucuuuaauuggcaug

SEQ ID NO: 2136271 - RNA, 22 nt, Staphylococcus aureus subsp. aureus N315
ucuugcauacgaauuaaaauaa

SEQ ID NO: 2136272 - RNA, 22 nt, Staphylococcus aureus subsp. aureus N315
ucuugcgccuuguucaauucag

SEQ ID NO: 2136273 - RNA, 22 nt, Staphylococcus aureus subsp. aureus N315
ucuugauuuaaaccaucaauuc

SEQ ID NO: 2136274 - RNA, 16 nt, Staphylococcus aureus subsp. aureus N315
ucuugauaaaauaaau

SEQ ID NO: 2136275 - RNA, 12 nt, Staphylococcus aureus subsp. aureus N315
ucuucuuuuaau

SEQ ID NO: 2136276 - RNA, 22 nt, Staphylococcus aureus subsp. aureus N315
ucuugaaauccguuaaaauuuu

SEQ ID NO: 2136277 - RNA, 21 nt, Staphylococcus aureus subsp. aureus N315
ucuucuuuuuuucuccuuugu

SEQ ID NO: 2136278 - RNA, 15 nt, Staphylococcus aureus subsp. aureus N315
ucuucuuuuuuuaac

SEQ ID NO: 2136279 - RNA, 15 nt, Staphylococcus aureus subsp. aureus N315
ucuugaauaaauuuu

SEQ ID NO: 2136280 - RNA, 18 nt, Staphylococcus aureus subsp. aureus N315
ucuugaaacacaaaaagg

SEQ ID NO: 2136281 - RNA, 19 nt, Staphylococcus aureus subsp. aureus N315
ucuugaaccccauucacua

SEQ ID NO: 2136282 - RNA, 20 nt, Staphylococcus aureus subsp. aureus N315
ucuugagcuguuacacuuuu

SEQ ID NO: 2136283 - RNA, 13 nt, Staphylococcus aureus subsp. aureus N315
ucuugaguacuaa

SEQ ID NO: 2136284 - RNA, 14 nt, Staphylococcus aureus subsp. aureus N315
ucuugagcaauguc

SEQ ID NO: 2136285 - RNA, 14 nt, Staphylococcus aureus subsp. aureus N315
ucuucuaucuuuuc

SEQ ID NO: 2136286 - RNA, 23 nt, Staphylococcus aureus subsp. aureus N315
ucuucucaacaaaucuauaaaua

SEQ ID NO: 2136287 - RNA, 20 nt, Staphylococcus aureus subsp. aureus N315
ucuucuaguaauucuucauc

SEQ ID NO: 2136288 - RNA, 19 nt, Staphylococcus aureus subsp. aureus N315
ucuucuugauuguaaauaa

SEQ ID NO: 2136289 - RNA, 17 nt, Staphylococcus aureus subsp. aureus N315
ucuucugcauagcgcuc

SEQ ID NO: 2136290 - RNA, 16 nt, Staphylococcus aureus subsp. aureus N315
ucuucugcuaacucug

SEQ ID NO: 2136291 - RNA, 19 nt, Staphylococcus aureus subsp. aureus N315
ucuucaguuaaaucuuuaa

SEQ ID NO: 2136292 - RNA, 19 nt, Staphylococcus aureus subsp. aureus N315
ucuucagguguuuuaccuu

SEQ ID NO: 2136293 - RNA, 17 nt, Staphylococcus aureus subsp. aureus N315
ucuucagguguuuuacc

SEQ ID NO: 2136294 - RNA, 16 nt, Staphylococcus aureus subsp. aureus N315
ucuucagguguaguag

SEQ ID NO: 2136295 - RNA, 16 nt, Staphylococcus aureus subsp. aureus N315
ucuucaacaauuucaa

SEQ ID NO: 2136296 - RNA, 20 nt, Staphylococcus aureus subsp. aureus N315
ucuuauuuuguuuuaaaaaa

SEQ ID NO: 2136297 - RNA, 14 nt, Staphylococcus aureus subsp. aureus N315
ucuuauuuuuaugc

SEQ ID NO: 2136298 - RNA, 19 nt, Staphylococcus aureus subsp. aureus N315
ucuuauuuguaauuucagc

SEQ ID NO: 2136299 - RNA, 16 nt, Staphylococcus aureus subsp. aureus N315
ucuuauuuguuuaauu

SEQ ID NO: 2136300 - RNA, 18 nt, Staphylococcus aureus subsp. aureus N315
ucuuauuuguaauuucag

SEQ ID NO: 2136301 - RNA, 13 nt, Staphylococcus aureus subsp. aureus N315
ucuucaucauauu

SEQ ID NO: 2136302 - RNA, 17 nt, Staphylococcus aureus subsp. aureus N315
ucuucauuaucaauaga

SEQ ID NO: 2136303 - RNA, 12 nt, Staphylococcus aureus subsp. aureus N315
ucuucaucuuua

SEQ ID NO: 2136304 - RNA, 14 nt, Staphylococcus aureus subsp. aureus N315
ucuucauuuaaaag

SEQ ID NO: 2136305 - RNA, 19 nt, Staphylococcus aureus subsp. aureus N315
ucuucauugaaaauaaucu

SEQ ID NO: 2136306 - RNA, 22 nt, Staphylococcus aureus subsp. aureus N315
ucuuagauuuucacuaauauuu

SEQ ID NO: 2136307 - RNA, 14 nt, Staphylococcus aureus subsp. aureus N315
ucuuagauauuauu

SEQ ID NO: 2136308 - RNA, 15 nt, Staphylococcus aureus subsp. aureus N315
ucuuauuuauucaua

SEQ ID NO: 2136309 - RNA, 20 nt, Staphylococcus aureus subsp. aureus N315
ucuuacuucguacaucguug

SEQ ID NO: 2136310 - RNA, 19 nt, Staphylococcus aureus subsp. aureus N315
ucuuacugcuguuuuuuau

SEQ ID NO: 2136311 - RNA, 20 nt, Staphylococcus aureus subsp. aureus N315
ucuuacugcuguucucuauu

SEQ ID NO: 2136312 - RNA, 17 nt, Staphylococcus aureus subsp. aureus N315
ucuuacucauuuuucuu

SEQ ID NO: 2136313 - RNA, 18 nt, Staphylococcus aureus subsp. aureus N315
ucuuacugcaauuauuuu

SEQ ID NO: 2136314 - RNA, 21 nt, Staphylococcus aureus subsp. aureus N315
ucuuacugcugcuuuuaauau

SEQ ID NO: 2136315 - RNA, 13 nt, Staphylococcus aureus subsp. aureus N315
ucuuaauucuucu

SEQ ID NO: 2136316 - RNA, 14 nt, Staphylococcus aureus subsp. aureus N315
ucuuaauucuucug

SEQ ID NO: 2136317 - RNA, 17 nt, Staphylococcus aureus subsp. aureus N315
ucuuaaucuaaaaauag

SEQ ID NO: 2136318 - RNA, 13 nt, Staphylococcus aureus subsp. aureus N315
ucuuaauuaucau

SEQ ID NO: 2136319 - RNA, 19 nt, Staphylococcus aureus subsp. aureus N315
ucuuaaucagcuauaaaag

SEQ ID NO: 2136320 - RNA, 14 nt, Staphylococcus aureus subsp. aureus N315
ucugguaaaaaaau

SEQ ID NO: 2136321 - RNA, 16 nt, Staphylococcus aureus subsp. aureus N315
ucuguuugucacuuaa

SEQ ID NO: 2136322 - RNA, 14 nt, Staphylococcus aureus subsp. aureus N315
ucuuaacaacauga

SEQ ID NO: 2136323 - RNA, 16 nt, Staphylococcus aureus subsp. aureus N315
ucuuaacaacaugauu

SEQ ID NO: 2136324 - RNA, 16 nt, Staphylococcus aureus subsp. aureus N315
ucuuaacaacuuuaau

SEQ ID NO: 2136325 - RNA, 18 nt, Staphylococcus aureus subsp. aureus N315
ucuuaacaacuuuaauuu

SEQ ID NO: 2136326 - RNA, 16 nt, Staphylococcus aureus subsp. aureus N315
ucuuaaguacauaaau

SEQ ID NO: 2136327 - RNA, 22 nt, Staphylococcus aureus subsp. aureus N315
ucuuaaaucacuagcuaaugca

SEQ ID NO: 2136328 - RNA, 17 nt, Staphylococcus aureus subsp. aureus N315
ucuuaaaucaacaucau

SEQ ID NO: 2136329 - RNA, 15 nt, Staphylococcus aureus subsp. aureus N315
ucuuaaacauaacau

SEQ ID NO: 2136330 - RNA, 17 nt, Staphylococcus aureus subsp. aureus N315
ucuuaaagauuuuucag

SEQ ID NO: 2136331 - RNA, 19 nt, Staphylococcus aureus subsp. aureus N315
ucuuaaagauuuuucagcu

SEQ ID NO: 2136332 - RNA, 18 nt, Staphylococcus aureus subsp. aureus N315
ucuuaaaauugaauauca

SEQ ID NO: 2136333 - RNA, 22 nt, Staphylococcus aureus subsp. aureus N315
ucugauuucacuucuaaaacua

SEQ ID NO: 2136334 - RNA, 13 nt, Staphylococcus aureus subsp. aureus N315
ucugcaaaaugca

SEQ ID NO: 2136335 - RNA, 13 nt, Staphylococcus aureus subsp. aureus N315
ucugcugcuguug

SEQ ID NO: 2136336 - RNA, 21 nt, Staphylococcus aureus subsp. aureus N315
ucugcuaaucuucucauaaaa

SEQ ID NO: 2136337 - RNA, 14 nt, Staphylococcus aureus subsp. aureus N315
ucugcuacuuguug

SEQ ID NO: 2136338 - RNA, 16 nt, Staphylococcus aureus subsp. aureus N315
ucgcauuuuuuauucc

SEQ ID NO: 2136339 - RNA, 17 nt, Staphylococcus aureus subsp. aureus N315
ucgcaucuccaaaggcc

SEQ ID NO: 2136340 - RNA, 22 nt, Staphylococcus aureus subsp. aureus N315
ucgcaucuguuaacugaauuuc

SEQ ID NO: 2136341 - RNA, 14 nt, Staphylococcus aureus subsp. aureus N315
ucgcauauuuugau

SEQ ID NO: 2136342 - RNA, 14 nt, Staphylococcus aureus subsp. aureus N315
ucucguaauaaugu

SEQ ID NO: 2136343 - RNA, 15 nt, Staphylococcus aureus subsp. aureus N315
ucucuguagauauca

SEQ ID NO: 2136344 - RNA, 14 nt, Staphylococcus aureus subsp. aureus N315
ucucuaguaucuga

SEQ ID NO: 2136345 - RNA, 18 nt, Staphylococcus aureus subsp. aureus N315
ucucuaguaucugauacc

SEQ ID NO: 2136346 - RNA, 13 nt, Staphylococcus aureus subsp. aureus N315
ucucuacuaauau

SEQ ID NO: 2136347 - RNA, 16 nt, Staphylococcus aureus subsp. aureus N315
ucucuacuaauauucu

SEQ ID NO: 2136348 - RNA, 14 nt, Staphylococcus aureus subsp. aureus N315
aaaugcuaaaagua

SEQ ID NO: 2136349 - RNA, 19 nt, Staphylococcus aureus subsp. aureus N315
ucugaaaaaauuaauaauu

SEQ ID NO: 2136350 - RNA, 21 nt, Staphylococcus aureus subsp. aureus N315
ucucuuuguuggggcccacac

SEQ ID NO: 2136351 - RNA, 19 nt, Staphylococcus aureus subsp. aureus N315
ucugaaaugauacauuauu

SEQ ID NO: 2136352 - RNA, 14 nt, Staphylococcus aureus subsp. aureus N315
ucucuuuucacgaa

SEQ ID NO: 2136353 - RNA, 17 nt, Staphylococcus aureus subsp. aureus N315
ucugaaaaacuucuuaa

SEQ ID NO: 2136354 - RNA, 17 nt, Staphylococcus aureus subsp. aureus N315
aaaugcuacaauuuccu

SEQ ID NO: 2136355 - RNA, 12 nt, Staphylococcus aureus subsp. aureus N315
ucugaauuuagg

SEQ ID NO: 2136356 - RNA, 13 nt, Staphylococcus aureus subsp. aureus N315
ucugaauuuaaua

SEQ ID NO: 2136357 - RNA, 13 nt, Staphylococcus aureus subsp. aureus N315
ucugaauuuagga

SEQ ID NO: 2136358 - RNA, 19 nt, Staphylococcus aureus subsp. aureus N315
ucugacaacuuaauagaaa

SEQ ID NO: 2136359 - RNA, 17 nt, Staphylococcus aureus subsp. aureus N315
ucugacuuuuaaaaaac

SEQ ID NO: 2136360 - RNA, 20 nt, Staphylococcus aureus subsp. aureus N315
ucugaugaggcaauauuaaa

SEQ ID NO: 2136361 - RNA, 19 nt, Staphylococcus aureus subsp. aureus N315
ugacauguguuaaaccaac

SEQ ID NO: 2136362 - RNA, 20 nt, Staphylococcus aureus subsp. aureus N315
ugacauuucaucaauaauuu

SEQ ID NO: 2136363 - RNA, 19 nt, Staphylococcus aureus subsp. aureus N315
ugaccaauagcaauugaau

SEQ ID NO: 2136364 - RNA, 18 nt, Staphylococcus aureus subsp. aureus N315
ugacauuugaccaaguau

SEQ ID NO: 2136365 - RNA, 21 nt, Staphylococcus aureus subsp. aureus N315
ugacauuuucaaguuuaaaau

SEQ ID NO: 2136366 - RNA, 14 nt, Staphylococcus aureus subsp. aureus N315
ugaauaaauaacuu

SEQ ID NO: 2136367 - RNA, 15 nt, Staphylococcus aureus subsp. aureus N315
ugacaucuauuucuu

SEQ ID NO: 2136368 - RNA, 22 nt, Staphylococcus aureus subsp. aureus N315
ugaccaccuuuaucuguaacaa

SEQ ID NO: 2136369 - RNA, 14 nt, Staphylococcus aureus subsp. aureus N315
ugacccuugucagu

SEQ ID NO: 2136370 - RNA, 12 nt, Staphylococcus aureus subsp. aureus N315
ugaccucagguu

SEQ ID NO: 2136371 - RNA, 22 nt, Staphylococcus aureus subsp. aureus N315
ugacgauaccuuuaauaauauu

SEQ ID NO: 2136372 - RNA, 17 nt, Staphylococcus aureus subsp. aureus N315
ugacgauuuaauuaaaa

SEQ ID NO: 2136373 - RNA, 15 nt, Staphylococcus aureus subsp. aureus N315
ugagauaaaaucaua

SEQ ID NO: 2136374 - RNA, 23 nt, Staphylococcus aureus subsp. aureus N315
ugagauaaaaucauaugucuuaa

SEQ ID NO: 2136375 - RNA, 13 nt, Staphylococcus aureus subsp. aureus N315
ugagacgcauugc

SEQ ID NO: 2136376 - RNA, 16 nt, Staphylococcus aureus subsp. aureus N315
ugagaaaucuuaaaga

SEQ ID NO: 2136377 - RNA, 21 nt, Staphylococcus aureus subsp. aureus N315
ugacucggggaauuuuuaugc

SEQ ID NO: 2136378 - RNA, 15 nt, Staphylococcus aureus subsp. aureus N315
ugacuuccuuaguca

SEQ ID NO: 2136379 - RNA, 17 nt, Staphylococcus aureus subsp. aureus N315
ugacugagaaaaauauu

SEQ ID NO: 2136380 - RNA, 22 nt, Staphylococcus aureus subsp. aureus N315
ugacuuaauaucauauucaaaa

SEQ ID NO: 2136381 - RNA, 18 nt, Staphylococcus aureus subsp. aureus N315
ugacuuauuuuucaucau

SEQ ID NO: 2136382 - RNA, 14 nt, Staphylococcus aureus subsp. aureus N315
ugacuuauuuuuca

SEQ ID NO: 2136383 - RNA, 15 nt, Staphylococcus aureus subsp. aureus N315
ugacuaauaaaacuu

SEQ ID NO: 2136384 - RNA, 16 nt, Staphylococcus aureus subsp. aureus N315
ugacuagggguuuuua

SEQ ID NO: 2136385 - RNA, 18 nt, Staphylococcus aureus subsp. aureus N315
ugacuagggguuuuuaau

SEQ ID NO: 2136386 - RNA, 12 nt, Staphylococcus aureus subsp. aureus N315
ugacuauuuucc

SEQ ID NO: 2136387 - RNA, 22 nt, Staphylococcus aureus subsp. aureus N315
ugacuauuucgcuuuuuuuauu

SEQ ID NO: 2136388 - RNA, 14 nt, Staphylococcus aureus subsp. aureus N315
ugacguugugucau

SEQ ID NO: 2136389 - RNA, 18 nt, Staphylococcus aureus subsp. aureus N315
ugacguugugucaugcug

SEQ ID NO: 2136390 - RNA, 16 nt, Staphylococcus aureus subsp. aureus N315
ugacgugcuuuuaaau

SEQ ID NO: 2136391 - RNA, 19 nt, Staphylococcus aureus subsp. aureus N315
ugacgugcuuuuaaaugua

SEQ ID NO: 2136392 - RNA, 20 nt, Staphylococcus aureus subsp. aureus N315
ugacgcugguaauauuuuug

SEQ ID NO: 2136393 - RNA, 18 nt, Staphylococcus aureus subsp. aureus N315
ugauaucugacauuucau

SEQ ID NO: 2136394 - RNA, 18 nt, Staphylococcus aureus subsp. aureus N315
ugauauguuuccucuuua

SEQ ID NO: 2136395 - RNA, 18 nt, Staphylococcus aureus subsp. aureus N315
ugauaugugaaaaagcua

SEQ ID NO: 2136396 - RNA, 20 nt, Staphylococcus aureus subsp. aureus N315
ugauaugugaaaaagcuaau

SEQ ID NO: 2136397 - RNA, 14 nt, Staphylococcus aureus subsp. aureus N315
ugaucauaauucag

SEQ ID NO: 2136398 - RNA, 18 nt, Staphylococcus aureus subsp. aureus N315
ugaugaauuguuguacau

SEQ ID NO: 2136399 - RNA, 18 nt, Staphylococcus aureus subsp. aureus N315
ugaucgauuguuuauuag

SEQ ID NO: 2136400 - RNA, 15 nt, Staphylococcus aureus subsp. aureus N315
ugauauaugaaauau

SEQ ID NO: 2136401 - RNA, 15 nt, Staphylococcus aureus subsp. aureus N315
ugauauauucaucuc

SEQ ID NO: 2136402 - RNA, 17 nt, Staphylococcus aureus subsp. aureus N315
ugauauauguaacauaa

SEQ ID NO: 2136403 - RNA, 22 nt, Staphylococcus aureus subsp. aureus N315
ugauauccaaagcuugauuuaa

SEQ ID NO: 2136404 - RNA, 22 nt, Staphylococcus aureus subsp. aureus N315
ugauagugguagccaauaucau

SEQ ID NO: 2136405 - RNA, 12 nt, Staphylococcus aureus subsp. aureus N315
ugauauaaaaag

SEQ ID NO: 2136406 - RNA, 17 nt, Staphylococcus aureus subsp. aureus N315
ugauauauaacaaguac

SEQ ID NO: 2136407 - RNA, 13 nt, Staphylococcus aureus subsp. aureus N315
ugauauauaacca

SEQ ID NO: 2136408 - RNA, 17 nt, Staphylococcus aureus subsp. aureus N315
ugauauacuugaagaaa

SEQ ID NO: 2136409 - RNA, 15 nt, Staphylococcus aureus subsp. aureus N315
ugauaguacauuuau

SEQ ID NO: 2136410 - RNA, 17 nt, Staphylococcus aureus subsp. aureus N315
ugauaguuucuaaucuu

SEQ ID NO: 2136411 - RNA, 22 nt, Staphylococcus aureus subsp. aureus N315
ugauagcuaaacauuuuauacu

SEQ ID NO: 2136412 - RNA, 16 nt, Staphylococcus aureus subsp. aureus N315
ugauagcuaaugcauu

SEQ ID NO: 2136413 - RNA, 17 nt, Staphylococcus aureus subsp. aureus N315
ugauagcaaugaauuaa

SEQ ID NO: 2136414 - RNA, 20 nt, Staphylococcus aureus subsp. aureus N315
ugauagcaaugaauuaauag

SEQ ID NO: 2136415 - RNA, 14 nt, Staphylococcus aureus subsp. aureus N315
ugauaauaaaaguu

SEQ ID NO: 2136416 - RNA, 18 nt, Staphylococcus aureus subsp. aureus N315
ugauacccgcgauacugc

SEQ ID NO: 2136417 - RNA, 18 nt, Staphylococcus aureus subsp. aureus N315
ugauaagucuugauggug

SEQ ID NO: 2136418 - RNA, 16 nt, Staphylococcus aureus subsp. aureus N315
ugauaaguagaaaaua

SEQ ID NO: 2136419 - RNA, 17 nt, Staphylococcus aureus subsp. aureus N315
ugauacgcacguauaua

SEQ ID NO: 2136420 - RNA, 19 nt, Staphylococcus aureus subsp. aureus N315
ugauacgccuaaauauuua

SEQ ID NO: 2136421 - RNA, 15 nt, Staphylococcus aureus subsp. aureus N315
ugauacgcuuuuuaa

SEQ ID NO: 2136422 - RNA, 16 nt, Staphylococcus aureus subsp. aureus N315
ugauacgcuuuuuaaa

SEQ ID NO: 2136423 - RNA, 18 nt, Staphylococcus aureus subsp. aureus N315
ugauacgugguuuuauuu

SEQ ID NO: 2136424 - RNA, 22 nt, Staphylococcus aureus subsp. aureus N315
ugaguguguccaucauuugugu

SEQ ID NO: 2136425 - RNA, 23 nt, Staphylococcus aureus subsp. aureus N315
ugagugguuuucuuuauuuuaaa

SEQ ID NO: 2136426 - RNA, 15 nt, Staphylococcus aureus subsp. aureus N315
ugauaaagagccacu

SEQ ID NO: 2136427 - RNA, 18 nt, Staphylococcus aureus subsp. aureus N315
ugaguuuuuuaaaauaau

SEQ ID NO: 2136428 - RNA, 23 nt, Staphylococcus aureus subsp. aureus N315
ugagucuuggacauuguaaaaug

SEQ ID NO: 2136429 - RNA, 22 nt, Staphylococcus aureus subsp. aureus N315
ugagucuuggacauuguaaaau

SEQ ID NO: 2136430 - RNA, 15 nt, Staphylococcus aureus subsp. aureus N315
ugagggauuuuuaua

SEQ ID NO: 2136431 - RNA, 19 nt, Staphylococcus aureus subsp. aureus N315
ugaggcguuucagaaguug

SEQ ID NO: 2136432 - RNA, 14 nt, Staphylococcus aureus subsp. aureus N315
ugagggccccaaca

SEQ ID NO: 2136433 - RNA, 19 nt, Staphylococcus aureus subsp. aureus N315
ugagggccccaacacagaa

SEQ ID NO: 2136434 - RNA, 12 nt, Staphylococcus aureus subsp. aureus N315
ugagggccccaa

SEQ ID NO: 2136435 - RNA, 13 nt, Staphylococcus aureus subsp. aureus N315
ugagggccccaac

SEQ ID NO: 2136436 - RNA, 14 nt, Staphylococcus aureus subsp. aureus N315
ugagcaacaaaaga

SEQ ID NO: 2136437 - RNA, 23 nt, Staphylococcus aureus subsp. aureus N315
ugcauugcacuugucucaaauua

SEQ ID NO: 2136438 - RNA, 20 nt, Staphylococcus aureus subsp. aureus N315
ugcauuauuauaauagcuuu

SEQ ID NO: 2136439 - RNA, 22 nt, Staphylococcus aureus subsp. aureus N315
ugcauuacuacuuuauaaauau

SEQ ID NO: 2136440 - RNA, 12 nt, Staphylococcus aureus subsp. aureus N315
ugcaucauucaa

SEQ ID NO: 2136441 - RNA, 17 nt, Staphylococcus aureus subsp. aureus N315
ugccaauggaaguuuuu

SEQ ID NO: 2136442 - RNA, 21 nt, Staphylococcus aureus subsp. aureus N315
ugcauuuagaugauucuuauc

SEQ ID NO: 2136443 - RNA, 22 nt, Staphylococcus aureus subsp. aureus N315
ugcauuuagaugauucuuauca

SEQ ID NO: 2136444 - RNA, 16 nt, Staphylococcus aureus subsp. aureus N315
ugcaucagaccuauga

SEQ ID NO: 2136445 - RNA, 23 nt, Staphylococcus aureus subsp. aureus N315
ugcauagcgcucuggauuuuucu

SEQ ID NO: 2136446 - RNA, 13 nt, Staphylococcus aureus subsp. aureus N315
ugcauaaaaaaag

SEQ ID NO: 2136447 - RNA, 21 nt, Staphylococcus aureus subsp. aureus N315
ugcauaauuaggauuaacaua

SEQ ID NO: 2136448 - RNA, 12 nt, Staphylococcus aureus subsp. aureus N315
ugcacaacaguc

SEQ ID NO: 2136449 - RNA, 15 nt, Staphylococcus aureus subsp. aureus N315
ugcacacauaccuca

SEQ ID NO: 2136450 - RNA, 23 nt, Staphylococcus aureus subsp. aureus N315
ugcacaucauaauaaaucuaucu

SEQ ID NO: 2136451 - RNA, 11 nt, Staphylococcus aureus subsp. aureus N315
ugcacaucaua

SEQ ID NO: 2136452 - RNA, 21 nt, Staphylococcus aureus subsp. aureus N315
ugcacauaaaaaaugugaccu

SEQ ID NO: 2136453 - RNA, 20 nt, Staphylococcus aureus subsp. aureus N315
ugcacuaauggcacuuaaua

SEQ ID NO: 2136454 - RNA, 14 nt, Staphylococcus aureus subsp. aureus N315
ugcacgugagaaac

SEQ ID NO: 2136455 - RNA, 18 nt, Staphylococcus aureus subsp. aureus N315
ugcaccuaaggcuaauga

SEQ ID NO: 2136456 - RNA, 14 nt, Staphylococcus aureus subsp. aureus N315
ugcaccuauaccuc

SEQ ID NO: 2136457 - RNA, 16 nt, Staphylococcus aureus subsp. aureus N315
ugcacugcuaauauua

SEQ ID NO: 2136458 - RNA, 19 nt, Staphylococcus aureus subsp. aureus N315
ugcacuaugcauaauacca

SEQ ID NO: 2136459 - RNA, 20 nt, Staphylococcus aureus subsp. aureus N315
ugcagauugauauaaauuau

SEQ ID NO: 2136460 - RNA, 23 nt, Staphylococcus aureus subsp. aureus N315
ugcagcaacugcauuacgcuguc

SEQ ID NO: 2136461 - RNA, 22 nt, Staphylococcus aureus subsp. aureus N315
ugcaacauuugauaaccaaugc

SEQ ID NO: 2136462 - RNA, 16 nt, Staphylococcus aureus subsp. aureus N315
ugcaaauuaucauuaa

SEQ ID NO: 2136463 - RNA, 16 nt, Staphylococcus aureus subsp. aureus N315
ugcaaaugccucuuuc

SEQ ID NO: 2136464 - RNA, 20 nt, Staphylococcus aureus subsp. aureus N315
ugcaaaucucgucacauaua

SEQ ID NO: 2136465 - RNA, 14 nt, Staphylococcus aureus subsp. aureus N315
ugcaacaauuugca

SEQ ID NO: 2136466 - RNA, 19 nt, Staphylococcus aureus subsp. aureus N315
ugcaacuuauaauauuaaa

SEQ ID NO: 2136467 - RNA, 15 nt, Staphylococcus aureus subsp. aureus N315
ugcaacuuauaauau

SEQ ID NO: 2136468 - RNA, 14 nt, Staphylococcus aureus subsp. aureus N315
ugcaacuuauaaua

SEQ ID NO: 2136469 - RNA, 21 nt, Staphylococcus aureus subsp. aureus N315
ugcaauuauuucaauuaucaa

SEQ ID NO: 2136470 - RNA, 23 nt, Staphylococcus aureus subsp. aureus N315
ugcaauuauuuuucaaauauauc

SEQ ID NO: 2136471 - RNA, 22 nt, Staphylococcus aureus subsp. aureus N315
ugcaauuagaauauauguauaa

SEQ ID NO: 2136472 - RNA, 21 nt, Staphylococcus aureus subsp. aureus N315
ugcaauuuuucacuuauaaca

SEQ ID NO: 2136473 - RNA, 20 nt, Staphylococcus aureus subsp. aureus N315
ugcaaucguauguaacaauu

SEQ ID NO: 2136474 - RNA, 15 nt, Staphylococcus aureus subsp. aureus N315
ugcaaucguugaaaa

SEQ ID NO: 2136475 - RNA, 19 nt, Staphylococcus aureus subsp. aureus N315
ugcaauaacaccaauugaa

SEQ ID NO: 2136476 - RNA, 19 nt, Staphylococcus aureus subsp. aureus N315
ugcaaguuggcggggcccc

SEQ ID NO: 2136477 - RNA, 14 nt, Staphylococcus aureus subsp. aureus N315
ugcaauaauaaaua

SEQ ID NO: 2136478 - RNA, 17 nt, Staphylococcus aureus subsp. aureus N315
ugcaaguaauuuaauug

SEQ ID NO: 2136479 - RNA, 19 nt, Staphylococcus aureus subsp. aureus N315
ugcaaguaauuuaauuggu

SEQ ID NO: 2136480 - RNA, 18 nt, Staphylococcus aureus subsp. aureus N315
ugcaauacaccuauuaca

SEQ ID NO: 2136481 - RNA, 16 nt, Staphylococcus aureus subsp. aureus N315
ugcaauaauucaucuu

SEQ ID NO: 2136482 - RNA, 17 nt, Staphylococcus aureus subsp. aureus N315
ugcaauaggaugaaacu

SEQ ID NO: 2136483 - RNA, 13 nt, Staphylococcus aureus subsp. aureus N315
ugcaauauuauau

SEQ ID NO: 2136484 - RNA, 14 nt, Staphylococcus aureus subsp. aureus N315
ugauuuuaggcaau

SEQ ID NO: 2136485 - RNA, 14 nt, Staphylococcus aureus subsp. aureus N315
ugauuuugaaucac

SEQ ID NO: 2136486 - RNA, 17 nt, Staphylococcus aureus subsp. aureus N315
ugauuuugaauaaaaaa

SEQ ID NO: 2136487 - RNA, 12 nt, Staphylococcus aureus subsp. aureus N315
ugauuuucuuua

SEQ ID NO: 2136488 - RNA, 12 nt, Staphylococcus aureus subsp. aureus N315
ugauuuugcuuu

SEQ ID NO: 2136489 - RNA, 14 nt, Staphylococcus aureus subsp. aureus N315
ugauuuuuaauaau

SEQ ID NO: 2136490 - RNA, 24 nt, Staphylococcus aureus subsp. aureus N315
ugauuuuucaucaauaucaaauuu

SEQ ID NO: 2136491 - RNA, 20 nt, Staphylococcus aureus subsp. aureus N315
ugcaaaaauaauaugaauuu

SEQ ID NO: 2136492 - RNA, 12 nt, Staphylococcus aureus subsp. aureus N315
ugcaaaaauaau

SEQ ID NO: 2136493 - RNA, 18 nt, Staphylococcus aureus subsp. aureus N315
ugcaaaaaaacaaauauu

SEQ ID NO: 2136494 - RNA, 14 nt, Staphylococcus aureus subsp. aureus N315
ugauuuuuuauuca

SEQ ID NO: 2136495 - RNA, 15 nt, Staphylococcus aureus subsp. aureus N315
ugcaaaguaacaaua

SEQ ID NO: 2136496 - RNA, 20 nt, Staphylococcus aureus subsp. aureus N315
ugcaaauacgaguguuuuaa

SEQ ID NO: 2136497 - RNA, 22 nt, Staphylococcus aureus subsp. aureus N315
ugcaaauacgaguguuuuaauc

SEQ ID NO: 2136498 - RNA, 17 nt, Staphylococcus aureus subsp. aureus N315
ugcaaauaaaaaaguua

SEQ ID NO: 2136499 - RNA, 15 nt, Staphylococcus aureus subsp. aureus N315
ugcaaacgauauguu

SEQ ID NO: 2136500 - RNA, 19 nt, Staphylococcus aureus subsp. aureus N315
ugcaaacuugauucaauau

SEQ ID NO: 2136501 - RNA, 13 nt, Staphylococcus aureus subsp. aureus N315
ugcaaaauuaaug

SEQ ID NO: 2136502 - RNA, 18 nt, Staphylococcus aureus subsp. aureus N315
ugcaaaacgcauuucaug

SEQ ID NO: 2136503 - RNA, 21 nt, Staphylococcus aureus subsp. aureus N315
ugauugcauugauuucagcac

SEQ ID NO: 2136504 - RNA, 17 nt, Staphylococcus aureus subsp. aureus N315
ugauugcaaauuaucau

SEQ ID NO: 2136505 - RNA, 18 nt, Staphylococcus aureus subsp. aureus N315
ugauugcaaauuaucauu

SEQ ID NO: 2136506 - RNA, 22 nt, Staphylococcus aureus subsp. aureus N315
ugauugcaaaaaaacaaauauu

SEQ ID NO: 2136507 - RNA, 14 nt, Staphylococcus aureus subsp. aureus N315
ugauucguauucaa

SEQ ID NO: 2136508 - RNA, 12 nt, Staphylococcus aureus subsp. aureus N315
ugauugaacaau

SEQ ID NO: 2136509 - RNA, 17 nt, Staphylococcus aureus subsp. aureus N315
ugauuuagcauacauua

SEQ ID NO: 2136510 - RNA, 14 nt, Staphylococcus aureus subsp. aureus N315
ugauuuacgugcau

SEQ ID NO: 2136511 - RNA, 21 nt, Staphylococcus aureus subsp. aureus N315
ugauuuuaccuguuucuauau

SEQ ID NO: 2136512 - RNA, 14 nt, Staphylococcus aureus subsp. aureus N315
ugauuuuacuugaa

SEQ ID NO: 2136513 - RNA, 12 nt, Staphylococcus aureus subsp. aureus N315
ugauuuaaaaaa

SEQ ID NO: 2136514 - RNA, 17 nt, Staphylococcus aureus subsp. aureus N315
ugauuuaagauuuaaua

SEQ ID NO: 2136515 - RNA, 17 nt, Staphylococcus aureus subsp. aureus N315
ugauuuaauuuuuaaug

SEQ ID NO: 2136516 - RNA, 14 nt, Staphylococcus aureus subsp. aureus N315
ugauuuaauguuaa

SEQ ID NO: 2136517 - RNA, 15 nt, Staphylococcus aureus subsp. aureus N315
ugauuuaauugaaau

SEQ ID NO: 2136518 - RNA, 14 nt, Staphylococcus aureus subsp. aureus N315
ugaugauaaauuga

SEQ ID NO: 2136519 - RNA, 19 nt, Staphylococcus aureus subsp. aureus N315
ugaugauacccgcgauacu

SEQ ID NO: 2136520 - RNA, 21 nt, Staphylococcus aureus subsp. aureus N315
ugaugauuuauaaaaacuuau

SEQ ID NO: 2136521 - RNA, 11 nt, Staphylococcus aureus subsp. aureus N315
ugauucccaaa

SEQ ID NO: 2136522 - RNA, 19 nt, Staphylococcus aureus subsp. aureus N315
ugauucgauaugaauaacc

SEQ ID NO: 2136523 - RNA, 21 nt, Staphylococcus aureus subsp. aureus N315
ucaugugucacaaugaccauu

SEQ ID NO: 2136524 - RNA, 22 nt, Staphylococcus aureus subsp. aureus N315
ucaugugcaagcuuuuuaggaa

SEQ ID NO: 2136525 - RNA, 18 nt, Staphylococcus aureus subsp. aureus N315
ucauguuuggcauaauaa

SEQ ID NO: 2136526 - RNA, 16 nt, Staphylococcus aureus subsp. aureus N315
ucaguugagucaauuu

SEQ ID NO: 2136527 - RNA, 14 nt, Staphylococcus aureus subsp. aureus N315
ucaguuaaaucuuu

SEQ ID NO: 2136528 - RNA, 13 nt, Staphylococcus aureus subsp. aureus N315
ucaguuaaaucuu

SEQ ID NO: 2136529 - RNA, 19 nt, Staphylococcus aureus subsp. aureus N315
ucaguuaaaauaaccauuu

SEQ ID NO: 2136530 - RNA, 17 nt, Staphylococcus aureus subsp. aureus N315
ucauucaccuaaaaaga

SEQ ID NO: 2136531 - RNA, 19 nt, Staphylococcus aureus subsp. aureus N315
ucauucaccuaaaaagaaa

SEQ ID NO: 2136532 - RNA, 11 nt, Staphylococcus aureus subsp. aureus N315
ucauuaucauu

SEQ ID NO: 2136533 - RNA, 21 nt, Staphylococcus aureus subsp. aureus N315
ucauucagucaacuacuguca

SEQ ID NO: 2136534 - RNA, 13 nt, Staphylococcus aureus subsp. aureus N315
ucauucacuguau

SEQ ID NO: 2136535 - RNA, 18 nt, Staphylococcus aureus subsp. aureus N315
ucauuagcgcaagagaua

SEQ ID NO: 2136536 - RNA, 23 nt, Staphylococcus aureus subsp. aureus N315
ucauuaggucuacgaucaaaauc

SEQ ID NO: 2136537 - RNA, 16 nt, Staphylococcus aureus subsp. aureus N315
ucauuagccaaaucuu

SEQ ID NO: 2136538 - RNA, 15 nt, Staphylococcus aureus subsp. aureus N315
ucauuaguguagaaa

SEQ ID NO: 2136539 - RNA, 22 nt, Staphylococcus aureus subsp. aureus N315
ucauuaguugccccuagcaaaa

SEQ ID NO: 2136540 - RNA, 19 nt, Staphylococcus aureus subsp. aureus N315
ucauuuucugcuuucgcuu

SEQ ID NO: 2136541 - RNA, 22 nt, Staphylococcus aureus subsp. aureus N315
ucauuuuuaauuuugacauaaa

SEQ ID NO: 2136542 - RNA, 19 nt, Staphylococcus aureus subsp. aureus N315
uccaaacacaaauaaaggc

SEQ ID NO: 2136543 - RNA, 17 nt, Staphylococcus aureus subsp. aureus N315
ucauuuuuaauuuugac

SEQ ID NO: 2136544 - RNA, 22 nt, Staphylococcus aureus subsp. aureus N315
uccaaauugcaaaguaacaaua

SEQ ID NO: 2136545 - RNA, 21 nt, Staphylococcus aureus subsp. aureus N315
uccaacacccauauaauuugg

SEQ ID NO: 2136546 - RNA, 18 nt, Staphylococcus aureus subsp. aureus N315
ucauuugauuuaaaaagu

SEQ ID NO: 2136547 - RNA, 20 nt, Staphylococcus aureus subsp. aureus N315
ucauuugaacaucauuuaau

SEQ ID NO: 2136548 - RNA, 16 nt, Staphylococcus aureus subsp. aureus N315
ucauuucgauuaauuu

SEQ ID NO: 2136549 - RNA, 16 nt, Staphylococcus aureus subsp. aureus N315
ucauuguauaaaaagu

SEQ ID NO: 2136550 - RNA, 16 nt, Staphylococcus aureus subsp. aureus N315
ucauugaucaacauua

SEQ ID NO: 2136551 - RNA, 14 nt, Staphylococcus aureus subsp. aureus N315
ucauuguauaaaaa

SEQ ID NO: 2136552 - RNA, 15 nt, Staphylococcus aureus subsp. aureus N315
ucauuguaauaauaa

SEQ ID NO: 2136553 - RNA, 22 nt, Staphylococcus aureus subsp. aureus N315
ucauuguguccauaaauauuaa

SEQ ID NO: 2136554 - RNA, 21 nt, Staphylococcus aureus subsp. aureus N315
ucauugugguauuaauuacag

SEQ ID NO: 2136555 - RNA, 13 nt, Staphylococcus aureus subsp. aureus N315
ucauuuaaaauau

SEQ ID NO: 2136556 - RNA, 19 nt, Staphylococcus aureus subsp. aureus N315
ucauuuaaaucaauacuuu

SEQ ID NO: 2136557 - RNA, 14 nt, Staphylococcus aureus subsp. aureus N315
ucauuuaaaauuug

SEQ ID NO: 2136558 - RNA, 13 nt, Staphylococcus aureus subsp. aureus N315
uccacacauuaag

SEQ ID NO: 2136559 - RNA, 13 nt, Staphylococcus aureus subsp. aureus N315
uccacagaauuag

SEQ ID NO: 2136560 - RNA, 18 nt, Staphylococcus aureus subsp. aureus N315
uccaauuaccaaugaaua

SEQ ID NO: 2136561 - RNA, 15 nt, Staphylococcus aureus subsp. aureus N315
uccaauuauguuuau

SEQ ID NO: 2136562 - RNA, 21 nt, Staphylococcus aureus subsp. aureus N315
uccaauuaccaaugaauaaau

SEQ ID NO: 2136563 - RNA, 19 nt, Staphylococcus aureus subsp. aureus N315
uccaauucauuuuauaaau

SEQ ID NO: 2136564 - RNA, 15 nt, Staphylococcus aureus subsp. aureus N315
uccacuucaucuaaa

SEQ ID NO: 2136565 - RNA, 23 nt, Staphylococcus aureus subsp. aureus N315
uccacguuugaccacaacuucuu

SEQ ID NO: 2136566 - RNA, 20 nt, Staphylococcus aureus subsp. aureus N315
uccaaucaucauuaaaucug

SEQ ID NO: 2136567 - RNA, 16 nt, Staphylococcus aureus subsp. aureus N315
uccaaucaucauuaaa

SEQ ID NO: 2136568 - RNA, 11 nt, Staphylococcus aureus subsp. aureus N315
uccaaugaauc

SEQ ID NO: 2136569 - RNA, 15 nt, Staphylococcus aureus subsp. aureus N315
uccaauguauaaaac

SEQ ID NO: 2136570 - RNA, 22 nt, Staphylococcus aureus subsp. aureus N315
uccaaucuauuuuaaacucauc

SEQ ID NO: 2136571 - RNA, 22 nt, Staphylococcus aureus subsp. aureus N315
uccaagcgcuucaggcauaacu

SEQ ID NO: 2136572 - RNA, 23 nt, Staphylococcus aureus subsp. aureus N315
uccaauacuuuuuauauaauucg

SEQ ID NO: 2136573 - RNA, 13 nt, Staphylococcus aureus subsp. aureus N315
uccaauaaauugu

SEQ ID NO: 2136574 - RNA, 19 nt, Staphylococcus aureus subsp. aureus N315
uccaagagaauuaauaauu

SEQ ID NO: 2136575 - RNA, 17 nt, Staphylococcus aureus subsp. aureus N315
uccaagagaauuaauaa

SEQ ID NO: 2136576 - RNA, 20 nt, Staphylococcus aureus subsp. aureus N315
uccaagagaauuaauaauuu

SEQ ID NO: 2136577 - RNA, 19 nt, Staphylococcus aureus subsp. aureus N315
uccaagauuaugacaacau

SEQ ID NO: 2136578 - RNA, 16 nt, Staphylococcus aureus subsp. aureus N315
uccaagagaauuaaua

SEQ ID NO: 2136579 - RNA, 15 nt, Staphylococcus aureus subsp. aureus N315
uccauaggauucuua

SEQ ID NO: 2136580 - RNA, 16 nt, Staphylococcus aureus subsp. aureus N315
uccaguggaaaugaua

SEQ ID NO: 2136581 - RNA, 19 nt, Staphylococcus aureus subsp. aureus N315
uccagcguauauugaaauu

SEQ ID NO: 2136582 - RNA, 20 nt, Staphylococcus aureus subsp. aureus N315
uccagcguauauugaaauua

SEQ ID NO: 2136583 - RNA, 15 nt, Staphylococcus aureus subsp. aureus N315
ucccaacuuaauaac

SEQ ID NO: 2136584 - RNA, 21 nt, Staphylococcus aureus subsp. aureus N315
ucccaaagcgaauuaucuuua

SEQ ID NO: 2136585 - RNA, 20 nt, Staphylococcus aureus subsp. aureus N315
uccauugcacuaugcauaau

SEQ ID NO: 2136586 - RNA, 13 nt, Staphylococcus aureus subsp. aureus N315
uccauugcacuau

SEQ ID NO: 2136587 - RNA, 21 nt, Staphylococcus aureus subsp. aureus N315
uccauugaucuuuuauaauga

SEQ ID NO: 2136588 - RNA, 17 nt, Staphylococcus aureus subsp. aureus N315
uccauucaauguuuaau

SEQ ID NO: 2136589 - RNA, 22 nt, Staphylococcus aureus subsp. aureus N315
uccauucaauguuuaauuuucu

SEQ ID NO: 2136590 - RNA, 11 nt, Staphylococcus aureus subsp. aureus N315
uccauuauugg

SEQ ID NO: 2136591 - RNA, 13 nt, Staphylococcus aureus subsp. aureus N315
uccauuuuaugca

SEQ ID NO: 2136592 - RNA, 21 nt, Staphylococcus aureus subsp. aureus N315
uccaugaguuuacuaaacuuu

SEQ ID NO: 2136593 - RNA, 22 nt, Staphylococcus aureus subsp. aureus N315
uccauuagaacuaagaugugca

SEQ ID NO: 2136594 - RNA, 20 nt, Staphylococcus aureus subsp. aureus N315
uccauucaaaguauauacua

SEQ ID NO: 2136595 - RNA, 14 nt, Staphylococcus aureus subsp. aureus N315
uccgauuuuuuuac

SEQ ID NO: 2136596 - RNA, 15 nt, Staphylococcus aureus subsp. aureus N315
uccgauaucuuuuaa

SEQ ID NO: 2136597 - RNA, 12 nt, Staphylococcus aureus subsp. aureus N315
ucccuuuuuaaa

SEQ ID NO: 2136598 - RNA, 14 nt, Staphylococcus aureus subsp. aureus N315
ucccuuuuuaaaau

SEQ ID NO: 2136599 - RNA, 20 nt, Staphylococcus aureus subsp. aureus N315
uccgaauucuccguuaauuu

SEQ ID NO: 2136600 - RNA, 15 nt, Staphylococcus aureus subsp. aureus N315
aaaucugauucauua

SEQ ID NO: 2136601 - RNA, 21 nt, Staphylococcus aureus subsp. aureus N315
aaaucugcuuuauuuuaucau

SEQ ID NO: 2136602 - RNA, 23 nt, Staphylococcus aureus subsp. aureus N315
aaaucuggcacuuaagcuuuaau

SEQ ID NO: 2136603 - RNA, 22 nt, Staphylococcus aureus subsp. aureus N315
aaaucuguacuucuaauuugca

SEQ ID NO: 2136604 - RNA, 20 nt, Staphylococcus aureus subsp. aureus N315
aaaucugcuugugugucauu

SEQ ID NO: 2136605 - RNA, 14 nt, Staphylococcus aureus subsp. aureus N315
uccgacugcaccuc

SEQ ID NO: 2136606 - RNA, 20 nt, Staphylococcus aureus subsp. aureus N315
aaaucuguuuaaauuuaaaa

SEQ ID NO: 2136607 - RNA, 23 nt, Staphylococcus aureus subsp. aureus N315
aaaucuguuuaaauuuaaaagaa

SEQ ID NO: 2136608 - RNA, 14 nt, Staphylococcus aureus subsp. aureus N315
ucccuuaauaauaa

SEQ ID NO: 2136609 - RNA, 19 nt, Staphylococcus aureus subsp. aureus N315
ucccuucaaaguagacauu

SEQ ID NO: 2136610 - RNA, 19 nt, Staphylococcus aureus subsp. aureus N315
ucccuucaaaguuuucauu

SEQ ID NO: 2136611 - RNA, 14 nt, Staphylococcus aureus subsp. aureus N315
ucccuucaacauag

SEQ ID NO: 2136612 - RNA, 22 nt, Staphylococcus aureus subsp. aureus N315
ucccuuaaauacaauuucuuca

SEQ ID NO: 2136613 - RNA, 12 nt, Staphylococcus aureus subsp. aureus N315
ucccuuaauaau

SEQ ID NO: 2136614 - RNA, 23 nt, Staphylococcus aureus subsp. aureus N315
ucccucuaucaaauuaccauuca

SEQ ID NO: 2136615 - RNA, 12 nt, Staphylococcus aureus subsp. aureus N315
ucccuaugaaau

SEQ ID NO: 2136616 - RNA, 19 nt, Staphylococcus aureus subsp. aureus N315
ucccuaggaaauaaaaaau

SEQ ID NO: 2136617 - RNA, 16 nt, Staphylococcus aureus subsp. aureus N315
ucccuacugcaccgau

SEQ ID NO: 2136618 - RNA, 22 nt, Staphylococcus aureus subsp. aureus N315
ucccauucaccaauauuaauga

SEQ ID NO: 2136619 - RNA, 23 nt, Staphylococcus aureus subsp. aureus N315
ucccauuaacacgaacugcauag

SEQ ID NO: 2136620 - RNA, 22 nt, Staphylococcus aureus subsp. aureus N315
ucccauguauucuuagauauua

SEQ ID NO: 2136621 - RNA, 16 nt, Staphylococcus aureus subsp. aureus N315
uccccauuuauguguu

SEQ ID NO: 2136622 - RNA, 13 nt, Staphylococcus aureus subsp. aureus N315
ucccauaaugacu

SEQ ID NO: 2136623 - RNA, 20 nt, Staphylococcus aureus subsp. aureus N315
ucccauaaugacuauaacac

SEQ ID NO: 2136624 - RNA, 16 nt, Staphylococcus aureus subsp. aureus N315
uccugguauaauggac

SEQ ID NO: 2136625 - RNA, 17 nt, Staphylococcus aureus subsp. aureus N315
uccuguguaaaauaaau

SEQ ID NO: 2136626 - RNA, 13 nt, Staphylococcus aureus subsp. aureus N315
uccuuaccuuuua

SEQ ID NO: 2136627 - RNA, 20 nt, Staphylococcus aureus subsp. aureus N315
uccuucaauguucaauucac

SEQ ID NO: 2136628 - RNA, 16 nt, Staphylococcus aureus subsp. aureus N315
uccuucaaaaguuuuu

SEQ ID NO: 2136629 - RNA, 14 nt, Staphylococcus aureus subsp. aureus N315
uccuucaucaauaa

SEQ ID NO: 2136630 - RNA, 17 nt, Staphylococcus aureus subsp. aureus N315
uccuuccaauaauaaau

SEQ ID NO: 2136631 - RNA, 14 nt, Staphylococcus aureus subsp. aureus N315
uccugcuuauuaau

SEQ ID NO: 2136632 - RNA, 16 nt, Staphylococcus aureus subsp. aureus N315
uccuccaaagcuaagu

SEQ ID NO: 2136633 - RNA, 16 nt, Staphylococcus aureus subsp. aureus N315
uccucauuaauaaauu

SEQ ID NO: 2136634 - RNA, 18 nt, Staphylococcus aureus subsp. aureus N315
uccucauuaugagaccca

SEQ ID NO: 2136635 - RNA, 14 nt, Staphylococcus aureus subsp. aureus N315
uccucauaauuauc

SEQ ID NO: 2136636 - RNA, 22 nt, Staphylococcus aureus subsp. aureus N315
uccuccgccaucaauauuuaua

SEQ ID NO: 2136637 - RNA, 19 nt, Staphylococcus aureus subsp. aureus N315
uccuccuaccgcuaaaauu

SEQ ID NO: 2136638 - RNA, 20 nt, Staphylococcus aureus subsp. aureus N315
uccucgguuuuauuuuuauc

SEQ ID NO: 2136639 - RNA, 15 nt, Staphylococcus aureus subsp. aureus N315
uccucgguauuuaau

SEQ ID NO: 2136640 - RNA, 19 nt, Staphylococcus aureus subsp. aureus N315
uccucuaacgguauaucau

SEQ ID NO: 2136641 - RNA, 19 nt, Staphylococcus aureus subsp. aureus N315
uccucuguccgauuuuuaa

SEQ ID NO: 2136642 - RNA, 14 nt, Staphylococcus aureus subsp. aureus N315
uccugauuccacua

SEQ ID NO: 2136643 - RNA, 18 nt, Staphylococcus aureus subsp. aureus N315
uccugauuuaauguuaaa

SEQ ID NO: 2136644 - RNA, 13 nt, Staphylococcus aureus subsp. aureus N315
uccugauacaaug

SEQ ID NO: 2136645 - RNA, 22 nt, Staphylococcus aureus subsp. aureus N315
uccuacgacacguguaaaaaug

SEQ ID NO: 2136646 - RNA, 21 nt, Staphylococcus aureus subsp. aureus N315
uccuacuuuucaacuuuaguu

SEQ ID NO: 2136647 - RNA, 13 nt, Staphylococcus aureus subsp. aureus N315
uccuacuuuucaa

SEQ ID NO: 2136648 - RNA, 21 nt, Staphylococcus aureus subsp. aureus N315
uccuaaagguaacuuuuuaac

SEQ ID NO: 2136649 - RNA, 11 nt, Staphylococcus aureus subsp. aureus N315
uccuaauucuu

SEQ ID NO: 2136650 - RNA, 15 nt, Staphylococcus aureus subsp. aureus N315
uccuaagcuaguguu

SEQ ID NO: 2136651 - RNA, 17 nt, Staphylococcus aureus subsp. aureus N315
uccuaagucuuuuaaau

SEQ ID NO: 2136652 - RNA, 20 nt, Staphylococcus aureus subsp. aureus N315
uccuaucuguaccguauuuu

SEQ ID NO: 2136653 - RNA, 21 nt, Staphylococcus aureus subsp. aureus N315
uccuaugccaaauaacguuaa

SEQ ID NO: 2136654 - RNA, 17 nt, Staphylococcus aureus subsp. aureus N315
uccuauggcgcaauuuu

SEQ ID NO: 2136655 - RNA, 17 nt, Staphylococcus aureus subsp. aureus N315
uccuauuacuacauaau

SEQ ID NO: 2136656 - RNA, 15 nt, Staphylococcus aureus subsp. aureus N315
uccuaucuguaccgu

SEQ ID NO: 2136657 - RNA, 16 nt, Staphylococcus aureus subsp. aureus N315
uccucaacgggaacau

SEQ ID NO: 2136658 - RNA, 16 nt, Staphylococcus aureus subsp. aureus N315
uccguauuuaccuucu

SEQ ID NO: 2136659 - RNA, 13 nt, Staphylococcus aureus subsp. aureus N315
uccuaaaaacugu

SEQ ID NO: 2136660 - RNA, 15 nt, Staphylococcus aureus subsp. aureus N315
uccguugaauucaac

SEQ ID NO: 2136661 - RNA, 13 nt, Staphylococcus aureus subsp. aureus N315
uccguuaauuaua

SEQ ID NO: 2136662 - RNA, 14 nt, Staphylococcus aureus subsp. aureus N315
uccguuaauuuaac

SEQ ID NO: 2136663 - RNA, 17 nt, Staphylococcus aureus subsp. aureus N315
uccgcuuguucaacuaa

SEQ ID NO: 2136664 - RNA, 21 nt, Staphylococcus aureus subsp. aureus N315
uccggaccuuguaaauuuaaa

SEQ ID NO: 2136665 - RNA, 15 nt, Staphylococcus aureus subsp. aureus N315
ucgcacuauaaaauu

SEQ ID NO: 2136666 - RNA, 21 nt, Staphylococcus aureus subsp. aureus N315
ucgcaccgucaaacuuaaaac

SEQ ID NO: 2136667 - RNA, 23 nt, Staphylococcus aureus subsp. aureus N315
ucgcaccgucaaacuuaaaacua

SEQ ID NO: 2136668 - RNA, 22 nt, Staphylococcus aureus subsp. aureus N315
ucgcacaacugcauaaaagccu

SEQ ID NO: 2136669 - RNA, 15 nt, Staphylococcus aureus subsp. aureus N315
ucgcaaauacauaau

SEQ ID NO: 2136670 - RNA, 18 nt, Staphylococcus aureus subsp. aureus N315
ucgcaaauacauaaucau

SEQ ID NO: 2136671 - RNA, 18 nt, Staphylococcus aureus subsp. aureus N315
ucgauucauaaaauuuaa

SEQ ID NO: 2136672 - RNA, 15 nt, Staphylococcus aureus subsp. aureus N315
ucgauuaauuuucuu

SEQ ID NO: 2136673 - RNA, 13 nt, Staphylococcus aureus subsp. aureus N315
ucgauuuuuuaau

SEQ ID NO: 2136674 - RNA, 16 nt, Staphylococcus aureus subsp. aureus N315
ucgaugacuuuuuaau

SEQ ID NO: 2136675 - RNA, 17 nt, Staphylococcus aureus subsp. aureus N315
ucgaugacuuugucuuu

SEQ ID NO: 2136676 - RNA, 15 nt, Staphylococcus aureus subsp. aureus N315
ucgauauuuguuucg

SEQ ID NO: 2136677 - RNA, 13 nt, Staphylococcus aureus subsp. aureus N315
ucgauauuucuag

SEQ ID NO: 2136678 - RNA, 15 nt, Staphylococcus aureus subsp. aureus N315
ucgauaugaauaacc

SEQ ID NO: 2136679 - RNA, 19 nt, Staphylococcus aureus subsp. aureus N315
ucgauaguucuauauaauu

SEQ ID NO: 2136680 - RNA, 21 nt, Staphylococcus aureus subsp. aureus N315
ucgauauagcauaaaauuucu

SEQ ID NO: 2136681 - RNA, 13 nt, Staphylococcus aureus subsp. aureus N315
ucgauaaguuuuu

SEQ ID NO: 2136682 - RNA, 23 nt, Staphylococcus aureus subsp. aureus N315
ucgaguuuguuucuaaauucuuu

SEQ ID NO: 2136683 - RNA, 17 nt, Staphylococcus aureus subsp. aureus N315
ucgaguagcccuauuuu

SEQ ID NO: 2136684 - RNA, 15 nt, Staphylococcus aureus subsp. aureus N315
ucgagguaauuucac

SEQ ID NO: 2136685 - RNA, 18 nt, Staphylococcus aureus subsp. aureus N315
ucgacuucagauacauua

SEQ ID NO: 2136686 - RNA, 19 nt, Staphylococcus aureus subsp. aureus N315
ucgacuacaaguuuauaau

SEQ ID NO: 2136687 - RNA, 14 nt, Staphylococcus aureus subsp. aureus N315
ucgacuacaaguuu

SEQ ID NO: 2136688 - RNA, 22 nt, Staphylococcus aureus subsp. aureus N315
ucgacuaauuuuucuuucaggc

SEQ ID NO: 2136689 - RNA, 20 nt, Staphylococcus aureus subsp. aureus N315
ucgacuaauuuuucuuucag

SEQ ID NO: 2136690 - RNA, 20 nt, Staphylococcus aureus subsp. aureus N315
ucgaauaacuguuuaucaug

SEQ ID NO: 2136691 - RNA, 22 nt, Staphylococcus aureus subsp. aureus N315
ucgaauguauugcuauaagaac

SEQ ID NO: 2136692 - RNA, 14 nt, Staphylococcus aureus subsp. aureus N315
ucgaauguuucuuc

SEQ ID NO: 2136693 - RNA, 21 nt, Staphylococcus aureus subsp. aureus N315
ucgaauguauugcuauaagaa

SEQ ID NO: 2136694 - RNA, 23 nt, Staphylococcus aureus subsp. aureus N315
ucgaauguuucuucguuagugau

SEQ ID NO: 2136695 - RNA, 20 nt, Staphylococcus aureus subsp. aureus N315
ucgacaacugauuuaauauc

SEQ ID NO: 2136696 - RNA, 15 nt, Staphylococcus aureus subsp. aureus N315
ucgaauucauuugca

SEQ ID NO: 2136697 - RNA, 17 nt, Staphylococcus aureus subsp. aureus N315
ucgaauugauggaaaag

SEQ ID NO: 2136698 - RNA, 15 nt, Staphylococcus aureus subsp. aureus N315
ucgacaauugcgacc

SEQ ID NO: 2136699 - RNA, 15 nt, Staphylococcus aureus subsp. aureus N315
ucgaacuaucaauau

SEQ ID NO: 2136700 - RNA, 17 nt, Staphylococcus aureus subsp. aureus N315
ucgaacgauauuuuaaa

SEQ ID NO: 2136701 - RNA, 15 nt, Staphylococcus aureus subsp. aureus N315
ucgaaguagcuuguu

SEQ ID NO: 2136702 - RNA, 20 nt, Staphylococcus aureus subsp. aureus N315
ucgaaguagcuuguuuagaa

SEQ ID NO: 2136703 - RNA, 17 nt, Staphylococcus aureus subsp. aureus N315
ucgaaaugccuucugua

SEQ ID NO: 2136704 - RNA, 17 nt, Staphylococcus aureus subsp. aureus N315
ucgaaagguauaucuuc

SEQ ID NO: 2136705 - RNA, 21 nt, Staphylococcus aureus subsp. aureus N315
ucgaaaauagcuauuaaaaua

SEQ ID NO: 2136706 - RNA, 20 nt, Staphylococcus aureus subsp. aureus N315
ucgaaaauagcuauuaaaau

SEQ ID NO: 2136707 - RNA, 15 nt, Staphylococcus aureus subsp. aureus N315
ucgaacauaaauaaa

SEQ ID NO: 2136708 - RNA, 16 nt, Staphylococcus aureus subsp. aureus N315
ucgaaauucucuuugu

SEQ ID NO: 2136709 - RNA, 23 nt, Staphylococcus aureus subsp. aureus N315
uccuuugauguucacuaaaugug

SEQ ID NO: 2136710 - RNA, 13 nt, Staphylococcus aureus subsp. aureus N315
uccuuuuugacuc

SEQ ID NO: 2136711 - RNA, 20 nt, Staphylococcus aureus subsp. aureus N315
ucgaaaaacuguaaaucauc

SEQ ID NO: 2136712 - RNA, 15 nt, Staphylococcus aureus subsp. aureus N315
ucgaaaagaaauucu

SEQ ID NO: 2136713 - RNA, 17 nt, Staphylococcus aureus subsp. aureus N315
ucgaaaauaaaacaaau

SEQ ID NO: 2136714 - RNA, 20 nt, Staphylococcus aureus subsp. aureus N315
ucgaaaagaaauucuacagg

SEQ ID NO: 2136715 - RNA, 15 nt, Staphylococcus aureus subsp. aureus N315
uccuuuauauucuaa

SEQ ID NO: 2136716 - RNA, 15 nt, Staphylococcus aureus subsp. aureus N315
uccuuuauauuuagu

SEQ ID NO: 2136717 - RNA, 18 nt, Staphylococcus aureus subsp. aureus N315
uccuugguuauuaaaauu

SEQ ID NO: 2136718 - RNA, 20 nt, Staphylococcus aureus subsp. aureus N315
uccuucgauaguuuauuaau

SEQ ID NO: 2136719 - RNA, 22 nt, Staphylococcus aureus subsp. aureus N315
uccuucgauaguuuauuaauau

SEQ ID NO: 2136720 - RNA, 22 nt, Staphylococcus aureus subsp. aureus N315
uccuucgcuaugaccaugauau

SEQ ID NO: 2136721 - RNA, 13 nt, Staphylococcus aureus subsp. aureus N315
uagucuuuuuaag

SEQ ID NO: 2136722 - RNA, 12 nt, Staphylococcus aureus subsp. aureus N315
uagugaaaagaa

SEQ ID NO: 2136723 - RNA, 12 nt, Staphylococcus aureus subsp. aureus N315
uagugaauaaug

SEQ ID NO: 2136724 - RNA, 17 nt, Staphylococcus aureus subsp. aureus N315
uagucgucgaaaugccu

SEQ ID NO: 2136725 - RNA, 15 nt, Staphylococcus aureus subsp. aureus N315
uagucgguguuuucu

SEQ ID NO: 2136726 - RNA, 23 nt, Staphylococcus aureus subsp. aureus N315
uagucuaugaauaauguuuucau

SEQ ID NO: 2136727 - RNA, 18 nt, Staphylococcus aureus subsp. aureus N315
uaguggugguacuuuuuu

SEQ ID NO: 2136728 - RNA, 23 nt, Staphylococcus aureus subsp. aureus N315
uaguggaagacaaugauuugugg

SEQ ID NO: 2136729 - RNA, 14 nt, Staphylococcus aureus subsp. aureus N315
uagugcuuuuucaa

SEQ ID NO: 2136730 - RNA, 12 nt, Staphylococcus aureus subsp. aureus N315
uaguucuguuga

SEQ ID NO: 2136731 - RNA, 22 nt, Staphylococcus aureus subsp. aureus N315
uaguucuauugcagaagaaaac

SEQ ID NO: 2136732 - RNA, 22 nt, Staphylococcus aureus subsp. aureus N315
uaguuagggaaauguagauuac

SEQ ID NO: 2136733 - RNA, 19 nt, Staphylococcus aureus subsp. aureus N315
uacuuucacauuuucaaau

SEQ ID NO: 2136734 - RNA, 17 nt, Staphylococcus aureus subsp. aureus N315
uacuuucacuuuuuaua

SEQ ID NO: 2136735 - RNA, 18 nt, Staphylococcus aureus subsp. aureus N315
uacuuucacuuuuuauau

SEQ ID NO: 2136736 - RNA, 17 nt, Staphylococcus aureus subsp. aureus N315
uacuuuauaaauaucuu

SEQ ID NO: 2136737 - RNA, 16 nt, Staphylococcus aureus subsp. aureus N315
uagguucaucuuuaug

SEQ ID NO: 2136738 - RNA, 16 nt, Staphylococcus aureus subsp. aureus N315
uagguuauuauaaaau

SEQ ID NO: 2136739 - RNA, 19 nt, Staphylococcus aureus subsp. aureus N315
uaguaaguagaagcaaaag

SEQ ID NO: 2136740 - RNA, 17 nt, Staphylococcus aureus subsp. aureus N315
uaguaagguuugaacuc

SEQ ID NO: 2136741 - RNA, 20 nt, Staphylococcus aureus subsp. aureus N315
uaguaagagcucucguguau

SEQ ID NO: 2136742 - RNA, 14 nt, Staphylococcus aureus subsp. aureus N315
uaguaacucaacau

SEQ ID NO: 2136743 - RNA, 15 nt, Staphylococcus aureus subsp. aureus N315
uaguaacucaacauu

SEQ ID NO: 2136744 - RNA, 23 nt, Staphylococcus aureus subsp. aureus N315
uaguccuucuuuacuaaaccuca

SEQ ID NO: 2136745 - RNA, 21 nt, Staphylococcus aureus subsp. aureus N315
uagucgaagaagauuaugaaa

SEQ ID NO: 2136746 - RNA, 22 nt, Staphylococcus aureus subsp. aureus N315
uaguccuucccacuuaucauca

SEQ ID NO: 2136747 - RNA, 22 nt, Staphylococcus aureus subsp. aureus N315
uagucaggggccccaacacaga

SEQ ID NO: 2136748 - RNA, 18 nt, Staphylococcus aureus subsp. aureus N315
uagucaggggccccaaca

SEQ ID NO: 2136749 - RNA, 17 nt, Staphylococcus aureus subsp. aureus N315
uagucauaauuuaaaag

SEQ ID NO: 2136750 - RNA, 19 nt, Staphylococcus aureus subsp. aureus N315
uaguaaugauuaacuuucu

SEQ ID NO: 2136751 - RNA, 14 nt, Staphylococcus aureus subsp. aureus N315
uaguaaugauguga

SEQ ID NO: 2136752 - RNA, 18 nt, Staphylococcus aureus subsp. aureus N315
uaguaauagcuauauuuu

SEQ ID NO: 2136753 - RNA, 16 nt, Staphylococcus aureus subsp. aureus N315
uaguaauaagacaaua

SEQ ID NO: 2136754 - RNA, 19 nt, Staphylococcus aureus subsp. aureus N315
uaguacacgaauucauuaa

SEQ ID NO: 2136755 - RNA, 19 nt, Staphylococcus aureus subsp. aureus N315
uaguacaccucuaaguuca

SEQ ID NO: 2136756 - RNA, 18 nt, Staphylococcus aureus subsp. aureus N315
uaguaccaagcuucauua

SEQ ID NO: 2136757 - RNA, 18 nt, Staphylococcus aureus subsp. aureus N315
uauaaauaaaaauacaua

SEQ ID NO: 2136758 - RNA, 20 nt, Staphylococcus aureus subsp. aureus N315
uauaaauaaaaauacauaau

SEQ ID NO: 2136759 - RNA, 21 nt, Staphylococcus aureus subsp. aureus N315
uauaaaguugacaauacaaau

SEQ ID NO: 2136760 - RNA, 22 nt, Staphylococcus aureus subsp. aureus N315
uauaaaggaauagcuacaauua

SEQ ID NO: 2136761 - RNA, 16 nt, Staphylococcus aureus subsp. aureus N315
uauaaagauuuaaguc

SEQ ID NO: 2136762 - RNA, 21 nt, Staphylococcus aureus subsp. aureus N315
uaguugagcguuuaauuagaa

SEQ ID NO: 2136763 - RNA, 15 nt, Staphylococcus aureus subsp. aureus N315
uaguucuuuaaauua

SEQ ID NO: 2136764 - RNA, 16 nt, Staphylococcus aureus subsp. aureus N315
uaguugaucaaaaaga

SEQ ID NO: 2136765 - RNA, 23 nt, Staphylococcus aureus subsp. aureus N315
uaguugaucaaaaagacagcagu

SEQ ID NO: 2136766 - RNA, 14 nt, Staphylococcus aureus subsp. aureus N315
uauaaaauaaaaaa

SEQ ID NO: 2136767 - RNA, 13 nt, Staphylococcus aureus subsp. aureus N315
uauaaaaguacuu

SEQ ID NO: 2136768 - RNA, 20 nt, Staphylococcus aureus subsp. aureus N315
uauaaaaggaagcaucucca

SEQ ID NO: 2136769 - RNA, 14 nt, Staphylococcus aureus subsp. aureus N315
uauaaaauauauuu

SEQ ID NO: 2136770 - RNA, 17 nt, Staphylococcus aureus subsp. aureus N315
uauaaaauauauuuaau

SEQ ID NO: 2136771 - RNA, 23 nt, Staphylococcus aureus subsp. aureus N315
uauaaaauggugcgaauaauaau

SEQ ID NO: 2136772 - RNA, 16 nt, Staphylococcus aureus subsp. aureus N315
uauaaaauucaccaac

SEQ ID NO: 2136773 - RNA, 19 nt, Staphylococcus aureus subsp. aureus N315
uauaacccucguaggcaua

SEQ ID NO: 2136774 - RNA, 18 nt, Staphylococcus aureus subsp. aureus N315
uauaacccuaaugugugg

SEQ ID NO: 2136775 - RNA, 17 nt, Staphylococcus aureus subsp. aureus N315
uauaaccgcuacaauua

SEQ ID NO: 2136776 - RNA, 17 nt, Staphylococcus aureus subsp. aureus N315
uauaaccuauuaaaucu

SEQ ID NO: 2136777 - RNA, 17 nt, Staphylococcus aureus subsp. aureus N315
uauaaccuuguucuuua

SEQ ID NO: 2136778 - RNA, 17 nt, Staphylococcus aureus subsp. aureus N315
uauaagauagauaaauc

SEQ ID NO: 2136779 - RNA, 21 nt, Staphylococcus aureus subsp. aureus N315
uauaagaauuuaaaagagaau

SEQ ID NO: 2136780 - RNA, 19 nt, Staphylococcus aureus subsp. aureus N315
uauaaaugcagcuguauaa

SEQ ID NO: 2136781 - RNA, 21 nt, Staphylococcus aureus subsp. aureus N315
uauaaaugaaucgcuuugauu

SEQ ID NO: 2136782 - RNA, 22 nt, Staphylococcus aureus subsp. aureus N315
uauaaaucauucuuuauagaaa

SEQ ID NO: 2136783 - RNA, 22 nt, Staphylococcus aureus subsp. aureus N315
uauaaauccuaagucuuuuaaa

SEQ ID NO: 2136784 - RNA, 14 nt, Staphylococcus aureus subsp. aureus N315
uauaacauuaaaau

SEQ ID NO: 2136785 - RNA, 20 nt, Staphylococcus aureus subsp. aureus N315
uauaacacuucguauugaau

SEQ ID NO: 2136786 - RNA, 13 nt, Staphylococcus aureus subsp. aureus N315
uauaaauaucuuu

SEQ ID NO: 2136787 - RNA, 23 nt, Staphylococcus aureus subsp. aureus N315
uauaaauaauaaaugcuauauuu

SEQ ID NO: 2136788 - RNA, 20 nt, Staphylococcus aureus subsp. aureus N315
uauaaauaaccgcacuuucu

SEQ ID NO: 2136789 - RNA, 14 nt, Staphylococcus aureus subsp. aureus N315
uauaaauacaaaua

SEQ ID NO: 2136790 - RNA, 20 nt, Staphylococcus aureus subsp. aureus N315
uauaaucauuuaaacgaucu

SEQ ID NO: 2136791 - RNA, 16 nt, Staphylococcus aureus subsp. aureus N315
uauaaucuauaaaugg

SEQ ID NO: 2136792 - RNA, 15 nt, Staphylococcus aureus subsp. aureus N315
uauaauuaaacauuu

SEQ ID NO: 2136793 - RNA, 14 nt, Staphylococcus aureus subsp. aureus N315
uauaauuaaacuaa

SEQ ID NO: 2136794 - RNA, 15 nt, Staphylococcus aureus subsp. aureus N315
uauaauguauaaaac

SEQ ID NO: 2136795 - RNA, 16 nt, Staphylococcus aureus subsp. aureus N315
uauaaugguugaauaa

SEQ ID NO: 2136796 - RNA, 15 nt, Staphylococcus aureus subsp. aureus N315
uauaaugauguauuu

SEQ ID NO: 2136797 - RNA, 15 nt, Staphylococcus aureus subsp. aureus N315
uauaauuuauaaaaa

SEQ ID NO: 2136798 - RNA, 17 nt, Staphylococcus aureus subsp. aureus N315
uauaauuuauaaaaaga

SEQ ID NO: 2136799 - RNA, 16 nt, Staphylococcus aureus subsp. aureus N315
uauaauuuaucuuaau

SEQ ID NO: 2136800 - RNA, 10 nt, Staphylococcus aureus subsp. aureus N315
uauaauuuaa

SEQ ID NO: 2136801 - RNA, 16 nt, Staphylococcus aureus subsp. aureus N315
uauaauugauugucau

SEQ ID NO: 2136802 - RNA, 11 nt, Staphylococcus aureus subsp. aureus N315
uauaauucuuc

SEQ ID NO: 2136803 - RNA, 20 nt, Staphylococcus aureus subsp. aureus N315
uauaauuggcagauagaaug

SEQ ID NO: 2136804 - RNA, 15 nt, Staphylococcus aureus subsp. aureus N315
uauaauuauuaaacu

SEQ ID NO: 2136805 - RNA, 22 nt, Staphylococcus aureus subsp. aureus N315
uauaauucgucuguuucauaua

SEQ ID NO: 2136806 - RNA, 14 nt, Staphylococcus aureus subsp. aureus N315
uauaauuauuaaac

SEQ ID NO: 2136807 - RNA, 13 nt, Staphylococcus aureus subsp. aureus N315
uauaauuauuaaa

SEQ ID NO: 2136808 - RNA, 13 nt, Staphylococcus aureus subsp. aureus N315
uauaauagagaaa

SEQ ID NO: 2136809 - RNA, 14 nt, Staphylococcus aureus subsp. aureus N315
uauaauagaaauaa

SEQ ID NO: 2136810 - RNA, 16 nt, Staphylococcus aureus subsp. aureus N315
uauaauauacacaaaa

SEQ ID NO: 2136811 - RNA, 14 nt, Staphylococcus aureus subsp. aureus N315
uauaauauacacaa

SEQ ID NO: 2136812 - RNA, 13 nt, Staphylococcus aureus subsp. aureus N315
uauaauaccccaa

SEQ ID NO: 2136813 - RNA, 13 nt, Staphylococcus aureus subsp. aureus N315
uauaauagaaaua

SEQ ID NO: 2136814 - RNA, 14 nt, Staphylococcus aureus subsp. aureus N315
uauaauacgugugu

SEQ ID NO: 2136815 - RNA, 18 nt, Staphylococcus aureus subsp. aureus N315
uauaaguuaaaaauguaa

SEQ ID NO: 2136816 - RNA, 18 nt, Staphylococcus aureus subsp. aureus N315
uauaaggauguacuauaa

SEQ ID NO: 2136817 - RNA, 23 nt, Staphylococcus aureus subsp. aureus N315
uauaaggauguacuauaaauccu

SEQ ID NO: 2136818 - RNA, 15 nt, Staphylococcus aureus subsp. aureus N315
uauaagcuuuuucuu

SEQ ID NO: 2136819 - RNA, 19 nt, Staphylococcus aureus subsp. aureus N315
uauaaguaaucauaauaau

SEQ ID NO: 2136820 - RNA, 16 nt, Staphylococcus aureus subsp. aureus N315
uauaaguaaauaauag

SEQ ID NO: 2136821 - RNA, 19 nt, Staphylococcus aureus subsp. aureus N315
uauaaguugcauauaaaaa

SEQ ID NO: 2136822 - RNA, 13 nt, Staphylococcus aureus subsp. aureus N315
uauaaguuaaaaa

SEQ ID NO: 2136823 - RNA, 14 nt, Staphylococcus aureus subsp. aureus N315
uauaaguauaauga

SEQ ID NO: 2136824 - RNA, 21 nt, Staphylococcus aureus subsp. aureus N315
uauaaguaucgccaucauuca

SEQ ID NO: 2136825 - RNA, 15 nt, Staphylococcus aureus subsp. aureus N315
uauauauuaaaguaa

SEQ ID NO: 2136826 - RNA, 17 nt, Staphylococcus aureus subsp. aureus N315
uauauccgcaucuuuug

SEQ ID NO: 2136827 - RNA, 14 nt, Staphylococcus aureus subsp. aureus N315
uauauccauucaau

SEQ ID NO: 2136828 - RNA, 16 nt, Staphylococcus aureus subsp. aureus N315
uauauauucaauaauu

SEQ ID NO: 2136829 - RNA, 15 nt, Staphylococcus aureus subsp. aureus N315
uauaucgcuuuugaa

SEQ ID NO: 2136830 - RNA, 19 nt, Staphylococcus aureus subsp. aureus N315
uauaucuuaaguacauaaa

SEQ ID NO: 2136831 - RNA, 16 nt, Staphylococcus aureus subsp. aureus N315
uauaugaauugaguau

SEQ ID NO: 2136832 - RNA, 13 nt, Staphylococcus aureus subsp. aureus N315
uauaucuuuuaua

SEQ ID NO: 2136833 - RNA, 18 nt, Staphylococcus aureus subsp. aureus N315
uauaugaaauauuuaucu

SEQ ID NO: 2136834 - RNA, 11 nt, Staphylococcus aureus subsp. aureus N315
uauauaaauua

SEQ ID NO: 2136835 - RNA, 20 nt, Staphylococcus aureus subsp. aureus N315
uauauaaaguugacaauaca

SEQ ID NO: 2136836 - RNA, 18 nt, Staphylococcus aureus subsp. aureus N315
uauauaaacaaaaaucua

SEQ ID NO: 2136837 - RNA, 20 nt, Staphylococcus aureus subsp. aureus N315
uauauaaagcuuugacauau

SEQ ID NO: 2136838 - RNA, 16 nt, Staphylococcus aureus subsp. aureus N315
uauauauuaaaacaau

SEQ ID NO: 2136839 - RNA, 16 nt, Staphylococcus aureus subsp. aureus N315
uauauaucaaauacau

SEQ ID NO: 2136840 - RNA, 18 nt, Staphylococcus aureus subsp. aureus N315
uauauaucaaauacauuu

SEQ ID NO: 2136841 - RNA, 17 nt, Staphylococcus aureus subsp. aureus N315
uauauaucacauauuau

SEQ ID NO: 2136842 - RNA, 20 nt, Staphylococcus aureus subsp. aureus N315
uauauauaaagaaauaauuu

SEQ ID NO: 2136843 - RNA, 14 nt, Staphylococcus aureus subsp. aureus N315
uauauauauuaaag

SEQ ID NO: 2136844 - RNA, 12 nt, Staphylococcus aureus subsp. aureus N315
uauauaucaaau

SEQ ID NO: 2136845 - RNA, 15 nt, Staphylococcus aureus subsp. aureus N315
uauauaguaaaauaa

SEQ ID NO: 2136846 - RNA, 20 nt, Staphylococcus aureus subsp. aureus N315
uauauaaaaaagaaauaucu

SEQ ID NO: 2136847 - RNA, 17 nt, Staphylococcus aureus subsp. aureus N315
uauaguaauagcuauau

SEQ ID NO: 2136848 - RNA, 13 nt, Staphylococcus aureus subsp. aureus N315
uauaguuuagauu

SEQ ID NO: 2136849 - RNA, 15 nt, Staphylococcus aureus subsp. aureus N315
uauaguaauaaaagu

SEQ ID NO: 2136850 - RNA, 19 nt, Staphylococcus aureus subsp. aureus N315
uauaggugcaguuaaauua

SEQ ID NO: 2136851 - RNA, 15 nt, Staphylococcus aureus subsp. aureus N315
uauacaaugacagca

SEQ ID NO: 2136852 - RNA, 16 nt, Staphylococcus aureus subsp. aureus N315
uauacacuuacaaaua

SEQ ID NO: 2136853 - RNA, 15 nt, Staphylococcus aureus subsp. aureus N315
uauaauuuuguuuca

SEQ ID NO: 2136854 - RNA, 20 nt, Staphylococcus aureus subsp. aureus N315
uauaauuuccuaaaaacugu

SEQ ID NO: 2136855 - RNA, 20 nt, Staphylococcus aureus subsp. aureus N315
uauaauuuucuguccaaaaa

SEQ ID NO: 2136856 - RNA, 15 nt, Staphylococcus aureus subsp. aureus N315
uauaauuuuaauauu

SEQ ID NO: 2136857 - RNA, 17 nt, Staphylococcus aureus subsp. aureus N315
uauaauuuuaauauuau

SEQ ID NO: 2136858 - RNA, 17 nt, Staphylococcus aureus subsp. aureus N315
uauaugauaaauauugu

SEQ ID NO: 2136859 - RNA, 21 nt, Staphylococcus aureus subsp. aureus N315
uauauggagcuacccuauuuu

SEQ ID NO: 2136860 - RNA, 23 nt, Staphylococcus aureus subsp. aureus N315
uauaugccgauugcucuaaucca

SEQ ID NO: 2136861 - RNA, 20 nt, Staphylococcus aureus subsp. aureus N315
uauauuaagacguuguaaug

SEQ ID NO: 2136862 - RNA, 14 nt, Staphylococcus aureus subsp. aureus N315
uauauuaaauacua

SEQ ID NO: 2136863 - RNA, 16 nt, Staphylococcus aureus subsp. aureus N315
uauauguaaucagagu

SEQ ID NO: 2136864 - RNA, 22 nt, Staphylococcus aureus subsp. aureus N315
uauauguaaucagaguagaaag

SEQ ID NO: 2136865 - RNA, 23 nt, Staphylococcus aureus subsp. aureus N315
uauauuaaaaauuucaauaaugu

SEQ ID NO: 2136866 - RNA, 17 nt, Staphylococcus aureus subsp. aureus N315
uauauuuaaacucucua

SEQ ID NO: 2136867 - RNA, 23 nt, Staphylococcus aureus subsp. aureus N315
uauauuuaguuagcccuauucaa

SEQ ID NO: 2136868 - RNA, 12 nt, Staphylococcus aureus subsp. aureus N315
uauauuuaauuu

SEQ ID NO: 2136869 - RNA, 14 nt, Staphylococcus aureus subsp. aureus N315
uauauuuaaauugg

SEQ ID NO: 2136870 - RNA, 20 nt, Staphylococcus aureus subsp. aureus N315
uauauuucgguauuuuaaau

SEQ ID NO: 2136871 - RNA, 13 nt, Staphylococcus aureus subsp. aureus N315
uauauuugugaau

SEQ ID NO: 2136872 - RNA, 20 nt, Staphylococcus aureus subsp. aureus N315
uaucacauauuaugauacgc

SEQ ID NO: 2136873 - RNA, 20 nt, Staphylococcus aureus subsp. aureus N315
uaucacaacacauaaauuaa

SEQ ID NO: 2136874 - RNA, 16 nt, Staphylococcus aureus subsp. aureus N315
uaucaccuucaaacuu

SEQ ID NO: 2136875 - RNA, 17 nt, Staphylococcus aureus subsp. aureus N315
uaucaacagcuucaaaa

SEQ ID NO: 2136876 - RNA, 20 nt, Staphylococcus aureus subsp. aureus N315
uaucaagaaaaaguuuuucu

SEQ ID NO: 2136877 - RNA, 15 nt, Staphylococcus aureus subsp. aureus N315
uaucaagaaaaaguu

SEQ ID NO: 2136878 - RNA, 13 nt, Staphylococcus aureus subsp. aureus N315
uauauuuuauuag

SEQ ID NO: 2136879 - RNA, 19 nt, Staphylococcus aureus subsp. aureus N315
uauauuuuauuuaaaaaua

SEQ ID NO: 2136880 - RNA, 14 nt, Staphylococcus aureus subsp. aureus N315
uaucaacauaaaau

SEQ ID NO: 2136881 - RNA, 21 nt, Staphylococcus aureus subsp. aureus N315
uaucaauuguugcaaaauacg

SEQ ID NO: 2136882 - RNA, 17 nt, Staphylococcus aureus subsp. aureus N315
uaucguaaaaaaacguc

SEQ ID NO: 2136883 - RNA, 15 nt, Staphylococcus aureus subsp. aureus N315
uaucgucaauuuuaa

SEQ ID NO: 2136884 - RNA, 18 nt, Staphylococcus aureus subsp. aureus N315
uaucgccuaaaaauaaaa

SEQ ID NO: 2136885 - RNA, 17 nt, Staphylococcus aureus subsp. aureus N315
uaucgauaguucuauau

SEQ ID NO: 2136886 - RNA, 21 nt, Staphylococcus aureus subsp. aureus N315
uaucgauaguucuauauaauu

SEQ ID NO: 2136887 - RNA, 19 nt, Staphylococcus aureus subsp. aureus N315
uaucgauauagcauaaaau

SEQ ID NO: 2136888 - RNA, 14 nt, Staphylococcus aureus subsp. aureus N315
uaucgauuaucuga

SEQ ID NO: 2136889 - RNA, 17 nt, Staphylococcus aureus subsp. aureus N315
uaucgauucgauuauuu

SEQ ID NO: 2136890 - RNA, 16 nt, Staphylococcus aureus subsp. aureus N315
uaucgacuuugucauu

SEQ ID NO: 2136891 - RNA, 21 nt, Staphylococcus aureus subsp. aureus N315
uaucgaagaaacauuauauaa

SEQ ID NO: 2136892 - RNA, 16 nt, Staphylococcus aureus subsp. aureus N315
uauccuguguaaaaua

SEQ ID NO: 2136893 - RNA, 13 nt, Staphylococcus aureus subsp. aureus N315
uauccugauuuaa

SEQ ID NO: 2136894 - RNA, 14 nt, Staphylococcus aureus subsp. aureus N315
uauccuuuaaauca

SEQ ID NO: 2136895 - RNA, 22 nt, Staphylococcus aureus subsp. aureus N315
uaucgaaagguauaucuucauu

SEQ ID NO: 2136896 - RNA, 16 nt, Staphylococcus aureus subsp. aureus N315
uauccuucucaucauu

SEQ ID NO: 2136897 - RNA, 13 nt, Staphylococcus aureus subsp. aureus N315
uauccuucaaaag

SEQ ID NO: 2136898 - RNA, 15 nt, Staphylococcus aureus subsp. aureus N315
uauccuucaaaaguu

SEQ ID NO: 2136899 - RNA, 18 nt, Staphylococcus aureus subsp. aureus N315
uauccucgguauuuaaug

SEQ ID NO: 2136900 - RNA, 12 nt, Staphylococcus aureus subsp. aureus N315
uaucaucaugac

SEQ ID NO: 2136901 - RNA, 20 nt, Staphylococcus aureus subsp. aureus N315
uaucauaccgacaccuauac

SEQ ID NO: 2136902 - RNA, 13 nt, Staphylococcus aureus subsp. aureus N315
uaucauaauauug

SEQ ID NO: 2136903 - RNA, 18 nt, Staphylococcus aureus subsp. aureus N315
uaucauacuucaaacguu

SEQ ID NO: 2136904 - RNA, 14 nt, Staphylococcus aureus subsp. aureus N315
uaucagcuuuuuca

SEQ ID NO: 2136905 - RNA, 13 nt, Staphylococcus aureus subsp. aureus N315
uaucagcuuuaau

SEQ ID NO: 2136906 - RNA, 18 nt, Staphylococcus aureus subsp. aureus N315
uaucagcgaaauuuguaa

SEQ ID NO: 2136907 - RNA, 19 nt, Staphylococcus aureus subsp. aureus N315
uaugcguggucuauuuuau

SEQ ID NO: 2136908 - RNA, 22 nt, Staphylococcus aureus subsp. aureus N315
uaugcguagcaacauuauuuuu

SEQ ID NO: 2136909 - RNA, 17 nt, Staphylococcus aureus subsp. aureus N315
uaugcuagaaaguaaug

SEQ ID NO: 2136910 - RNA, 21 nt, Staphylococcus aureus subsp. aureus N315
uaugccgccuaauaauaaaau

SEQ ID NO: 2136911 - RNA, 18 nt, Staphylococcus aureus subsp. aureus N315
uaugccgccuaauaauaa

SEQ ID NO: 2136912 - RNA, 21 nt, Staphylococcus aureus subsp. aureus N315
uauggucuugaguacuaauca

SEQ ID NO: 2136913 - RNA, 22 nt, Staphylococcus aureus subsp. aureus N315
uaugcuuguugugaauaaaauu

SEQ ID NO: 2136914 - RNA, 16 nt, Staphylococcus aureus subsp. aureus N315
uaugcuuuuaauagug

SEQ ID NO: 2136915 - RNA, 15 nt, Staphylococcus aureus subsp. aureus N315
uauggaaaauguuau

SEQ ID NO: 2136916 - RNA, 16 nt, Staphylococcus aureus subsp. aureus N315
uauggauguauuucug

SEQ ID NO: 2136917 - RNA, 13 nt, Staphylococcus aureus subsp. aureus N315
uauggauaaaauu

SEQ ID NO: 2136918 - RNA, 20 nt, Staphylococcus aureus subsp. aureus N315
uauggagcuacccuauuuua

SEQ ID NO: 2136919 - RNA, 15 nt, Staphylococcus aureus subsp. aureus N315
uaugauccuuuaaug

SEQ ID NO: 2136920 - RNA, 17 nt, Staphylococcus aureus subsp. aureus N315
uaugaugucauguauug

SEQ ID NO: 2136921 - RNA, 19 nt, Staphylococcus aureus subsp. aureus N315
uaugauugcuuauuuauuu

SEQ ID NO: 2136922 - RNA, 23 nt, Staphylococcus aureus subsp. aureus N315
uaugauucuaacggcguuuguuu

SEQ ID NO: 2136923 - RNA, 22 nt, Staphylococcus aureus subsp. aureus N315
uaugaugucauguauuguccau

SEQ ID NO: 2136924 - RNA, 15 nt, Staphylococcus aureus subsp. aureus N315
uaugauguuaaaaaa

SEQ ID NO: 2136925 - RNA, 17 nt, Staphylococcus aureus subsp. aureus N315
uaugauguuaaaaaaua

SEQ ID NO: 2136926 - RNA, 16 nt, Staphylococcus aureus subsp. aureus N315
uaugaugggaaaaaau

SEQ ID NO: 2136927 - RNA, 20 nt, Staphylococcus aureus subsp. aureus N315
uaugcauaauaccaauugcu

SEQ ID NO: 2136928 - RNA, 22 nt, Staphylococcus aureus subsp. aureus N315
uaugcauacacuugauuaucau

SEQ ID NO: 2136929 - RNA, 16 nt, Staphylococcus aureus subsp. aureus N315
uaugcauagcucuugc

SEQ ID NO: 2136930 - RNA, 23 nt, Staphylococcus aureus subsp. aureus N315
uaugauuugccccgccauucaua

SEQ ID NO: 2136931 - RNA, 12 nt, Staphylococcus aureus subsp. aureus N315
uaugauuuguuu

SEQ ID NO: 2136932 - RNA, 16 nt, Staphylococcus aureus subsp. aureus N315
uaugcaaaugaaauuc

SEQ ID NO: 2136933 - RNA, 20 nt, Staphylococcus aureus subsp. aureus N315
uaugcaaugcaccuauaaua

SEQ ID NO: 2136934 - RNA, 13 nt, Staphylococcus aureus subsp. aureus N315
uaugaauuuuaua

SEQ ID NO: 2136935 - RNA, 17 nt, Staphylococcus aureus subsp. aureus N315
uaugaauugaguauuaa

SEQ ID NO: 2136936 - RNA, 23 nt, Staphylococcus aureus subsp. aureus N315
uaugaauuuagaugcauaaaaaa

SEQ ID NO: 2136937 - RNA, 16 nt, Staphylococcus aureus subsp. aureus N315
uaugaauugcuuguuu

SEQ ID NO: 2136938 - RNA, 15 nt, Staphylococcus aureus subsp. aureus N315
uaugacuuuuuauua

SEQ ID NO: 2136939 - RNA, 18 nt, Staphylococcus aureus subsp. aureus N315
uaugacugcuuuuuauua

SEQ ID NO: 2136940 - RNA, 19 nt, Staphylococcus aureus subsp. aureus N315
uaugacugcaaauacgagu

SEQ ID NO: 2136941 - RNA, 17 nt, Staphylococcus aureus subsp. aureus N315
uaugagcuuaauaaauu

SEQ ID NO: 2136942 - RNA, 15 nt, Staphylococcus aureus subsp. aureus N315
uaugagugauagaaa

SEQ ID NO: 2136943 - RNA, 22 nt, Staphylococcus aureus subsp. aureus N315
uaugauacgcuuuuuaaaaaau

SEQ ID NO: 2136944 - RNA, 19 nt, Staphylococcus aureus subsp. aureus N315
uaugauacgcuuuuuaaaa

SEQ ID NO: 2136945 - RNA, 16 nt, Staphylococcus aureus subsp. aureus N315
uaugauaaccauuaug

SEQ ID NO: 2136946 - RNA, 16 nt, Staphylococcus aureus subsp. aureus N315
uaugagugauagaaag

SEQ ID NO: 2136947 - RNA, 21 nt, Staphylococcus aureus subsp. aureus N315
uaugauaaucguuuuuacugu

SEQ ID NO: 2136948 - RNA, 22 nt, Staphylococcus aureus subsp. aureus N315
uaugauaaccauuaugauuaau

SEQ ID NO: 2136949 - RNA, 18 nt, Staphylococcus aureus subsp. aureus N315
uaucuauaugcauauauu

SEQ ID NO: 2136950 - RNA, 23 nt, Staphylococcus aureus subsp. aureus N315
uaucuaguguucucauuauaaug

SEQ ID NO: 2136951 - RNA, 18 nt, Staphylococcus aureus subsp. aureus N315
uaucuauaaaaagaauau

SEQ ID NO: 2136952 - RNA, 12 nt, Staphylococcus aureus subsp. aureus N315
uaucuacuauuu

SEQ ID NO: 2136953 - RNA, 15 nt, Staphylococcus aureus subsp. aureus N315
uaucuacuauuuguu

SEQ ID NO: 2136954 - RNA, 16 nt, Staphylococcus aureus subsp. aureus N315
uaucuaguguucucau

SEQ ID NO: 2136955 - RNA, 14 nt, Staphylococcus aureus subsp. aureus N315
uaucuagcugcuuc

SEQ ID NO: 2136956 - RNA, 13 nt, Staphylococcus aureus subsp. aureus N315
uaucgugaagaaa

SEQ ID NO: 2136957 - RNA, 15 nt, Staphylococcus aureus subsp. aureus N315
uaucguuuauugaua

SEQ ID NO: 2136958 - RNA, 16 nt, Staphylococcus aureus subsp. aureus N315
uaucuaaacaauuccc

SEQ ID NO: 2136959 - RNA, 18 nt, Staphylococcus aureus subsp. aureus N315
uaucuacaugguuuucac

SEQ ID NO: 2136960 - RNA, 20 nt, Staphylococcus aureus subsp. aureus N315
uaucuaaugggucaaugacu

SEQ ID NO: 2136961 - RNA, 23 nt, Staphylococcus aureus subsp. aureus N315
uaucuaaugaucaucuauauuua

SEQ ID NO: 2136962 - RNA, 20 nt, Staphylococcus aureus subsp. aureus N315
uaucuaacaaucguuuuaau

SEQ ID NO: 2136963 - RNA, 15 nt, Staphylococcus aureus subsp. aureus N315
uaucuaaaucuucau

SEQ ID NO: 2136964 - RNA, 18 nt, Staphylococcus aureus subsp. aureus N315
uaucuaaaucuucaucau

SEQ ID NO: 2136965 - RNA, 14 nt, Staphylococcus aureus subsp. aureus N315
uaucugacauuuaa

SEQ ID NO: 2136966 - RNA, 18 nt, Staphylococcus aureus subsp. aureus N315
uaucucaaagauuccugu

SEQ ID NO: 2136967 - RNA, 13 nt, Staphylococcus aureus subsp. aureus N315
uaucugaaaauau

SEQ ID NO: 2136968 - RNA, 19 nt, Staphylococcus aureus subsp. aureus N315
uaucucugaaaaacuucuu

SEQ ID NO: 2136969 - RNA, 19 nt, Staphylococcus aureus subsp. aureus N315
uaucuuacuacuuaauuaa

SEQ ID NO: 2136970 - RNA, 14 nt, Staphylococcus aureus subsp. aureus N315
uaucuucaguuauu

SEQ ID NO: 2136971 - RNA, 14 nt, Staphylococcus aureus subsp. aureus N315
uaucuuacugcugu

SEQ ID NO: 2136972 - RNA, 21 nt, Staphylococcus aureus subsp. aureus N315
uaucuuacugcuguucucuau

SEQ ID NO: 2136973 - RNA, 22 nt, Staphylococcus aureus subsp. aureus N315
uaucuuacugcuguucucuauu

SEQ ID NO: 2136974 - RNA, 17 nt, Staphylococcus aureus subsp. aureus N315
uaucuuauaacaaaaau

SEQ ID NO: 2136975 - RNA, 19 nt, Staphylococcus aureus subsp. aureus N315
uaucuuaaagaauuaagua

SEQ ID NO: 2136976 - RNA, 19 nt, Staphylococcus aureus subsp. aureus N315
uaucuguaccguauuuuaa

SEQ ID NO: 2136977 - RNA, 15 nt, Staphylococcus aureus subsp. aureus N315
uaucuguaucaaaau

SEQ ID NO: 2136978 - RNA, 17 nt, Staphylococcus aureus subsp. aureus N315
uaucuuuaguauuucau

SEQ ID NO: 2136979 - RNA, 14 nt, Staphylococcus aureus subsp. aureus N315
uaucuuuagacaua

SEQ ID NO: 2136980 - RNA, 14 nt, Staphylococcus aureus subsp. aureus N315
uaucuuuaauuggc

SEQ ID NO: 2136981 - RNA, 13 nt, Staphylococcus aureus subsp. aureus N315
uaucuugauuuaa

SEQ ID NO: 2136982 - RNA, 18 nt, Staphylococcus aureus subsp. aureus N315
uaucuugauuuaaaccau

SEQ ID NO: 2136983 - RNA, 19 nt, Staphylococcus aureus subsp. aureus N315
uaucuugauuuaaaccauc

SEQ ID NO: 2136984 - RNA, 18 nt, Staphylococcus aureus subsp. aureus N315
uaucuugauuuuauaaau

SEQ ID NO: 2136985 - RNA, 18 nt, Staphylococcus aureus subsp. aureus N315
uaucuucuuuuaauauuu

SEQ ID NO: 2136986 - RNA, 14 nt, Staphylococcus aureus subsp. aureus N315
uaucuucauuuaaa

SEQ ID NO: 2136987 - RNA, 14 nt, Staphylococcus aureus subsp. aureus N315
uaugaaauaacuag

SEQ ID NO: 2136988 - RNA, 14 nt, Staphylococcus aureus subsp. aureus N315
uaugaacaaaaaau

SEQ ID NO: 2136989 - RNA, 15 nt, Staphylococcus aureus subsp. aureus N315
uaugaacaauaagug

SEQ ID NO: 2136990 - RNA, 14 nt, Staphylococcus aureus subsp. aureus N315
uaugaaauaacaau

SEQ ID NO: 2136991 - RNA, 18 nt, Staphylococcus aureus subsp. aureus N315
uaugaaaccuuugguuca

SEQ ID NO: 2136992 - RNA, 15 nt, Staphylococcus aureus subsp. aureus N315
uaugaauaaccaucu

SEQ ID NO: 2136993 - RNA, 14 nt, Staphylococcus aureus subsp. aureus N315
uaugaauagaugau

SEQ ID NO: 2136994 - RNA, 12 nt, Staphylococcus aureus subsp. aureus N315
uaucuuuucauc

SEQ ID NO: 2136995 - RNA, 16 nt, Staphylococcus aureus subsp. aureus N315
uaucuuuuucuaaguu

SEQ ID NO: 2136996 - RNA, 16 nt, Staphylococcus aureus subsp. aureus N315
uaucuuuaucauuauu

SEQ ID NO: 2136997 - RNA, 20 nt, Staphylococcus aureus subsp. aureus N315
uaucuuuauaacgcuuuaau

SEQ ID NO: 2136998 - RNA, 17 nt, Staphylococcus aureus subsp. aureus N315
uaucuuuauuugauucu

SEQ ID NO: 2136999 - RNA, 19 nt, Staphylococcus aureus subsp. aureus N315
uaucuuucaaauuaauuaa

SEQ ID NO: 2137000 - RNA, 14 nt, Staphylococcus aureus subsp. aureus N315
uaucuuucaauuaa

SEQ ID NO: 2137001 - RNA, 17 nt, Staphylococcus aureus subsp. aureus N315
uauucaaaguuuucauu

SEQ ID NO: 2137002 - RNA, 17 nt, Staphylococcus aureus subsp. aureus N315
uauucaaaaaauauuua

SEQ ID NO: 2137003 - RNA, 19 nt, Staphylococcus aureus subsp. aureus N315
uauuauuuuguauuuuuca

SEQ ID NO: 2137004 - RNA, 16 nt, Staphylococcus aureus subsp. aureus N315
uauuaugccuuugauu

SEQ ID NO: 2137005 - RNA, 17 nt, Staphylococcus aureus subsp. aureus N315
uauuaugaauuauuaau

SEQ ID NO: 2137006 - RNA, 22 nt, Staphylococcus aureus subsp. aureus N315
uauuaugauugcuuauuuauuu

SEQ ID NO: 2137007 - RNA, 16 nt, Staphylococcus aureus subsp. aureus N315
uauuauguguauauua

SEQ ID NO: 2137008 - RNA, 18 nt, Staphylococcus aureus subsp. aureus N315
uauucaaauaaacacauc

SEQ ID NO: 2137009 - RNA, 23 nt, Staphylococcus aureus subsp. aureus N315
uauucaacuaauuuaaagcauca

SEQ ID NO: 2137010 - RNA, 13 nt, Staphylococcus aureus subsp. aureus N315
uauucccaaaaug

SEQ ID NO: 2137011 - RNA, 21 nt, Staphylococcus aureus subsp. aureus N315
uauucguaucuaguguucuca

SEQ ID NO: 2137012 - RNA, 15 nt, Staphylococcus aureus subsp. aureus N315
uauucuaaauauauu

SEQ ID NO: 2137013 - RNA, 20 nt, Staphylococcus aureus subsp. aureus N315
uauucuagauucauauuuau

SEQ ID NO: 2137014 - RNA, 14 nt, Staphylococcus aureus subsp. aureus N315
uauucuaaguuaaa

SEQ ID NO: 2137015 - RNA, 13 nt, Staphylococcus aureus subsp. aureus N315
uauucuucauuua

SEQ ID NO: 2137016 - RNA, 15 nt, Staphylococcus aureus subsp. aureus N315
uauucuuaucauuca

SEQ ID NO: 2137017 - RNA, 14 nt, Staphylococcus aureus subsp. aureus N315
uauucuuaauuuaa

SEQ ID NO: 2137018 - RNA, 21 nt, Staphylococcus aureus subsp. aureus N315
uauucuucuaauucugaaauc

SEQ ID NO: 2137019 - RNA, 17 nt, Staphylococcus aureus subsp. aureus N315
uauucuucccaaaaauu

SEQ ID NO: 2137020 - RNA, 18 nt, Staphylococcus aureus subsp. aureus N315
uauugaaacuaauaauuu

SEQ ID NO: 2137021 - RNA, 16 nt, Staphylococcus aureus subsp. aureus N315
uauugaaaauagaaag

SEQ ID NO: 2137022 - RNA, 20 nt, Staphylococcus aureus subsp. aureus N315
uauucuuggcguauuuuuug

SEQ ID NO: 2137023 - RNA, 13 nt, Staphylococcus aureus subsp. aureus N315
uauucuuucucua

SEQ ID NO: 2137024 - RNA, 23 nt, Staphylococcus aureus subsp. aureus N315
uauugauuugauucauuacaugu

SEQ ID NO: 2137025 - RNA, 14 nt, Staphylococcus aureus subsp. aureus N315
uauugauuguacca

SEQ ID NO: 2137026 - RNA, 14 nt, Staphylococcus aureus subsp. aureus N315
uauugcaaaaauaa

SEQ ID NO: 2137027 - RNA, 15 nt, Staphylococcus aureus subsp. aureus N315
uauugcaaaaauaau

SEQ ID NO: 2137028 - RNA, 24 nt, Staphylococcus aureus subsp. aureus N315
aaauccuuaaauggagauucucgg

SEQ ID NO: 2137029 - RNA, 23 nt, Staphylococcus aureus subsp. aureus N315
uauugcagcaacgcgauugcuaa

SEQ ID NO: 2137030 - RNA, 15 nt, Staphylococcus aureus subsp. aureus N315
uauugcaauaaaauu

SEQ ID NO: 2137031 - RNA, 14 nt, Staphylococcus aureus subsp. aureus N315
uauugcuuauuuuu

SEQ ID NO: 2137032 - RNA, 17 nt, Staphylococcus aureus subsp. aureus N315
uauugcauuuagacuug

SEQ ID NO: 2137033 - RNA, 16 nt, Staphylococcus aureus subsp. aureus N315
aaauccuaauuuuucu

SEQ ID NO: 2137034 - RNA, 21 nt, Staphylococcus aureus subsp. aureus N315
uauugaacaauuuuugggaag

SEQ ID NO: 2137035 - RNA, 17 nt, Staphylococcus aureus subsp. aureus N315
uauugaaauuaaauuug

SEQ ID NO: 2137036 - RNA, 16 nt, Staphylococcus aureus subsp. aureus N315
uauugaaauaauauaa

SEQ ID NO: 2137037 - RNA, 18 nt, Staphylococcus aureus subsp. aureus N315
uauugaaaucgauacuaa

SEQ ID NO: 2137038 - RNA, 14 nt, Staphylococcus aureus subsp. aureus N315
uauuguuugaaaau

SEQ ID NO: 2137039 - RNA, 14 nt, Staphylococcus aureus subsp. aureus N315
uauuguuuuuaaaa

SEQ ID NO: 2137040 - RNA, 20 nt, Staphylococcus aureus subsp. aureus N315
uauuguuugaaaauuaacua

SEQ ID NO: 2137041 - RNA, 19 nt, Staphylococcus aureus subsp. aureus N315
uauuguuuguuuuuauagu

SEQ ID NO: 2137042 - RNA, 15 nt, Staphylococcus aureus subsp. aureus N315
uauuguuuuauauuu

SEQ ID NO: 2137043 - RNA, 15 nt, Staphylococcus aureus subsp. aureus N315
uauuguuuucaucau

SEQ ID NO: 2137044 - RNA, 20 nt, Staphylococcus aureus subsp. aureus N315
uauuuaacacuucaguuaaa

SEQ ID NO: 2137045 - RNA, 17 nt, Staphylococcus aureus subsp. aureus N315
uauuuaacaucaauuac

SEQ ID NO: 2137046 - RNA, 22 nt, Staphylococcus aureus subsp. aureus N315
uauuggguggucguaauuuggu

SEQ ID NO: 2137047 - RNA, 15 nt, Staphylococcus aureus subsp. aureus N315
uauugguaaauuuau

SEQ ID NO: 2137048 - RNA, 18 nt, Staphylococcus aureus subsp. aureus N315
uauuggucauuacuaaaa

SEQ ID NO: 2137049 - RNA, 20 nt, Staphylococcus aureus subsp. aureus N315
uaugucaaauugaacuuaua

SEQ ID NO: 2137050 - RNA, 22 nt, Staphylococcus aureus subsp. aureus N315
uaugucaauagcgguuuaaaaa

SEQ ID NO: 2137051 - RNA, 14 nt, Staphylococcus aureus subsp. aureus N315
uauguaaucagagu

SEQ ID NO: 2137052 - RNA, 15 nt, Staphylococcus aureus subsp. aureus N315
uaugguucguccauu

SEQ ID NO: 2137053 - RNA, 22 nt, Staphylococcus aureus subsp. aureus N315
uaugguuguuuuccaauaauaa

SEQ ID NO: 2137054 - RNA, 23 nt, Staphylococcus aureus subsp. aureus N315
uauguaacaauuuagcaaauauu

SEQ ID NO: 2137055 - RNA, 20 nt, Staphylococcus aureus subsp. aureus N315
uaugucuagacuuauuugaa

SEQ ID NO: 2137056 - RNA, 21 nt, Staphylococcus aureus subsp. aureus N315
uaugucuagacuuauuugaau

SEQ ID NO: 2137057 - RNA, 22 nt, Staphylococcus aureus subsp. aureus N315
uaugucuagacuuauuugaaug

SEQ ID NO: 2137058 - RNA, 22 nt, Staphylococcus aureus subsp. aureus N315
uaugucauucuaguagcuagaa

SEQ ID NO: 2137059 - RNA, 21 nt, Staphylococcus aureus subsp. aureus N315
uaugucccaaugcugaauaaa

SEQ ID NO: 2137060 - RNA, 16 nt, Staphylococcus aureus subsp. aureus N315
uaugucucucuuucuu

SEQ ID NO: 2137061 - RNA, 21 nt, Staphylococcus aureus subsp. aureus N315
uaugucucucuuucuuauuca

SEQ ID NO: 2137062 - RNA, 21 nt, Staphylococcus aureus subsp. aureus N315
uaugugcaugagacuuauuca

SEQ ID NO: 2137063 - RNA, 16 nt, Staphylococcus aureus subsp. aureus N315
uauguuguuucuaaug

SEQ ID NO: 2137064 - RNA, 13 nt, Staphylococcus aureus subsp. aureus N315
uauguuuauauug

SEQ ID NO: 2137065 - RNA, 21 nt, Staphylococcus aureus subsp. aureus N315
uauguuugggauauagaaaag

SEQ ID NO: 2137066 - RNA, 19 nt, Staphylococcus aureus subsp. aureus N315
uauuaaacauuuuugaauu

SEQ ID NO: 2137067 - RNA, 22 nt, Staphylococcus aureus subsp. aureus N315
uauuaaacauuuuugaauuuaa

SEQ ID NO: 2137068 - RNA, 19 nt, Staphylococcus aureus subsp. aureus N315
uauuaaaauuaaauaauga

SEQ ID NO: 2137069 - RNA, 20 nt, Staphylococcus aureus subsp. aureus N315
uauuaaaaccaaaagaaauu

SEQ ID NO: 2137070 - RNA, 22 nt, Staphylococcus aureus subsp. aureus N315
uauuaaaagcaugauacucaau

SEQ ID NO: 2137071 - RNA, 12 nt, Staphylococcus aureus subsp. aureus N315
uauguguauaug

SEQ ID NO: 2137072 - RNA, 18 nt, Staphylococcus aureus subsp. aureus N315
uauguuacuuauauauuc

SEQ ID NO: 2137073 - RNA, 21 nt, Staphylococcus aureus subsp. aureus N315
uauguuacuuauauauucaau

SEQ ID NO: 2137074 - RNA, 15 nt, Staphylococcus aureus subsp. aureus N315
uauguuauauuaaac

SEQ ID NO: 2137075 - RNA, 19 nt, Staphylococcus aureus subsp. aureus N315
uauguuaaugucuuaaaau

SEQ ID NO: 2137076 - RNA, 21 nt, Staphylococcus aureus subsp. aureus N315
uauguugaaagugacacugua

SEQ ID NO: 2137077 - RNA, 17 nt, Staphylococcus aureus subsp. aureus N315
uauuaguuuuuacguuu

SEQ ID NO: 2137078 - RNA, 19 nt, Staphylococcus aureus subsp. aureus N315
uauuauaaaauaaauauaa

SEQ ID NO: 2137079 - RNA, 21 nt, Staphylococcus aureus subsp. aureus N315
uauuauaaaaacagcagugaa

SEQ ID NO: 2137080 - RNA, 20 nt, Staphylococcus aureus subsp. aureus N315
uauuaucuauccauuugguu

SEQ ID NO: 2137081 - RNA, 14 nt, Staphylococcus aureus subsp. aureus N315
uauuaucuuuaauu

SEQ ID NO: 2137082 - RNA, 15 nt, Staphylococcus aureus subsp. aureus N315
uauuauaaauauuuu

SEQ ID NO: 2137083 - RNA, 23 nt, Staphylococcus aureus subsp. aureus N315
uauuauaaguugcauauaaaaac

SEQ ID NO: 2137084 - RNA, 18 nt, Staphylococcus aureus subsp. aureus N315
uauuauaauaaauagacu

SEQ ID NO: 2137085 - RNA, 17 nt, Staphylococcus aureus subsp. aureus N315
uauuauaauagagaaac

SEQ ID NO: 2137086 - RNA, 22 nt, Staphylococcus aureus subsp. aureus N315
uauuauaacccucguaggcaua

SEQ ID NO: 2137087 - RNA, 20 nt, Staphylococcus aureus subsp. aureus N315
uauuaauuacgucauaaaau

SEQ ID NO: 2137088 - RNA, 16 nt, Staphylococcus aureus subsp. aureus N315
uauuaauuucauugua

SEQ ID NO: 2137089 - RNA, 12 nt, Staphylococcus aureus subsp. aureus N315
uauuaauuucau

SEQ ID NO: 2137090 - RNA, 13 nt, Staphylococcus aureus subsp. aureus N315
uauuacauaauuu

SEQ ID NO: 2137091 - RNA, 21 nt, Staphylococcus aureus subsp. aureus N315
uauuaaucauaaugaauaauu

SEQ ID NO: 2137092 - RNA, 17 nt, Staphylococcus aureus subsp. aureus N315
uauuaaugauugacgau

SEQ ID NO: 2137093 - RNA, 20 nt, Staphylococcus aureus subsp. aureus N315
uauuaauauuagugacauuu

SEQ ID NO: 2137094 - RNA, 16 nt, Staphylococcus aureus subsp. aureus N315
uauuaagugaguuuua

SEQ ID NO: 2137095 - RNA, 17 nt, Staphylococcus aureus subsp. aureus N315
uauuaagacugauuaau

SEQ ID NO: 2137096 - RNA, 17 nt, Staphylococcus aureus subsp. aureus N315
uauuaagaaauacucac

SEQ ID NO: 2137097 - RNA, 18 nt, Staphylococcus aureus subsp. aureus N315
uauuaagcuauacucauu

SEQ ID NO: 2137098 - RNA, 13 nt, Staphylococcus aureus subsp. aureus N315
uauuaacuuuaau

SEQ ID NO: 2137099 - RNA, 20 nt, Staphylococcus aureus subsp. aureus N315
uauuaaauuuuguauaaccu

SEQ ID NO: 2137100 - RNA, 16 nt, Staphylococcus aureus subsp. aureus N315
uauuaaauuugaaagu

SEQ ID NO: 2137101 - RNA, 17 nt, Staphylococcus aureus subsp. aureus N315
uauuaaauauaugcgua

SEQ ID NO: 2137102 - RNA, 12 nt, Staphylococcus aureus subsp. aureus N315
uauuaaaggaaa

SEQ ID NO: 2137103 - RNA, 18 nt, Staphylococcus aureus subsp. aureus N315
uauuaaacgcaauuaacc

SEQ ID NO: 2137104 - RNA, 15 nt, Staphylococcus aureus subsp. aureus N315
ucaauacuugaaaga

SEQ ID NO: 2137105 - RNA, 20 nt, Staphylococcus aureus subsp. aureus N315
ucaauaccauaauuaaauaa

SEQ ID NO: 2137106 - RNA, 22 nt, Staphylococcus aureus subsp. aureus N315
ucaauacgaaguguuauaaaua

SEQ ID NO: 2137107 - RNA, 19 nt, Staphylococcus aureus subsp. aureus N315
ucaauaguuucaaugccuu

SEQ ID NO: 2137108 - RNA, 14 nt, Staphylococcus aureus subsp. aureus N315
ucaauaucuucuaa

SEQ ID NO: 2137109 - RNA, 24 nt, Staphylococcus aureus subsp. aureus N315
ucaauaucuucuucuaaccacuuc

SEQ ID NO: 2137110 - RNA, 16 nt, Staphylococcus aureus subsp. aureus N315
ucaauaucuuuaauug

SEQ ID NO: 2137111 - RNA, 13 nt, Staphylococcus aureus subsp. aureus N315
ucaauaugauaau

SEQ ID NO: 2137112 - RNA, 14 nt, Staphylococcus aureus subsp. aureus N315
ucaauaguuuauaa

SEQ ID NO: 2137113 - RNA, 16 nt, Staphylococcus aureus subsp. aureus N315
ucaauauaacauugca

SEQ ID NO: 2137114 - RNA, 22 nt, Staphylococcus aureus subsp. aureus N315
ucaauaggaauaccacuuaauc

SEQ ID NO: 2137115 - RNA, 23 nt, Staphylococcus aureus subsp. aureus N315
ucaauagcgguuuaaaaaugcug

SEQ ID NO: 2137116 - RNA, 17 nt, Staphylococcus aureus subsp. aureus N315
ucaauagcgguuuaaaa

SEQ ID NO: 2137117 - RNA, 20 nt, Staphylococcus aureus subsp. aureus N315
ucaauagcgguuuaaaaaug

SEQ ID NO: 2137118 - RNA, 13 nt, Staphylococcus aureus subsp. aureus N315
ucaauaaauaaac

SEQ ID NO: 2137119 - RNA, 19 nt, Staphylococcus aureus subsp. aureus N315
ucaauaaauaaacaacugc

SEQ ID NO: 2137120 - RNA, 11 nt, Staphylococcus aureus subsp. aureus N315
ucaauaaauug

SEQ ID NO: 2137121 - RNA, 17 nt, Staphylococcus aureus subsp. aureus N315
ucaauaaaaaugguauu

SEQ ID NO: 2137122 - RNA, 16 nt, Staphylococcus aureus subsp. aureus N315
ucaacuuuuuuaacuu

SEQ ID NO: 2137123 - RNA, 14 nt, Staphylococcus aureus subsp. aureus N315
ucaagaaaaaguuu

SEQ ID NO: 2137124 - RNA, 18 nt, Staphylococcus aureus subsp. aureus N315
ucaauaaugugucaaaua

SEQ ID NO: 2137125 - RNA, 12 nt, Staphylococcus aureus subsp. aureus N315
ucaauaaucuua

SEQ ID NO: 2137126 - RNA, 19 nt, Staphylococcus aureus subsp. aureus N315
ucaauaacaccuuucauuu

SEQ ID NO: 2137127 - RNA, 16 nt, Staphylococcus aureus subsp. aureus N315
ucaauaaggcaauuuu

SEQ ID NO: 2137128 - RNA, 16 nt, Staphylococcus aureus subsp. aureus N315
ucaauaacuauaauca

SEQ ID NO: 2137129 - RNA, 21 nt, Staphylococcus aureus subsp. aureus N315
ucaauuuauaugguuguuuuc

SEQ ID NO: 2137130 - RNA, 19 nt, Staphylococcus aureus subsp. aureus N315
ucaauuuauguugcguuaa

SEQ ID NO: 2137131 - RNA, 23 nt, Staphylococcus aureus subsp. aureus N315
ucaauuuauguugcguuaaauau

SEQ ID NO: 2137132 - RNA, 18 nt, Staphylococcus aureus subsp. aureus N315
ucaauuuaguauaaauaa

SEQ ID NO: 2137133 - RNA, 23 nt, Staphylococcus aureus subsp. aureus N315
ucaauuuaguccuucuuuacuaa

SEQ ID NO: 2137134 - RNA, 15 nt, Staphylococcus aureus subsp. aureus N315
ucaauuguaaaucuu

SEQ ID NO: 2137135 - RNA, 13 nt, Staphylococcus aureus subsp. aureus N315
ucaauuuaauuaa

SEQ ID NO: 2137136 - RNA, 12 nt, Staphylococcus aureus subsp. aureus N315
ucaauuuaaaua

SEQ ID NO: 2137137 - RNA, 15 nt, Staphylococcus aureus subsp. aureus N315
ucaauuauuucaucg

SEQ ID NO: 2137138 - RNA, 21 nt, Staphylococcus aureus subsp. aureus N315
ucaauucacgagcugcuucaa

SEQ ID NO: 2137139 - RNA, 15 nt, Staphylococcus aureus subsp. aureus N315
ucaauucgcucacau

SEQ ID NO: 2137140 - RNA, 21 nt, Staphylococcus aureus subsp. aureus N315
ucaaugugauuuucuuucaua

SEQ ID NO: 2137141 - RNA, 14 nt, Staphylococcus aureus subsp. aureus N315
ucaauguaauuuuc

SEQ ID NO: 2137142 - RNA, 16 nt, Staphylococcus aureus subsp. aureus N315
ucaauguaagcaacau

SEQ ID NO: 2137143 - RNA, 16 nt, Staphylococcus aureus subsp. aureus N315
ucaauguauauuuaac

SEQ ID NO: 2137144 - RNA, 15 nt, Staphylococcus aureus subsp. aureus N315
ucaauguauauuuaa

SEQ ID NO: 2137145 - RNA, 14 nt, Staphylococcus aureus subsp. aureus N315
ucaaugaauuuacu

SEQ ID NO: 2137146 - RNA, 15 nt, Staphylococcus aureus subsp. aureus N315
ucaaugaauucauuu

SEQ ID NO: 2137147 - RNA, 23 nt, Staphylococcus aureus subsp. aureus N315
ucaauccaagcaaucuuaguaca

SEQ ID NO: 2137148 - RNA, 16 nt, Staphylococcus aureus subsp. aureus N315
ucaaugauuuuuaaaa

SEQ ID NO: 2137149 - RNA, 19 nt, Staphylococcus aureus subsp. aureus N315
ucaaugauuuuauaauauu

SEQ ID NO: 2137150 - RNA, 12 nt, Staphylococcus aureus subsp. aureus N315
ucaaugauuuuu

SEQ ID NO: 2137151 - RNA, 21 nt, Staphylococcus aureus subsp. aureus N315
ucaauggugaccaagauucca

SEQ ID NO: 2137152 - RNA, 22 nt, Staphylococcus aureus subsp. aureus N315
ucaaugagcaagucuucuaaaa

SEQ ID NO: 2137153 - RNA, 13 nt, Staphylococcus aureus subsp. aureus N315
ucaaugacaucua

SEQ ID NO: 2137154 - RNA, 18 nt, Staphylococcus aureus subsp. aureus N315
ucaaugacugagaaaaau

SEQ ID NO: 2137155 - RNA, 19 nt, Staphylococcus aureus subsp. aureus N315
ucaaugacugagaaaaaua

SEQ ID NO: 2137156 - RNA, 23 nt, Staphylococcus aureus subsp. aureus N315
ucacaucacguugugcaauaccu

SEQ ID NO: 2137157 - RNA, 14 nt, Staphylococcus aureus subsp. aureus N315
ucacauauaaauau

SEQ ID NO: 2137158 - RNA, 13 nt, Staphylococcus aureus subsp. aureus N315
ucacauauaaaua

SEQ ID NO: 2137159 - RNA, 22 nt, Staphylococcus aureus subsp. aureus N315
ucacaucacguugugcaauacc

SEQ ID NO: 2137160 - RNA, 18 nt, Staphylococcus aureus subsp. aureus N315
ucacauguaccacauuuu

SEQ ID NO: 2137161 - RNA, 21 nt, Staphylococcus aureus subsp. aureus N315
ucacaugaggaucaacugaaa

SEQ ID NO: 2137162 - RNA, 23 nt, Staphylococcus aureus subsp. aureus N315
ucacaucuuuagcuauguaaaau

SEQ ID NO: 2137163 - RNA, 23 nt, Staphylococcus aureus subsp. aureus N315
ucacaugaggaucaacugaaauu

SEQ ID NO: 2137164 - RNA, 20 nt, Staphylococcus aureus subsp. aureus N315
ucaccagguuuuuuauuuuc

SEQ ID NO: 2137165 - RNA, 14 nt, Staphylococcus aureus subsp. aureus N315
ucaccauauuuaac

SEQ ID NO: 2137166 - RNA, 17 nt, Staphylococcus aureus subsp. aureus N315
ucaccauacuaaaacau

SEQ ID NO: 2137167 - RNA, 16 nt, Staphylococcus aureus subsp. aureus N315
ucacauacauuuugaa

SEQ ID NO: 2137168 - RNA, 22 nt, Staphylococcus aureus subsp. aureus N315
ucacauacauuuugaaacaucu

SEQ ID NO: 2137169 - RNA, 20 nt, Staphylococcus aureus subsp. aureus N315
ucacaguaucuucaguuauu

SEQ ID NO: 2137170 - RNA, 21 nt, Staphylococcus aureus subsp. aureus N315
ucacaguacacuaaguuuucu

SEQ ID NO: 2137171 - RNA, 16 nt, Staphylococcus aureus subsp. aureus N315
ucacauaaaauacauu

SEQ ID NO: 2137172 - RNA, 12 nt, Staphylococcus aureus subsp. aureus N315
ucacaaagaaau

SEQ ID NO: 2137173 - RNA, 22 nt, Staphylococcus aureus subsp. aureus N315
ucaauuucaacuuauaaaauga

SEQ ID NO: 2137174 - RNA, 15 nt, Staphylococcus aureus subsp. aureus N315
ucacagcaauaauaa

SEQ ID NO: 2137175 - RNA, 14 nt, Staphylococcus aureus subsp. aureus N315
ucacagcaauaaua

SEQ ID NO: 2137176 - RNA, 13 nt, Staphylococcus aureus subsp. aureus N315
ucaacaaauuuaa

SEQ ID NO: 2137177 - RNA, 18 nt, Staphylococcus aureus subsp. aureus N315
ucaacaacaaguucuuga

SEQ ID NO: 2137178 - RNA, 16 nt, Staphylococcus aureus subsp. aureus N315
ucaacacgauagucau

SEQ ID NO: 2137179 - RNA, 19 nt, Staphylococcus aureus subsp. aureus N315
ucaacagauacuucaguac

SEQ ID NO: 2137180 - RNA, 15 nt, Staphylococcus aureus subsp. aureus N315
ucaacagcaaaaaau

SEQ ID NO: 2137181 - RNA, 17 nt, Staphylococcus aureus subsp. aureus N315
ucaacagcaaaaaauaa

SEQ ID NO: 2137182 - RNA, 22 nt, Staphylococcus aureus subsp. aureus N315
ucaacagcaaaaaauaaaucuc

SEQ ID NO: 2137183 - RNA, 22 nt, Staphylococcus aureus subsp. aureus N315
ucaacacacacaguuuauaaua

SEQ ID NO: 2137184 - RNA, 20 nt, Staphylococcus aureus subsp. aureus N315
ucaaccauuuguucugcaga

SEQ ID NO: 2137185 - RNA, 18 nt, Staphylococcus aureus subsp. aureus N315
ucaacauuaauaaauaau

SEQ ID NO: 2137186 - RNA, 18 nt, Staphylococcus aureus subsp. aureus N315
ucaacauuacuaauugau

SEQ ID NO: 2137187 - RNA, 20 nt, Staphylococcus aureus subsp. aureus N315
ucaacauaacucaaauaucu

SEQ ID NO: 2137188 - RNA, 19 nt, Staphylococcus aureus subsp. aureus N315
ucaacaucaucuuuaauuu

SEQ ID NO: 2137189 - RNA, 17 nt, Staphylococcus aureus subsp. aureus N315
ucaacaucaucuuuaau

SEQ ID NO: 2137190 - RNA, 20 nt, Staphylococcus aureus subsp. aureus N315
ucaacaucguauucuuuuaa

SEQ ID NO: 2137191 - RNA, 19 nt, Staphylococcus aureus subsp. aureus N315
ucaacauaacucaaauauc

SEQ ID NO: 2137192 - RNA, 17 nt, Staphylococcus aureus subsp. aureus N315
ucaacauaaaauuuaaa

SEQ ID NO: 2137193 - RNA, 14 nt, Staphylococcus aureus subsp. aureus N315
ucaacaguuucuug

SEQ ID NO: 2137194 - RNA, 16 nt, Staphylococcus aureus subsp. aureus N315
ucaacaguuuuaaaga

SEQ ID NO: 2137195 - RNA, 16 nt, Staphylococcus aureus subsp. aureus N315
ucaacauaaaauuuaa

SEQ ID NO: 2137196 - RNA, 15 nt, Staphylococcus aureus subsp. aureus N315
ucaacuacugucaau

SEQ ID NO: 2137197 - RNA, 17 nt, Staphylococcus aureus subsp. aureus N315
ucaacuacugucaauau

SEQ ID NO: 2137198 - RNA, 13 nt, Staphylococcus aureus subsp. aureus N315
ucaacuacuucau

SEQ ID NO: 2137199 - RNA, 21 nt, Staphylococcus aureus subsp. aureus N315
ucaacuaauuuaaagcaucau

SEQ ID NO: 2137200 - RNA, 16 nt, Staphylococcus aureus subsp. aureus N315
ucaacuuuaguuguua

SEQ ID NO: 2137201 - RNA, 10 nt, Staphylococcus aureus subsp. aureus N315
ucaacuuuuc

SEQ ID NO: 2137202 - RNA, 12 nt, Staphylococcus aureus subsp. aureus N315
ucaacuuuucaa

SEQ ID NO: 2137203 - RNA, 17 nt, Staphylococcus aureus subsp. aureus N315
ucaacuuuuuaauaaua

SEQ ID NO: 2137204 - RNA, 15 nt, Staphylococcus aureus subsp. aureus N315
ucaacuugauuaauu

SEQ ID NO: 2137205 - RNA, 17 nt, Staphylococcus aureus subsp. aureus N315
ucaacuuauuauuuauc

SEQ ID NO: 2137206 - RNA, 17 nt, Staphylococcus aureus subsp. aureus N315
ucaacgccauauuuauu

SEQ ID NO: 2137207 - RNA, 14 nt, Staphylococcus aureus subsp. aureus N315
ucaacgauugaauu

SEQ ID NO: 2137208 - RNA, 23 nt, Staphylococcus aureus subsp. aureus N315
ucaaccuguucuuuauuuaaagg

SEQ ID NO: 2137209 - RNA, 17 nt, Staphylococcus aureus subsp. aureus N315
ucaacccaucauguaca

SEQ ID NO: 2137210 - RNA, 16 nt, Staphylococcus aureus subsp. aureus N315
uauuuaauguuuuagu

SEQ ID NO: 2137211 - RNA, 13 nt, Staphylococcus aureus subsp. aureus N315
uauuuaauuauuu

SEQ ID NO: 2137212 - RNA, 18 nt, Staphylococcus aureus subsp. aureus N315
uauuuaauuuuuuacuuu

SEQ ID NO: 2137213 - RNA, 19 nt, Staphylococcus aureus subsp. aureus N315
uauuuaauuuugauauuuu

SEQ ID NO: 2137214 - RNA, 18 nt, Staphylococcus aureus subsp. aureus N315
uauuuaauuuuucuaaau

SEQ ID NO: 2137215 - RNA, 12 nt, Staphylococcus aureus subsp. aureus N315
ucaaaacugcca

SEQ ID NO: 2137216 - RNA, 13 nt, Staphylococcus aureus subsp. aureus N315
ucaaaauucaaua

SEQ ID NO: 2137217 - RNA, 20 nt, Staphylococcus aureus subsp. aureus N315
ucaaaauguuuaacaauaau

SEQ ID NO: 2137218 - RNA, 13 nt, Staphylococcus aureus subsp. aureus N315
ucaaaauguuuaa

SEQ ID NO: 2137219 - RNA, 21 nt, Staphylococcus aureus subsp. aureus N315
ucaaaauguuuaacaauaaua

SEQ ID NO: 2137220 - RNA, 19 nt, Staphylococcus aureus subsp. aureus N315
ucaaaaucggauuaacauu

SEQ ID NO: 2137221 - RNA, 19 nt, Staphylococcus aureus subsp. aureus N315
ucaaacaguccuuauuaua

SEQ ID NO: 2137222 - RNA, 13 nt, Staphylococcus aureus subsp. aureus N315
ucaaacaauaaag

SEQ ID NO: 2137223 - RNA, 11 nt, Staphylococcus aureus subsp. aureus N315
ucaaacaacau

SEQ ID NO: 2137224 - RNA, 13 nt, Staphylococcus aureus subsp. aureus N315
ucaaaauuuugac

SEQ ID NO: 2137225 - RNA, 19 nt, Staphylococcus aureus subsp. aureus N315
ucaaauuuaccaguuugau

SEQ ID NO: 2137226 - RNA, 21 nt, Staphylococcus aureus subsp. aureus N315
ucaaauuuaccgucauuauau

SEQ ID NO: 2137227 - RNA, 23 nt, Staphylococcus aureus subsp. aureus N315
ucaaauugguuuucaugugucau

SEQ ID NO: 2137228 - RNA, 16 nt, Staphylococcus aureus subsp. aureus N315
ucaaauugaacuucuu

SEQ ID NO: 2137229 - RNA, 13 nt, Staphylococcus aureus subsp. aureus N315
ucaacaaacauaa

SEQ ID NO: 2137230 - RNA, 13 nt, Staphylococcus aureus subsp. aureus N315
ucaaauuuuucga

SEQ ID NO: 2137231 - RNA, 20 nt, Staphylococcus aureus subsp. aureus N315
ucaaaugccgcuucuaauuu

SEQ ID NO: 2137232 - RNA, 22 nt, Staphylococcus aureus subsp. aureus N315
ucaaauguugaauguggaacau

SEQ ID NO: 2137233 - RNA, 21 nt, Staphylococcus aureus subsp. aureus N315
ucaaauguaacauuaaaaaua

SEQ ID NO: 2137234 - RNA, 22 nt, Staphylococcus aureus subsp. aureus N315
ucaaauucaucaguaccaaaga

SEQ ID NO: 2137235 - RNA, 20 nt, Staphylococcus aureus subsp. aureus N315
ucaaauucaacgucaucaaa

SEQ ID NO: 2137236 - RNA, 18 nt, Staphylococcus aureus subsp. aureus N315
ucaaagcuauauaugaau

SEQ ID NO: 2137237 - RNA, 13 nt, Staphylococcus aureus subsp. aureus N315
ucaaauauaucua

SEQ ID NO: 2137238 - RNA, 15 nt, Staphylococcus aureus subsp. aureus N315
ucaaagccacagcuu

SEQ ID NO: 2137239 - RNA, 21 nt, Staphylococcus aureus subsp. aureus N315
ucaaagcgauaaaguaugagu

SEQ ID NO: 2137240 - RNA, 14 nt, Staphylococcus aureus subsp. aureus N315
ucaaacuuaucgcc

SEQ ID NO: 2137241 - RNA, 13 nt, Staphylococcus aureus subsp. aureus N315
ucacuauacaauc

SEQ ID NO: 2137242 - RNA, 16 nt, Staphylococcus aureus subsp. aureus N315
ucacuaggauguucau

SEQ ID NO: 2137243 - RNA, 19 nt, Staphylococcus aureus subsp. aureus N315
ucacuaggauguucaucaa

SEQ ID NO: 2137244 - RNA, 13 nt, Staphylococcus aureus subsp. aureus N315
ucacuaaaaauau

SEQ ID NO: 2137245 - RNA, 11 nt, Staphylococcus aureus subsp. aureus N315
ucacuucaacg

SEQ ID NO: 2137246 - RNA, 20 nt, Staphylococcus aureus subsp. aureus N315
ucacugcaaacacaguacaa

SEQ ID NO: 2137247 - RNA, 15 nt, Staphylococcus aureus subsp. aureus N315
ucacuuuaacuucuu

SEQ ID NO: 2137248 - RNA, 23 nt, Staphylococcus aureus subsp. aureus N315
ucacuuuagauaaacucuaaaua

SEQ ID NO: 2137249 - RNA, 18 nt, Staphylococcus aureus subsp. aureus N315
ucacuuuaggguucauug

SEQ ID NO: 2137250 - RNA, 15 nt, Staphylococcus aureus subsp. aureus N315
ucacuugguacaccu

SEQ ID NO: 2137251 - RNA, 17 nt, Staphylococcus aureus subsp. aureus N315
ucacuuuauuaaauaac

SEQ ID NO: 2137252 - RNA, 21 nt, Staphylococcus aureus subsp. aureus N315
ucacuuuuuaaacguacauuu

SEQ ID NO: 2137253 - RNA, 16 nt, Staphylococcus aureus subsp. aureus N315
ucagaaucaaguaauu

SEQ ID NO: 2137254 - RNA, 15 nt, Staphylococcus aureus subsp. aureus N315
ucagaacuaugaaua

SEQ ID NO: 2137255 - RNA, 17 nt, Staphylococcus aureus subsp. aureus N315
ucagaugaauaauguuu

SEQ ID NO: 2137256 - RNA, 19 nt, Staphylococcus aureus subsp. aureus N315
ucagauauaaguagcauca

SEQ ID NO: 2137257 - RNA, 12 nt, Staphylococcus aureus subsp. aureus N315
aaaucguuucau

SEQ ID NO: 2137258 - RNA, 15 nt, Staphylococcus aureus subsp. aureus N315
aaaucguuaaggaaa

SEQ ID NO: 2137259 - RNA, 16 nt, Staphylococcus aureus subsp. aureus N315
aaaucuaauuauucau

SEQ ID NO: 2137260 - RNA, 15 nt, Staphylococcus aureus subsp. aureus N315
aaaucgguuugauua

SEQ ID NO: 2137261 - RNA, 14 nt, Staphylococcus aureus subsp. aureus N315
aaaucgguuugauu

SEQ ID NO: 2137262 - RNA, 23 nt, Staphylococcus aureus subsp. aureus N315
aaaucguauagauuaaaaaauca

SEQ ID NO: 2137263 - RNA, 22 nt, Staphylococcus aureus subsp. aureus N315
aaaucuacaauauuaaaauuaa

SEQ ID NO: 2137264 - RNA, 18 nt, Staphylococcus aureus subsp. aureus N315
aaaucuacaauauuaaaa

SEQ ID NO: 2137265 - RNA, 13 nt, Staphylococcus aureus subsp. aureus N315
aaaucuacaauau

SEQ ID NO: 2137266 - RNA, 23 nt, Staphylococcus aureus subsp. aureus N315
ucaguacgguuauuuaauaaugc

SEQ ID NO: 2137267 - RNA, 17 nt, Staphylococcus aureus subsp. aureus N315
ucaguacgaacaacuaa

SEQ ID NO: 2137268 - RNA, 18 nt, Staphylococcus aureus subsp. aureus N315
ucaggcuuaauuaauaaa

SEQ ID NO: 2137269 - RNA, 16 nt, Staphylococcus aureus subsp. aureus N315
aaaucucauaauaauu

SEQ ID NO: 2137270 - RNA, 14 nt, Staphylococcus aureus subsp. aureus N315
aaaucucauaauaa

SEQ ID NO: 2137271 - RNA, 13 nt, Staphylococcus aureus subsp. aureus N315
aaaucuccauuaa

SEQ ID NO: 2137272 - RNA, 13 nt, Staphylococcus aureus subsp. aureus N315
aaaucuauauaaa

SEQ ID NO: 2137273 - RNA, 13 nt, Staphylococcus aureus subsp. aureus N315
aaaucuaucuacu

SEQ ID NO: 2137274 - RNA, 14 nt, Staphylococcus aureus subsp. aureus N315
aaaucuaucuacuc

SEQ ID NO: 2137275 - RNA, 12 nt, Staphylococcus aureus subsp. aureus N315
aaaucuauaaau

SEQ ID NO: 2137276 - RNA, 22 nt, Staphylococcus aureus subsp. aureus N315
ucaggaccaaauagagaaauac

SEQ ID NO: 2137277 - RNA, 21 nt, Staphylococcus aureus subsp. aureus N315
ucagcauugggacauaaaauu

SEQ ID NO: 2137278 - RNA, 21 nt, Staphylococcus aureus subsp. aureus N315
guggcguaguuugaauuggga

SEQ ID NO: 2137279 - RNA, 22 nt, Staphylococcus aureus subsp. aureus N315
guggcaccucuuuuguuuagua

SEQ ID NO: 2137280 - RNA, 12 nt, Staphylococcus aureus subsp. aureus N315
guggcauuuuau

SEQ ID NO: 2137281 - RNA, 17 nt, Staphylococcus aureus subsp. aureus N315
guggcauuuuaucauga

SEQ ID NO: 2137282 - RNA, 15 nt, Staphylococcus aureus subsp. aureus N315
guggaaagucagcuu

SEQ ID NO: 2137283 - RNA, 19 nt, Staphylococcus aureus subsp. aureus N315
aaauauaccaaccaaaacc

SEQ ID NO: 2137284 - RNA, 18 nt, Staphylococcus aureus subsp. aureus N315
aaauauacuaaauuugaa

SEQ ID NO: 2137285 - RNA, 17 nt, Staphylococcus aureus subsp. aureus N315
aaauauaccaaccaaaa

SEQ ID NO: 2137286 - RNA, 16 nt, Staphylococcus aureus subsp. aureus N315
aaauauaaaauccuaa

SEQ ID NO: 2137287 - RNA, 15 nt, Staphylococcus aureus subsp. aureus N315
aaauauaaauaaaag

SEQ ID NO: 2137288 - RNA, 21 nt, Staphylococcus aureus subsp. aureus N315
aaauauaauacuguauuuuaa

SEQ ID NO: 2137289 - RNA, 20 nt, Staphylococcus aureus subsp. aureus N315
guguuaaucaacguauauaa

SEQ ID NO: 2137290 - RNA, 21 nt, Staphylococcus aureus subsp. aureus N315
aaauauccuggaauauuaaca

SEQ ID NO: 2137291 - RNA, 20 nt, Staphylococcus aureus subsp. aureus N315
aaauauccuggaauauuaac

SEQ ID NO: 2137292 - RNA, 15 nt, Staphylococcus aureus subsp. aureus N315
aaauaucauaaaugc

SEQ ID NO: 2137293 - RNA, 16 nt, Staphylococcus aureus subsp. aureus N315
aaauaucaucaaguuu

SEQ ID NO: 2137294 - RNA, 11 nt, Staphylococcus aureus subsp. aureus N315
aaauauauuug

SEQ ID NO: 2137295 - RNA, 11 nt, Staphylococcus aureus subsp. aureus N315
aaauauauuua

SEQ ID NO: 2137296 - RNA, 18 nt, Staphylococcus aureus subsp. aureus N315
aaauauaucuagccugaa

SEQ ID NO: 2137297 - RNA, 15 nt, Staphylococcus aureus subsp. aureus N315
gugugauuuuggaac

SEQ ID NO: 2137298 - RNA, 23 nt, Staphylococcus aureus subsp. aureus N315
aaauauauaaggcgcucucuuuu

SEQ ID NO: 2137299 - RNA, 20 nt, Staphylococcus aureus subsp. aureus N315
aaauauaucaacguuaauau

SEQ ID NO: 2137300 - RNA, 19 nt, Staphylococcus aureus subsp. aureus N315
guguagauaaaucgauaaa

SEQ ID NO: 2137301 - RNA, 15 nt, Staphylococcus aureus subsp. aureus N315
gugucacaaagaaau

SEQ ID NO: 2137302 - RNA, 16 nt, Staphylococcus aureus subsp. aureus N315
gugucauaauccauuc

SEQ ID NO: 2137303 - RNA, 19 nt, Staphylococcus aureus subsp. aureus N315
gugucuaacgcuguuucaa

SEQ ID NO: 2137304 - RNA, 22 nt, Staphylococcus aureus subsp. aureus N315
guguacguuaaucagugaaaua

SEQ ID NO: 2137305 - RNA, 13 nt, Staphylococcus aureus subsp. aureus N315
gugguguuuauau

SEQ ID NO: 2137306 - RNA, 21 nt, Staphylococcus aureus subsp. aureus N315
gugguucauuagcauuauuau

SEQ ID NO: 2137307 - RNA, 17 nt, Staphylococcus aureus subsp. aureus N315
guucaucugauaauucg

SEQ ID NO: 2137308 - RNA, 17 nt, Staphylococcus aureus subsp. aureus N315
guuauugcuuauuuuug

SEQ ID NO: 2137309 - RNA, 18 nt, Staphylococcus aureus subsp. aureus N315
guuauuuauacagugaau

SEQ ID NO: 2137310 - RNA, 21 nt, Staphylococcus aureus subsp. aureus N315
guuauuuuugcuauuucaaca

SEQ ID NO: 2137311 - RNA, 15 nt, Staphylococcus aureus subsp. aureus N315
guucacguuaucaua

SEQ ID NO: 2137312 - RNA, 15 nt, Staphylococcus aureus subsp. aureus N315
guuaggagagaugua

SEQ ID NO: 2137313 - RNA, 15 nt, Staphylococcus aureus subsp. aureus N315
guuagggaaauguag

SEQ ID NO: 2137314 - RNA, 16 nt, Staphylococcus aureus subsp. aureus N315
guuacuuauauauuca

SEQ ID NO: 2137315 - RNA, 19 nt, Staphylococcus aureus subsp. aureus N315
guuacuuucacauuuucaa

SEQ ID NO: 2137316 - RNA, 20 nt, Staphylococcus aureus subsp. aureus N315
guuacucugcgauuucuaaa

SEQ ID NO: 2137317 - RNA, 12 nt, Staphylococcus aureus subsp. aureus N315
guuauauuuuua

SEQ ID NO: 2137318 - RNA, 14 nt, Staphylococcus aureus subsp. aureus N315
guuauauauuccuu

SEQ ID NO: 2137319 - RNA, 20 nt, Staphylococcus aureus subsp. aureus N315
guuaggggcuuuuaugcaug

SEQ ID NO: 2137320 - RNA, 22 nt, Staphylococcus aureus subsp. aureus N315
guuagugauaccuuuaauuguu

SEQ ID NO: 2137321 - RNA, 21 nt, Staphylococcus aureus subsp. aureus N315
guuaguauaaacguccaaaca

SEQ ID NO: 2137322 - RNA, 14 nt, Staphylococcus aureus subsp. aureus N315
guuauaccauauuu

SEQ ID NO: 2137323 - RNA, 21 nt, Staphylococcus aureus subsp. aureus N315
guuauaccauauuuauggugu

SEQ ID NO: 2137324 - RNA, 13 nt, Staphylococcus aureus subsp. aureus N315
guuaugguguguu

SEQ ID NO: 2137325 - RNA, 23 nt, Staphylococcus aureus subsp. aureus N315
guuauguacacgagucauuaaau

SEQ ID NO: 2137326 - RNA, 23 nt, Staphylococcus aureus subsp. aureus N315
guguugaaaaguaauuaaauacu

SEQ ID NO: 2137327 - RNA, 22 nt, Staphylococcus aureus subsp. aureus N315
guuaaaaaauauguauguuuua

SEQ ID NO: 2137328 - RNA, 16 nt, Staphylococcus aureus subsp. aureus N315
guuaaaaaauauguau

SEQ ID NO: 2137329 - RNA, 14 nt, Staphylococcus aureus subsp. aureus N315
guuaaaaaauaugu

SEQ ID NO: 2137330 - RNA, 20 nt, Staphylococcus aureus subsp. aureus N315
guguuuuuaauguuugcuuu

SEQ ID NO: 2137331 - RNA, 11 nt, Staphylococcus aureus subsp. aureus N315
guuaaaaagac

SEQ ID NO: 2137332 - RNA, 22 nt, Staphylococcus aureus subsp. aureus N315
guuaaaauaaccauuuuuucaa

SEQ ID NO: 2137333 - RNA, 19 nt, Staphylococcus aureus subsp. aureus N315
guuaacauuugucauaaua

SEQ ID NO: 2137334 - RNA, 14 nt, Staphylococcus aureus subsp. aureus N315
guuaacaucuucau

SEQ ID NO: 2137335 - RNA, 18 nt, Staphylococcus aureus subsp. aureus N315
guuaagauaccuuuuucu

SEQ ID NO: 2137336 - RNA, 14 nt, Staphylococcus aureus subsp. aureus N315
guuaaccauacaua

SEQ ID NO: 2137337 - RNA, 18 nt, Staphylococcus aureus subsp. aureus N315
guuaaguauuuaaauaac

SEQ ID NO: 2137338 - RNA, 23 nt, Staphylococcus aureus subsp. aureus N315
guuaauuuuauuuuagcagcagu

SEQ ID NO: 2137339 - RNA, 12 nt, Staphylococcus aureus subsp. aureus N315
guuaauuuaucg

SEQ ID NO: 2137340 - RNA, 23 nt, Staphylococcus aureus subsp. aureus N315
guuaauuuaauaauuaaauauaa

SEQ ID NO: 2137341 - RNA, 16 nt, Staphylococcus aureus subsp. aureus N315
guuaauuauguauuuu

SEQ ID NO: 2137342 - RNA, 12 nt, Staphylococcus aureus subsp. aureus N315
guuaauuauaau

SEQ ID NO: 2137343 - RNA, 19 nt, Staphylococcus aureus subsp. aureus N315
guugcaauugaagugaaau

SEQ ID NO: 2137344 - RNA, 15 nt, Staphylococcus aureus subsp. aureus N315
guugcacucuuuucu

SEQ ID NO: 2137345 - RNA, 19 nt, Staphylococcus aureus subsp. aureus N315
guucuccgaucaugccuuc

SEQ ID NO: 2137346 - RNA, 15 nt, Staphylococcus aureus subsp. aureus N315
guucucgucuuucgu

SEQ ID NO: 2137347 - RNA, 21 nt, Staphylococcus aureus subsp. aureus N315
guucuaaccauucguaauaaa

SEQ ID NO: 2137348 - RNA, 15 nt, Staphylococcus aureus subsp. aureus N315
guugguugugauuug

SEQ ID NO: 2137349 - RNA, 17 nt, Staphylococcus aureus subsp. aureus N315
guugguauuaauuuuuc

SEQ ID NO: 2137350 - RNA, 14 nt, Staphylococcus aureus subsp. aureus N315
guugcuucuuauca

SEQ ID NO: 2137351 - RNA, 18 nt, Staphylococcus aureus subsp. aureus N315
guuggcggggccccaaca

SEQ ID NO: 2137352 - RNA, 13 nt, Staphylococcus aureus subsp. aureus N315
guugcucgugcau

SEQ ID NO: 2137353 - RNA, 21 nt, Staphylococcus aureus subsp. aureus N315
guugcugaauaaaauauaucu

SEQ ID NO: 2137354 - RNA, 22 nt, Staphylococcus aureus subsp. aureus N315
guugcuuaaucgggcuauauuu

SEQ ID NO: 2137355 - RNA, 15 nt, Staphylococcus aureus subsp. aureus N315
guuuacuauacuuug

SEQ ID NO: 2137356 - RNA, 20 nt, Staphylococcus aureus subsp. aureus N315
guuuaauuaaaauacaaauu

SEQ ID NO: 2137357 - RNA, 15 nt, Staphylococcus aureus subsp. aureus N315
guuuaaguuuuucag

SEQ ID NO: 2137358 - RNA, 17 nt, Staphylococcus aureus subsp. aureus N315
guuuaaucgcauuguua

SEQ ID NO: 2137359 - RNA, 19 nt, Staphylococcus aureus subsp. aureus N315
guuuaaucgcauuguuaaa

SEQ ID NO: 2137360 - RNA, 21 nt, Staphylococcus aureus subsp. aureus N315
guuguauucugaaacuuuaau

SEQ ID NO: 2137361 - RNA, 22 nt, Staphylococcus aureus subsp. aureus N315
guugucacuuggauucaaauga

SEQ ID NO: 2137362 - RNA, 19 nt, Staphylococcus aureus subsp. aureus N315
guuuaaauucauuuuaagu

SEQ ID NO: 2137363 - RNA, 18 nt, Staphylococcus aureus subsp. aureus N315
guuuaacaacacuaccca

SEQ ID NO: 2137364 - RNA, 19 nt, Staphylococcus aureus subsp. aureus N315
guuuaucuguaucaaaauc

SEQ ID NO: 2137365 - RNA, 20 nt, Staphylococcus aureus subsp. aureus N315
guuuaucuguugucaucaug

SEQ ID NO: 2137366 - RNA, 18 nt, Staphylococcus aureus subsp. aureus N315
guuuauccuuuaaaucau

SEQ ID NO: 2137367 - RNA, 23 nt, Staphylococcus aureus subsp. aureus N315
guuuaucgaucgguauuuucauu

SEQ ID NO: 2137368 - RNA, 17 nt, Staphylococcus aureus subsp. aureus N315
guuuauauugcaaaaau

SEQ ID NO: 2137369 - RNA, 13 nt, Staphylococcus aureus subsp. aureus N315
guuuaucagcuuu

SEQ ID NO: 2137370 - RNA, 16 nt, Staphylococcus aureus subsp. aureus N315
guuuaucagcuuuaau

SEQ ID NO: 2137371 - RNA, 23 nt, Staphylococcus aureus subsp. aureus N315
guuucaacauuucagcauuugcu

SEQ ID NO: 2137372 - RNA, 21 nt, Staphylococcus aureus subsp. aureus N315
guuucaagcguuucuugaucu

SEQ ID NO: 2137373 - RNA, 22 nt, Staphylococcus aureus subsp. aureus N315
guuucaaugaguucuaguuuuu

SEQ ID NO: 2137374 - RNA, 20 nt, Staphylococcus aureus subsp. aureus N315
guuucaaucgcauuuuguuu

SEQ ID NO: 2137375 - RNA, 16 nt, Staphylococcus aureus subsp. aureus N315
aaauaucuuuuucuaa

SEQ ID NO: 2137376 - RNA, 17 nt, Staphylococcus aureus subsp. aureus N315
aaauaucuaaacaauuc

SEQ ID NO: 2137377 - RNA, 20 nt, Staphylococcus aureus subsp. aureus N315
aaauaucuaccuuuuaauuu

SEQ ID NO: 2137378 - RNA, 18 nt, Staphylococcus aureus subsp. aureus N315
aaauaugaauaaugcaau

SEQ ID NO: 2137379 - RNA, 15 nt, Staphylococcus aureus subsp. aureus N315
aaauaugacacauac

SEQ ID NO: 2137380 - RNA, 15 nt, Staphylococcus aureus subsp. aureus N315
guuucacguaaugaa

SEQ ID NO: 2137381 - RNA, 19 nt, Staphylococcus aureus subsp. aureus N315
guuucauauggugaacugu

SEQ ID NO: 2137382 - RNA, 13 nt, Staphylococcus aureus subsp. aureus N315
guuuccaaucuau

SEQ ID NO: 2137383 - RNA, 22 nt, Staphylococcus aureus subsp. aureus N315
aaauauuaauauaaaauaaagu

SEQ ID NO: 2137384 - RNA, 15 nt, Staphylococcus aureus subsp. aureus N315
aaauauuauuaaauc

SEQ ID NO: 2137385 - RNA, 16 nt, Staphylococcus aureus subsp. aureus N315
aaauauuacuaacaac

SEQ ID NO: 2137386 - RNA, 21 nt, Staphylococcus aureus subsp. aureus N315
aaauauguauguuuuaucaau

SEQ ID NO: 2137387 - RNA, 15 nt, Staphylococcus aureus subsp. aureus N315
aaauauuaaauuaug

SEQ ID NO: 2137388 - RNA, 12 nt, Staphylococcus aureus subsp. aureus N315
aaauauuaaaaa

SEQ ID NO: 2137389 - RNA, 19 nt, Staphylococcus aureus subsp. aureus N315
aaauauggaauuucauaua

SEQ ID NO: 2137390 - RNA, 20 nt, Staphylococcus aureus subsp. aureus N315
aaaucaguuuuuaaaucaaa

SEQ ID NO: 2137391 - RNA, 13 nt, Staphylococcus aureus subsp. aureus N315
aaaucauauauuu

SEQ ID NO: 2137392 - RNA, 18 nt, Staphylococcus aureus subsp. aureus N315
aaaucauauauuucuauu

SEQ ID NO: 2137393 - RNA, 17 nt, Staphylococcus aureus subsp. aureus N315
aaaucauacgagaaauu

SEQ ID NO: 2137394 - RNA, 13 nt, Staphylococcus aureus subsp. aureus N315
aaaucauaaauaa

SEQ ID NO: 2137395 - RNA, 19 nt, Staphylococcus aureus subsp. aureus N315
aaaucauucuuuauagaaa

SEQ ID NO: 2137396 - RNA, 20 nt, Staphylococcus aureus subsp. aureus N315
aaaucauucaccuaaaaaga

SEQ ID NO: 2137397 - RNA, 16 nt, Staphylococcus aureus subsp. aureus N315
aaauccacacauuaag

SEQ ID NO: 2137398 - RNA, 15 nt, Staphylococcus aureus subsp. aureus N315
guuuuauuuauaaac

SEQ ID NO: 2137399 - RNA, 21 nt, Staphylococcus aureus subsp. aureus N315
guuuucuuuauuuuaaacaug

SEQ ID NO: 2137400 - RNA, 12 nt, Staphylococcus aureus subsp. aureus N315
guuuucuuuuca

SEQ ID NO: 2137401 - RNA, 22 nt, Staphylococcus aureus subsp. aureus N315
guuuucacuguuuuaucuacag

SEQ ID NO: 2137402 - RNA, 17 nt, Staphylococcus aureus subsp. aureus N315
guuuucacuguuuuauc

SEQ ID NO: 2137403 - RNA, 12 nt, Staphylococcus aureus subsp. aureus N315
guuuugcuaacc

SEQ ID NO: 2137404 - RNA, 15 nt, Staphylococcus aureus subsp. aureus N315
guuuugaagaauaaa

SEQ ID NO: 2137405 - RNA, 12 nt, Staphylococcus aureus subsp. aureus N315
guuuugagagau

SEQ ID NO: 2137406 - RNA, 19 nt, Staphylococcus aureus subsp. aureus N315
guuucugacuuuuaaaaaa

SEQ ID NO: 2137407 - RNA, 14 nt, Staphylococcus aureus subsp. aureus N315
guuucugacuuuua

SEQ ID NO: 2137408 - RNA, 14 nt, Staphylococcus aureus subsp. aureus N315
guuucuuaacauaa

SEQ ID NO: 2137409 - RNA, 16 nt, Staphylococcus aureus subsp. aureus N315
guuucuucaauugucu

SEQ ID NO: 2137410 - RNA, 17 nt, Staphylococcus aureus subsp. aureus N315
guuucuuccgcacugcc

SEQ ID NO: 2137411 - RNA, 14 nt, Staphylococcus aureus subsp. aureus N315
guuugaccacaacu

SEQ ID NO: 2137412 - RNA, 13 nt, Staphylococcus aureus subsp. aureus N315
guuugcuuuaaaa

SEQ ID NO: 2137413 - RNA, 15 nt, Staphylococcus aureus subsp. aureus N315
guuugcguuuuaauu

SEQ ID NO: 2137414 - RNA, 19 nt, Staphylococcus aureus subsp. aureus N315
guuuuacuauaaugaugua

SEQ ID NO: 2137415 - RNA, 16 nt, Staphylococcus aureus subsp. aureus N315
guuuguuucuaaauuc

SEQ ID NO: 2137416 - RNA, 21 nt, Staphylococcus aureus subsp. aureus N315
guuugugguaaugauuuugcu

SEQ ID NO: 2137417 - RNA, 19 nt, Staphylococcus aureus subsp. aureus N315
guuuguuacauauugcauu

SEQ ID NO: 2137418 - RNA, 14 nt, Staphylococcus aureus subsp. aureus N315
aaaucaaguguugu

SEQ ID NO: 2137419 - RNA, 12 nt, Staphylococcus aureus subsp. aureus N315
aaaucaauccau

SEQ ID NO: 2137420 - RNA, 15 nt, Staphylococcus aureus subsp. aureus N315
aaaucaauccaucaa

SEQ ID NO: 2137421 - RNA, 16 nt, Staphylococcus aureus subsp. aureus N315
aaaucaauccaucaau

SEQ ID NO: 2137422 - RNA, 21 nt, Staphylococcus aureus subsp. aureus N315
guuucggaaaaagaugaaaaa

SEQ ID NO: 2137423 - RNA, 13 nt, Staphylococcus aureus subsp. aureus N315
guuucgucagauu

SEQ ID NO: 2137424 - RNA, 19 nt, Staphylococcus aureus subsp. aureus N315
guuucgucuacuauuuuuu

SEQ ID NO: 2137425 - RNA, 14 nt, Staphylococcus aureus subsp. aureus N315
guuucuaaauucuu

SEQ ID NO: 2137426 - RNA, 17 nt, Staphylococcus aureus subsp. aureus N315
guuucuaaauucuuuuu

SEQ ID NO: 2137427 - RNA, 20 nt, Staphylococcus aureus subsp. aureus N315
guuucuauaaagaaugauuu

SEQ ID NO: 2137428 - RNA, 23 nt, Staphylococcus aureus subsp. aureus N315
aaaucacgauuuucaaguaauga

SEQ ID NO: 2137429 - RNA, 14 nt, Staphylococcus aureus subsp. aureus N315
aaaucacgccauaa

SEQ ID NO: 2137430 - RNA, 18 nt, Staphylococcus aureus subsp. aureus N315
aaaucaccagauuuuaag

SEQ ID NO: 2137431 - RNA, 12 nt, Staphylococcus aureus subsp. aureus N315
aaaucaccaaca

SEQ ID NO: 2137432 - RNA, 20 nt, Staphylococcus aureus subsp. aureus N315
aaaucacauaugauaauuaa

SEQ ID NO: 2137433 - RNA, 20 nt, Staphylococcus aureus subsp. aureus N315
aaaucaacaagaacuuagaa

SEQ ID NO: 2137434 - RNA, 21 nt, Staphylococcus aureus subsp. aureus N315
aaaucaaauauacuuuuacca

SEQ ID NO: 2137435 - RNA, 14 nt, Staphylococcus aureus subsp. aureus N315
aaaucaaauauuug

SEQ ID NO: 2137436 - RNA, 11 nt, Staphylococcus aureus subsp. aureus N315
aaaucaaagag

SEQ ID NO: 2137437 - RNA, 15 nt, Staphylococcus aureus subsp. aureus N315
aaauauuuuaucugu

SEQ ID NO: 2137438 - RNA, 15 nt, Staphylococcus aureus subsp. aureus N315
aaauauuuuuuaaaa

SEQ ID NO: 2137439 - RNA, 14 nt, Staphylococcus aureus subsp. aureus N315
aaauauuuuuucug

SEQ ID NO: 2137440 - RNA, 14 nt, Staphylococcus aureus subsp. aureus N315
aaauauuugaugau

SEQ ID NO: 2137441 - RNA, 21 nt, Staphylococcus aureus subsp. aureus N315
aaauauuugaugaucccaaaa

SEQ ID NO: 2137442 - RNA, 21 nt, Staphylococcus aureus subsp. aureus N315
aaauauuuacauugccacuuu

SEQ ID NO: 2137443 - RNA, 20 nt, Staphylococcus aureus subsp. aureus N315
aaauauuuaaccuuuaaaac

SEQ ID NO: 2137444 - RNA, 11 nt, Staphylococcus aureus subsp. aureus N315
aaauauuuaau

SEQ ID NO: 2137445 - RNA, 19 nt, Staphylococcus aureus subsp. aureus N315
aaauauugcguuuaauuua

SEQ ID NO: 2137446 - RNA, 22 nt, Staphylococcus aureus subsp. aureus N315
aaauauuucuaaaccauuuuca

SEQ ID NO: 2137447 - RNA, 16 nt, Staphylococcus aureus subsp. aureus N315
aaauauuugaaaauuu

SEQ ID NO: 2137448 - RNA, 12 nt, Staphylococcus aureus subsp. aureus N315
aaauauuugaaa

SEQ ID NO: 2137449 - RNA, 13 nt, Staphylococcus aureus subsp. aureus N315
aaauauuugaaaa

SEQ ID NO: 2137450 - RNA, 17 nt, Staphylococcus aureus subsp. aureus N315
aaauauuugaaaauuuc

SEQ ID NO: 2137451 - RNA, 20 nt, Staphylococcus aureus subsp. aureus N315
aaauauuugaaaauuucacc

SEQ ID NO: 2137452 - RNA, 11 nt, Staphylococcus aureus subsp. aureus N315
guuucccaagc

SEQ ID NO: 2137453 - RNA, 14 nt, Staphylococcus aureus subsp. aureus N315
guuuccauaaauaa

SEQ ID NO: 2137454 - RNA, 16 nt, Staphylococcus aureus subsp. aureus N315
aaauauuggaauacuc

SEQ ID NO: 2137455 - RNA, 15 nt, Staphylococcus aureus subsp. aureus N315
aaauauuuaaacuag

SEQ ID NO: 2137456 - RNA, 17 nt, Staphylococcus aureus subsp. aureus N315
aaauauuguaaucacua

SEQ ID NO: 2137457 - RNA, 17 nt, Staphylococcus aureus subsp. aureus N315
gugaagagaugaaagau

SEQ ID NO: 2137458 - RNA, 16 nt, Staphylococcus aureus subsp. aureus N315
aaauagcguaauuauu

SEQ ID NO: 2137459 - RNA, 15 nt, Staphylococcus aureus subsp. aureus N315
aaauagcuauuaaaa

SEQ ID NO: 2137460 - RNA, 16 nt, Staphylococcus aureus subsp. aureus N315
aaauagcuauuaaaau

SEQ ID NO: 2137461 - RNA, 17 nt, Staphylococcus aureus subsp. aureus N315
aaauagcuauuaaaaua

SEQ ID NO: 2137462 - RNA, 22 nt, Staphylococcus aureus subsp. aureus N315
aaauagcugcaaucguugaaaa

SEQ ID NO: 2137463 - RNA, 23 nt, Staphylococcus aureus subsp. aureus N315
gugaauauaaguaaucauaauaa

SEQ ID NO: 2137464 - RNA, 23 nt, Staphylococcus aureus subsp. aureus N315
gugaaucuuauuuuguuuuaaaa

SEQ ID NO: 2137465 - RNA, 20 nt, Staphylococcus aureus subsp. aureus N315
gugaaucuuauuuuguuuua

SEQ ID NO: 2137466 - RNA, 16 nt, Staphylococcus aureus subsp. aureus N315
gugaaucuaaacuaua

SEQ ID NO: 2137467 - RNA, 13 nt, Staphylococcus aureus subsp. aureus N315
gugacauuuucaa

SEQ ID NO: 2137468 - RNA, 19 nt, Staphylococcus aureus subsp. aureus N315
aaauaguucuuuaaauuau

SEQ ID NO: 2137469 - RNA, 19 nt, Staphylococcus aureus subsp. aureus N315
aaauaguucaaaauacuca

SEQ ID NO: 2137470 - RNA, 18 nt, Staphylococcus aureus subsp. aureus N315
aaauagucggggccccaa

SEQ ID NO: 2137471 - RNA, 22 nt, Staphylococcus aureus subsp. aureus N315
aaauaggguaauagaucuaucg

SEQ ID NO: 2137472 - RNA, 22 nt, Staphylococcus aureus subsp. aureus N315
gugauaauuaaaauaagauaua

SEQ ID NO: 2137473 - RNA, 16 nt, Staphylococcus aureus subsp. aureus N315
gugauaaauaaugcau

SEQ ID NO: 2137474 - RNA, 11 nt, Staphylococcus aureus subsp. aureus N315
gugauaaaaau

SEQ ID NO: 2137475 - RNA, 19 nt, Staphylococcus aureus subsp. aureus N315
gugagggccccaacacaga

SEQ ID NO: 2137476 - RNA, 15 nt, Staphylococcus aureus subsp. aureus N315
gugaggcccauaaau

SEQ ID NO: 2137477 - RNA, 17 nt, Staphylococcus aureus subsp. aureus N315
gugacuuuuauaauucu

SEQ ID NO: 2137478 - RNA, 20 nt, Staphylococcus aureus subsp. aureus N315
gugagauacguuauuucaau

SEQ ID NO: 2137479 - RNA, 15 nt, Staphylococcus aureus subsp. aureus N315
gugacucaaugaauu

SEQ ID NO: 2137480 - RNA, 18 nt, Staphylococcus aureus subsp. aureus N315
gugcaauaauaaauagga

SEQ ID NO: 2137481 - RNA, 16 nt, Staphylococcus aureus subsp. aureus N315
gugcaaguauaaucca

SEQ ID NO: 2137482 - RNA, 22 nt, Staphylococcus aureus subsp. aureus N315
gugcaagugguaaaaaugaacc

SEQ ID NO: 2137483 - RNA, 22 nt, Staphylococcus aureus subsp. aureus N315
gugcaauaauaaauaggaugaa

SEQ ID NO: 2137484 - RNA, 23 nt, Staphylococcus aureus subsp. aureus N315
gugcaauauuauauuuugaauca

SEQ ID NO: 2137485 - RNA, 13 nt, Staphylococcus aureus subsp. aureus N315
gugauucaucuau

SEQ ID NO: 2137486 - RNA, 17 nt, Staphylococcus aureus subsp. aureus N315
gugauaauguacaugua

SEQ ID NO: 2137487 - RNA, 17 nt, Staphylococcus aureus subsp. aureus N315
gugcaggauaacguuca

SEQ ID NO: 2137488 - RNA, 20 nt, Staphylococcus aureus subsp. aureus N315
gugaaauucgaacuaucaau

SEQ ID NO: 2137489 - RNA, 21 nt, Staphylococcus aureus subsp. aureus N315
gugaaauuagaaaaauaugau

SEQ ID NO: 2137490 - RNA, 22 nt, Staphylococcus aureus subsp. aureus N315
aaauagccauauucauauuacu

SEQ ID NO: 2137491 - RNA, 21 nt, Staphylococcus aureus subsp. aureus N315
gugaaaauuuauucaaaucau

SEQ ID NO: 2137492 - RNA, 20 nt, Staphylococcus aureus subsp. aureus N315
gucuuguggcacauaaccga

SEQ ID NO: 2137493 - RNA, 16 nt, Staphylococcus aureus subsp. aureus N315
gucuugugauaauucu

SEQ ID NO: 2137494 - RNA, 14 nt, Staphylococcus aureus subsp. aureus N315
gucuugugauaauu

SEQ ID NO: 2137495 - RNA, 15 nt, Staphylococcus aureus subsp. aureus N315
gucuuguaaacuucu

SEQ ID NO: 2137496 - RNA, 20 nt, Staphylococcus aureus subsp. aureus N315
gucuuucucggcgauaaaau

SEQ ID NO: 2137497 - RNA, 12 nt, Staphylococcus aureus subsp. aureus N315
gucuuaaacaua

SEQ ID NO: 2137498 - RNA, 11 nt, Staphylococcus aureus subsp. aureus N315
gucuuaaacau

SEQ ID NO: 2137499 - RNA, 18 nt, Staphylococcus aureus subsp. aureus N315
gucuuacuuuuaaauuaa

SEQ ID NO: 2137500 - RNA, 13 nt, Staphylococcus aureus subsp. aureus N315
gucuuaauucauu

SEQ ID NO: 2137501 - RNA, 19 nt, Staphylococcus aureus subsp. aureus N315
gucuuccaaucaacuucau

SEQ ID NO: 2137502 - RNA, 16 nt, Staphylococcus aureus subsp. aureus N315
gucuugcaauaccucc

SEQ ID NO: 2137503 - RNA, 18 nt, Staphylococcus aureus subsp. aureus N315
gucucuaaaacuuuuuca

SEQ ID NO: 2137504 - RNA, 20 nt, Staphylococcus aureus subsp. aureus N315
gucucauaucuauuuuucga

SEQ ID NO: 2137505 - RNA, 16 nt, Staphylococcus aureus subsp. aureus N315
gucguuguaaaacuaa

SEQ ID NO: 2137506 - RNA, 20 nt, Staphylococcus aureus subsp. aureus N315
gucugaugucgaaaauagcu

SEQ ID NO: 2137507 - RNA, 18 nt, Staphylococcus aureus subsp. aureus N315
gucugcauuaauuucaug

SEQ ID NO: 2137508 - RNA, 13 nt, Staphylococcus aureus subsp. aureus N315
gucuggaauaaau

SEQ ID NO: 2137509 - RNA, 23 nt, Staphylococcus aureus subsp. aureus N315
gucuguaaauuaucuaaagaaau

SEQ ID NO: 2137510 - RNA, 22 nt, Staphylococcus aureus subsp. aureus N315
gucgcacuauaaaauucaccaa

SEQ ID NO: 2137511 - RNA, 14 nt, Staphylococcus aureus subsp. aureus N315
gucgguucaucuaa

SEQ ID NO: 2137512 - RNA, 16 nt, Staphylococcus aureus subsp. aureus N315
gucgaaaauagcuauu

SEQ ID NO: 2137513 - RNA, 19 nt, Staphylococcus aureus subsp. aureus N315
gucgaaaauagcuauuaaa

SEQ ID NO: 2137514 - RNA, 20 nt, Staphylococcus aureus subsp. aureus N315
gucgaaaauagcuauuaaaa

SEQ ID NO: 2137515 - RNA, 22 nt, Staphylococcus aureus subsp. aureus N315
gucgaaaauagcuauuaaaaua

SEQ ID NO: 2137516 - RNA, 22 nt, Staphylococcus aureus subsp. aureus N315
gucgauaaauaugauguuaaaa

SEQ ID NO: 2137517 - RNA, 19 nt, Staphylococcus aureus subsp. aureus N315
gucccauaaggaaccuguc

SEQ ID NO: 2137518 - RNA, 17 nt, Staphylococcus aureus subsp. aureus N315
gucccauaaaagacaga

SEQ ID NO: 2137519 - RNA, 17 nt, Staphylococcus aureus subsp. aureus N315
guccgcuuuuucauaga

SEQ ID NO: 2137520 - RNA, 21 nt, Staphylococcus aureus subsp. aureus N315
gucaaugacugagaaaaauau

SEQ ID NO: 2137521 - RNA, 16 nt, Staphylococcus aureus subsp. aureus N315
gucaauucaaacugau

SEQ ID NO: 2137522 - RNA, 21 nt, Staphylococcus aureus subsp. aureus N315
gucaacuuuuuuaacuuuaac

SEQ ID NO: 2137523 - RNA, 23 nt, Staphylococcus aureus subsp. aureus N315
gucaacuuagcuuagucaaugua

SEQ ID NO: 2137524 - RNA, 12 nt, Staphylococcus aureus subsp. aureus N315
gucaacugcugc

SEQ ID NO: 2137525 - RNA, 19 nt, Staphylococcus aureus subsp. aureus N315
ggugaaaguacuuggaaaa

SEQ ID NO: 2137526 - RNA, 19 nt, Staphylococcus aureus subsp. aureus N315
gucaacuacugucaauaua

SEQ ID NO: 2137527 - RNA, 23 nt, Staphylococcus aureus subsp. aureus N315
guccagcuaauaacgcugcaccu

SEQ ID NO: 2137528 - RNA, 22 nt, Staphylococcus aureus subsp. aureus N315
gucccagauucauaucuuucaa

SEQ ID NO: 2137529 - RNA, 20 nt, Staphylococcus aureus subsp. aureus N315
guccaucauuuguguuuuua

SEQ ID NO: 2137530 - RNA, 14 nt, Staphylococcus aureus subsp. aureus N315
guccaauaaugaaa

SEQ ID NO: 2137531 - RNA, 15 nt, Staphylococcus aureus subsp. aureus N315
guccaauaaugaaau

SEQ ID NO: 2137532 - RNA, 21 nt, Staphylococcus aureus subsp. aureus N315
gucaucaaaaguuuguauauu

SEQ ID NO: 2137533 - RNA, 18 nt, Staphylococcus aureus subsp. aureus N315
gucauauguuuuauaaua

SEQ ID NO: 2137534 - RNA, 21 nt, Staphylococcus aureus subsp. aureus N315
gucaucaccuuguuaaaauaa

SEQ ID NO: 2137535 - RNA, 11 nt, Staphylococcus aureus subsp. aureus N315
gucaucaacac

SEQ ID NO: 2137536 - RNA, 13 nt, Staphylococcus aureus subsp. aureus N315
gucauuacaaauc

SEQ ID NO: 2137537 - RNA, 14 nt, Staphylococcus aureus subsp. aureus N315
gucauuuugauuaa

SEQ ID NO: 2137538 - RNA, 19 nt, Staphylococcus aureus subsp. aureus N315
gucaucuugagauuuucaa

SEQ ID NO: 2137539 - RNA, 22 nt, Staphylococcus aureus subsp. aureus N315
gucaucuucaauucuuacaccu

SEQ ID NO: 2137540 - RNA, 16 nt, Staphylococcus aureus subsp. aureus N315
gucaucuuucaacgca

SEQ ID NO: 2137541 - RNA, 17 nt, Staphylococcus aureus subsp. aureus N315
gucaucuggaauaccua

SEQ ID NO: 2137542 - RNA, 16 nt, Staphylococcus aureus subsp. aureus N315
uacgccuucuuuauaa

SEQ ID NO: 2137543 - RNA, 17 nt, Staphylococcus aureus subsp. aureus N315
uacgcccaucaucacug

SEQ ID NO: 2137544 - RNA, 20 nt, Staphylococcus aureus subsp. aureus N315
uacgccaccaguuucaagug

SEQ ID NO: 2137545 - RNA, 17 nt, Staphylococcus aureus subsp. aureus N315
uacgcaaugauuauaaa

SEQ ID NO: 2137546 - RNA, 22 nt, Staphylococcus aureus subsp. aureus N315
uacgcaaugauuauaaauacau

SEQ ID NO: 2137547 - RNA, 18 nt, Staphylococcus aureus subsp. aureus N315
uacgacgucgcaacagga

SEQ ID NO: 2137548 - RNA, 20 nt, Staphylococcus aureus subsp. aureus N315
uacgauaacuacacuuaaua

SEQ ID NO: 2137549 - RNA, 15 nt, Staphylococcus aureus subsp. aureus N315
uacgauaaauaguga

SEQ ID NO: 2137550 - RNA, 12 nt, Staphylococcus aureus subsp. aureus N315
uacgauuuucaa

SEQ ID NO: 2137551 - RNA, 19 nt, Staphylococcus aureus subsp. aureus N315
uaccguauuuuaauauuga

SEQ ID NO: 2137552 - RNA, 21 nt, Staphylococcus aureus subsp. aureus N315
uacuaaccuauuaaaauaaac

SEQ ID NO: 2137553 - RNA, 17 nt, Staphylococcus aureus subsp. aureus N315
uacuaaccuauuaaaau

SEQ ID NO: 2137554 - RNA, 13 nt, Staphylococcus aureus subsp. aureus N315
uacuaaaucauuu

SEQ ID NO: 2137555 - RNA, 21 nt, Staphylococcus aureus subsp. aureus N315
uacuaaauaaguaguucagca

SEQ ID NO: 2137556 - RNA, 16 nt, Staphylococcus aureus subsp. aureus N315
uacgucauaaaauacc

SEQ ID NO: 2137557 - RNA, 14 nt, Staphylococcus aureus subsp. aureus N315
uacgucauaaaaua

SEQ ID NO: 2137558 - RNA, 13 nt, Staphylococcus aureus subsp. aureus N315
uacuaauaucuuc

SEQ ID NO: 2137559 - RNA, 15 nt, Staphylococcus aureus subsp. aureus N315
uacuaauauauuaau

SEQ ID NO: 2137560 - RNA, 16 nt, Staphylococcus aureus subsp. aureus N315
uacuaacugaagacac

SEQ ID NO: 2137561 - RNA, 22 nt, Staphylococcus aureus subsp. aureus N315
uacuaagcgcucauaaacgauu

SEQ ID NO: 2137562 - RNA, 18 nt, Staphylococcus aureus subsp. aureus N315
uacuaacaauuacgacaa

SEQ ID NO: 2137563 - RNA, 12 nt, Staphylococcus aureus subsp. aureus N315
uacuaauuucua

SEQ ID NO: 2137564 - RNA, 22 nt, Staphylococcus aureus subsp. aureus N315
uacuaccguuuuuauauacuug

SEQ ID NO: 2137565 - RNA, 23 nt, Staphylococcus aureus subsp. aureus N315
uacuaauuucuauagaaaaagua

SEQ ID NO: 2137566 - RNA, 21 nt, Staphylococcus aureus subsp. aureus N315
uacguaucaagaaaaaguuuu

SEQ ID NO: 2137567 - RNA, 14 nt, Staphylococcus aureus subsp. aureus N315
uacucuuuuucuuu

SEQ ID NO: 2137568 - RNA, 21 nt, Staphylococcus aureus subsp. aureus N315
uacugaaacaugagcuccucu

SEQ ID NO: 2137569 - RNA, 20 nt, Staphylococcus aureus subsp. aureus N315
uacugaaacuaaauuaaaag

SEQ ID NO: 2137570 - RNA, 22 nt, Staphylococcus aureus subsp. aureus N315
uacugcccaauguguuuaacuu

SEQ ID NO: 2137571 - RNA, 21 nt, Staphylococcus aureus subsp. aureus N315
uacugcagcaucauaaucuuu

SEQ ID NO: 2137572 - RNA, 17 nt, Staphylococcus aureus subsp. aureus N315
uacugcaauuauuuuuc

SEQ ID NO: 2137573 - RNA, 17 nt, Staphylococcus aureus subsp. aureus N315
uacucuggucugugaua

SEQ ID NO: 2137574 - RNA, 17 nt, Staphylococcus aureus subsp. aureus N315
uacucugggcauuuuga

SEQ ID NO: 2137575 - RNA, 18 nt, Staphylococcus aureus subsp. aureus N315
uacucugggcauuuugac

SEQ ID NO: 2137576 - RNA, 12 nt, Staphylococcus aureus subsp. aureus N315
uacucugaaaag

SEQ ID NO: 2137577 - RNA, 23 nt, Staphylococcus aureus subsp. aureus N315
uacuaguuuguaauaauuaacuu

SEQ ID NO: 2137578 - RNA, 19 nt, Staphylococcus aureus subsp. aureus N315
uacuagcauuagcaaauau

SEQ ID NO: 2137579 - RNA, 14 nt, Staphylococcus aureus subsp. aureus N315
uacuucaauaacaa

SEQ ID NO: 2137580 - RNA, 14 nt, Staphylococcus aureus subsp. aureus N315
uacuucauaaguca

SEQ ID NO: 2137581 - RNA, 13 nt, Staphylococcus aureus subsp. aureus N315
uacuuauuucuuu

SEQ ID NO: 2137582 - RNA, 15 nt, Staphylococcus aureus subsp. aureus N315
uacuuauuucuuuuc

SEQ ID NO: 2137583 - RNA, 17 nt, Staphylococcus aureus subsp. aureus N315
uacuuauuucuuuucau

SEQ ID NO: 2137584 - RNA, 20 nt, Staphylococcus aureus subsp. aureus N315
uacuugauuagauuugugug

SEQ ID NO: 2137585 - RNA, 17 nt, Staphylococcus aureus subsp. aureus N315
uacuugccuucaaauuc

SEQ ID NO: 2137586 - RNA, 14 nt, Staphylococcus aureus subsp. aureus N315
uacuuuauaaauau

SEQ ID NO: 2137587 - RNA, 18 nt, Staphylococcus aureus subsp. aureus N315
uacuucucccuuaaauac

SEQ ID NO: 2137588 - RNA, 12 nt, Staphylococcus aureus subsp. aureus N315
uacuucuucuuc

SEQ ID NO: 2137589 - RNA, 18 nt, Staphylococcus aureus subsp. aureus N315
uacuugaauuuaauaagu

SEQ ID NO: 2137590 - RNA, 17 nt, Staphylococcus aureus subsp. aureus N315
uacuucuuuugcaaaac

SEQ ID NO: 2137591 - RNA, 12 nt, Staphylococcus aureus subsp. aureus N315
uacuugaagaaa

SEQ ID NO: 2137592 - RNA, 19 nt, Staphylococcus aureus subsp. aureus N315
uacugcuguuuuuuauagu

SEQ ID NO: 2137593 - RNA, 18 nt, Staphylococcus aureus subsp. aureus N315
uacugcuucgacauugau

SEQ ID NO: 2137594 - RNA, 16 nt, Staphylococcus aureus subsp. aureus N315
uacugcuguucucuau

SEQ ID NO: 2137595 - RNA, 14 nt, Staphylococcus aureus subsp. aureus N315
uacugcgcuuuuaa

SEQ ID NO: 2137596 - RNA, 20 nt, Staphylococcus aureus subsp. aureus N315
uacugucucaucuucuaaau

SEQ ID NO: 2137597 - RNA, 16 nt, Staphylococcus aureus subsp. aureus N315
uacugugaaaauacca

SEQ ID NO: 2137598 - RNA, 18 nt, Staphylococcus aureus subsp. aureus N315
uacuguuuaaauaaaauu

SEQ ID NO: 2137599 - RNA, 21 nt, Staphylococcus aureus subsp. aureus N315
uaccgauuguuaauuuaaagu

SEQ ID NO: 2137600 - RNA, 21 nt, Staphylococcus aureus subsp. aureus N315
uaccgcuaaaauucuuucagc

SEQ ID NO: 2137601 - RNA, 22 nt, Staphylococcus aureus subsp. aureus N315
uaccccuguugaauauacuaaa

SEQ ID NO: 2137602 - RNA, 15 nt, Staphylococcus aureus subsp. aureus N315
uaccaguugauuuaa

SEQ ID NO: 2137603 - RNA, 14 nt, Staphylococcus aureus subsp. aureus N315
uaccauauaauucu

SEQ ID NO: 2137604 - RNA, 19 nt, Staphylococcus aureus subsp. aureus N315
uaccaguaacaauaacacc

SEQ ID NO: 2137605 - RNA, 17 nt, Staphylococcus aureus subsp. aureus N315
uaccaucugaaucaguu

SEQ ID NO: 2137606 - RNA, 14 nt, Staphylococcus aureus subsp. aureus N315
uaccaucuuuaaua

SEQ ID NO: 2137607 - RNA, 17 nt, Staphylococcus aureus subsp. aureus N315
uaccauguuuuuuaagu

SEQ ID NO: 2137608 - RNA, 18 nt, Staphylococcus aureus subsp. aureus N315
uaccauguuuuuuaagua

SEQ ID NO: 2137609 - RNA, 23 nt, Staphylococcus aureus subsp. aureus N315
uaccauugugaugauaauuaaug

SEQ ID NO: 2137610 - RNA, 19 nt, Staphylococcus aureus subsp. aureus N315
uacccauuuuuuuccaagc

SEQ ID NO: 2137611 - RNA, 17 nt, Staphylococcus aureus subsp. aureus N315
uaccccaaguccaauuc

SEQ ID NO: 2137612 - RNA, 18 nt, Staphylococcus aureus subsp. aureus N315
uacccacuuauaaacaaa

SEQ ID NO: 2137613 - RNA, 12 nt, Staphylococcus aureus subsp. aureus N315
uaccauuugcug

SEQ ID NO: 2137614 - RNA, 12 nt, Staphylococcus aureus subsp. aureus N315
uaccagcaugaa

SEQ ID NO: 2137615 - RNA, 16 nt, Staphylococcus aureus subsp. aureus N315
uaccaccagccccaau

SEQ ID NO: 2137616 - RNA, 12 nt, Staphylococcus aureus subsp. aureus N315
uaccaccccaac

SEQ ID NO: 2137617 - RNA, 14 nt, Staphylococcus aureus subsp. aureus N315
uaccaccccaacuu

SEQ ID NO: 2137618 - RNA, 16 nt, Staphylococcus aureus subsp. aureus N315
uaccacauuuuccuug

SEQ ID NO: 2137619 - RNA, 19 nt, Staphylococcus aureus subsp. aureus N315
uaccacuuuuucuguaaua

SEQ ID NO: 2137620 - RNA, 19 nt, Staphylococcus aureus subsp. aureus N315
uaccacuugaauacuuuuu

SEQ ID NO: 2137621 - RNA, 22 nt, Staphylococcus aureus subsp. aureus N315
uaccacuugaauacuuuuuaac

SEQ ID NO: 2137622 - RNA, 18 nt, Staphylococcus aureus subsp. aureus N315
uacauuacgcucaucacc

SEQ ID NO: 2137623 - RNA, 15 nt, Staphylococcus aureus subsp. aureus N315
uacauugauaaaaua

SEQ ID NO: 2137624 - RNA, 17 nt, Staphylococcus aureus subsp. aureus N315
uacauugauaaaauaau

SEQ ID NO: 2137625 - RNA, 16 nt, Staphylococcus aureus subsp. aureus N315
uaccaaauaaauaagu

SEQ ID NO: 2137626 - RNA, 22 nt, Staphylococcus aureus subsp. aureus N315
uaccaacaagguucuaaaucuu

SEQ ID NO: 2137627 - RNA, 18 nt, Staphylococcus aureus subsp. aureus N315
uaccacacuuuaaacaag

SEQ ID NO: 2137628 - RNA, 13 nt, Staphylococcus aureus subsp. aureus N315
uaccacaaauauc

SEQ ID NO: 2137629 - RNA, 17 nt, Staphylococcus aureus subsp. aureus N315
uaccaauugauuuugcu

SEQ ID NO: 2137630 - RNA, 19 nt, Staphylococcus aureus subsp. aureus N315
uaccaaccaaaaccaaaug

SEQ ID NO: 2137631 - RNA, 22 nt, Staphylococcus aureus subsp. aureus N315
uacauaccgauuuucaaccauc

SEQ ID NO: 2137632 - RNA, 20 nt, Staphylococcus aureus subsp. aureus N315
uacauacggcaaauucaacu

SEQ ID NO: 2137633 - RNA, 18 nt, Staphylococcus aureus subsp. aureus N315
uacauacggcaaauucaa

SEQ ID NO: 2137634 - RNA, 14 nt, Staphylococcus aureus subsp. aureus N315
uacauaaugguuca

SEQ ID NO: 2137635 - RNA, 15 nt, Staphylococcus aureus subsp. aureus N315
uacaucauuaaauau

SEQ ID NO: 2137636 - RNA, 17 nt, Staphylococcus aureus subsp. aureus N315
uacaucauuaaauauuu

SEQ ID NO: 2137637 - RNA, 16 nt, Staphylococcus aureus subsp. aureus N315
uacaucauuaaauauu

SEQ ID NO: 2137638 - RNA, 14 nt, Staphylococcus aureus subsp. aureus N315
uacauccauacuuc

SEQ ID NO: 2137639 - RNA, 14 nt, Staphylococcus aureus subsp. aureus N315
uacaucguguugcu

SEQ ID NO: 2137640 - RNA, 14 nt, Staphylococcus aureus subsp. aureus N315
uacaucuaauaaau

SEQ ID NO: 2137641 - RNA, 23 nt, Staphylococcus aureus subsp. aureus N315
uacaagucuuauuuguuuaauua

SEQ ID NO: 2137642 - RNA, 16 nt, Staphylococcus aureus subsp. aureus N315
uacaauucauaagaaa

SEQ ID NO: 2137643 - RNA, 18 nt, Staphylococcus aureus subsp. aureus N315
uacaauucauaagaaaaa

SEQ ID NO: 2137644 - RNA, 13 nt, Staphylococcus aureus subsp. aureus N315
uacaauuuccuac

SEQ ID NO: 2137645 - RNA, 21 nt, Staphylococcus aureus subsp. aureus N315
uacaauuucuucauuuucauu

SEQ ID NO: 2137646 - RNA, 22 nt, Staphylococcus aureus subsp. aureus N315
uacaauuuuccuuccaauaaua

SEQ ID NO: 2137647 - RNA, 23 nt, Staphylococcus aureus subsp. aureus N315
uacaauuuuccuuccaauaauaa

SEQ ID NO: 2137648 - RNA, 15 nt, Staphylococcus aureus subsp. aureus N315
uacauaacccuaaaa

SEQ ID NO: 2137649 - RNA, 15 nt, Staphylococcus aureus subsp. aureus N315
uacagucaacugcug

SEQ ID NO: 2137650 - RNA, 20 nt, Staphylococcus aureus subsp. aureus N315
uacagucaauacaaagaauu

SEQ ID NO: 2137651 - RNA, 17 nt, Staphylococcus aureus subsp. aureus N315
uacaauuuucucauuaa

SEQ ID NO: 2137652 - RNA, 14 nt, Staphylococcus aureus subsp. aureus N315
uacaauuuuuaaaa

SEQ ID NO: 2137653 - RNA, 19 nt, Staphylococcus aureus subsp. aureus N315
uacagguuuuaaaauuaaa

SEQ ID NO: 2137654 - RNA, 14 nt, Staphylococcus aureus subsp. aureus N315
uacagguugaauaa

SEQ ID NO: 2137655 - RNA, 12 nt, Staphylococcus aureus subsp. aureus N315
uaauuugauuaa

SEQ ID NO: 2137656 - RNA, 22 nt, Staphylococcus aureus subsp. aureus N315
uaauuucaauuuggaaauaucu

SEQ ID NO: 2137657 - RNA, 19 nt, Staphylococcus aureus subsp. aureus N315
uaauuucaccaguagucac

SEQ ID NO: 2137658 - RNA, 18 nt, Staphylococcus aureus subsp. aureus N315
uaauuucaguucuuagau

SEQ ID NO: 2137659 - RNA, 12 nt, Staphylococcus aureus subsp. aureus N315
uaauugcauuac

SEQ ID NO: 2137660 - RNA, 20 nt, Staphylococcus aureus subsp. aureus N315
uaauugcauagcuaaauaaa

SEQ ID NO: 2137661 - RNA, 22 nt, Staphylococcus aureus subsp. aureus N315
uaauugcauagcuaaauaaauu

SEQ ID NO: 2137662 - RNA, 15 nt, Staphylococcus aureus subsp. aureus N315
uaauugcauguaaaa

SEQ ID NO: 2137663 - RNA, 19 nt, Staphylococcus aureus subsp. aureus N315
uaauugcauguaaaauuaa

SEQ ID NO: 2137664 - RNA, 21 nt, Staphylococcus aureus subsp. aureus N315
uaauugcauguaaaauuaaau

SEQ ID NO: 2137665 - RNA, 20 nt, Staphylococcus aureus subsp. aureus N315
uaauugauauggaucauaau

SEQ ID NO: 2137666 - RNA, 15 nt, Staphylococcus aureus subsp. aureus N315
uaauugaugucacau

SEQ ID NO: 2137667 - RNA, 19 nt, Staphylococcus aureus subsp. aureus N315
uaauugauucucuguagau

SEQ ID NO: 2137668 - RNA, 16 nt, Staphylococcus aureus subsp. aureus N315
uaauugcguuuaauaa

SEQ ID NO: 2137669 - RNA, 14 nt, Staphylococcus aureus subsp. aureus N315
uaauuucaauuuau

SEQ ID NO: 2137670 - RNA, 20 nt, Staphylococcus aureus subsp. aureus N315
uaauuuuuuauuaagacuga

SEQ ID NO: 2137671 - RNA, 14 nt, Staphylococcus aureus subsp. aureus N315
uaauuuuucuucuu

SEQ ID NO: 2137672 - RNA, 12 nt, Staphylococcus aureus subsp. aureus N315
uaauuuuucauu

SEQ ID NO: 2137673 - RNA, 18 nt, Staphylococcus aureus subsp. aureus N315
uaauuuuuauucuguaac

SEQ ID NO: 2137674 - RNA, 17 nt, Staphylococcus aureus subsp. aureus N315
uacaaaacauauucagu

SEQ ID NO: 2137675 - RNA, 21 nt, Staphylococcus aureus subsp. aureus N315
uacaaaacaccucgauauuau

SEQ ID NO: 2137676 - RNA, 18 nt, Staphylococcus aureus subsp. aureus N315
uaauuuugacauaaaaaa

SEQ ID NO: 2137677 - RNA, 16 nt, Staphylococcus aureus subsp. aureus N315
uaauuuuuaaaucuac

SEQ ID NO: 2137678 - RNA, 16 nt, Staphylococcus aureus subsp. aureus N315
uaauuuguuuuaaaua

SEQ ID NO: 2137679 - RNA, 23 nt, Staphylococcus aureus subsp. aureus N315
uaauuuguccauccauuuuaggu

SEQ ID NO: 2137680 - RNA, 10 nt, Staphylococcus aureus subsp. aureus N315
uaauuuguua

SEQ ID NO: 2137681 - RNA, 20 nt, Staphylococcus aureus subsp. aureus N315
uaauuuggucauagaaauuu

SEQ ID NO: 2137682 - RNA, 17 nt, Staphylococcus aureus subsp. aureus N315
uacaaacaaugcaaguu

SEQ ID NO: 2137683 - RNA, 22 nt, Staphylococcus aureus subsp. aureus N315
uacaaacauuccucuauuguau

SEQ ID NO: 2137684 - RNA, 17 nt, Staphylococcus aureus subsp. aureus N315
uacaaaggauuauuaac

SEQ ID NO: 2137685 - RNA, 16 nt, Staphylococcus aureus subsp. aureus N315
uacaaagucauuuuca

SEQ ID NO: 2137686 - RNA, 17 nt, Staphylococcus aureus subsp. aureus N315
uacaaagucauuuucau

SEQ ID NO: 2137687 - RNA, 15 nt, Staphylococcus aureus subsp. aureus N315
uacaaagugauuuaa

SEQ ID NO: 2137688 - RNA, 20 nt, Staphylococcus aureus subsp. aureus N315
uacaaaguuuauacuuaaua

SEQ ID NO: 2137689 - RNA, 14 nt, Staphylococcus aureus subsp. aureus N315
uacaaauaacaaac

SEQ ID NO: 2137690 - RNA, 19 nt, Staphylococcus aureus subsp. aureus N315
uacaaauaacaaacauuaa

SEQ ID NO: 2137691 - RNA, 23 nt, Staphylococcus aureus subsp. aureus N315
uacaaauaacaaacauuaaucua

SEQ ID NO: 2137692 - RNA, 21 nt, Staphylococcus aureus subsp. aureus N315
uacaaaucaugacauaaaacu

SEQ ID NO: 2137693 - RNA, 14 nt, Staphylococcus aureus subsp. aureus N315
uacaaaucgauauu

SEQ ID NO: 2137694 - RNA, 22 nt, Staphylococcus aureus subsp. aureus N315
uacaaauauuguggaaaacgug

SEQ ID NO: 2137695 - RNA, 14 nt, Staphylococcus aureus subsp. aureus N315
uacaaauauaucua

SEQ ID NO: 2137696 - RNA, 12 nt, Staphylococcus aureus subsp. aureus N315
uacaaauugauu

SEQ ID NO: 2137697 - RNA, 23 nt, Staphylococcus aureus subsp. aureus N315
uacaaauguauaaauaauaaaug

SEQ ID NO: 2137698 - RNA, 18 nt, Staphylococcus aureus subsp. aureus N315
uacaaauuacaauaagcg

SEQ ID NO: 2137699 - RNA, 15 nt, Staphylococcus aureus subsp. aureus N315
uacaacaguugcacc

SEQ ID NO: 2137700 - RNA, 14 nt, Staphylococcus aureus subsp. aureus N315
uacaacuaaauaug

SEQ ID NO: 2137701 - RNA, 20 nt, Staphylococcus aureus subsp. aureus N315
uacaacucguuuuuccaugu

SEQ ID NO: 2137702 - RNA, 23 nt, Staphylococcus aureus subsp. aureus N315
uacaaauuuuuuuuauuaauuaa

SEQ ID NO: 2137703 - RNA, 12 nt, Staphylococcus aureus subsp. aureus N315
uacaacuucauu

SEQ ID NO: 2137704 - RNA, 15 nt, Staphylococcus aureus subsp. aureus N315
uacaacuuuuagagu

SEQ ID NO: 2137705 - RNA, 23 nt, Staphylococcus aureus subsp. aureus N315
uacaacuuuaguuguuaggggcu

SEQ ID NO: 2137706 - RNA, 15 nt, Staphylococcus aureus subsp. aureus N315
uaauuauuuuaaaaa

SEQ ID NO: 2137707 - RNA, 17 nt, Staphylococcus aureus subsp. aureus N315
uaauuauuucucuuucc

SEQ ID NO: 2137708 - RNA, 12 nt, Staphylococcus aureus subsp. aureus N315
uaauuccuggug

SEQ ID NO: 2137709 - RNA, 13 nt, Staphylococcus aureus subsp. aureus N315
uaauuccuggugc

SEQ ID NO: 2137710 - RNA, 15 nt, Staphylococcus aureus subsp. aureus N315
uaauuccugauacaa

SEQ ID NO: 2137711 - RNA, 23 nt, Staphylococcus aureus subsp. aureus N315
uaauuccucuggaacuuuaauac

SEQ ID NO: 2137712 - RNA, 15 nt, Staphylococcus aureus subsp. aureus N315
uaauucgccaucuuu

SEQ ID NO: 2137713 - RNA, 21 nt, Staphylococcus aureus subsp. aureus N315
uaauuccuggugcaauaauaa

SEQ ID NO: 2137714 - RNA, 18 nt, Staphylococcus aureus subsp. aureus N315
uaauucgaaaucaaauau

SEQ ID NO: 2137715 - RNA, 20 nt, Staphylococcus aureus subsp. aureus N315
uaauucgaaaucaaauauuu

SEQ ID NO: 2137716 - RNA, 20 nt, Staphylococcus aureus subsp. aureus N315
uaauuacuuucauuguaaau

SEQ ID NO: 2137717 - RNA, 14 nt, Staphylococcus aureus subsp. aureus N315
uaauuacuuucauu

SEQ ID NO: 2137718 - RNA, 15 nt, Staphylococcus aureus subsp. aureus N315
uaauuauucaugaau

SEQ ID NO: 2137719 - RNA, 14 nt, Staphylococcus aureus subsp. aureus N315
uaauuauuauauaa

SEQ ID NO: 2137720 - RNA, 17 nt, Staphylococcus aureus subsp. aureus N315
uaauuauuaauaaaggg

SEQ ID NO: 2137721 - RNA, 16 nt, Staphylococcus aureus subsp. aureus N315
uaauuauugagaauau

SEQ ID NO: 2137722 - RNA, 13 nt, Staphylococcus aureus subsp. aureus N315
uaauuauuucucu

SEQ ID NO: 2137723 - RNA, 14 nt, Staphylococcus aureus subsp. aureus N315
uaauuauuucucuu

SEQ ID NO: 2137724 - RNA, 19 nt, Staphylococcus aureus subsp. aureus N315
uaauuacgucauaaaauac

SEQ ID NO: 2137725 - RNA, 19 nt, Staphylococcus aureus subsp. aureus N315
uaauuacagguuuaaacau

SEQ ID NO: 2137726 - RNA, 19 nt, Staphylococcus aureus subsp. aureus N315
uaauuacagguuuaauuga

SEQ ID NO: 2137727 - RNA, 17 nt, Staphylococcus aureus subsp. aureus N315
uaauuaaaaaauuccua

SEQ ID NO: 2137728 - RNA, 20 nt, Staphylococcus aureus subsp. aureus N315
uaaugugcgucacucacuuc

SEQ ID NO: 2137729 - RNA, 13 nt, Staphylococcus aureus subsp. aureus N315
uaauguuaaacac

SEQ ID NO: 2137730 - RNA, 20 nt, Staphylococcus aureus subsp. aureus N315
uaauguuaaaauaacugcua

SEQ ID NO: 2137731 - RNA, 15 nt, Staphylococcus aureus subsp. aureus N315
uaauguuacgcugug

SEQ ID NO: 2137732 - RNA, 21 nt, Staphylococcus aureus subsp. aureus N315
uaauguuuccugauauuucaa

SEQ ID NO: 2137733 - RNA, 15 nt, Staphylococcus aureus subsp. aureus N315
uaauguuugcuuuuu

SEQ ID NO: 2137734 - RNA, 23 nt, Staphylococcus aureus subsp. aureus N315
uaauguuuccugauauuucaacu

SEQ ID NO: 2137735 - RNA, 21 nt, Staphylococcus aureus subsp. aureus N315
uaaugccugcccuuuagucau

SEQ ID NO: 2137736 - RNA, 23 nt, Staphylococcus aureus subsp. aureus N315
uaaugcaagcgacgauuggaaag

SEQ ID NO: 2137737 - RNA, 14 nt, Staphylococcus aureus subsp. aureus N315
uaaugauuuuucau

SEQ ID NO: 2137738 - RNA, 17 nt, Staphylococcus aureus subsp. aureus N315
uaaugcuacuauuaaau

SEQ ID NO: 2137739 - RNA, 13 nt, Staphylococcus aureus subsp. aureus N315
uaaugcuauauuu

SEQ ID NO: 2137740 - RNA, 14 nt, Staphylococcus aureus subsp. aureus N315
uaaugcuaauuuaa

SEQ ID NO: 2137741 - RNA, 17 nt, Staphylococcus aureus subsp. aureus N315
uaaugcucuauauaucc

SEQ ID NO: 2137742 - RNA, 23 nt, Staphylococcus aureus subsp. aureus N315
uaauguacauguauaaaagauau

SEQ ID NO: 2137743 - RNA, 11 nt, Staphylococcus aureus subsp. aureus N315
uaauguauaaa

SEQ ID NO: 2137744 - RNA, 15 nt, Staphylococcus aureus subsp. aureus N315
uaauguauaaaacag

SEQ ID NO: 2137745 - RNA, 13 nt, Staphylococcus aureus subsp. aureus N315
uaauguauucuuc

SEQ ID NO: 2137746 - RNA, 17 nt, Staphylococcus aureus subsp. aureus N315
uaaugugcgucacucac

SEQ ID NO: 2137747 - RNA, 15 nt, Staphylococcus aureus subsp. aureus N315
uaaugucauaucuuu

SEQ ID NO: 2137748 - RNA, 11 nt, Staphylococcus aureus subsp. aureus N315
uaaugauuuug

SEQ ID NO: 2137749 - RNA, 19 nt, Staphylococcus aureus subsp. aureus N315
uaaugauuuuuauuauugu

SEQ ID NO: 2137750 - RNA, 14 nt, Staphylococcus aureus subsp. aureus N315
uaaugauugucuua

SEQ ID NO: 2137751 - RNA, 16 nt, Staphylococcus aureus subsp. aureus N315
uaaugauugucuuaua

SEQ ID NO: 2137752 - RNA, 14 nt, Staphylococcus aureus subsp. aureus N315
uaaugaugcgaugg

SEQ ID NO: 2137753 - RNA, 18 nt, Staphylococcus aureus subsp. aureus N315
uaaugauaaauuaaagcu

SEQ ID NO: 2137754 - RNA, 18 nt, Staphylococcus aureus subsp. aureus N315
uaaugaguaguuucucua

SEQ ID NO: 2137755 - RNA, 14 nt, Staphylococcus aureus subsp. aureus N315
uaaugaucaucuau

SEQ ID NO: 2137756 - RNA, 18 nt, Staphylococcus aureus subsp. aureus N315
uaaugagcccguuaaaaa

SEQ ID NO: 2137757 - RNA, 23 nt, Staphylococcus aureus subsp. aureus N315
uaaucgauugguaaaucuacuac

SEQ ID NO: 2137758 - RNA, 14 nt, Staphylococcus aureus subsp. aureus N315
uaaucgauugguaa

SEQ ID NO: 2137759 - RNA, 21 nt, Staphylococcus aureus subsp. aureus N315
uaauauuaaauugcguacuug

SEQ ID NO: 2137760 - RNA, 13 nt, Staphylococcus aureus subsp. aureus N315
uaauaucuuuugc

SEQ ID NO: 2137761 - RNA, 21 nt, Staphylococcus aureus subsp. aureus N315
uaauaugaauuuagaugcaua

SEQ ID NO: 2137762 - RNA, 14 nt, Staphylococcus aureus subsp. aureus N315
uaauaucuucuuua

SEQ ID NO: 2137763 - RNA, 13 nt, Staphylococcus aureus subsp. aureus N315
uaauauauuaauu

SEQ ID NO: 2137764 - RNA, 14 nt, Staphylococcus aureus subsp. aureus N315
uaauauauuacuaa

SEQ ID NO: 2137765 - RNA, 16 nt, Staphylococcus aureus subsp. aureus N315
uaauauauuauaaccc

SEQ ID NO: 2137766 - RNA, 15 nt, Staphylococcus aureus subsp. aureus N315
uaauauauaaaaguc

SEQ ID NO: 2137767 - RNA, 14 nt, Staphylococcus aureus subsp. aureus N315
uaauauauaaaagu

SEQ ID NO: 2137768 - RNA, 14 nt, Staphylococcus aureus subsp. aureus N315
uaauauauuuggag

SEQ ID NO: 2137769 - RNA, 14 nt, Staphylococcus aureus subsp. aureus N315
uaauauauuuauuu

SEQ ID NO: 2137770 - RNA, 18 nt, Staphylococcus aureus subsp. aureus N315
uaauaucaugcuuaucug

SEQ ID NO: 2137771 - RNA, 13 nt, Staphylococcus aureus subsp. aureus N315
uaauauucaacuu

SEQ ID NO: 2137772 - RNA, 12 nt, Staphylococcus aureus subsp. aureus N315
uaauauuauaag

SEQ ID NO: 2137773 - RNA, 17 nt, Staphylococcus aureus subsp. aureus N315
uaauauugaaaugagcu

SEQ ID NO: 2137774 - RNA, 19 nt, Staphylococcus aureus subsp. aureus N315
uaauauugaauauaaaaaa

SEQ ID NO: 2137775 - RNA, 14 nt, Staphylococcus aureus subsp. aureus N315
uaauauugacauuu

SEQ ID NO: 2137776 - RNA, 17 nt, Staphylococcus aureus subsp. aureus N315
uaauauuucuuaccauu

SEQ ID NO: 2137777 - RNA, 18 nt, Staphylococcus aureus subsp. aureus N315
uaauauuucuuaccauuu

SEQ ID NO: 2137778 - RNA, 20 nt, Staphylococcus aureus subsp. aureus N315
uaaucaaaguaucagucauu

SEQ ID NO: 2137779 - RNA, 15 nt, Staphylococcus aureus subsp. aureus N315
uaaucaagcaaugca

SEQ ID NO: 2137780 - RNA, 20 nt, Staphylococcus aureus subsp. aureus N315
uaaucaagucugcauuaauu

SEQ ID NO: 2137781 - RNA, 21 nt, Staphylococcus aureus subsp. aureus N315
uaaucaagaauauaagugauu

SEQ ID NO: 2137782 - RNA, 17 nt, Staphylococcus aureus subsp. aureus N315
uaaucaaaauuaugacu

SEQ ID NO: 2137783 - RNA, 15 nt, Staphylococcus aureus subsp. aureus N315
uaaucaaaccaccaa

SEQ ID NO: 2137784 - RNA, 21 nt, Staphylococcus aureus subsp. aureus N315
uaaucaaaccaccaaaaauca

SEQ ID NO: 2137785 - RNA, 16 nt, Staphylococcus aureus subsp. aureus N315
uaauauuuucuuagaa

SEQ ID NO: 2137786 - RNA, 12 nt, Staphylococcus aureus subsp. aureus N315
uaauauuuuggc

SEQ ID NO: 2137787 - RNA, 12 nt, Staphylococcus aureus subsp. aureus N315
uaauauuuuaaa

SEQ ID NO: 2137788 - RNA, 19 nt, Staphylococcus aureus subsp. aureus N315
uaaucaugaaguugguuua

SEQ ID NO: 2137789 - RNA, 21 nt, Staphylococcus aureus subsp. aureus N315
uaaucauuguguauuguuuua

SEQ ID NO: 2137790 - RNA, 20 nt, Staphylococcus aureus subsp. aureus N315
uaaucauugguuucaucaua

SEQ ID NO: 2137791 - RNA, 14 nt, Staphylococcus aureus subsp. aureus N315
uaaucauuguguau

SEQ ID NO: 2137792 - RNA, 18 nt, Staphylococcus aureus subsp. aureus N315
uaaucauuguguauuguu

SEQ ID NO: 2137793 - RNA, 19 nt, Staphylococcus aureus subsp. aureus N315
uaauccaguaaucaaagau

SEQ ID NO: 2137794 - RNA, 13 nt, Staphylococcus aureus subsp. aureus N315
uaauccauccauu

SEQ ID NO: 2137795 - RNA, 14 nt, Staphylococcus aureus subsp. aureus N315
uaaucccuucaaaa

SEQ ID NO: 2137796 - RNA, 16 nt, Staphylococcus aureus subsp. aureus N315
uaauccccgaagcaca

SEQ ID NO: 2137797 - RNA, 21 nt, Staphylococcus aureus subsp. aureus N315
uaaucaccuuauugaugaaaa

SEQ ID NO: 2137798 - RNA, 22 nt, Staphylococcus aureus subsp. aureus N315
uaaucacuuggcgacauuugua

SEQ ID NO: 2137799 - RNA, 16 nt, Staphylococcus aureus subsp. aureus N315
uaaucagcuuuuucac

SEQ ID NO: 2137800 - RNA, 15 nt, Staphylococcus aureus subsp. aureus N315
uaaucaguuuccgca

SEQ ID NO: 2137801 - RNA, 14 nt, Staphylococcus aureus subsp. aureus N315
uaaucauaaugaau

SEQ ID NO: 2137802 - RNA, 16 nt, Staphylococcus aureus subsp. aureus N315
uaauaagcugaaauaa

SEQ ID NO: 2137803 - RNA, 15 nt, Staphylococcus aureus subsp. aureus N315
uaauaagagguauag

SEQ ID NO: 2137804 - RNA, 19 nt, Staphylococcus aureus subsp. aureus N315
uaauaacgcugcaccuaag

SEQ ID NO: 2137805 - RNA, 15 nt, Staphylococcus aureus subsp. aureus N315
uaauaacgauaagca

SEQ ID NO: 2137806 - RNA, 19 nt, Staphylococcus aureus subsp. aureus N315
uaauaaccauguaaaauua

SEQ ID NO: 2137807 - RNA, 19 nt, Staphylococcus aureus subsp. aureus N315
uaauaauacuucuaaucgu

SEQ ID NO: 2137808 - RNA, 20 nt, Staphylococcus aureus subsp. aureus N315
uaauaaguugaauauaaaaa

SEQ ID NO: 2137809 - RNA, 21 nt, Staphylococcus aureus subsp. aureus N315
uaauaaguugaauauaaaaaa

SEQ ID NO: 2137810 - RNA, 16 nt, Staphylococcus aureus subsp. aureus N315
uaauaaguaauaauuu

SEQ ID NO: 2137811 - RNA, 17 nt, Staphylococcus aureus subsp. aureus N315
uaauaaguugaauauaa

SEQ ID NO: 2137812 - RNA, 13 nt, Staphylococcus aureus subsp. aureus N315
uaauaaugacuga

SEQ ID NO: 2137813 - RNA, 19 nt, Staphylococcus aureus subsp. aureus N315
uaauaaugaauucuauccu

SEQ ID NO: 2137814 - RNA, 15 nt, Staphylococcus aureus subsp. aureus N315
uaauaaugacgagaa

SEQ ID NO: 2137815 - RNA, 17 nt, Staphylococcus aureus subsp. aureus N315
uaauaaucuuuaacauu

SEQ ID NO: 2137816 - RNA, 19 nt, Staphylococcus aureus subsp. aureus N315
uaauacaagucuuuacucu

SEQ ID NO: 2137817 - RNA, 13 nt, Staphylococcus aureus subsp. aureus N315
uaauacaauucaa

SEQ ID NO: 2137818 - RNA, 13 nt, Staphylococcus aureus subsp. aureus N315
uaauacauuaugu

SEQ ID NO: 2137819 - RNA, 18 nt, Staphylococcus aureus subsp. aureus N315
uaauacaugacauucauu

SEQ ID NO: 2137820 - RNA, 18 nt, Staphylococcus aureus subsp. aureus N315
uaauacaucuaauaaaua

SEQ ID NO: 2137821 - RNA, 18 nt, Staphylococcus aureus subsp. aureus N315
uaauaaugggaauuguau

SEQ ID NO: 2137822 - RNA, 20 nt, Staphylococcus aureus subsp. aureus N315
uaauaauggcaauuaaaacu

SEQ ID NO: 2137823 - RNA, 13 nt, Staphylococcus aureus subsp. aureus N315
uaauaauuaauaa

SEQ ID NO: 2137824 - RNA, 18 nt, Staphylococcus aureus subsp. aureus N315
uaauaauucauaaaugcu

SEQ ID NO: 2137825 - RNA, 14 nt, Staphylococcus aureus subsp. aureus N315
uaauaauuauuaau

SEQ ID NO: 2137826 - RNA, 16 nt, Staphylococcus aureus subsp. aureus N315
uaauaauuauuaauaa

SEQ ID NO: 2137827 - RNA, 18 nt, Staphylococcus aureus subsp. aureus N315
uaauaauuaauaagcauu

SEQ ID NO: 2137828 - RNA, 14 nt, Staphylococcus aureus subsp. aureus N315
uaauacaaaacaaa

SEQ ID NO: 2137829 - RNA, 18 nt, Staphylococcus aureus subsp. aureus N315
uaauaauuuuuuuccuuu

SEQ ID NO: 2137830 - RNA, 14 nt, Staphylococcus aureus subsp. aureus N315
uaauaauuguccau

SEQ ID NO: 2137831 - RNA, 12 nt, Staphylococcus aureus subsp. aureus N315
uaauaauuuaca

SEQ ID NO: 2137832 - RNA, 20 nt, Staphylococcus aureus subsp. aureus N315
uaauaauugcauguaaaauu

SEQ ID NO: 2137833 - RNA, 21 nt, Staphylococcus aureus subsp. aureus N315
uaauaauugcauguaaaauua

SEQ ID NO: 2137834 - RNA, 20 nt, Staphylococcus aureus subsp. aureus N315
uaauagcauuccuaauuaua

SEQ ID NO: 2137835 - RNA, 15 nt, Staphylococcus aureus subsp. aureus N315
uaauaguguuauauu

SEQ ID NO: 2137836 - RNA, 21 nt, Staphylococcus aureus subsp. aureus N315
uaauagguuauguuauguaaa

SEQ ID NO: 2137837 - RNA, 14 nt, Staphylococcus aureus subsp. aureus N315
uaauauaaaauaaa

SEQ ID NO: 2137838 - RNA, 16 nt, Staphylococcus aureus subsp. aureus N315
uaauauaaauuuugaa

SEQ ID NO: 2137839 - RNA, 15 nt, Staphylococcus aureus subsp. aureus N315
uaauauaaaaacaaa

SEQ ID NO: 2137840 - RNA, 14 nt, Staphylococcus aureus subsp. aureus N315
uaauauaauuauua

SEQ ID NO: 2137841 - RNA, 14 nt, Staphylococcus aureus subsp. aureus N315
uaauauaauuaauu

SEQ ID NO: 2137842 - RNA, 12 nt, Staphylococcus aureus subsp. aureus N315
uaauauaauacc

SEQ ID NO: 2137843 - RNA, 16 nt, Staphylococcus aureus subsp. aureus N315
uaauacuguuuaaaua

SEQ ID NO: 2137844 - RNA, 17 nt, Staphylococcus aureus subsp. aureus N315
uaauacuguuuaaauaa

SEQ ID NO: 2137845 - RNA, 18 nt, Staphylococcus aureus subsp. aureus N315
uaauacguguguuuucuu

SEQ ID NO: 2137846 - RNA, 17 nt, Staphylococcus aureus subsp. aureus N315
uaauacguuuaauaaug

SEQ ID NO: 2137847 - RNA, 23 nt, Staphylococcus aureus subsp. aureus N315
uaauaccuucaauugacauuaau

SEQ ID NO: 2137848 - RNA, 17 nt, Staphylococcus aureus subsp. aureus N315
uaauagcaaaauuaugu

SEQ ID NO: 2137849 - RNA, 14 nt, Staphylococcus aureus subsp. aureus N315
uaauagacauuaac

SEQ ID NO: 2137850 - RNA, 14 nt, Staphylococcus aureus subsp. aureus N315
uaauacuuucacuu

SEQ ID NO: 2137851 - RNA, 17 nt, Staphylococcus aureus subsp. aureus N315
uaauacuuuuugaguau

SEQ ID NO: 2137852 - RNA, 13 nt, Staphylococcus aureus subsp. aureus N315
uaauagaaauaau

SEQ ID NO: 2137853 - RNA, 14 nt, Staphylococcus aureus subsp. aureus N315
uaauagaaauaauc

SEQ ID NO: 2137854 - RNA, 17 nt, Staphylococcus aureus subsp. aureus N315
uaauagaacgaaauagu

SEQ ID NO: 2137855 - RNA, 14 nt, Staphylococcus aureus subsp. aureus N315
uaacucaagugauu

SEQ ID NO: 2137856 - RNA, 20 nt, Staphylococcus aureus subsp. aureus N315
uaacucaaauaucuaaacaa

SEQ ID NO: 2137857 - RNA, 17 nt, Staphylococcus aureus subsp. aureus N315
uaacuagugccucuuuu

SEQ ID NO: 2137858 - RNA, 17 nt, Staphylococcus aureus subsp. aureus N315
uaacuagcaaaugcacu

SEQ ID NO: 2137859 - RNA, 22 nt, Staphylococcus aureus subsp. aureus N315
uaacuauaacaauaguuuucuu

SEQ ID NO: 2137860 - RNA, 17 nt, Staphylococcus aureus subsp. aureus N315
uaacuaguguaaugucu

SEQ ID NO: 2137861 - RNA, 22 nt, Staphylococcus aureus subsp. aureus N315
uaacuauauugugcuaaguuag

SEQ ID NO: 2137862 - RNA, 17 nt, Staphylococcus aureus subsp. aureus N315
uaacuaugaaugcugug

SEQ ID NO: 2137863 - RNA, 21 nt, Staphylococcus aureus subsp. aureus N315
uaacuauguuacuuauauauu

SEQ ID NO: 2137864 - RNA, 16 nt, Staphylococcus aureus subsp. aureus N315
uaacuauugaaaauag

SEQ ID NO: 2137865 - RNA, 20 nt, Staphylococcus aureus subsp. aureus N315
uaacucuaaauauaauagaa

SEQ ID NO: 2137866 - RNA, 16 nt, Staphylococcus aureus subsp. aureus N315
uaacucguaaucauag

SEQ ID NO: 2137867 - RNA, 20 nt, Staphylococcus aureus subsp. aureus N315
uaacucugaucuaaaaccau

SEQ ID NO: 2137868 - RNA, 16 nt, Staphylococcus aureus subsp. aureus N315
uaacucuuuguauaag

SEQ ID NO: 2137869 - RNA, 14 nt, Staphylococcus aureus subsp. aureus N315
uaacuccuccaaag

SEQ ID NO: 2137870 - RNA, 13 nt, Staphylococcus aureus subsp. aureus N315
uaacuaaaauguc

SEQ ID NO: 2137871 - RNA, 14 nt, Staphylococcus aureus subsp. aureus N315
uaacuaaaaugucu

SEQ ID NO: 2137872 - RNA, 21 nt, Staphylococcus aureus subsp. aureus N315
uaacguuucuuuguauaccua

SEQ ID NO: 2137873 - RNA, 15 nt, Staphylococcus aureus subsp. aureus N315
uaacuacacuuaaua

SEQ ID NO: 2137874 - RNA, 17 nt, Staphylococcus aureus subsp. aureus N315
uaacuagaaugauuaaa

SEQ ID NO: 2137875 - RNA, 16 nt, Staphylococcus aureus subsp. aureus N315
uaacuagaaugauuaa

SEQ ID NO: 2137876 - RNA, 17 nt, Staphylococcus aureus subsp. aureus N315
uaacuaaaccauugaau

SEQ ID NO: 2137877 - RNA, 14 nt, Staphylococcus aureus subsp. aureus N315
uaacguuauucauu

SEQ ID NO: 2137878 - RNA, 15 nt, Staphylococcus aureus subsp. aureus N315
uaacguuaauauaau

SEQ ID NO: 2137879 - RNA, 19 nt, Staphylococcus aureus subsp. aureus N315
uaacgugaggcccauaaau

SEQ ID NO: 2137880 - RNA, 21 nt, Staphylococcus aureus subsp. aureus N315
uaacguguuugcucaaaaaug

SEQ ID NO: 2137881 - RNA, 20 nt, Staphylococcus aureus subsp. aureus N315
uaacguacauuuaugauugu

SEQ ID NO: 2137882 - RNA, 20 nt, Staphylococcus aureus subsp. aureus N315
uaacgucauuuuuaauaaug

SEQ ID NO: 2137883 - RNA, 13 nt, Staphylococcus aureus subsp. aureus N315
uaacuguucuuuc

SEQ ID NO: 2137884 - RNA, 15 nt, Staphylococcus aureus subsp. aureus N315
uaacuguaaaacauu

SEQ ID NO: 2137885 - RNA, 15 nt, Staphylococcus aureus subsp. aureus N315
uaacuguuuaucaug

SEQ ID NO: 2137886 - RNA, 16 nt, Staphylococcus aureus subsp. aureus N315
uaacuguuuauccaua

SEQ ID NO: 2137887 - RNA, 13 nt, Staphylococcus aureus subsp. aureus N315
uaacuuaaaauuu

SEQ ID NO: 2137888 - RNA, 18 nt, Staphylococcus aureus subsp. aureus N315
uaacuuaaaauuuaaaua

SEQ ID NO: 2137889 - RNA, 14 nt, Staphylococcus aureus subsp. aureus N315
uaacugggauauag

SEQ ID NO: 2137890 - RNA, 21 nt, Staphylococcus aureus subsp. aureus N315
uaacuuaaaauuuaaauauug

SEQ ID NO: 2137891 - RNA, 19 nt, Staphylococcus aureus subsp. aureus N315
uaacugcuaauuuuuucau

SEQ ID NO: 2137892 - RNA, 14 nt, Staphylococcus aureus subsp. aureus N315
uaacugauaauacu

SEQ ID NO: 2137893 - RNA, 17 nt, Staphylococcus aureus subsp. aureus N315
uaacugaauuaaagcau

SEQ ID NO: 2137894 - RNA, 14 nt, Staphylococcus aureus subsp. aureus N315
uaagaucaauauca

SEQ ID NO: 2137895 - RNA, 20 nt, Staphylococcus aureus subsp. aureus N315
uaagauauuuccaaauugaa

SEQ ID NO: 2137896 - RNA, 12 nt, Staphylococcus aureus subsp. aureus N315
uaagauauauug

SEQ ID NO: 2137897 - RNA, 22 nt, Staphylococcus aureus subsp. aureus N315
uaagauguauaugaauuuuaua

SEQ ID NO: 2137898 - RNA, 21 nt, Staphylococcus aureus subsp. aureus N315
uaagauguauaugaauuuuau

SEQ ID NO: 2137899 - RNA, 17 nt, Staphylococcus aureus subsp. aureus N315
uaagaugauuuagacuc

SEQ ID NO: 2137900 - RNA, 18 nt, Staphylococcus aureus subsp. aureus N315
uaagauagauaaaucaag

SEQ ID NO: 2137901 - RNA, 18 nt, Staphylococcus aureus subsp. aureus N315
uaagauaacgagugaaaa

SEQ ID NO: 2137902 - RNA, 18 nt, Staphylococcus aureus subsp. aureus N315
uaagauaauuuucaauua

SEQ ID NO: 2137903 - RNA, 14 nt, Staphylococcus aureus subsp. aureus N315
uaagauacaggcug

SEQ ID NO: 2137904 - RNA, 15 nt, Staphylococcus aureus subsp. aureus N315
uaagauaauuuucaa

SEQ ID NO: 2137905 - RNA, 24 nt, Staphylococcus aureus subsp. aureus N315
uaagacugccauucuuuuucucaa

SEQ ID NO: 2137906 - RNA, 16 nt, Staphylococcus aureus subsp. aureus N315
uaagacugauuaauua

SEQ ID NO: 2137907 - RNA, 22 nt, Staphylococcus aureus subsp. aureus N315
uaagacagcuucucauugaaau

SEQ ID NO: 2137908 - RNA, 16 nt, Staphylococcus aureus subsp. aureus N315
uaagacauaugcagug

SEQ ID NO: 2137909 - RNA, 20 nt, Staphylococcus aureus subsp. aureus N315
uaagagaacuuuucaaacaa

SEQ ID NO: 2137910 - RNA, 17 nt, Staphylococcus aureus subsp. aureus N315
uaagagaacuuuucaaa

SEQ ID NO: 2137911 - RNA, 23 nt, Staphylococcus aureus subsp. aureus N315
uaagagucuucuuacugcaauua

SEQ ID NO: 2137912 - RNA, 21 nt, Staphylococcus aureus subsp. aureus N315
uaagaaaaauguguuaaaaua

SEQ ID NO: 2137913 - RNA, 16 nt, Staphylococcus aureus subsp. aureus N315
uaacuuguuuauucag

SEQ ID NO: 2137914 - RNA, 18 nt, Staphylococcus aureus subsp. aureus N315
uaacuucugauucuucac

SEQ ID NO: 2137915 - RNA, 21 nt, Staphylococcus aureus subsp. aureus N315
uaacuucuauuaagaaauacu

SEQ ID NO: 2137916 - RNA, 13 nt, Staphylococcus aureus subsp. aureus N315
uaacuuuaaaaau

SEQ ID NO: 2137917 - RNA, 16 nt, Staphylococcus aureus subsp. aureus N315
uaacuuuaauuaaagc

SEQ ID NO: 2137918 - RNA, 18 nt, Staphylococcus aureus subsp. aureus N315
uaacuuuaccaauaucau

SEQ ID NO: 2137919 - RNA, 18 nt, Staphylococcus aureus subsp. aureus N315
uaacuuucagcaccagaa

SEQ ID NO: 2137920 - RNA, 13 nt, Staphylococcus aureus subsp. aureus N315
uaacuuucccuac

SEQ ID NO: 2137921 - RNA, 14 nt, Staphylococcus aureus subsp. aureus N315
uaagaagcuuucug

SEQ ID NO: 2137922 - RNA, 14 nt, Staphylococcus aureus subsp. aureus N315
uaagaauuuaaaag

SEQ ID NO: 2137923 - RNA, 14 nt, Staphylococcus aureus subsp. aureus N315
uaagaagaaauacu

SEQ ID NO: 2137924 - RNA, 15 nt, Staphylococcus aureus subsp. aureus N315
uaagaacgagaauuu

SEQ ID NO: 2137925 - RNA, 19 nt, Staphylococcus aureus subsp. aureus N315
uaagcuuacgacauacuug

SEQ ID NO: 2137926 - RNA, 23 nt, Staphylococcus aureus subsp. aureus N315
uaagcucauuucaauauuaaaau

SEQ ID NO: 2137927 - RNA, 21 nt, Staphylococcus aureus subsp. aureus N315
uaagcugcucgauauaugucu

SEQ ID NO: 2137928 - RNA, 23 nt, Staphylococcus aureus subsp. aureus N315
uaaggcuaaugauaauccaccaa

SEQ ID NO: 2137929 - RNA, 15 nt, Staphylococcus aureus subsp. aureus N315
uaagcuuuguuugac

SEQ ID NO: 2137930 - RNA, 20 nt, Staphylococcus aureus subsp. aureus N315
uaagcuuuuucuuucucuaa

SEQ ID NO: 2137931 - RNA, 13 nt, Staphylococcus aureus subsp. aureus N315
uaaggaaaauuau

SEQ ID NO: 2137932 - RNA, 14 nt, Staphylococcus aureus subsp. aureus N315
uaaggaaccugucu

SEQ ID NO: 2137933 - RNA, 22 nt, Staphylococcus aureus subsp. aureus N315
uaaggaugauuuauuaacucau

SEQ ID NO: 2137934 - RNA, 15 nt, Staphylococcus aureus subsp. aureus N315
uaagcaguuaauaag

SEQ ID NO: 2137935 - RNA, 20 nt, Staphylococcus aureus subsp. aureus N315
uaagcauaauucaacuuaaa

SEQ ID NO: 2137936 - RNA, 22 nt, Staphylococcus aureus subsp. aureus N315
uaagcaguaagaugacuacaac

SEQ ID NO: 2137937 - RNA, 17 nt, Staphylococcus aureus subsp. aureus N315
uaagcaguaagaugacu

SEQ ID NO: 2137938 - RNA, 18 nt, Staphylococcus aureus subsp. aureus N315
uaagcaucacauaugucc

SEQ ID NO: 2137939 - RNA, 21 nt, Staphylococcus aureus subsp. aureus N315
uaagcaguuaauaagaaacuu

SEQ ID NO: 2137940 - RNA, 14 nt, Staphylococcus aureus subsp. aureus N315
uaagcaaucauaau

SEQ ID NO: 2137941 - RNA, 18 nt, Staphylococcus aureus subsp. aureus N315
uaagccuuuucaaacaua

SEQ ID NO: 2137942 - RNA, 21 nt, Staphylococcus aureus subsp. aureus N315
uaagcgcaauggccauuugau

SEQ ID NO: 2137943 - RNA, 23 nt, Staphylococcus aureus subsp. aureus N315
uaagggguauauuaaaaauuuca

SEQ ID NO: 2137944 - RNA, 14 nt, Staphylococcus aureus subsp. aureus N315
uaaguaauaaaaua

SEQ ID NO: 2137945 - RNA, 22 nt, Staphylococcus aureus subsp. aureus N315
uaagucugaugucgaaaauagc

SEQ ID NO: 2137946 - RNA, 20 nt, Staphylococcus aureus subsp. aureus N315
uaagucgccuaacuuuuauu

SEQ ID NO: 2137947 - RNA, 12 nt, Staphylococcus aureus subsp. aureus N315
uaaguauucaua

SEQ ID NO: 2137948 - RNA, 21 nt, Staphylococcus aureus subsp. aureus N315
uaaguauuuaaauaacaagua

SEQ ID NO: 2137949 - RNA, 19 nt, Staphylococcus aureus subsp. aureus N315
uaaguaucgccaucauuca

SEQ ID NO: 2137950 - RNA, 15 nt, Staphylococcus aureus subsp. aureus N315
uaaguaguuguuaua

SEQ ID NO: 2137951 - RNA, 20 nt, Staphylococcus aureus subsp. aureus N315
uaaguauaauuaaacuaaua

SEQ ID NO: 2137952 - RNA, 20 nt, Staphylococcus aureus subsp. aureus N315
uaaguauaaugaugugccuc

SEQ ID NO: 2137953 - RNA, 12 nt, Staphylococcus aureus subsp. aureus N315
uaaguaauucau

SEQ ID NO: 2137954 - RNA, 15 nt, Staphylococcus aureus subsp. aureus N315
uaaguacaaauaaua

SEQ ID NO: 2137955 - RNA, 15 nt, Staphylococcus aureus subsp. aureus N315
uaaguacauaaaugc

SEQ ID NO: 2137956 - RNA, 17 nt, Staphylococcus aureus subsp. aureus N315
uaaguagcucaaaacaa

SEQ ID NO: 2137957 - RNA, 15 nt, Staphylococcus aureus subsp. aureus N315
uaaguuaaaaaugua

SEQ ID NO: 2137958 - RNA, 22 nt, Staphylococcus aureus subsp. aureus N315
uaaguuaaaaauguaaauaaaa

SEQ ID NO: 2137959 - RNA, 23 nt, Staphylococcus aureus subsp. aureus N315
uaaguuaaaaccuuuucaaauua

SEQ ID NO: 2137960 - RNA, 12 nt, Staphylococcus aureus subsp. aureus N315
uaaguuaaaaau

SEQ ID NO: 2137961 - RNA, 17 nt, Staphylococcus aureus subsp. aureus N315
uaagucuuuuaaaugau

SEQ ID NO: 2137962 - RNA, 13 nt, Staphylococcus aureus subsp. aureus N315
uaagugauaaaua

SEQ ID NO: 2137963 - RNA, 22 nt, Staphylococcus aureus subsp. aureus N315
uaagugauauacgacaaucaca

SEQ ID NO: 2137964 - RNA, 22 nt, Staphylococcus aureus subsp. aureus N315
uaagugguuaucacgugcuucg

SEQ ID NO: 2137965 - RNA, 22 nt, Staphylococcus aureus subsp. aureus N315
uaaguuucgcugcuacaccacc

SEQ ID NO: 2137966 - RNA, 21 nt, Staphylococcus aureus subsp. aureus N315
uaaguuugaaggagauauuuu

SEQ ID NO: 2137967 - RNA, 16 nt, Staphylococcus aureus subsp. aureus N315
uaaguugaauauaaaa

SEQ ID NO: 2137968 - RNA, 14 nt, Staphylococcus aureus subsp. aureus N315
uaaguugauuucua

SEQ ID NO: 2137969 - RNA, 14 nt, Staphylococcus aureus subsp. aureus N315
uaaguuaugacuaa

SEQ ID NO: 2137970 - RNA, 21 nt, Staphylococcus aureus subsp. aureus N315
uaaguuaugacuaacgaaaaa

SEQ ID NO: 2137971 - RNA, 17 nt, Staphylococcus aureus subsp. aureus N315
uaauaacaucuaaauuu

SEQ ID NO: 2137972 - RNA, 15 nt, Staphylococcus aureus subsp. aureus N315
uaauaaauuuaacgu

SEQ ID NO: 2137973 - RNA, 21 nt, Staphylococcus aureus subsp. aureus N315
uaauaaauuuccaaaguaaua

SEQ ID NO: 2137974 - RNA, 22 nt, Staphylococcus aureus subsp. aureus N315
uaauaaauaggaugaaaaagau

SEQ ID NO: 2137975 - RNA, 11 nt, Staphylococcus aureus subsp. aureus N315
uaauaaauauc

SEQ ID NO: 2137976 - RNA, 23 nt, Staphylococcus aureus subsp. aureus N315
uaauaaaucgaauugauggaaaa

SEQ ID NO: 2137977 - RNA, 15 nt, Staphylococcus aureus subsp. aureus N315
uaauaaaucauuagu

SEQ ID NO: 2137978 - RNA, 16 nt, Staphylococcus aureus subsp. aureus N315
uaauaaaacuugugau

SEQ ID NO: 2137979 - RNA, 16 nt, Staphylococcus aureus subsp. aureus N315
uaauaaaccuacaaua

SEQ ID NO: 2137980 - RNA, 23 nt, Staphylococcus aureus subsp. aureus N315
uaauaaaaaccaauauuucuggg

SEQ ID NO: 2137981 - RNA, 14 nt, Staphylococcus aureus subsp. aureus N315
uaaauucauuuuaa

SEQ ID NO: 2137982 - RNA, 17 nt, Staphylococcus aureus subsp. aureus N315
uaaauucauuuuaagug

SEQ ID NO: 2137983 - RNA, 20 nt, Staphylococcus aureus subsp. aureus N315
uaaauuccaagagaauuaau

SEQ ID NO: 2137984 - RNA, 20 nt, Staphylococcus aureus subsp. aureus N315
uaaauucccauguauucuua

SEQ ID NO: 2137985 - RNA, 18 nt, Staphylococcus aureus subsp. aureus N315
uaaauucaaaucuggcac

SEQ ID NO: 2137986 - RNA, 14 nt, Staphylococcus aureus subsp. aureus N315
uaaauucaucuguu

SEQ ID NO: 2137987 - RNA, 16 nt, Staphylococcus aureus subsp. aureus N315
uaaauucuaaaacgga

SEQ ID NO: 2137988 - RNA, 14 nt, Staphylococcus aureus subsp. aureus N315
uaaauucuaucuau

SEQ ID NO: 2137989 - RNA, 19 nt, Staphylococcus aureus subsp. aureus N315
uaaauucuuauaaaauaaa

SEQ ID NO: 2137990 - RNA, 14 nt, Staphylococcus aureus subsp. aureus N315
uaaauuaauagaga

SEQ ID NO: 2137991 - RNA, 19 nt, Staphylococcus aureus subsp. aureus N315
uaaauuaauagagaaagaa

SEQ ID NO: 2137992 - RNA, 12 nt, Staphylococcus aureus subsp. aureus N315
uaaauuaauaug

SEQ ID NO: 2137993 - RNA, 17 nt, Staphylococcus aureus subsp. aureus N315
uaaauguuuuauguauu

SEQ ID NO: 2137994 - RNA, 20 nt, Staphylococcus aureus subsp. aureus N315
uaaauguuauuaaccaucau

SEQ ID NO: 2137995 - RNA, 22 nt, Staphylococcus aureus subsp. aureus N315
uaaauguugacucguuauucaa

SEQ ID NO: 2137996 - RNA, 16 nt, Staphylococcus aureus subsp. aureus N315
uaaauguuuauaucuu

SEQ ID NO: 2137997 - RNA, 23 nt, Staphylococcus aureus subsp. aureus N315
uaaauuauggagcggaagauagg

SEQ ID NO: 2137998 - RNA, 14 nt, Staphylococcus aureus subsp. aureus N315
uaaauuauuuaauu

SEQ ID NO: 2137999 - RNA, 15 nt, Staphylococcus aureus subsp. aureus N315
uaaauuauuuauuca

SEQ ID NO: 2138000 - RNA, 16 nt, Staphylococcus aureus subsp. aureus N315
uaaaucccuaaaaaaa

SEQ ID NO: 2138001 - RNA, 14 nt, Staphylococcus aureus subsp. aureus N315
uaaaucgauaacag

SEQ ID NO: 2138002 - RNA, 14 nt, Staphylococcus aureus subsp. aureus N315
uaaauccuuuauau

SEQ ID NO: 2138003 - RNA, 21 nt, Staphylococcus aureus subsp. aureus N315
uaaaugcuuaauuuguuuuaa

SEQ ID NO: 2138004 - RNA, 22 nt, Staphylococcus aureus subsp. aureus N315
uaaaugcucaagccaugauuua

SEQ ID NO: 2138005 - RNA, 18 nt, Staphylococcus aureus subsp. aureus N315
uaaauguuauuaaccauc

SEQ ID NO: 2138006 - RNA, 21 nt, Staphylococcus aureus subsp. aureus N315
uaaaugcuucugguucuucaa

SEQ ID NO: 2138007 - RNA, 17 nt, Staphylococcus aureus subsp. aureus N315
uaacaauuuuaaaucuu

SEQ ID NO: 2138008 - RNA, 13 nt, Staphylococcus aureus subsp. aureus N315
uaacaaguauaaa

SEQ ID NO: 2138009 - RNA, 12 nt, Staphylococcus aureus subsp. aureus N315
uaacaagcauuu

SEQ ID NO: 2138010 - RNA, 17 nt, Staphylococcus aureus subsp. aureus N315
uaacaccaauugaauau

SEQ ID NO: 2138011 - RNA, 21 nt, Staphylococcus aureus subsp. aureus N315
uaacacauucuuauuugaaau

SEQ ID NO: 2138012 - RNA, 14 nt, Staphylococcus aureus subsp. aureus N315
uaaauuuuuaagaa

SEQ ID NO: 2138013 - RNA, 22 nt, Staphylococcus aureus subsp. aureus N315
uaaauuuucuguuuaauuaaaa

SEQ ID NO: 2138014 - RNA, 17 nt, Staphylococcus aureus subsp. aureus N315
uaaauuuugaauuacag

SEQ ID NO: 2138015 - RNA, 21 nt, Staphylococcus aureus subsp. aureus N315
uaaauuuugcgaaaauaucau

SEQ ID NO: 2138016 - RNA, 23 nt, Staphylococcus aureus subsp. aureus N315
uaaauugacucaaagauauacuu

SEQ ID NO: 2138017 - RNA, 20 nt, Staphylococcus aureus subsp. aureus N315
uaaauuuucaucauaaucug

SEQ ID NO: 2138018 - RNA, 19 nt, Staphylococcus aureus subsp. aureus N315
uaacaaaaucucaacagca

SEQ ID NO: 2138019 - RNA, 20 nt, Staphylococcus aureus subsp. aureus N315
uaacaaaaucucaacagcaa

SEQ ID NO: 2138020 - RNA, 19 nt, Staphylococcus aureus subsp. aureus N315
uaacaagaaguaauguuaa

SEQ ID NO: 2138021 - RNA, 20 nt, Staphylococcus aureus subsp. aureus N315
uaacaagaaguaauguuaaa

SEQ ID NO: 2138022 - RNA, 13 nt, Staphylococcus aureus subsp. aureus N315
uaacaagaaaaac

SEQ ID NO: 2138023 - RNA, 23 nt, Staphylococcus aureus subsp. aureus N315
uaacaaacauuaaucuauauaaa

SEQ ID NO: 2138024 - RNA, 21 nt, Staphylococcus aureus subsp. aureus N315
uaaccuaauucgccaucuuuu

SEQ ID NO: 2138025 - RNA, 16 nt, Staphylococcus aureus subsp. aureus N315
uaaccuauuaaaucug

SEQ ID NO: 2138026 - RNA, 14 nt, Staphylococcus aureus subsp. aureus N315
uaaccuacuuugau

SEQ ID NO: 2138027 - RNA, 21 nt, Staphylococcus aureus subsp. aureus N315
uaacgcucaugaguuucucau

SEQ ID NO: 2138028 - RNA, 16 nt, Staphylococcus aureus subsp. aureus N315
uaacguacaauguauu

SEQ ID NO: 2138029 - RNA, 18 nt, Staphylococcus aureus subsp. aureus N315
uaaccauaguaauaaaau

SEQ ID NO: 2138030 - RNA, 16 nt, Staphylococcus aureus subsp. aureus N315
uaacccuaaaaugaau

SEQ ID NO: 2138031 - RNA, 19 nt, Staphylococcus aureus subsp. aureus N315
uaaccaguauaauuuucug

SEQ ID NO: 2138032 - RNA, 21 nt, Staphylococcus aureus subsp. aureus N315
uaaccacaccaugcugcacau

SEQ ID NO: 2138033 - RNA, 22 nt, Staphylococcus aureus subsp. aureus N315
uaaccaccaucccauuaaacca

SEQ ID NO: 2138034 - RNA, 14 nt, Staphylococcus aureus subsp. aureus N315
uaacaucuaaauuu

SEQ ID NO: 2138035 - RNA, 21 nt, Staphylococcus aureus subsp. aureus N315
uaacauccugcuuauuaauug

SEQ ID NO: 2138036 - RNA, 21 nt, Staphylococcus aureus subsp. aureus N315
uaacauccccaaaaauagauu

SEQ ID NO: 2138037 - RNA, 20 nt, Staphylococcus aureus subsp. aureus N315
uaacacugccggcgcacuua

SEQ ID NO: 2138038 - RNA, 16 nt, Staphylococcus aureus subsp. aureus N315
uaaaucauacgagaaa

SEQ ID NO: 2138039 - RNA, 22 nt, Staphylococcus aureus subsp. aureus N315
uaaaucauacgagaaauuagaa

SEQ ID NO: 2138040 - RNA, 14 nt, Staphylococcus aureus subsp. aureus N315
uaaaucauagaggc

SEQ ID NO: 2138041 - RNA, 22 nt, Staphylococcus aureus subsp. aureus N315
uaaaucaugaaauaaaaaaaca

SEQ ID NO: 2138042 - RNA, 16 nt, Staphylococcus aureus subsp. aureus N315
uaaaucauuucguuca

SEQ ID NO: 2138043 - RNA, 12 nt, Staphylococcus aureus subsp. aureus N315
uaaaucauucuu

SEQ ID NO: 2138044 - RNA, 12 nt, Staphylococcus aureus subsp. aureus N315
uaaauaucaauu

SEQ ID NO: 2138045 - RNA, 17 nt, Staphylococcus aureus subsp. aureus N315
uaaauaucaauaauucg

SEQ ID NO: 2138046 - RNA, 18 nt, Staphylococcus aureus subsp. aureus N315
uaaauaugaaucuagaau

SEQ ID NO: 2138047 - RNA, 23 nt, Staphylococcus aureus subsp. aureus N315
uaaaucacgccauaaucuucauu

SEQ ID NO: 2138048 - RNA, 19 nt, Staphylococcus aureus subsp. aureus N315
uaaauaugauguuaaaaaa

SEQ ID NO: 2138049 - RNA, 22 nt, Staphylococcus aureus subsp. aureus N315
uaaauaugacgcgugaauuaaa

SEQ ID NO: 2138050 - RNA, 20 nt, Staphylococcus aureus subsp. aureus N315
uaaauauggaugauauucaa

SEQ ID NO: 2138051 - RNA, 21 nt, Staphylococcus aureus subsp. aureus N315
uaaauaacuucguuuuaauaa

SEQ ID NO: 2138052 - RNA, 19 nt, Staphylococcus aureus subsp. aureus N315
uaaauaacuuuuuaaagga

SEQ ID NO: 2138053 - RNA, 21 nt, Staphylococcus aureus subsp. aureus N315
uaaauaaccgcacuuucuauu

SEQ ID NO: 2138054 - RNA, 19 nt, Staphylococcus aureus subsp. aureus N315
uaaauaacaguuaauuaua

SEQ ID NO: 2138055 - RNA, 20 nt, Staphylococcus aureus subsp. aureus N315
uaaauaaaaauuauauaaau

SEQ ID NO: 2138056 - RNA, 15 nt, Staphylococcus aureus subsp. aureus N315
uaaauaaaaauuaua

SEQ ID NO: 2138057 - RNA, 19 nt, Staphylococcus aureus subsp. aureus N315
uaaauaagugauaaauaau

SEQ ID NO: 2138058 - RNA, 15 nt, Staphylococcus aureus subsp. aureus N315
uaaauaauaaguuga

SEQ ID NO: 2138059 - RNA, 20 nt, Staphylococcus aureus subsp. aureus N315
uaaauaguuuuucauauuca

SEQ ID NO: 2138060 - RNA, 16 nt, Staphylococcus aureus subsp. aureus N315
uaaauaguuuuucaua

SEQ ID NO: 2138061 - RNA, 22 nt, Staphylococcus aureus subsp. aureus N315
uaaauauauaaggcgcucucuu

SEQ ID NO: 2138062 - RNA, 15 nt, Staphylococcus aureus subsp. aureus N315
uaaauauaaauauga

SEQ ID NO: 2138063 - RNA, 22 nt, Staphylococcus aureus subsp. aureus N315
uaaauauaauagaaauaaucac

SEQ ID NO: 2138064 - RNA, 15 nt, Staphylococcus aureus subsp. aureus N315
uaaaguuuaaauauu

SEQ ID NO: 2138065 - RNA, 16 nt, Staphylococcus aureus subsp. aureus N315
uaaaguguuucaacau

SEQ ID NO: 2138066 - RNA, 12 nt, Staphylococcus aureus subsp. aureus N315
uaaaguuacaug

SEQ ID NO: 2138067 - RNA, 16 nt, Staphylococcus aureus subsp. aureus N315
uaaagucaauuuaaau

SEQ ID NO: 2138068 - RNA, 18 nt, Staphylococcus aureus subsp. aureus N315
uaaagucaauuuaaauaa

SEQ ID NO: 2138069 - RNA, 21 nt, Staphylococcus aureus subsp. aureus N315
uaaagucaacaucguauucuu

SEQ ID NO: 2138070 - RNA, 23 nt, Staphylococcus aureus subsp. aureus N315
uaaagucuucaucuuuaaagaaa

SEQ ID NO: 2138071 - RNA, 21 nt, Staphylococcus aureus subsp. aureus N315
uaaagucguaucauauauuga

SEQ ID NO: 2138072 - RNA, 15 nt, Staphylococcus aureus subsp. aureus N315
uaaagugaaauaaag

SEQ ID NO: 2138073 - RNA, 18 nt, Staphylococcus aureus subsp. aureus N315
uaaaguacuuacaaauau

SEQ ID NO: 2138074 - RNA, 17 nt, Staphylococcus aureus subsp. aureus N315
uaaaguacuuacaaaua

SEQ ID NO: 2138075 - RNA, 15 nt, Staphylococcus aureus subsp. aureus N315
uaaaguaaaauauac

SEQ ID NO: 2138076 - RNA, 22 nt, Staphylococcus aureus subsp. aureus N315
uaaagauuauuauuacaaugaa

SEQ ID NO: 2138077 - RNA, 16 nt, Staphylococcus aureus subsp. aureus N315
uaaagauuaaaauaug

SEQ ID NO: 2138078 - RNA, 17 nt, Staphylococcus aureus subsp. aureus N315
uaaagcugauuuuucau

SEQ ID NO: 2138079 - RNA, 16 nt, Staphylococcus aureus subsp. aureus N315
uaaagcuuauuaaauc

SEQ ID NO: 2138080 - RNA, 23 nt, Staphylococcus aureus subsp. aureus N315
uaaagcuagggugaauuaguaaa

SEQ ID NO: 2138081 - RNA, 15 nt, Staphylococcus aureus subsp. aureus N315
uaaagcuauaaaaaa

SEQ ID NO: 2138082 - RNA, 23 nt, Staphylococcus aureus subsp. aureus N315
uaaacaacugagucaaagucauu

SEQ ID NO: 2138083 - RNA, 21 nt, Staphylococcus aureus subsp. aureus N315
uaaacaacugcaauagcuaua

SEQ ID NO: 2138084 - RNA, 21 nt, Staphylococcus aureus subsp. aureus N315
uaaacaacugagucaaaguca

SEQ ID NO: 2138085 - RNA, 19 nt, Staphylococcus aureus subsp. aureus N315
uaaacaagcaucaugaaau

SEQ ID NO: 2138086 - RNA, 14 nt, Staphylococcus aureus subsp. aureus N315
uaaacaagcaucau

SEQ ID NO: 2138087 - RNA, 22 nt, Staphylococcus aureus subsp. aureus N315
uaaacaacaucgauuuaucauu

SEQ ID NO: 2138088 - RNA, 14 nt, Staphylococcus aureus subsp. aureus N315
uaaacaacauacag

SEQ ID NO: 2138089 - RNA, 20 nt, Staphylococcus aureus subsp. aureus N315
guuuuucaucauuaaaauca

SEQ ID NO: 2138090 - RNA, 12 nt, Staphylococcus aureus subsp. aureus N315
guuuuuccaugu

SEQ ID NO: 2138091 - RNA, 17 nt, Staphylococcus aureus subsp. aureus N315
guuuuggucaaguaaau

SEQ ID NO: 2138092 - RNA, 16 nt, Staphylococcus aureus subsp. aureus N315
guuuuuagcauuauca

SEQ ID NO: 2138093 - RNA, 12 nt, Staphylococcus aureus subsp. aureus N315
guuuuuauuauu

SEQ ID NO: 2138094 - RNA, 11 nt, Staphylococcus aureus subsp. aureus N315
uaaacauuuuu

SEQ ID NO: 2138095 - RNA, 20 nt, Staphylococcus aureus subsp. aureus N315
uaaacauuuuugaauuuaau

SEQ ID NO: 2138096 - RNA, 21 nt, Staphylococcus aureus subsp. aureus N315
uaaaccaaaucggaauaaaau

SEQ ID NO: 2138097 - RNA, 22 nt, Staphylococcus aureus subsp. aureus N315
uaaaccaaaucggaauaaaaua

SEQ ID NO: 2138098 - RNA, 21 nt, Staphylococcus aureus subsp. aureus N315
uaaaccgauuguuucaccagc

SEQ ID NO: 2138099 - RNA, 20 nt, Staphylococcus aureus subsp. aureus N315
uaaaccgcacuucuauauua

SEQ ID NO: 2138100 - RNA, 18 nt, Staphylococcus aureus subsp. aureus N315
uaaacacuauaaaagcca

SEQ ID NO: 2138101 - RNA, 18 nt, Staphylococcus aureus subsp. aureus N315
uaaacacuuuaguauuau

SEQ ID NO: 2138102 - RNA, 23 nt, Staphylococcus aureus subsp. aureus N315
uaaacacuauaaaagccaugaua

SEQ ID NO: 2138103 - RNA, 16 nt, Staphylococcus aureus subsp. aureus N315
uaaaccuacaauauag

SEQ ID NO: 2138104 - RNA, 20 nt, Staphylococcus aureus subsp. aureus N315
uaaacuagaaaacauaaaua

SEQ ID NO: 2138105 - RNA, 19 nt, Staphylococcus aureus subsp. aureus N315
uaaacuaguaauagaauag

SEQ ID NO: 2138106 - RNA, 16 nt, Staphylococcus aureus subsp. aureus N315
uaaacucauaccaaaa

SEQ ID NO: 2138107 - RNA, 14 nt, Staphylococcus aureus subsp. aureus N315
uaaacuauaauaau

SEQ ID NO: 2138108 - RNA, 20 nt, Staphylococcus aureus subsp. aureus N315
uaaacucguugcacucuuuu

SEQ ID NO: 2138109 - RNA, 17 nt, Staphylococcus aureus subsp. aureus N315
uaaagauagaaugaaua

SEQ ID NO: 2138110 - RNA, 13 nt, Staphylococcus aureus subsp. aureus N315
uaaagaaugauuu

SEQ ID NO: 2138111 - RNA, 13 nt, Staphylococcus aureus subsp. aureus N315
uaaagaauuaagu

SEQ ID NO: 2138112 - RNA, 15 nt, Staphylococcus aureus subsp. aureus N315
uaaagaauuaaguag

SEQ ID NO: 2138113 - RNA, 16 nt, Staphylococcus aureus subsp. aureus N315
uaaagaauuaaguagu

SEQ ID NO: 2138114 - RNA, 19 nt, Staphylococcus aureus subsp. aureus N315
uaaacuuauuaauuaauag

SEQ ID NO: 2138115 - RNA, 19 nt, Staphylococcus aureus subsp. aureus N315
gcugacaccuauauuuuua

SEQ ID NO: 2138116 - RNA, 21 nt, Staphylococcus aureus subsp. aureus N315
gcugaaguuugaacaacaucu

SEQ ID NO: 2138117 - RNA, 23 nt, Staphylococcus aureus subsp. aureus N315
gcugaacguaaguuuaguucaaa

SEQ ID NO: 2138118 - RNA, 18 nt, Staphylococcus aureus subsp. aureus N315
gcugcaaucguugaaaaa

SEQ ID NO: 2138119 - RNA, 14 nt, Staphylococcus aureus subsp. aureus N315
gcugauuuuauaaa

SEQ ID NO: 2138120 - RNA, 19 nt, Staphylococcus aureus subsp. aureus N315
gcugccaaauauaauuuca

SEQ ID NO: 2138121 - RNA, 15 nt, Staphylococcus aureus subsp. aureus N315
gcugcuguacaauuu

SEQ ID NO: 2138122 - RNA, 18 nt, Staphylococcus aureus subsp. aureus N315
gcuggacagcuacaauuu

SEQ ID NO: 2138123 - RNA, 18 nt, Staphylococcus aureus subsp. aureus N315
gcucuaauucaaugauuu

SEQ ID NO: 2138124 - RNA, 22 nt, Staphylococcus aureus subsp. aureus N315
gcucuaauucaaugauuuuuaa

SEQ ID NO: 2138125 - RNA, 17 nt, Staphylococcus aureus subsp. aureus N315
gcucuaauccaaaauaa

SEQ ID NO: 2138126 - RNA, 20 nt, Staphylococcus aureus subsp. aureus N315
gcucuaauccaaaauaaucg

SEQ ID NO: 2138127 - RNA, 15 nt, Staphylococcus aureus subsp. aureus N315
gcucuauaucaaauu

SEQ ID NO: 2138128 - RNA, 16 nt, Staphylococcus aureus subsp. aureus N315
gcucauaugucuguuc

SEQ ID NO: 2138129 - RNA, 19 nt, Staphylococcus aureus subsp. aureus N315
gcuuuagucgguguuuucu

SEQ ID NO: 2138130 - RNA, 20 nt, Staphylococcus aureus subsp. aureus N315
gcuuuagucgguguuuucuu

SEQ ID NO: 2138131 - RNA, 16 nt, Staphylococcus aureus subsp. aureus N315
gcuuuagcaauugaau

SEQ ID NO: 2138132 - RNA, 19 nt, Staphylococcus aureus subsp. aureus N315
gcuuuacguucugauucau

SEQ ID NO: 2138133 - RNA, 17 nt, Staphylococcus aureus subsp. aureus N315
gcuuguugucacgauca

SEQ ID NO: 2138134 - RNA, 19 nt, Staphylococcus aureus subsp. aureus N315
gcuuguucaacuaaauuuu

SEQ ID NO: 2138135 - RNA, 13 nt, Staphylococcus aureus subsp. aureus N315
gcuuuaauuaaag

SEQ ID NO: 2138136 - RNA, 15 nt, Staphylococcus aureus subsp. aureus N315
gcuuuaauaaaucgu

SEQ ID NO: 2138137 - RNA, 13 nt, Staphylococcus aureus subsp. aureus N315
gcuuuaauauaaa

SEQ ID NO: 2138138 - RNA, 23 nt, Staphylococcus aureus subsp. aureus N315
gcuuuauuuucuuguguauuuuu

SEQ ID NO: 2138139 - RNA, 15 nt, Staphylococcus aureus subsp. aureus N315
gcuuguaaaauuuuc

SEQ ID NO: 2138140 - RNA, 18 nt, Staphylococcus aureus subsp. aureus N315
gcuuguaacaagcauuuu

SEQ ID NO: 2138141 - RNA, 22 nt, Staphylococcus aureus subsp. aureus N315
gcuuguacaaaaaauuguaagu

SEQ ID NO: 2138142 - RNA, 17 nt, Staphylococcus aureus subsp. aureus N315
aaaggcgaaacauuaaa

SEQ ID NO: 2138143 - RNA, 20 nt, Staphylococcus aureus subsp. aureus N315
aaaggcgucuuaaauuaggg

SEQ ID NO: 2138144 - RNA, 14 nt, Staphylococcus aureus subsp. aureus N315
gcuugguuaaaguu

SEQ ID NO: 2138145 - RNA, 17 nt, Staphylococcus aureus subsp. aureus N315
aaaggcuagcuaaaauu

SEQ ID NO: 2138146 - RNA, 14 nt, Staphylococcus aureus subsp. aureus N315
aaaggauuauuaac

SEQ ID NO: 2138147 - RNA, 15 nt, Staphylococcus aureus subsp. aureus N315
aaaggcauucuucca

SEQ ID NO: 2138148 - RNA, 13 nt, Staphylococcus aureus subsp. aureus N315
gcuuggauuuuuu

SEQ ID NO: 2138149 - RNA, 16 nt, Staphylococcus aureus subsp. aureus N315
gcuugcuuacaauaau

SEQ ID NO: 2138150 - RNA, 15 nt, Staphylococcus aureus subsp. aureus N315
gcuugcuucuuuccu

SEQ ID NO: 2138151 - RNA, 17 nt, Staphylococcus aureus subsp. aureus N315
gcuugcggauacauauu

SEQ ID NO: 2138152 - RNA, 20 nt, Staphylococcus aureus subsp. aureus N315
gcuugaccuucaguuucuac

SEQ ID NO: 2138153 - RNA, 17 nt, Staphylococcus aureus subsp. aureus N315
gcuucuuucuaaaauaa

SEQ ID NO: 2138154 - RNA, 21 nt, Staphylococcus aureus subsp. aureus N315
gcuugaaauuauuauuuaaau

SEQ ID NO: 2138155 - RNA, 19 nt, Staphylococcus aureus subsp. aureus N315
gcuucuuaucaacaacaag

SEQ ID NO: 2138156 - RNA, 18 nt, Staphylococcus aureus subsp. aureus N315
gcuucuguguuggggccc

SEQ ID NO: 2138157 - RNA, 15 nt, Staphylococcus aureus subsp. aureus N315
gcuucuaauuuuuca

SEQ ID NO: 2138158 - RNA, 13 nt, Staphylococcus aureus subsp. aureus N315
gcuucuuaaauca

SEQ ID NO: 2138159 - RNA, 23 nt, Staphylococcus aureus subsp. aureus N315
gcuucuguguuggggcccacacc

SEQ ID NO: 2138160 - RNA, 16 nt, Staphylococcus aureus subsp. aureus N315
gcuucugguucuucaa

SEQ ID NO: 2138161 - RNA, 18 nt, Staphylococcus aureus subsp. aureus N315
gcuucgcuagaaccugcu

SEQ ID NO: 2138162 - RNA, 18 nt, Staphylococcus aureus subsp. aureus N315
gcuucauagucacuuuua

SEQ ID NO: 2138163 - RNA, 20 nt, Staphylococcus aureus subsp. aureus N315
gcuucaguuaaaucacugcu

SEQ ID NO: 2138164 - RNA, 18 nt, Staphylococcus aureus subsp. aureus N315
gcuuccaauuuaaaauga

SEQ ID NO: 2138165 - RNA, 18 nt, Staphylococcus aureus subsp. aureus N315
gcuuccacuucaucuaaa

SEQ ID NO: 2138166 - RNA, 17 nt, Staphylococcus aureus subsp. aureus N315
gcuuccacuucaucuaa

SEQ ID NO: 2138167 - RNA, 15 nt, Staphylococcus aureus subsp. aureus N315
gcuuccaaauguuca

SEQ ID NO: 2138168 - RNA, 22 nt, Staphylococcus aureus subsp. aureus N315
gcuucauuaguugcauaaucaa

SEQ ID NO: 2138169 - RNA, 22 nt, Staphylococcus aureus subsp. aureus N315
gcuuagcgcaggcgcuccuacu

SEQ ID NO: 2138170 - RNA, 21 nt, Staphylococcus aureus subsp. aureus N315
gcuuagcgcaggcgcuccuac

SEQ ID NO: 2138171 - RNA, 22 nt, Staphylococcus aureus subsp. aureus N315
gcuuauauaaacaaaaaucuac

SEQ ID NO: 2138172 - RNA, 23 nt, Staphylococcus aureus subsp. aureus N315
gcuuagggcuuuguuuucugucc

SEQ ID NO: 2138173 - RNA, 24 nt, Staphylococcus aureus subsp. aureus N315
gcuuagucaauguauauuuaacau

SEQ ID NO: 2138174 - RNA, 13 nt, Staphylococcus aureus subsp. aureus N315
gcuuauugaaaag

SEQ ID NO: 2138175 - RNA, 15 nt, Staphylococcus aureus subsp. aureus N315
gcugucauaccuuuu

SEQ ID NO: 2138176 - RNA, 12 nt, Staphylococcus aureus subsp. aureus N315
gcugucauaccu

SEQ ID NO: 2138177 - RNA, 17 nt, Staphylococcus aureus subsp. aureus N315
gcuguccacuauauccu

SEQ ID NO: 2138178 - RNA, 17 nt, Staphylococcus aureus subsp. aureus N315
gcugucauuuucugcuu

SEQ ID NO: 2138179 - RNA, 20 nt, Staphylococcus aureus subsp. aureus N315
gcuguuaauaaaucauuagu

SEQ ID NO: 2138180 - RNA, 12 nt, Staphylococcus aureus subsp. aureus N315
gcuguucucuau

SEQ ID NO: 2138181 - RNA, 18 nt, Staphylococcus aureus subsp. aureus N315
gcuuaagaaauuuuuucu

SEQ ID NO: 2138182 - RNA, 16 nt, Staphylococcus aureus subsp. aureus N315
gcuuaagaaauuuuuu

SEQ ID NO: 2138183 - RNA, 19 nt, Staphylococcus aureus subsp. aureus N315
gcuuaauuuguuuuaaaua

SEQ ID NO: 2138184 - RNA, 16 nt, Staphylococcus aureus subsp. aureus N315
gcuuaauuuuauuauu

SEQ ID NO: 2138185 - RNA, 14 nt, Staphylococcus aureus subsp. aureus N315
gcuguuuuauucaa

SEQ ID NO: 2138186 - RNA, 20 nt, Staphylococcus aureus subsp. aureus N315
gcuguuuuuauuauaauaga

SEQ ID NO: 2138187 - RNA, 21 nt, Staphylococcus aureus subsp. aureus N315
gcuguuggcaaaacaauauac

SEQ ID NO: 2138188 - RNA, 20 nt, Staphylococcus aureus subsp. aureus N315
aaaggaauguuuaaaaaacu

SEQ ID NO: 2138189 - RNA, 18 nt, Staphylococcus aureus subsp. aureus N315
aaaggaugugacaaauac

SEQ ID NO: 2138190 - RNA, 19 nt, Staphylococcus aureus subsp. aureus N315
aaaggauggauacuuaaag

SEQ ID NO: 2138191 - RNA, 20 nt, Staphylococcus aureus subsp. aureus N315
aaaggaaggauuuuagauuu

SEQ ID NO: 2138192 - RNA, 21 nt, Staphylococcus aureus subsp. aureus N315
ggcauuauauuuaguccucuu

SEQ ID NO: 2138193 - RNA, 21 nt, Staphylococcus aureus subsp. aureus N315
aaaguauuagauauauuugaa

SEQ ID NO: 2138194 - RNA, 20 nt, Staphylococcus aureus subsp. aureus N315
aaagucauaggcuugccaau

SEQ ID NO: 2138195 - RNA, 17 nt, Staphylococcus aureus subsp. aureus N315
aaagucauuaaauguac

SEQ ID NO: 2138196 - RNA, 17 nt, Staphylococcus aureus subsp. aureus N315
aaagucauuuucauuca

SEQ ID NO: 2138197 - RNA, 13 nt, Staphylococcus aureus subsp. aureus N315
aaagucaacaauu

SEQ ID NO: 2138198 - RNA, 15 nt, Staphylococcus aureus subsp. aureus N315
aaaguaucagucauu

SEQ ID NO: 2138199 - RNA, 15 nt, Staphylococcus aureus subsp. aureus N315
aaaguauauugcuua

SEQ ID NO: 2138200 - RNA, 12 nt, Staphylococcus aureus subsp. aureus N315
aaaguauaaggu

SEQ ID NO: 2138201 - RNA, 16 nt, Staphylococcus aureus subsp. aureus N315
aaaguauaaaccaaau

SEQ ID NO: 2138202 - RNA, 15 nt, Staphylococcus aureus subsp. aureus N315
aaaguauaaauauaa

SEQ ID NO: 2138203 - RNA, 13 nt, Staphylococcus aureus subsp. aureus N315
aaaguagauauug

SEQ ID NO: 2138204 - RNA, 16 nt, Staphylococcus aureus subsp. aureus N315
aaaguagacauugaaa

SEQ ID NO: 2138205 - RNA, 19 nt, Staphylococcus aureus subsp. aureus N315
aaaguagaauuauuuagaa

SEQ ID NO: 2138206 - RNA, 16 nt, Staphylococcus aureus subsp. aureus N315
aaaguagaauuauuua

SEQ ID NO: 2138207 - RNA, 21 nt, Staphylococcus aureus subsp. aureus N315
ggcagacguaucaucaaaguu

SEQ ID NO: 2138208 - RNA, 22 nt, Staphylococcus aureus subsp. aureus N315
aaagucguuguugaaauuaaau

SEQ ID NO: 2138209 - RNA, 20 nt, Staphylococcus aureus subsp. aureus N315
aaagucguuguugaaauuaa

SEQ ID NO: 2138210 - RNA, 17 nt, Staphylococcus aureus subsp. aureus N315
aaagucguuguugaaau

SEQ ID NO: 2138211 - RNA, 15 nt, Staphylococcus aureus subsp. aureus N315
aaagugaaaguauua

SEQ ID NO: 2138212 - RNA, 13 nt, Staphylococcus aureus subsp. aureus N315
aaagugaauugua

SEQ ID NO: 2138213 - RNA, 19 nt, Staphylococcus aureus subsp. aureus N315
aaagugaaaacuucucuau

SEQ ID NO: 2138214 - RNA, 24 nt, Staphylococcus aureus subsp. aureus N315
aaagucuuucucggcgauaaaaug

SEQ ID NO: 2138215 - RNA, 14 nt, Staphylococcus aureus subsp. aureus N315
aaagugauucccaa

SEQ ID NO: 2138216 - RNA, 13 nt, Staphylococcus aureus subsp. aureus N315
ggccaugagcucu

SEQ ID NO: 2138217 - RNA, 13 nt, Staphylococcus aureus subsp. aureus N315
ggccccaacacag

SEQ ID NO: 2138218 - RNA, 23 nt, Staphylococcus aureus subsp. aureus N315
ggcaaaaaaggaugaugugaaug

SEQ ID NO: 2138219 - RNA, 22 nt, Staphylococcus aureus subsp. aureus N315
ggauuuuuuuauguuugggaua

SEQ ID NO: 2138220 - RNA, 19 nt, Staphylococcus aureus subsp. aureus N315
ggauuucuuauuuguaauu

SEQ ID NO: 2138221 - RNA, 15 nt, Staphylococcus aureus subsp. aureus N315
ggauuaucuguaauu

SEQ ID NO: 2138222 - RNA, 16 nt, Staphylococcus aureus subsp. aureus N315
ggauguuuucguuugc

SEQ ID NO: 2138223 - RNA, 19 nt, Staphylococcus aureus subsp. aureus N315
ggauuaaaagcaucuuuaa

SEQ ID NO: 2138224 - RNA, 12 nt, Staphylococcus aureus subsp. aureus N315
aaaguacucaag

SEQ ID NO: 2138225 - RNA, 15 nt, Staphylococcus aureus subsp. aureus N315
aaaguacuuacaaau

SEQ ID NO: 2138226 - RNA, 22 nt, Staphylococcus aureus subsp. aureus N315
aaaguaccuaaaauagaaaaau

SEQ ID NO: 2138227 - RNA, 16 nt, Staphylococcus aureus subsp. aureus N315
aaaguaccuaaaauag

SEQ ID NO: 2138228 - RNA, 17 nt, Staphylococcus aureus subsp. aureus N315
aaaguaccuaaaauaga

SEQ ID NO: 2138229 - RNA, 23 nt, Staphylococcus aureus subsp. aureus N315
aaaguacaaguugaucaaaaaug

SEQ ID NO: 2138230 - RNA, 19 nt, Staphylococcus aureus subsp. aureus N315
aaaguacaaguugaucaaa

SEQ ID NO: 2138231 - RNA, 17 nt, Staphylococcus aureus subsp. aureus N315
aaaguaauuaaauacuu

SEQ ID NO: 2138232 - RNA, 13 nt, Staphylococcus aureus subsp. aureus N315
aaaguaaugcugu

SEQ ID NO: 2138233 - RNA, 16 nt, Staphylococcus aureus subsp. aureus N315
ggauguaauagagaag

SEQ ID NO: 2138234 - RNA, 22 nt, Staphylococcus aureus subsp. aureus N315
ggaugggccccaacaaagagaa

SEQ ID NO: 2138235 - RNA, 15 nt, Staphylococcus aureus subsp. aureus N315
ggaucuuucaaagua

SEQ ID NO: 2138236 - RNA, 13 nt, Staphylococcus aureus subsp. aureus N315
ggauaaaaauuua

SEQ ID NO: 2138237 - RNA, 15 nt, Staphylococcus aureus subsp. aureus N315
ggagcauuucauuag

SEQ ID NO: 2138238 - RNA, 15 nt, Staphylococcus aureus subsp. aureus N315
ggagugggacagaaa

SEQ ID NO: 2138239 - RNA, 13 nt, Staphylococcus aureus subsp. aureus N315
ggauaagaacgag

SEQ ID NO: 2138240 - RNA, 21 nt, Staphylococcus aureus subsp. aureus N315
aaaggucaaaaaauuaaucaa

SEQ ID NO: 2138241 - RNA, 16 nt, Staphylococcus aureus subsp. aureus N315
aaagguaacuuuuuaa

SEQ ID NO: 2138242 - RNA, 22 nt, Staphylococcus aureus subsp. aureus N315
aaagguauaucuucauuuaaaa

SEQ ID NO: 2138243 - RNA, 18 nt, Staphylococcus aureus subsp. aureus N315
aaagguaacuuuuuaacu

SEQ ID NO: 2138244 - RNA, 23 nt, Staphylococcus aureus subsp. aureus N315
aaaggugugggcuuuauuaucau

SEQ ID NO: 2138245 - RNA, 17 nt, Staphylococcus aureus subsp. aureus N315
aaaggucccauuaaaau

SEQ ID NO: 2138246 - RNA, 13 nt, Staphylococcus aureus subsp. aureus N315
aaaguaacauacu

SEQ ID NO: 2138247 - RNA, 17 nt, Staphylococcus aureus subsp. aureus N315
ggaccuuguaaauuuaa

SEQ ID NO: 2138248 - RNA, 19 nt, Staphylococcus aureus subsp. aureus N315
aaaggcuagcuaaaauuug

SEQ ID NO: 2138249 - RNA, 15 nt, Staphylococcus aureus subsp. aureus N315
aaaggcucauuuguu

SEQ ID NO: 2138250 - RNA, 18 nt, Staphylococcus aureus subsp. aureus N315
aaaggcucauuuguuaaa

SEQ ID NO: 2138251 - RNA, 20 nt, Staphylococcus aureus subsp. aureus N315
ggaauuuuuaugcauuauag

SEQ ID NO: 2138252 - RNA, 18 nt, Staphylococcus aureus subsp. aureus N315
ggaaguuaggcaacuaaa

SEQ ID NO: 2138253 - RNA, 20 nt, Staphylococcus aureus subsp. aureus N315
ggaauacagaugaugcuucg

SEQ ID NO: 2138254 - RNA, 22 nt, Staphylococcus aureus subsp. aureus N315
ggaacuacuacauuauuacuga

SEQ ID NO: 2138255 - RNA, 18 nt, Staphylococcus aureus subsp. aureus N315
ggaacuacuacauuauua

SEQ ID NO: 2138256 - RNA, 16 nt, Staphylococcus aureus subsp. aureus N315
ggucuccaauacuuuu

SEQ ID NO: 2138257 - RNA, 20 nt, Staphylococcus aureus subsp. aureus N315
ggucgugagccccucccaag

SEQ ID NO: 2138258 - RNA, 18 nt, Staphylococcus aureus subsp. aureus N315
ggucacacccauacucug

SEQ ID NO: 2138259 - RNA, 18 nt, Staphylococcus aureus subsp. aureus N315
ggucauagaaauuuuaaa

SEQ ID NO: 2138260 - RNA, 18 nt, Staphylococcus aureus subsp. aureus N315
ggucaucaauuggcaacg

SEQ ID NO: 2138261 - RNA, 18 nt, Staphylococcus aureus subsp. aureus N315
gguaugauuuuugaacca

SEQ ID NO: 2138262 - RNA, 20 nt, Staphylococcus aureus subsp. aureus N315
gguaugcguggucuauuuua

SEQ ID NO: 2138263 - RNA, 19 nt, Staphylococcus aureus subsp. aureus N315
gguauucaaauaaacacau

SEQ ID NO: 2138264 - RNA, 15 nt, Staphylococcus aureus subsp. aureus N315
gguaugacugcaaau

SEQ ID NO: 2138265 - RNA, 21 nt, Staphylococcus aureus subsp. aureus N315
gguaugauauuucuaaauugu

SEQ ID NO: 2138266 - RNA, 22 nt, Staphylococcus aureus subsp. aureus N315
gguaccuuuuuauuaucuuuaa

SEQ ID NO: 2138267 - RNA, 21 nt, Staphylococcus aureus subsp. aureus N315
gguacauaaauagugaaauua

SEQ ID NO: 2138268 - RNA, 17 nt, Staphylococcus aureus subsp. aureus N315
gguacauaaauaccugg

SEQ ID NO: 2138269 - RNA, 19 nt, Staphylococcus aureus subsp. aureus N315
gguacacuucaacauauaa

SEQ ID NO: 2138270 - RNA, 22 nt, Staphylococcus aureus subsp. aureus N315
gguacaccuacaaauauuucua

SEQ ID NO: 2138271 - RNA, 13 nt, Staphylococcus aureus subsp. aureus N315
gguacuuuuuuga

SEQ ID NO: 2138272 - RNA, 19 nt, Staphylococcus aureus subsp. aureus N315
gggugagggccccaacaca

SEQ ID NO: 2138273 - RNA, 14 nt, Staphylococcus aureus subsp. aureus N315
gguaauuuaacauu

SEQ ID NO: 2138274 - RNA, 17 nt, Staphylococcus aureus subsp. aureus N315
gguaaugauuuugcuuu

SEQ ID NO: 2138275 - RNA, 21 nt, Staphylococcus aureus subsp. aureus N315
gguaauacuauaugaaaagag

SEQ ID NO: 2138276 - RNA, 12 nt, Staphylococcus aureus subsp. aureus N315
gguaauacuuuu

SEQ ID NO: 2138277 - RNA, 19 nt, Staphylococcus aureus subsp. aureus N315
gguaagaccccgaaaagag

SEQ ID NO: 2138278 - RNA, 17 nt, Staphylococcus aureus subsp. aureus N315
gguaaguauaauuaaac

SEQ ID NO: 2138279 - RNA, 18 nt, Staphylococcus aureus subsp. aureus N315
gguaagguguucuaaguu

SEQ ID NO: 2138280 - RNA, 11 nt, Staphylococcus aureus subsp. aureus N315
gguaaaaaguu

SEQ ID NO: 2138281 - RNA, 18 nt, Staphylococcus aureus subsp. aureus N315
gguaaaaaucucaaaauu

SEQ ID NO: 2138282 - RNA, 19 nt, Staphylococcus aureus subsp. aureus N315
gggcauugagauuggaagg

SEQ ID NO: 2138283 - RNA, 15 nt, Staphylococcus aureus subsp. aureus N315
gggccccaacacaga

SEQ ID NO: 2138284 - RNA, 13 nt, Staphylococcus aureus subsp. aureus N315
gggccccaacaca

SEQ ID NO: 2138285 - RNA, 16 nt, Staphylococcus aureus subsp. aureus N315
gggcccacaccccaac

SEQ ID NO: 2138286 - RNA, 15 nt, Staphylococcus aureus subsp. aureus N315
gggccagccaacuug

SEQ ID NO: 2138287 - RNA, 23 nt, Staphylococcus aureus subsp. aureus N315
ggggauuuuuuuauguuugggau

SEQ ID NO: 2138288 - RNA, 15 nt, Staphylococcus aureus subsp. aureus N315
ggggaugggccccaa

SEQ ID NO: 2138289 - RNA, 12 nt, Staphylococcus aureus subsp. aureus N315
gggcuucugcua

SEQ ID NO: 2138290 - RNA, 15 nt, Staphylococcus aureus subsp. aureus N315
ggggccccaacacag

SEQ ID NO: 2138291 - RNA, 18 nt, Staphylococcus aureus subsp. aureus N315
ggggccccaacacagaga

SEQ ID NO: 2138292 - RNA, 12 nt, Staphylococcus aureus subsp. aureus N315
ggguaauguuuu

SEQ ID NO: 2138293 - RNA, 16 nt, Staphylococcus aureus subsp. aureus N315
ggggugagggccccaa

SEQ ID NO: 2138294 - RNA, 21 nt, Staphylococcus aureus subsp. aureus N315
gggaauacagcuagcaagaau

SEQ ID NO: 2138295 - RNA, 14 nt, Staphylococcus aureus subsp. aureus N315
ggcuuuguuuuuca

SEQ ID NO: 2138296 - RNA, 19 nt, Staphylococcus aureus subsp. aureus N315
ggcuuuuuguuuugaaugu

SEQ ID NO: 2138297 - RNA, 22 nt, Staphylococcus aureus subsp. aureus N315
ggcuuuuuauaccaauaauuac

SEQ ID NO: 2138298 - RNA, 19 nt, Staphylococcus aureus subsp. aureus N315
ggcuuuuuuuauggugugg

SEQ ID NO: 2138299 - RNA, 21 nt, Staphylococcus aureus subsp. aureus N315
ggcuuuuuuauuuuauaagaa

SEQ ID NO: 2138300 - RNA, 18 nt, Staphylococcus aureus subsp. aureus N315
ggcuuuuuuauuuuauaa

SEQ ID NO: 2138301 - RNA, 14 nt, Staphylococcus aureus subsp. aureus N315
gggaagaccauuuu

SEQ ID NO: 2138302 - RNA, 13 nt, Staphylococcus aureus subsp. aureus N315
gggcagaucauaa

SEQ ID NO: 2138303 - RNA, 24 nt, Staphylococcus aureus subsp. aureus N315
gggaugggccccaacacagagaau

SEQ ID NO: 2138304 - RNA, 17 nt, Staphylococcus aureus subsp. aureus N315
gggauauagaaaaggga

SEQ ID NO: 2138305 - RNA, 19 nt, Staphylococcus aureus subsp. aureus N315
ggcuuaauuaauaaaaaaa

SEQ ID NO: 2138306 - RNA, 18 nt, Staphylococcus aureus subsp. aureus N315
ggcuucuuucuaaaauaa

SEQ ID NO: 2138307 - RNA, 20 nt, Staphylococcus aureus subsp. aureus N315
aaauaaccgcacuuucuauu

SEQ ID NO: 2138308 - RNA, 20 nt, Staphylococcus aureus subsp. aureus N315
aaauaacuucguuuuaauaa

SEQ ID NO: 2138309 - RNA, 21 nt, Staphylococcus aureus subsp. aureus N315
aaauaacguuaauauaauuaa

SEQ ID NO: 2138310 - RNA, 21 nt, Staphylococcus aureus subsp. aureus N315
aaauaacuagauguucacauu

SEQ ID NO: 2138311 - RNA, 13 nt, Staphylococcus aureus subsp. aureus N315
ggcgacauuugua

SEQ ID NO: 2138312 - RNA, 14 nt, Staphylococcus aureus subsp. aureus N315
ggccuuuuuuauug

SEQ ID NO: 2138313 - RNA, 22 nt, Staphylococcus aureus subsp. aureus N315
aaauaauaacccgaacacaaaa

SEQ ID NO: 2138314 - RNA, 23 nt, Staphylococcus aureus subsp. aureus N315
aaauaauaaguugaauauaaaaa

SEQ ID NO: 2138315 - RNA, 18 nt, Staphylococcus aureus subsp. aureus N315
aaauaagcaaucauaaua

SEQ ID NO: 2138316 - RNA, 19 nt, Staphylococcus aureus subsp. aureus N315
aaauaaucgaacagaaaau

SEQ ID NO: 2138317 - RNA, 13 nt, Staphylococcus aureus subsp. aureus N315
aaauaaucgaaga

SEQ ID NO: 2138318 - RNA, 20 nt, Staphylococcus aureus subsp. aureus N315
aaauaaugucuuacuuuuaa

SEQ ID NO: 2138319 - RNA, 16 nt, Staphylococcus aureus subsp. aureus N315
aaauacaaaaauauag

SEQ ID NO: 2138320 - RNA, 22 nt, Staphylococcus aureus subsp. aureus N315
aaauaauuuaaaggcauaauaa

SEQ ID NO: 2138321 - RNA, 13 nt, Staphylococcus aureus subsp. aureus N315
aaauaauuaugaa

SEQ ID NO: 2138322 - RNA, 19 nt, Staphylococcus aureus subsp. aureus N315
aaauaauuaugaaaaguaa

SEQ ID NO: 2138323 - RNA, 15 nt, Staphylococcus aureus subsp. aureus N315
aaauacaucggaauu

SEQ ID NO: 2138324 - RNA, 14 nt, Staphylococcus aureus subsp. aureus N315
aaauacauaauuaa

SEQ ID NO: 2138325 - RNA, 13 nt, Staphylococcus aureus subsp. aureus N315
aaauacauaauca

SEQ ID NO: 2138326 - RNA, 16 nt, Staphylococcus aureus subsp. aureus N315
aaauacaucaauuucu

SEQ ID NO: 2138327 - RNA, 16 nt, Staphylococcus aureus subsp. aureus N315
aaauacauaauaaaaa

SEQ ID NO: 2138328 - RNA, 22 nt, Staphylococcus aureus subsp. aureus N315
aaauacaugugggauaucuucu

SEQ ID NO: 2138329 - RNA, 23 nt, Staphylococcus aureus subsp. aureus N315
aaauaccagaugaaccaaaaaac

SEQ ID NO: 2138330 - RNA, 22 nt, Staphylococcus aureus subsp. aureus N315
aaauacuuuugcaucacagaua

SEQ ID NO: 2138331 - RNA, 14 nt, Staphylococcus aureus subsp. aureus N315
aaauacuuuugcau

SEQ ID NO: 2138332 - RNA, 17 nt, Staphylococcus aureus subsp. aureus N315
aaauacuugaauuuaau

SEQ ID NO: 2138333 - RNA, 19 nt, Staphylococcus aureus subsp. aureus N315
aaauacgacaccaacauau

SEQ ID NO: 2138334 - RNA, 23 nt, Staphylococcus aureus subsp. aureus N315
gccuugaccuacuuuuucaauau

SEQ ID NO: 2138335 - RNA, 15 nt, Staphylococcus aureus subsp. aureus N315
gccuucuauauagua

SEQ ID NO: 2138336 - RNA, 17 nt, Staphylococcus aureus subsp. aureus N315
gccuuucucuaaauaau

SEQ ID NO: 2138337 - RNA, 14 nt, Staphylococcus aureus subsp. aureus N315
gcgaacguuauuuu

SEQ ID NO: 2138338 - RNA, 15 nt, Staphylococcus aureus subsp. aureus N315
gcgaaaguaucuaug

SEQ ID NO: 2138339 - RNA, 15 nt, Staphylococcus aureus subsp. aureus N315
gccuuuugaauaauu

SEQ ID NO: 2138340 - RNA, 18 nt, Staphylococcus aureus subsp. aureus N315
gccuuaacuucauaauau

SEQ ID NO: 2138341 - RNA, 21 nt, Staphylococcus aureus subsp. aureus N315
gccugcccuuuagucauguuu

SEQ ID NO: 2138342 - RNA, 16 nt, Staphylococcus aureus subsp. aureus N315
gccuauccauucaaau

SEQ ID NO: 2138343 - RNA, 23 nt, Staphylococcus aureus subsp. aureus N315
gccucuaaugauuaaaaaucaaa

SEQ ID NO: 2138344 - RNA, 18 nt, Staphylococcus aureus subsp. aureus N315
gccucuaaugauuaaaaa

SEQ ID NO: 2138345 - RNA, 23 nt, Staphylococcus aureus subsp. aureus N315
gccuaauacacuugauaaaacua

SEQ ID NO: 2138346 - RNA, 18 nt, Staphylococcus aureus subsp. aureus N315
gccguauuucaaauguaa

SEQ ID NO: 2138347 - RNA, 15 nt, Staphylococcus aureus subsp. aureus N315
gcgcagcaaaugcuu

SEQ ID NO: 2138348 - RNA, 15 nt, Staphylococcus aureus subsp. aureus N315
gcgauaaaaguugua

SEQ ID NO: 2138349 - RNA, 23 nt, Staphylococcus aureus subsp. aureus N315
gcgacguuuaaaugcccaccaug

SEQ ID NO: 2138350 - RNA, 13 nt, Staphylococcus aureus subsp. aureus N315
gcgcaaaagcgca

SEQ ID NO: 2138351 - RNA, 19 nt, Staphylococcus aureus subsp. aureus N315
gcgcaaaagcgcaggcgaa

SEQ ID NO: 2138352 - RNA, 17 nt, Staphylococcus aureus subsp. aureus N315
gcgcaagagauaagaaa

SEQ ID NO: 2138353 - RNA, 15 nt, Staphylococcus aureus subsp. aureus N315
gcgccauaaucauua

SEQ ID NO: 2138354 - RNA, 14 nt, Staphylococcus aureus subsp. aureus N315
gcgccauaaucauu

SEQ ID NO: 2138355 - RNA, 14 nt, Staphylococcus aureus subsp. aureus N315
gcgcgacguuuaaa

SEQ ID NO: 2138356 - RNA, 12 nt, Staphylococcus aureus subsp. aureus N315
gcaguaaaacca

SEQ ID NO: 2138357 - RNA, 23 nt, Staphylococcus aureus subsp. aureus N315
gcaguaagauaauuuucaauuag

SEQ ID NO: 2138358 - RNA, 12 nt, Staphylococcus aureus subsp. aureus N315
gcaguauauauc

SEQ ID NO: 2138359 - RNA, 17 nt, Staphylococcus aureus subsp. aureus N315
gcagucaaacauagaua

SEQ ID NO: 2138360 - RNA, 14 nt, Staphylococcus aureus subsp. aureus N315
gcaguugaaaaaga

SEQ ID NO: 2138361 - RNA, 17 nt, Staphylococcus aureus subsp. aureus N315
gcaguuucugagaagaa

SEQ ID NO: 2138362 - RNA, 14 nt, Staphylococcus aureus subsp. aureus N315
gcauaaaaaaagaa

SEQ ID NO: 2138363 - RNA, 23 nt, Staphylococcus aureus subsp. aureus N315
gcauaaaaaaagaacuacgcauu

SEQ ID NO: 2138364 - RNA, 22 nt, Staphylococcus aureus subsp. aureus N315
gcauaacgagcaguauauauca

SEQ ID NO: 2138365 - RNA, 15 nt, Staphylococcus aureus subsp. aureus N315
gcagcuaaaaaguau

SEQ ID NO: 2138366 - RNA, 16 nt, Staphylococcus aureus subsp. aureus N315
gcagcuugaucuaaau

SEQ ID NO: 2138367 - RNA, 14 nt, Staphylococcus aureus subsp. aureus N315
gcaggcgaaccgaa

SEQ ID NO: 2138368 - RNA, 15 nt, Staphylococcus aureus subsp. aureus N315
gcaucuaugauugua

SEQ ID NO: 2138369 - RNA, 16 nt, Staphylococcus aureus subsp. aureus N315
gcaucaacagauacuu

SEQ ID NO: 2138370 - RNA, 19 nt, Staphylococcus aureus subsp. aureus N315
gcaucaaaaauaaaaaugc

SEQ ID NO: 2138371 - RNA, 19 nt, Staphylococcus aureus subsp. aureus N315
gcauauguaauacaaaaga

SEQ ID NO: 2138372 - RNA, 16 nt, Staphylococcus aureus subsp. aureus N315
gcauaucuuuaucauu

SEQ ID NO: 2138373 - RNA, 18 nt, Staphylococcus aureus subsp. aureus N315
gcauaucuuuaucauuau

SEQ ID NO: 2138374 - RNA, 16 nt, Staphylococcus aureus subsp. aureus N315
gcaugcuucucaauuu

SEQ ID NO: 2138375 - RNA, 17 nt, Staphylococcus aureus subsp. aureus N315
gcauguccugaauguuc

SEQ ID NO: 2138376 - RNA, 17 nt, Staphylococcus aureus subsp. aureus N315
gcauuaauguucaauuu

SEQ ID NO: 2138377 - RNA, 13 nt, Staphylococcus aureus subsp. aureus N315
gcauuaaugauuc

SEQ ID NO: 2138378 - RNA, 15 nt, Staphylococcus aureus subsp. aureus N315
gcaugccagaugcaa

SEQ ID NO: 2138379 - RNA, 15 nt, Staphylococcus aureus subsp. aureus N315
gcauucaguuaaugu

SEQ ID NO: 2138380 - RNA, 18 nt, Staphylococcus aureus subsp. aureus N315
gcauuacuacuuuauaaa

SEQ ID NO: 2138381 - RNA, 15 nt, Staphylococcus aureus subsp. aureus N315
gcauuacuacaaacu

SEQ ID NO: 2138382 - RNA, 17 nt, Staphylococcus aureus subsp. aureus N315
gcauuacgccaccaguu

SEQ ID NO: 2138383 - RNA, 15 nt, Staphylococcus aureus subsp. aureus N315
gcauugagauggucu

SEQ ID NO: 2138384 - RNA, 17 nt, Staphylococcus aureus subsp. aureus N315
gcauuuguaaacaguau

SEQ ID NO: 2138385 - RNA, 18 nt, Staphylococcus aureus subsp. aureus N315
gccaaaggcaaaauguau

SEQ ID NO: 2138386 - RNA, 19 nt, Staphylococcus aureus subsp. aureus N315
gccaaauaucaguaauaau

SEQ ID NO: 2138387 - RNA, 14 nt, Staphylococcus aureus subsp. aureus N315
gccaccaguuucaa

SEQ ID NO: 2138388 - RNA, 12 nt, Staphylococcus aureus subsp. aureus N315
gccauauuuauu

SEQ ID NO: 2138389 - RNA, 17 nt, Staphylococcus aureus subsp. aureus N315
gccauuggauucuuuug

SEQ ID NO: 2138390 - RNA, 12 nt, Staphylococcus aureus subsp. aureus N315
gcccacacccca

SEQ ID NO: 2138391 - RNA, 13 nt, Staphylococcus aureus subsp. aureus N315
gcccacaccccaa

SEQ ID NO: 2138392 - RNA, 13 nt, Staphylococcus aureus subsp. aureus N315
gcccauaccacca

SEQ ID NO: 2138393 - RNA, 15 nt, Staphylococcus aureus subsp. aureus N315
gcccgagacuauauu

SEQ ID NO: 2138394 - RNA, 21 nt, Staphylococcus aureus subsp. aureus N315
gcccgagacuauauucaauuu

SEQ ID NO: 2138395 - RNA, 22 nt, Staphylococcus aureus subsp. aureus N315
gcccauucugcagcgacaucuu

SEQ ID NO: 2138396 - RNA, 13 nt, Staphylococcus aureus subsp. aureus N315
gcaacaauuugca

SEQ ID NO: 2138397 - RNA, 13 nt, Staphylococcus aureus subsp. aureus N315
gcaacaacuuuuc

SEQ ID NO: 2138398 - RNA, 15 nt, Staphylococcus aureus subsp. aureus N315
gcaacaacuuuucau

SEQ ID NO: 2138399 - RNA, 12 nt, Staphylococcus aureus subsp. aureus N315
gcaacauauuuu

SEQ ID NO: 2138400 - RNA, 15 nt, Staphylococcus aureus subsp. aureus N315
gcaaauuauauagaa

SEQ ID NO: 2138401 - RNA, 18 nt, Staphylococcus aureus subsp. aureus N315
gcaaauuauauagaaaac

SEQ ID NO: 2138402 - RNA, 19 nt, Staphylococcus aureus subsp. aureus N315
gcaaauuauauagaaaacu

SEQ ID NO: 2138403 - RNA, 20 nt, Staphylococcus aureus subsp. aureus N315
gcaaauucaacuuuaaucaa

SEQ ID NO: 2138404 - RNA, 13 nt, Staphylococcus aureus subsp. aureus N315
gcaaauuggaaaa

SEQ ID NO: 2138405 - RNA, 18 nt, Staphylococcus aureus subsp. aureus N315
gcaaauuaguaugacuua

SEQ ID NO: 2138406 - RNA, 17 nt, Staphylococcus aureus subsp. aureus N315
gcaaaucucgucacaua

SEQ ID NO: 2138407 - RNA, 14 nt, Staphylococcus aureus subsp. aureus N315
gcaaaguaacaaua

SEQ ID NO: 2138408 - RNA, 17 nt, Staphylococcus aureus subsp. aureus N315
gcaaauaaaaucauaac

SEQ ID NO: 2138409 - RNA, 12 nt, Staphylococcus aureus subsp. aureus N315
gcaaauaaaaaa

SEQ ID NO: 2138410 - RNA, 13 nt, Staphylococcus aureus subsp. aureus N315
gcaaauauuaaau

SEQ ID NO: 2138411 - RNA, 14 nt, Staphylococcus aureus subsp. aureus N315
gcaaauauuaaauu

SEQ ID NO: 2138412 - RNA, 16 nt, Staphylococcus aureus subsp. aureus N315
gcaaauauuauuaaau

SEQ ID NO: 2138413 - RNA, 15 nt, Staphylococcus aureus subsp. aureus N315
gcaaauauuauuaaa

SEQ ID NO: 2138414 - RNA, 15 nt, Staphylococcus aureus subsp. aureus N315
gcaaagaauccuuaa

SEQ ID NO: 2138415 - RNA, 17 nt, Staphylococcus aureus subsp. aureus N315
gcaaacucauuuauaaa

SEQ ID NO: 2138416 - RNA, 21 nt, Staphylococcus aureus subsp. aureus N315
gcaaacucauuuauaaacauu

SEQ ID NO: 2138417 - RNA, 18 nt, Staphylococcus aureus subsp. aureus N315
gcaaacacaguacaaaua

SEQ ID NO: 2138418 - RNA, 22 nt, Staphylococcus aureus subsp. aureus N315
gcaaaacgcauuucauguguca

SEQ ID NO: 2138419 - RNA, 12 nt, Staphylococcus aureus subsp. aureus N315
gcaaaacaauau

SEQ ID NO: 2138420 - RNA, 21 nt, Staphylococcus aureus subsp. aureus N315
gcaaaauuauguaaaaaauau

SEQ ID NO: 2138421 - RNA, 11 nt, Staphylococcus aureus subsp. aureus N315
gcaaaaucaac

SEQ ID NO: 2138422 - RNA, 14 nt, Staphylococcus aureus subsp. aureus N315
gcaaaagcgcaggc

SEQ ID NO: 2138423 - RNA, 13 nt, Staphylococcus aureus subsp. aureus N315
gcaaaaaaacaaa

SEQ ID NO: 2138424 - RNA, 15 nt, Staphylococcus aureus subsp. aureus N315
gcaaaaaaacaaaua

SEQ ID NO: 2138425 - RNA, 13 nt, Staphylococcus aureus subsp. aureus N315
gauuuuucuuaua

SEQ ID NO: 2138426 - RNA, 13 nt, Staphylococcus aureus subsp. aureus N315
gauuuuuaaaaug

SEQ ID NO: 2138427 - RNA, 12 nt, Staphylococcus aureus subsp. aureus N315
gauuuuguuuca

SEQ ID NO: 2138428 - RNA, 11 nt, Staphylococcus aureus subsp. aureus N315
gauuuuauaau

SEQ ID NO: 2138429 - RNA, 15 nt, Staphylococcus aureus subsp. aureus N315
gauuuugaauaaaaa

SEQ ID NO: 2138430 - RNA, 12 nt, Staphylococcus aureus subsp. aureus N315
gauuuucuucau

SEQ ID NO: 2138431 - RNA, 17 nt, Staphylococcus aureus subsp. aureus N315
gauuuuaaagaaaaguu

SEQ ID NO: 2138432 - RNA, 13 nt, Staphylococcus aureus subsp. aureus N315
gauuuuagauuua

SEQ ID NO: 2138433 - RNA, 12 nt, Staphylococcus aureus subsp. aureus N315
gauuuuaauuau

SEQ ID NO: 2138434 - RNA, 20 nt, Staphylococcus aureus subsp. aureus N315
gauuuuaauauugacauuua

SEQ ID NO: 2138435 - RNA, 14 nt, Staphylococcus aureus subsp. aureus N315
gauuuuaaucuauc

SEQ ID NO: 2138436 - RNA, 19 nt, Staphylococcus aureus subsp. aureus N315
gauuuuaagugguuaucac

SEQ ID NO: 2138437 - RNA, 15 nt, Staphylococcus aureus subsp. aureus N315
gauuuuaacaagaua

SEQ ID NO: 2138438 - RNA, 12 nt, Staphylococcus aureus subsp. aureus N315
gauuucuuauuu

SEQ ID NO: 2138439 - RNA, 14 nt, Staphylococcus aureus subsp. aureus N315
gauuucuucugcua

SEQ ID NO: 2138440 - RNA, 14 nt, Staphylococcus aureus subsp. aureus N315
gauuugaaauuuau

SEQ ID NO: 2138441 - RNA, 14 nt, Staphylococcus aureus subsp. aureus N315
gauuugcaccuaua

SEQ ID NO: 2138442 - RNA, 14 nt, Staphylococcus aureus subsp. aureus N315
gauuucaaugagaa

SEQ ID NO: 2138443 - RNA, 18 nt, Staphylococcus aureus subsp. aureus N315
gauuuauuuuuuucuuca

SEQ ID NO: 2138444 - RNA, 16 nt, Staphylococcus aureus subsp. aureus N315
gauuuauuaacucaug

SEQ ID NO: 2138445 - RNA, 13 nt, Staphylococcus aureus subsp. aureus N315
gauuuauucuaaa

SEQ ID NO: 2138446 - RNA, 19 nt, Staphylococcus aureus subsp. aureus N315
gauuuauuucauauucaau

SEQ ID NO: 2138447 - RNA, 21 nt, Staphylococcus aureus subsp. aureus N315
gauuuaguuuuuuuaaaguuu

SEQ ID NO: 2138448 - RNA, 14 nt, Staphylococcus aureus subsp. aureus N315
gauuuacaccuaua

SEQ ID NO: 2138449 - RNA, 15 nt, Staphylococcus aureus subsp. aureus N315
gauuuaauuaaaaca

SEQ ID NO: 2138450 - RNA, 13 nt, Staphylococcus aureus subsp. aureus N315
gauuuaaaccauc

SEQ ID NO: 2138451 - RNA, 22 nt, Staphylococcus aureus subsp. aureus N315
gauuuaaaaaauuuaauguuuu

SEQ ID NO: 2138452 - RNA, 16 nt, Staphylococcus aureus subsp. aureus N315
gauuuaaguuuauaau

SEQ ID NO: 2138453 - RNA, 15 nt, Staphylococcus aureus subsp. aureus N315
gauuguuaauacaac

SEQ ID NO: 2138454 - RNA, 16 nt, Staphylococcus aureus subsp. aureus N315
gauuguuucaccagcu

SEQ ID NO: 2138455 - RNA, 13 nt, Staphylococcus aureus subsp. aureus N315
gauuguaccagua

SEQ ID NO: 2138456 - RNA, 14 nt, Staphylococcus aureus subsp. aureus N315
gauuguaaauaaaa

SEQ ID NO: 2138457 - RNA, 12 nt, Staphylococcus aureus subsp. aureus N315
gauuguaaauaa

SEQ ID NO: 2138458 - RNA, 15 nt, Staphylococcus aureus subsp. aureus N315
gauugucuuauaaga

SEQ ID NO: 2138459 - RNA, 16 nt, Staphylococcus aureus subsp. aureus N315
gauucaacuuguuucc

SEQ ID NO: 2138460 - RNA, 14 nt, Staphylococcus aureus subsp. aureus N315
gauucaaaugacau

SEQ ID NO: 2138461 - RNA, 12 nt, Staphylococcus aureus subsp. aureus N315
gauucaaccuua

SEQ ID NO: 2138462 - RNA, 22 nt, Staphylococcus aureus subsp. aureus N315
gauucuaacggcguuuguuucu

SEQ ID NO: 2138463 - RNA, 17 nt, Staphylococcus aureus subsp. aureus N315
gauucuacagcacugaa

SEQ ID NO: 2138464 - RNA, 13 nt, Staphylococcus aureus subsp. aureus N315
gauucuacagcau

SEQ ID NO: 2138465 - RNA, 16 nt, Staphylococcus aureus subsp. aureus N315
gauucuacagcacuga

SEQ ID NO: 2138466 - RNA, 14 nt, Staphylococcus aureus subsp. aureus N315
gauucggaaaauau

SEQ ID NO: 2138467 - RNA, 18 nt, Staphylococcus aureus subsp. aureus N315
gauuccuguaacaagaac

SEQ ID NO: 2138468 - RNA, 20 nt, Staphylococcus aureus subsp. aureus N315
gauucgauuauuuagauaaa

SEQ ID NO: 2138469 - RNA, 21 nt, Staphylococcus aureus subsp. aureus N315
gauugcacguuugaaugaacc

SEQ ID NO: 2138470 - RNA, 21 nt, Staphylococcus aureus subsp. aureus N315
gauugaucagcucuuaaauca

SEQ ID NO: 2138471 - RNA, 22 nt, Staphylococcus aureus subsp. aureus N315
gauugauauaaauuaucagaau

SEQ ID NO: 2138472 - RNA, 20 nt, Staphylococcus aureus subsp. aureus N315
gauugcaaaaaaacaaauau

SEQ ID NO: 2138473 - RNA, 21 nt, Staphylococcus aureus subsp. aureus N315
gauugcaaauuaucauuaaau

SEQ ID NO: 2138474 - RNA, 14 nt, Staphylococcus aureus subsp. aureus N315
gauugguaaaucua

SEQ ID NO: 2138475 - RNA, 19 nt, Staphylococcus aureus subsp. aureus N315
gauuggcugugcuauaauc

SEQ ID NO: 2138476 - RNA, 22 nt, Staphylococcus aureus subsp. aureus N315
gauuggaaaguuucuccaccug

SEQ ID NO: 2138477 - RNA, 18 nt, Staphylococcus aureus subsp. aureus N315
gauucuuaucuuuaauca

SEQ ID NO: 2138478 - RNA, 16 nt, Staphylococcus aureus subsp. aureus N315
gauucuuaucuuuaau

SEQ ID NO: 2138479 - RNA, 17 nt, Staphylococcus aureus subsp. aureus N315
gauucuuauauguuuua

SEQ ID NO: 2138480 - RNA, 13 nt, Staphylococcus aureus subsp. aureus N315
gauucuauuucuu

SEQ ID NO: 2138481 - RNA, 19 nt, Staphylococcus aureus subsp. aureus N315
gauucuccaguggaaauga

SEQ ID NO: 2138482 - RNA, 12 nt, Staphylococcus aureus subsp. aureus N315
gauugaaaaaau

SEQ ID NO: 2138483 - RNA, 14 nt, Staphylococcus aureus subsp. aureus N315
gauugaaaaaauaa

SEQ ID NO: 2138484 - RNA, 22 nt, Staphylococcus aureus subsp. aureus N315
gauucuuuauaagcuuuuucuu

SEQ ID NO: 2138485 - RNA, 19 nt, Staphylococcus aureus subsp. aureus N315
gauucuucacuaaaaauau

SEQ ID NO: 2138486 - RNA, 16 nt, Staphylococcus aureus subsp. aureus N315
gauugaguugaaaaua

SEQ ID NO: 2138487 - RNA, 17 nt, Staphylococcus aureus subsp. aureus N315
gauuaaaauaugacaca

SEQ ID NO: 2138488 - RNA, 13 nt, Staphylococcus aureus subsp. aureus N315
gauuaaaaguguu

SEQ ID NO: 2138489 - RNA, 20 nt, Staphylococcus aureus subsp. aureus N315
gauuaaauucuuuucaagaa

SEQ ID NO: 2138490 - RNA, 17 nt, Staphylococcus aureus subsp. aureus N315
gauuaaauaaucaacaa

SEQ ID NO: 2138491 - RNA, 15 nt, Staphylococcus aureus subsp. aureus N315
gauuaacuuucuaau

SEQ ID NO: 2138492 - RNA, 12 nt, Staphylococcus aureus subsp. aureus N315
gauuaacauuau

SEQ ID NO: 2138493 - RNA, 15 nt, Staphylococcus aureus subsp. aureus N315
gauguucaucaacau

SEQ ID NO: 2138494 - RNA, 12 nt, Staphylococcus aureus subsp. aureus N315
gauuaaaagugu

SEQ ID NO: 2138495 - RNA, 17 nt, Staphylococcus aureus subsp. aureus N315
gauguuucaaaauaauu

SEQ ID NO: 2138496 - RNA, 14 nt, Staphylococcus aureus subsp. aureus N315
gauguuauaaaaug

SEQ ID NO: 2138497 - RNA, 22 nt, Staphylococcus aureus subsp. aureus N315
gauguguuuuaauaauaucuuu

SEQ ID NO: 2138498 - RNA, 14 nt, Staphylococcus aureus subsp. aureus N315
gaugugacaaauac

SEQ ID NO: 2138499 - RNA, 14 nt, Staphylococcus aureus subsp. aureus N315
gaugugaauguuuu

SEQ ID NO: 2138500 - RNA, 16 nt, Staphylococcus aureus subsp. aureus N315
gaugucuguacuuuua

SEQ ID NO: 2138501 - RNA, 20 nt, Staphylococcus aureus subsp. aureus N315
gaugucgaaaaguauaugaa

SEQ ID NO: 2138502 - RNA, 13 nt, Staphylococcus aureus subsp. aureus N315
gaugucgaaaaua

SEQ ID NO: 2138503 - RNA, 20 nt, Staphylococcus aureus subsp. aureus N315
gauuauuuaaaacuuguaaa

SEQ ID NO: 2138504 - RNA, 12 nt, Staphylococcus aureus subsp. aureus N315
gauuauucuuca

SEQ ID NO: 2138505 - RNA, 13 nt, Staphylococcus aureus subsp. aureus N315
gauuauucuucau

SEQ ID NO: 2138506 - RNA, 15 nt, Staphylococcus aureus subsp. aureus N315
gauuauuaccauaua

SEQ ID NO: 2138507 - RNA, 22 nt, Staphylococcus aureus subsp. aureus N315
gauuauguuaaugucuuaaaau

SEQ ID NO: 2138508 - RNA, 16 nt, Staphylococcus aureus subsp. aureus N315
gauuauuaacuuuaau

SEQ ID NO: 2138509 - RNA, 20 nt, Staphylococcus aureus subsp. aureus N315
gauuaugacaacauaacaaa

SEQ ID NO: 2138510 - RNA, 16 nt, Staphylococcus aureus subsp. aureus N315
gauuauagguauaaga

SEQ ID NO: 2138511 - RNA, 16 nt, Staphylococcus aureus subsp. aureus N315
gauuauaaugauuguc

SEQ ID NO: 2138512 - RNA, 22 nt, Staphylococcus aureus subsp. aureus N315
gauuaguaauuuuuaaaucuac

SEQ ID NO: 2138513 - RNA, 18 nt, Staphylococcus aureus subsp. aureus N315
gauuacagaugaugcuuc

SEQ ID NO: 2138514 - RNA, 22 nt, Staphylococcus aureus subsp. aureus N315
gauuaauuuaauugaaguaugc

SEQ ID NO: 2138515 - RNA, 16 nt, Staphylococcus aureus subsp. aureus N315
gauuaauuuucuuuuu

SEQ ID NO: 2138516 - RNA, 20 nt, Staphylococcus aureus subsp. aureus N315
gauuaauuauaaguagugau

SEQ ID NO: 2138517 - RNA, 19 nt, Staphylococcus aureus subsp. aureus N315
gauuaauccaguaaucaaa

SEQ ID NO: 2138518 - RNA, 14 nt, Staphylococcus aureus subsp. aureus N315
gauuagaugauauu

SEQ ID NO: 2138519 - RNA, 15 nt, Staphylococcus aureus subsp. aureus N315
gauuaccguuaaaaa

SEQ ID NO: 2138520 - RNA, 13 nt, Staphylococcus aureus subsp. aureus N315
gaugguugcuuca

SEQ ID NO: 2138521 - RNA, 13 nt, Staphylococcus aureus subsp. aureus N315
gauguaauucugu

SEQ ID NO: 2138522 - RNA, 16 nt, Staphylococcus aureus subsp. aureus N315
gaugguuaaugacuau

SEQ ID NO: 2138523 - RNA, 14 nt, Staphylococcus aureus subsp. aureus N315
gaugguuaucacuu

SEQ ID NO: 2138524 - RNA, 16 nt, Staphylococcus aureus subsp. aureus N315
gaugucacauaugacu

SEQ ID NO: 2138525 - RNA, 17 nt, Staphylococcus aureus subsp. aureus N315
gauguaccacucauaau

SEQ ID NO: 2138526 - RNA, 17 nt, Staphylococcus aureus subsp. aureus N315
gauguacuauaaauccu

SEQ ID NO: 2138527 - RNA, 13 nt, Staphylococcus aureus subsp. aureus N315
gaugucauguauu

SEQ ID NO: 2138528 - RNA, 16 nt, Staphylococcus aureus subsp. aureus N315
gaugucagacgaauca

SEQ ID NO: 2138529 - RNA, 16 nt, Staphylococcus aureus subsp. aureus N315
gaugguacuaaaguug

SEQ ID NO: 2138530 - RNA, 19 nt, Staphylococcus aureus subsp. aureus N315
gaugggccccaacaaagag

SEQ ID NO: 2138531 - RNA, 19 nt, Staphylococcus aureus subsp. aureus N315
gaugggaaaucaguaauau

SEQ ID NO: 2138532 - RNA, 16 nt, Staphylococcus aureus subsp. aureus N315
gaugcuugaauguuug

SEQ ID NO: 2138533 - RNA, 18 nt, Staphylococcus aureus subsp. aureus N315
gaugcuuuaauuaaaguu

SEQ ID NO: 2138534 - RNA, 13 nt, Staphylococcus aureus subsp. aureus N315
gaugcuuccuuuu

SEQ ID NO: 2138535 - RNA, 22 nt, Staphylococcus aureus subsp. aureus N315
gaugcuucgaauuuaacaucuu

SEQ ID NO: 2138536 - RNA, 19 nt, Staphylococcus aureus subsp. aureus N315
gaugcuucgcacaacugca

SEQ ID NO: 2138537 - RNA, 13 nt, Staphylococcus aureus subsp. aureus N315
gaugauucuuauc

SEQ ID NO: 2138538 - RNA, 14 nt, Staphylococcus aureus subsp. aureus N315
gaugauucuuauca

SEQ ID NO: 2138539 - RNA, 14 nt, Staphylococcus aureus subsp. aureus N315
aaagcgaauuaucu

SEQ ID NO: 2138540 - RNA, 16 nt, Staphylococcus aureus subsp. aureus N315
gaugcucguauagaaa

SEQ ID NO: 2138541 - RNA, 23 nt, Staphylococcus aureus subsp. aureus N315
gaugaacaaaauaacauguuugu

SEQ ID NO: 2138542 - RNA, 19 nt, Staphylococcus aureus subsp. aureus N315
gaugaacaaaauaacaugu

SEQ ID NO: 2138543 - RNA, 21 nt, Staphylococcus aureus subsp. aureus N315
gaugaaagacugacuaauaaa

SEQ ID NO: 2138544 - RNA, 14 nt, Staphylococcus aureus subsp. aureus N315
gaugaaccaaaaaa

SEQ ID NO: 2138545 - RNA, 19 nt, Staphylococcus aureus subsp. aureus N315
gaugaacauaccugcauau

SEQ ID NO: 2138546 - RNA, 14 nt, Staphylococcus aureus subsp. aureus N315
gaugaauaaauaga

SEQ ID NO: 2138547 - RNA, 21 nt, Staphylococcus aureus subsp. aureus N315
gaugaauuuuuauuuuuagua

SEQ ID NO: 2138548 - RNA, 16 nt, Staphylococcus aureus subsp. aureus N315
gaugaaugauugcauu

SEQ ID NO: 2138549 - RNA, 14 nt, Staphylococcus aureus subsp. aureus N315
gaugaauuaaacug

SEQ ID NO: 2138550 - RNA, 18 nt, Staphylococcus aureus subsp. aureus N315
gaucuucccaucuuuuag

SEQ ID NO: 2138551 - RNA, 14 nt, Staphylococcus aureus subsp. aureus N315
gaucuucuuguuuu

SEQ ID NO: 2138552 - RNA, 19 nt, Staphylococcus aureus subsp. aureus N315
gaugaaaaucuuuaacucu

SEQ ID NO: 2138553 - RNA, 14 nt, Staphylococcus aureus subsp. aureus N315
gaugaaaauauagu

SEQ ID NO: 2138554 - RNA, 16 nt, Staphylococcus aureus subsp. aureus N315
gaucuuuuccauucau

SEQ ID NO: 2138555 - RNA, 18 nt, Staphylococcus aureus subsp. aureus N315
gaugacuguagaaaacau

SEQ ID NO: 2138556 - RNA, 23 nt, Staphylococcus aureus subsp. aureus N315
gaugacuuugucuuuaaugaaag

SEQ ID NO: 2138557 - RNA, 16 nt, Staphylococcus aureus subsp. aureus N315
gaugagauaaaaucau

SEQ ID NO: 2138558 - RNA, 21 nt, Staphylococcus aureus subsp. aureus N315
gaugacugaaccaauccaaua

SEQ ID NO: 2138559 - RNA, 12 nt, Staphylococcus aureus subsp. aureus N315
gaugauauucaa

SEQ ID NO: 2138560 - RNA, 19 nt, Staphylococcus aureus subsp. aureus N315
gaugauaaaaauaaaaccg

SEQ ID NO: 2138561 - RNA, 12 nt, Staphylococcus aureus subsp. aureus N315
gaugaugcuucg

SEQ ID NO: 2138562 - RNA, 18 nt, Staphylococcus aureus subsp. aureus N315
gagauucucgguuuuuuc

SEQ ID NO: 2138563 - RNA, 15 nt, Staphylococcus aureus subsp. aureus N315
gagauuguaagaauu

SEQ ID NO: 2138564 - RNA, 20 nt, Staphylococcus aureus subsp. aureus N315
gagauuaucuuuagacauaa

SEQ ID NO: 2138565 - RNA, 14 nt, Staphylococcus aureus subsp. aureus N315
gacucacuucuuaa

SEQ ID NO: 2138566 - RNA, 16 nt, Staphylococcus aureus subsp. aureus N315
gagcaacgauaccaaa

SEQ ID NO: 2138567 - RNA, 20 nt, Staphylococcus aureus subsp. aureus N315
gagcgaccgugguucaaaaa

SEQ ID NO: 2138568 - RNA, 14 nt, Staphylococcus aureus subsp. aureus N315
gagcggaagauagg

SEQ ID NO: 2138569 - RNA, 15 nt, Staphylococcus aureus subsp. aureus N315
gagcggaagauagga

SEQ ID NO: 2138570 - RNA, 20 nt, Staphylococcus aureus subsp. aureus N315
gagcuaauaugucuagacuu

SEQ ID NO: 2138571 - RNA, 16 nt, Staphylococcus aureus subsp. aureus N315
gagcucauguuucagu

SEQ ID NO: 2138572 - RNA, 23 nt, Staphylococcus aureus subsp. aureus N315
gagcuauucauagaccuaugaau

SEQ ID NO: 2138573 - RNA, 16 nt, Staphylococcus aureus subsp. aureus N315
gaguauuuuugcguua

SEQ ID NO: 2138574 - RNA, 13 nt, Staphylococcus aureus subsp. aureus N315
gaguauuaaauuu

SEQ ID NO: 2138575 - RNA, 19 nt, Staphylococcus aureus subsp. aureus N315
gaguauuacuugaaaauag

SEQ ID NO: 2138576 - RNA, 19 nt, Staphylococcus aureus subsp. aureus N315
gaguacuaaucaauacuaa

SEQ ID NO: 2138577 - RNA, 20 nt, Staphylococcus aureus subsp. aureus N315
gagugauuuuaaucuauccu

SEQ ID NO: 2138578 - RNA, 12 nt, Staphylococcus aureus subsp. aureus N315
gagugauagaaa

SEQ ID NO: 2138579 - RNA, 20 nt, Staphylococcus aureus subsp. aureus N315
gaguuguacuacuugauucu

SEQ ID NO: 2138580 - RNA, 17 nt, Staphylococcus aureus subsp. aureus N315
gaggcgccacaacaugu

SEQ ID NO: 2138581 - RNA, 14 nt, Staphylococcus aureus subsp. aureus N315
gaggcgauaaaaga

SEQ ID NO: 2138582 - RNA, 19 nt, Staphylococcus aureus subsp. aureus N315
gaggauacauaaaucuaau

SEQ ID NO: 2138583 - RNA, 13 nt, Staphylococcus aureus subsp. aureus N315
gaucuaaaaccau

SEQ ID NO: 2138584 - RNA, 13 nt, Staphylococcus aureus subsp. aureus N315
gaucgguauuuuc

SEQ ID NO: 2138585 - RNA, 17 nt, Staphylococcus aureus subsp. aureus N315
gaucauuuucaacauaa

SEQ ID NO: 2138586 - RNA, 15 nt, Staphylococcus aureus subsp. aureus N315
gaucgauacuuuuug

SEQ ID NO: 2138587 - RNA, 18 nt, Staphylococcus aureus subsp. aureus N315
gaucauaaauauuuucug

SEQ ID NO: 2138588 - RNA, 21 nt, Staphylococcus aureus subsp. aureus N315
gaucacuuacugugaaaauac

SEQ ID NO: 2138589 - RNA, 20 nt, Staphylococcus aureus subsp. aureus N315
gauauguuuggauaucuuug

SEQ ID NO: 2138590 - RNA, 14 nt, Staphylococcus aureus subsp. aureus N315
gauacuuugaaaga

SEQ ID NO: 2138591 - RNA, 14 nt, Staphylococcus aureus subsp. aureus N315
gauacgcuuuuuaa

SEQ ID NO: 2138592 - RNA, 19 nt, Staphylococcus aureus subsp. aureus N315
gauacgcuuuuuaaaaaau

SEQ ID NO: 2138593 - RNA, 13 nt, Staphylococcus aureus subsp. aureus N315
gauacugaaauuu

SEQ ID NO: 2138594 - RNA, 22 nt, Staphylococcus aureus subsp. aureus N315
gauacuuuuuguaguccuucuu

SEQ ID NO: 2138595 - RNA, 20 nt, Staphylococcus aureus subsp. aureus N315
gauagaauacuaaaaguguu

SEQ ID NO: 2138596 - RNA, 19 nt, Staphylococcus aureus subsp. aureus N315
gauagaauacuaaaagugu

SEQ ID NO: 2138597 - RNA, 22 nt, Staphylococcus aureus subsp. aureus N315
gauagaaguuuuuugauuagua

SEQ ID NO: 2138598 - RNA, 21 nt, Staphylococcus aureus subsp. aureus N315
gauagaaugucgauauuucua

SEQ ID NO: 2138599 - RNA, 23 nt, Staphylococcus aureus subsp. aureus N315
gauaagaauuaacaacaaauaua

SEQ ID NO: 2138600 - RNA, 19 nt, Staphylococcus aureus subsp. aureus N315
gauaccuuuuucuaccaau

SEQ ID NO: 2138601 - RNA, 18 nt, Staphylococcus aureus subsp. aureus N315
gauaccuuuaauaucuaa

SEQ ID NO: 2138602 - RNA, 21 nt, Staphylococcus aureus subsp. aureus N315
gauaccuuuaauaauauugaa

SEQ ID NO: 2138603 - RNA, 14 nt, Staphylococcus aureus subsp. aureus N315
gauagaugaaaaug

SEQ ID NO: 2138604 - RNA, 19 nt, Staphylococcus aureus subsp. aureus N315
gauagauucugauacagaa

SEQ ID NO: 2138605 - RNA, 16 nt, Staphylococcus aureus subsp. aureus N315
gauagcugcuauccuu

SEQ ID NO: 2138606 - RNA, 16 nt, Staphylococcus aureus subsp. aureus N315
gauaggaaacuuaaau

SEQ ID NO: 2138607 - RNA, 22 nt, Staphylococcus aureus subsp. aureus N315
gauaggauuugcaccuauaccu

SEQ ID NO: 2138608 - RNA, 22 nt, Staphylococcus aureus subsp. aureus N315
gauaggauuuacaccuauaccu

SEQ ID NO: 2138609 - RNA, 13 nt, Staphylococcus aureus subsp. aureus N315
gauagugaauaau

SEQ ID NO: 2138610 - RNA, 18 nt, Staphylococcus aureus subsp. aureus N315
gauauagaauucacgcaa

SEQ ID NO: 2138611 - RNA, 18 nt, Staphylococcus aureus subsp. aureus N315
gauauacuugaagaaaag

SEQ ID NO: 2138612 - RNA, 15 nt, Staphylococcus aureus subsp. aureus N315
gauauacgaauccuc

SEQ ID NO: 2138613 - RNA, 12 nt, Staphylococcus aureus subsp. aureus N315
gauaucuuuuaa

SEQ ID NO: 2138614 - RNA, 23 nt, Staphylococcus aureus subsp. aureus N315
cuuucguuucuuuuauaucgcuu

SEQ ID NO: 2138615 - RNA, 16 nt, Staphylococcus aureus subsp. aureus N315
cuuuccauuguugaua

SEQ ID NO: 2138616 - RNA, 15 nt, Staphylococcus aureus subsp. aureus N315
cuuucauuguaaauu

SEQ ID NO: 2138617 - RNA, 22 nt, Staphylococcus aureus subsp. aureus N315
cuuucuugaugaauuaaacuga

SEQ ID NO: 2138618 - RNA, 17 nt, Staphylococcus aureus subsp. aureus N315
cuuucuuuuucaucuuu

SEQ ID NO: 2138619 - RNA, 16 nt, Staphylococcus aureus subsp. aureus N315
cuuucuuuucugaaug

SEQ ID NO: 2138620 - RNA, 12 nt, Staphylococcus aureus subsp. aureus N315
cuuucuuuucug

SEQ ID NO: 2138621 - RNA, 13 nt, Staphylococcus aureus subsp. aureus N315
cuuucuuuuucau

SEQ ID NO: 2138622 - RNA, 21 nt, Staphylococcus aureus subsp. aureus N315
cuuucucggcgauaaaauguu

SEQ ID NO: 2138623 - RNA, 16 nt, Staphylococcus aureus subsp. aureus N315
cuuucucggcgauaaa

SEQ ID NO: 2138624 - RNA, 16 nt, Staphylococcus aureus subsp. aureus N315
cuuucucaucuauuua

SEQ ID NO: 2138625 - RNA, 19 nt, Staphylococcus aureus subsp. aureus N315
cuuuguguuugcuuuuuac

SEQ ID NO: 2138626 - RNA, 18 nt, Staphylococcus aureus subsp. aureus N315
cuuuguucugcuuuuucu

SEQ ID NO: 2138627 - RNA, 23 nt, Staphylococcus aureus subsp. aureus N315
cuuuguucugcuuuuucuuuauc

SEQ ID NO: 2138628 - RNA, 13 nt, Staphylococcus aureus subsp. aureus N315
cuuuguucugcuu

SEQ ID NO: 2138629 - RNA, 18 nt, Staphylococcus aureus subsp. aureus N315
cuuuguuauauuuuuagg

SEQ ID NO: 2138630 - RNA, 18 nt, Staphylococcus aureus subsp. aureus N315
cuuuguagccuucaacua

SEQ ID NO: 2138631 - RNA, 23 nt, Staphylococcus aureus subsp. aureus N315
cuuuguauggaaauggugguuac

SEQ ID NO: 2138632 - RNA, 19 nt, Staphylococcus aureus subsp. aureus N315
cuuugucacgauagauuua

SEQ ID NO: 2138633 - RNA, 18 nt, Staphylococcus aureus subsp. aureus N315
cuuugucauacuaacuau

SEQ ID NO: 2138634 - RNA, 21 nt, Staphylococcus aureus subsp. aureus N315
cuuugauguucacuaaaugug

SEQ ID NO: 2138635 - RNA, 19 nt, Staphylococcus aureus subsp. aureus N315
cuuugauguucacuaaaug

SEQ ID NO: 2138636 - RNA, 16 nt, Staphylococcus aureus subsp. aureus N315
cuuugacauguguuaa

SEQ ID NO: 2138637 - RNA, 14 nt, Staphylococcus aureus subsp. aureus N315
cuuugcuaaaucaa

SEQ ID NO: 2138638 - RNA, 14 nt, Staphylococcus aureus subsp. aureus N315
cuuugcucaccuuu

SEQ ID NO: 2138639 - RNA, 14 nt, Staphylococcus aureus subsp. aureus N315
cuuuauucuuccca

SEQ ID NO: 2138640 - RNA, 22 nt, Staphylococcus aureus subsp. aureus N315
cuuuauucuucccaaaaauugu

SEQ ID NO: 2138641 - RNA, 14 nt, Staphylococcus aureus subsp. aureus N315
cuuuauuacuuuaa

SEQ ID NO: 2138642 - RNA, 15 nt, Staphylococcus aureus subsp. aureus N315
cuuuauuacuuuaau

SEQ ID NO: 2138643 - RNA, 22 nt, Staphylococcus aureus subsp. aureus N315
cuuuagcaaaaauauuuaaacu

SEQ ID NO: 2138644 - RNA, 22 nt, Staphylococcus aureus subsp. aureus N315
cuuuagaugagauuucguuaga

SEQ ID NO: 2138645 - RNA, 12 nt, Staphylococcus aureus subsp. aureus N315
cuuuauaugaag

SEQ ID NO: 2138646 - RNA, 21 nt, Staphylococcus aureus subsp. aureus N315
cuuuauauauaaagaaauaau

SEQ ID NO: 2138647 - RNA, 14 nt, Staphylococcus aureus subsp. aureus N315
cuuuauauuuauca

SEQ ID NO: 2138648 - RNA, 13 nt, Staphylococcus aureus subsp. aureus N315
cuuucaguuuuug

SEQ ID NO: 2138649 - RNA, 17 nt, Staphylococcus aureus subsp. aureus N315
cuuucauaauuaacaca

SEQ ID NO: 2138650 - RNA, 20 nt, Staphylococcus aureus subsp. aureus N315
cuuucaccauuuacuucaua

SEQ ID NO: 2138651 - RNA, 16 nt, Staphylococcus aureus subsp. aureus N315
cuuucaccauuuacuu

SEQ ID NO: 2138652 - RNA, 20 nt, Staphylococcus aureus subsp. aureus N315
cuuuauuuacaauguuaucu

SEQ ID NO: 2138653 - RNA, 16 nt, Staphylococcus aureus subsp. aureus N315
cuuuaaaucuuguucu

SEQ ID NO: 2138654 - RNA, 14 nt, Staphylococcus aureus subsp. aureus N315
cuuuaaauuauaua

SEQ ID NO: 2138655 - RNA, 16 nt, Staphylococcus aureus subsp. aureus N315
aaagacaugagauuau

SEQ ID NO: 2138656 - RNA, 11 nt, Staphylococcus aureus subsp. aureus N315
aaagacauuua

SEQ ID NO: 2138657 - RNA, 15 nt, Staphylococcus aureus subsp. aureus N315
cuuuaauaaccuuua

SEQ ID NO: 2138658 - RNA, 17 nt, Staphylococcus aureus subsp. aureus N315
cuuuaaguuauuuuguc

SEQ ID NO: 2138659 - RNA, 19 nt, Staphylococcus aureus subsp. aureus N315
cuuuaauagcgucaaguuu

SEQ ID NO: 2138660 - RNA, 12 nt, Staphylococcus aureus subsp. aureus N315
cuuuaauacuac

SEQ ID NO: 2138661 - RNA, 19 nt, Staphylococcus aureus subsp. aureus N315
cuuuaauauaauuauuaaa

SEQ ID NO: 2138662 - RNA, 14 nt, Staphylococcus aureus subsp. aureus N315
cuuuagaaagugau

SEQ ID NO: 2138663 - RNA, 15 nt, Staphylococcus aureus subsp. aureus N315
cuuuaauuaaaguua

SEQ ID NO: 2138664 - RNA, 17 nt, Staphylococcus aureus subsp. aureus N315
cuuuaauguaauuauuu

SEQ ID NO: 2138665 - RNA, 12 nt, Staphylococcus aureus subsp. aureus N315
cuuuaccaucuu

SEQ ID NO: 2138666 - RNA, 14 nt, Staphylococcus aureus subsp. aureus N315
gaaaacagguggaa

SEQ ID NO: 2138667 - RNA, 11 nt, Staphylococcus aureus subsp. aureus N315
gaaaacaauaa

SEQ ID NO: 2138668 - RNA, 22 nt, Staphylococcus aureus subsp. aureus N315
gaaaacauaaauacaaaaauau

SEQ ID NO: 2138669 - RNA, 23 nt, Staphylococcus aureus subsp. aureus N315
gaaaacguugaguauuacuugaa

SEQ ID NO: 2138670 - RNA, 21 nt, Staphylococcus aureus subsp. aureus N315
gaaaauaccucuacauuauau

SEQ ID NO: 2138671 - RNA, 14 nt, Staphylococcus aureus subsp. aureus N315
gaaaauagaaagaa

SEQ ID NO: 2138672 - RNA, 15 nt, Staphylococcus aureus subsp. aureus N315
gaaaagagaaacaaa

SEQ ID NO: 2138673 - RNA, 15 nt, Staphylococcus aureus subsp. aureus N315
cuuuuguuuuaccau

SEQ ID NO: 2138674 - RNA, 18 nt, Staphylococcus aureus subsp. aureus N315
cuuuuguuuucacuguuu

SEQ ID NO: 2138675 - RNA, 13 nt, Staphylococcus aureus subsp. aureus N315
cuuuuguuaaaaa

SEQ ID NO: 2138676 - RNA, 20 nt, Staphylococcus aureus subsp. aureus N315
cuuuuguguuugcccugcug

SEQ ID NO: 2138677 - RNA, 19 nt, Staphylococcus aureus subsp. aureus N315
cuuuuguuuaguauggaau

SEQ ID NO: 2138678 - RNA, 15 nt, Staphylococcus aureus subsp. aureus N315
cuuuuuaaaaaauuu

SEQ ID NO: 2138679 - RNA, 14 nt, Staphylococcus aureus subsp. aureus N315
cuuuuucuauacaa

SEQ ID NO: 2138680 - RNA, 19 nt, Staphylococcus aureus subsp. aureus N315
cuuuuucuguaauaauuau

SEQ ID NO: 2138681 - RNA, 13 nt, Staphylococcus aureus subsp. aureus N315
cuuuuuguuuauc

SEQ ID NO: 2138682 - RNA, 14 nt, Staphylococcus aureus subsp. aureus N315
cuuuuuguuuucaa

SEQ ID NO: 2138683 - RNA, 18 nt, Staphylococcus aureus subsp. aureus N315
cuuuuuguuaauuuuuua

SEQ ID NO: 2138684 - RNA, 14 nt, Staphylococcus aureus subsp. aureus N315
cuuuuuuaacuuua

SEQ ID NO: 2138685 - RNA, 13 nt, Staphylococcus aureus subsp. aureus N315
cuuuuuuauauuc

SEQ ID NO: 2138686 - RNA, 22 nt, Staphylococcus aureus subsp. aureus N315
cuuuuugacauauuuuuuaaau

SEQ ID NO: 2138687 - RNA, 21 nt, Staphylococcus aureus subsp. aureus N315
cuuuuugacauauuuuuuaaa

SEQ ID NO: 2138688 - RNA, 15 nt, Staphylococcus aureus subsp. aureus N315
cuuuuuguguaucug

SEQ ID NO: 2138689 - RNA, 13 nt, Staphylococcus aureus subsp. aureus N315
cuuuuucuuucau

SEQ ID NO: 2138690 - RNA, 16 nt, Staphylococcus aureus subsp. aureus N315
cuuuuucuuucucuaa

SEQ ID NO: 2138691 - RNA, 17 nt, Staphylococcus aureus subsp. aureus N315
gaaaaagcaggcaagcu

SEQ ID NO: 2138692 - RNA, 15 nt, Staphylococcus aureus subsp. aureus N315
gaaaaagaugaaaaa

SEQ ID NO: 2138693 - RNA, 14 nt, Staphylococcus aureus subsp. aureus N315
gaaaaagucuuucu

SEQ ID NO: 2138694 - RNA, 13 nt, Staphylococcus aureus subsp. aureus N315
gaaaacaaacaag

SEQ ID NO: 2138695 - RNA, 21 nt, Staphylococcus aureus subsp. aureus N315
cuuuuacagaacguucauaua

SEQ ID NO: 2138696 - RNA, 14 nt, Staphylococcus aureus subsp. aureus N315
cuuuuacauuugua

SEQ ID NO: 2138697 - RNA, 22 nt, Staphylococcus aureus subsp. aureus N315
cuuuuaaaccguguucuuuaau

SEQ ID NO: 2138698 - RNA, 21 nt, Staphylococcus aureus subsp. aureus N315
cuuuuaaaaucguugcagauu

SEQ ID NO: 2138699 - RNA, 19 nt, Staphylococcus aureus subsp. aureus N315
cuuuguuugcuucuguauc

SEQ ID NO: 2138700 - RNA, 14 nt, Staphylococcus aureus subsp. aureus N315
cuuuuacuaaauga

SEQ ID NO: 2138701 - RNA, 16 nt, Staphylococcus aureus subsp. aureus N315
cuuuuauuauuuuaug

SEQ ID NO: 2138702 - RNA, 18 nt, Staphylococcus aureus subsp. aureus N315
cuuuuaugucuaguucuu

SEQ ID NO: 2138703 - RNA, 23 nt, Staphylococcus aureus subsp. aureus N315
cuuuuauuaaagaaacaugauug

SEQ ID NO: 2138704 - RNA, 14 nt, Staphylococcus aureus subsp. aureus N315
cuuuuauuacuuau

SEQ ID NO: 2138705 - RNA, 19 nt, Staphylococcus aureus subsp. aureus N315
cuuuuauuacuuauuucuu

SEQ ID NO: 2138706 - RNA, 15 nt, Staphylococcus aureus subsp. aureus N315
cuuuuaugcaugcgc

SEQ ID NO: 2138707 - RNA, 12 nt, Staphylococcus aureus subsp. aureus N315
cuuuuaugcaug

SEQ ID NO: 2138708 - RNA, 14 nt, Staphylococcus aureus subsp. aureus N315
cuuuuccauucaua

SEQ ID NO: 2138709 - RNA, 15 nt, Staphylococcus aureus subsp. aureus N315
cuuuucaaagccaca

SEQ ID NO: 2138710 - RNA, 22 nt, Staphylococcus aureus subsp. aureus N315
cuuuucaucaguugagugauuu

SEQ ID NO: 2138711 - RNA, 18 nt, Staphylococcus aureus subsp. aureus N315
cuuuucugucuguaaauu

SEQ ID NO: 2138712 - RNA, 20 nt, Staphylococcus aureus subsp. aureus N315
cuuuucuagcuauauccagu

SEQ ID NO: 2138713 - RNA, 21 nt, Staphylococcus aureus subsp. aureus N315
cuuuucucgauuaauuuucuu

SEQ ID NO: 2138714 - RNA, 15 nt, Staphylococcus aureus subsp. aureus N315
aaagacuacaaguca

SEQ ID NO: 2138715 - RNA, 19 nt, Staphylococcus aureus subsp. aureus N315
aaagacuagccauaccuua

SEQ ID NO: 2138716 - RNA, 21 nt, Staphylococcus aureus subsp. aureus N315
aaagacuauauaacacaauac

SEQ ID NO: 2138717 - RNA, 19 nt, Staphylococcus aureus subsp. aureus N315
aaagacugacuaauaaaac

SEQ ID NO: 2138718 - RNA, 22 nt, Staphylococcus aureus subsp. aureus N315
aaagacucaauuucauuugaaa

SEQ ID NO: 2138719 - RNA, 17 nt, Staphylococcus aureus subsp. aureus N315
gaaccuauauuaagcau

SEQ ID NO: 2138720 - RNA, 14 nt, Staphylococcus aureus subsp. aureus N315
gaaccccauucacu

SEQ ID NO: 2138721 - RNA, 18 nt, Staphylococcus aureus subsp. aureus N315
gaaccguaacuauaugaa

SEQ ID NO: 2138722 - RNA, 14 nt, Staphylococcus aureus subsp. aureus N315
gaacauuaaaagga

SEQ ID NO: 2138723 - RNA, 15 nt, Staphylococcus aureus subsp. aureus N315
gaacauguuucuaga

SEQ ID NO: 2138724 - RNA, 15 nt, Staphylococcus aureus subsp. aureus N315
gaacauauuauaaaa

SEQ ID NO: 2138725 - RNA, 20 nt, Staphylococcus aureus subsp. aureus N315
gaacauuuaucgugaagaaa

SEQ ID NO: 2138726 - RNA, 22 nt, Staphylococcus aureus subsp. aureus N315
gaacauuuaucgugaagaaaaa

SEQ ID NO: 2138727 - RNA, 23 nt, Staphylococcus aureus subsp. aureus N315
gaacauuuaucgugaagaaaaaa

SEQ ID NO: 2138728 - RNA, 15 nt, Staphylococcus aureus subsp. aureus N315
gaaccacgcaucaug

SEQ ID NO: 2138729 - RNA, 14 nt, Staphylococcus aureus subsp. aureus N315
gaaccaacaauaaa

SEQ ID NO: 2138730 - RNA, 16 nt, Staphylococcus aureus subsp. aureus N315
gaacucugagcacuua

SEQ ID NO: 2138731 - RNA, 18 nt, Staphylococcus aureus subsp. aureus N315
gaacuaguacgaaaugca

SEQ ID NO: 2138732 - RNA, 15 nt, Staphylococcus aureus subsp. aureus N315
gaacuauuaaaacca

SEQ ID NO: 2138733 - RNA, 19 nt, Staphylococcus aureus subsp. aureus N315
gaacuacaauucauaagaa

SEQ ID NO: 2138734 - RNA, 22 nt, Staphylococcus aureus subsp. aureus N315
gaacuacaauucauaagaaaaa

SEQ ID NO: 2138735 - RNA, 19 nt, Staphylococcus aureus subsp. aureus N315
gaacgcuagcauaucuuua

SEQ ID NO: 2138736 - RNA, 15 nt, Staphylococcus aureus subsp. aureus N315
gaacguuauuuucaa

SEQ ID NO: 2138737 - RNA, 18 nt, Staphylococcus aureus subsp. aureus N315
gaacguguuugaauggca

SEQ ID NO: 2138738 - RNA, 15 nt, Staphylococcus aureus subsp. aureus N315
gaacuaacauaauuu

SEQ ID NO: 2138739 - RNA, 22 nt, Staphylococcus aureus subsp. aureus N315
gaacaaucggaagcauauuucu

SEQ ID NO: 2138740 - RNA, 23 nt, Staphylococcus aureus subsp. aureus N315
gaacaaucggaagcauauuucua

SEQ ID NO: 2138741 - RNA, 17 nt, Staphylococcus aureus subsp. aureus N315
gaacacgaaauggugaa

SEQ ID NO: 2138742 - RNA, 13 nt, Staphylococcus aureus subsp. aureus N315
gaacaauaauaug

SEQ ID NO: 2138743 - RNA, 16 nt, Staphylococcus aureus subsp. aureus N315
gaacaagucuugcaau

SEQ ID NO: 2138744 - RNA, 15 nt, Staphylococcus aureus subsp. aureus N315
gaacaaaauaacaug

SEQ ID NO: 2138745 - RNA, 14 nt, Staphylococcus aureus subsp. aureus N315
gaacaaaauguagg

SEQ ID NO: 2138746 - RNA, 18 nt, Staphylococcus aureus subsp. aureus N315
gaaauuuuuuagugaaaa

SEQ ID NO: 2138747 - RNA, 12 nt, Staphylococcus aureus subsp. aureus N315
gaaaugaaugag

SEQ ID NO: 2138748 - RNA, 13 nt, Staphylococcus aureus subsp. aureus N315
gaaaugauaauuu

SEQ ID NO: 2138749 - RNA, 23 nt, Staphylococcus aureus subsp. aureus N315
gaaauucuacagguaaugcaagu

SEQ ID NO: 2138750 - RNA, 23 nt, Staphylococcus aureus subsp. aureus N315
gaaauucuacaggcaaugcaagu

SEQ ID NO: 2138751 - RNA, 22 nt, Staphylococcus aureus subsp. aureus N315
gaaauucuacagguaaugcaag

SEQ ID NO: 2138752 - RNA, 20 nt, Staphylococcus aureus subsp. aureus N315
gaaauucucuuuguuggggc

SEQ ID NO: 2138753 - RNA, 20 nt, Staphylococcus aureus subsp. aureus N315
gaaauuuuaaaauaaaucuu

SEQ ID NO: 2138754 - RNA, 22 nt, Staphylococcus aureus subsp. aureus N315
aaagagaugggcuaagguuguu

SEQ ID NO: 2138755 - RNA, 22 nt, Staphylococcus aureus subsp. aureus N315
gaaauucuacaggcaaugcaag

SEQ ID NO: 2138756 - RNA, 17 nt, Staphylococcus aureus subsp. aureus N315
gaaauucuacagguaau

SEQ ID NO: 2138757 - RNA, 17 nt, Staphylococcus aureus subsp. aureus N315
gaaauucuacaggcaau

SEQ ID NO: 2138758 - RNA, 17 nt, Staphylococcus aureus subsp. aureus N315
gaaagaugauauauuca

SEQ ID NO: 2138759 - RNA, 17 nt, Staphylococcus aureus subsp. aureus N315
gaaacuuccaacauaua

SEQ ID NO: 2138760 - RNA, 13 nt, Staphylococcus aureus subsp. aureus N315
gaaacuaaauuaa

SEQ ID NO: 2138761 - RNA, 14 nt, Staphylococcus aureus subsp. aureus N315
gaaacuaauaauuu

SEQ ID NO: 2138762 - RNA, 16 nt, Staphylococcus aureus subsp. aureus N315
gaaaaugaguacaaca

SEQ ID NO: 2138763 - RNA, 23 nt, Staphylococcus aureus subsp. aureus N315
gaaaaucuuuaacucuugaaaca

SEQ ID NO: 2138764 - RNA, 22 nt, Staphylococcus aureus subsp. aureus N315
gaaauacuugaauuuaauaagu

SEQ ID NO: 2138765 - RNA, 16 nt, Staphylococcus aureus subsp. aureus N315
gaaauaccuccugauu

SEQ ID NO: 2138766 - RNA, 19 nt, Staphylococcus aureus subsp. aureus N315
gaaauaccuccugauugcu

SEQ ID NO: 2138767 - RNA, 13 nt, Staphylococcus aureus subsp. aureus N315
gaaauauuuaucu

SEQ ID NO: 2138768 - RNA, 20 nt, Staphylococcus aureus subsp. aureus N315
gaaaucaaaaauaauuauga

SEQ ID NO: 2138769 - RNA, 14 nt, Staphylococcus aureus subsp. aureus N315
gaaaucaaaaauaa

SEQ ID NO: 2138770 - RNA, 12 nt, Staphylococcus aureus subsp. aureus N315
gaaaucaaauau

SEQ ID NO: 2138771 - RNA, 17 nt, Staphylococcus aureus subsp. aureus N315
gaaaucaccagauuuua

SEQ ID NO: 2138772 - RNA, 20 nt, Staphylococcus aureus subsp. aureus N315
gaaagucaacaauugcuaau

SEQ ID NO: 2138773 - RNA, 23 nt, Staphylococcus aureus subsp. aureus N315
gaaaguaauaaguaauaauuuau

SEQ ID NO: 2138774 - RNA, 22 nt, Staphylococcus aureus subsp. aureus N315
gaaagcuaauggcuaauacaaa

SEQ ID NO: 2138775 - RNA, 15 nt, Staphylococcus aureus subsp. aureus N315
gacaguaaucaaagu

SEQ ID NO: 2138776 - RNA, 19 nt, Staphylococcus aureus subsp. aureus N315
gacauuuaaauauaaccua

SEQ ID NO: 2138777 - RNA, 19 nt, Staphylococcus aureus subsp. aureus N315
gacauuuaauacuuuucuc

SEQ ID NO: 2138778 - RNA, 16 nt, Staphylococcus aureus subsp. aureus N315
gacauugugaaaguuu

SEQ ID NO: 2138779 - RNA, 15 nt, Staphylococcus aureus subsp. aureus N315
gacauuuucaaguuu

SEQ ID NO: 2138780 - RNA, 15 nt, Staphylococcus aureus subsp. aureus N315
gacauuuguaaauau

SEQ ID NO: 2138781 - RNA, 15 nt, Staphylococcus aureus subsp. aureus N315
gacauuuuuggcuua

SEQ ID NO: 2138782 - RNA, 19 nt, Staphylococcus aureus subsp. aureus N315
gaccauugucaugccuuca

SEQ ID NO: 2138783 - RNA, 15 nt, Staphylococcus aureus subsp. aureus N315
gaccaugcaaacuca

SEQ ID NO: 2138784 - RNA, 18 nt, Staphylococcus aureus subsp. aureus N315
gaccaugcaaacucauuu

SEQ ID NO: 2138785 - RNA, 21 nt, Staphylococcus aureus subsp. aureus N315
gacgauaccuuuaauaauauu

SEQ ID NO: 2138786 - RNA, 20 nt, Staphylococcus aureus subsp. aureus N315
gacgguauaaaaaaauuaac

SEQ ID NO: 2138787 - RNA, 19 nt, Staphylococcus aureus subsp. aureus N315
gacuaaaaugaaugaagac

SEQ ID NO: 2138788 - RNA, 15 nt, Staphylococcus aureus subsp. aureus N315
gacguucauggauuc

SEQ ID NO: 2138789 - RNA, 14 nt, Staphylococcus aureus subsp. aureus N315
gacuaauaauuguc

SEQ ID NO: 2138790 - RNA, 13 nt, Staphylococcus aureus subsp. aureus N315
gacguaucaucaa

SEQ ID NO: 2138791 - RNA, 17 nt, Staphylococcus aureus subsp. aureus N315
gacgugucauuggugga

SEQ ID NO: 2138792 - RNA, 17 nt, Staphylococcus aureus subsp. aureus N315
gacuaugcaaaugaaau

SEQ ID NO: 2138793 - RNA, 11 nt, Staphylococcus aureus subsp. aureus N315
gacuauuuuug

SEQ ID NO: 2138794 - RNA, 20 nt, Staphylococcus aureus subsp. aureus N315
gacuauaacaccaauuaaau

SEQ ID NO: 2138795 - RNA, 17 nt, Staphylococcus aureus subsp. aureus N315
gacuacaaguuuauaau

SEQ ID NO: 2138796 - RNA, 11 nt, Staphylococcus aureus subsp. aureus N315
gacuacucaau

SEQ ID NO: 2138797 - RNA, 17 nt, Staphylococcus aureus subsp. aureus N315
gacaauucaucuaaccu

SEQ ID NO: 2138798 - RNA, 12 nt, Staphylococcus aureus subsp. aureus N315
gacaauuauaau

SEQ ID NO: 2138799 - RNA, 14 nt, Staphylococcus aureus subsp. aureus N315
gacaauuauaauaa

SEQ ID NO: 2138800 - RNA, 23 nt, Staphylococcus aureus subsp. aureus N315
gacaauugcgaccauuaguacua

SEQ ID NO: 2138801 - RNA, 19 nt, Staphylococcus aureus subsp. aureus N315
gacaacauaacaaagaacc

SEQ ID NO: 2138802 - RNA, 23 nt, Staphylococcus aureus subsp. aureus N315
gacaaccgauauaauuaauuugu

SEQ ID NO: 2138803 - RNA, 23 nt, Staphylococcus aureus subsp. aureus N315
gaauugguuuuuagugaaaagaa

SEQ ID NO: 2138804 - RNA, 17 nt, Staphylococcus aureus subsp. aureus N315
gaauuaucuuuacgaua

SEQ ID NO: 2138805 - RNA, 15 nt, Staphylococcus aureus subsp. aureus N315
gaauuauuuaaaaug

SEQ ID NO: 2138806 - RNA, 16 nt, Staphylococcus aureus subsp. aureus N315
gaauuauuuagaaacu

SEQ ID NO: 2138807 - RNA, 12 nt, Staphylococcus aureus subsp. aureus N315
gaauccuuaauu

SEQ ID NO: 2138808 - RNA, 18 nt, Staphylococcus aureus subsp. aureus N315
gaaucuuacauugauaaa

SEQ ID NO: 2138809 - RNA, 16 nt, Staphylococcus aureus subsp. aureus N315
gaaucuuggaaguauc

SEQ ID NO: 2138810 - RNA, 21 nt, Staphylococcus aureus subsp. aureus N315
gaaugaaaauaagcuuguaac

SEQ ID NO: 2138811 - RNA, 14 nt, Staphylococcus aureus subsp. aureus N315
gaaugaaguaauau

SEQ ID NO: 2138812 - RNA, 10 nt, Staphylococcus aureus subsp. aureus N315
gaaucaguau

SEQ ID NO: 2138813 - RNA, 14 nt, Staphylococcus aureus subsp. aureus N315
gaaucccauaauga

SEQ ID NO: 2138814 - RNA, 23 nt, Staphylococcus aureus subsp. aureus N315
gaauauuugcuuuuuguguaucu

SEQ ID NO: 2138815 - RNA, 23 nt, Staphylococcus aureus subsp. aureus N315
gaauagugagcguauuauuauug

SEQ ID NO: 2138816 - RNA, 23 nt, Staphylococcus aureus subsp. aureus N315
gaauauuuauuguuuuuaaaauc

SEQ ID NO: 2138817 - RNA, 12 nt, Staphylococcus aureus subsp. aureus N315
gaaucaacaauu

SEQ ID NO: 2138818 - RNA, 22 nt, Staphylococcus aureus subsp. aureus N315
gaaucaacaauuuaaacgcacu

SEQ ID NO: 2138819 - RNA, 15 nt, Staphylococcus aureus subsp. aureus N315
aaagauuuaagucau

SEQ ID NO: 2138820 - RNA, 18 nt, Staphylococcus aureus subsp. aureus N315
aaagauuauuauuacaau

SEQ ID NO: 2138821 - RNA, 19 nt, Staphylococcus aureus subsp. aureus N315
aaagauuagaugauauuua

SEQ ID NO: 2138822 - RNA, 13 nt, Staphylococcus aureus subsp. aureus N315
aaagaugucgaaa

SEQ ID NO: 2138823 - RNA, 18 nt, Staphylococcus aureus subsp. aureus N315
aaagaugucgaaaaguau

SEQ ID NO: 2138824 - RNA, 19 nt, Staphylococcus aureus subsp. aureus N315
gaauaacuguuuaucauga

SEQ ID NO: 2138825 - RNA, 21 nt, Staphylococcus aureus subsp. aureus N315
gaauaagugguuguucccauu

SEQ ID NO: 2138826 - RNA, 15 nt, Staphylococcus aureus subsp. aureus N315
gaauaacgucauaug

SEQ ID NO: 2138827 - RNA, 12 nt, Staphylococcus aureus subsp. aureus N315
gaauaauauauu

SEQ ID NO: 2138828 - RNA, 18 nt, Staphylococcus aureus subsp. aureus N315
gaauacaugaguaaaacu

SEQ ID NO: 2138829 - RNA, 19 nt, Staphylococcus aureus subsp. aureus N315
gaauacaugaguaaaacuc

SEQ ID NO: 2138830 - RNA, 13 nt, Staphylococcus aureus subsp. aureus N315
gaauaaaaaaguu

SEQ ID NO: 2138831 - RNA, 14 nt, Staphylococcus aureus subsp. aureus N315
aaagaucauuaaaa

SEQ ID NO: 2138832 - RNA, 16 nt, Staphylococcus aureus subsp. aureus N315
aaagaucgauacuuuu

SEQ ID NO: 2138833 - RNA, 22 nt, Staphylococcus aureus subsp. aureus N315
gaagucuugugauaauucuuca

SEQ ID NO: 2138834 - RNA, 15 nt, Staphylococcus aureus subsp. aureus N315
aaagauauagaauuc

SEQ ID NO: 2138835 - RNA, 14 nt, Staphylococcus aureus subsp. aureus N315
aaagauauguuuau

SEQ ID NO: 2138836 - RNA, 21 nt, Staphylococcus aureus subsp. aureus N315
aaagauauguuuauauugcaa

SEQ ID NO: 2138837 - RNA, 20 nt, Staphylococcus aureus subsp. aureus N315
gaaggacaggaauaaauuuu

SEQ ID NO: 2138838 - RNA, 19 nt, Staphylococcus aureus subsp. aureus N315
gaaggaacguguucuaaaa

SEQ ID NO: 2138839 - RNA, 21 nt, Staphylococcus aureus subsp. aureus N315
gaaggaauaauuuuaaaaaua

SEQ ID NO: 2138840 - RNA, 22 nt, Staphylococcus aureus subsp. aureus N315
gaaggccauuuuuauuuaacac

SEQ ID NO: 2138841 - RNA, 15 nt, Staphylococcus aureus subsp. aureus N315
gaaggauuuuagauu

SEQ ID NO: 2138842 - RNA, 16 nt, Staphylococcus aureus subsp. aureus N315
gaagggguuuuuucuu

SEQ ID NO: 2138843 - RNA, 17 nt, Staphylococcus aureus subsp. aureus N315
gaagauaggauuugcac

SEQ ID NO: 2138844 - RNA, 17 nt, Staphylococcus aureus subsp. aureus N315
gaagauaggauuuacac

SEQ ID NO: 2138845 - RNA, 16 nt, Staphylococcus aureus subsp. aureus N315
aaagagguacuagaau

SEQ ID NO: 2138846 - RNA, 19 nt, Staphylococcus aureus subsp. aureus N315
aaagagguacuagaauuaa

SEQ ID NO: 2138847 - RNA, 22 nt, Staphylococcus aureus subsp. aureus N315
aaagaggcgccacaacauguuu

SEQ ID NO: 2138848 - RNA, 19 nt, Staphylococcus aureus subsp. aureus N315
gaagaaacuuaaucaagcu

SEQ ID NO: 2138849 - RNA, 13 nt, Staphylococcus aureus subsp. aureus N315
gaacuuuaaaaau

SEQ ID NO: 2138850 - RNA, 20 nt, Staphylococcus aureus subsp. aureus N315
gaacuuuuauuuuuuauaaa

SEQ ID NO: 2138851 - RNA, 14 nt, Staphylococcus aureus subsp. aureus N315
gaagaaacauuaua

SEQ ID NO: 2138852 - RNA, 15 nt, Staphylococcus aureus subsp. aureus N315
gaagaaacauuauau

SEQ ID NO: 2138853 - RNA, 14 nt, Staphylococcus aureus subsp. aureus N315
gaacuuuuguucua

SEQ ID NO: 2138854 - RNA, 14 nt, Staphylococcus aureus subsp. aureus N315
cuguaguuucuuaa

SEQ ID NO: 2138855 - RNA, 19 nt, Staphylococcus aureus subsp. aureus N315
cuguaguuucaacuuuuga

SEQ ID NO: 2138856 - RNA, 18 nt, Staphylococcus aureus subsp. aureus N315
cuguagcgauaccuuuaa

SEQ ID NO: 2138857 - RNA, 23 nt, Staphylococcus aureus subsp. aureus N315
cuguagacaauuguaguaaugaa

SEQ ID NO: 2138858 - RNA, 21 nt, Staphylococcus aureus subsp. aureus N315
cuguacuuugccacuuugugg

SEQ ID NO: 2138859 - RNA, 22 nt, Staphylococcus aureus subsp. aureus N315
cuguauauggcgauaacaagaa

SEQ ID NO: 2138860 - RNA, 18 nt, Staphylococcus aureus subsp. aureus N315
cuguauaguaaccuuuau

SEQ ID NO: 2138861 - RNA, 11 nt, Staphylococcus aureus subsp. aureus N315
cuguauauaua

SEQ ID NO: 2138862 - RNA, 18 nt, Staphylococcus aureus subsp. aureus N315
cuguauaaccauaaugaa

SEQ ID NO: 2138863 - RNA, 14 nt, Staphylococcus aureus subsp. aureus N315
aaacucuuggauug

SEQ ID NO: 2138864 - RNA, 18 nt, Staphylococcus aureus subsp. aureus N315
cugucaccuucuauauug

SEQ ID NO: 2138865 - RNA, 17 nt, Staphylococcus aureus subsp. aureus N315
cugucaccuucuauauu

SEQ ID NO: 2138866 - RNA, 22 nt, Staphylococcus aureus subsp. aureus N315
aaacugaguucaauuaaauuau

SEQ ID NO: 2138867 - RNA, 20 nt, Staphylococcus aureus subsp. aureus N315
cugucaauauaacauugcag

SEQ ID NO: 2138868 - RNA, 13 nt, Staphylococcus aureus subsp. aureus N315
cugucauuuucug

SEQ ID NO: 2138869 - RNA, 15 nt, Staphylococcus aureus subsp. aureus N315
cugucauuuucugcu

SEQ ID NO: 2138870 - RNA, 14 nt, Staphylococcus aureus subsp. aureus N315
cuguccgauuuuua

SEQ ID NO: 2138871 - RNA, 16 nt, Staphylococcus aureus subsp. aureus N315
cugucucauuaaugua

SEQ ID NO: 2138872 - RNA, 19 nt, Staphylococcus aureus subsp. aureus N315
cugucucaucuucuaaauc

SEQ ID NO: 2138873 - RNA, 16 nt, Staphylococcus aureus subsp. aureus N315
cugucuaaaaacauaa

SEQ ID NO: 2138874 - RNA, 16 nt, Staphylococcus aureus subsp. aureus N315
cugugauauuaauuga

SEQ ID NO: 2138875 - RNA, 20 nt, Staphylococcus aureus subsp. aureus N315
cugugauauuaauugaaaaa

SEQ ID NO: 2138876 - RNA, 17 nt, Staphylococcus aureus subsp. aureus N315
cugugauucauucguac

SEQ ID NO: 2138877 - RNA, 22 nt, Staphylococcus aureus subsp. aureus N315
cugugcaugacgauaaugaaau

SEQ ID NO: 2138878 - RNA, 20 nt, Staphylococcus aureus subsp. aureus N315
cuggguuguuauuuauauga

SEQ ID NO: 2138879 - RNA, 18 nt, Staphylococcus aureus subsp. aureus N315
cugguacauaaauaccug

SEQ ID NO: 2138880 - RNA, 16 nt, Staphylococcus aureus subsp. aureus N315
cugguaauauuuuugu

SEQ ID NO: 2138881 - RNA, 17 nt, Staphylococcus aureus subsp. aureus N315
cuggucgugaggcuggg

SEQ ID NO: 2138882 - RNA, 12 nt, Staphylococcus aureus subsp. aureus N315
cuguaccugcua

SEQ ID NO: 2138883 - RNA, 21 nt, Staphylococcus aureus subsp. aureus N315
cuguaccguuuuuuauaaauc

SEQ ID NO: 2138884 - RNA, 18 nt, Staphylococcus aureus subsp. aureus N315
cuguacgauucaauuuaa

SEQ ID NO: 2138885 - RNA, 20 nt, Staphylococcus aureus subsp. aureus N315
cuguaccguauuuuaauauu

SEQ ID NO: 2138886 - RNA, 19 nt, Staphylococcus aureus subsp. aureus N315
cuguaccaucacuaaagua

SEQ ID NO: 2138887 - RNA, 19 nt, Staphylococcus aureus subsp. aureus N315
cuguacauccacuuuauaa

SEQ ID NO: 2138888 - RNA, 20 nt, Staphylococcus aureus subsp. aureus N315
cuguaacaaagucucuagua

SEQ ID NO: 2138889 - RNA, 17 nt, Staphylococcus aureus subsp. aureus N315
cuguaacgaguccauuu

SEQ ID NO: 2138890 - RNA, 23 nt, Staphylococcus aureus subsp. aureus N315
cuguaacgaguccauuuucuuuu

SEQ ID NO: 2138891 - RNA, 15 nt, Staphylococcus aureus subsp. aureus N315
cuguaauaauuauua

SEQ ID NO: 2138892 - RNA, 19 nt, Staphylococcus aureus subsp. aureus N315
cuguaauaauuauuaauaa

SEQ ID NO: 2138893 - RNA, 15 nt, Staphylococcus aureus subsp. aureus N315
cugguugauaaauaa

SEQ ID NO: 2138894 - RNA, 14 nt, Staphylococcus aureus subsp. aureus N315
cuuccgcacugccu

SEQ ID NO: 2138895 - RNA, 21 nt, Staphylococcus aureus subsp. aureus N315
cuuccuccgccaucaauauuu

SEQ ID NO: 2138896 - RNA, 19 nt, Staphylococcus aureus subsp. aureus N315
cuucccagucaugucccau

SEQ ID NO: 2138897 - RNA, 14 nt, Staphylococcus aureus subsp. aureus N315
cuucccaaggaagu

SEQ ID NO: 2138898 - RNA, 22 nt, Staphylococcus aureus subsp. aureus N315
cuucccaucuuuuagguaauaa

SEQ ID NO: 2138899 - RNA, 14 nt, Staphylococcus aureus subsp. aureus N315
cuuccaauuuaaaa

SEQ ID NO: 2138900 - RNA, 10 nt, Staphylococcus aureus subsp. aureus N315
aaacuuauaa

SEQ ID NO: 2138901 - RNA, 18 nt, Staphylococcus aureus subsp. aureus N315
aaacuuauaaaucaaagu

SEQ ID NO: 2138902 - RNA, 15 nt, Staphylococcus aureus subsp. aureus N315
aaacuuauaacuuua

SEQ ID NO: 2138903 - RNA, 23 nt, Staphylococcus aureus subsp. aureus N315
aaacuuacauuacauauaucaac

SEQ ID NO: 2138904 - RNA, 14 nt, Staphylococcus aureus subsp. aureus N315
aaacuuaagaauac

SEQ ID NO: 2138905 - RNA, 19 nt, Staphylococcus aureus subsp. aureus N315
cuuccaauacuguugucuu

SEQ ID NO: 2138906 - RNA, 21 nt, Staphylococcus aureus subsp. aureus N315
cuuccaauaaccccugucacu

SEQ ID NO: 2138907 - RNA, 16 nt, Staphylococcus aureus subsp. aureus N315
cuuccaauaauaaauc

SEQ ID NO: 2138908 - RNA, 19 nt, Staphylococcus aureus subsp. aureus N315
cuuccaauaaccccuguca

SEQ ID NO: 2138909 - RNA, 14 nt, Staphylococcus aureus subsp. aureus N315
aaacuuauuugcca

SEQ ID NO: 2138910 - RNA, 15 nt, Staphylococcus aureus subsp. aureus N315
cuucaauuuaaugua

SEQ ID NO: 2138911 - RNA, 24 nt, Staphylococcus aureus subsp. aureus N315
cuucaauauucuuaucauucauua

SEQ ID NO: 2138912 - RNA, 19 nt, Staphylococcus aureus subsp. aureus N315
cuucaauaucuucagcuaa

SEQ ID NO: 2138913 - RNA, 18 nt, Staphylococcus aureus subsp. aureus N315
cuucacacuuuuagaauc

SEQ ID NO: 2138914 - RNA, 23 nt, Staphylococcus aureus subsp. aureus N315
cuucaaaguuuucauuuuuucaa

SEQ ID NO: 2138915 - RNA, 20 nt, Staphylococcus aureus subsp. aureus N315
cuucaaaguuuucauuuuuu

SEQ ID NO: 2138916 - RNA, 21 nt, Staphylococcus aureus subsp. aureus N315
cuuauucgcaccacuggccuu

SEQ ID NO: 2138917 - RNA, 13 nt, Staphylococcus aureus subsp. aureus N315
cuucaacauaacu

SEQ ID NO: 2138918 - RNA, 17 nt, Staphylococcus aureus subsp. aureus N315
cuucaaauguaacauua

SEQ ID NO: 2138919 - RNA, 14 nt, Staphylococcus aureus subsp. aureus N315
cuucaaguuguuuu

SEQ ID NO: 2138920 - RNA, 15 nt, Staphylococcus aureus subsp. aureus N315
cuucauauuuugccu

SEQ ID NO: 2138921 - RNA, 15 nt, Staphylococcus aureus subsp. aureus N315
cuucauaguucaaau

SEQ ID NO: 2138922 - RNA, 22 nt, Staphylococcus aureus subsp. aureus N315
cuucauaguucaaauugaacuu

SEQ ID NO: 2138923 - RNA, 14 nt, Staphylococcus aureus subsp. aureus N315
cuuaauuuaaaucu

SEQ ID NO: 2138924 - RNA, 17 nt, Staphylococcus aureus subsp. aureus N315
cuuaauuuguuuuaaau

SEQ ID NO: 2138925 - RNA, 15 nt, Staphylococcus aureus subsp. aureus N315
cuuaauuuguuuuaa

SEQ ID NO: 2138926 - RNA, 18 nt, Staphylococcus aureus subsp. aureus N315
cuuaauucuucaucaaua

SEQ ID NO: 2138927 - RNA, 12 nt, Staphylococcus aureus subsp. aureus N315
cuuaauucuuca

SEQ ID NO: 2138928 - RNA, 21 nt, Staphylococcus aureus subsp. aureus N315
cuuaauucuucaucaauaacu

SEQ ID NO: 2138929 - RNA, 21 nt, Staphylococcus aureus subsp. aureus N315
cuuaaguaagauuuaaacauc

SEQ ID NO: 2138930 - RNA, 21 nt, Staphylococcus aureus subsp. aureus N315
cuuaagcuuuaaucauagcau

SEQ ID NO: 2138931 - RNA, 18 nt, Staphylococcus aureus subsp. aureus N315
cuuaagaaauuuuuucua

SEQ ID NO: 2138932 - RNA, 15 nt, Staphylococcus aureus subsp. aureus N315
cuuacaauaaagaca

SEQ ID NO: 2138933 - RNA, 14 nt, Staphylococcus aureus subsp. aureus N315
cuuacaauaaucac

SEQ ID NO: 2138934 - RNA, 15 nt, Staphylococcus aureus subsp. aureus N315
cuuacaacuuuaguu

SEQ ID NO: 2138935 - RNA, 14 nt, Staphylococcus aureus subsp. aureus N315
cuuacaaauauacu

SEQ ID NO: 2138936 - RNA, 14 nt, Staphylococcus aureus subsp. aureus N315
cuuacaauaaagac

SEQ ID NO: 2138937 - RNA, 20 nt, Staphylococcus aureus subsp. aureus N315
cuuacuaaguaaccaagucu

SEQ ID NO: 2138938 - RNA, 15 nt, Staphylococcus aureus subsp. aureus N315
cuuaucuguaaauaa

SEQ ID NO: 2138939 - RNA, 18 nt, Staphylococcus aureus subsp. aureus N315
cuuaucuguaaauaacuu

SEQ ID NO: 2138940 - RNA, 22 nt, Staphylococcus aureus subsp. aureus N315
cuuaucuguaaauaacuuaugg

SEQ ID NO: 2138941 - RNA, 13 nt, Staphylococcus aureus subsp. aureus N315
cuuauuauuuugu

SEQ ID NO: 2138942 - RNA, 14 nt, Staphylococcus aureus subsp. aureus N315
cuuaugagcaaagc

SEQ ID NO: 2138943 - RNA, 20 nt, Staphylococcus aureus subsp. aureus N315
cuuaucaguuugcacuucaa

SEQ ID NO: 2138944 - RNA, 18 nt, Staphylococcus aureus subsp. aureus N315
cuuaucauuucaaauaag

SEQ ID NO: 2138945 - RNA, 15 nt, Staphylococcus aureus subsp. aureus N315
cuuaucauuucaaau

SEQ ID NO: 2138946 - RNA, 14 nt, Staphylococcus aureus subsp. aureus N315
cuuaucauuacuug

SEQ ID NO: 2138947 - RNA, 19 nt, Staphylococcus aureus subsp. aureus N315
cuuaucuaaaucuucauca

SEQ ID NO: 2138948 - RNA, 14 nt, Staphylococcus aureus subsp. aureus N315
cuuauaacauucuu

SEQ ID NO: 2138949 - RNA, 21 nt, Staphylococcus aureus subsp. aureus N315
cuuauaaagacaccuucaaua

SEQ ID NO: 2138950 - RNA, 22 nt, Staphylococcus aureus subsp. aureus N315
cuuauaaacaaaagaucgauac

SEQ ID NO: 2138951 - RNA, 15 nt, Staphylococcus aureus subsp. aureus N315
cuuauaaacaaaaga

SEQ ID NO: 2138952 - RNA, 17 nt, Staphylococcus aureus subsp. aureus N315
cuuauaacaaaaauugc

SEQ ID NO: 2138953 - RNA, 20 nt, Staphylococcus aureus subsp. aureus N315
cuuauacacuuacaaauauu

SEQ ID NO: 2138954 - RNA, 14 nt, Staphylococcus aureus subsp. aureus N315
cuuagaauuuacaa

SEQ ID NO: 2138955 - RNA, 17 nt, Staphylococcus aureus subsp. aureus N315
cuuaguuugacaucuau

SEQ ID NO: 2138956 - RNA, 13 nt, Staphylococcus aureus subsp. aureus N315
cuuauaaaauaaa

SEQ ID NO: 2138957 - RNA, 15 nt, Staphylococcus aureus subsp. aureus N315
cuuauaaaaugaaau

SEQ ID NO: 2138958 - RNA, 19 nt, Staphylococcus aureus subsp. aureus N315
cuuauaaaaugaaauauuu

SEQ ID NO: 2138959 - RNA, 19 nt, Staphylococcus aureus subsp. aureus N315
cuuaguuugacaucuauuu

SEQ ID NO: 2138960 - RNA, 14 nt, Staphylococcus aureus subsp. aureus N315
cuuauaaaaaacaa

SEQ ID NO: 2138961 - RNA, 19 nt, Staphylococcus aureus subsp. aureus N315
cuuagacgcuguuuuaaau

SEQ ID NO: 2138962 - RNA, 18 nt, Staphylococcus aureus subsp. aureus N315
cuguuuuaucuacaguuu

SEQ ID NO: 2138963 - RNA, 19 nt, Staphylococcus aureus subsp. aureus N315
cuguuuugcgguuuuuuug

SEQ ID NO: 2138964 - RNA, 18 nt, Staphylococcus aureus subsp. aureus N315
cuuaaaccuaacauaacu

SEQ ID NO: 2138965 - RNA, 17 nt, Staphylococcus aureus subsp. aureus N315
aaacugugcaugacgau

SEQ ID NO: 2138966 - RNA, 13 nt, Staphylococcus aureus subsp. aureus N315
aaacuuaaaacua

SEQ ID NO: 2138967 - RNA, 23 nt, Staphylococcus aureus subsp. aureus N315
aaacuuaaauauucuuaucugua

SEQ ID NO: 2138968 - RNA, 14 nt, Staphylococcus aureus subsp. aureus N315
cuuaacuuccuuuu

SEQ ID NO: 2138969 - RNA, 15 nt, Staphylococcus aureus subsp. aureus N315
cuuaacucaaagaaa

SEQ ID NO: 2138970 - RNA, 13 nt, Staphylococcus aureus subsp. aureus N315
cuguuugcuuuau

SEQ ID NO: 2138971 - RNA, 16 nt, Staphylococcus aureus subsp. aureus N315
cuguugcauuaagugc

SEQ ID NO: 2138972 - RNA, 20 nt, Staphylococcus aureus subsp. aureus N315
cuguuggaauaccuuuuucu

SEQ ID NO: 2138973 - RNA, 16 nt, Staphylococcus aureus subsp. aureus N315
cuguuggcaaaacaau

SEQ ID NO: 2138974 - RNA, 17 nt, Staphylococcus aureus subsp. aureus N315
cuguguaaaauaaauca

SEQ ID NO: 2138975 - RNA, 13 nt, Staphylococcus aureus subsp. aureus N315
cuguguaucauca

SEQ ID NO: 2138976 - RNA, 18 nt, Staphylococcus aureus subsp. aureus N315
cuguguaaaauaaaucau

SEQ ID NO: 2138977 - RNA, 14 nt, Staphylococcus aureus subsp. aureus N315
cuguuaauaaauca

SEQ ID NO: 2138978 - RNA, 22 nt, Staphylococcus aureus subsp. aureus N315
cuguuaaacgcugauuuuauaa

SEQ ID NO: 2138979 - RNA, 21 nt, Staphylococcus aureus subsp. aureus N315
cuguguuggggcccacacccc

SEQ ID NO: 2138980 - RNA, 16 nt, Staphylococcus aureus subsp. aureus N315
cuguguuggggcccac

SEQ ID NO: 2138981 - RNA, 15 nt, Staphylococcus aureus subsp. aureus N315
cuguuaauguuccaa

SEQ ID NO: 2138982 - RNA, 16 nt, Staphylococcus aureus subsp. aureus N315
cuguuacacuuuucuu

SEQ ID NO: 2138983 - RNA, 21 nt, Staphylococcus aureus subsp. aureus N315
cuguucucuauuuauacaaua

SEQ ID NO: 2138984 - RNA, 13 nt, Staphylococcus aureus subsp. aureus N315
cuguucuauucca

SEQ ID NO: 2138985 - RNA, 22 nt, Staphylococcus aureus subsp. aureus N315
aaacucguugcacucuuuucuc

SEQ ID NO: 2138986 - RNA, 14 nt, Staphylococcus aureus subsp. aureus N315
aaacucauuuauaa

SEQ ID NO: 2138987 - RNA, 20 nt, Staphylococcus aureus subsp. aureus N315
aaacucaugcauaagaaaua

SEQ ID NO: 2138988 - RNA, 12 nt, Staphylococcus aureus subsp. aureus N315
cuggcuuuuuaa

SEQ ID NO: 2138989 - RNA, 18 nt, Staphylococcus aureus subsp. aureus N315
cuggaacuuuaauaccag

SEQ ID NO: 2138990 - RNA, 18 nt, Staphylococcus aureus subsp. aureus N315
cugcuucuacccuugcaa

SEQ ID NO: 2138991 - RNA, 17 nt, Staphylococcus aureus subsp. aureus N315
cugcuucuacccuugca

SEQ ID NO: 2138992 - RNA, 21 nt, Staphylococcus aureus subsp. aureus N315
cugcuucuucagguguuuuac

SEQ ID NO: 2138993 - RNA, 22 nt, Staphylococcus aureus subsp. aureus N315
cugcuguucuuuuuauuuacuc

SEQ ID NO: 2138994 - RNA, 14 nt, Staphylococcus aureus subsp. aureus N315
cugcuguacguuua

SEQ ID NO: 2138995 - RNA, 20 nt, Staphylococcus aureus subsp. aureus N315
cugcugguaacucuucagua

SEQ ID NO: 2138996 - RNA, 14 nt, Staphylococcus aureus subsp. aureus N315
cuggaauaccuaac

SEQ ID NO: 2138997 - RNA, 18 nt, Staphylococcus aureus subsp. aureus N315
cuggaauauuaacaccag

SEQ ID NO: 2138998 - RNA, 18 nt, Staphylococcus aureus subsp. aureus N315
aaacuauaauaauuggaa

SEQ ID NO: 2138999 - RNA, 21 nt, Staphylococcus aureus subsp. aureus N315
aaacuauaauaauuggaauca

SEQ ID NO: 2139000 - RNA, 19 nt, Staphylococcus aureus subsp. aureus N315
aaacuauaauaaagauuau

SEQ ID NO: 2139001 - RNA, 22 nt, Staphylococcus aureus subsp. aureus N315
aaacuauuaucgaagaaacauu

SEQ ID NO: 2139002 - RNA, 20 nt, Staphylococcus aureus subsp. aureus N315
cugcuaauuuuuucaucauu

SEQ ID NO: 2139003 - RNA, 21 nt, Staphylococcus aureus subsp. aureus N315
cugcuaauuuuuucaucauuc

SEQ ID NO: 2139004 - RNA, 15 nt, Staphylococcus aureus subsp. aureus N315
cugcuaauuuuuuca

SEQ ID NO: 2139005 - RNA, 17 nt, Staphylococcus aureus subsp. aureus N315
cugcuaguucagcuucu

SEQ ID NO: 2139006 - RNA, 15 nt, Staphylococcus aureus subsp. aureus N315
cugccauuaaacgaa

SEQ ID NO: 2139007 - RNA, 19 nt, Staphylococcus aureus subsp. aureus N315
cugcccuuuagucauguuu

SEQ ID NO: 2139008 - RNA, 17 nt, Staphylococcus aureus subsp. aureus N315
cugcagcaauuacaccu

SEQ ID NO: 2139009 - RNA, 23 nt, Staphylococcus aureus subsp. aureus N315
cugcauauucacgauauaacauu

SEQ ID NO: 2139010 - RNA, 18 nt, Staphylococcus aureus subsp. aureus N315
cugcaccgauaucauaua

SEQ ID NO: 2139011 - RNA, 15 nt, Staphylococcus aureus subsp. aureus N315
cugcacauuccaucu

SEQ ID NO: 2139012 - RNA, 17 nt, Staphylococcus aureus subsp. aureus N315
cugcacaucauaauaaa

SEQ ID NO: 2139013 - RNA, 20 nt, Staphylococcus aureus subsp. aureus N315
cugcaacauuugauaaccaa

SEQ ID NO: 2139014 - RNA, 15 nt, Staphylococcus aureus subsp. aureus N315
cugauuuuguuucaa

SEQ ID NO: 2139015 - RNA, 19 nt, Staphylococcus aureus subsp. aureus N315
cugacuuuuaaaaaacaua

SEQ ID NO: 2139016 - RNA, 12 nt, Staphylococcus aureus subsp. aureus N315
cugacuuuccac

SEQ ID NO: 2139017 - RNA, 18 nt, Staphylococcus aureus subsp. aureus N315
cugagcuuuaauuuuuug

SEQ ID NO: 2139018 - RNA, 16 nt, Staphylococcus aureus subsp. aureus N315
cugaugaacauaccug

SEQ ID NO: 2139019 - RNA, 22 nt, Staphylococcus aureus subsp. aureus N315
cugauguaccacucauaaucaa

SEQ ID NO: 2139020 - RNA, 22 nt, Staphylococcus aureus subsp. aureus N315
cugaugcuucgaauuuaacauc

SEQ ID NO: 2139021 - RNA, 16 nt, Staphylococcus aureus subsp. aureus N315
cugauuaauuauugag

SEQ ID NO: 2139022 - RNA, 18 nt, Staphylococcus aureus subsp. aureus N315
cugauuauguucagaacu

SEQ ID NO: 2139023 - RNA, 19 nt, Staphylococcus aureus subsp. aureus N315
cugaauuaauauccaaaau

SEQ ID NO: 2139024 - RNA, 13 nt, Staphylococcus aureus subsp. aureus N315
cucuaauuucaca

SEQ ID NO: 2139025 - RNA, 14 nt, Staphylococcus aureus subsp. aureus N315
cugaauaaaauaua

SEQ ID NO: 2139026 - RNA, 13 nt, Staphylococcus aureus subsp. aureus N315
cguucauauauuu

SEQ ID NO: 2139027 - RNA, 14 nt, Staphylococcus aureus subsp. aureus N315
cguucauauauuuu

SEQ ID NO: 2139028 - RNA, 15 nt, Staphylococcus aureus subsp. aureus N315
cguucccauucuuug

SEQ ID NO: 2139029 - RNA, 14 nt, Staphylococcus aureus subsp. aureus N315
cguucaucuaauuu

SEQ ID NO: 2139030 - RNA, 16 nt, Staphylococcus aureus subsp. aureus N315
cguuauuuucaauaaa

SEQ ID NO: 2139031 - RNA, 19 nt, Staphylococcus aureus subsp. aureus N315
cguucaagaacaaucaaua

SEQ ID NO: 2139032 - RNA, 13 nt, Staphylococcus aureus subsp. aureus N315
cguuauucauuug

SEQ ID NO: 2139033 - RNA, 17 nt, Staphylococcus aureus subsp. aureus N315
cguuaauaauuuguuuu

SEQ ID NO: 2139034 - RNA, 15 nt, Staphylococcus aureus subsp. aureus N315
cguuaauaucaugcu

SEQ ID NO: 2139035 - RNA, 17 nt, Staphylococcus aureus subsp. aureus N315
cguuaauaucaugcuua

SEQ ID NO: 2139036 - RNA, 17 nt, Staphylococcus aureus subsp. aureus N315
cguggauguguuuuaau

SEQ ID NO: 2139037 - RNA, 18 nt, Staphylococcus aureus subsp. aureus N315
cuaaaaguuguaauuuaa

SEQ ID NO: 2139038 - RNA, 17 nt, Staphylococcus aureus subsp. aureus N315
cuaaaaguuucccaagc

SEQ ID NO: 2139039 - RNA, 22 nt, Staphylococcus aureus subsp. aureus N315
cuaaaaguuguaauuuaaaaua

SEQ ID NO: 2139040 - RNA, 21 nt, Staphylococcus aureus subsp. aureus N315
cuaaaaguuguaauuuaaaau

SEQ ID NO: 2139041 - RNA, 16 nt, Staphylococcus aureus subsp. aureus N315
cuaaaauucuuucagc

SEQ ID NO: 2139042 - RNA, 13 nt, Staphylococcus aureus subsp. aureus N315
cuaaaauaaaauu

SEQ ID NO: 2139043 - RNA, 21 nt, Staphylococcus aureus subsp. aureus N315
cuaaaauuugcucgugaaaag

SEQ ID NO: 2139044 - RNA, 18 nt, Staphylococcus aureus subsp. aureus N315
cuaaacaaugaugggaaa

SEQ ID NO: 2139045 - RNA, 19 nt, Staphylococcus aureus subsp. aureus N315
cuaaacauuuuauacucug

SEQ ID NO: 2139046 - RNA, 20 nt, Staphylococcus aureus subsp. aureus N315
cuaaacauuuuugugcaaaa

SEQ ID NO: 2139047 - RNA, 21 nt, Staphylococcus aureus subsp. aureus N315
cuaaaacggaaauaaccacca

SEQ ID NO: 2139048 - RNA, 12 nt, Staphylococcus aureus subsp. aureus N315
cuaaaaaacuaa

SEQ ID NO: 2139049 - RNA, 13 nt, Staphylococcus aureus subsp. aureus N315
cuaaaaaaauuaa

SEQ ID NO: 2139050 - RNA, 15 nt, Staphylococcus aureus subsp. aureus N315
cguuuuagacauaaa

SEQ ID NO: 2139051 - RNA, 14 nt, Staphylococcus aureus subsp. aureus N315
cguuuuuaaauaau

SEQ ID NO: 2139052 - RNA, 13 nt, Staphylococcus aureus subsp. aureus N315
cguuuuguagaua

SEQ ID NO: 2139053 - RNA, 17 nt, Staphylococcus aureus subsp. aureus N315
cguuuuuuuaaauacau

SEQ ID NO: 2139054 - RNA, 23 nt, Staphylococcus aureus subsp. aureus N315
cguuguucauaaucauaauaaga

SEQ ID NO: 2139055 - RNA, 18 nt, Staphylococcus aureus subsp. aureus N315
cguuuguguguuuuaaaa

SEQ ID NO: 2139056 - RNA, 17 nt, Staphylococcus aureus subsp. aureus N315
cguuuguguguuuuaaa

SEQ ID NO: 2139057 - RNA, 23 nt, Staphylococcus aureus subsp. aureus N315
cguuuuaauucaucaauaaggca

SEQ ID NO: 2139058 - RNA, 20 nt, Staphylococcus aureus subsp. aureus N315
cguugugcagcaacugcauu

SEQ ID NO: 2139059 - RNA, 17 nt, Staphylococcus aureus subsp. aureus N315
cuaaucguguauuauug

SEQ ID NO: 2139060 - RNA, 19 nt, Staphylococcus aureus subsp. aureus N315
cuaauccucacuaacucaa

SEQ ID NO: 2139061 - RNA, 22 nt, Staphylococcus aureus subsp. aureus N315
cuaaucguguauuauugaaacu

SEQ ID NO: 2139062 - RNA, 16 nt, Staphylococcus aureus subsp. aureus N315
cuaaucgcauuuuuua

SEQ ID NO: 2139063 - RNA, 14 nt, Staphylococcus aureus subsp. aureus N315
cuaaucucagauuu

SEQ ID NO: 2139064 - RNA, 21 nt, Staphylococcus aureus subsp. aureus N315
cuaaucguuaauaaaccuaca

SEQ ID NO: 2139065 - RNA, 19 nt, Staphylococcus aureus subsp. aureus N315
cuaaugcauuauuauaaua

SEQ ID NO: 2139066 - RNA, 19 nt, Staphylococcus aureus subsp. aureus N315
cuaaugcacgugagaaacu

SEQ ID NO: 2139067 - RNA, 17 nt, Staphylococcus aureus subsp. aureus N315
cuaaugcuaauuuaacu

SEQ ID NO: 2139068 - RNA, 22 nt, Staphylococcus aureus subsp. aureus N315
cuaaugagcccguuaaaaagac

SEQ ID NO: 2139069 - RNA, 21 nt, Staphylococcus aureus subsp. aureus N315
cuaaugagcccguuaaaaaga

SEQ ID NO: 2139070 - RNA, 18 nt, Staphylococcus aureus subsp. aureus N315
cuaaugauuaaaaaucaa

SEQ ID NO: 2139071 - RNA, 22 nt, Staphylococcus aureus subsp. aureus N315
cuaaugauuaaaaaucaaagag

SEQ ID NO: 2139072 - RNA, 15 nt, Staphylococcus aureus subsp. aureus N315
cuaauauuuuaaacg

SEQ ID NO: 2139073 - RNA, 16 nt, Staphylococcus aureus subsp. aureus N315
cuaauauuuuaaacgu

SEQ ID NO: 2139074 - RNA, 12 nt, Staphylococcus aureus subsp. aureus N315
cuaaucaauacu

SEQ ID NO: 2139075 - RNA, 14 nt, Staphylococcus aureus subsp. aureus N315
cuaaucaauacuaa

SEQ ID NO: 2139076 - RNA, 15 nt, Staphylococcus aureus subsp. aureus N315
cuaauauuucuuaga

SEQ ID NO: 2139077 - RNA, 19 nt, Staphylococcus aureus subsp. aureus N315
cuaaucaugaaguugguuu

SEQ ID NO: 2139078 - RNA, 18 nt, Staphylococcus aureus subsp. aureus N315
cuaauauuagauaucuua

SEQ ID NO: 2139079 - RNA, 24 nt, Staphylococcus aureus subsp. aureus N315
cuaauauuagauaucuuaaucuaa

SEQ ID NO: 2139080 - RNA, 13 nt, Staphylococcus aureus subsp. aureus N315
cuaauaugucuag

SEQ ID NO: 2139081 - RNA, 14 nt, Staphylococcus aureus subsp. aureus N315
cuaauaucaauaau

SEQ ID NO: 2139082 - RNA, 22 nt, Staphylococcus aureus subsp. aureus N315
cuaauaucaucuuguuguucug

SEQ ID NO: 2139083 - RNA, 15 nt, Staphylococcus aureus subsp. aureus N315
cuaauauauuaauuu

SEQ ID NO: 2139084 - RNA, 14 nt, Staphylococcus aureus subsp. aureus N315
cuaauagcauuugu

SEQ ID NO: 2139085 - RNA, 18 nt, Staphylococcus aureus subsp. aureus N315
cuaauacuuucacuuuuu

SEQ ID NO: 2139086 - RNA, 22 nt, Staphylococcus aureus subsp. aureus N315
cuaauacauacggcaaauucaa

SEQ ID NO: 2139087 - RNA, 13 nt, Staphylococcus aureus subsp. aureus N315
cuaauacaaaaca

SEQ ID NO: 2139088 - RNA, 14 nt, Staphylococcus aureus subsp. aureus N315
cuaauacaaaacaa

SEQ ID NO: 2139089 - RNA, 15 nt, Staphylococcus aureus subsp. aureus N315
cuaauacaaaacaaa

SEQ ID NO: 2139090 - RNA, 23 nt, Staphylococcus aureus subsp. aureus N315
cuaauacacuugauaaaacuaau

SEQ ID NO: 2139091 - RNA, 19 nt, Staphylococcus aureus subsp. aureus N315
cuaauaauuuguaauuccu

SEQ ID NO: 2139092 - RNA, 14 nt, Staphylococcus aureus subsp. aureus N315
cuaauaauaaaaua

SEQ ID NO: 2139093 - RNA, 23 nt, Staphylococcus aureus subsp. aureus N315
cuacaacgaagaauccuaugcca

SEQ ID NO: 2139094 - RNA, 23 nt, Staphylococcus aureus subsp. aureus N315
cuacaaaguuuauacuuaauaua

SEQ ID NO: 2139095 - RNA, 13 nt, Staphylococcus aureus subsp. aureus N315
cuaauuuuuucau

SEQ ID NO: 2139096 - RNA, 11 nt, Staphylococcus aureus subsp. aureus N315
cuaauuuauaa

SEQ ID NO: 2139097 - RNA, 22 nt, Staphylococcus aureus subsp. aureus N315
cuaauuucuaauacauacugau

SEQ ID NO: 2139098 - RNA, 18 nt, Staphylococcus aureus subsp. aureus N315
cuaauuucuauagaaaaa

SEQ ID NO: 2139099 - RNA, 12 nt, Staphylococcus aureus subsp. aureus N315
cuaauuucacaa

SEQ ID NO: 2139100 - RNA, 12 nt, Staphylococcus aureus subsp. aureus N315
cuaauuuuaauu

SEQ ID NO: 2139101 - RNA, 20 nt, Staphylococcus aureus subsp. aureus N315
cuaauuuugugaauuuauuu

SEQ ID NO: 2139102 - RNA, 17 nt, Staphylococcus aureus subsp. aureus N315
cuaauuuuaauuuucag

SEQ ID NO: 2139103 - RNA, 18 nt, Staphylococcus aureus subsp. aureus N315
cuaauuuuaauuuucaga

SEQ ID NO: 2139104 - RNA, 18 nt, Staphylococcus aureus subsp. aureus N315
cuaaugguuucauaaacu

SEQ ID NO: 2139105 - RNA, 18 nt, Staphylococcus aureus subsp. aureus N315
cuaaugucgcacuauaaa

SEQ ID NO: 2139106 - RNA, 20 nt, Staphylococcus aureus subsp. aureus N315
cuaauguguacuuaaaaaua

SEQ ID NO: 2139107 - RNA, 13 nt, Staphylococcus aureus subsp. aureus N315
cuaauuauauuaa

SEQ ID NO: 2139108 - RNA, 22 nt, Staphylococcus aureus subsp. aureus N315
cuaauuagguauaguguuugac

SEQ ID NO: 2139109 - RNA, 14 nt, Staphylococcus aureus subsp. aureus N315
cuaauucgccaucu

SEQ ID NO: 2139110 - RNA, 15 nt, Staphylococcus aureus subsp. aureus N315
cuaauucaagaacag

SEQ ID NO: 2139111 - RNA, 20 nt, Staphylococcus aureus subsp. aureus N315
cuaauucuugagcaaugucu

SEQ ID NO: 2139112 - RNA, 19 nt, Staphylococcus aureus subsp. aureus N315
cuaauucgccaucuuuuuu

SEQ ID NO: 2139113 - RNA, 20 nt, Staphylococcus aureus subsp. aureus N315
cuaauucuguuucaaagcug

SEQ ID NO: 2139114 - RNA, 13 nt, Staphylococcus aureus subsp. aureus N315
cuaauucuguuuc

SEQ ID NO: 2139115 - RNA, 16 nt, Staphylococcus aureus subsp. aureus N315
cuaauugagagaaguu

SEQ ID NO: 2139116 - RNA, 12 nt, Staphylococcus aureus subsp. aureus N315
cuaagaaccuuu

SEQ ID NO: 2139117 - RNA, 17 nt, Staphylococcus aureus subsp. aureus N315
cuaagauacuuuuaaau

SEQ ID NO: 2139118 - RNA, 17 nt, Staphylococcus aureus subsp. aureus N315
cuaagaguugaaauacu

SEQ ID NO: 2139119 - RNA, 20 nt, Staphylococcus aureus subsp. aureus N315
cuaagcucguuaauuuuauu

SEQ ID NO: 2139120 - RNA, 21 nt, Staphylococcus aureus subsp. aureus N315
cuaagcaucguaaaaaacaaa

SEQ ID NO: 2139121 - RNA, 15 nt, Staphylococcus aureus subsp. aureus N315
cuaaguguuuuauag

SEQ ID NO: 2139122 - RNA, 19 nt, Staphylococcus aureus subsp. aureus N315
cuaagucuuuuaaaugaug

SEQ ID NO: 2139123 - RNA, 15 nt, Staphylococcus aureus subsp. aureus N315
cuaaguuaugacuaa

SEQ ID NO: 2139124 - RNA, 16 nt, Staphylococcus aureus subsp. aureus N315
cuaaguuaauuuaucg

SEQ ID NO: 2139125 - RNA, 15 nt, Staphylococcus aureus subsp. aureus N315
cuaaguuaauuuauc

SEQ ID NO: 2139126 - RNA, 13 nt, Staphylococcus aureus subsp. aureus N315
cuaaguuugaauc

SEQ ID NO: 2139127 - RNA, 18 nt, Staphylococcus aureus subsp. aureus N315
cuaaggacuuuaugcccu

SEQ ID NO: 2139128 - RNA, 15 nt, Staphylococcus aureus subsp. aureus N315
cuaaggacuuuaugc

SEQ ID NO: 2139129 - RNA, 17 nt, Staphylococcus aureus subsp. aureus N315
cuaaguaaccaagucua

SEQ ID NO: 2139130 - RNA, 18 nt, Staphylococcus aureus subsp. aureus N315
cuaagguuguucuauaca

SEQ ID NO: 2139131 - RNA, 14 nt, Staphylococcus aureus subsp. aureus N315
cuaagguuguucua

SEQ ID NO: 2139132 - RNA, 21 nt, Staphylococcus aureus subsp. aureus N315
cuaacaauuugaggauacaua

SEQ ID NO: 2139133 - RNA, 18 nt, Staphylococcus aureus subsp. aureus N315
cuaaaccucuaaauaaaa

SEQ ID NO: 2139134 - RNA, 15 nt, Staphylococcus aureus subsp. aureus N315
cuaaaccauugaaug

SEQ ID NO: 2139135 - RNA, 23 nt, Staphylococcus aureus subsp. aureus N315
cuaaaccaaugauuguuaauaca

SEQ ID NO: 2139136 - RNA, 16 nt, Staphylococcus aureus subsp. aureus N315
cuaaaccucuaaauaa

SEQ ID NO: 2139137 - RNA, 15 nt, Staphylococcus aureus subsp. aureus N315
cuaaaccucuaaaua

SEQ ID NO: 2139138 - RNA, 19 nt, Staphylococcus aureus subsp. aureus N315
cuaaaccgauuaauauaau

SEQ ID NO: 2139139 - RNA, 19 nt, Staphylococcus aureus subsp. aureus N315
cuaaacauugcuuaacuuc

SEQ ID NO: 2139140 - RNA, 14 nt, Staphylococcus aureus subsp. aureus N315
cuaacucaccugca

SEQ ID NO: 2139141 - RNA, 20 nt, Staphylococcus aureus subsp. aureus N315
cuaacucauaaucaacaugu

SEQ ID NO: 2139142 - RNA, 22 nt, Staphylococcus aureus subsp. aureus N315
cuaacucugaucuaaaaccaua

SEQ ID NO: 2139143 - RNA, 18 nt, Staphylococcus aureus subsp. aureus N315
cuaacuaaguauaguguu

SEQ ID NO: 2139144 - RNA, 13 nt, Staphylococcus aureus subsp. aureus N315
cuaacguuuuaaa

SEQ ID NO: 2139145 - RNA, 14 nt, Staphylococcus aureus subsp. aureus N315
cuaacuauauugug

SEQ ID NO: 2139146 - RNA, 12 nt, Staphylococcus aureus subsp. aureus N315
cuaacuauauug

SEQ ID NO: 2139147 - RNA, 16 nt, Staphylococcus aureus subsp. aureus N315
cuaaccuauuaaaaua

SEQ ID NO: 2139148 - RNA, 22 nt, Staphylococcus aureus subsp. aureus N315
cuaaccuguuugagauauauua

SEQ ID NO: 2139149 - RNA, 15 nt, Staphylococcus aureus subsp. aureus N315
cuaaccuuuucauca

SEQ ID NO: 2139150 - RNA, 22 nt, Staphylococcus aureus subsp. aureus N315
cgugaauucgaugacuuuuuaa

SEQ ID NO: 2139151 - RNA, 17 nt, Staphylococcus aureus subsp. aureus N315
cgucuuguaaacuucuu

SEQ ID NO: 2139152 - RNA, 16 nt, Staphylococcus aureus subsp. aureus N315
cgucuuguaaacuucu

SEQ ID NO: 2139153 - RNA, 12 nt, Staphylococcus aureus subsp. aureus N315
cgugaagaaaaa

SEQ ID NO: 2139154 - RNA, 17 nt, Staphylococcus aureus subsp. aureus N315
cgugaagaaaaaaugau

SEQ ID NO: 2139155 - RNA, 17 nt, Staphylococcus aureus subsp. aureus N315
cgucuggcacauuacug

SEQ ID NO: 2139156 - RNA, 16 nt, Staphylococcus aureus subsp. aureus N315
cgugaggcugggacau

SEQ ID NO: 2139157 - RNA, 13 nt, Staphylococcus aureus subsp. aureus N315
cgugauuuuucau

SEQ ID NO: 2139158 - RNA, 17 nt, Staphylococcus aureus subsp. aureus N315
cgugccuuaacuucaua

SEQ ID NO: 2139159 - RNA, 13 nt, Staphylococcus aureus subsp. aureus N315
cgucgugauggcu

SEQ ID NO: 2139160 - RNA, 14 nt, Staphylococcus aureus subsp. aureus N315
cguauuuuaauauu

SEQ ID NO: 2139161 - RNA, 15 nt, Staphylococcus aureus subsp. aureus N315
cguauuuuaaugauu

SEQ ID NO: 2139162 - RNA, 14 nt, Staphylococcus aureus subsp. aureus N315
cgucacucacuuca

SEQ ID NO: 2139163 - RNA, 19 nt, Staphylococcus aureus subsp. aureus N315
cguauauauauauuaaaac

SEQ ID NO: 2139164 - RNA, 18 nt, Staphylococcus aureus subsp. aureus N315
cguacaaagguaauagaa

SEQ ID NO: 2139165 - RNA, 20 nt, Staphylococcus aureus subsp. aureus N315
cguacauuuaugauuguuua

SEQ ID NO: 2139166 - RNA, 20 nt, Staphylococcus aureus subsp. aureus N315
cguacguugauguguugcau

SEQ ID NO: 2139167 - RNA, 14 nt, Staphylococcus aureus subsp. aureus N315
cuaccgcuaaaauu

SEQ ID NO: 2139168 - RNA, 14 nt, Staphylococcus aureus subsp. aureus N315
cuacccuauuuuac

SEQ ID NO: 2139169 - RNA, 13 nt, Staphylococcus aureus subsp. aureus N315
cuacccuauuuua

SEQ ID NO: 2139170 - RNA, 15 nt, Staphylococcus aureus subsp. aureus N315
cuaccuguuggcuuu

SEQ ID NO: 2139171 - RNA, 21 nt, Staphylococcus aureus subsp. aureus N315
cuaccuacuuguucaauacuu

SEQ ID NO: 2139172 - RNA, 20 nt, Staphylococcus aureus subsp. aureus N315
cuacagauuuuaaaaauuca

SEQ ID NO: 2139173 - RNA, 17 nt, Staphylococcus aureus subsp. aureus N315
cuacagauaaagcuucg

SEQ ID NO: 2139174 - RNA, 17 nt, Staphylococcus aureus subsp. aureus N315
cuacaggcaaugcaagu

SEQ ID NO: 2139175 - RNA, 15 nt, Staphylococcus aureus subsp. aureus N315
cuacaguguaugaug

SEQ ID NO: 2139176 - RNA, 17 nt, Staphylococcus aureus subsp. aureus N315
cuacagguaaugcaagu

SEQ ID NO: 2139177 - RNA, 20 nt, Staphylococcus aureus subsp. aureus N315
cuacauuaaagaaaauaucu

SEQ ID NO: 2139178 - RNA, 19 nt, Staphylococcus aureus subsp. aureus N315
cuacaauauuaaaauuaaa

SEQ ID NO: 2139179 - RNA, 21 nt, Staphylococcus aureus subsp. aureus N315
cuacaauuauaaaugauuaaa

SEQ ID NO: 2139180 - RNA, 22 nt, Staphylococcus aureus subsp. aureus N315
cuacaaucauaccggcaaauaa

SEQ ID NO: 2139181 - RNA, 13 nt, Staphylococcus aureus subsp. aureus N315
cuacaauccuaug

SEQ ID NO: 2139182 - RNA, 23 nt, Staphylococcus aureus subsp. aureus N315
cuacagaauggauaccuaaagcu

SEQ ID NO: 2139183 - RNA, 21 nt, Staphylococcus aureus subsp. aureus N315
cuacagaauggauaccuaaag

SEQ ID NO: 2139184 - RNA, 14 nt, Staphylococcus aureus subsp. aureus N315
cuacacuguuuuau

SEQ ID NO: 2139185 - RNA, 14 nt, Staphylococcus aureus subsp. aureus N315
cuacacuuaauaua

SEQ ID NO: 2139186 - RNA, 12 nt, Staphylococcus aureus subsp. aureus N315
cuacacccauuu

SEQ ID NO: 2139187 - RNA, 17 nt, Staphylococcus aureus subsp. aureus N315
cuagagauaacuagaau

SEQ ID NO: 2139188 - RNA, 22 nt, Staphylococcus aureus subsp. aureus N315
cuagcauguuuugagcaauaau

SEQ ID NO: 2139189 - RNA, 14 nt, Staphylococcus aureus subsp. aureus N315
cuagcauaucuuua

SEQ ID NO: 2139190 - RNA, 14 nt, Staphylococcus aureus subsp. aureus N315
cuagaaaguaaugc

SEQ ID NO: 2139191 - RNA, 16 nt, Staphylococcus aureus subsp. aureus N315
cuagaacauugauuau

SEQ ID NO: 2139192 - RNA, 12 nt, Staphylococcus aureus subsp. aureus N315
cuagaauauaac

SEQ ID NO: 2139193 - RNA, 17 nt, Staphylococcus aureus subsp. aureus N315
cuagaauauaacaacua

SEQ ID NO: 2139194 - RNA, 17 nt, Staphylococcus aureus subsp. aureus N315
cuacuaaaaaugcuuua

SEQ ID NO: 2139195 - RNA, 19 nt, Staphylococcus aureus subsp. aureus N315
cuagaaaacauaaauacaa

SEQ ID NO: 2139196 - RNA, 23 nt, Staphylococcus aureus subsp. aureus N315
cuacguguguaguagcaccgauu

SEQ ID NO: 2139197 - RNA, 16 nt, Staphylococcus aureus subsp. aureus N315
cuauaaaauucaccaa

SEQ ID NO: 2139198 - RNA, 23 nt, Staphylococcus aureus subsp. aureus N315
cuauaaaaucaucguauuucaua

SEQ ID NO: 2139199 - RNA, 17 nt, Staphylococcus aureus subsp. aureus N315
cuauaaaaguacuuuaa

SEQ ID NO: 2139200 - RNA, 19 nt, Staphylococcus aureus subsp. aureus N315
cuauaaaaguacuuuaaaa

SEQ ID NO: 2139201 - RNA, 23 nt, Staphylococcus aureus subsp. aureus N315
cuauaaagaaugauuuauaaaaa

SEQ ID NO: 2139202 - RNA, 15 nt, Staphylococcus aureus subsp. aureus N315
cuaguuguuuuauag

SEQ ID NO: 2139203 - RNA, 22 nt, Staphylococcus aureus subsp. aureus N315
cuaguuguuuuauagcauuucu

SEQ ID NO: 2139204 - RNA, 16 nt, Staphylococcus aureus subsp. aureus N315
cuaguuuuuuuuauau

SEQ ID NO: 2139205 - RNA, 20 nt, Staphylococcus aureus subsp. aureus N315
cuauaaaaauuuauucaaaa

SEQ ID NO: 2139206 - RNA, 16 nt, Staphylococcus aureus subsp. aureus N315
cuaguuuguaauaauu

SEQ ID NO: 2139207 - RNA, 14 nt, Staphylococcus aureus subsp. aureus N315
cuauacuuuuaauu

SEQ ID NO: 2139208 - RNA, 18 nt, Staphylococcus aureus subsp. aureus N315
cuauacugaugaaaacuu

SEQ ID NO: 2139209 - RNA, 14 nt, Staphylococcus aureus subsp. aureus N315
cuauaacaaaaucu

SEQ ID NO: 2139210 - RNA, 17 nt, Staphylococcus aureus subsp. aureus N315
cuauaaauacuuuugca

SEQ ID NO: 2139211 - RNA, 21 nt, Staphylococcus aureus subsp. aureus N315
cuauaaauacgucaucuuuau

SEQ ID NO: 2139212 - RNA, 23 nt, Staphylococcus aureus subsp. aureus N315
cuauaaauacgucaucuuuauuu

SEQ ID NO: 2139213 - RNA, 18 nt, Staphylococcus aureus subsp. aureus N315
cuaguagcuagaacagau

SEQ ID NO: 2139214 - RNA, 17 nt, Staphylococcus aureus subsp. aureus N315
cuaggaaauaaaaaaua

SEQ ID NO: 2139215 - RNA, 22 nt, Staphylococcus aureus subsp. aureus N315
cuagucuuuaacuuuaauuaaa

SEQ ID NO: 2139216 - RNA, 17 nt, Staphylococcus aureus subsp. aureus N315
cuagucaggggccccaa

SEQ ID NO: 2139217 - RNA, 18 nt, Staphylococcus aureus subsp. aureus N315
cuaguguucucauuauaa

SEQ ID NO: 2139218 - RNA, 12 nt, Staphylococcus aureus subsp. aureus N315
cuaguucaacuc

SEQ ID NO: 2139219 - RNA, 21 nt, Staphylococcus aureus subsp. aureus N315
cuaguucuaaguguugaccau

SEQ ID NO: 2139220 - RNA, 18 nt, Staphylococcus aureus subsp. aureus N315
cuaguucagcuucuaagu

SEQ ID NO: 2139221 - RNA, 19 nt, Staphylococcus aureus subsp. aureus N315
cucaauuuaguauaaauaa

SEQ ID NO: 2139222 - RNA, 21 nt, Staphylococcus aureus subsp. aureus N315
cucaauuuaguauaaauaaaa

SEQ ID NO: 2139223 - RNA, 23 nt, Staphylococcus aureus subsp. aureus N315
cucaauuuaguauaaauaaaaau

SEQ ID NO: 2139224 - RNA, 14 nt, Staphylococcus aureus subsp. aureus N315
cucaauuuaguaua

SEQ ID NO: 2139225 - RNA, 18 nt, Staphylococcus aureus subsp. aureus N315
cucaauucucuaacuuua

SEQ ID NO: 2139226 - RNA, 22 nt, Staphylococcus aureus subsp. aureus N315
cucaauuaauuuagucauuaca

SEQ ID NO: 2139227 - RNA, 20 nt, Staphylococcus aureus subsp. aureus N315
cucaaagguuuacuauuaaa

SEQ ID NO: 2139228 - RNA, 14 nt, Staphylococcus aureus subsp. aureus N315
cucaaaacaauuua

SEQ ID NO: 2139229 - RNA, 20 nt, Staphylococcus aureus subsp. aureus N315
cucaaaagcuguaguuucaa

SEQ ID NO: 2139230 - RNA, 22 nt, Staphylococcus aureus subsp. aureus N315
cucagccucuuuuuacauugcc

SEQ ID NO: 2139231 - RNA, 11 nt, Staphylococcus aureus subsp. aureus N315
cuauucaacug

SEQ ID NO: 2139232 - RNA, 18 nt, Staphylococcus aureus subsp. aureus N315
cuauuaggauccaauuua

SEQ ID NO: 2139233 - RNA, 18 nt, Staphylococcus aureus subsp. aureus N315
cuauuaggauccaauuca

SEQ ID NO: 2139234 - RNA, 19 nt, Staphylococcus aureus subsp. aureus N315
cuauucauagaccuaugaa

SEQ ID NO: 2139235 - RNA, 17 nt, Staphylococcus aureus subsp. aureus N315
cuauuccguuucauuga

SEQ ID NO: 2139236 - RNA, 22 nt, Staphylococcus aureus subsp. aureus N315
cuauucccaaaaugauugccac

SEQ ID NO: 2139237 - RNA, 16 nt, Staphylococcus aureus subsp. aureus N315
cuauggcacaaaugaa

SEQ ID NO: 2139238 - RNA, 19 nt, Staphylococcus aureus subsp. aureus N315
cuauggcgcaauuuuuaac

SEQ ID NO: 2139239 - RNA, 23 nt, Staphylococcus aureus subsp. aureus N315
cuauggcgcaauuuuuaacaaaa

SEQ ID NO: 2139240 - RNA, 23 nt, Staphylococcus aureus subsp. aureus N315
cuaugcuuagcgaacgcuagcau

SEQ ID NO: 2139241 - RNA, 23 nt, Staphylococcus aureus subsp. aureus N315
cuaugaauuuagcaucaaaaaua

SEQ ID NO: 2139242 - RNA, 19 nt, Staphylococcus aureus subsp. aureus N315
cuaugaagaaaucuauaac

SEQ ID NO: 2139243 - RNA, 21 nt, Staphylococcus aureus subsp. aureus N315
cuaucuguaccguauuuuaau

SEQ ID NO: 2139244 - RNA, 16 nt, Staphylococcus aureus subsp. aureus N315
cuaucuauaaacguca

SEQ ID NO: 2139245 - RNA, 21 nt, Staphylococcus aureus subsp. aureus N315
cuaucguuuauugauagucac

SEQ ID NO: 2139246 - RNA, 22 nt, Staphylococcus aureus subsp. aureus N315
cuaucuccgcuacaauuauaug

SEQ ID NO: 2139247 - RNA, 20 nt, Staphylococcus aureus subsp. aureus N315
cuaucucuuuaguuaaaagu

SEQ ID NO: 2139248 - RNA, 21 nt, Staphylococcus aureus subsp. aureus N315
cuauagccaaaggcaaaaugu

SEQ ID NO: 2139249 - RNA, 19 nt, Staphylococcus aureus subsp. aureus N315
cuauagauaggauauuuuu

SEQ ID NO: 2139250 - RNA, 21 nt, Staphylococcus aureus subsp. aureus N315
cuauagauaggauauuuuuua

SEQ ID NO: 2139251 - RNA, 16 nt, Staphylococcus aureus subsp. aureus N315
cuauagaauuuuucau

SEQ ID NO: 2139252 - RNA, 17 nt, Staphylococcus aureus subsp. aureus N315
cuauuggucauuacuaa

SEQ ID NO: 2139253 - RNA, 20 nt, Staphylococcus aureus subsp. aureus N315
cuauugcagaagaaaacuau

SEQ ID NO: 2139254 - RNA, 21 nt, Staphylococcus aureus subsp. aureus N315
cuauugauauucuaaaaaauu

SEQ ID NO: 2139255 - RNA, 17 nt, Staphylococcus aureus subsp. aureus N315
cuauuuauugagauaga

SEQ ID NO: 2139256 - RNA, 17 nt, Staphylococcus aureus subsp. aureus N315
cuauuucacucuacaau

SEQ ID NO: 2139257 - RNA, 22 nt, Staphylococcus aureus subsp. aureus N315
cuauuucaacaaacauaaauaa

SEQ ID NO: 2139258 - RNA, 14 nt, Staphylococcus aureus subsp. aureus N315
cuauuguaagcuga

SEQ ID NO: 2139259 - RNA, 19 nt, Staphylococcus aureus subsp. aureus N315
cuauugugauauaugaaau

SEQ ID NO: 2139260 - RNA, 16 nt, Staphylococcus aureus subsp. aureus N315
cuauuuaaaagacaau

SEQ ID NO: 2139261 - RNA, 16 nt, Staphylococcus aureus subsp. aureus N315
cucaaaaagccaacac

SEQ ID NO: 2139262 - RNA, 14 nt, Staphylococcus aureus subsp. aureus N315
cuauuuuuaaugua

SEQ ID NO: 2139263 - RNA, 12 nt, Staphylococcus aureus subsp. aureus N315
cuauuuuuaaau

SEQ ID NO: 2139264 - RNA, 19 nt, Staphylococcus aureus subsp. aureus N315
cuauuuuucgauuuugaga

SEQ ID NO: 2139265 - RNA, 16 nt, Staphylococcus aureus subsp. aureus N315
cuauuuuugauuuaau

SEQ ID NO: 2139266 - RNA, 21 nt, Staphylococcus aureus subsp. aureus N315
cuauuuuccaucacauaacua

SEQ ID NO: 2139267 - RNA, 15 nt, Staphylococcus aureus subsp. aureus N315
cuauuuuauaaaaua

SEQ ID NO: 2139268 - RNA, 23 nt, Staphylococcus aureus subsp. aureus N315
cuauuuuauaaaauauauuuaau

SEQ ID NO: 2139269 - RNA, 12 nt, Staphylococcus aureus subsp. aureus N315
cucuaaauaaaa

SEQ ID NO: 2139270 - RNA, 16 nt, Staphylococcus aureus subsp. aureus N315
cucuaaauauaauaga

SEQ ID NO: 2139271 - RNA, 12 nt, Staphylococcus aureus subsp. aureus N315
cucuaacauuuu

SEQ ID NO: 2139272 - RNA, 14 nt, Staphylococcus aureus subsp. aureus N315
cucuaacauuuucu

SEQ ID NO: 2139273 - RNA, 23 nt, Staphylococcus aureus subsp. aureus N315
cucuaacauuuucuuauuugauu

SEQ ID NO: 2139274 - RNA, 22 nt, Staphylococcus aureus subsp. aureus N315
cucuaacgguauaucauccaca

SEQ ID NO: 2139275 - RNA, 22 nt, Staphylococcus aureus subsp. aureus N315
cucuaauucaaugauuuuuaaa

SEQ ID NO: 2139276 - RNA, 20 nt, Staphylococcus aureus subsp. aureus N315
cucuaaugauuaaaaaucaa

SEQ ID NO: 2139277 - RNA, 14 nt, Staphylococcus aureus subsp. aureus N315
cucuaagguuaaau

SEQ ID NO: 2139278 - RNA, 20 nt, Staphylococcus aureus subsp. aureus N315
cucuaacuuuaccaauauca

SEQ ID NO: 2139279 - RNA, 15 nt, Staphylococcus aureus subsp. aureus N315
cucuaaaacuuuuuc

SEQ ID NO: 2139280 - RNA, 22 nt, Staphylococcus aureus subsp. aureus N315
cucuaaacuucuauuaauaauu

SEQ ID NO: 2139281 - RNA, 20 nt, Staphylococcus aureus subsp. aureus N315
cucgauuagaucacaguaca

SEQ ID NO: 2139282 - RNA, 14 nt, Staphylococcus aureus subsp. aureus N315
cucgaccuuuauau

SEQ ID NO: 2139283 - RNA, 15 nt, Staphylococcus aureus subsp. aureus N315
cucgaagucagcgau

SEQ ID NO: 2139284 - RNA, 15 nt, Staphylococcus aureus subsp. aureus N315
cuccgaucaugccuu

SEQ ID NO: 2139285 - RNA, 14 nt, Staphylococcus aureus subsp. aureus N315
cuccgaucaugccu

SEQ ID NO: 2139286 - RNA, 19 nt, Staphylococcus aureus subsp. aureus N315
cuccguauuuaccuucuuc

SEQ ID NO: 2139287 - RNA, 14 nt, Staphylococcus aureus subsp. aureus N315
cuccguuaauuuaa

SEQ ID NO: 2139288 - RNA, 18 nt, Staphylococcus aureus subsp. aureus N315
cuccuaaagcugcaauua

SEQ ID NO: 2139289 - RNA, 22 nt, Staphylococcus aureus subsp. aureus N315
cuccuaaagguaacuuuuuaac

SEQ ID NO: 2139290 - RNA, 17 nt, Staphylococcus aureus subsp. aureus N315
cuccuaaagcugcaauu

SEQ ID NO: 2139291 - RNA, 16 nt, Staphylococcus aureus subsp. aureus N315
cuccuaaauuauuguu

SEQ ID NO: 2139292 - RNA, 23 nt, Staphylococcus aureus subsp. aureus N315
cuccuaaauuauuguuuaugcca

SEQ ID NO: 2139293 - RNA, 14 nt, Staphylococcus aureus subsp. aureus N315
cuccccaacuuaau

SEQ ID NO: 2139294 - RNA, 18 nt, Staphylococcus aureus subsp. aureus N315
cucauuagcgaaaacuaa

SEQ ID NO: 2139295 - RNA, 20 nt, Staphylococcus aureus subsp. aureus N315
cucauuagcgaaaacuaaag

SEQ ID NO: 2139296 - RNA, 20 nt, Staphylococcus aureus subsp. aureus N315
cucauuauaaugauuuuuau

SEQ ID NO: 2139297 - RNA, 20 nt, Staphylococcus aureus subsp. aureus N315
cucauuccaggaaggaaugu

SEQ ID NO: 2139298 - RNA, 13 nt, Staphylococcus aureus subsp. aureus N315
cucauuaauaaau

SEQ ID NO: 2139299 - RNA, 16 nt, Staphylococcus aureus subsp. aureus N315
cucauuaaccuuacau

SEQ ID NO: 2139300 - RNA, 14 nt, Staphylococcus aureus subsp. aureus N315
cucauguuucagua

SEQ ID NO: 2139301 - RNA, 20 nt, Staphylococcus aureus subsp. aureus N315
cucauuuuuauaaauuuugg

SEQ ID NO: 2139302 - RNA, 17 nt, Staphylococcus aureus subsp. aureus N315
cuccaaaaauaauuaaa

SEQ ID NO: 2139303 - RNA, 17 nt, Staphylococcus aureus subsp. aureus N315
cucauuuagcucuacua

SEQ ID NO: 2139304 - RNA, 13 nt, Staphylococcus aureus subsp. aureus N315
cucauuuauaaac

SEQ ID NO: 2139305 - RNA, 20 nt, Staphylococcus aureus subsp. aureus N315
cuccaagauuaugacaacau

SEQ ID NO: 2139306 - RNA, 19 nt, Staphylococcus aureus subsp. aureus N315
cuccaauacuuuuuauaua

SEQ ID NO: 2139307 - RNA, 18 nt, Staphylococcus aureus subsp. aureus N315
cuccaccaccugcaauuu

SEQ ID NO: 2139308 - RNA, 14 nt, Staphylococcus aureus subsp. aureus N315
aaaaaacaguguag

SEQ ID NO: 2139309 - RNA, 22 nt, Staphylococcus aureus subsp. aureus N315
aaaaaaacaaauauuagaacau

SEQ ID NO: 2139310 - RNA, 15 nt, Staphylococcus aureus subsp. aureus N315
aaaaaauuaauaauu

SEQ ID NO: 2139311 - RNA, 12 nt, Staphylococcus aureus subsp. aureus N315
aaaaaauuauua

SEQ ID NO: 2139312 - RNA, 13 nt, Staphylococcus aureus subsp. aureus N315
aaaaaauuguaua

SEQ ID NO: 2139313 - RNA, 13 nt, Staphylococcus aureus subsp. aureus N315
aaaaaauuuaaau

SEQ ID NO: 2139314 - RNA, 16 nt, Staphylococcus aureus subsp. aureus N315
aaaaaauuuaaauaau

SEQ ID NO: 2139315 - RNA, 17 nt, Staphylococcus aureus subsp. aureus N315
aaaaaauuuaauguuuu

SEQ ID NO: 2139316 - RNA, 12 nt, Staphylococcus aureus subsp. aureus N315
aaaaacaaaaaa

SEQ ID NO: 2139317 - RNA, 16 nt, Staphylococcus aureus subsp. aureus N315
aaaaaauuaaaauguu

SEQ ID NO: 2139318 - RNA, 16 nt, Staphylococcus aureus subsp. aureus N315
aaaaaauuaaaaauuu

SEQ ID NO: 2139319 - RNA, 15 nt, Staphylococcus aureus subsp. aureus N315
aaaaagaauuucgaa

SEQ ID NO: 2139320 - RNA, 13 nt, Staphylococcus aureus subsp. aureus N315
aaaaagaugaaaa

SEQ ID NO: 2139321 - RNA, 14 nt, Staphylococcus aureus subsp. aureus N315
aaaaagaugaaaaa

SEQ ID NO: 2139322 - RNA, 20 nt, Staphylococcus aureus subsp. aureus N315
aaaaacuucuuaacuugaaa

SEQ ID NO: 2139323 - RNA, 21 nt, Staphylococcus aureus subsp. aureus N315
aaaaagggcaacacucggaaa

SEQ ID NO: 2139324 - RNA, 22 nt, Staphylococcus aureus subsp. aureus N315
aaaaaggaugaugugaauguuu

SEQ ID NO: 2139325 - RNA, 20 nt, Staphylococcus aureus subsp. aureus N315
aaaaaggaagaacagcacau

SEQ ID NO: 2139326 - RNA, 19 nt, Staphylococcus aureus subsp. aureus N315
aaaaaggaagaacagcaca

SEQ ID NO: 2139327 - RNA, 15 nt, Staphylococcus aureus subsp. aureus N315
aaaaaguauuacuuu

SEQ ID NO: 2139328 - RNA, 23 nt, Staphylococcus aureus subsp. aureus N315
aaaaagcggacugaaagaaaagu

SEQ ID NO: 2139329 - RNA, 19 nt, Staphylococcus aureus subsp. aureus N315
aaaaacaccuucguuuaaa

SEQ ID NO: 2139330 - RNA, 18 nt, Staphylococcus aureus subsp. aureus N315
aaaaaccguaauuuuaau

SEQ ID NO: 2139331 - RNA, 17 nt, Staphylococcus aureus subsp. aureus N315
aaaaaccugaaacaaau

SEQ ID NO: 2139332 - RNA, 15 nt, Staphylococcus aureus subsp. aureus N315
aaaaacgcuuuuaaa

SEQ ID NO: 2139333 - RNA, 22 nt, Staphylococcus aureus subsp. aureus N315
aaaaacgguaauuucuauuuau

SEQ ID NO: 2139334 - RNA, 19 nt, Staphylococcus aureus subsp. aureus N315
aaaaacuguaaaucaucau

SEQ ID NO: 2139335 - RNA, 20 nt, Staphylococcus aureus subsp. aureus N315
aaaaacgcuuuuaaaccgug

SEQ ID NO: 2139336 - RNA, 23 nt, Staphylococcus aureus subsp. aureus N315
aaaaacgguacagauaagaauau

SEQ ID NO: 2139337 - RNA, 15 nt, Staphylococcus aureus subsp. aureus N315
aaaaccgagaaucuc

SEQ ID NO: 2139338 - RNA, 20 nt, Staphylococcus aureus subsp. aureus N315
aaaaccgagaaucuccauuu

SEQ ID NO: 2139339 - RNA, 13 nt, Staphylococcus aureus subsp. aureus N315
aaaaccucuuuuu

SEQ ID NO: 2139340 - RNA, 22 nt, Staphylococcus aureus subsp. aureus N315
aaaacaaauauuagaacauuua

SEQ ID NO: 2139341 - RNA, 17 nt, Staphylococcus aureus subsp. aureus N315
aaaacaaauccauuaaa

SEQ ID NO: 2139342 - RNA, 16 nt, Staphylococcus aureus subsp. aureus N315
aaaacaaaaaaaccga

SEQ ID NO: 2139343 - RNA, 15 nt, Staphylococcus aureus subsp. aureus N315
aaaacaaaaaaaccg

SEQ ID NO: 2139344 - RNA, 15 nt, Staphylococcus aureus subsp. aureus N315
aaaacaaaaaauauc

SEQ ID NO: 2139345 - RNA, 16 nt, Staphylococcus aureus subsp. aureus N315
aaaacaaaaaauaucu

SEQ ID NO: 2139346 - RNA, 22 nt, Staphylococcus aureus subsp. aureus N315
aaaacaaaaacgguaauuucua

SEQ ID NO: 2139347 - RNA, 18 nt, Staphylococcus aureus subsp. aureus N315
aaaacauaaauacaaaaa

SEQ ID NO: 2139348 - RNA, 19 nt, Staphylococcus aureus subsp. aureus N315
aaaacaguguagcacaaga

SEQ ID NO: 2139349 - RNA, 12 nt, Staphylococcus aureus subsp. aureus N315
aaaacauaccug

SEQ ID NO: 2139350 - RNA, 15 nt, Staphylococcus aureus subsp. aureus N315
aaaaagucuuucucg

SEQ ID NO: 2139351 - RNA, 21 nt, Staphylococcus aureus subsp. aureus N315
aaaaagugaagauauuuauaa

SEQ ID NO: 2139352 - RNA, 20 nt, Staphylococcus aureus subsp. aureus N315
aaaaagugaaaguauuagau

SEQ ID NO: 2139353 - RNA, 19 nt, Staphylococcus aureus subsp. aureus N315
aaaaagugauaauuaaaau

SEQ ID NO: 2139354 - RNA, 13 nt, Staphylococcus aureus subsp. aureus N315
aaaaaguuuaaag

SEQ ID NO: 2139355 - RNA, 13 nt, Staphylococcus aureus subsp. aureus N315
aaaaauauuuaaa

SEQ ID NO: 2139356 - RNA, 14 nt, Staphylococcus aureus subsp. aureus N315
aaaaauauuuaaac

SEQ ID NO: 2139357 - RNA, 14 nt, Staphylococcus aureus subsp. aureus N315
aaaaaucaaagagg

SEQ ID NO: 2139358 - RNA, 14 nt, Staphylococcus aureus subsp. aureus N315
aaaaauauugaaua

SEQ ID NO: 2139359 - RNA, 12 nt, Staphylococcus aureus subsp. aureus N315
aaaaauauguau

SEQ ID NO: 2139360 - RNA, 22 nt, Staphylococcus aureus subsp. aureus N315
aaaaaucaguuuuuaaaucaaa

SEQ ID NO: 2139361 - RNA, 12 nt, Staphylococcus aureus subsp. aureus N315
aaaaaugaugua

SEQ ID NO: 2139362 - RNA, 16 nt, Staphylococcus aureus subsp. aureus N315
aaaaaucuuuugauag

SEQ ID NO: 2139363 - RNA, 20 nt, Staphylococcus aureus subsp. aureus N315
aaaaaucuuuugauagcuaa

SEQ ID NO: 2139364 - RNA, 21 nt, Staphylococcus aureus subsp. aureus N315
aaaaauggugauccgccuuga

SEQ ID NO: 2139365 - RNA, 21 nt, Staphylococcus aureus subsp. aureus N315
aaaaaugcuuauauaaacaaa

SEQ ID NO: 2139366 - RNA, 17 nt, Staphylococcus aureus subsp. aureus N315
aaaaaugcuguuuuaug

SEQ ID NO: 2139367 - RNA, 18 nt, Staphylococcus aureus subsp. aureus N315
aaaaaugcgcuuccaauu

SEQ ID NO: 2139368 - RNA, 19 nt, Staphylococcus aureus subsp. aureus N315
aaaaaugcgcuuccaauuu

SEQ ID NO: 2139369 - RNA, 16 nt, Staphylococcus aureus subsp. aureus N315
aaaaaugugaccuuau

SEQ ID NO: 2139370 - RNA, 18 nt, Staphylococcus aureus subsp. aureus N315
aaaaauguaaauaaaaau

SEQ ID NO: 2139371 - RNA, 22 nt, Staphylococcus aureus subsp. aureus N315
aaaaaugucguauauguaauca

SEQ ID NO: 2139372 - RNA, 20 nt, Staphylococcus aureus subsp. aureus N315
aaaaauuccuagcuuuuaug

SEQ ID NO: 2139373 - RNA, 13 nt, Staphylococcus aureus subsp. aureus N315
aaaaauucauaau

SEQ ID NO: 2139374 - RNA, 22 nt, Staphylococcus aureus subsp. aureus N315
aaaaauugcuauauuaguauaa

SEQ ID NO: 2139375 - RNA, 16 nt, Staphylococcus aureus subsp. aureus N315
aaaaauuuaaauaaua

SEQ ID NO: 2139376 - RNA, 12 nt, Staphylococcus aureus subsp. aureus N315
aaaaauuguaaa

SEQ ID NO: 2139377 - RNA, 16 nt, Staphylococcus aureus subsp. aureus N315
aaaaauuuauucaaaa

SEQ ID NO: 2139378 - RNA, 18 nt, Staphylococcus aureus subsp. aureus N315
aaaccgagaaucuccauu

SEQ ID NO: 2139379 - RNA, 17 nt, Staphylococcus aureus subsp. aureus N315
aaaccgaggaaauccuu

SEQ ID NO: 2139380 - RNA, 22 nt, Staphylococcus aureus subsp. aureus N315
aaaccgccaacuaauguuaaaa

SEQ ID NO: 2139381 - RNA, 16 nt, Staphylococcus aureus subsp. aureus N315
aaaccguaauuuuaau

SEQ ID NO: 2139382 - RNA, 20 nt, Staphylococcus aureus subsp. aureus N315
aaaccguauagucauuacau

SEQ ID NO: 2139383 - RNA, 18 nt, Staphylococcus aureus subsp. aureus N315
aaacauuuuuagaaucaa

SEQ ID NO: 2139384 - RNA, 13 nt, Staphylococcus aureus subsp. aureus N315
aaacauuuuauac

SEQ ID NO: 2139385 - RNA, 14 nt, Staphylococcus aureus subsp. aureus N315
aaaccaauuuuaac

SEQ ID NO: 2139386 - RNA, 13 nt, Staphylococcus aureus subsp. aureus N315
aaaccaauuuuaa

SEQ ID NO: 2139387 - RNA, 20 nt, Staphylococcus aureus subsp. aureus N315
aaacaugggcaaucacuccu

SEQ ID NO: 2139388 - RNA, 15 nt, Staphylococcus aureus subsp. aureus N315
aaacaugaacaauca

SEQ ID NO: 2139389 - RNA, 18 nt, Staphylococcus aureus subsp. aureus N315
aaacaucuauaacaaaau

SEQ ID NO: 2139390 - RNA, 20 nt, Staphylococcus aureus subsp. aureus N315
aaacaucuauaacaaaaucu

SEQ ID NO: 2139391 - RNA, 21 nt, Staphylococcus aureus subsp. aureus N315
aaacauucccuuaauaauaag

SEQ ID NO: 2139392 - RNA, 19 nt, Staphylococcus aureus subsp. aureus N315
aaacauugcuuaacuuccu

SEQ ID NO: 2139393 - RNA, 20 nt, Staphylococcus aureus subsp. aureus N315
aaacauucccuuaauaauaa

SEQ ID NO: 2139394 - RNA, 19 nt, Staphylococcus aureus subsp. aureus N315
aaacauguacaauuuuuaa

SEQ ID NO: 2139395 - RNA, 16 nt, Staphylococcus aureus subsp. aureus N315
aaacauuuauauagau

SEQ ID NO: 2139396 - RNA, 23 nt, Staphylococcus aureus subsp. aureus N315
aaacauuuauauagauugccauu

SEQ ID NO: 2139397 - RNA, 22 nt, Staphylococcus aureus subsp. aureus N315
aaacauugcuuaacuuccuuuu

SEQ ID NO: 2139398 - RNA, 13 nt, Staphylococcus aureus subsp. aureus N315
aaacaauaaaaaa

SEQ ID NO: 2139399 - RNA, 20 nt, Staphylococcus aureus subsp. aureus N315
aaacaauaaaaaaccaagug

SEQ ID NO: 2139400 - RNA, 13 nt, Staphylococcus aureus subsp. aureus N315
aaacaauuuaaaa

SEQ ID NO: 2139401 - RNA, 17 nt, Staphylococcus aureus subsp. aureus N315
aaacaauuacaaaauca

SEQ ID NO: 2139402 - RNA, 17 nt, Staphylococcus aureus subsp. aureus N315
aaacaaugauuaaaauu

SEQ ID NO: 2139403 - RNA, 13 nt, Staphylococcus aureus subsp. aureus N315
aaacaaugcaagu

SEQ ID NO: 2139404 - RNA, 19 nt, Staphylococcus aureus subsp. aureus N315
aaaauugcuaaaaaaauua

SEQ ID NO: 2139405 - RNA, 18 nt, Staphylococcus aureus subsp. aureus N315
aaaauugcuauauuagua

SEQ ID NO: 2139406 - RNA, 22 nt, Staphylococcus aureus subsp. aureus N315
aaaauugcugacaccuauauuu

SEQ ID NO: 2139407 - RNA, 16 nt, Staphylococcus aureus subsp. aureus N315
aaaauuguauagaaug

SEQ ID NO: 2139408 - RNA, 20 nt, Staphylococcus aureus subsp. aureus N315
aaaauugguuuggauaaaau

SEQ ID NO: 2139409 - RNA, 17 nt, Staphylococcus aureus subsp. aureus N315
aaaauuguaagucgaaa

SEQ ID NO: 2139410 - RNA, 23 nt, Staphylococcus aureus subsp. aureus N315
aaaauugguuuggauaaaaugau

SEQ ID NO: 2139411 - RNA, 13 nt, Staphylococcus aureus subsp. aureus N315
aaaauugaacuuu

SEQ ID NO: 2139412 - RNA, 13 nt, Staphylococcus aureus subsp. aureus N315
aaacacaaaaagg

SEQ ID NO: 2139413 - RNA, 22 nt, Staphylococcus aureus subsp. aureus N315
aaacaauuuguaacuauugaaa

SEQ ID NO: 2139414 - RNA, 13 nt, Staphylococcus aureus subsp. aureus N315
aaacaauuuugua

SEQ ID NO: 2139415 - RNA, 14 nt, Staphylococcus aureus subsp. aureus N315
aaacacaguacaaa

SEQ ID NO: 2139416 - RNA, 18 nt, Staphylococcus aureus subsp. aureus N315
aaacacccugcuuaucau

SEQ ID NO: 2139417 - RNA, 15 nt, Staphylococcus aureus subsp. aureus N315
aaacauauucauucu

SEQ ID NO: 2139418 - RNA, 21 nt, Staphylococcus aureus subsp. aureus N315
aaacauaauuaccuuuccauu

SEQ ID NO: 2139419 - RNA, 17 nt, Staphylococcus aureus subsp. aureus N315
aaacauaaugacaucau

SEQ ID NO: 2139420 - RNA, 18 nt, Staphylococcus aureus subsp. aureus N315
aaacauaaauaagcagua

SEQ ID NO: 2139421 - RNA, 23 nt, Staphylococcus aureus subsp. aureus N315
aaacagcaguaagauaauuuuca

SEQ ID NO: 2139422 - RNA, 17 nt, Staphylococcus aureus subsp. aureus N315
aaacagcaguaagauau

SEQ ID NO: 2139423 - RNA, 22 nt, Staphylococcus aureus subsp. aureus N315
aaacagaaauugcgaauuguua

SEQ ID NO: 2139424 - RNA, 21 nt, Staphylococcus aureus subsp. aureus N315
aaaaagacggugaccuuauau

SEQ ID NO: 2139425 - RNA, 12 nt, Staphylococcus aureus subsp. aureus N315
aaaaggaaaaac

SEQ ID NO: 2139426 - RNA, 18 nt, Staphylococcus aureus subsp. aureus N315
aaaagcuguaguuucaac

SEQ ID NO: 2139427 - RNA, 22 nt, Staphylococcus aureus subsp. aureus N315
aaaagcucggcacaccauuuua

SEQ ID NO: 2139428 - RNA, 17 nt, Staphylococcus aureus subsp. aureus N315
aaaaacuucuuaacuug

SEQ ID NO: 2139429 - RNA, 13 nt, Staphylococcus aureus subsp. aureus N315
aaaaagaaaauua

SEQ ID NO: 2139430 - RNA, 11 nt, Staphylococcus aureus subsp. aureus N315
aaaaagaaaau

SEQ ID NO: 2139431 - RNA, 21 nt, Staphylococcus aureus subsp. aureus N315
aaaacgcauugcgaaagaaag

SEQ ID NO: 2139432 - RNA, 19 nt, Staphylococcus aureus subsp. aureus N315
aaaaccuuuucaaauuaua

SEQ ID NO: 2139433 - RNA, 16 nt, Staphylococcus aureus subsp. aureus N315
aaaacgauaagaauua

SEQ ID NO: 2139434 - RNA, 13 nt, Staphylococcus aureus subsp. aureus N315
aaaacgauaauaa

SEQ ID NO: 2139435 - RNA, 14 nt, Staphylococcus aureus subsp. aureus N315
aaaacgagauuaca

SEQ ID NO: 2139436 - RNA, 17 nt, Staphylococcus aureus subsp. aureus N315
aaaagcggacugaaaga

SEQ ID NO: 2139437 - RNA, 21 nt, Staphylococcus aureus subsp. aureus N315
aaaaguugauuaaaaguguug

SEQ ID NO: 2139438 - RNA, 18 nt, Staphylococcus aureus subsp. aureus N315
aaaaguuguaauuuaaaa

SEQ ID NO: 2139439 - RNA, 17 nt, Staphylococcus aureus subsp. aureus N315
aaaaguugauuaaaagu

SEQ ID NO: 2139440 - RNA, 23 nt, Staphylococcus aureus subsp. aureus N315
aaaauaaaucauacgagaaauua

SEQ ID NO: 2139441 - RNA, 13 nt, Staphylococcus aureus subsp. aureus N315
aaaauaaaaaaau

SEQ ID NO: 2139442 - RNA, 19 nt, Staphylococcus aureus subsp. aureus N315
aaaauaaccgcuuaauucu

SEQ ID NO: 2139443 - RNA, 19 nt, Staphylococcus aureus subsp. aureus N315
aaaaggcgaaacauuaaaa

SEQ ID NO: 2139444 - RNA, 13 nt, Staphylococcus aureus subsp. aureus N315
aaaagggcaaaaa

SEQ ID NO: 2139445 - RNA, 21 nt, Staphylococcus aureus subsp. aureus N315
aaaaggaugaugugaauguuu

SEQ ID NO: 2139446 - RNA, 19 nt, Staphylococcus aureus subsp. aureus N315
aaaagucccgcuuaaaaug

SEQ ID NO: 2139447 - RNA, 23 nt, Staphylococcus aureus subsp. aureus N315
aaaaggugugggcuuuauuauca

SEQ ID NO: 2139448 - RNA, 15 nt, Staphylococcus aureus subsp. aureus N315
aaaaggucaaaaaau

SEQ ID NO: 2139449 - RNA, 16 nt, Staphylococcus aureus subsp. aureus N315
aaaaugacgauacgua

SEQ ID NO: 2139450 - RNA, 22 nt, Staphylococcus aureus subsp. aureus N315
aaaaugacuaccuguuggcuuu

SEQ ID NO: 2139451 - RNA, 19 nt, Staphylococcus aureus subsp. aureus N315
aaaaugaauguuaagacau

SEQ ID NO: 2139452 - RNA, 24 nt, Staphylococcus aureus subsp. aureus N315
aaaaugaauaauugcuaaaauauc

SEQ ID NO: 2139453 - RNA, 15 nt, Staphylococcus aureus subsp. aureus N315
aaaaugaaauauuug

SEQ ID NO: 2139454 - RNA, 17 nt, Staphylococcus aureus subsp. aureus N315
aaaaugaagaauacaaa

SEQ ID NO: 2139455 - RNA, 21 nt, Staphylococcus aureus subsp. aureus N315
aaaaugauagcuaaacauuuu

SEQ ID NO: 2139456 - RNA, 13 nt, Staphylococcus aureus subsp. aureus N315
aaaaugauaucug

SEQ ID NO: 2139457 - RNA, 14 nt, Staphylococcus aureus subsp. aureus N315
aaaaugaguacaac

SEQ ID NO: 2139458 - RNA, 15 nt, Staphylococcus aureus subsp. aureus N315
aaaaugguuaaaauc

SEQ ID NO: 2139459 - RNA, 22 nt, Staphylococcus aureus subsp. aureus N315
aaaauuaaauaaugauaaauua

SEQ ID NO: 2139460 - RNA, 17 nt, Staphylococcus aureus subsp. aureus N315
aaaauuaaaaaacaaaa

SEQ ID NO: 2139461 - RNA, 14 nt, Staphylococcus aureus subsp. aureus N315
aaaauguuuaacaa

SEQ ID NO: 2139462 - RNA, 15 nt, Staphylococcus aureus subsp. aureus N315
aaaaugucauuugaa

SEQ ID NO: 2139463 - RNA, 21 nt, Staphylococcus aureus subsp. aureus N315
aaaauguguuaaaauauauuu

SEQ ID NO: 2139464 - RNA, 17 nt, Staphylococcus aureus subsp. aureus N315
aaaauguuacacaaauu

SEQ ID NO: 2139465 - RNA, 19 nt, Staphylococcus aureus subsp. aureus N315
aaaauguuacacaaauuaa

SEQ ID NO: 2139466 - RNA, 21 nt, Staphylococcus aureus subsp. aureus N315
aaaauuacuuagcaaacaauu

SEQ ID NO: 2139467 - RNA, 22 nt, Staphylococcus aureus subsp. aureus N315
aaaauuacuaacguaaagguga

SEQ ID NO: 2139468 - RNA, 14 nt, Staphylococcus aureus subsp. aureus N315
aaaauuaaucaccu

SEQ ID NO: 2139469 - RNA, 18 nt, Staphylococcus aureus subsp. aureus N315
aaaauucuauaauuuuaa

SEQ ID NO: 2139470 - RNA, 21 nt, Staphylococcus aureus subsp. aureus N315
aaaauucuauaaauagaauuu

SEQ ID NO: 2139471 - RNA, 13 nt, Staphylococcus aureus subsp. aureus N315
aaaauucucuuuu

SEQ ID NO: 2139472 - RNA, 19 nt, Staphylococcus aureus subsp. aureus N315
aaaauaucugaaaaaccaa

SEQ ID NO: 2139473 - RNA, 17 nt, Staphylococcus aureus subsp. aureus N315
aaaauaucuuuuuguuu

SEQ ID NO: 2139474 - RNA, 14 nt, Staphylococcus aureus subsp. aureus N315
aaaauaucauuucu

SEQ ID NO: 2139475 - RNA, 12 nt, Staphylococcus aureus subsp. aureus N315
aaaauaucauuu

SEQ ID NO: 2139476 - RNA, 17 nt, Staphylococcus aureus subsp. aureus N315
aaaauaucugaaaaacc

SEQ ID NO: 2139477 - RNA, 20 nt, Staphylococcus aureus subsp. aureus N315
aaaauaugauugcaaauuau

SEQ ID NO: 2139478 - RNA, 15 nt, Staphylococcus aureus subsp. aureus N315
aaaauaugauuuaaa

SEQ ID NO: 2139479 - RNA, 20 nt, Staphylococcus aureus subsp. aureus N315
aaaauauguguuaacugaua

SEQ ID NO: 2139480 - RNA, 19 nt, Staphylococcus aureus subsp. aureus N315
aaaauauugcguuuaauuu

SEQ ID NO: 2139481 - RNA, 15 nt, Staphylococcus aureus subsp. aureus N315
aaaauacaaauuaca

SEQ ID NO: 2139482 - RNA, 17 nt, Staphylococcus aureus subsp. aureus N315
aaaauacauaauuaacu

SEQ ID NO: 2139483 - RNA, 19 nt, Staphylococcus aureus subsp. aureus N315
aaaauacauaauuaacuuu

SEQ ID NO: 2139484 - RNA, 23 nt, Staphylococcus aureus subsp. aureus N315
aaaauaucaauuuauuauuaacu

SEQ ID NO: 2139485 - RNA, 18 nt, Staphylococcus aureus subsp. aureus N315
aaaauaucaauuuauuau

SEQ ID NO: 2139486 - RNA, 11 nt, Staphylococcus aureus subsp. aureus N315
aaaauauauuu

SEQ ID NO: 2139487 - RNA, 13 nt, Staphylococcus aureus subsp. aureus N315
aaaauaucaucaa

SEQ ID NO: 2139488 - RNA, 19 nt, Staphylococcus aureus subsp. aureus N315
aaaaucauccauaaaaaua

SEQ ID NO: 2139489 - RNA, 21 nt, Staphylococcus aureus subsp. aureus N315
aaaaucaucuuaacaacuuua

SEQ ID NO: 2139490 - RNA, 18 nt, Staphylococcus aureus subsp. aureus N315
aaaaucaucuuaacaacu

SEQ ID NO: 2139491 - RNA, 14 nt, Staphylococcus aureus subsp. aureus N315
aaaaucaaagaggc

SEQ ID NO: 2139492 - RNA, 17 nt, Staphylococcus aureus subsp. aureus N315
aaagcaggcaagcuauc

SEQ ID NO: 2139493 - RNA, 21 nt, Staphylococcus aureus subsp. aureus N315
aaagcaguaagagauuuucuu

SEQ ID NO: 2139494 - RNA, 19 nt, Staphylococcus aureus subsp. aureus N315
aaagcaucuucaauauuua

SEQ ID NO: 2139495 - RNA, 16 nt, Staphylococcus aureus subsp. aureus N315
aaagccuucuaucucu

SEQ ID NO: 2139496 - RNA, 17 nt, Staphylococcus aureus subsp. aureus N315
aaagcgaauuaucuuua

SEQ ID NO: 2139497 - RNA, 23 nt, Staphylococcus aureus subsp. aureus N315
aaaggaugaugugaauguuuugu

SEQ ID NO: 2139498 - RNA, 21 nt, Staphylococcus aureus subsp. aureus N315
aaaggauuauuaacuuuaaua

SEQ ID NO: 2139499 - RNA, 22 nt, Staphylococcus aureus subsp. aureus N315
aaaggauuauuaacuuuaauau

SEQ ID NO: 2139500 - RNA, 14 nt, Staphylococcus aureus subsp. aureus N315
aaaggacuuaguag

SEQ ID NO: 2139501 - RNA, 15 nt, Staphylococcus aureus subsp. aureus N315
aaaggauauugaaaa

SEQ ID NO: 2139502 - RNA, 19 nt, Staphylococcus aureus subsp. aureus N315
aaaggauauugaaaacacg

SEQ ID NO: 2139503 - RNA, 21 nt, Staphylococcus aureus subsp. aureus N315
aaagcuugauuuaacaaccuc

SEQ ID NO: 2139504 - RNA, 14 nt, Staphylococcus aureus subsp. aureus N315
aaagcuugauuuaa

SEQ ID NO: 2139505 - RNA, 16 nt, Staphylococcus aureus subsp. aureus N315
aaagcuuauuaaauca

SEQ ID NO: 2139506 - RNA, 15 nt, Staphylococcus aureus subsp. aureus N315
aaagcugauuuuuca

SEQ ID NO: 2139507 - RNA, 21 nt, Staphylococcus aureus subsp. aureus N315
aaagcuuuuuugcuuuuauaa

SEQ ID NO: 2139508 - RNA, 16 nt, Staphylococcus aureus subsp. aureus N315
aaagcuuuuuugcuuu

SEQ ID NO: 2139509 - RNA, 17 nt, Staphylococcus aureus subsp. aureus N315
aaagcuuuaguuaaaua

SEQ ID NO: 2139510 - RNA, 21 nt, Staphylococcus aureus subsp. aureus N315
aaaguaacauacuauaaaaau

SEQ ID NO: 2139511 - RNA, 13 nt, Staphylococcus aureus subsp. aureus N315
aaaguaaauuaca

SEQ ID NO: 2139512 - RNA, 19 nt, Staphylococcus aureus subsp. aureus N315
aaagguauucaaauaaaca

SEQ ID NO: 2139513 - RNA, 12 nt, Staphylococcus aureus subsp. aureus N315
aaaggucaucug

SEQ ID NO: 2139514 - RNA, 18 nt, Staphylococcus aureus subsp. aureus N315
aaagguauucuauuuuuc

SEQ ID NO: 2139515 - RNA, 22 nt, Staphylococcus aureus subsp. aureus N315
aaagaacgucgcgaaaacguug

SEQ ID NO: 2139516 - RNA, 14 nt, Staphylococcus aureus subsp. aureus N315
aaagaaaucaccag

SEQ ID NO: 2139517 - RNA, 14 nt, Staphylococcus aureus subsp. aureus N315
aaagaaauaauuua

SEQ ID NO: 2139518 - RNA, 16 nt, Staphylococcus aureus subsp. aureus N315
aaagaaauaauuuaaa

SEQ ID NO: 2139519 - RNA, 21 nt, Staphylococcus aureus subsp. aureus N315
aaagaauuucgaaaagaaauu

SEQ ID NO: 2139520 - RNA, 18 nt, Staphylococcus aureus subsp. aureus N315
aaagaauuucgaaaagaa

SEQ ID NO: 2139521 - RNA, 16 nt, Staphylococcus aureus subsp. aureus N315
aaagaaugauuuauaa

SEQ ID NO: 2139522 - RNA, 15 nt, Staphylococcus aureus subsp. aureus N315
aaagaaucauuuaaa

SEQ ID NO: 2139523 - RNA, 22 nt, Staphylococcus aureus subsp. aureus N315
aaagaauccuuaauugcucuuc

SEQ ID NO: 2139524 - RNA, 16 nt, Staphylococcus aureus subsp. aureus N315
aaaccguuauauauua

SEQ ID NO: 2139525 - RNA, 20 nt, Staphylococcus aureus subsp. aureus N315
aaaccucuaaauaaaauuaa

SEQ ID NO: 2139526 - RNA, 20 nt, Staphylococcus aureus subsp. aureus N315
aaaccuaaugcuuuaauaaa

SEQ ID NO: 2139527 - RNA, 16 nt, Staphylococcus aureus subsp. aureus N315
aaaccuagggauaauu

SEQ ID NO: 2139528 - RNA, 14 nt, Staphylococcus aureus subsp. aureus N315
aaagaaacaugauu

SEQ ID NO: 2139529 - RNA, 17 nt, Staphylococcus aureus subsp. aureus N315
aaagaaaauaucugaaa

SEQ ID NO: 2139530 - RNA, 13 nt, Staphylococcus aureus subsp. aureus N315
aaagcacauguau

SEQ ID NO: 2139531 - RNA, 12 nt, Staphylococcus aureus subsp. aureus N315
aaagauuaaaau

SEQ ID NO: 2139532 - RNA, 12 nt, Staphylococcus aureus subsp. aureus N315
aaagauuauuau

SEQ ID NO: 2139533 - RNA, 15 nt, Staphylococcus aureus subsp. aureus N315
aaagaggcuuuaaaa

SEQ ID NO: 2139534 - RNA, 14 nt, Staphylococcus aureus subsp. aureus N315
aaagaugaaaaagu

SEQ ID NO: 2139535 - RNA, 14 nt, Staphylococcus aureus subsp. aureus N315
aaagaugaaaaucu

SEQ ID NO: 2139536 - RNA, 19 nt, Staphylococcus aureus subsp. aureus N315
aaagacauccacagaauua

SEQ ID NO: 2139537 - RNA, 12 nt, Staphylococcus aureus subsp. aureus N315
aaagacagaaau

SEQ ID NO: 2139538 - RNA, 13 nt, Staphylococcus aureus subsp. aureus N315
aaagacagcagua

SEQ ID NO: 2139539 - RNA, 13 nt, Staphylococcus aureus subsp. aureus N315
aaagaccauugua

SEQ ID NO: 2139540 - RNA, 17 nt, Staphylococcus aureus subsp. aureus N315
aaauaguucaaaauacu

SEQ ID NO: 2139541 - RNA, 20 nt, Staphylococcus aureus subsp. aureus N315
aaauaguucaaauggacuaa

SEQ ID NO: 2139542 - RNA, 16 nt, Staphylococcus aureus subsp. aureus N315
aaauagaugagaaagu

SEQ ID NO: 2139543 - RNA, 15 nt, Staphylococcus aureus subsp. aureus N315
aaauagauaauauau

SEQ ID NO: 2139544 - RNA, 22 nt, Staphylococcus aureus subsp. aureus N315
aaauagacaccaaaaaacagag

SEQ ID NO: 2139545 - RNA, 14 nt, Staphylococcus aureus subsp. aureus N315
aaauagaauuuuug

SEQ ID NO: 2139546 - RNA, 20 nt, Staphylococcus aureus subsp. aureus N315
aaauaguucuuuaaauuaua

SEQ ID NO: 2139547 - RNA, 21 nt, Staphylococcus aureus subsp. aureus N315
aaauaguucuuuaaauuauau

SEQ ID NO: 2139548 - RNA, 19 nt, Staphylococcus aureus subsp. aureus N315
aaauauaaaauccuaagca

SEQ ID NO: 2139549 - RNA, 16 nt, Staphylococcus aureus subsp. aureus N315
aaauauaaccuaaaaa

SEQ ID NO: 2139550 - RNA, 19 nt, Staphylococcus aureus subsp. aureus N315
aaauauaauagaaauaauc

SEQ ID NO: 2139551 - RNA, 12 nt, Staphylococcus aureus subsp. aureus N315
aaauauaaauuu

SEQ ID NO: 2139552 - RNA, 23 nt, Staphylococcus aureus subsp. aureus N315
aaauauacuuuuaccauugugaa

SEQ ID NO: 2139553 - RNA, 15 nt, Staphylococcus aureus subsp. aureus N315
aaauauaccaaccaa

SEQ ID NO: 2139554 - RNA, 16 nt, Staphylococcus aureus subsp. aureus N315
aaauauaccaaccaaa

SEQ ID NO: 2139555 - RNA, 19 nt, Staphylococcus aureus subsp. aureus N315
aaauauaauguauaaaaca

SEQ ID NO: 2139556 - RNA, 20 nt, Staphylococcus aureus subsp. aureus N315
aaauauaauagaaauaauca

SEQ ID NO: 2139557 - RNA, 18 nt, Staphylococcus aureus subsp. aureus N315
aaauauaauguauaaaac

SEQ ID NO: 2139558 - RNA, 23 nt, Staphylococcus aureus subsp. aureus N315
aaauauaucuaauacuuucacuu

SEQ ID NO: 2139559 - RNA, 22 nt, Staphylococcus aureus subsp. aureus N315
aaauauauaaggcgcucucuuu

SEQ ID NO: 2139560 - RNA, 17 nt, Staphylococcus aureus subsp. aureus N315
aaauauaguaauaaaag

SEQ ID NO: 2139561 - RNA, 17 nt, Staphylococcus aureus subsp. aureus N315
aaauauauuuguaguaa

SEQ ID NO: 2139562 - RNA, 15 nt, Staphylococcus aureus subsp. aureus N315
aaauauauuuguaua

SEQ ID NO: 2139563 - RNA, 22 nt, Staphylococcus aureus subsp. aureus N315
aaauauauugcacauaaaaaau

SEQ ID NO: 2139564 - RNA, 12 nt, Staphylococcus aureus subsp. aureus N315
aaauauauuguc

SEQ ID NO: 2139565 - RNA, 19 nt, Staphylococcus aureus subsp. aureus N315
aaauaucaugcaaaacuaa

SEQ ID NO: 2139566 - RNA, 15 nt, Staphylococcus aureus subsp. aureus N315
aaauaucaugcaaaa

SEQ ID NO: 2139567 - RNA, 18 nt, Staphylococcus aureus subsp. aureus N315
aaauaucaugcaaaacua

SEQ ID NO: 2139568 - RNA, 17 nt, Staphylococcus aureus subsp. aureus N315
aaauaucaguaauaaua

SEQ ID NO: 2139569 - RNA, 21 nt, Staphylococcus aureus subsp. aureus N315
aaauaucuaccuuuuaauuua

SEQ ID NO: 2139570 - RNA, 22 nt, Staphylococcus aureus subsp. aureus N315
aaauaucuaccuuuuaauuuau

SEQ ID NO: 2139571 - RNA, 20 nt, Staphylococcus aureus subsp. aureus N315
aaauaucgagaggguacacu

SEQ ID NO: 2139572 - RNA, 19 nt, Staphylococcus aureus subsp. aureus N315
aaauagaaaaauuucaaaa

SEQ ID NO: 2139573 - RNA, 15 nt, Staphylococcus aureus subsp. aureus N315
aaauacgcaaaccaa

SEQ ID NO: 2139574 - RNA, 12 nt, Staphylococcus aureus subsp. aureus N315
aaauagaaacua

SEQ ID NO: 2139575 - RNA, 14 nt, Staphylococcus aureus subsp. aureus N315
aaauagaaagaaau

SEQ ID NO: 2139576 - RNA, 18 nt, Staphylococcus aureus subsp. aureus N315
aaauaccuaccacaauaa

SEQ ID NO: 2139577 - RNA, 17 nt, Staphylococcus aureus subsp. aureus N315
aaauaccgucuucucua

SEQ ID NO: 2139578 - RNA, 21 nt, Staphylococcus aureus subsp. aureus N315
aaauacuuuuugaugauuuac

SEQ ID NO: 2139579 - RNA, 16 nt, Staphylococcus aureus subsp. aureus N315
aaauacaucggaauuc

SEQ ID NO: 2139580 - RNA, 19 nt, Staphylococcus aureus subsp. aureus N315
aaauacauccauacuucua

SEQ ID NO: 2139581 - RNA, 17 nt, Staphylococcus aureus subsp. aureus N315
aaauacaucaauuucua

SEQ ID NO: 2139582 - RNA, 17 nt, Staphylococcus aureus subsp. aureus N315
aaauacaauuucuucau

SEQ ID NO: 2139583 - RNA, 18 nt, Staphylococcus aureus subsp. aureus N315
aaauacaaugaauuguua

SEQ ID NO: 2139584 - RNA, 19 nt, Staphylococcus aureus subsp. aureus N315
aaauacaaagccuuaauau

SEQ ID NO: 2139585 - RNA, 12 nt, Staphylococcus aureus subsp. aureus N315
aaauacaaauau

SEQ ID NO: 2139586 - RNA, 14 nt, Staphylococcus aureus subsp. aureus N315
aaauaaauauaaaa

SEQ ID NO: 2139587 - RNA, 17 nt, Staphylococcus aureus subsp. aureus N315
aaauaaugucuuacuuu

SEQ ID NO: 2139588 - RNA, 15 nt, Staphylococcus aureus subsp. aureus N315
aaaguugacaauaca

SEQ ID NO: 2139589 - RNA, 18 nt, Staphylococcus aureus subsp. aureus N315
aaaguugacaauacaaau

SEQ ID NO: 2139590 - RNA, 20 nt, Staphylococcus aureus subsp. aureus N315
aaaguugguuuuauuaauuc

SEQ ID NO: 2139591 - RNA, 17 nt, Staphylococcus aureus subsp. aureus N315
aaaguuguaauuuaaaa

SEQ ID NO: 2139592 - RNA, 16 nt, Staphylococcus aureus subsp. aureus N315
aaaguuguauucugaa

SEQ ID NO: 2139593 - RNA, 20 nt, Staphylococcus aureus subsp. aureus N315
aaaguuguauucugaaacuu

SEQ ID NO: 2139594 - RNA, 17 nt, Staphylococcus aureus subsp. aureus N315
aaaguuuauuuauguuc

SEQ ID NO: 2139595 - RNA, 18 nt, Staphylococcus aureus subsp. aureus N315
aaaguuacaguguaauca

SEQ ID NO: 2139596 - RNA, 21 nt, Staphylococcus aureus subsp. aureus N315
aaaguuaucugcuuuucuauu

SEQ ID NO: 2139597 - RNA, 18 nt, Staphylococcus aureus subsp. aureus N315
aaaguucauuacaaacuu

SEQ ID NO: 2139598 - RNA, 13 nt, Staphylococcus aureus subsp. aureus N315
aaauaaaaauuau

SEQ ID NO: 2139599 - RNA, 19 nt, Staphylococcus aureus subsp. aureus N315
aaauaaacucaccaaguuc

SEQ ID NO: 2139600 - RNA, 13 nt, Staphylococcus aureus subsp. aureus N315
aaauaaaaaaugc

SEQ ID NO: 2139601 - RNA, 16 nt, Staphylococcus aureus subsp. aureus N315
aaauaaauacaauaga

SEQ ID NO: 2139602 - RNA, 14 nt, Staphylococcus aureus subsp. aureus N315
aaauaaauaagcaa

SEQ ID NO: 2139603 - RNA, 15 nt, Staphylococcus aureus subsp. aureus N315
aaaguuucuccaccu

SEQ ID NO: 2139604 - RNA, 11 nt, Staphylococcus aureus subsp. aureus N315
aaaguuucucc

SEQ ID NO: 2139605 - RNA, 22 nt, Staphylococcus aureus subsp. aureus N315
aaaguuuguauauucuuuuuaa

SEQ ID NO: 2139606 - RNA, 11 nt, Staphylococcus aureus subsp. aureus N315
aaaguuuucau

SEQ ID NO: 2139607 - RNA, 16 nt, Staphylococcus aureus subsp. aureus N315
aaaguuuguauauucu

SEQ ID NO: 2139608 - RNA, 14 nt, Staphylococcus aureus subsp. aureus N315
aaaguuuuugucuu

SEQ ID NO: 2139609 - RNA, 15 nt, Staphylococcus aureus subsp. aureus N315
aaauaaaaaaacacc

SEQ ID NO: 2139610 - RNA, 14 nt, Staphylococcus aureus subsp. aureus N315
aaagugguuuuacu

SEQ ID NO: 2139611 - RNA, 15 nt, Staphylococcus aureus subsp. aureus N315
aaagugguuuuacug

SEQ ID NO: 2139612 - RNA, 16 nt, Staphylococcus aureus subsp. aureus N315
aaaguguuaugaauua

SEQ ID NO: 2139613 - RNA, 21 nt, Staphylococcus aureus subsp. aureus N315
aaagugucuaacgcuguuuca

SEQ ID NO: 2139614 - RNA, 18 nt, Staphylococcus aureus subsp. aureus N315
aaagugcgguuauuuaua

SEQ ID NO: 2139615 - RNA, 14 nt, Staphylococcus aureus subsp. aureus N315
aaagugauuuaaaa

SEQ ID NO: 2139616 - RNA, 16 nt, Staphylococcus aureus subsp. aureus N315
aaagugauaauuaaaa

SEQ ID NO: 2139617 - RNA, 22 nt, Staphylococcus aureus subsp. aureus N315
aaagugauaauuaaaauaagau

SEQ ID NO: 2139618 - RNA, 13 nt, Staphylococcus aureus subsp. aureus N315
aaagugaauauua

SEQ ID NO: 2139619 - RNA, 19 nt, Staphylococcus aureus subsp. aureus N315
aaagucuucuucaacaauu

SEQ ID NO: 2139620 - RNA, 13 nt, Staphylococcus aureus subsp. aureus N315
aaagucuuuaaua

SEQ ID NO: 2139621 - RNA, 21 nt, Staphylococcus aureus subsp. aureus N315
aaagucguuguugaaauuaaa

SEQ ID NO: 2139622 - RNA, 14 nt, Staphylococcus aureus subsp. aureus N315
aaagucuucaucuu

SEQ ID NO: 2139623 - RNA, 21 nt, Staphylococcus aureus subsp. aureus N315
aaagucuguugguuuaucagc

SEQ ID NO: 2139624 - RNA, 18 nt, Staphylococcus aureus subsp. aureus N315
aaaguagaauuauuuaga

SEQ ID NO: 2139625 - RNA, 14 nt, Staphylococcus aureus subsp. aureus N315
aaaguacuuuaaaa

SEQ ID NO: 2139626 - RNA, 19 nt, Staphylococcus aureus subsp. aureus N315
aaaguacuuuaaaauugua

SEQ ID NO: 2139627 - RNA, 22 nt, Staphylococcus aureus subsp. aureus N315
aaaguaauaugagugaaaguuu

SEQ ID NO: 2139628 - RNA, 13 nt, Staphylococcus aureus subsp. aureus N315
aaaguaauaugag

SEQ ID NO: 2139629 - RNA, 15 nt, Staphylococcus aureus subsp. aureus N315
aaaguaaguaaaaua

SEQ ID NO: 2139630 - RNA, 16 nt, Staphylococcus aureus subsp. aureus N315
aaaguaaguaaaauaa

SEQ ID NO: 2139631 - RNA, 13 nt, Staphylococcus aureus subsp. aureus N315
aaaguaaguaaaa

SEQ ID NO: 2139632 - RNA, 23 nt, Staphylococcus aureus subsp. aureus N315
aaauuacuuaauaguaacauaag

SEQ ID NO: 2139633 - RNA, 15 nt, Staphylococcus aureus subsp. aureus N315
aaauuagucauccaa

SEQ ID NO: 2139634 - RNA, 18 nt, Staphylococcus aureus subsp. aureus N315
aaauuagucauccaaaga

SEQ ID NO: 2139635 - RNA, 17 nt, Staphylococcus aureus subsp. aureus N315
aaauuagggugaacagu

SEQ ID NO: 2139636 - RNA, 22 nt, Staphylococcus aureus subsp. aureus N315
aaauuagcaagugaguaacauu

SEQ ID NO: 2139637 - RNA, 23 nt, Staphylococcus aureus subsp. aureus N315
aaauuagccuaauugagagaagu

SEQ ID NO: 2139638 - RNA, 12 nt, Staphylococcus aureus subsp. aureus N315
aaauuauuuaau

SEQ ID NO: 2139639 - RNA, 12 nt, Staphylococcus aureus subsp. aureus N315
aaauuauauaaa

SEQ ID NO: 2139640 - RNA, 15 nt, Staphylococcus aureus subsp. aureus N315
aaaaagaugaaaaag

SEQ ID NO: 2139641 - RNA, 18 nt, Staphylococcus aureus subsp. aureus N315
aaauuaaaaaacaaaacu

SEQ ID NO: 2139642 - RNA, 18 nt, Staphylococcus aureus subsp. aureus N315
aaauuaaaaagguacuaa

SEQ ID NO: 2139643 - RNA, 17 nt, Staphylococcus aureus subsp. aureus N315
aaauuaagaagaaauac

SEQ ID NO: 2139644 - RNA, 21 nt, Staphylococcus aureus subsp. aureus N315
aaauuaagaagaaauacuuga

SEQ ID NO: 2139645 - RNA, 13 nt, Staphylococcus aureus subsp. aureus N315
aaauuaagaauaa

SEQ ID NO: 2139646 - RNA, 15 nt, Staphylococcus aureus subsp. aureus N315
aaauuaagaauaauc

SEQ ID NO: 2139647 - RNA, 12 nt, Staphylococcus aureus subsp. aureus N315
aaauuaaugaac

SEQ ID NO: 2139648 - RNA, 17 nt, Staphylococcus aureus subsp. aureus N315
aaauuaauaauuuucca

SEQ ID NO: 2139649 - RNA, 15 nt, Staphylococcus aureus subsp. aureus N315
aaauuaauagagaaa

SEQ ID NO: 2139650 - RNA, 19 nt, Staphylococcus aureus subsp. aureus N315
aaauggugcgaauaauaau

SEQ ID NO: 2139651 - RNA, 16 nt, Staphylococcus aureus subsp. aureus N315
aaauggugaacuaaau

SEQ ID NO: 2139652 - RNA, 20 nt, Staphylococcus aureus subsp. aureus N315
aaauggugaacuaaauugaa

SEQ ID NO: 2139653 - RNA, 23 nt, Staphylococcus aureus subsp. aureus N315
aaauguaacauuaaaaauaaaag

SEQ ID NO: 2139654 - RNA, 15 nt, Staphylococcus aureus subsp. aureus N315
aaauguacauuguaa

SEQ ID NO: 2139655 - RNA, 19 nt, Staphylococcus aureus subsp. aureus N315
aaaugugcaauuagaauau

SEQ ID NO: 2139656 - RNA, 18 nt, Staphylococcus aureus subsp. aureus N315
aaaugugcaauuagaaua

SEQ ID NO: 2139657 - RNA, 19 nt, Staphylococcus aureus subsp. aureus N315
aaauguuuuauguauuuau

SEQ ID NO: 2139658 - RNA, 22 nt, Staphylococcus aureus subsp. aureus N315
aaauguauuauucucucauuug

SEQ ID NO: 2139659 - RNA, 16 nt, Staphylococcus aureus subsp. aureus N315
aaauguauuaaacauu

SEQ ID NO: 2139660 - RNA, 21 nt, Staphylococcus aureus subsp. aureus N315
aaaugucaguuuugaagaaua

SEQ ID NO: 2139661 - RNA, 14 nt, Staphylococcus aureus subsp. aureus N315
aaaugucauuugaa

SEQ ID NO: 2139662 - RNA, 13 nt, Staphylococcus aureus subsp. aureus N315
aaaugcauuacua

SEQ ID NO: 2139663 - RNA, 23 nt, Staphylococcus aureus subsp. aureus N315
aaaugauagcuaaacauuuuaua

SEQ ID NO: 2139664 - RNA, 12 nt, Staphylococcus aureus subsp. aureus N315
aaaugauaagaa

SEQ ID NO: 2139665 - RNA, 19 nt, Staphylococcus aureus subsp. aureus N315
aaaugcagcuguauaacca

SEQ ID NO: 2139666 - RNA, 14 nt, Staphylococcus aureus subsp. aureus N315
aaaugcaauuuuuc

SEQ ID NO: 2139667 - RNA, 16 nt, Staphylococcus aureus subsp. aureus N315
aaaugaucaucguaua

SEQ ID NO: 2139668 - RNA, 22 nt, Staphylococcus aureus subsp. aureus N315
aaaugcaauacaccuauuacac

SEQ ID NO: 2139669 - RNA, 22 nt, Staphylococcus aureus subsp. aureus N315
aaaucucgucacauauaaauau

SEQ ID NO: 2139670 - RNA, 18 nt, Staphylococcus aureus subsp. aureus N315
aaaucgugcccauaugau

SEQ ID NO: 2139671 - RNA, 16 nt, Staphylococcus aureus subsp. aureus N315
aaaucuuuacuuguaa

SEQ ID NO: 2139672 - RNA, 19 nt, Staphylococcus aureus subsp. aureus N315
aaaucuuuaacauuugucc

SEQ ID NO: 2139673 - RNA, 23 nt, Staphylococcus aureus subsp. aureus N315
aaaucuuguuggauuuuaacaag

SEQ ID NO: 2139674 - RNA, 13 nt, Staphylococcus aureus subsp. aureus N315
aaaucuucuauuu

SEQ ID NO: 2139675 - RNA, 14 nt, Staphylococcus aureus subsp. aureus N315
aaaugaauuauuua

SEQ ID NO: 2139676 - RNA, 20 nt, Staphylococcus aureus subsp. aureus N315
aaaugaauguuaagacauau

SEQ ID NO: 2139677 - RNA, 22 nt, Staphylococcus aureus subsp. aureus N315
aaaugaaucgcuuugauuacca

SEQ ID NO: 2139678 - RNA, 18 nt, Staphylococcus aureus subsp. aureus N315
aaaugaagguguugaaaa

SEQ ID NO: 2139679 - RNA, 15 nt, Staphylococcus aureus subsp. aureus N315
aaaugaauugcuugu

SEQ ID NO: 2139680 - RNA, 21 nt, Staphylococcus aureus subsp. aureus N315
aaaugaauuauuuaaaaugcu

SEQ ID NO: 2139681 - RNA, 15 nt, Staphylococcus aureus subsp. aureus N315
aaaugacauuuuaaa

SEQ ID NO: 2139682 - RNA, 23 nt, Staphylococcus aureus subsp. aureus N315
aaaugacugaauuaauauccaaa

SEQ ID NO: 2139683 - RNA, 21 nt, Staphylococcus aureus subsp. aureus N315
aaaugacugaauuaauaucca

SEQ ID NO: 2139684 - RNA, 24 nt, Staphylococcus aureus subsp. aureus N315
aaaugacgugcuuuuaaauguauu

SEQ ID NO: 2139685 - RNA, 16 nt, Staphylococcus aureus subsp. aureus N315
aaaugagcguuccauu

SEQ ID NO: 2139686 - RNA, 18 nt, Staphylococcus aureus subsp. aureus N315
aaaugacgcucgagcucu

SEQ ID NO: 2139687 - RNA, 22 nt, Staphylococcus aureus subsp. aureus N315
aaaugacgauaccuuuaauaau

SEQ ID NO: 2139688 - RNA, 19 nt, Staphylococcus aureus subsp. aureus N315
aaaugacgauaccuuuaau

SEQ ID NO: 2139689 - RNA, 14 nt, Staphylococcus aureus subsp. aureus N315
aaaugacugaauua

SEQ ID NO: 2139690 - RNA, 18 nt, Staphylococcus aureus subsp. aureus N315
aaaugacugaauuaauau

SEQ ID NO: 2139691 - RNA, 20 nt, Staphylococcus aureus subsp. aureus N315
aaaugacgugcuuuuaaaug

SEQ ID NO: 2139692 - RNA, 23 nt, Staphylococcus aureus subsp. aureus N315
aaauauguauguuuuaucaauau

SEQ ID NO: 2139693 - RNA, 17 nt, Staphylococcus aureus subsp. aureus N315
aaauauguaaucagguu

SEQ ID NO: 2139694 - RNA, 23 nt, Staphylococcus aureus subsp. aureus N315
aaauauguaaucagguuuaaaca

SEQ ID NO: 2139695 - RNA, 18 nt, Staphylococcus aureus subsp. aureus N315
aaauauuaauauaaaaua

SEQ ID NO: 2139696 - RNA, 16 nt, Staphylococcus aureus subsp. aureus N315
aaauccaaaaucuuua

SEQ ID NO: 2139697 - RNA, 15 nt, Staphylococcus aureus subsp. aureus N315
aaauccacacauuaa

SEQ ID NO: 2139698 - RNA, 22 nt, Staphylococcus aureus subsp. aureus N315
aaaucccgccgucuccauauuu

SEQ ID NO: 2139699 - RNA, 16 nt, Staphylococcus aureus subsp. aureus N315
aaaucggauuaacauu

SEQ ID NO: 2139700 - RNA, 15 nt, Staphylococcus aureus subsp. aureus N315
aaaucggauuaacau

SEQ ID NO: 2139701 - RNA, 15 nt, Staphylococcus aureus subsp. aureus N315
aaaucggaauaaaau

SEQ ID NO: 2139702 - RNA, 23 nt, Staphylococcus aureus subsp. aureus N315
aaaucgaauugguaaaaaucuca

SEQ ID NO: 2139703 - RNA, 22 nt, Staphylococcus aureus subsp. aureus N315
aaauccuaagcaucguaaaaaa

SEQ ID NO: 2139704 - RNA, 20 nt, Staphylococcus aureus subsp. aureus N315
aaauccguuaaaauuuuaau

SEQ ID NO: 2139705 - RNA, 13 nt, Staphylococcus aureus subsp. aureus N315
aaaucccuaaaaa

SEQ ID NO: 2139706 - RNA, 23 nt, Staphylococcus aureus subsp. aureus N315
aaauuguggagaucuaacaauau

SEQ ID NO: 2139707 - RNA, 16 nt, Staphylococcus aureus subsp. aureus N315
aaauuguguugaauca

SEQ ID NO: 2139708 - RNA, 23 nt, Staphylococcus aureus subsp. aureus N315
aaauuguguugaaucaacaguuu

SEQ ID NO: 2139709 - RNA, 17 nt, Staphylococcus aureus subsp. aureus N315
aaauuguucuaauacac

SEQ ID NO: 2139710 - RNA, 14 nt, Staphylococcus aureus subsp. aureus N315
aaauuguguuucuu

SEQ ID NO: 2139711 - RNA, 17 nt, Staphylococcus aureus subsp. aureus N315
aaauuuaagaaugcgaa

SEQ ID NO: 2139712 - RNA, 11 nt, Staphylococcus aureus subsp. aureus N315
aaauuuaaaua

SEQ ID NO: 2139713 - RNA, 12 nt, Staphylococcus aureus subsp. aureus N315
aaauuuauuaua

SEQ ID NO: 2139714 - RNA, 13 nt, Staphylococcus aureus subsp. aureus N315
aaauuuauuuuua

SEQ ID NO: 2139715 - RNA, 22 nt, Staphylococcus aureus subsp. aureus N315
aaauuuauuauaaaauagaagu

SEQ ID NO: 2139716 - RNA, 17 nt, Staphylococcus aureus subsp. aureus N315
aaauuuauuauaaaaua

SEQ ID NO: 2139717 - RNA, 14 nt, Staphylococcus aureus subsp. aureus N315
aaauuuauuauaaa

SEQ ID NO: 2139718 - RNA, 16 nt, Staphylococcus aureus subsp. aureus N315
aaauuuaguaucucau

SEQ ID NO: 2139719 - RNA, 15 nt, Staphylococcus aureus subsp. aureus N315
aaauuuaauauuguu

SEQ ID NO: 2139720 - RNA, 22 nt, Staphylococcus aureus subsp. aureus N315
aaauuuacgaaaguagaauuau

SEQ ID NO: 2139721 - RNA, 14 nt, Staphylococcus aureus subsp. aureus N315
aaauuuaauacaau

SEQ ID NO: 2139722 - RNA, 17 nt, Staphylococcus aureus subsp. aureus N315
aaauuuaauacaauuca

SEQ ID NO: 2139723 - RNA, 14 nt, Staphylococcus aureus subsp. aureus N315
aaauuuauucaaaa

SEQ ID NO: 2139724 - RNA, 17 nt, Staphylococcus aureus subsp. aureus N315
aaauuucaggcguuaau

SEQ ID NO: 2139725 - RNA, 16 nt, Staphylococcus aureus subsp. aureus N315
aaauuucauaaaguuu

SEQ ID NO: 2139726 - RNA, 22 nt, Staphylococcus aureus subsp. aureus N315
aaauuucauaaaguuuauuuau

SEQ ID NO: 2139727 - RNA, 16 nt, Staphylococcus aureus subsp. aureus N315
aaauuucgacaucuag

SEQ ID NO: 2139728 - RNA, 19 nt, Staphylococcus aureus subsp. aureus N315
aaauuucgccucaucuaau

SEQ ID NO: 2139729 - RNA, 23 nt, Staphylococcus aureus subsp. aureus N315
aaauuucgccucaucuaauuuau

SEQ ID NO: 2139730 - RNA, 22 nt, Staphylococcus aureus subsp. aureus N315
aaauuuguaccaaauaaauuaa

SEQ ID NO: 2139731 - RNA, 14 nt, Staphylococcus aureus subsp. aureus N315
aaauuuuacgaaaa

SEQ ID NO: 2139732 - RNA, 17 nt, Staphylococcus aureus subsp. aureus N315
aaauugcuugaaauuau

SEQ ID NO: 2139733 - RNA, 18 nt, Staphylococcus aureus subsp. aureus N315
aaauugcuugaaauuauu

SEQ ID NO: 2139734 - RNA, 20 nt, Staphylococcus aureus subsp. aureus N315
aaauuggacuuauggguuca

SEQ ID NO: 2139735 - RNA, 15 nt, Staphylococcus aureus subsp. aureus N315
aaauugguuuggaua

SEQ ID NO: 2139736 - RNA, 23 nt, Staphylococcus aureus subsp. aureus N315
aaauugguuuggauaaaaugaua

SEQ ID NO: 2139737 - RNA, 21 nt, Staphylococcus aureus subsp. aureus N315
aaauugcuaaaaaaauuaaaa

SEQ ID NO: 2139738 - RNA, 17 nt, Staphylococcus aureus subsp. aureus N315
aaauugcuauauuagua

SEQ ID NO: 2139739 - RNA, 13 nt, Staphylococcus aureus subsp. aureus N315
aaauugcugacac

SEQ ID NO: 2139740 - RNA, 17 nt, Staphylococcus aureus subsp. aureus N315
aaauugccuuucauuuu

SEQ ID NO: 2139741 - RNA, 19 nt, Staphylococcus aureus subsp. aureus N315
aaauugcuaaaaaaauuaa

SEQ ID NO: 2139742 - RNA, 13 nt, Staphylococcus aureus subsp. aureus N315
aaauucauuugua

SEQ ID NO: 2139743 - RNA, 11 nt, Staphylococcus aureus subsp. aureus N315
aaauucauuug

SEQ ID NO: 2139744 - RNA, 20 nt, Staphylococcus aureus subsp. aureus N315
aaauuccaagagaauuaaua

SEQ ID NO: 2139745 - RNA, 12 nt, Staphylococcus aureus subsp. aureus N315
aaauucaucuug

SEQ ID NO: 2139746 - RNA, 19 nt, Staphylococcus aureus subsp. aureus N315
aaauugaccgacaaaacuu

SEQ ID NO: 2139747 - RNA, 15 nt, Staphylococcus aureus subsp. aureus N315
aaauugacgcauuaa

SEQ ID NO: 2139748 - RNA, 13 nt, Staphylococcus aureus subsp. aureus N315
aaauugaacuuug

SEQ ID NO: 2139749 - RNA, 16 nt, Staphylococcus aureus subsp. aureus N315
aaauugaaauguuuau

SEQ ID NO: 2139750 - RNA, 12 nt, Staphylococcus aureus subsp. aureus N315
aaauuuugaaga

SEQ ID NO: 2139751 - RNA, 18 nt, Staphylococcus aureus subsp. aureus N315
aaauuuguguucaaauca

SEQ ID NO: 2139752 - RNA, 17 nt, Staphylococcus aureus subsp. aureus N315
aaauuuuuaagaagcuu

SEQ ID NO: 2139753 - RNA, 18 nt, Staphylococcus aureus subsp. aureus N315
aacaaaaagguucuccac

SEQ ID NO: 2139754 - RNA, 19 nt, Staphylococcus aureus subsp. aureus N315
aaauuuuuuagugaaaaag

SEQ ID NO: 2139755 - RNA, 17 nt, Staphylococcus aureus subsp. aureus N315
aaauuuuuuguaaacau

SEQ ID NO: 2139756 - RNA, 23 nt, Staphylococcus aureus subsp. aureus N315
aacaaaguaauccccgaagcaca

SEQ ID NO: 2139757 - RNA, 22 nt, Staphylococcus aureus subsp. aureus N315
aacaaacauuaaucuauauaaa

SEQ ID NO: 2139758 - RNA, 13 nt, Staphylococcus aureus subsp. aureus N315
aacaaacauaaau

SEQ ID NO: 2139759 - RNA, 23 nt, Staphylococcus aureus subsp. aureus N315
aacaaaauuaagaagaaauacuu

SEQ ID NO: 2139760 - RNA, 13 nt, Staphylococcus aureus subsp. aureus N315
aacaaaauuaaga

SEQ ID NO: 2139761 - RNA, 14 nt, Staphylococcus aureus subsp. aureus N315
aacaaaauuaaaua

SEQ ID NO: 2139762 - RNA, 18 nt, Staphylococcus aureus subsp. aureus N315
aacaaaauauacuaaauu

SEQ ID NO: 2139763 - RNA, 14 nt, Staphylococcus aureus subsp. aureus N315
aacaaaagaaaguu

SEQ ID NO: 2139764 - RNA, 22 nt, Staphylococcus aureus subsp. aureus N315
aacaaaacuugagcuauucaua

SEQ ID NO: 2139765 - RNA, 20 nt, Staphylococcus aureus subsp. aureus N315
aacaagcuuuucauuuuuau

SEQ ID NO: 2139766 - RNA, 14 nt, Staphylococcus aureus subsp. aureus N315
aacaagcaucauga

SEQ ID NO: 2139767 - RNA, 18 nt, Staphylococcus aureus subsp. aureus N315
aacaagcauuuuucaauu

SEQ ID NO: 2139768 - RNA, 17 nt, Staphylococcus aureus subsp. aureus N315
aacaagaaguuuccaac

SEQ ID NO: 2139769 - RNA, 23 nt, Staphylococcus aureus subsp. aureus N315
aacaacuugggcaggugacuuuc

SEQ ID NO: 2139770 - RNA, 14 nt, Staphylococcus aureus subsp. aureus N315
aacaacuaaagguc

SEQ ID NO: 2139771 - RNA, 20 nt, Staphylococcus aureus subsp. aureus N315
aacaaccgucccauaaaaga

SEQ ID NO: 2139772 - RNA, 14 nt, Staphylococcus aureus subsp. aureus N315
aacaaauauuagaa

SEQ ID NO: 2139773 - RNA, 19 nt, Staphylococcus aureus subsp. aureus N315
aacaaauauuagaacauuu

SEQ ID NO: 2139774 - RNA, 15 nt, Staphylococcus aureus subsp. aureus N315
aacaaaucuuuuaaa

SEQ ID NO: 2139775 - RNA, 19 nt, Staphylococcus aureus subsp. aureus N315
aacaaaugaaaaaguaaaa

SEQ ID NO: 2139776 - RNA, 20 nt, Staphylococcus aureus subsp. aureus N315
aacaaauucauauuaacugu

SEQ ID NO: 2139777 - RNA, 16 nt, Staphylococcus aureus subsp. aureus N315
aacaaaucgauuaauu

SEQ ID NO: 2139778 - RNA, 20 nt, Staphylococcus aureus subsp. aureus N315
aacaaauccauuaaaucaac

SEQ ID NO: 2139779 - RNA, 22 nt, Staphylococcus aureus subsp. aureus N315
aacaaauccauuaaaucaacaa

SEQ ID NO: 2139780 - RNA, 22 nt, Staphylococcus aureus subsp. aureus N315
aacaaauauaauguauaaaaca

SEQ ID NO: 2139781 - RNA, 15 nt, Staphylococcus aureus subsp. aureus N315
aacaaauaguucaaa

SEQ ID NO: 2139782 - RNA, 22 nt, Staphylococcus aureus subsp. aureus N315
aacaacaaauauaauguauaaa

SEQ ID NO: 2139783 - RNA, 15 nt, Staphylococcus aureus subsp. aureus N315
aacaacaaucaaauu

SEQ ID NO: 2139784 - RNA, 18 nt, Staphylococcus aureus subsp. aureus N315
caacugucgguucaucua

SEQ ID NO: 2139785 - RNA, 17 nt, Staphylococcus aureus subsp. aureus N315
caacugaucauuuucau

SEQ ID NO: 2139786 - RNA, 13 nt, Staphylococcus aureus subsp. aureus N315
caacugagaaauc

SEQ ID NO: 2139787 - RNA, 16 nt, Staphylococcus aureus subsp. aureus N315
caacugaaauuuuucc

SEQ ID NO: 2139788 - RNA, 17 nt, Staphylococcus aureus subsp. aureus N315
caacuaauuuaaagcau

SEQ ID NO: 2139789 - RNA, 16 nt, Staphylococcus aureus subsp. aureus N315
caacuaagaugacuga

SEQ ID NO: 2139790 - RNA, 14 nt, Staphylococcus aureus subsp. aureus N315
caacuaaauuuucu

SEQ ID NO: 2139791 - RNA, 18 nt, Staphylococcus aureus subsp. aureus N315
caacuaaaggucccauua

SEQ ID NO: 2139792 - RNA, 17 nt, Staphylococcus aureus subsp. aureus N315
caagacucccuuuuuaa

SEQ ID NO: 2139793 - RNA, 14 nt, Staphylococcus aureus subsp. aureus N315
caagaacuuuaaaa

SEQ ID NO: 2139794 - RNA, 17 nt, Staphylococcus aureus subsp. aureus N315
caagaaauguuaaauua

SEQ ID NO: 2139795 - RNA, 12 nt, Staphylococcus aureus subsp. aureus N315
caagaaaaaguu

SEQ ID NO: 2139796 - RNA, 20 nt, Staphylococcus aureus subsp. aureus N315
caacuuuguuuucaguaacu

SEQ ID NO: 2139797 - RNA, 15 nt, Staphylococcus aureus subsp. aureus N315
caacuuuuagaguuu

SEQ ID NO: 2139798 - RNA, 21 nt, Staphylococcus aureus subsp. aureus N315
caacuuuuagaguuuuuauua

SEQ ID NO: 2139799 - RNA, 18 nt, Staphylococcus aureus subsp. aureus N315
caacuuuucaaagccaca

SEQ ID NO: 2139800 - RNA, 23 nt, Staphylococcus aureus subsp. aureus N315
caacuucuucuccguauuuaccu

SEQ ID NO: 2139801 - RNA, 16 nt, Staphylococcus aureus subsp. aureus N315
caacuucuuucguuuc

SEQ ID NO: 2139802 - RNA, 21 nt, Staphylococcus aureus subsp. aureus N315
caacuuuagcauauucgcuua

SEQ ID NO: 2139803 - RNA, 19 nt, Staphylococcus aureus subsp. aureus N315
caacuuuaauuuuucauua

SEQ ID NO: 2139804 - RNA, 23 nt, Staphylococcus aureus subsp. aureus N315
caacuuuaaucaaaaaagacuca

SEQ ID NO: 2139805 - RNA, 15 nt, Staphylococcus aureus subsp. aureus N315
caacuuuacgauaaa

SEQ ID NO: 2139806 - RNA, 23 nt, Staphylococcus aureus subsp. aureus N315
caacuugugguuggaagucugcu

SEQ ID NO: 2139807 - RNA, 18 nt, Staphylococcus aureus subsp. aureus N315
caacuuuaagacuuugau

SEQ ID NO: 2139808 - RNA, 12 nt, Staphylococcus aureus subsp. aureus N315
caacuuguauug

SEQ ID NO: 2139809 - RNA, 22 nt, Staphylococcus aureus subsp. aureus N315
caagagccuuguuggcuuuuuu

SEQ ID NO: 2139810 - RNA, 16 nt, Staphylococcus aureus subsp. aureus N315
caagagguaaaucugu

SEQ ID NO: 2139811 - RNA, 14 nt, Staphylococcus aureus subsp. aureus N315
caagauuccaucac

SEQ ID NO: 2139812 - RNA, 23 nt, Staphylococcus aureus subsp. aureus N315
caagauuccaucacgauauguug

SEQ ID NO: 2139813 - RNA, 23 nt, Staphylococcus aureus subsp. aureus N315
caagauuaugacaacauaacaaa

SEQ ID NO: 2139814 - RNA, 16 nt, Staphylococcus aureus subsp. aureus N315
caaggaaaucauauau

SEQ ID NO: 2139815 - RNA, 18 nt, Staphylococcus aureus subsp. aureus N315
caaggaaaucauauauuu

SEQ ID NO: 2139816 - RNA, 20 nt, Staphylococcus aureus subsp. aureus N315
caaggaaaucauauauuucu

SEQ ID NO: 2139817 - RNA, 16 nt, Staphylococcus aureus subsp. aureus N315
caagcuuuuuaggaau

SEQ ID NO: 2139818 - RNA, 17 nt, Staphylococcus aureus subsp. aureus N315
caagcuuuuuaggaaug

SEQ ID NO: 2139819 - RNA, 13 nt, Staphylococcus aureus subsp. aureus N315
caauacuuuuuau

SEQ ID NO: 2139820 - RNA, 15 nt, Staphylococcus aureus subsp. aureus N315
caauacuuuuuauau

SEQ ID NO: 2139821 - RNA, 18 nt, Staphylococcus aureus subsp. aureus N315
caauacuuucacuuugaa

SEQ ID NO: 2139822 - RNA, 16 nt, Staphylococcus aureus subsp. aureus N315
caauaccgaauaauuu

SEQ ID NO: 2139823 - RNA, 18 nt, Staphylococcus aureus subsp. aureus N315
caauacauuaauauaaau

SEQ ID NO: 2139824 - RNA, 22 nt, Staphylococcus aureus subsp. aureus N315
caauagguucauuauuuaaaua

SEQ ID NO: 2139825 - RNA, 15 nt, Staphylococcus aureus subsp. aureus N315
caauauaacaucaaa

SEQ ID NO: 2139826 - RNA, 19 nt, Staphylococcus aureus subsp. aureus N315
caauagugugcaaguuggc

SEQ ID NO: 2139827 - RNA, 17 nt, Staphylococcus aureus subsp. aureus N315
caauagguacaacuaaa

SEQ ID NO: 2139828 - RNA, 18 nt, Staphylococcus aureus subsp. aureus N315
caauagguacaacuaaau

SEQ ID NO: 2139829 - RNA, 15 nt, Staphylococcus aureus subsp. aureus N315
caauaggaugaaacu

SEQ ID NO: 2139830 - RNA, 15 nt, Staphylococcus aureus subsp. aureus N315
caauauaacauugca

SEQ ID NO: 2139831 - RNA, 17 nt, Staphylococcus aureus subsp. aureus N315
caauauaauuuccuaaa

SEQ ID NO: 2139832 - RNA, 13 nt, Staphylococcus aureus subsp. aureus N315
caauauuaaaaua

SEQ ID NO: 2139833 - RNA, 13 nt, Staphylococcus aureus subsp. aureus N315
caauauuaaaauc

SEQ ID NO: 2139834 - RNA, 15 nt, Staphylococcus aureus subsp. aureus N315
caauauuaaugaaua

SEQ ID NO: 2139835 - RNA, 17 nt, Staphylococcus aureus subsp. aureus N315
caauauuaaugaauaua

SEQ ID NO: 2139836 - RNA, 19 nt, Staphylococcus aureus subsp. aureus N315
caauaaugugcaaguuggg

SEQ ID NO: 2139837 - RNA, 12 nt, Staphylococcus aureus subsp. aureus N315
caauaaugaaau

SEQ ID NO: 2139838 - RNA, 16 nt, Staphylococcus aureus subsp. aureus N315
caauaaugaaaugaag

SEQ ID NO: 2139839 - RNA, 24 nt, Staphylococcus aureus subsp. aureus N315
caauaauugaugaaagacugacua

SEQ ID NO: 2139840 - RNA, 18 nt, Staphylococcus aureus subsp. aureus N315
caauaaugugucaaauag

SEQ ID NO: 2139841 - RNA, 23 nt, Staphylococcus aureus subsp. aureus N315
caauaacaccuguuacuugagaa

SEQ ID NO: 2139842 - RNA, 21 nt, Staphylococcus aureus subsp. aureus N315
caauaacaggugcuuacuuuu

SEQ ID NO: 2139843 - RNA, 16 nt, Staphylococcus aureus subsp. aureus N315
caauaacaccaauuga

SEQ ID NO: 2139844 - RNA, 17 nt, Staphylococcus aureus subsp. aureus N315
caauaacaccaauugaa

SEQ ID NO: 2139845 - RNA, 17 nt, Staphylococcus aureus subsp. aureus N315
caaguugcacauuauaa

SEQ ID NO: 2139846 - RNA, 22 nt, Staphylococcus aureus subsp. aureus N315
caaguugcugaauaaaauauau

SEQ ID NO: 2139847 - RNA, 15 nt, Staphylococcus aureus subsp. aureus N315
caauaaauuaugaaa

SEQ ID NO: 2139848 - RNA, 14 nt, Staphylococcus aureus subsp. aureus N315
caauaaaucuuucc

SEQ ID NO: 2139849 - RNA, 12 nt, Staphylococcus aureus subsp. aureus N315
caauaaaucuuu

SEQ ID NO: 2139850 - RNA, 18 nt, Staphylococcus aureus subsp. aureus N315
caauaaauauugauucua

SEQ ID NO: 2139851 - RNA, 14 nt, Staphylococcus aureus subsp. aureus N315
caaguuguuuuuug

SEQ ID NO: 2139852 - RNA, 18 nt, Staphylococcus aureus subsp. aureus N315
caaguaacucaagugauu

SEQ ID NO: 2139853 - RNA, 15 nt, Staphylococcus aureus subsp. aureus N315
caaguaaauguuuua

SEQ ID NO: 2139854 - RNA, 15 nt, Staphylococcus aureus subsp. aureus N315
caagguuuucgccaa

SEQ ID NO: 2139855 - RNA, 17 nt, Staphylococcus aureus subsp. aureus N315
caaguaaauguuuuaug

SEQ ID NO: 2139856 - RNA, 16 nt, Staphylococcus aureus subsp. aureus N315
caaugcauccaaauau

SEQ ID NO: 2139857 - RNA, 15 nt, Staphylococcus aureus subsp. aureus N315
caaugcaaguuggcg

SEQ ID NO: 2139858 - RNA, 12 nt, Staphylococcus aureus subsp. aureus N315
caaucuuuuuaa

SEQ ID NO: 2139859 - RNA, 18 nt, Staphylococcus aureus subsp. aureus N315
caaugaauaacaagaaaa

SEQ ID NO: 2139860 - RNA, 15 nt, Staphylococcus aureus subsp. aureus N315
caaugauuuuuaaaa

SEQ ID NO: 2139861 - RNA, 18 nt, Staphylococcus aureus subsp. aureus N315
caaugauuuuuaaaaaua

SEQ ID NO: 2139862 - RNA, 18 nt, Staphylococcus aureus subsp. aureus N315
caaugauugaauauuguu

SEQ ID NO: 2139863 - RNA, 22 nt, Staphylococcus aureus subsp. aureus N315
caaugaugggaaaucaguaaua

SEQ ID NO: 2139864 - RNA, 11 nt, Staphylococcus aureus subsp. aureus N315
caaugauuaau

SEQ ID NO: 2139865 - RNA, 17 nt, Staphylococcus aureus subsp. aureus N315
caaugauaccuuuaaau

SEQ ID NO: 2139866 - RNA, 22 nt, Staphylococcus aureus subsp. aureus N315
caaugagcaucuugucuaguuc

SEQ ID NO: 2139867 - RNA, 17 nt, Staphylococcus aureus subsp. aureus N315
caaugaggauuguguaa

SEQ ID NO: 2139868 - RNA, 18 nt, Staphylococcus aureus subsp. aureus N315
caaucauuguaaaugauc

SEQ ID NO: 2139869 - RNA, 21 nt, Staphylococcus aureus subsp. aureus N315
caaucaucgcaaauacauaau

SEQ ID NO: 2139870 - RNA, 20 nt, Staphylococcus aureus subsp. aureus N315
caauauuuaccacaaauauc

SEQ ID NO: 2139871 - RNA, 22 nt, Staphylococcus aureus subsp. aureus N315
caauauuugauaaguagaaaau

SEQ ID NO: 2139872 - RNA, 12 nt, Staphylococcus aureus subsp. aureus N315
caauauucguaa

SEQ ID NO: 2139873 - RNA, 13 nt, Staphylococcus aureus subsp. aureus N315
caaccaaaaccaa

SEQ ID NO: 2139874 - RNA, 13 nt, Staphylococcus aureus subsp. aureus N315
caaccaauuauua

SEQ ID NO: 2139875 - RNA, 14 nt, Staphylococcus aureus subsp. aureus N315
caacauauuauaua

SEQ ID NO: 2139876 - RNA, 14 nt, Staphylococcus aureus subsp. aureus N315
caacauuuuuucua

SEQ ID NO: 2139877 - RNA, 23 nt, Staphylococcus aureus subsp. aureus N315
caacauuuugauacguaaacacu

SEQ ID NO: 2139878 - RNA, 13 nt, Staphylococcus aureus subsp. aureus N315
caacauacaugcc

SEQ ID NO: 2139879 - RNA, 16 nt, Staphylococcus aureus subsp. aureus N315
caacagggguuuuuau

SEQ ID NO: 2139880 - RNA, 18 nt, Staphylococcus aureus subsp. aureus N315
caacagggguuuuuauau

SEQ ID NO: 2139881 - RNA, 22 nt, Staphylococcus aureus subsp. aureus N315
caaccuuugguuguuaggggcu

SEQ ID NO: 2139882 - RNA, 18 nt, Staphylococcus aureus subsp. aureus N315
caaccugugauaaaaauc

SEQ ID NO: 2139883 - RNA, 14 nt, Staphylococcus aureus subsp. aureus N315
caacgauaccaaau

SEQ ID NO: 2139884 - RNA, 14 nt, Staphylococcus aureus subsp. aureus N315
caacgaugaaacuc

SEQ ID NO: 2139885 - RNA, 17 nt, Staphylococcus aureus subsp. aureus N315
caacacguuuuaagcca

SEQ ID NO: 2139886 - RNA, 10 nt, Staphylococcus aureus subsp. aureus N315
caacacagaa

SEQ ID NO: 2139887 - RNA, 22 nt, Staphylococcus aureus subsp. aureus N315
caacacagaggcugguggaaag

SEQ ID NO: 2139888 - RNA, 13 nt, Staphylococcus aureus subsp. aureus N315
caacacagagaau

SEQ ID NO: 2139889 - RNA, 12 nt, Staphylococcus aureus subsp. aureus N315
caacaauuugca

SEQ ID NO: 2139890 - RNA, 12 nt, Staphylococcus aureus subsp. aureus N315
caacaauuuuau

SEQ ID NO: 2139891 - RNA, 13 nt, Staphylococcus aureus subsp. aureus N315
caacacaaagaau

SEQ ID NO: 2139892 - RNA, 12 nt, Staphylococcus aureus subsp. aureus N315
caacacaaagaa

SEQ ID NO: 2139893 - RNA, 23 nt, Staphylococcus aureus subsp. aureus N315
caacaaguaaaacgcauugcgaa

SEQ ID NO: 2139894 - RNA, 22 nt, Staphylococcus aureus subsp. aureus N315
caaauuuugaguauuugccuuu

SEQ ID NO: 2139895 - RNA, 14 nt, Staphylococcus aureus subsp. aureus N315
caaauuuugaguau

SEQ ID NO: 2139896 - RNA, 20 nt, Staphylococcus aureus subsp. aureus N315
caaauuugugauuaugcaua

SEQ ID NO: 2139897 - RNA, 12 nt, Staphylococcus aureus subsp. aureus N315
caacaaaaagaa

SEQ ID NO: 2139898 - RNA, 19 nt, Staphylococcus aureus subsp. aureus N315
caaauucaacuuuucaaag

SEQ ID NO: 2139899 - RNA, 17 nt, Staphylococcus aureus subsp. aureus N315
caaauugacgcauuaau

SEQ ID NO: 2139900 - RNA, 18 nt, Staphylococcus aureus subsp. aureus N315
caaauugaccgacaaaac

SEQ ID NO: 2139901 - RNA, 21 nt, Staphylococcus aureus subsp. aureus N315
caaauugagcaguauuuuuug

SEQ ID NO: 2139902 - RNA, 13 nt, Staphylococcus aureus subsp. aureus N315
caaauugcaaugg

SEQ ID NO: 2139903 - RNA, 15 nt, Staphylococcus aureus subsp. aureus N315
caaauugcaaaguaa

SEQ ID NO: 2139904 - RNA, 21 nt, Staphylococcus aureus subsp. aureus N315
caaauugcaauggcaaccuuu

SEQ ID NO: 2139905 - RNA, 17 nt, Staphylococcus aureus subsp. aureus N315
caaauugccuuucauuu

SEQ ID NO: 2139906 - RNA, 18 nt, Staphylococcus aureus subsp. aureus N315
caaaugcuuaauaaaauc

SEQ ID NO: 2139907 - RNA, 16 nt, Staphylococcus aureus subsp. aureus N315
caaauuacaaauuauc

SEQ ID NO: 2139908 - RNA, 18 nt, Staphylococcus aureus subsp. aureus N315
caaauuaauuaaaccaau

SEQ ID NO: 2139909 - RNA, 14 nt, Staphylococcus aureus subsp. aureus N315
caaauagagaaaua

SEQ ID NO: 2139910 - RNA, 22 nt, Staphylococcus aureus subsp. aureus N315
caaagcccuaagcucguuaauu

SEQ ID NO: 2139911 - RNA, 18 nt, Staphylococcus aureus subsp. aureus N315
caaagcuugauuuaacaa

SEQ ID NO: 2139912 - RNA, 18 nt, Staphylococcus aureus subsp. aureus N315
caaagcuuccaaauguuc

SEQ ID NO: 2139913 - RNA, 17 nt, Staphylococcus aureus subsp. aureus N315
caaagggcgaaauggau

SEQ ID NO: 2139914 - RNA, 18 nt, Staphylococcus aureus subsp. aureus N315
caaagcuauauaugaauu

SEQ ID NO: 2139915 - RNA, 18 nt, Staphylococcus aureus subsp. aureus N315
caaagaggcuuuaaaauu

SEQ ID NO: 2139916 - RNA, 18 nt, Staphylococcus aureus subsp. aureus N315
caaacugccuaauacacu

SEQ ID NO: 2139917 - RNA, 14 nt, Staphylococcus aureus subsp. aureus N315
caaauacaguugua

SEQ ID NO: 2139918 - RNA, 16 nt, Staphylococcus aureus subsp. aureus N315
caaauacauuucaaaa

SEQ ID NO: 2139919 - RNA, 19 nt, Staphylococcus aureus subsp. aureus N315
caaauaaugugaaaaaucu

SEQ ID NO: 2139920 - RNA, 19 nt, Staphylococcus aureus subsp. aureus N315
caaauacgaguguuuuaau

SEQ ID NO: 2139921 - RNA, 19 nt, Staphylococcus aureus subsp. aureus N315
caaauaaauaagugauaaa

SEQ ID NO: 2139922 - RNA, 18 nt, Staphylococcus aureus subsp. aureus N315
caaauaaauuaaauuuug

SEQ ID NO: 2139923 - RNA, 18 nt, Staphylococcus aureus subsp. aureus N315
caaauaaugaugcauaag

SEQ ID NO: 2139924 - RNA, 13 nt, Staphylococcus aureus subsp. aureus N315
caaauaaugaaua

SEQ ID NO: 2139925 - RNA, 12 nt, Staphylococcus aureus subsp. aureus N315
caaauaaaauca

SEQ ID NO: 2139926 - RNA, 19 nt, Staphylococcus aureus subsp. aureus N315
caaauaaaacgcuucauau

SEQ ID NO: 2139927 - RNA, 12 nt, Staphylococcus aureus subsp. aureus N315
caaauaaaaaag

SEQ ID NO: 2139928 - RNA, 17 nt, Staphylococcus aureus subsp. aureus N315
caaauaaacacaucuau

SEQ ID NO: 2139929 - RNA, 12 nt, Staphylococcus aureus subsp. aureus N315
caaaguuuucau

SEQ ID NO: 2139930 - RNA, 23 nt, Staphylococcus aureus subsp. aureus N315
caaagguuuacuauuaaaggaaa

SEQ ID NO: 2139931 - RNA, 19 nt, Staphylococcus aureus subsp. aureus N315
caaaguaacaugugcaagu

SEQ ID NO: 2139932 - RNA, 17 nt, Staphylococcus aureus subsp. aureus N315
caaaguacaguuagugg

SEQ ID NO: 2139933 - RNA, 20 nt, Staphylococcus aureus subsp. aureus N315
caaacauuacccuuuaaacu

SEQ ID NO: 2139934 - RNA, 20 nt, Staphylococcus aureus subsp. aureus N315
caaacuaaaaggucaucuga

SEQ ID NO: 2139935 - RNA, 12 nt, Staphylococcus aureus subsp. aureus N315
caaacauuuguu

SEQ ID NO: 2139936 - RNA, 21 nt, Staphylococcus aureus subsp. aureus N315
caaaaucaccuuuuuuaacuu

SEQ ID NO: 2139937 - RNA, 15 nt, Staphylococcus aureus subsp. aureus N315
caaaauaacauguuu

SEQ ID NO: 2139938 - RNA, 14 nt, Staphylococcus aureus subsp. aureus N315
caaaaccaaaugaa

SEQ ID NO: 2139939 - RNA, 15 nt, Staphylococcus aureus subsp. aureus N315
caaaaccaaaugaac

SEQ ID NO: 2139940 - RNA, 21 nt, Staphylococcus aureus subsp. aureus N315
caaaaccaauuaauuguaaag

SEQ ID NO: 2139941 - RNA, 22 nt, Staphylococcus aureus subsp. aureus N315
caaaaccgcuauaaaauuuuga

SEQ ID NO: 2139942 - RNA, 21 nt, Staphylococcus aureus subsp. aureus N315
caaaaguuauauaaauuugua

SEQ ID NO: 2139943 - RNA, 16 nt, Staphylococcus aureus subsp. aureus N315
caaacaauuuuguaca

SEQ ID NO: 2139944 - RNA, 12 nt, Staphylococcus aureus subsp. aureus N315
caaaauuuucua

SEQ ID NO: 2139945 - RNA, 23 nt, Staphylococcus aureus subsp. aureus N315
caaaauuugaaauauaccaacca

SEQ ID NO: 2139946 - RNA, 12 nt, Staphylococcus aureus subsp. aureus N315
caaaauugucuc

SEQ ID NO: 2139947 - RNA, 18 nt, Staphylococcus aureus subsp. aureus N315
caaaauugcugacaccua

SEQ ID NO: 2139948 - RNA, 12 nt, Staphylococcus aureus subsp. aureus N315
cacguaaaauau

SEQ ID NO: 2139949 - RNA, 15 nt, Staphylococcus aureus subsp. aureus N315
aaaauagcuauuaaa

SEQ ID NO: 2139950 - RNA, 13 nt, Staphylococcus aureus subsp. aureus N315
cacggucccaaga

SEQ ID NO: 2139951 - RNA, 14 nt, Staphylococcus aureus subsp. aureus N315
aaaauauaugaaua

SEQ ID NO: 2139952 - RNA, 15 nt, Staphylococcus aureus subsp. aureus N315
aaaauauaugaauaa

SEQ ID NO: 2139953 - RNA, 20 nt, Staphylococcus aureus subsp. aureus N315
aaaauaucaaaauauaaaau

SEQ ID NO: 2139954 - RNA, 14 nt, Staphylococcus aureus subsp. aureus N315
cacgcugaaauuuu

SEQ ID NO: 2139955 - RNA, 16 nt, Staphylococcus aureus subsp. aureus N315
cacgcugaaauuuuuu

SEQ ID NO: 2139956 - RNA, 19 nt, Staphylococcus aureus subsp. aureus N315
aaaauacucccuucaacau

SEQ ID NO: 2139957 - RNA, 15 nt, Staphylococcus aureus subsp. aureus N315
aaaauacuauacuga

SEQ ID NO: 2139958 - RNA, 13 nt, Staphylococcus aureus subsp. aureus N315
caccuuuaucugu

SEQ ID NO: 2139959 - RNA, 17 nt, Staphylococcus aureus subsp. aureus N315
caccuuuagacaauauu

SEQ ID NO: 2139960 - RNA, 23 nt, Staphylococcus aureus subsp. aureus N315
cacgauauaacauuaaaaugaua

SEQ ID NO: 2139961 - RNA, 17 nt, Staphylococcus aureus subsp. aureus N315
cacgauaucuagcugcu

SEQ ID NO: 2139962 - RNA, 21 nt, Staphylococcus aureus subsp. aureus N315
cacgauaucuagcugcuucug

SEQ ID NO: 2139963 - RNA, 20 nt, Staphylococcus aureus subsp. aureus N315
cacgauaucuagcugcuucu

SEQ ID NO: 2139964 - RNA, 21 nt, Staphylococcus aureus subsp. aureus N315
cacgcccgacaucauaaauga

SEQ ID NO: 2139965 - RNA, 19 nt, Staphylococcus aureus subsp. aureus N315
aaaauaacugcuaauuuuu

SEQ ID NO: 2139966 - RNA, 21 nt, Staphylococcus aureus subsp. aureus N315
aaaauaacuaagugaauuauc

SEQ ID NO: 2139967 - RNA, 20 nt, Staphylococcus aureus subsp. aureus N315
caccugcaauuuguaauaca

SEQ ID NO: 2139968 - RNA, 17 nt, Staphylococcus aureus subsp. aureus N315
caccugauugacaaugu

SEQ ID NO: 2139969 - RNA, 19 nt, Staphylococcus aureus subsp. aureus N315
caccucuaaguucaccuaa

SEQ ID NO: 2139970 - RNA, 18 nt, Staphylococcus aureus subsp. aureus N315
caccauuuacuucauaag

SEQ ID NO: 2139971 - RNA, 21 nt, Staphylococcus aureus subsp. aureus N315
caccgacaaggauugaaaaaa

SEQ ID NO: 2139972 - RNA, 20 nt, Staphylococcus aureus subsp. aureus N315
aaaaguuaggcgacuuaacu

SEQ ID NO: 2139973 - RNA, 13 nt, Staphylococcus aureus subsp. aureus N315
aaaaguuuaaagu

SEQ ID NO: 2139974 - RNA, 20 nt, Staphylococcus aureus subsp. aureus N315
aaaaguuuaagucaguccau

SEQ ID NO: 2139975 - RNA, 19 nt, Staphylococcus aureus subsp. aureus N315
aaaaguuguaauuuaaaau

SEQ ID NO: 2139976 - RNA, 12 nt, Staphylococcus aureus subsp. aureus N315
caccagccucug

SEQ ID NO: 2139977 - RNA, 13 nt, Staphylococcus aureus subsp. aureus N315
caccagccucugu

SEQ ID NO: 2139978 - RNA, 23 nt, Staphylococcus aureus subsp. aureus N315
caccagccucuguguuggggccc

SEQ ID NO: 2139979 - RNA, 17 nt, Staphylococcus aureus subsp. aureus N315
caccagccccaauuagc

SEQ ID NO: 2139980 - RNA, 12 nt, Staphylococcus aureus subsp. aureus N315
aaaauaaaaaau

SEQ ID NO: 2139981 - RNA, 13 nt, Staphylococcus aureus subsp. aureus N315
aaaaguuucggaa

SEQ ID NO: 2139982 - RNA, 16 nt, Staphylococcus aureus subsp. aureus N315
caccauacuaaaacau

SEQ ID NO: 2139983 - RNA, 17 nt, Staphylococcus aureus subsp. aureus N315
caccauacuaaaacaug

SEQ ID NO: 2139984 - RNA, 14 nt, Staphylococcus aureus subsp. aureus N315
caccaguuucaagu

SEQ ID NO: 2139985 - RNA, 12 nt, Staphylococcus aureus subsp. aureus N315
caccauaugugg

SEQ ID NO: 2139986 - RNA, 21 nt, Staphylococcus aureus subsp. aureus N315
caccauguacauugguuuuua

SEQ ID NO: 2139987 - RNA, 19 nt, Staphylococcus aureus subsp. aureus N315
caccaugcugcacauucca

SEQ ID NO: 2139988 - RNA, 20 nt, Staphylococcus aureus subsp. aureus N315
caccaugcugcacauuccau

SEQ ID NO: 2139989 - RNA, 23 nt, Staphylococcus aureus subsp. aureus N315
caccaucuguaacuaauaugauu

SEQ ID NO: 2139990 - RNA, 18 nt, Staphylococcus aureus subsp. aureus N315
caccacuuucaguaauug

SEQ ID NO: 2139991 - RNA, 16 nt, Staphylococcus aureus subsp. aureus N315
caccaccugcaauuug

SEQ ID NO: 2139992 - RNA, 22 nt, Staphylococcus aureus subsp. aureus N315
cacauucugcccugcaaugcaa

SEQ ID NO: 2139993 - RNA, 18 nt, Staphylococcus aureus subsp. aureus N315
cacauuguuuacaaaguu

SEQ ID NO: 2139994 - RNA, 19 nt, Staphylococcus aureus subsp. aureus N315
caccaaguucacuaaauuc

SEQ ID NO: 2139995 - RNA, 12 nt, Staphylococcus aureus subsp. aureus N315
cacauaaaauac

SEQ ID NO: 2139996 - RNA, 17 nt, Staphylococcus aureus subsp. aureus N315
cacaugaggaucaacug

SEQ ID NO: 2139997 - RNA, 21 nt, Staphylococcus aureus subsp. aureus N315
cacaugcacuuuauuaaaaau

SEQ ID NO: 2139998 - RNA, 15 nt, Staphylococcus aureus subsp. aureus N315
caauucauaagaaaa

SEQ ID NO: 2139999 - RNA, 13 nt, Staphylococcus aureus subsp. aureus N315
caauucauaagaa

SEQ ID NO: 2140000 - RNA, 23 nt, Staphylococcus aureus subsp. aureus N315
caauucaauguaucaccuaauug

SEQ ID NO: 2140001 - RNA, 18 nt, Staphylococcus aureus subsp. aureus N315
caauugaaucaaauacau

SEQ ID NO: 2140002 - RNA, 22 nt, Staphylococcus aureus subsp. aureus N315
caauugaaugaaguaauauaua

SEQ ID NO: 2140003 - RNA, 22 nt, Staphylococcus aureus subsp. aureus N315
caauuagccccaguauagaagc

SEQ ID NO: 2140004 - RNA, 12 nt, Staphylococcus aureus subsp. aureus N315
caauuauggaua

SEQ ID NO: 2140005 - RNA, 14 nt, Staphylococcus aureus subsp. aureus N315
caauuauggauaaa

SEQ ID NO: 2140006 - RNA, 16 nt, Staphylococcus aureus subsp. aureus N315
caauuauuuuucaaau

SEQ ID NO: 2140007 - RNA, 19 nt, Staphylococcus aureus subsp. aureus N315
caauucaagaccaugcaaa

SEQ ID NO: 2140008 - RNA, 14 nt, Staphylococcus aureus subsp. aureus N315
caauuaauuguaaa

SEQ ID NO: 2140009 - RNA, 22 nt, Staphylococcus aureus subsp. aureus N315
caauuaauuuagucauuacaaa

SEQ ID NO: 2140010 - RNA, 16 nt, Staphylococcus aureus subsp. aureus N315
caauuacucuuuuucu

SEQ ID NO: 2140011 - RNA, 24 nt, Staphylococcus aureus subsp. aureus N315
caauuacucuuuuucuuucauaau

SEQ ID NO: 2140012 - RNA, 23 nt, Staphylococcus aureus subsp. aureus N315
caauuagaaaacaucuuacugcu

SEQ ID NO: 2140013 - RNA, 13 nt, Staphylococcus aureus subsp. aureus N315
caauuaauaaaca

SEQ ID NO: 2140014 - RNA, 17 nt, Staphylococcus aureus subsp. aureus N315
caauguuuaauuuucua

SEQ ID NO: 2140015 - RNA, 16 nt, Staphylococcus aureus subsp. aureus N315
caauguuuaauuuucu

SEQ ID NO: 2140016 - RNA, 13 nt, Staphylococcus aureus subsp. aureus N315
caauuaaaaguac

SEQ ID NO: 2140017 - RNA, 19 nt, Staphylococcus aureus subsp. aureus N315
caauuaaaacuauaauaaa

SEQ ID NO: 2140018 - RNA, 13 nt, Staphylococcus aureus subsp. aureus N315
caauuaaauguuu

SEQ ID NO: 2140019 - RNA, 23 nt, Staphylococcus aureus subsp. aureus N315
caauguuuaauuuucuaaauaua

SEQ ID NO: 2140020 - RNA, 23 nt, Staphylococcus aureus subsp. aureus N315
caauuuuuaaaaaccuagggaua

SEQ ID NO: 2140021 - RNA, 16 nt, Staphylococcus aureus subsp. aureus N315
caauuuuuaaaaaccu

SEQ ID NO: 2140022 - RNA, 16 nt, Staphylococcus aureus subsp. aureus N315
caauuuuuaacaaaau

SEQ ID NO: 2140023 - RNA, 18 nt, Staphylococcus aureus subsp. aureus N315
caauuuuuacuaaaucau

SEQ ID NO: 2140024 - RNA, 13 nt, Staphylococcus aureus subsp. aureus N315
caauuuuaccaug

SEQ ID NO: 2140025 - RNA, 21 nt, Staphylococcus aureus subsp. aureus N315
caauuuuaucugaaucugcua

SEQ ID NO: 2140026 - RNA, 23 nt, Staphylococcus aureus subsp. aureus N315
caauuuuccguguuuauuuuuau

SEQ ID NO: 2140027 - RNA, 20 nt, Staphylococcus aureus subsp. aureus N315
caauuuguaacuauugaaaa

SEQ ID NO: 2140028 - RNA, 19 nt, Staphylococcus aureus subsp. aureus N315
caauuuaguauaaauaaaa

SEQ ID NO: 2140029 - RNA, 19 nt, Staphylococcus aureus subsp. aureus N315
caauuuaaauaaguuacuc

SEQ ID NO: 2140030 - RNA, 17 nt, Staphylococcus aureus subsp. aureus N315
caauuuaauagacauua

SEQ ID NO: 2140031 - RNA, 16 nt, Staphylococcus aureus subsp. aureus N315
caauuguuacuuuaac

SEQ ID NO: 2140032 - RNA, 12 nt, Staphylococcus aureus subsp. aureus N315
caauugcaauga

SEQ ID NO: 2140033 - RNA, 24 nt, Staphylococcus aureus subsp. aureus N315
caauugcaaugaauaacaagaaaa

SEQ ID NO: 2140034 - RNA, 21 nt, Staphylococcus aureus subsp. aureus N315
cacaaagaauuucgaaaagaa

SEQ ID NO: 2140035 - RNA, 21 nt, Staphylococcus aureus subsp. aureus N315
caauuuuuucaugauuuacua

SEQ ID NO: 2140036 - RNA, 19 nt, Staphylococcus aureus subsp. aureus N315
caauuuuucacuuauaaca

SEQ ID NO: 2140037 - RNA, 18 nt, Staphylococcus aureus subsp. aureus N315
cacagacguuuuugaauc

SEQ ID NO: 2140038 - RNA, 21 nt, Staphylococcus aureus subsp. aureus N315
cacagagaauuucgaaaagaa

SEQ ID NO: 2140039 - RNA, 18 nt, Staphylococcus aureus subsp. aureus N315
cacagcgauuaaaugaug

SEQ ID NO: 2140040 - RNA, 15 nt, Staphylococcus aureus subsp. aureus N315
cacaauuguauaaug

SEQ ID NO: 2140041 - RNA, 14 nt, Staphylococcus aureus subsp. aureus N315
cacaacacauaaau

SEQ ID NO: 2140042 - RNA, 14 nt, Staphylococcus aureus subsp. aureus N315
cacaaauaaaggca

SEQ ID NO: 2140043 - RNA, 18 nt, Staphylococcus aureus subsp. aureus N315
cacacuauuguaagcuga

SEQ ID NO: 2140044 - RNA, 14 nt, Staphylococcus aureus subsp. aureus N315
cacacccauacucu

SEQ ID NO: 2140045 - RNA, 18 nt, Staphylococcus aureus subsp. aureus N315
cacaccccaacucgcauu

SEQ ID NO: 2140046 - RNA, 21 nt, Staphylococcus aureus subsp. aureus N315
auuucuauuuauugagauaga

SEQ ID NO: 2140047 - RNA, 16 nt, Staphylococcus aureus subsp. aureus N315
auuucuaugaaaaaaa

SEQ ID NO: 2140048 - RNA, 23 nt, Staphylococcus aureus subsp. aureus N315
auuucuauaucuauuuaucauac

SEQ ID NO: 2140049 - RNA, 20 nt, Staphylococcus aureus subsp. aureus N315
auuucuaucaaauaaugaau

SEQ ID NO: 2140050 - RNA, 17 nt, Staphylococcus aureus subsp. aureus N315
auuucuaauacauacug

SEQ ID NO: 2140051 - RNA, 13 nt, Staphylococcus aureus subsp. aureus N315
auuucuaauuuag

SEQ ID NO: 2140052 - RNA, 20 nt, Staphylococcus aureus subsp. aureus N315
auuucgauaccuaaaauacc

SEQ ID NO: 2140053 - RNA, 16 nt, Staphylococcus aureus subsp. aureus N315
auuucgaaaagaaauu

SEQ ID NO: 2140054 - RNA, 18 nt, Staphylococcus aureus subsp. aureus N315
auuucgaaaagaaauucu

SEQ ID NO: 2140055 - RNA, 16 nt, Staphylococcus aureus subsp. aureus N315
auuuccucgguuuuau

SEQ ID NO: 2140056 - RNA, 21 nt, Staphylococcus aureus subsp. aureus N315
auuuccucaccuucauuuuca

SEQ ID NO: 2140057 - RNA, 21 nt, Staphylococcus aureus subsp. aureus N315
auuuccucgguuuuauuuuua

SEQ ID NO: 2140058 - RNA, 21 nt, Staphylococcus aureus subsp. aureus N315
auuuccuauuaggauccaauu

SEQ ID NO: 2140059 - RNA, 13 nt, Staphylococcus aureus subsp. aureus N315
auuucaucaaauc

SEQ ID NO: 2140060 - RNA, 15 nt, Staphylococcus aureus subsp. aureus N315
auuucaucaauaauu

SEQ ID NO: 2140061 - RNA, 18 nt, Staphylococcus aureus subsp. aureus N315
auuucauagggaaauauu

SEQ ID NO: 2140062 - RNA, 17 nt, Staphylococcus aureus subsp. aureus N315
auuucauaguguuugua

SEQ ID NO: 2140063 - RNA, 11 nt, Staphylococcus aureus subsp. aureus N315
auuucaucaaa

SEQ ID NO: 2140064 - RNA, 18 nt, Staphylococcus aureus subsp. aureus N315
auuucaugugcaagcuuu

SEQ ID NO: 2140065 - RNA, 20 nt, Staphylococcus aureus subsp. aureus N315
auuucaguucuuagauuuuc

SEQ ID NO: 2140066 - RNA, 11 nt, Staphylococcus aureus subsp. aureus N315
auuucacuuua

SEQ ID NO: 2140067 - RNA, 15 nt, Staphylococcus aureus subsp. aureus N315
auuucacuuuaacuu

SEQ ID NO: 2140068 - RNA, 18 nt, Staphylococcus aureus subsp. aureus N315
auuucacuugaccacuuu

SEQ ID NO: 2140069 - RNA, 16 nt, Staphylococcus aureus subsp. aureus N315
auuuauaaauguuuca

SEQ ID NO: 2140070 - RNA, 19 nt, Staphylococcus aureus subsp. aureus N315
auuuauaaacaauuacaaa

SEQ ID NO: 2140071 - RNA, 15 nt, Staphylococcus aureus subsp. aureus N315
auuuauaaacaauaa

SEQ ID NO: 2140072 - RNA, 20 nt, Staphylococcus aureus subsp. aureus N315
auuucaacuuuuuaauaaua

SEQ ID NO: 2140073 - RNA, 14 nt, Staphylococcus aureus subsp. aureus N315
auuucaacaaacau

SEQ ID NO: 2140074 - RNA, 15 nt, Staphylococcus aureus subsp. aureus N315
auuucaacaaacaua

SEQ ID NO: 2140075 - RNA, 17 nt, Staphylococcus aureus subsp. aureus N315
auuucaacaaacauaaa

SEQ ID NO: 2140076 - RNA, 18 nt, Staphylococcus aureus subsp. aureus N315
auuuauaacauuuaagaa

SEQ ID NO: 2140077 - RNA, 16 nt, Staphylococcus aureus subsp. aureus N315
auuucacucuacaauc

SEQ ID NO: 2140078 - RNA, 16 nt, Staphylococcus aureus subsp. aureus N315
auuucaacuuauaaaa

SEQ ID NO: 2140079 - RNA, 23 nt, Staphylococcus aureus subsp. aureus N315
auuuaggaguauccugauuuaau

SEQ ID NO: 2140080 - RNA, 16 nt, Staphylococcus aureus subsp. aureus N315
auuuagggauuauaac

SEQ ID NO: 2140081 - RNA, 18 nt, Staphylococcus aureus subsp. aureus N315
auuuagggauuauaacca

SEQ ID NO: 2140082 - RNA, 14 nt, Staphylococcus aureus subsp. aureus N315
auuuaguacauaug

SEQ ID NO: 2140083 - RNA, 16 nt, Staphylococcus aureus subsp. aureus N315
auuuaguauaaauaaa

SEQ ID NO: 2140084 - RNA, 18 nt, Staphylococcus aureus subsp. aureus N315
auuuaguacucaauguua

SEQ ID NO: 2140085 - RNA, 15 nt, Staphylococcus aureus subsp. aureus N315
auuuaguauaaauaa

SEQ ID NO: 2140086 - RNA, 19 nt, Staphylococcus aureus subsp. aureus N315
auuuaguuaauuauuuaga

SEQ ID NO: 2140087 - RNA, 17 nt, Staphylococcus aureus subsp. aureus N315
auuuaguuuuuuuaaag

SEQ ID NO: 2140088 - RNA, 22 nt, Staphylococcus aureus subsp. aureus N315
auuuauaaaaacuuauuugcca

SEQ ID NO: 2140089 - RNA, 22 nt, Staphylococcus aureus subsp. aureus N315
auuuaguauaaauaaaaauaca

SEQ ID NO: 2140090 - RNA, 16 nt, Staphylococcus aureus subsp. aureus N315
auuuaguaucuauaca

SEQ ID NO: 2140091 - RNA, 23 nt, Staphylococcus aureus subsp. aureus N315
auuugccccgccauucauaaaug

SEQ ID NO: 2140092 - RNA, 17 nt, Staphylococcus aureus subsp. aureus N315
auuugcgauuucuucug

SEQ ID NO: 2140093 - RNA, 21 nt, Staphylococcus aureus subsp. aureus N315
auuugcgauuucuucugcuaa

SEQ ID NO: 2140094 - RNA, 21 nt, Staphylococcus aureus subsp. aureus N315
auuugcagaacguucuaaggu

SEQ ID NO: 2140095 - RNA, 20 nt, Staphylococcus aureus subsp. aureus N315
auuugauuuaaaaaguuaau

SEQ ID NO: 2140096 - RNA, 23 nt, Staphylococcus aureus subsp. aureus N315
auuugauucuauuucuucauuug

SEQ ID NO: 2140097 - RNA, 22 nt, Staphylococcus aureus subsp. aureus N315
auuucuugugcgguaaccauuu

SEQ ID NO: 2140098 - RNA, 15 nt, Staphylococcus aureus subsp. aureus N315
auuucuuuugaaucu

SEQ ID NO: 2140099 - RNA, 22 nt, Staphylococcus aureus subsp. aureus N315
auuugaauugacuuacauuuua

SEQ ID NO: 2140100 - RNA, 15 nt, Staphylococcus aureus subsp. aureus N315
auuugacacauuauu

SEQ ID NO: 2140101 - RNA, 13 nt, Staphylococcus aureus subsp. aureus N315
auuucuuuuuaaa

SEQ ID NO: 2140102 - RNA, 18 nt, Staphylococcus aureus subsp. aureus N315
auuugaaugccuacagau

SEQ ID NO: 2140103 - RNA, 19 nt, Staphylococcus aureus subsp. aureus N315
auuugaauugacuuacauu

SEQ ID NO: 2140104 - RNA, 10 nt, Staphylococcus aureus subsp. aureus N315
auuucuuuuu

SEQ ID NO: 2140105 - RNA, 12 nt, Staphylococcus aureus subsp. aureus N315
auuugaauacuu

SEQ ID NO: 2140106 - RNA, 20 nt, Staphylococcus aureus subsp. aureus N315
auuugaaugcaaaucaaaua

SEQ ID NO: 2140107 - RNA, 21 nt, Staphylococcus aureus subsp. aureus N315
auuugacacauuauugaaauu

SEQ ID NO: 2140108 - RNA, 16 nt, Staphylococcus aureus subsp. aureus N315
auuugauguucuugaa

SEQ ID NO: 2140109 - RNA, 13 nt, Staphylococcus aureus subsp. aureus N315
auuuggucaaguu

SEQ ID NO: 2140110 - RNA, 20 nt, Staphylococcus aureus subsp. aureus N315
auuuggucauagaaauuuua

SEQ ID NO: 2140111 - RNA, 23 nt, Staphylococcus aureus subsp. aureus N315
auuugguggagaaccuuuaaaag

SEQ ID NO: 2140112 - RNA, 21 nt, Staphylococcus aureus subsp. aureus N315
auuuggguaauguuuuuacaa

SEQ ID NO: 2140113 - RNA, 13 nt, Staphylococcus aureus subsp. aureus N315
auuuguaauacaa

SEQ ID NO: 2140114 - RNA, 16 nt, Staphylococcus aureus subsp. aureus N315
auuuguaaucccauuu

SEQ ID NO: 2140115 - RNA, 24 nt, Staphylococcus aureus subsp. aureus N315
auuuguaauuccucuggaacuuua

SEQ ID NO: 2140116 - RNA, 21 nt, Staphylococcus aureus subsp. aureus N315
auuuguaaucccauuuuaaag

SEQ ID NO: 2140117 - RNA, 15 nt, Staphylococcus aureus subsp. aureus N315
auuuguaaauauuuu

SEQ ID NO: 2140118 - RNA, 18 nt, Staphylococcus aureus subsp. aureus N315
auuuguaaauauuuuuua

SEQ ID NO: 2140119 - RNA, 21 nt, Staphylococcus aureus subsp. aureus N315
auuugcuguuaauaaaucauu

SEQ ID NO: 2140120 - RNA, 21 nt, Staphylococcus aureus subsp. aureus N315
auuuggauaauuuuuaacagc

SEQ ID NO: 2140121 - RNA, 21 nt, Staphylococcus aureus subsp. aureus N315
auuuggauauuuauuuuaaua

SEQ ID NO: 2140122 - RNA, 19 nt, Staphylococcus aureus subsp. aureus N315
auuuguuaauuuaauaauu

SEQ ID NO: 2140123 - RNA, 18 nt, Staphylococcus aureus subsp. aureus N315
auuuguuaauuuaauaau

SEQ ID NO: 2140124 - RNA, 16 nt, Staphylococcus aureus subsp. aureus N315
auuuguguauaaaugu

SEQ ID NO: 2140125 - RNA, 15 nt, Staphylococcus aureus subsp. aureus N315
auuuguguauaaaug

SEQ ID NO: 2140126 - RNA, 19 nt, Staphylococcus aureus subsp. aureus N315
auuugugguaaucauguaa

SEQ ID NO: 2140127 - RNA, 19 nt, Staphylococcus aureus subsp. aureus N315
auuugugcauucaucaaug

SEQ ID NO: 2140128 - RNA, 21 nt, Staphylococcus aureus subsp. aureus N315
auuugugugcgauaagcaaaa

SEQ ID NO: 2140129 - RNA, 22 nt, Staphylococcus aureus subsp. aureus N315
auuuguagcuugaauaauauau

SEQ ID NO: 2140130 - RNA, 15 nt, Staphylococcus aureus subsp. aureus N315
auuuguaguaaguag

SEQ ID NO: 2140131 - RNA, 21 nt, Staphylococcus aureus subsp. aureus N315
auuuguagcuugaauaauaua

SEQ ID NO: 2140132 - RNA, 19 nt, Staphylococcus aureus subsp. aureus N315
auuuguagcuugaauaaua

SEQ ID NO: 2140133 - RNA, 17 nt, Staphylococcus aureus subsp. aureus N315
auuuguaccaaauaaau

SEQ ID NO: 2140134 - RNA, 13 nt, Staphylococcus aureus subsp. aureus N315
auuuuuaguuaaa

SEQ ID NO: 2140135 - RNA, 14 nt, Staphylococcus aureus subsp. aureus N315
auuuuuaucaucau

SEQ ID NO: 2140136 - RNA, 20 nt, Staphylococcus aureus subsp. aureus N315
auuuuuggauucaccaauua

SEQ ID NO: 2140137 - RNA, 16 nt, Staphylococcus aureus subsp. aureus N315
auuuuuguauuuaugu

SEQ ID NO: 2140138 - RNA, 23 nt, Staphylococcus aureus subsp. aureus N315
caaaaaaggaugaugugaauguu

SEQ ID NO: 2140139 - RNA, 19 nt, Staphylococcus aureus subsp. aureus N315
auuuuuuuguacuuucuga

SEQ ID NO: 2140140 - RNA, 15 nt, Staphylococcus aureus subsp. aureus N315
auuuuuuuauauuuu

SEQ ID NO: 2140141 - RNA, 12 nt, Staphylococcus aureus subsp. aureus N315
auuuuuuuaaau

SEQ ID NO: 2140142 - RNA, 21 nt, Staphylococcus aureus subsp. aureus N315
auuuuuuggagcguaaaguuu

SEQ ID NO: 2140143 - RNA, 18 nt, Staphylococcus aureus subsp. aureus N315
auuuuuugugccuuucuc

SEQ ID NO: 2140144 - RNA, 11 nt, Staphylococcus aureus subsp. aureus N315
auuuuuuuagg

SEQ ID NO: 2140145 - RNA, 15 nt, Staphylococcus aureus subsp. aureus N315
auuuuuuucuuucuu

SEQ ID NO: 2140146 - RNA, 23 nt, Staphylococcus aureus subsp. aureus N315
auuuuuuucguaacauuuaaaaa

SEQ ID NO: 2140147 - RNA, 21 nt, Staphylococcus aureus subsp. aureus N315
auuuuuuucguaacauuuaaa

SEQ ID NO: 2140148 - RNA, 22 nt, Staphylococcus aureus subsp. aureus N315
auuuuuuucguaacauuuaaaa

SEQ ID NO: 2140149 - RNA, 16 nt, Staphylococcus aureus subsp. aureus N315
caaaacaauaugaauu

SEQ ID NO: 2140150 - RNA, 19 nt, Staphylococcus aureus subsp. aureus N315
caaaacaaauccauuaaau

SEQ ID NO: 2140151 - RNA, 18 nt, Staphylococcus aureus subsp. aureus N315
caaaacauuuugugacuu

SEQ ID NO: 2140152 - RNA, 13 nt, Staphylococcus aureus subsp. aureus N315
caaaaauuguaaa

SEQ ID NO: 2140153 - RNA, 15 nt, Staphylococcus aureus subsp. aureus N315
caaaacaaaaaauau

SEQ ID NO: 2140154 - RNA, 22 nt, Staphylococcus aureus subsp. aureus N315
caaaacaaaaaauaucuuuuug

SEQ ID NO: 2140155 - RNA, 21 nt, Staphylococcus aureus subsp. aureus N315
caaaaaugaagaauacaaaua

SEQ ID NO: 2140156 - RNA, 14 nt, Staphylococcus aureus subsp. aureus N315
caaaaauaaaaaug

SEQ ID NO: 2140157 - RNA, 18 nt, Staphylococcus aureus subsp. aureus N315
caaaaauaauuaaauccg

SEQ ID NO: 2140158 - RNA, 17 nt, Staphylococcus aureus subsp. aureus N315
caaaaauaguaaaaccu

SEQ ID NO: 2140159 - RNA, 21 nt, Staphylococcus aureus subsp. aureus N315
caaaaauagauugaaaaaaua

SEQ ID NO: 2140160 - RNA, 19 nt, Staphylococcus aureus subsp. aureus N315
caaaaacaguuacaacuga

SEQ ID NO: 2140161 - RNA, 16 nt, Staphylococcus aureus subsp. aureus N315
auuuucaguuaaaaua

SEQ ID NO: 2140162 - RNA, 23 nt, Staphylococcus aureus subsp. aureus N315
auuuucaguuaaaauaaccauuu

SEQ ID NO: 2140163 - RNA, 15 nt, Staphylococcus aureus subsp. aureus N315
auuuuccaucacaua

SEQ ID NO: 2140164 - RNA, 21 nt, Staphylococcus aureus subsp. aureus N315
auuuucuguuuaauuaaaaua

SEQ ID NO: 2140165 - RNA, 20 nt, Staphylococcus aureus subsp. aureus N315
auuuucuuagaaaaucaagu

SEQ ID NO: 2140166 - RNA, 21 nt, Staphylococcus aureus subsp. aureus N315
auuuucuuagaaaaucaaguu

SEQ ID NO: 2140167 - RNA, 23 nt, Staphylococcus aureus subsp. aureus N315
auuuuauugaguaucaugcuuuu

SEQ ID NO: 2140168 - RNA, 13 nt, Staphylococcus aureus subsp. aureus N315
auuuuauucuuca

SEQ ID NO: 2140169 - RNA, 21 nt, Staphylococcus aureus subsp. aureus N315
auuuuauuagguaauacuuuu

SEQ ID NO: 2140170 - RNA, 14 nt, Staphylococcus aureus subsp. aureus N315
auuuuauuagaaua

SEQ ID NO: 2140171 - RNA, 16 nt, Staphylococcus aureus subsp. aureus N315
auuuguuguuauuaua

SEQ ID NO: 2140172 - RNA, 17 nt, Staphylococcus aureus subsp. aureus N315
auuuguuguuauuauaa

SEQ ID NO: 2140173 - RNA, 22 nt, Staphylococcus aureus subsp. aureus N315
auuuuaaacaugaacaaucaga

SEQ ID NO: 2140174 - RNA, 14 nt, Staphylococcus aureus subsp. aureus N315
auuuuaaacaugaa

SEQ ID NO: 2140175 - RNA, 21 nt, Staphylococcus aureus subsp. aureus N315
auuuuaaacguaucauuuaaa

SEQ ID NO: 2140176 - RNA, 20 nt, Staphylococcus aureus subsp. aureus N315
auuuuaaagaaaaguuuaag

SEQ ID NO: 2140177 - RNA, 20 nt, Staphylococcus aureus subsp. aureus N315
auuuuaaauauugauauaaa

SEQ ID NO: 2140178 - RNA, 12 nt, Staphylococcus aureus subsp. aureus N315
auuuuaaaucuu

SEQ ID NO: 2140179 - RNA, 21 nt, Staphylococcus aureus subsp. aureus N315
auuuuaaauauugauauaaaa

SEQ ID NO: 2140180 - RNA, 15 nt, Staphylococcus aureus subsp. aureus N315
auuuuguauaaccuu

SEQ ID NO: 2140181 - RNA, 20 nt, Staphylococcus aureus subsp. aureus N315
auuuuguaagcucaugaauc

SEQ ID NO: 2140182 - RNA, 15 nt, Staphylococcus aureus subsp. aureus N315
auuuuuagacauuaa

SEQ ID NO: 2140183 - RNA, 19 nt, Staphylococcus aureus subsp. aureus N315
auuuuuagacauuaaaaaa

SEQ ID NO: 2140184 - RNA, 15 nt, Staphylococcus aureus subsp. aureus N315
auuuuguauuuuuca

SEQ ID NO: 2140185 - RNA, 17 nt, Staphylococcus aureus subsp. aureus N315
auuuuguauuuuucaaa

SEQ ID NO: 2140186 - RNA, 21 nt, Staphylococcus aureus subsp. aureus N315
auuuuuacaaagugauuuaaa

SEQ ID NO: 2140187 - RNA, 17 nt, Staphylococcus aureus subsp. aureus N315
auuuuuaauuucuggua

SEQ ID NO: 2140188 - RNA, 14 nt, Staphylococcus aureus subsp. aureus N315
auuuugaguauuug

SEQ ID NO: 2140189 - RNA, 19 nt, Staphylococcus aureus subsp. aureus N315
auuuugagucguagauacu

SEQ ID NO: 2140190 - RNA, 22 nt, Staphylococcus aureus subsp. aureus N315
auuuugagucguagauacuacc

SEQ ID NO: 2140191 - RNA, 15 nt, Staphylococcus aureus subsp. aureus N315
auuuugauauaaaaa

SEQ ID NO: 2140192 - RNA, 18 nt, Staphylococcus aureus subsp. aureus N315
auuuugauauuuuucacg

SEQ ID NO: 2140193 - RNA, 20 nt, Staphylococcus aureus subsp. aureus N315
auuuugcaauugcaaugaau

SEQ ID NO: 2140194 - RNA, 16 nt, Staphylococcus aureus subsp. aureus N315
auuuugaauaaaaaaa

SEQ ID NO: 2140195 - RNA, 15 nt, Staphylococcus aureus subsp. aureus N315
auuuucuuuuucuaa

SEQ ID NO: 2140196 - RNA, 21 nt, Staphylococcus aureus subsp. aureus N315
auuuucuuuuucuaaauaaac

SEQ ID NO: 2140197 - RNA, 16 nt, Staphylococcus aureus subsp. aureus N315
auuuucuuuuuuaauu

SEQ ID NO: 2140198 - RNA, 20 nt, Staphylococcus aureus subsp. aureus N315
auuuucuuuuuuaauucuau

SEQ ID NO: 2140199 - RNA, 17 nt, Staphylococcus aureus subsp. aureus N315
auuuucuugccaucaau

SEQ ID NO: 2140200 - RNA, 12 nt, Staphylococcus aureus subsp. aureus N315
auucauaauauc

SEQ ID NO: 2140201 - RNA, 15 nt, Staphylococcus aureus subsp. aureus N315
auucauaaaauuuaa

SEQ ID NO: 2140202 - RNA, 19 nt, Staphylococcus aureus subsp. aureus N315
auucauaacguguuugcuc

SEQ ID NO: 2140203 - RNA, 20 nt, Staphylococcus aureus subsp. aureus N315
auucauacacugcacaucau

SEQ ID NO: 2140204 - RNA, 19 nt, Staphylococcus aureus subsp. aureus N315
auucauacacugcacauca

SEQ ID NO: 2140205 - RNA, 23 nt, Staphylococcus aureus subsp. aureus N315
auuccucuggaacuuuaauacca

SEQ ID NO: 2140206 - RNA, 16 nt, Staphylococcus aureus subsp. aureus N315
auucgcaccacuggcc

SEQ ID NO: 2140207 - RNA, 21 nt, Staphylococcus aureus subsp. aureus N315
auucgaugcuaaaaauauuga

SEQ ID NO: 2140208 - RNA, 16 nt, Staphylococcus aureus subsp. aureus N315
auucgaaaagaaauuc

SEQ ID NO: 2140209 - RNA, 14 nt, Staphylococcus aureus subsp. aureus N315
auuccugauacaau

SEQ ID NO: 2140210 - RNA, 19 nt, Staphylococcus aureus subsp. aureus N315
auuccugcaaaauguuaca

SEQ ID NO: 2140211 - RNA, 13 nt, Staphylococcus aureus subsp. aureus N315
auucggauuauau

SEQ ID NO: 2140212 - RNA, 21 nt, Staphylococcus aureus subsp. aureus N315
auucuaaaaaauuaaaaauuu

SEQ ID NO: 2140213 - RNA, 18 nt, Staphylococcus aureus subsp. aureus N315
auucuaaauauauuuuau

SEQ ID NO: 2140214 - RNA, 20 nt, Staphylococcus aureus subsp. aureus N315
auucuaaauauauuuuaugu

SEQ ID NO: 2140215 - RNA, 13 nt, Staphylococcus aureus subsp. aureus N315
auucuacuaaaaa

SEQ ID NO: 2140216 - RNA, 23 nt, Staphylococcus aureus subsp. aureus N315
auucuacuaaaaaugcuuuaacu

SEQ ID NO: 2140217 - RNA, 15 nt, Staphylococcus aureus subsp. aureus N315
auucuuagauauuau

SEQ ID NO: 2140218 - RNA, 14 nt, Staphylococcus aureus subsp. aureus N315
auucuuagauauua

SEQ ID NO: 2140219 - RNA, 22 nt, Staphylococcus aureus subsp. aureus N315
auucuuaucauuucaaauaaga

SEQ ID NO: 2140220 - RNA, 12 nt, Staphylococcus aureus subsp. aureus N315
auucuucaaaaa

SEQ ID NO: 2140221 - RNA, 18 nt, Staphylococcus aureus subsp. aureus N315
auucuucaaaaaauaaua

SEQ ID NO: 2140222 - RNA, 14 nt, Staphylococcus aureus subsp. aureus N315
auucuucaccaacu

SEQ ID NO: 2140223 - RNA, 22 nt, Staphylococcus aureus subsp. aureus N315
auucuucaccaacuuuuuuaac

SEQ ID NO: 2140224 - RNA, 22 nt, Staphylococcus aureus subsp. aureus N315
auucuucaucaauaacuauaau

SEQ ID NO: 2140225 - RNA, 13 nt, Staphylococcus aureus subsp. aureus N315
auucuuucucuau

SEQ ID NO: 2140226 - RNA, 15 nt, Staphylococcus aureus subsp. aureus N315
auucuuuuguaauug

SEQ ID NO: 2140227 - RNA, 21 nt, Staphylococcus aureus subsp. aureus N315
auugaaaucgucuuacugcug

SEQ ID NO: 2140228 - RNA, 15 nt, Staphylococcus aureus subsp. aureus N315
auugaaaugauagau

SEQ ID NO: 2140229 - RNA, 14 nt, Staphylococcus aureus subsp. aureus N315
auugaaaugagcuu

SEQ ID NO: 2140230 - RNA, 22 nt, Staphylococcus aureus subsp. aureus N315
auugaaauuauccuacugcugu

SEQ ID NO: 2140231 - RNA, 20 nt, Staphylococcus aureus subsp. aureus N315
auugaacaauucuucaucau

SEQ ID NO: 2140232 - RNA, 19 nt, Staphylococcus aureus subsp. aureus N315
auucugugagguaaaacua

SEQ ID NO: 2140233 - RNA, 23 nt, Staphylococcus aureus subsp. aureus N315
auucuguuugguguuaccgauuu

SEQ ID NO: 2140234 - RNA, 16 nt, Staphylococcus aureus subsp. aureus N315
auucuagugaaauacc

SEQ ID NO: 2140235 - RNA, 15 nt, Staphylococcus aureus subsp. aureus N315
auucuauaauuuuaa

SEQ ID NO: 2140236 - RNA, 14 nt, Staphylococcus aureus subsp. aureus N315
auucucauuuacuu

SEQ ID NO: 2140237 - RNA, 14 nt, Staphylococcus aureus subsp. aureus N315
auugaguuguugca

SEQ ID NO: 2140238 - RNA, 16 nt, Staphylococcus aureus subsp. aureus N315
auugagggauuuuuau

SEQ ID NO: 2140239 - RNA, 23 nt, Staphylococcus aureus subsp. aureus N315
auugaggaucaaaaguuguugca

SEQ ID NO: 2140240 - RNA, 21 nt, Staphylococcus aureus subsp. aureus N315
auugagaauauuaagauguau

SEQ ID NO: 2140241 - RNA, 19 nt, Staphylococcus aureus subsp. aureus N315
auugacucgaccuuuauau

SEQ ID NO: 2140242 - RNA, 18 nt, Staphylococcus aureus subsp. aureus N315
auugacuuacauuuuaau

SEQ ID NO: 2140243 - RNA, 13 nt, Staphylococcus aureus subsp. aureus N315
auugacuuuaauu

SEQ ID NO: 2140244 - RNA, 15 nt, Staphylococcus aureus subsp. aureus N315
auugaaugaaaauaa

SEQ ID NO: 2140245 - RNA, 14 nt, Staphylococcus aureus subsp. aureus N315
auugaauauaaaaa

SEQ ID NO: 2140246 - RNA, 19 nt, Staphylococcus aureus subsp. aureus N315
auugaauaucacuuuagau

SEQ ID NO: 2140247 - RNA, 13 nt, Staphylococcus aureus subsp. aureus N315
auugaacuucuuu

SEQ ID NO: 2140248 - RNA, 14 nt, Staphylococcus aureus subsp. aureus N315
auugaacuucuaac

SEQ ID NO: 2140249 - RNA, 23 nt, Staphylococcus aureus subsp. aureus N315
auugacauuaaugauagcaauga

SEQ ID NO: 2140250 - RNA, 18 nt, Staphylococcus aureus subsp. aureus N315
auugacauuuacauccaa

SEQ ID NO: 2140251 - RNA, 19 nt, Staphylococcus aureus subsp. aureus N315
auugauugcucuaagcauu

SEQ ID NO: 2140252 - RNA, 21 nt, Staphylococcus aureus subsp. aureus N315
auugauuguaccaguaacaau

SEQ ID NO: 2140253 - RNA, 12 nt, Staphylococcus aureus subsp. aureus N315
auugauagucac

SEQ ID NO: 2140254 - RNA, 16 nt, Staphylococcus aureus subsp. aureus N315
auugcuuuagaaaguc

SEQ ID NO: 2140255 - RNA, 15 nt, Staphylococcus aureus subsp. aureus N315
auuggaaaaauaaau

SEQ ID NO: 2140256 - RNA, 18 nt, Staphylococcus aureus subsp. aureus N315
auugcuuuacuaauuccg

SEQ ID NO: 2140257 - RNA, 17 nt, Staphylococcus aureus subsp. aureus N315
auugcuuguucuuucuu

SEQ ID NO: 2140258 - RNA, 16 nt, Staphylococcus aureus subsp. aureus N315
auugcucuuuaacaau

SEQ ID NO: 2140259 - RNA, 17 nt, Staphylococcus aureus subsp. aureus N315
auugcugacaccuauau

SEQ ID NO: 2140260 - RNA, 21 nt, Staphylococcus aureus subsp. aureus N315
auugcugacaccuauauuuuu

SEQ ID NO: 2140261 - RNA, 22 nt, Staphylococcus aureus subsp. aureus N315
auugcugacaccuauauuuuua

SEQ ID NO: 2140262 - RNA, 22 nt, Staphylococcus aureus subsp. aureus N315
auugcuauauuaguauaauuua

SEQ ID NO: 2140263 - RNA, 22 nt, Staphylococcus aureus subsp. aureus N315
auugcuauaagaacuaaugguu

SEQ ID NO: 2140264 - RNA, 17 nt, Staphylococcus aureus subsp. aureus N315
aaaaguaaguaaaauaa

SEQ ID NO: 2140265 - RNA, 14 nt, Staphylococcus aureus subsp. aureus N315
aaaaguaaguaaaa

SEQ ID NO: 2140266 - RNA, 20 nt, Staphylococcus aureus subsp. aureus N315
aaaaguaacauacuauaaaa

SEQ ID NO: 2140267 - RNA, 22 nt, Staphylococcus aureus subsp. aureus N315
auugguaggaggcuuuugcuuu

SEQ ID NO: 2140268 - RNA, 23 nt, Staphylococcus aureus subsp. aureus N315
auuguauuauccucaaauauauu

SEQ ID NO: 2140269 - RNA, 19 nt, Staphylococcus aureus subsp. aureus N315
auuguauuuuucaagcauu

SEQ ID NO: 2140270 - RNA, 24 nt, Staphylococcus aureus subsp. aureus N315
aaaaguacuaacccaacgaugaaa

SEQ ID NO: 2140271 - RNA, 22 nt, Staphylococcus aureus subsp. aureus N315
aaaaguacuuuaaaauuguaua

SEQ ID NO: 2140272 - RNA, 20 nt, Staphylococcus aureus subsp. aureus N315
auuggauuaucgaauuagau

SEQ ID NO: 2140273 - RNA, 20 nt, Staphylococcus aureus subsp. aureus N315
auuggaaucaucuuuuugaa

SEQ ID NO: 2140274 - RNA, 18 nt, Staphylococcus aureus subsp. aureus N315
auuggauaauuucuucuu

SEQ ID NO: 2140275 - RNA, 16 nt, Staphylococcus aureus subsp. aureus N315
auuggcauccaggcaa

SEQ ID NO: 2140276 - RNA, 17 nt, Staphylococcus aureus subsp. aureus N315
auuggcauccaggcaac

SEQ ID NO: 2140277 - RNA, 13 nt, Staphylococcus aureus subsp. aureus N315
auuggcauuuacg

SEQ ID NO: 2140278 - RNA, 18 nt, Staphylococcus aureus subsp. aureus N315
auuggcauuuacgaaguu

SEQ ID NO: 2140279 - RNA, 15 nt, Staphylococcus aureus subsp. aureus N315
auuuaauauuguuaa

SEQ ID NO: 2140280 - RNA, 19 nt, Staphylococcus aureus subsp. aureus N315
auuuaaucguaacauauca

SEQ ID NO: 2140281 - RNA, 14 nt, Staphylococcus aureus subsp. aureus N315
auuuaaucguagga

SEQ ID NO: 2140282 - RNA, 20 nt, Staphylococcus aureus subsp. aureus N315
auuuaauggucuaauaucaa

SEQ ID NO: 2140283 - RNA, 22 nt, Staphylococcus aureus subsp. aureus N315
auuuaauggucuaauaucaauu

SEQ ID NO: 2140284 - RNA, 12 nt, Staphylococcus aureus subsp. aureus N315
auuuaauguuuu

SEQ ID NO: 2140285 - RNA, 16 nt, Staphylococcus aureus subsp. aureus N315
auuuaauguuaaacaa

SEQ ID NO: 2140286 - RNA, 18 nt, Staphylococcus aureus subsp. aureus N315
auuuaauucugguuuaau

SEQ ID NO: 2140287 - RNA, 12 nt, Staphylococcus aureus subsp. aureus N315
auuuaauuuuuc

SEQ ID NO: 2140288 - RNA, 23 nt, Staphylococcus aureus subsp. aureus N315
auuuaagaaugcgaagauuuuua

SEQ ID NO: 2140289 - RNA, 16 nt, Staphylococcus aureus subsp. aureus N315
auuuaaaauauaaauu

SEQ ID NO: 2140290 - RNA, 21 nt, Staphylococcus aureus subsp. aureus N315
auuuaaaaucggacaacugag

SEQ ID NO: 2140291 - RNA, 16 nt, Staphylococcus aureus subsp. aureus N315
auuuaaaccaucaauu

SEQ ID NO: 2140292 - RNA, 17 nt, Staphylococcus aureus subsp. aureus N315
auuuaacuaugaaauug

SEQ ID NO: 2140293 - RNA, 21 nt, Staphylococcus aureus subsp. aureus N315
auuuaacuuucccuacugcuu

SEQ ID NO: 2140294 - RNA, 13 nt, Staphylococcus aureus subsp. aureus N315
auuuaaaaaaugc

SEQ ID NO: 2140295 - RNA, 16 nt, Staphylococcus aureus subsp. aureus N315
auuguuuuuaaaaucu

SEQ ID NO: 2140296 - RNA, 20 nt, Staphylococcus aureus subsp. aureus N315
auuguuuuagcaauuugcug

SEQ ID NO: 2140297 - RNA, 22 nt, Staphylococcus aureus subsp. aureus N315
auuuaaaauaguucuuuaaauu

SEQ ID NO: 2140298 - RNA, 13 nt, Staphylococcus aureus subsp. aureus N315
auuuaaaagacaa

SEQ ID NO: 2140299 - RNA, 13 nt, Staphylococcus aureus subsp. aureus N315
auuuaaaagauua

SEQ ID NO: 2140300 - RNA, 14 nt, Staphylococcus aureus subsp. aureus N315
auuuaaaagagaau

SEQ ID NO: 2140301 - RNA, 21 nt, Staphylococcus aureus subsp. aureus N315
auuuaaaacaaugauuaaaau

SEQ ID NO: 2140302 - RNA, 19 nt, Staphylococcus aureus subsp. aureus N315
auuuaaaaaucgaauuuuc

SEQ ID NO: 2140303 - RNA, 16 nt, Staphylococcus aureus subsp. aureus N315
auuuaaaaaucaaaga

SEQ ID NO: 2140304 - RNA, 16 nt, Staphylococcus aureus subsp. aureus N315
auuuaaaaauagccuu

SEQ ID NO: 2140305 - RNA, 15 nt, Staphylococcus aureus subsp. aureus N315
auuguuuguagaaau

SEQ ID NO: 2140306 - RNA, 19 nt, Staphylococcus aureus subsp. aureus N315
auugucuuuauaaaaaaau

SEQ ID NO: 2140307 - RNA, 23 nt, Staphylococcus aureus subsp. aureus N315
auugugaaaguuuuugucuuaau

SEQ ID NO: 2140308 - RNA, 15 nt, Staphylococcus aureus subsp. aureus N315
auugugaaaucuauu

SEQ ID NO: 2140309 - RNA, 15 nt, Staphylococcus aureus subsp. aureus N315
auuuaauuuuucuaa

SEQ ID NO: 2140310 - RNA, 19 nt, Staphylococcus aureus subsp. aureus N315
auuuaauuuuucuaaauga

SEQ ID NO: 2140311 - RNA, 21 nt, Staphylococcus aureus subsp. aureus N315
auuuaauuuuucuaaaugauu

SEQ ID NO: 2140312 - RNA, 21 nt, Staphylococcus aureus subsp. aureus N315
auuuacaauguuaucuugcuu

SEQ ID NO: 2140313 - RNA, 16 nt, Staphylococcus aureus subsp. aureus N315
auuuacacacaugaua

SEQ ID NO: 2140314 - RNA, 18 nt, Staphylococcus aureus subsp. aureus N315
auuuacaccuauaccuca

SEQ ID NO: 2140315 - RNA, 15 nt, Staphylococcus aureus subsp. aureus N315
auuuacaccuauacc

SEQ ID NO: 2140316 - RNA, 18 nt, Staphylococcus aureus subsp. aureus N315
auuuacaccuauaccucg

SEQ ID NO: 2140317 - RNA, 18 nt, Staphylococcus aureus subsp. aureus N315
auuuacuccuuacaauaa

SEQ ID NO: 2140318 - RNA, 15 nt, Staphylococcus aureus subsp. aureus N315
auuuaccuucuucua

SEQ ID NO: 2140319 - RNA, 21 nt, Staphylococcus aureus subsp. aureus N315
auuuaccucuugauaaaauaa

SEQ ID NO: 2140320 - RNA, 16 nt, Staphylococcus aureus subsp. aureus N315
auuuacgguuauggug

SEQ ID NO: 2140321 - RNA, 13 nt, Staphylococcus aureus subsp. aureus N315
auuuacuucuucu

SEQ ID NO: 2140322 - RNA, 15 nt, Staphylococcus aureus subsp. aureus N315
auuuacuugauuaga

SEQ ID NO: 2140323 - RNA, 22 nt, Staphylococcus aureus subsp. aureus N315
auuuacuuuuccuugauucuua

SEQ ID NO: 2140324 - RNA, 20 nt, Staphylococcus aureus subsp. aureus N315
auuuagacuuggauaaaaau

SEQ ID NO: 2140325 - RNA, 18 nt, Staphylococcus aureus subsp. aureus N315
auuuagaauaaacuuuau

SEQ ID NO: 2140326 - RNA, 20 nt, Staphylococcus aureus subsp. aureus N315
auuuagaauaaacuuuaugg

SEQ ID NO: 2140327 - RNA, 21 nt, Staphylococcus aureus subsp. aureus N315
auuuagaaacuuccaacauau

SEQ ID NO: 2140328 - RNA, 21 nt, Staphylococcus aureus subsp. aureus N315
auuuaggaguauccugauuua

SEQ ID NO: 2140329 - RNA, 15 nt, Staphylococcus aureus subsp. aureus N315
auuuagcaucaaaaa

SEQ ID NO: 2140330 - RNA, 19 nt, Staphylococcus aureus subsp. aureus N315
auuuagcaucaaaaauaaa

SEQ ID NO: 2140331 - RNA, 18 nt, Staphylococcus aureus subsp. aureus N315
auuuagaugauucuuauc

SEQ ID NO: 2140332 - RNA, 20 nt, Staphylococcus aureus subsp. aureus N315
auuuagaugcauaaaaaaag

SEQ ID NO: 2140333 - RNA, 17 nt, Staphylococcus aureus subsp. aureus N315
auuuagaugcauaaaaa

SEQ ID NO: 2140334 - RNA, 20 nt, Staphylococcus aureus subsp. aureus N315
auuuagauagcggauuuauu

SEQ ID NO: 2140335 - RNA, 18 nt, Staphylococcus aureus subsp. aureus N315
auuuagauuggucaaacu

SEQ ID NO: 2140336 - RNA, 22 nt, Staphylococcus aureus subsp. aureus N315
augccggucaaagcgaauagaa

SEQ ID NO: 2140337 - RNA, 19 nt, Staphylococcus aureus subsp. aureus N315
augccagcuucuaacaaau

SEQ ID NO: 2140338 - RNA, 18 nt, Staphylococcus aureus subsp. aureus N315
augccagaugcaaugaua

SEQ ID NO: 2140339 - RNA, 20 nt, Staphylococcus aureus subsp. aureus N315
augcaguaaaaccaaaucgu

SEQ ID NO: 2140340 - RNA, 21 nt, Staphylococcus aureus subsp. aureus N315
augcauaauuaggauuaacau

SEQ ID NO: 2140341 - RNA, 20 nt, Staphylococcus aureus subsp. aureus N315
augcauaauaccaauugcuu

SEQ ID NO: 2140342 - RNA, 14 nt, Staphylococcus aureus subsp. aureus N315
augcauaauaccaa

SEQ ID NO: 2140343 - RNA, 21 nt, Staphylococcus aureus subsp. aureus N315
augcaugccagaugcaaugau

SEQ ID NO: 2140344 - RNA, 21 nt, Staphylococcus aureus subsp. aureus N315
augcaugcgcaaaagcgcagg

SEQ ID NO: 2140345 - RNA, 13 nt, Staphylococcus aureus subsp. aureus N315
augcauauauaua

SEQ ID NO: 2140346 - RNA, 15 nt, Staphylococcus aureus subsp. aureus N315
augcauauauauaua

SEQ ID NO: 2140347 - RNA, 22 nt, Staphylococcus aureus subsp. aureus N315
augcauccaaauauuaaaaaca

SEQ ID NO: 2140348 - RNA, 21 nt, Staphylococcus aureus subsp. aureus N315
augcaccuuuacaacauacau

SEQ ID NO: 2140349 - RNA, 17 nt, Staphylococcus aureus subsp. aureus N315
augcaccuuuacaacau

SEQ ID NO: 2140350 - RNA, 14 nt, Staphylococcus aureus subsp. aureus N315
augcacuccuauug

SEQ ID NO: 2140351 - RNA, 21 nt, Staphylococcus aureus subsp. aureus N315
augcacuuuauuaaaaauccu

SEQ ID NO: 2140352 - RNA, 23 nt, Staphylococcus aureus subsp. aureus N315
augcuagcuuucuuuuucaucuu

SEQ ID NO: 2140353 - RNA, 22 nt, Staphylococcus aureus subsp. aureus N315
augcuauauuucgguauuuuaa

SEQ ID NO: 2140354 - RNA, 16 nt, Staphylococcus aureus subsp. aureus N315
augcuauauuucggua

SEQ ID NO: 2140355 - RNA, 22 nt, Staphylococcus aureus subsp. aureus N315
aaaagagaaacaaaacaaaaaa

SEQ ID NO: 2140356 - RNA, 14 nt, Staphylococcus aureus subsp. aureus N315
aaaagagaauuuua

SEQ ID NO: 2140357 - RNA, 12 nt, Staphylococcus aureus subsp. aureus N315
aaaagagaccuu

SEQ ID NO: 2140358 - RNA, 19 nt, Staphylococcus aureus subsp. aureus N315
augcuagcuuucuuuuuca

SEQ ID NO: 2140359 - RNA, 13 nt, Staphylococcus aureus subsp. aureus N315
aaaagacaaucuc

SEQ ID NO: 2140360 - RNA, 21 nt, Staphylococcus aureus subsp. aureus N315
augcuacacgaguauuaucac

SEQ ID NO: 2140361 - RNA, 16 nt, Staphylococcus aureus subsp. aureus N315
augcuaauuuaacugc

SEQ ID NO: 2140362 - RNA, 17 nt, Staphylococcus aureus subsp. aureus N315
augcuaaaaauauugaa

SEQ ID NO: 2140363 - RNA, 13 nt, Staphylococcus aureus subsp. aureus N315
augcgcaaaagcg

SEQ ID NO: 2140364 - RNA, 18 nt, Staphylococcus aureus subsp. aureus N315
augcgcaaaagcgcaggc

SEQ ID NO: 2140365 - RNA, 19 nt, Staphylococcus aureus subsp. aureus N315
augcgcaaaagcgcaggcg

SEQ ID NO: 2140366 - RNA, 16 nt, Staphylococcus aureus subsp. aureus N315
augcgauucucauuua

SEQ ID NO: 2140367 - RNA, 14 nt, Staphylococcus aureus subsp. aureus N315
augucacauaugac

SEQ ID NO: 2140368 - RNA, 15 nt, Staphylococcus aureus subsp. aureus N315
augucacauaugacu

SEQ ID NO: 2140369 - RNA, 19 nt, Staphylococcus aureus subsp. aureus N315
augucaauagcgguuuaaa

SEQ ID NO: 2140370 - RNA, 24 nt, Staphylococcus aureus subsp. aureus N315
augucaaaucggcuauacauugau

SEQ ID NO: 2140371 - RNA, 18 nt, Staphylococcus aureus subsp. aureus N315
augucacugcaaacacag

SEQ ID NO: 2140372 - RNA, 23 nt, Staphylococcus aureus subsp. aureus N315
augucacugcaaacacaguacaa

SEQ ID NO: 2140373 - RNA, 17 nt, Staphylococcus aureus subsp. aureus N315
auguauucuuagauauu

SEQ ID NO: 2140374 - RNA, 22 nt, Staphylococcus aureus subsp. aureus N315
auguauguuuuaucaauauuag

SEQ ID NO: 2140375 - RNA, 13 nt, Staphylococcus aureus subsp. aureus N315
auguauugcuaua

SEQ ID NO: 2140376 - RNA, 19 nt, Staphylococcus aureus subsp. aureus N315
auguauuuaguaucaugau

SEQ ID NO: 2140377 - RNA, 17 nt, Staphylococcus aureus subsp. aureus N315
auguauuuuuauuuaua

SEQ ID NO: 2140378 - RNA, 21 nt, Staphylococcus aureus subsp. aureus N315
augucauagccuauuuaaaag

SEQ ID NO: 2140379 - RNA, 18 nt, Staphylococcus aureus subsp. aureus N315
augucaguuuugaagaau

SEQ ID NO: 2140380 - RNA, 17 nt, Staphylococcus aureus subsp. aureus N315
augucauguauugucca

SEQ ID NO: 2140381 - RNA, 18 nt, Staphylococcus aureus subsp. aureus N315
aaaagaugaaaaucuuua

SEQ ID NO: 2140382 - RNA, 14 nt, Staphylococcus aureus subsp. aureus N315
aaaagaucgauacu

SEQ ID NO: 2140383 - RNA, 22 nt, Staphylococcus aureus subsp. aureus N315
auguagugaaagucguuguuga

SEQ ID NO: 2140384 - RNA, 19 nt, Staphylococcus aureus subsp. aureus N315
auguauaaaacagaauuuc

SEQ ID NO: 2140385 - RNA, 15 nt, Staphylococcus aureus subsp. aureus N315
auguauaucuuuauu

SEQ ID NO: 2140386 - RNA, 18 nt, Staphylococcus aureus subsp. aureus N315
auguauauggcaucauca

SEQ ID NO: 2140387 - RNA, 21 nt, Staphylococcus aureus subsp. aureus N315
auguaugcuuguacaaaaaau

SEQ ID NO: 2140388 - RNA, 16 nt, Staphylococcus aureus subsp. aureus N315
auguaugagucaaauu

SEQ ID NO: 2140389 - RNA, 14 nt, Staphylococcus aureus subsp. aureus N315
auguaucuauacaa

SEQ ID NO: 2140390 - RNA, 21 nt, Staphylococcus aureus subsp. aureus N315
aaaagauuagaugauauuuaa

SEQ ID NO: 2140391 - RNA, 21 nt, Staphylococcus aureus subsp. aureus N315
aaaagaugguuuuguuuugcu

SEQ ID NO: 2140392 - RNA, 23 nt, Staphylococcus aureus subsp. aureus N315
auguacguuuuuuuaaauacaua

SEQ ID NO: 2140393 - RNA, 18 nt, Staphylococcus aureus subsp. aureus N315
auguacguuuuuuuaaau

SEQ ID NO: 2140394 - RNA, 12 nt, Staphylococcus aureus subsp. aureus N315
auguacuauaaa

SEQ ID NO: 2140395 - RNA, 16 nt, Staphylococcus aureus subsp. aureus N315
auguacuauaaauccu

SEQ ID NO: 2140396 - RNA, 13 nt, Staphylococcus aureus subsp. aureus N315
auguaauuauuuu

SEQ ID NO: 2140397 - RNA, 21 nt, Staphylococcus aureus subsp. aureus N315
auguaaugauacaaacccaua

SEQ ID NO: 2140398 - RNA, 15 nt, Staphylococcus aureus subsp. aureus N315
auguaaucagguuua

SEQ ID NO: 2140399 - RNA, 17 nt, Staphylococcus aureus subsp. aureus N315
auguaagcuaucguaaa

SEQ ID NO: 2140400 - RNA, 17 nt, Staphylococcus aureus subsp. aureus N315
auguaacuuuagacaua

SEQ ID NO: 2140401 - RNA, 22 nt, Staphylococcus aureus subsp. aureus N315
auguacuuuucugucuguaaau

SEQ ID NO: 2140402 - RNA, 21 nt, Staphylococcus aureus subsp. aureus N315
auguagacgauucacagacaa

SEQ ID NO: 2140403 - RNA, 21 nt, Staphylococcus aureus subsp. aureus N315
auguaggcuuuuuuauuaugu

SEQ ID NO: 2140404 - RNA, 15 nt, Staphylococcus aureus subsp. aureus N315
auggugaacuaaauu

SEQ ID NO: 2140405 - RNA, 15 nt, Staphylococcus aureus subsp. aureus N315
augguuucauaaacu

SEQ ID NO: 2140406 - RNA, 14 nt, Staphylococcus aureus subsp. aureus N315
augguuugaguaaa

SEQ ID NO: 2140407 - RNA, 22 nt, Staphylococcus aureus subsp. aureus N315
augguuuuguuuugcucuuuaa

SEQ ID NO: 2140408 - RNA, 21 nt, Staphylococcus aureus subsp. aureus N315
augguuuucuuuuuaucauga

SEQ ID NO: 2140409 - RNA, 13 nt, Staphylococcus aureus subsp. aureus N315
auguaaaaaauau

SEQ ID NO: 2140410 - RNA, 20 nt, Staphylococcus aureus subsp. aureus N315
auguaaaaaauaucuuguca

SEQ ID NO: 2140411 - RNA, 12 nt, Staphylococcus aureus subsp. aureus N315
augggccccaac

SEQ ID NO: 2140412 - RNA, 19 nt, Staphylococcus aureus subsp. aureus N315
augggggauuuuuuuaugu

SEQ ID NO: 2140413 - RNA, 21 nt, Staphylococcus aureus subsp. aureus N315
augggauuucacuugaccacu

SEQ ID NO: 2140414 - RNA, 20 nt, Staphylococcus aureus subsp. aureus N315
auggucaacuuuuuuaacuu

SEQ ID NO: 2140415 - RNA, 21 nt, Staphylococcus aureus subsp. aureus N315
auggguauccuucucaucauu

SEQ ID NO: 2140416 - RNA, 23 nt, Staphylococcus aureus subsp. aureus N315
augggucaaugacugagaaaaau

SEQ ID NO: 2140417 - RNA, 22 nt, Staphylococcus aureus subsp. aureus N315
auggguauuuuguucaguuaaa

SEQ ID NO: 2140418 - RNA, 23 nt, Staphylococcus aureus subsp. aureus N315
auggcuuuuuuugcuguuuaguu

SEQ ID NO: 2140419 - RNA, 17 nt, Staphylococcus aureus subsp. aureus N315
augcugauaauuuuucu

SEQ ID NO: 2140420 - RNA, 22 nt, Staphylococcus aureus subsp. aureus N315
augcuguacuauauucaaugau

SEQ ID NO: 2140421 - RNA, 20 nt, Staphylococcus aureus subsp. aureus N315
auggcaucuggcaaauugcc

SEQ ID NO: 2140422 - RNA, 18 nt, Staphylococcus aureus subsp. aureus N315
auggcgcaauuuuuaaca

SEQ ID NO: 2140423 - RNA, 16 nt, Staphylococcus aureus subsp. aureus N315
auucagaugaauaaug

SEQ ID NO: 2140424 - RNA, 17 nt, Staphylococcus aureus subsp. aureus N315
auucagucaguaaaaau

SEQ ID NO: 2140425 - RNA, 13 nt, Staphylococcus aureus subsp. aureus N315
auucagucaacua

SEQ ID NO: 2140426 - RNA, 12 nt, Staphylococcus aureus subsp. aureus N315
auucagauuuuc

SEQ ID NO: 2140427 - RNA, 17 nt, Staphylococcus aureus subsp. aureus N315
auucaaccaauuauuaa

SEQ ID NO: 2140428 - RNA, 17 nt, Staphylococcus aureus subsp. aureus N315
auucaaccuuaauagga

SEQ ID NO: 2140429 - RNA, 21 nt, Staphylococcus aureus subsp. aureus N315
auucaauacgaaguguuauaa

SEQ ID NO: 2140430 - RNA, 22 nt, Staphylococcus aureus subsp. aureus N315
auucaauaauuauuaauuuaau

SEQ ID NO: 2140431 - RNA, 17 nt, Staphylococcus aureus subsp. aureus N315
auucaauaauuauuaau

SEQ ID NO: 2140432 - RNA, 14 nt, Staphylococcus aureus subsp. aureus N315
auucaauauuuuuu

SEQ ID NO: 2140433 - RNA, 15 nt, Staphylococcus aureus subsp. aureus N315
auucaaugauuuuua

SEQ ID NO: 2140434 - RNA, 20 nt, Staphylococcus aureus subsp. aureus N315
auucaaaguuuucauuuaac

SEQ ID NO: 2140435 - RNA, 18 nt, Staphylococcus aureus subsp. aureus N315
auuauugagaauauuuau

SEQ ID NO: 2140436 - RNA, 12 nt, Staphylococcus aureus subsp. aureus N315
auuauugaaauu

SEQ ID NO: 2140437 - RNA, 19 nt, Staphylococcus aureus subsp. aureus N315
auucaaauaaaucaaacuu

SEQ ID NO: 2140438 - RNA, 16 nt, Staphylococcus aureus subsp. aureus N315
auuauucuuuauauuu

SEQ ID NO: 2140439 - RNA, 22 nt, Staphylococcus aureus subsp. aureus N315
auuauugaaaucgauacuaaua

SEQ ID NO: 2140440 - RNA, 18 nt, Staphylococcus aureus subsp. aureus N315
auuauugaaacuaauaau

SEQ ID NO: 2140441 - RNA, 20 nt, Staphylococcus aureus subsp. aureus N315
auuauugaaaucgauacuaa

SEQ ID NO: 2140442 - RNA, 19 nt, Staphylococcus aureus subsp. aureus N315
auuauucuuugauuaaauc

SEQ ID NO: 2140443 - RNA, 14 nt, Staphylococcus aureus subsp. aureus N315
auuauucuuugauu

SEQ ID NO: 2140444 - RNA, 16 nt, Staphylococcus aureus subsp. aureus N315
aaaaggcucauuuguu

SEQ ID NO: 2140445 - RNA, 15 nt, Staphylococcus aureus subsp. aureus N315
auucaauguuuuaaa

SEQ ID NO: 2140446 - RNA, 21 nt, Staphylococcus aureus subsp. aureus N315
auucaauguaucaccuaauug

SEQ ID NO: 2140447 - RNA, 16 nt, Staphylococcus aureus subsp. aureus N315
auucaaugauuuuuaa

SEQ ID NO: 2140448 - RNA, 14 nt, Staphylococcus aureus subsp. aureus N315
auucaauguuuaau

SEQ ID NO: 2140449 - RNA, 18 nt, Staphylococcus aureus subsp. aureus N315
auucaccagguuuuuuau

SEQ ID NO: 2140450 - RNA, 20 nt, Staphylococcus aureus subsp. aureus N315
auucaauuucucaccagcuc

SEQ ID NO: 2140451 - RNA, 13 nt, Staphylococcus aureus subsp. aureus N315
auucaauuucuca

SEQ ID NO: 2140452 - RNA, 20 nt, Staphylococcus aureus subsp. aureus N315
auuaugauacgcuuuuuaaa

SEQ ID NO: 2140453 - RNA, 15 nt, Staphylococcus aureus subsp. aureus N315
auuaugacuaacauu

SEQ ID NO: 2140454 - RNA, 21 nt, Staphylococcus aureus subsp. aureus N315
auuaugaggcugaguauacca

SEQ ID NO: 2140455 - RNA, 13 nt, Staphylococcus aureus subsp. aureus N315
auuaugacaacau

SEQ ID NO: 2140456 - RNA, 12 nt, Staphylococcus aureus subsp. aureus N315
auuaucuuuacg

SEQ ID NO: 2140457 - RNA, 22 nt, Staphylococcus aureus subsp. aureus N315
auuaucuguaauuaauccaucu

SEQ ID NO: 2140458 - RNA, 20 nt, Staphylococcus aureus subsp. aureus N315
auuaucuuaagucaucaauc

SEQ ID NO: 2140459 - RNA, 22 nt, Staphylococcus aureus subsp. aureus N315
auuaucuuuacgauaaacuaaa

SEQ ID NO: 2140460 - RNA, 22 nt, Staphylococcus aureus subsp. aureus N315
auuaucuuuaguauuucaucau

SEQ ID NO: 2140461 - RNA, 14 nt, Staphylococcus aureus subsp. aureus N315
auuauuauuuuaau

SEQ ID NO: 2140462 - RNA, 14 nt, Staphylococcus aureus subsp. aureus N315
auuauuauugaaau

SEQ ID NO: 2140463 - RNA, 14 nt, Staphylococcus aureus subsp. aureus N315
auuauuauuaaauu

SEQ ID NO: 2140464 - RNA, 17 nt, Staphylococcus aureus subsp. aureus N315
auuauuauuaaauuaug

SEQ ID NO: 2140465 - RNA, 15 nt, Staphylococcus aureus subsp. aureus N315
auuauuauuuaaauu

SEQ ID NO: 2140466 - RNA, 19 nt, Staphylococcus aureus subsp. aureus N315
auuauuaagugaguuuuau

SEQ ID NO: 2140467 - RNA, 13 nt, Staphylococcus aureus subsp. aureus N315
auuauuaccauau

SEQ ID NO: 2140468 - RNA, 16 nt, Staphylococcus aureus subsp. aureus N315
auuaucuguaauuaau

SEQ ID NO: 2140469 - RNA, 14 nt, Staphylococcus aureus subsp. aureus N315
auuauccuacugcu

SEQ ID NO: 2140470 - RNA, 18 nt, Staphylococcus aureus subsp. aureus N315
auuauccucaaauauauu

SEQ ID NO: 2140471 - RNA, 22 nt, Staphylococcus aureus subsp. aureus N315
auuaucauuacagauaauuauu

SEQ ID NO: 2140472 - RNA, 13 nt, Staphylococcus aureus subsp. aureus N315
auuauccuacugc

SEQ ID NO: 2140473 - RNA, 14 nt, Staphylococcus aureus subsp. aureus N315
auuauauuuucuca

SEQ ID NO: 2140474 - RNA, 13 nt, Staphylococcus aureus subsp. aureus N315
auuauauuuuucu

SEQ ID NO: 2140475 - RNA, 14 nt, Staphylococcus aureus subsp. aureus N315
auuaucaacauaau

SEQ ID NO: 2140476 - RNA, 13 nt, Staphylococcus aureus subsp. aureus N315
auuaucaaagaaa

SEQ ID NO: 2140477 - RNA, 15 nt, Staphylococcus aureus subsp. aureus N315
auuaucauaaagaua

SEQ ID NO: 2140478 - RNA, 16 nt, Staphylococcus aureus subsp. aureus N315
auuaggauucaauaau

SEQ ID NO: 2140479 - RNA, 18 nt, Staphylococcus aureus subsp. aureus N315
aaaagcugauuucuauca

SEQ ID NO: 2140480 - RNA, 22 nt, Staphylococcus aureus subsp. aureus N315
auuagcgaaaaccucuguuuug

SEQ ID NO: 2140481 - RNA, 20 nt, Staphylococcus aureus subsp. aureus N315
auuagcgaaaacuaaaggga

SEQ ID NO: 2140482 - RNA, 14 nt, Staphylococcus aureus subsp. aureus N315
auuagcgaaaacua

SEQ ID NO: 2140483 - RNA, 19 nt, Staphylococcus aureus subsp. aureus N315
auuagcguuagauaccucu

SEQ ID NO: 2140484 - RNA, 17 nt, Staphylococcus aureus subsp. aureus N315
auuacgcucauaugucu

SEQ ID NO: 2140485 - RNA, 18 nt, Staphylococcus aureus subsp. aureus N315
auuacgcucaucaccuuu

SEQ ID NO: 2140486 - RNA, 15 nt, Staphylococcus aureus subsp. aureus N315
auuagcgaaaaccuc

SEQ ID NO: 2140487 - RNA, 15 nt, Staphylococcus aureus subsp. aureus N315
auuaccuuuccauuc

SEQ ID NO: 2140488 - RNA, 20 nt, Staphylococcus aureus subsp. aureus N315
auuaggucuacgaucaaaau

SEQ ID NO: 2140489 - RNA, 19 nt, Staphylococcus aureus subsp. aureus N315
auuagguuucgauucauuu

SEQ ID NO: 2140490 - RNA, 16 nt, Staphylococcus aureus subsp. aureus N315
auuaguuuuuaaaauu

SEQ ID NO: 2140491 - RNA, 21 nt, Staphylococcus aureus subsp. aureus N315
auuaguuuuuaaaauuaucaa

SEQ ID NO: 2140492 - RNA, 17 nt, Staphylococcus aureus subsp. aureus N315
auuauaaaaacagcagu

SEQ ID NO: 2140493 - RNA, 14 nt, Staphylococcus aureus subsp. aureus N315
auuauaaaauaaau

SEQ ID NO: 2140494 - RNA, 13 nt, Staphylococcus aureus subsp. aureus N315
auuauaaaauaaa

SEQ ID NO: 2140495 - RNA, 13 nt, Staphylococcus aureus subsp. aureus N315
auuauaaaugauu

SEQ ID NO: 2140496 - RNA, 14 nt, Staphylococcus aureus subsp. aureus N315
auuauaacgugcuu

SEQ ID NO: 2140497 - RNA, 16 nt, Staphylococcus aureus subsp. aureus N315
auuauaauaaauagac

SEQ ID NO: 2140498 - RNA, 20 nt, Staphylococcus aureus subsp. aureus N315
auuauaaguagugauuuuuu

SEQ ID NO: 2140499 - RNA, 21 nt, Staphylococcus aureus subsp. aureus N315
auuauaaguugcauauaaaaa

SEQ ID NO: 2140500 - RNA, 15 nt, Staphylococcus aureus subsp. aureus N315
auuauacuuuacauu

SEQ ID NO: 2140501 - RNA, 13 nt, Staphylococcus aureus subsp. aureus N315
auuauacacuuuu

SEQ ID NO: 2140502 - RNA, 13 nt, Staphylococcus aureus subsp. aureus N315
auguuuaaaaaac

SEQ ID NO: 2140503 - RNA, 16 nt, Staphylococcus aureus subsp. aureus N315
auguuuaaaaaacuac

SEQ ID NO: 2140504 - RNA, 14 nt, Staphylococcus aureus subsp. aureus N315
auguuuaaacauuu

SEQ ID NO: 2140505 - RNA, 15 nt, Staphylococcus aureus subsp. aureus N315
auguuuaaacauuuu

SEQ ID NO: 2140506 - RNA, 17 nt, Staphylococcus aureus subsp. aureus N315
auguuuaauuuucuaaa

SEQ ID NO: 2140507 - RNA, 19 nt, Staphylococcus aureus subsp. aureus N315
auguuuauauugcaaaaau

SEQ ID NO: 2140508 - RNA, 14 nt, Staphylococcus aureus subsp. aureus N315
auguuuaugacaaa

SEQ ID NO: 2140509 - RNA, 17 nt, Staphylococcus aureus subsp. aureus N315
auguuucagaacugcca

SEQ ID NO: 2140510 - RNA, 18 nt, Staphylococcus aureus subsp. aureus N315
auguugucacuuggauuc

SEQ ID NO: 2140511 - RNA, 18 nt, Staphylococcus aureus subsp. aureus N315
auguugguucaucaaaca

SEQ ID NO: 2140512 - RNA, 20 nt, Staphylococcus aureus subsp. aureus N315
auguuggaaaaggucaaaaa

SEQ ID NO: 2140513 - RNA, 15 nt, Staphylococcus aureus subsp. aureus N315
auguccugaauguuc

SEQ ID NO: 2140514 - RNA, 18 nt, Staphylococcus aureus subsp. aureus N315
augucccagauucauauc

SEQ ID NO: 2140515 - RNA, 15 nt, Staphylococcus aureus subsp. aureus N315
auguucaauauuuuc

SEQ ID NO: 2140516 - RNA, 16 nt, Staphylococcus aureus subsp. aureus N315
auguucagaacuacaa

SEQ ID NO: 2140517 - RNA, 18 nt, Staphylococcus aureus subsp. aureus N315
auguucagaacuacaauu

SEQ ID NO: 2140518 - RNA, 15 nt, Staphylococcus aureus subsp. aureus N315
auguucagaaauuua

SEQ ID NO: 2140519 - RNA, 18 nt, Staphylococcus aureus subsp. aureus N315
auguucaucaacaugaua

SEQ ID NO: 2140520 - RNA, 18 nt, Staphylococcus aureus subsp. aureus N315
auuaaauuugaaaguaaa

SEQ ID NO: 2140521 - RNA, 16 nt, Staphylococcus aureus subsp. aureus N315
auuaaauucaaaucug

SEQ ID NO: 2140522 - RNA, 23 nt, Staphylococcus aureus subsp. aureus N315
auuaaauucuuuucaagaaauuc

SEQ ID NO: 2140523 - RNA, 22 nt, Staphylococcus aureus subsp. aureus N315
auuaaauucuuuucaagaaauu

SEQ ID NO: 2140524 - RNA, 21 nt, Staphylococcus aureus subsp. aureus N315
auuaaauacuuguuuaccuaa

SEQ ID NO: 2140525 - RNA, 11 nt, Staphylococcus aureus subsp. aureus N315
auuaaauagau

SEQ ID NO: 2140526 - RNA, 22 nt, Staphylococcus aureus subsp. aureus N315
auuaaauauuuaaccuuuaaaa

SEQ ID NO: 2140527 - RNA, 20 nt, Staphylococcus aureus subsp. aureus N315
auuaaacauuuagauuucau

SEQ ID NO: 2140528 - RNA, 19 nt, Staphylococcus aureus subsp. aureus N315
auuaaacgcucaacuauau

SEQ ID NO: 2140529 - RNA, 19 nt, Staphylococcus aureus subsp. aureus N315
auuaaacucaaaaagccaa

SEQ ID NO: 2140530 - RNA, 17 nt, Staphylococcus aureus subsp. aureus N315
auuaaacuuauaacuuu

SEQ ID NO: 2140531 - RNA, 20 nt, Staphylococcus aureus subsp. aureus N315
auuaaacuuaagaauacaug

SEQ ID NO: 2140532 - RNA, 12 nt, Staphylococcus aureus subsp. aureus N315
auuaaacuuaua

SEQ ID NO: 2140533 - RNA, 17 nt, Staphylococcus aureus subsp. aureus N315
auuaaaguguuucaaca

SEQ ID NO: 2140534 - RNA, 15 nt, Staphylococcus aureus subsp. aureus N315
auuaaagugaauauu

SEQ ID NO: 2140535 - RNA, 14 nt, Staphylococcus aureus subsp. aureus N315
auuaaaaaacaaaa

SEQ ID NO: 2140536 - RNA, 15 nt, Staphylococcus aureus subsp. aureus N315
auguuuuuuaaguac

SEQ ID NO: 2140537 - RNA, 15 nt, Staphylococcus aureus subsp. aureus N315
auuaaaaaacaaaac

SEQ ID NO: 2140538 - RNA, 14 nt, Staphylococcus aureus subsp. aureus N315
auuaaaaaaucauu

SEQ ID NO: 2140539 - RNA, 22 nt, Staphylococcus aureus subsp. aureus N315
auuaaacacgcgguaaaacgaa

SEQ ID NO: 2140540 - RNA, 12 nt, Staphylococcus aureus subsp. aureus N315
auuaaaauagag

SEQ ID NO: 2140541 - RNA, 21 nt, Staphylococcus aureus subsp. aureus N315
auuaaaaugauaucugacauu

SEQ ID NO: 2140542 - RNA, 15 nt, Staphylococcus aureus subsp. aureus N315
auuaaaauaauuaaa

SEQ ID NO: 2140543 - RNA, 12 nt, Staphylococcus aureus subsp. aureus N315
auuaaaaugaua

SEQ ID NO: 2140544 - RNA, 20 nt, Staphylococcus aureus subsp. aureus N315
auuaaaaguguugacuuuau

SEQ ID NO: 2140545 - RNA, 22 nt, Staphylococcus aureus subsp. aureus N315
auuaacauuuugaaucauacga

SEQ ID NO: 2140546 - RNA, 13 nt, Staphylococcus aureus subsp. aureus N315
auuaacacauuca

SEQ ID NO: 2140547 - RNA, 19 nt, Staphylococcus aureus subsp. aureus N315
auuaacacauucaaauaaa

SEQ ID NO: 2140548 - RNA, 19 nt, Staphylococcus aureus subsp. aureus N315
auuaaauuuuguuaggaga

SEQ ID NO: 2140549 - RNA, 15 nt, Staphylococcus aureus subsp. aureus N315
auuaaguauaucuuu

SEQ ID NO: 2140550 - RNA, 17 nt, Staphylococcus aureus subsp. aureus N315
auuaaguaauagcaacc

SEQ ID NO: 2140551 - RNA, 16 nt, Staphylococcus aureus subsp. aureus N315
auuaaguacuuuuaca

SEQ ID NO: 2140552 - RNA, 16 nt, Staphylococcus aureus subsp. aureus N315
auuaaggcuuuaguag

SEQ ID NO: 2140553 - RNA, 16 nt, Staphylococcus aureus subsp. aureus N315
auuaagugcaauaaca

SEQ ID NO: 2140554 - RNA, 17 nt, Staphylococcus aureus subsp. aureus N315
auuaaguacuuuuacaa

SEQ ID NO: 2140555 - RNA, 13 nt, Staphylococcus aureus subsp. aureus N315
aaaagcaucuuua

SEQ ID NO: 2140556 - RNA, 18 nt, Staphylococcus aureus subsp. aureus N315
aaaagcaugauacucaau

SEQ ID NO: 2140557 - RNA, 17 nt, Staphylococcus aureus subsp. aureus N315
aaaagcaggcaagcuau

SEQ ID NO: 2140558 - RNA, 16 nt, Staphylococcus aureus subsp. aureus N315
aaaagcagcaguaaga

SEQ ID NO: 2140559 - RNA, 18 nt, Staphylococcus aureus subsp. aureus N315
auuaaucauaaugaauaa

SEQ ID NO: 2140560 - RNA, 18 nt, Staphylococcus aureus subsp. aureus N315
auuaaucccuucaaaauu

SEQ ID NO: 2140561 - RNA, 16 nt, Staphylococcus aureus subsp. aureus N315
auuaaugaaauaccua

SEQ ID NO: 2140562 - RNA, 15 nt, Staphylococcus aureus subsp. aureus N315
auuaauucugauuau

SEQ ID NO: 2140563 - RNA, 17 nt, Staphylococcus aureus subsp. aureus N315
auuaauugaaaaaccaa

SEQ ID NO: 2140564 - RNA, 19 nt, Staphylococcus aureus subsp. aureus N315
auuaauuguaaagcaugaa

SEQ ID NO: 2140565 - RNA, 11 nt, Staphylococcus aureus subsp. aureus N315
auuaauuuuuc

SEQ ID NO: 2140566 - RNA, 13 nt, Staphylococcus aureus subsp. aureus N315
auuaauuugauaa

SEQ ID NO: 2140567 - RNA, 14 nt, Staphylococcus aureus subsp. aureus N315
auuaauguaaugau

SEQ ID NO: 2140568 - RNA, 14 nt, Staphylococcus aureus subsp. aureus N315
auuaauuaaagauu

SEQ ID NO: 2140569 - RNA, 21 nt, Staphylococcus aureus subsp. aureus N315
auuaauuacuguaaauaugaa

SEQ ID NO: 2140570 - RNA, 21 nt, Staphylococcus aureus subsp. aureus N315
auuaauuacaggaauugcuuu

SEQ ID NO: 2140571 - RNA, 18 nt, Staphylococcus aureus subsp. aureus N315
auuaauuacagguuuaau

SEQ ID NO: 2140572 - RNA, 22 nt, Staphylococcus aureus subsp. aureus N315
auuaauuauaaguagugauuuu

SEQ ID NO: 2140573 - RNA, 21 nt, Staphylococcus aureus subsp. aureus N315
auuaauuauugagaauauuua

SEQ ID NO: 2140574 - RNA, 15 nt, Staphylococcus aureus subsp. aureus N315
auuacagaugaugcu

SEQ ID NO: 2140575 - RNA, 12 nt, Staphylococcus aureus subsp. aureus N315
auuacagaugau

SEQ ID NO: 2140576 - RNA, 19 nt, Staphylococcus aureus subsp. aureus N315
auuacccacaucuuuuuaa

SEQ ID NO: 2140577 - RNA, 21 nt, Staphylococcus aureus subsp. aureus N315
auuacccacaucuuuuuaaaa

SEQ ID NO: 2140578 - RNA, 14 nt, Staphylococcus aureus subsp. aureus N315
auuacaauaaggac

SEQ ID NO: 2140579 - RNA, 15 nt, Staphylococcus aureus subsp. aureus N315
auuacaaugaaaaaa

SEQ ID NO: 2140580 - RNA, 16 nt, Staphylococcus aureus subsp. aureus N315
auuaauuuuucaaaug

SEQ ID NO: 2140581 - RNA, 12 nt, Staphylococcus aureus subsp. aureus N315
auuacaaacauu

SEQ ID NO: 2140582 - RNA, 16 nt, Staphylococcus aureus subsp. aureus N315
auauugcgaaaaauaa

SEQ ID NO: 2140583 - RNA, 18 nt, Staphylococcus aureus subsp. aureus N315
auauugcguuuaauuuac

SEQ ID NO: 2140584 - RNA, 22 nt, Staphylococcus aureus subsp. aureus N315
auauugcaaaaauaauaugaau

SEQ ID NO: 2140585 - RNA, 14 nt, Staphylococcus aureus subsp. aureus N315
auauugaaaacacg

SEQ ID NO: 2140586 - RNA, 11 nt, Staphylococcus aureus subsp. aureus N315
auauucuuuuu

SEQ ID NO: 2140587 - RNA, 14 nt, Staphylococcus aureus subsp. aureus N315
auauucuuuuuaac

SEQ ID NO: 2140588 - RNA, 22 nt, Staphylococcus aureus subsp. aureus N315
auauugaaaugagcuuaaguua

SEQ ID NO: 2140589 - RNA, 19 nt, Staphylococcus aureus subsp. aureus N315
auauugaaauuaaauuugu

SEQ ID NO: 2140590 - RNA, 19 nt, Staphylococcus aureus subsp. aureus N315
auauugaaaguguaugcau

SEQ ID NO: 2140591 - RNA, 20 nt, Staphylococcus aureus subsp. aureus N315
auauugaauauaaaaaacac

SEQ ID NO: 2140592 - RNA, 21 nt, Staphylococcus aureus subsp. aureus N315
auauugaauauaaaaaacacg

SEQ ID NO: 2140593 - RNA, 15 nt, Staphylococcus aureus subsp. aureus N315
auauugacauuuaca

SEQ ID NO: 2140594 - RNA, 16 nt, Staphylococcus aureus subsp. aureus N315
auauugaauugaaaaa

SEQ ID NO: 2140595 - RNA, 17 nt, Staphylococcus aureus subsp. aureus N315
auauugaauugaaaaau

SEQ ID NO: 2140596 - RNA, 16 nt, Staphylococcus aureus subsp. aureus N315
auauugagaauauuaa

SEQ ID NO: 2140597 - RNA, 23 nt, Staphylococcus aureus subsp. aureus N315
auauugagaauauuaagauguau

SEQ ID NO: 2140598 - RNA, 11 nt, Staphylococcus aureus subsp. aureus N315
auauugauagc

SEQ ID NO: 2140599 - RNA, 22 nt, Staphylococcus aureus subsp. aureus N315
auauucauguucuuguaauccu

SEQ ID NO: 2140600 - RNA, 19 nt, Staphylococcus aureus subsp. aureus N315
auauucauuaguuuuacca

SEQ ID NO: 2140601 - RNA, 20 nt, Staphylococcus aureus subsp. aureus N315
auauucaccuacaacaccaa

SEQ ID NO: 2140602 - RNA, 15 nt, Staphylococcus aureus subsp. aureus N315
auauucauauuacuu

SEQ ID NO: 2140603 - RNA, 19 nt, Staphylococcus aureus subsp. aureus N315
auauucaacuuauuauuua

SEQ ID NO: 2140604 - RNA, 16 nt, Staphylococcus aureus subsp. aureus N315
auauucaauaauuauu

SEQ ID NO: 2140605 - RNA, 17 nt, Staphylococcus aureus subsp. aureus N315
auauucaauaauuauua

SEQ ID NO: 2140606 - RNA, 14 nt, Staphylococcus aureus subsp. aureus N315
auauucaaugaauu

SEQ ID NO: 2140607 - RNA, 12 nt, Staphylococcus aureus subsp. aureus N315
auauucaaugaa

SEQ ID NO: 2140608 - RNA, 13 nt, Staphylococcus aureus subsp. aureus N315
auauucaaugaau

SEQ ID NO: 2140609 - RNA, 14 nt, Staphylococcus aureus subsp. aureus N315
auauucacaucuuu

SEQ ID NO: 2140610 - RNA, 17 nt, Staphylococcus aureus subsp. aureus N315
auaugcaacuuauaaua

SEQ ID NO: 2140611 - RNA, 12 nt, Staphylococcus aureus subsp. aureus N315
auaugauuuaaa

SEQ ID NO: 2140612 - RNA, 13 nt, Staphylococcus aureus subsp. aureus N315
auaugauugguuu

SEQ ID NO: 2140613 - RNA, 16 nt, Staphylococcus aureus subsp. aureus N315
auauuugauaacaaaa

SEQ ID NO: 2140614 - RNA, 16 nt, Staphylococcus aureus subsp. aureus N315
auauuucgguauuuua

SEQ ID NO: 2140615 - RNA, 15 nt, Staphylococcus aureus subsp. aureus N315
auauuucgguauuuu

SEQ ID NO: 2140616 - RNA, 22 nt, Staphylococcus aureus subsp. aureus N315
auauuuguagccuacaaccuuu

SEQ ID NO: 2140617 - RNA, 19 nt, Staphylococcus aureus subsp. aureus N315
auauuuuauuuaaaaauag

SEQ ID NO: 2140618 - RNA, 20 nt, Staphylococcus aureus subsp. aureus N315
auauuuuauuagaauauuca

SEQ ID NO: 2140619 - RNA, 12 nt, Staphylococcus aureus subsp. aureus N315
auauuuuaaaaa

SEQ ID NO: 2140620 - RNA, 12 nt, Staphylococcus aureus subsp. aureus N315
auauuuuaaacg

SEQ ID NO: 2140621 - RNA, 14 nt, Staphylococcus aureus subsp. aureus N315
auauuuuaguucac

SEQ ID NO: 2140622 - RNA, 11 nt, Staphylococcus aureus subsp. aureus N315
auauuuucuuc

SEQ ID NO: 2140623 - RNA, 13 nt, Staphylococcus aureus subsp. aureus N315
auauuuuguuaau

SEQ ID NO: 2140624 - RNA, 20 nt, Staphylococcus aureus subsp. aureus N315
aucaaaaccgcuauaaaauu

SEQ ID NO: 2140625 - RNA, 23 nt, Staphylococcus aureus subsp. aureus N315
auauuggcuugcuucauuauaua

SEQ ID NO: 2140626 - RNA, 19 nt, Staphylococcus aureus subsp. aureus N315
auauuguagggaguauugu

SEQ ID NO: 2140627 - RNA, 17 nt, Staphylococcus aureus subsp. aureus N315
auauuucccuaugaaau

SEQ ID NO: 2140628 - RNA, 19 nt, Staphylococcus aureus subsp. aureus N315
auauuucccuaugaaauaa

SEQ ID NO: 2140629 - RNA, 17 nt, Staphylococcus aureus subsp. aureus N315
auauuuauuuuauaaua

SEQ ID NO: 2140630 - RNA, 14 nt, Staphylococcus aureus subsp. aureus N315
auauuuauuuuuga

SEQ ID NO: 2140631 - RNA, 14 nt, Staphylococcus aureus subsp. aureus N315
auauuuauuuuaau

SEQ ID NO: 2140632 - RNA, 19 nt, Staphylococcus aureus subsp. aureus N315
auauuuaacaucaauuacu

SEQ ID NO: 2140633 - RNA, 19 nt, Staphylococcus aureus subsp. aureus N315
auauuuaaaugucuuucaa

SEQ ID NO: 2140634 - RNA, 12 nt, Staphylococcus aureus subsp. aureus N315
auauuuaaacua

SEQ ID NO: 2140635 - RNA, 23 nt, Staphylococcus aureus subsp. aureus N315
aucaagcugagcuuuaauuuuuu

SEQ ID NO: 2140636 - RNA, 18 nt, Staphylococcus aureus subsp. aureus N315
aucaagcugagcuuuaau

SEQ ID NO: 2140637 - RNA, 21 nt, Staphylococcus aureus subsp. aureus N315
aucaauaccauaauuaaauaa

SEQ ID NO: 2140638 - RNA, 20 nt, Staphylococcus aureus subsp. aureus N315
aucaauagaugaaaauuuaa

SEQ ID NO: 2140639 - RNA, 17 nt, Staphylococcus aureus subsp. aureus N315
aucaaucgcuuuagcaa

SEQ ID NO: 2140640 - RNA, 17 nt, Staphylococcus aureus subsp. aureus N315
aucaaugacuguugguu

SEQ ID NO: 2140641 - RNA, 19 nt, Staphylococcus aureus subsp. aureus N315
aucaauaucacuaucagcu

SEQ ID NO: 2140642 - RNA, 14 nt, Staphylococcus aureus subsp. aureus N315
aucaauauugauau

SEQ ID NO: 2140643 - RNA, 17 nt, Staphylococcus aureus subsp. aureus N315
aucaauaucaaauuugg

SEQ ID NO: 2140644 - RNA, 11 nt, Staphylococcus aureus subsp. aureus N315
aucaauauuua

SEQ ID NO: 2140645 - RNA, 20 nt, Staphylococcus aureus subsp. aureus N315
aucaaccuuugcuaaaucaa

SEQ ID NO: 2140646 - RNA, 17 nt, Staphylococcus aureus subsp. aureus N315
aucaacgccauauuuau

SEQ ID NO: 2140647 - RNA, 23 nt, Staphylococcus aureus subsp. aureus N315
aucaagacucccuuuuuaaaaua

SEQ ID NO: 2140648 - RNA, 21 nt, Staphylococcus aureus subsp. aureus N315
aucaagacucccuuuuuaaaa

SEQ ID NO: 2140649 - RNA, 22 nt, Staphylococcus aureus subsp. aureus N315
aucaagacucccuuuuuaaaau

SEQ ID NO: 2140650 - RNA, 13 nt, Staphylococcus aureus subsp. aureus N315
aucaagaaauguu

SEQ ID NO: 2140651 - RNA, 19 nt, Staphylococcus aureus subsp. aureus N315
aucaagaaauguuaaauua

SEQ ID NO: 2140652 - RNA, 18 nt, Staphylococcus aureus subsp. aureus N315
aucaaaaguuuguauauu

SEQ ID NO: 2140653 - RNA, 17 nt, Staphylococcus aureus subsp. aureus N315
aucaacagcuucaaaau

SEQ ID NO: 2140654 - RNA, 17 nt, Staphylococcus aureus subsp. aureus N315
aucaacaaauuuaacuu

SEQ ID NO: 2140655 - RNA, 22 nt, Staphylococcus aureus subsp. aureus N315
aucaacaagaacuuagaaaugc

SEQ ID NO: 2140656 - RNA, 14 nt, Staphylococcus aureus subsp. aureus N315
aucaacaaauuuaa

SEQ ID NO: 2140657 - RNA, 18 nt, Staphylococcus aureus subsp. aureus N315
aucaaacuuggcaaugaa

SEQ ID NO: 2140658 - RNA, 14 nt, Staphylococcus aureus subsp. aureus N315
aucacgauuuucaa

SEQ ID NO: 2140659 - RNA, 21 nt, Staphylococcus aureus subsp. aureus N315
aucaccuauuaggauccaauu

SEQ ID NO: 2140660 - RNA, 21 nt, Staphylococcus aureus subsp. aureus N315
aucacuuuaggguucauugcu

SEQ ID NO: 2140661 - RNA, 17 nt, Staphylococcus aureus subsp. aureus N315
aucacuugguaaaacau

SEQ ID NO: 2140662 - RNA, 21 nt, Staphylococcus aureus subsp. aureus N315
aucacuugcuguugcaauaaa

SEQ ID NO: 2140663 - RNA, 22 nt, Staphylococcus aureus subsp. aureus N315
aucacuugcuguugcaauaaaa

SEQ ID NO: 2140664 - RNA, 13 nt, Staphylococcus aureus subsp. aureus N315
aucacuuuuuaaa

SEQ ID NO: 2140665 - RNA, 22 nt, Staphylococcus aureus subsp. aureus N315
aucagcauuaaucguauuuuua

SEQ ID NO: 2140666 - RNA, 13 nt, Staphylococcus aureus subsp. aureus N315
aucagacuaaaau

SEQ ID NO: 2140667 - RNA, 16 nt, Staphylococcus aureus subsp. aureus N315
aucagacuaaaaugaa

SEQ ID NO: 2140668 - RNA, 11 nt, Staphylococcus aureus subsp. aureus N315
aucauauauuu

SEQ ID NO: 2140669 - RNA, 16 nt, Staphylococcus aureus subsp. aureus N315
aucauagauauaagaa

SEQ ID NO: 2140670 - RNA, 14 nt, Staphylococcus aureus subsp. aureus N315
aucauagaggcaca

SEQ ID NO: 2140671 - RNA, 17 nt, Staphylococcus aureus subsp. aureus N315
aucauaaauauuuucug

SEQ ID NO: 2140672 - RNA, 24 nt, Staphylococcus aureus subsp. aureus N315
aucauaaauauuuucugcgauaua

SEQ ID NO: 2140673 - RNA, 13 nt, Staphylococcus aureus subsp. aureus N315
aucauaaaugacg

SEQ ID NO: 2140674 - RNA, 12 nt, Staphylococcus aureus subsp. aureus N315
aucauaaauauu

SEQ ID NO: 2140675 - RNA, 13 nt, Staphylococcus aureus subsp. aureus N315
aucauaaaguaaa

SEQ ID NO: 2140676 - RNA, 15 nt, Staphylococcus aureus subsp. aureus N315
aucaguuauuuuaau

SEQ ID NO: 2140677 - RNA, 17 nt, Staphylococcus aureus subsp. aureus N315
aucagugugauuuugga

SEQ ID NO: 2140678 - RNA, 17 nt, Staphylococcus aureus subsp. aureus N315
aucaguuuuugaauauu

SEQ ID NO: 2140679 - RNA, 21 nt, Staphylococcus aureus subsp. aureus N315
aaaacgauucauuauaugguu

SEQ ID NO: 2140680 - RNA, 15 nt, Staphylococcus aureus subsp. aureus N315
aaaacgauucauuau

SEQ ID NO: 2140681 - RNA, 16 nt, Staphylococcus aureus subsp. aureus N315
aaaacgcauugcgaaa

SEQ ID NO: 2140682 - RNA, 19 nt, Staphylococcus aureus subsp. aureus N315
aaaacgcauugcgaaagaa

SEQ ID NO: 2140683 - RNA, 14 nt, Staphylococcus aureus subsp. aureus N315
aucaucgaacauga

SEQ ID NO: 2140684 - RNA, 20 nt, Staphylococcus aureus subsp. aureus N315
aucaucgcaaauacauaauc

SEQ ID NO: 2140685 - RNA, 17 nt, Staphylococcus aureus subsp. aureus N315
aucaucgccagcauuac

SEQ ID NO: 2140686 - RNA, 14 nt, Staphylococcus aureus subsp. aureus N315
aaaacuaaagggac

SEQ ID NO: 2140687 - RNA, 19 nt, Staphylococcus aureus subsp. aureus N315
aaaacuaaagguauucuau

SEQ ID NO: 2140688 - RNA, 16 nt, Staphylococcus aureus subsp. aureus N315
aucauccauaaaaaua

SEQ ID NO: 2140689 - RNA, 18 nt, Staphylococcus aureus subsp. aureus N315
aucauccauaaaaauacg

SEQ ID NO: 2140690 - RNA, 13 nt, Staphylococcus aureus subsp. aureus N315
aucauccacaauc

SEQ ID NO: 2140691 - RNA, 14 nt, Staphylococcus aureus subsp. aureus N315
aucauccacaauca

SEQ ID NO: 2140692 - RNA, 15 nt, Staphylococcus aureus subsp. aureus N315
aucauauucaaaaua

SEQ ID NO: 2140693 - RNA, 21 nt, Staphylococcus aureus subsp. aureus N315
aucauauuugaauacuuuauu

SEQ ID NO: 2140694 - RNA, 14 nt, Staphylococcus aureus subsp. aureus N315
aucauaucauacca

SEQ ID NO: 2140695 - RNA, 16 nt, Staphylococcus aureus subsp. aureus N315
aucaucaaaguuuaau

SEQ ID NO: 2140696 - RNA, 13 nt, Staphylococcus aureus subsp. aureus N315
aucaucacacaua

SEQ ID NO: 2140697 - RNA, 22 nt, Staphylococcus aureus subsp. aureus N315
aucaucaaguucaccguaaucu

SEQ ID NO: 2140698 - RNA, 21 nt, Staphylococcus aureus subsp. aureus N315
aucaucacuguagauucaaau

SEQ ID NO: 2140699 - RNA, 13 nt, Staphylococcus aureus subsp. aureus N315
aucaucacucuua

SEQ ID NO: 2140700 - RNA, 21 nt, Staphylococcus aureus subsp. aureus N315
aucaucaccauacuaaaacau

SEQ ID NO: 2140701 - RNA, 17 nt, Staphylococcus aureus subsp. aureus N315
auaugaaucuagaauau

SEQ ID NO: 2140702 - RNA, 22 nt, Staphylococcus aureus subsp. aureus N315
auaugaauugcuuguuuuaaau

SEQ ID NO: 2140703 - RNA, 20 nt, Staphylococcus aureus subsp. aureus N315
auaugaauuuagaugcauaa

SEQ ID NO: 2140704 - RNA, 23 nt, Staphylococcus aureus subsp. aureus N315
auaugaauuuagaugcauaaaaa

SEQ ID NO: 2140705 - RNA, 13 nt, Staphylococcus aureus subsp. aureus N315
auaugaauuuuau

SEQ ID NO: 2140706 - RNA, 16 nt, Staphylococcus aureus subsp. aureus N315
auaugacacauacacc

SEQ ID NO: 2140707 - RNA, 23 nt, Staphylococcus aureus subsp. aureus N315
auaugacgcgugaauuaaaaaau

SEQ ID NO: 2140708 - RNA, 13 nt, Staphylococcus aureus subsp. aureus N315
auaugauaaauau

SEQ ID NO: 2140709 - RNA, 12 nt, Staphylococcus aureus subsp. aureus N315
auaugauaacca

SEQ ID NO: 2140710 - RNA, 22 nt, Staphylococcus aureus subsp. aureus N315
auaucuugcuuggauaauugca

SEQ ID NO: 2140711 - RNA, 14 nt, Staphylococcus aureus subsp. aureus N315
auaugaaaagagaa

SEQ ID NO: 2140712 - RNA, 11 nt, Staphylococcus aureus subsp. aureus N315
auaugaaaugu

SEQ ID NO: 2140713 - RNA, 13 nt, Staphylococcus aureus subsp. aureus N315
auaugaacaaaaa

SEQ ID NO: 2140714 - RNA, 14 nt, Staphylococcus aureus subsp. aureus N315
auaucuuuguugca

SEQ ID NO: 2140715 - RNA, 18 nt, Staphylococcus aureus subsp. aureus N315
auaucuuuaucauuauuc

SEQ ID NO: 2140716 - RNA, 18 nt, Staphylococcus aureus subsp. aureus N315
auaucuuaaguacauaaa

SEQ ID NO: 2140717 - RNA, 23 nt, Staphylococcus aureus subsp. aureus N315
auaucuuaaucuaaaaauagaug

SEQ ID NO: 2140718 - RNA, 18 nt, Staphylococcus aureus subsp. aureus N315
auaucuaauucguaauuu

SEQ ID NO: 2140719 - RNA, 14 nt, Staphylococcus aureus subsp. aureus N315
auaucuacagagaa

SEQ ID NO: 2140720 - RNA, 17 nt, Staphylococcus aureus subsp. aureus N315
auaucuacagagaauca

SEQ ID NO: 2140721 - RNA, 23 nt, Staphylococcus aureus subsp. aureus N315
auaucuacagagaaucaauuauu

SEQ ID NO: 2140722 - RNA, 16 nt, Staphylococcus aureus subsp. aureus N315
auaucgucguaacucu

SEQ ID NO: 2140723 - RNA, 16 nt, Staphylococcus aureus subsp. aureus N315
auaucuaaugcaacuu

SEQ ID NO: 2140724 - RNA, 17 nt, Staphylococcus aureus subsp. aureus N315
auaucgcuuuugaaguu

SEQ ID NO: 2140725 - RNA, 15 nt, Staphylococcus aureus subsp. aureus N315
auauccuguuucaua

SEQ ID NO: 2140726 - RNA, 14 nt, Staphylococcus aureus subsp. aureus N315
auauccuucauuag

SEQ ID NO: 2140727 - RNA, 17 nt, Staphylococcus aureus subsp. aureus N315
auauccuucaaagauuu

SEQ ID NO: 2140728 - RNA, 15 nt, Staphylococcus aureus subsp. aureus N315
auaucgauaaaugua

SEQ ID NO: 2140729 - RNA, 16 nt, Staphylococcus aureus subsp. aureus N315
auaucgacaccauuua

SEQ ID NO: 2140730 - RNA, 21 nt, Staphylococcus aureus subsp. aureus N315
auaucgaugacuuugucuuua

SEQ ID NO: 2140731 - RNA, 15 nt, Staphylococcus aureus subsp. aureus N315
auaucaucauuuaaa

SEQ ID NO: 2140732 - RNA, 14 nt, Staphylococcus aureus subsp. aureus N315
auaucaucucuaug

SEQ ID NO: 2140733 - RNA, 12 nt, Staphylococcus aureus subsp. aureus N315
auaucaucaagu

SEQ ID NO: 2140734 - RNA, 20 nt, Staphylococcus aureus subsp. aureus N315
auaucauaccaaaaaguauu

SEQ ID NO: 2140735 - RNA, 17 nt, Staphylococcus aureus subsp. aureus N315
auaucaucucuaugucu

SEQ ID NO: 2140736 - RNA, 20 nt, Staphylococcus aureus subsp. aureus N315
auauccauucaauguuuaau

SEQ ID NO: 2140737 - RNA, 17 nt, Staphylococcus aureus subsp. aureus N315
auaucaaaauauaaaau

SEQ ID NO: 2140738 - RNA, 15 nt, Staphylococcus aureus subsp. aureus N315
auaucaguaauaaua

SEQ ID NO: 2140739 - RNA, 12 nt, Staphylococcus aureus subsp. aureus N315
auauauuugaaa

SEQ ID NO: 2140740 - RNA, 17 nt, Staphylococcus aureus subsp. aureus N315
auauauuugaaagguaa

SEQ ID NO: 2140741 - RNA, 22 nt, Staphylococcus aureus subsp. aureus N315
auauauuucuauuccuucuaac

SEQ ID NO: 2140742 - RNA, 18 nt, Staphylococcus aureus subsp. aureus N315
auauauuuguauaugcaa

SEQ ID NO: 2140743 - RNA, 21 nt, Staphylococcus aureus subsp. aureus N315
auauauuuggaggugaugaga

SEQ ID NO: 2140744 - RNA, 15 nt, Staphylococcus aureus subsp. aureus N315
auauauugucgacuu

SEQ ID NO: 2140745 - RNA, 16 nt, Staphylococcus aureus subsp. aureus N315
auauauuuauuuuuga

SEQ ID NO: 2140746 - RNA, 19 nt, Staphylococcus aureus subsp. aureus N315
auauauuuauuuuugauag

SEQ ID NO: 2140747 - RNA, 16 nt, Staphylococcus aureus subsp. aureus N315
auauacgaauccucau

SEQ ID NO: 2140748 - RNA, 22 nt, Staphylococcus aureus subsp. aureus N315
auauacgauugaguugaaaaua

SEQ ID NO: 2140749 - RNA, 17 nt, Staphylococcus aureus subsp. aureus N315
auauacuaaauuugaaa

SEQ ID NO: 2140750 - RNA, 14 nt, Staphylococcus aureus subsp. aureus N315
auauacucuaaaaa

SEQ ID NO: 2140751 - RNA, 13 nt, Staphylococcus aureus subsp. aureus N315
auauacuugaaga

SEQ ID NO: 2140752 - RNA, 15 nt, Staphylococcus aureus subsp. aureus N315
auauacuugaagaaa

SEQ ID NO: 2140753 - RNA, 18 nt, Staphylococcus aureus subsp. aureus N315
auauacuguauaguaacc

SEQ ID NO: 2140754 - RNA, 17 nt, Staphylococcus aureus subsp. aureus N315
auauacuuuuuaaauga

SEQ ID NO: 2140755 - RNA, 18 nt, Staphylococcus aureus subsp. aureus N315
auauacuugccuucaaau

SEQ ID NO: 2140756 - RNA, 20 nt, Staphylococcus aureus subsp. aureus N315
auauagaagauauaacaugu

SEQ ID NO: 2140757 - RNA, 11 nt, Staphylococcus aureus subsp. aureus N315
auauagaaaau

SEQ ID NO: 2140758 - RNA, 19 nt, Staphylococcus aureus subsp. aureus N315
auauacuuuuuaaaugauu

SEQ ID NO: 2140759 - RNA, 22 nt, Staphylococcus aureus subsp. aureus N315
auauagaaaacuagaacuuagu

SEQ ID NO: 2140760 - RNA, 18 nt, Staphylococcus aureus subsp. aureus N315
auauagagccaugaaaag

SEQ ID NO: 2140761 - RNA, 21 nt, Staphylococcus aureus subsp. aureus N315
auauagagccaugaaaaggaa

SEQ ID NO: 2140762 - RNA, 21 nt, Staphylococcus aureus subsp. aureus N315
auauauccugccaauauauuc

SEQ ID NO: 2140763 - RNA, 19 nt, Staphylococcus aureus subsp. aureus N315
auauaucuagccugaaaua

SEQ ID NO: 2140764 - RNA, 14 nt, Staphylococcus aureus subsp. aureus N315
auauaugaaauauu

SEQ ID NO: 2140765 - RNA, 15 nt, Staphylococcus aureus subsp. aureus N315
auauaugaaauauuu

SEQ ID NO: 2140766 - RNA, 17 nt, Staphylococcus aureus subsp. aureus N315
auauaugaaauauuuau

SEQ ID NO: 2140767 - RNA, 17 nt, Staphylococcus aureus subsp. aureus N315
auauaaaggaauagcua

SEQ ID NO: 2140768 - RNA, 20 nt, Staphylococcus aureus subsp. aureus N315
auauaaagcuagggugaauu

SEQ ID NO: 2140769 - RNA, 18 nt, Staphylococcus aureus subsp. aureus N315
auauaaaggaauagcuac

SEQ ID NO: 2140770 - RNA, 20 nt, Staphylococcus aureus subsp. aureus N315
auauaagaauuguugaucau

SEQ ID NO: 2140771 - RNA, 15 nt, Staphylococcus aureus subsp. aureus N315
auauaaggaaaagga

SEQ ID NO: 2140772 - RNA, 19 nt, Staphylococcus aureus subsp. aureus N315
auauaagauucauauuuau

SEQ ID NO: 2140773 - RNA, 21 nt, Staphylococcus aureus subsp. aureus N315
auauaaugcugauaauuuuuc

SEQ ID NO: 2140774 - RNA, 17 nt, Staphylococcus aureus subsp. aureus N315
auauaauuaauuuugua

SEQ ID NO: 2140775 - RNA, 14 nt, Staphylococcus aureus subsp. aureus N315
auauaaugguugaa

SEQ ID NO: 2140776 - RNA, 13 nt, Staphylococcus aureus subsp. aureus N315
auauaauagaaau

SEQ ID NO: 2140777 - RNA, 17 nt, Staphylococcus aureus subsp. aureus N315
auauaauauacacaaaa

SEQ ID NO: 2140778 - RNA, 19 nt, Staphylococcus aureus subsp. aureus N315
auauaccuugauucauuuc

SEQ ID NO: 2140779 - RNA, 23 nt, Staphylococcus aureus subsp. aureus N315
auauaauucgucuguuucauaua

SEQ ID NO: 2140780 - RNA, 19 nt, Staphylococcus aureus subsp. aureus N315
auauaauucuuguuugauu

SEQ ID NO: 2140781 - RNA, 18 nt, Staphylococcus aureus subsp. aureus N315
auagcuaaugcauuauua

SEQ ID NO: 2140782 - RNA, 18 nt, Staphylococcus aureus subsp. aureus N315
auagcucuucuuuuucuu

SEQ ID NO: 2140783 - RNA, 22 nt, Staphylococcus aureus subsp. aureus N315
auagcucuucuuuuucuugcau

SEQ ID NO: 2140784 - RNA, 16 nt, Staphylococcus aureus subsp. aureus N315
auagcucuauggcuuc

SEQ ID NO: 2140785 - RNA, 22 nt, Staphylococcus aureus subsp. aureus N315
auagucuuaaacauaacaugac

SEQ ID NO: 2140786 - RNA, 19 nt, Staphylococcus aureus subsp. aureus N315
auagugcuuguuuauuaca

SEQ ID NO: 2140787 - RNA, 22 nt, Staphylococcus aureus subsp. aureus N315
auaguucaaauugaacuucuuu

SEQ ID NO: 2140788 - RNA, 23 nt, Staphylococcus aureus subsp. aureus N315
auauaaaaaccccuguugaacuu

SEQ ID NO: 2140789 - RNA, 21 nt, Staphylococcus aureus subsp. aureus N315
auauaaaaagaagaucccuca

SEQ ID NO: 2140790 - RNA, 22 nt, Staphylococcus aureus subsp. aureus N315
auauaaaaagucccgcuuaaaa

SEQ ID NO: 2140791 - RNA, 15 nt, Staphylococcus aureus subsp. aureus N315
auauaaaaagugaaa

SEQ ID NO: 2140792 - RNA, 21 nt, Staphylococcus aureus subsp. aureus N315
auauaaaaaagaucacugcca

SEQ ID NO: 2140793 - RNA, 21 nt, Staphylococcus aureus subsp. aureus N315
auaguuuugauugcaaaaaaa

SEQ ID NO: 2140794 - RNA, 11 nt, Staphylococcus aureus subsp. aureus N315
auauaaaaagu

SEQ ID NO: 2140795 - RNA, 19 nt, Staphylococcus aureus subsp. aureus N315
auauaaaacgauaagaauu

SEQ ID NO: 2140796 - RNA, 15 nt, Staphylococcus aureus subsp. aureus N315
auaguuuucuucacu

SEQ ID NO: 2140797 - RNA, 21 nt, Staphylococcus aureus subsp. aureus N315
auaguuuauuaauauuaguga

SEQ ID NO: 2140798 - RNA, 14 nt, Staphylococcus aureus subsp. aureus N315
auaguuuauuaaua

SEQ ID NO: 2140799 - RNA, 14 nt, Staphylococcus aureus subsp. aureus N315
auaguucuauauaa

SEQ ID NO: 2140800 - RNA, 16 nt, Staphylococcus aureus subsp. aureus N315
auaguucuuuaaauua

SEQ ID NO: 2140801 - RNA, 14 nt, Staphylococcus aureus subsp. aureus N315
auaguucuuuaaau

SEQ ID NO: 2140802 - RNA, 23 nt, Staphylococcus aureus subsp. aureus N315
auaguugagcguuuaauuagaaa

SEQ ID NO: 2140803 - RNA, 16 nt, Staphylococcus aureus subsp. aureus N315
auagacugccaauaaa

SEQ ID NO: 2140804 - RNA, 22 nt, Staphylococcus aureus subsp. aureus N315
auagaguaguucggaugagaaa

SEQ ID NO: 2140805 - RNA, 22 nt, Staphylococcus aureus subsp. aureus N315
auagacuuucuugaugaauuaa

SEQ ID NO: 2140806 - RNA, 15 nt, Staphylococcus aureus subsp. aureus N315
auagagaaagaauaa

SEQ ID NO: 2140807 - RNA, 19 nt, Staphylococcus aureus subsp. aureus N315
auagagaaagaauaaaugu

SEQ ID NO: 2140808 - RNA, 14 nt, Staphylococcus aureus subsp. aureus N315
auacuuuuuauaua

SEQ ID NO: 2140809 - RNA, 22 nt, Staphylococcus aureus subsp. aureus N315
auacuuuuggucuguugaaguc

SEQ ID NO: 2140810 - RNA, 14 nt, Staphylococcus aureus subsp. aureus N315
auacuuuucucgau

SEQ ID NO: 2140811 - RNA, 20 nt, Staphylococcus aureus subsp. aureus N315
auagaaaagggacagaaaag

SEQ ID NO: 2140812 - RNA, 20 nt, Staphylococcus aureus subsp. aureus N315
auagaaaaugaguacaacau

SEQ ID NO: 2140813 - RNA, 15 nt, Staphylococcus aureus subsp. aureus N315
auagauaucauuuua

SEQ ID NO: 2140814 - RNA, 22 nt, Staphylococcus aureus subsp. aureus N315
auagaugacuguagaaaacaug

SEQ ID NO: 2140815 - RNA, 22 nt, Staphylococcus aureus subsp. aureus N315
auagauagacuuucuugaugaa

SEQ ID NO: 2140816 - RNA, 14 nt, Staphylococcus aureus subsp. aureus N315
auagauaaugcacc

SEQ ID NO: 2140817 - RNA, 15 nt, Staphylococcus aureus subsp. aureus N315
auagaugugucuuuu

SEQ ID NO: 2140818 - RNA, 14 nt, Staphylococcus aureus subsp. aureus N315
auagauuaaaaaau

SEQ ID NO: 2140819 - RNA, 15 nt, Staphylococcus aureus subsp. aureus N315
auagauuaaaaaauc

SEQ ID NO: 2140820 - RNA, 18 nt, Staphylococcus aureus subsp. aureus N315
auagauuaaaaaaucauu

SEQ ID NO: 2140821 - RNA, 19 nt, Staphylococcus aureus subsp. aureus N315
auagauuaaaaaaucauuc

SEQ ID NO: 2140822 - RNA, 17 nt, Staphylococcus aureus subsp. aureus N315
auagaugcauaaaaacc

SEQ ID NO: 2140823 - RNA, 14 nt, Staphylococcus aureus subsp. aureus N315
auagaugcauaaaa

SEQ ID NO: 2140824 - RNA, 16 nt, Staphylococcus aureus subsp. aureus N315
auagaugcauaaaaac

SEQ ID NO: 2140825 - RNA, 13 nt, Staphylococcus aureus subsp. aureus N315
auagaucuuugua

SEQ ID NO: 2140826 - RNA, 18 nt, Staphylococcus aureus subsp. aureus N315
auagaugcuucaaaaauu

SEQ ID NO: 2140827 - RNA, 22 nt, Staphylococcus aureus subsp. aureus N315
auagcauuucuuuauuagaaug

SEQ ID NO: 2140828 - RNA, 14 nt, Staphylococcus aureus subsp. aureus N315
auagccuucauuug

SEQ ID NO: 2140829 - RNA, 14 nt, Staphylococcus aureus subsp. aureus N315
auagcgguuuaaaa

SEQ ID NO: 2140830 - RNA, 14 nt, Staphylococcus aureus subsp. aureus N315
auagcgguguuuug

SEQ ID NO: 2140831 - RNA, 15 nt, Staphylococcus aureus subsp. aureus N315
auagcuaaacauuuu

SEQ ID NO: 2140832 - RNA, 22 nt, Staphylococcus aureus subsp. aureus N315
auagcauaaaauuucugcuucu

SEQ ID NO: 2140833 - RNA, 19 nt, Staphylococcus aureus subsp. aureus N315
auagcauaaaauuucugcu

SEQ ID NO: 2140834 - RNA, 13 nt, Staphylococcus aureus subsp. aureus N315
auagcauuucuuu

SEQ ID NO: 2140835 - RNA, 18 nt, Staphylococcus aureus subsp. aureus N315
auagcaaccauauuuuua

SEQ ID NO: 2140836 - RNA, 21 nt, Staphylococcus aureus subsp. aureus N315
auagcaaccauauuuuuagaa

SEQ ID NO: 2140837 - RNA, 20 nt, Staphylococcus aureus subsp. aureus N315
auacgcgcuucaucaaugga

SEQ ID NO: 2140838 - RNA, 15 nt, Staphylococcus aureus subsp. aureus N315
auacuaguucaacuc

SEQ ID NO: 2140839 - RNA, 21 nt, Staphylococcus aureus subsp. aureus N315
auacuauuccguuucauugau

SEQ ID NO: 2140840 - RNA, 16 nt, Staphylococcus aureus subsp. aureus N315
auacucuaacuuacca

SEQ ID NO: 2140841 - RNA, 18 nt, Staphylococcus aureus subsp. aureus N315
auacucugggcauuuuga

SEQ ID NO: 2140842 - RNA, 19 nt, Staphylococcus aureus subsp. aureus N315
auacugccauauguuuuag

SEQ ID NO: 2140843 - RNA, 17 nt, Staphylococcus aureus subsp. aureus N315
auacuuacugaaacuaa

SEQ ID NO: 2140844 - RNA, 20 nt, Staphylococcus aureus subsp. aureus N315
auacuucaaacguuauguac

SEQ ID NO: 2140845 - RNA, 21 nt, Staphylococcus aureus subsp. aureus N315
auacuugaagcaucgauuuau

SEQ ID NO: 2140846 - RNA, 15 nt, Staphylococcus aureus subsp. aureus N315
auacuugaagaaaag

SEQ ID NO: 2140847 - RNA, 15 nt, Staphylococcus aureus subsp. aureus N315
auacuugaagaauca

SEQ ID NO: 2140848 - RNA, 23 nt, Staphylococcus aureus subsp. aureus N315
auacuugaagcaucgauuuauua

SEQ ID NO: 2140849 - RNA, 16 nt, Staphylococcus aureus subsp. aureus N315
auacuugaugaaacug

SEQ ID NO: 2140850 - RNA, 15 nt, Staphylococcus aureus subsp. aureus N315
auaccugcauauuca

SEQ ID NO: 2140851 - RNA, 16 nt, Staphylococcus aureus subsp. aureus N315
auaccucuacauuaua

SEQ ID NO: 2140852 - RNA, 15 nt, Staphylococcus aureus subsp. aureus N315
auaccuauuccuauu

SEQ ID NO: 2140853 - RNA, 20 nt, Staphylococcus aureus subsp. aureus N315
auaccucauccgccaauuaa

SEQ ID NO: 2140854 - RNA, 15 nt, Staphylococcus aureus subsp. aureus N315
auacaggaaauugaa

SEQ ID NO: 2140855 - RNA, 22 nt, Staphylococcus aureus subsp. aureus N315
auacaggcugauuuuuuauuca

SEQ ID NO: 2140856 - RNA, 15 nt, Staphylococcus aureus subsp. aureus N315
auacgaguguuuuaa

SEQ ID NO: 2140857 - RNA, 20 nt, Staphylococcus aureus subsp. aureus N315
auacgacauuuuuagacauu

SEQ ID NO: 2140858 - RNA, 14 nt, Staphylococcus aureus subsp. aureus N315
auacgaauuaaaau

SEQ ID NO: 2140859 - RNA, 21 nt, Staphylococcus aureus subsp. aureus N315
auaccuuuuaauuuaguuaua

SEQ ID NO: 2140860 - RNA, 14 nt, Staphylococcus aureus subsp. aureus N315
auaccuuuuucuaa

SEQ ID NO: 2140861 - RNA, 16 nt, Staphylococcus aureus subsp. aureus N315
auaccuuuuucuacca

SEQ ID NO: 2140862 - RNA, 12 nt, Staphylococcus aureus subsp. aureus N315
auaccuuuaaua

SEQ ID NO: 2140863 - RNA, 14 nt, Staphylococcus aureus subsp. aureus N315
auaccuuuaauauc

SEQ ID NO: 2140864 - RNA, 18 nt, Staphylococcus aureus subsp. aureus N315
auaccuuuaauuguuaaa

SEQ ID NO: 2140865 - RNA, 19 nt, Staphylococcus aureus subsp. aureus N315
auaccuuuacuuucauuac

SEQ ID NO: 2140866 - RNA, 19 nt, Staphylococcus aureus subsp. aureus N315
auaccuuugccguauuuca

SEQ ID NO: 2140867 - RNA, 17 nt, Staphylococcus aureus subsp. aureus N315
auaccuugauuauaugc

SEQ ID NO: 2140868 - RNA, 18 nt, Staphylococcus aureus subsp. aureus N315
auacgccuaaauauuuac

SEQ ID NO: 2140869 - RNA, 14 nt, Staphylococcus aureus subsp. aureus N315
auacgccuaaauau

SEQ ID NO: 2140870 - RNA, 14 nt, Staphylococcus aureus subsp. aureus N315
aucgaauucauuug

SEQ ID NO: 2140871 - RNA, 14 nt, Staphylococcus aureus subsp. aureus N315
aucgaauuuucaaa

SEQ ID NO: 2140872 - RNA, 22 nt, Staphylococcus aureus subsp. aureus N315
aucgaauuuucaaagacguaca

SEQ ID NO: 2140873 - RNA, 23 nt, Staphylococcus aureus subsp. aureus N315
aucgacuaauuuuucuuucaggc

SEQ ID NO: 2140874 - RNA, 16 nt, Staphylococcus aureus subsp. aureus N315
aucgauacuaauaucu

SEQ ID NO: 2140875 - RNA, 13 nt, Staphylococcus aureus subsp. aureus N315
aucgauacuuuuu

SEQ ID NO: 2140876 - RNA, 20 nt, Staphylococcus aureus subsp. aureus N315
aucgaguuugaaauaaucua

SEQ ID NO: 2140877 - RNA, 18 nt, Staphylococcus aureus subsp. aureus N315
aucgauauagcauaaaau

SEQ ID NO: 2140878 - RNA, 19 nt, Staphylococcus aureus subsp. aureus N315
aucgauauugagaauauua

SEQ ID NO: 2140879 - RNA, 16 nt, Staphylococcus aureus subsp. aureus N315
aucgcauuuaaauaua

SEQ ID NO: 2140880 - RNA, 17 nt, Staphylococcus aureus subsp. aureus N315
auccugccaauauauuc

SEQ ID NO: 2140881 - RNA, 15 nt, Staphylococcus aureus subsp. aureus N315
auccuggaauauuaa

SEQ ID NO: 2140882 - RNA, 14 nt, Staphylococcus aureus subsp. aureus N315
aucgaacuagacaa

SEQ ID NO: 2140883 - RNA, 23 nt, Staphylococcus aureus subsp. aureus N315
aucgaacuaguacgaaaugcaau

SEQ ID NO: 2140884 - RNA, 21 nt, Staphylococcus aureus subsp. aureus N315
auccuuuaaugcuuuagcauu

SEQ ID NO: 2140885 - RNA, 18 nt, Staphylococcus aureus subsp. aureus N315
aucgaacaaaugaaaaag

SEQ ID NO: 2140886 - RNA, 17 nt, Staphylococcus aureus subsp. aureus N315
auccuugcuaucaaacu

SEQ ID NO: 2140887 - RNA, 14 nt, Staphylococcus aureus subsp. aureus N315
aucguauagauuaa

SEQ ID NO: 2140888 - RNA, 19 nt, Staphylococcus aureus subsp. aureus N315
aucguaaacacuauaaaag

SEQ ID NO: 2140889 - RNA, 15 nt, Staphylococcus aureus subsp. aureus N315
aucguaaaaaacaaa

SEQ ID NO: 2140890 - RNA, 17 nt, Staphylococcus aureus subsp. aureus N315
aucggaauaaaauaaau

SEQ ID NO: 2140891 - RNA, 15 nt, Staphylococcus aureus subsp. aureus N315
aucggaauaaaauaa

SEQ ID NO: 2140892 - RNA, 16 nt, Staphylococcus aureus subsp. aureus N315
aucccucuaucaaauu

SEQ ID NO: 2140893 - RNA, 12 nt, Staphylococcus aureus subsp. aureus N315
aucccuaaaaaa

SEQ ID NO: 2140894 - RNA, 21 nt, Staphylococcus aureus subsp. aureus N315
auccgaauucuccguuaauuu

SEQ ID NO: 2140895 - RNA, 22 nt, Staphylococcus aureus subsp. aureus N315
auccgauuuugauauaaaaagu

SEQ ID NO: 2140896 - RNA, 23 nt, Staphylococcus aureus subsp. aureus N315
aucccccgccacuaugugaagug

SEQ ID NO: 2140897 - RNA, 18 nt, Staphylococcus aureus subsp. aureus N315
aucccaucgcuuuuucca

SEQ ID NO: 2140898 - RNA, 14 nt, Staphylococcus aureus subsp. aureus N315
auccccauuuaugu

SEQ ID NO: 2140899 - RNA, 15 nt, Staphylococcus aureus subsp. aureus N315
auccauugaucuuuu

SEQ ID NO: 2140900 - RNA, 21 nt, Staphylococcus aureus subsp. aureus N315
auccauucuaacgguaaauaa

SEQ ID NO: 2140901 - RNA, 23 nt, Staphylococcus aureus subsp. aureus N315
auccacuuuauaauuuuugagua

SEQ ID NO: 2140902 - RNA, 20 nt, Staphylococcus aureus subsp. aureus N315
auccacuuuauaauuuuuga

SEQ ID NO: 2140903 - RNA, 22 nt, Staphylococcus aureus subsp. aureus N315
aucauuuguguuuuuaauguuu

SEQ ID NO: 2140904 - RNA, 18 nt, Staphylococcus aureus subsp. aureus N315
aucauuuguguuuuuaau

SEQ ID NO: 2140905 - RNA, 18 nt, Staphylococcus aureus subsp. aureus N315
aucauuuuuaauuuugac

SEQ ID NO: 2140906 - RNA, 21 nt, Staphylococcus aureus subsp. aureus N315
auccaaggauguuauaaaaug

SEQ ID NO: 2140907 - RNA, 24 nt, Staphylococcus aureus subsp. aureus N315
auccaagcgcuucaggcauaacug

SEQ ID NO: 2140908 - RNA, 20 nt, Staphylococcus aureus subsp. aureus N315
auccaagugacaacauuauu

SEQ ID NO: 2140909 - RNA, 14 nt, Staphylococcus aureus subsp. aureus N315
auccaccaaauaca

SEQ ID NO: 2140910 - RNA, 14 nt, Staphylococcus aureus subsp. aureus N315
aaaacuaaucaaau

SEQ ID NO: 2140911 - RNA, 16 nt, Staphylococcus aureus subsp. aureus N315
aaaacuacauuugguu

SEQ ID NO: 2140912 - RNA, 19 nt, Staphylococcus aureus subsp. aureus N315
aucauguucuuauaaaaaa

SEQ ID NO: 2140913 - RNA, 22 nt, Staphylococcus aureus subsp. aureus N315
aucauuaaauugcuugaaauua

SEQ ID NO: 2140914 - RNA, 12 nt, Staphylococcus aureus subsp. aureus N315
aucauuaaaauc

SEQ ID NO: 2140915 - RNA, 11 nt, Staphylococcus aureus subsp. aureus N315
aucauuaaaau

SEQ ID NO: 2140916 - RNA, 22 nt, Staphylococcus aureus subsp. aureus N315
aucauguucuuauaaaaaacaa

SEQ ID NO: 2140917 - RNA, 22 nt, Staphylococcus aureus subsp. aureus N315
aaaacuuguaaucauaccagca

SEQ ID NO: 2140918 - RNA, 23 nt, Staphylococcus aureus subsp. aureus N315
aaaacuuccugcuuuuuuuauaa

SEQ ID NO: 2140919 - RNA, 22 nt, Staphylococcus aureus subsp. aureus N315
aucauuguguccauaaauauua

SEQ ID NO: 2140920 - RNA, 13 nt, Staphylococcus aureus subsp. aureus N315
aucauuguggcuu

SEQ ID NO: 2140921 - RNA, 14 nt, Staphylococcus aureus subsp. aureus N315
aucauuuaaaauuu

SEQ ID NO: 2140922 - RNA, 16 nt, Staphylococcus aureus subsp. aureus N315
aucauucauuugcaaa

SEQ ID NO: 2140923 - RNA, 22 nt, Staphylococcus aureus subsp. aureus N315
aucauucaaguguaguaaaaau

SEQ ID NO: 2140924 - RNA, 18 nt, Staphylococcus aureus subsp. aureus N315
aucauuucagaaauacau

SEQ ID NO: 2140925 - RNA, 18 nt, Staphylococcus aureus subsp. aureus N315
aucauuuggcguucaaca

SEQ ID NO: 2140926 - RNA, 14 nt, Staphylococcus aureus subsp. aureus N315
aucauuucaaauaa

SEQ ID NO: 2140927 - RNA, 16 nt, Staphylococcus aureus subsp. aureus N315
aucauuaguuuuuaaa

SEQ ID NO: 2140928 - RNA, 14 nt, Staphylococcus aureus subsp. aureus N315
aucauuaucaaaua

SEQ ID NO: 2140929 - RNA, 15 nt, Staphylococcus aureus subsp. aureus N315
aucauuauaaaaugg

SEQ ID NO: 2140930 - RNA, 19 nt, Staphylococcus aureus subsp. aureus N315
aucauuauuugauaaauaa

SEQ ID NO: 2140931 - RNA, 16 nt, Staphylococcus aureus subsp. aureus N315
aucuguagaaacacuu

SEQ ID NO: 2140932 - RNA, 22 nt, Staphylococcus aureus subsp. aureus N315
aucuguuuuagguuuguugcuu

SEQ ID NO: 2140933 - RNA, 14 nt, Staphylococcus aureus subsp. aureus N315
aucuguuucuuguu

SEQ ID NO: 2140934 - RNA, 17 nt, Staphylococcus aureus subsp. aureus N315
aucuguuucuauuauua

SEQ ID NO: 2140935 - RNA, 20 nt, Staphylococcus aureus subsp. aureus N315
aucuuaaagauuuuucagcu

SEQ ID NO: 2140936 - RNA, 22 nt, Staphylococcus aureus subsp. aureus N315
aucuuaaauuacuuaauaguaa

SEQ ID NO: 2140937 - RNA, 18 nt, Staphylococcus aureus subsp. aureus N315
aucugacauuucaucaau

SEQ ID NO: 2140938 - RNA, 14 nt, Staphylococcus aureus subsp. aureus N315
aucugacauuuaaa

SEQ ID NO: 2140939 - RNA, 18 nt, Staphylococcus aureus subsp. aureus N315
aucugaagguaauuuaac

SEQ ID NO: 2140940 - RNA, 22 nt, Staphylococcus aureus subsp. aureus N315
aucuuaugauacuuugaaagaa

SEQ ID NO: 2140941 - RNA, 20 nt, Staphylococcus aureus subsp. aureus N315
aucuuaugacugcuuuuuau

SEQ ID NO: 2140942 - RNA, 20 nt, Staphylococcus aureus subsp. aureus N315
aucuuaugauacuuugaaag

SEQ ID NO: 2140943 - RNA, 13 nt, Staphylococcus aureus subsp. aureus N315
aucuuaucaagaa

SEQ ID NO: 2140944 - RNA, 20 nt, Staphylococcus aureus subsp. aureus N315
aucuuauaacaaaaauugcu

SEQ ID NO: 2140945 - RNA, 15 nt, Staphylococcus aureus subsp. aureus N315
aucuuacugcuuuuu

SEQ ID NO: 2140946 - RNA, 19 nt, Staphylococcus aureus subsp. aureus N315
aucuuacauugauaaaaua

SEQ ID NO: 2140947 - RNA, 16 nt, Staphylococcus aureus subsp. aureus N315
aucuuaccuuuauguu

SEQ ID NO: 2140948 - RNA, 15 nt, Staphylococcus aureus subsp. aureus N315
aucuuaaucuaaaaa

SEQ ID NO: 2140949 - RNA, 16 nt, Staphylococcus aureus subsp. aureus N315
aucuuaacaacuuuaa

SEQ ID NO: 2140950 - RNA, 21 nt, Staphylococcus aureus subsp. aureus N315
aucuuaaguacauaaaugcua

SEQ ID NO: 2140951 - RNA, 19 nt, Staphylococcus aureus subsp. aureus N315
aucuuaaucagcuauaaaa

SEQ ID NO: 2140952 - RNA, 22 nt, Staphylococcus aureus subsp. aureus N315
aucuuaauauugauuaaucuau

SEQ ID NO: 2140953 - RNA, 14 nt, Staphylococcus aureus subsp. aureus N315
aucuuaagucauca

SEQ ID NO: 2140954 - RNA, 22 nt, Staphylococcus aureus subsp. aureus N315
aucuuaaguacauaaaugcuaa

SEQ ID NO: 2140955 - RNA, 18 nt, Staphylococcus aureus subsp. aureus N315
aucuucaauauuuaaauu

SEQ ID NO: 2140956 - RNA, 16 nt, Staphylococcus aureus subsp. aureus N315
aucuucaauauuuaaa

SEQ ID NO: 2140957 - RNA, 15 nt, Staphylococcus aureus subsp. aureus N315
aucuauaaaaagaau

SEQ ID NO: 2140958 - RNA, 12 nt, Staphylococcus aureus subsp. aureus N315
aucuauaugcau

SEQ ID NO: 2140959 - RNA, 13 nt, Staphylococcus aureus subsp. aureus N315
aucuauaaauggc

SEQ ID NO: 2140960 - RNA, 19 nt, Staphylococcus aureus subsp. aureus N315
aucuauacaauuauggaua

SEQ ID NO: 2140961 - RNA, 21 nt, Staphylococcus aureus subsp. aureus N315
aucuauaacaaaaucucaaca

SEQ ID NO: 2140962 - RNA, 23 nt, Staphylococcus aureus subsp. aureus N315
aucuauaaaaagaauaugauauu

SEQ ID NO: 2140963 - RNA, 18 nt, Staphylococcus aureus subsp. aureus N315
aucuaucgguaauuuuug

SEQ ID NO: 2140964 - RNA, 20 nt, Staphylococcus aureus subsp. aureus N315
aucuaugcccgugaugggua

SEQ ID NO: 2140965 - RNA, 14 nt, Staphylococcus aureus subsp. aureus N315
aucuauauuuaauu

SEQ ID NO: 2140966 - RNA, 14 nt, Staphylococcus aureus subsp. aureus N315
aucucauaauaauu

SEQ ID NO: 2140967 - RNA, 20 nt, Staphylococcus aureus subsp. aureus N315
aucgucaauuuuaaugagua

SEQ ID NO: 2140968 - RNA, 14 nt, Staphylococcus aureus subsp. aureus N315
aucuacaauauuaa

SEQ ID NO: 2140969 - RNA, 18 nt, Staphylococcus aureus subsp. aureus N315
aucuacagagaaucaauu

SEQ ID NO: 2140970 - RNA, 13 nt, Staphylococcus aureus subsp. aureus N315
aucucauucuuua

SEQ ID NO: 2140971 - RNA, 22 nt, Staphylococcus aureus subsp. aureus N315
aucucauuuuuucgagaugaua

SEQ ID NO: 2140972 - RNA, 11 nt, Staphylococcus aureus subsp. aureus N315
aucucugaaaa

SEQ ID NO: 2140973 - RNA, 18 nt, Staphylococcus aureus subsp. aureus N315
aucucugcuuuaauauaa

SEQ ID NO: 2140974 - RNA, 19 nt, Staphylococcus aureus subsp. aureus N315
aucugaaaauaucacugaa

SEQ ID NO: 2140975 - RNA, 16 nt, Staphylococcus aureus subsp. aureus N315
aucucuuuucuauuca

SEQ ID NO: 2140976 - RNA, 18 nt, Staphylococcus aureus subsp. aureus N315
augaucagggaaaucauc

SEQ ID NO: 2140977 - RNA, 18 nt, Staphylococcus aureus subsp. aureus N315
augauauuaccuucaagu

SEQ ID NO: 2140978 - RNA, 20 nt, Staphylococcus aureus subsp. aureus N315
augauauuaggcuuaaauau

SEQ ID NO: 2140979 - RNA, 15 nt, Staphylococcus aureus subsp. aureus N315
augauauguucgcuu

SEQ ID NO: 2140980 - RNA, 23 nt, Staphylococcus aureus subsp. aureus N315
augauauugauuugauucauuac

SEQ ID NO: 2140981 - RNA, 20 nt, Staphylococcus aureus subsp. aureus N315
augauauugauuugauucau

SEQ ID NO: 2140982 - RNA, 18 nt, Staphylococcus aureus subsp. aureus N315
augauauuuaacaaaauu

SEQ ID NO: 2140983 - RNA, 22 nt, Staphylococcus aureus subsp. aureus N315
augauauugaaaguguaugcau

SEQ ID NO: 2140984 - RNA, 13 nt, Staphylococcus aureus subsp. aureus N315
augauauucaacu

SEQ ID NO: 2140985 - RNA, 14 nt, Staphylococcus aureus subsp. aureus N315
augauauucaacuu

SEQ ID NO: 2140986 - RNA, 19 nt, Staphylococcus aureus subsp. aureus N315
augauagcgugauuuuuca

SEQ ID NO: 2140987 - RNA, 19 nt, Staphylococcus aureus subsp. aureus N315
augauagcaaugaauuaau

SEQ ID NO: 2140988 - RNA, 20 nt, Staphylococcus aureus subsp. aureus N315
augauauacuugaagaaaag

SEQ ID NO: 2140989 - RNA, 13 nt, Staphylococcus aureus subsp. aureus N315
augauauauguaa

SEQ ID NO: 2140990 - RNA, 16 nt, Staphylococcus aureus subsp. aureus N315
augauauccaaagcuu

SEQ ID NO: 2140991 - RNA, 16 nt, Staphylococcus aureus subsp. aureus N315
augauagaauacuaaa

SEQ ID NO: 2140992 - RNA, 17 nt, Staphylococcus aureus subsp. aureus N315
augauacugauauuuag

SEQ ID NO: 2140993 - RNA, 20 nt, Staphylococcus aureus subsp. aureus N315
augauagccgcuucauugau

SEQ ID NO: 2140994 - RNA, 22 nt, Staphylococcus aureus subsp. aureus N315
augauacgcuuuuuaaaaaauu

SEQ ID NO: 2140995 - RNA, 16 nt, Staphylococcus aureus subsp. aureus N315
augauacucaauaaaa

SEQ ID NO: 2140996 - RNA, 17 nt, Staphylococcus aureus subsp. aureus N315
augauacucaauaaaau

SEQ ID NO: 2140997 - RNA, 19 nt, Staphylococcus aureus subsp. aureus N315
augauacgcuuuuuaaaaa

SEQ ID NO: 2140998 - RNA, 18 nt, Staphylococcus aureus subsp. aureus N315
augauacgccuaaauauu

SEQ ID NO: 2140999 - RNA, 20 nt, Staphylococcus aureus subsp. aureus N315
augauacauuauuaaauaga

SEQ ID NO: 2141000 - RNA, 18 nt, Staphylococcus aureus subsp. aureus N315
augauaauuaauuaaaau

SEQ ID NO: 2141001 - RNA, 16 nt, Staphylococcus aureus subsp. aureus N315
augauaauuaauuaaa

SEQ ID NO: 2141002 - RNA, 16 nt, Staphylococcus aureus subsp. aureus N315
augauaauaagaauau

SEQ ID NO: 2141003 - RNA, 20 nt, Staphylococcus aureus subsp. aureus N315
augaguuguucagauuugua

SEQ ID NO: 2141004 - RNA, 19 nt, Staphylococcus aureus subsp. aureus N315
augauaaccauuaugauua

SEQ ID NO: 2141005 - RNA, 20 nt, Staphylococcus aureus subsp. aureus N315
augauaaccaaucaucgcaa

SEQ ID NO: 2141006 - RNA, 18 nt, Staphylococcus aureus subsp. aureus N315
augaguuuacuaaacuuu

SEQ ID NO: 2141007 - RNA, 14 nt, Staphylococcus aureus subsp. aureus N315
augaguuuaaaaau

SEQ ID NO: 2141008 - RNA, 15 nt, Staphylococcus aureus subsp. aureus N315
augaguuuaaaaaua

SEQ ID NO: 2141009 - RNA, 17 nt, Staphylococcus aureus subsp. aureus N315
augaguuucucaucuac

SEQ ID NO: 2141010 - RNA, 15 nt, Staphylococcus aureus subsp. aureus N315
augagcgcauaaauu

SEQ ID NO: 2141011 - RNA, 13 nt, Staphylococcus aureus subsp. aureus N315
augacaucaauau

SEQ ID NO: 2141012 - RNA, 14 nt, Staphylococcus aureus subsp. aureus N315
augacaucaauauc

SEQ ID NO: 2141013 - RNA, 15 nt, Staphylococcus aureus subsp. aureus N315
augacaguaaucaaa

SEQ ID NO: 2141014 - RNA, 21 nt, Staphylococcus aureus subsp. aureus N315
augacgugcuuuuaaauguau

SEQ ID NO: 2141015 - RNA, 18 nt, Staphylococcus aureus subsp. aureus N315
augacauuuaauacuuuu

SEQ ID NO: 2141016 - RNA, 23 nt, Staphylococcus aureus subsp. aureus N315
augacugagaaaaauauuucuaa

SEQ ID NO: 2141017 - RNA, 14 nt, Staphylococcus aureus subsp. aureus N315
augacuauuuucca

SEQ ID NO: 2141018 - RNA, 19 nt, Staphylococcus aureus subsp. aureus N315
augacuacaacuuaagagu

SEQ ID NO: 2141019 - RNA, 19 nt, Staphylococcus aureus subsp. aureus N315
augacuuauuuuucaucau

SEQ ID NO: 2141020 - RNA, 20 nt, Staphylococcus aureus subsp. aureus N315
augacuuauuuuucaucauu

SEQ ID NO: 2141021 - RNA, 18 nt, Staphylococcus aureus subsp. aureus N315
augacuuauuuuucauca

SEQ ID NO: 2141022 - RNA, 15 nt, Staphylococcus aureus subsp. aureus N315
augacuuauuuuuca

SEQ ID NO: 2141023 - RNA, 14 nt, Staphylococcus aureus subsp. aureus N315
augacugcaaauac

SEQ ID NO: 2141024 - RNA, 21 nt, Staphylococcus aureus subsp. aureus N315
augacuguugguuugaucauu

SEQ ID NO: 2141025 - RNA, 22 nt, Staphylococcus aureus subsp. aureus N315
augacuguugguuugaucauuu

SEQ ID NO: 2141026 - RNA, 13 nt, Staphylococcus aureus subsp. aureus N315
augacuguagaaa

SEQ ID NO: 2141027 - RNA, 19 nt, Staphylococcus aureus subsp. aureus N315
augaauuuagcaucaaaaa

SEQ ID NO: 2141028 - RNA, 22 nt, Staphylococcus aureus subsp. aureus N315
augaauuuagaugcauaaaaaa

SEQ ID NO: 2141029 - RNA, 18 nt, Staphylococcus aureus subsp. aureus N315
augaauuguuguacaugu

SEQ ID NO: 2141030 - RNA, 15 nt, Staphylococcus aureus subsp. aureus N315
augaauuguuaguuu

SEQ ID NO: 2141031 - RNA, 20 nt, Staphylococcus aureus subsp. aureus N315
augaauugucuuaauaugca

SEQ ID NO: 2141032 - RNA, 19 nt, Staphylococcus aureus subsp. aureus N315
augaauuucuaauuuagua

SEQ ID NO: 2141033 - RNA, 15 nt, Staphylococcus aureus subsp. aureus N315
augaauuuuuauuuu

SEQ ID NO: 2141034 - RNA, 15 nt, Staphylococcus aureus subsp. aureus N315
augaaguuuuuagca

SEQ ID NO: 2141035 - RNA, 19 nt, Staphylococcus aureus subsp. aureus N315
augaaucccauaaugacua

SEQ ID NO: 2141036 - RNA, 18 nt, Staphylococcus aureus subsp. aureus N315
augaaucgauauaaugaa

SEQ ID NO: 2141037 - RNA, 17 nt, Staphylococcus aureus subsp. aureus N315
augaaucgcauuuaaau

SEQ ID NO: 2141038 - RNA, 21 nt, Staphylococcus aureus subsp. aureus N315
augaaucgcauuuaaauauaa

SEQ ID NO: 2141039 - RNA, 18 nt, Staphylococcus aureus subsp. aureus N315
augaaucuagaauauaac

SEQ ID NO: 2141040 - RNA, 21 nt, Staphylococcus aureus subsp. aureus N315
augaaccagcuaaccaaauaa

SEQ ID NO: 2141041 - RNA, 23 nt, Staphylococcus aureus subsp. aureus N315
augaaccauuuaacucaccuuua

SEQ ID NO: 2141042 - RNA, 14 nt, Staphylococcus aureus subsp. aureus N315
augaacauaccugc

SEQ ID NO: 2141043 - RNA, 18 nt, Staphylococcus aureus subsp. aureus N315
augaaauuucaguaucau

SEQ ID NO: 2141044 - RNA, 16 nt, Staphylococcus aureus subsp. aureus N315
augaaauuguguugaa

SEQ ID NO: 2141045 - RNA, 21 nt, Staphylococcus aureus subsp. aureus N315
augaaauuguguugaaucaac

SEQ ID NO: 2141046 - RNA, 22 nt, Staphylococcus aureus subsp. aureus N315
augaaaauaccucuacauuaua

SEQ ID NO: 2141047 - RNA, 23 nt, Staphylococcus aureus subsp. aureus N315
augaaaauaccucuacauuauau

SEQ ID NO: 2141048 - RNA, 22 nt, Staphylococcus aureus subsp. aureus N315
augaaaguaccuaaaauagaaa

SEQ ID NO: 2141049 - RNA, 20 nt, Staphylococcus aureus subsp. aureus N315
augaaaguaccuaaaauaga

SEQ ID NO: 2141050 - RNA, 16 nt, Staphylococcus aureus subsp. aureus N315
augaaaguaccuaaaa

SEQ ID NO: 2141051 - RNA, 22 nt, Staphylococcus aureus subsp. aureus N315
augaaauaacaauagugacuuu

SEQ ID NO: 2141052 - RNA, 11 nt, Staphylococcus aureus subsp. aureus N315
augaaaugaag

SEQ ID NO: 2141053 - RNA, 22 nt, Staphylococcus aureus subsp. aureus N315
augaaaugucugccaaaccuuu

SEQ ID NO: 2141054 - RNA, 18 nt, Staphylococcus aureus subsp. aureus N315
augaaaacuuaaaaauga

SEQ ID NO: 2141055 - RNA, 16 nt, Staphylococcus aureus subsp. aureus N315
augaaaacagguggaa

SEQ ID NO: 2141056 - RNA, 23 nt, Staphylococcus aureus subsp. aureus N315
augaaaaagauucggaaaauaug

SEQ ID NO: 2141057 - RNA, 23 nt, Staphylococcus aureus subsp. aureus N315
aucuuuuccauucauaaaagcaa

SEQ ID NO: 2141058 - RNA, 18 nt, Staphylococcus aureus subsp. aureus N315
aucuuuuacuaaaugaau

SEQ ID NO: 2141059 - RNA, 11 nt, Staphylococcus aureus subsp. aureus N315
aucuuuuacua

SEQ ID NO: 2141060 - RNA, 14 nt, Staphylococcus aureus subsp. aureus N315
aucuuuuaaauuua

SEQ ID NO: 2141061 - RNA, 14 nt, Staphylococcus aureus subsp. aureus N315
aucuuuuaauucuu

SEQ ID NO: 2141062 - RNA, 17 nt, Staphylococcus aureus subsp. aureus N315
aucuuuuaauucuuaau

SEQ ID NO: 2141063 - RNA, 11 nt, Staphylococcus aureus subsp. aureus N315
aucuuuuaugg

SEQ ID NO: 2141064 - RNA, 18 nt, Staphylococcus aureus subsp. aureus N315
aucuuuuccauucauaaa

SEQ ID NO: 2141065 - RNA, 21 nt, Staphylococcus aureus subsp. aureus N315
aucuuuuauccaauguauaaa

SEQ ID NO: 2141066 - RNA, 13 nt, Staphylococcus aureus subsp. aureus N315
aucuuucacaauu

SEQ ID NO: 2141067 - RNA, 17 nt, Staphylococcus aureus subsp. aureus N315
aucuuucacaauuguau

SEQ ID NO: 2141068 - RNA, 11 nt, Staphylococcus aureus subsp. aureus N315
aucuuucaaag

SEQ ID NO: 2141069 - RNA, 21 nt, Staphylococcus aureus subsp. aureus N315
aucuuuaucauuauucgcauc

SEQ ID NO: 2141070 - RNA, 22 nt, Staphylococcus aureus subsp. aureus N315
aucuuuguaaccuaaaaacaaa

SEQ ID NO: 2141071 - RNA, 23 nt, Staphylococcus aureus subsp. aureus N315
aucuuuguaugcaucaguuaaua

SEQ ID NO: 2141072 - RNA, 18 nt, Staphylococcus aureus subsp. aureus N315
aucuuuccacggcauuua

SEQ ID NO: 2141073 - RNA, 16 nt, Staphylococcus aureus subsp. aureus N315
aucuucgacuacaagu

SEQ ID NO: 2141074 - RNA, 21 nt, Staphylococcus aureus subsp. aureus N315
aguucaccguaaucuuuuaac

SEQ ID NO: 2141075 - RNA, 18 nt, Staphylococcus aureus subsp. aureus N315
aguuagaagaugauuauu

SEQ ID NO: 2141076 - RNA, 17 nt, Staphylococcus aureus subsp. aureus N315
aguuaugacuaacgaaa

SEQ ID NO: 2141077 - RNA, 13 nt, Staphylococcus aureus subsp. aureus N315
aguuauuaagcca

SEQ ID NO: 2141078 - RNA, 12 nt, Staphylococcus aureus subsp. aureus N315
aguuauuaaauc

SEQ ID NO: 2141079 - RNA, 21 nt, Staphylococcus aureus subsp. aureus N315
aguuaugaugggaaaaaaugg

SEQ ID NO: 2141080 - RNA, 15 nt, Staphylococcus aureus subsp. aureus N315
aguuauauuuuuagg

SEQ ID NO: 2141081 - RNA, 17 nt, Staphylococcus aureus subsp. aureus N315
aguuaauugaaugaaaa

SEQ ID NO: 2141082 - RNA, 15 nt, Staphylococcus aureus subsp. aureus N315
aguuacaguguaauc

SEQ ID NO: 2141083 - RNA, 15 nt, Staphylococcus aureus subsp. aureus N315
aguuacuuacgccaa

SEQ ID NO: 2141084 - RNA, 23 nt, Staphylococcus aureus subsp. aureus N315
aguuacugcgcuuuuaauuuuuu

SEQ ID NO: 2141085 - RNA, 15 nt, Staphylococcus aureus subsp. aureus N315
aguuaauguaaaguu

SEQ ID NO: 2141086 - RNA, 14 nt, Staphylococcus aureus subsp. aureus N315
aguguauucauuuu

SEQ ID NO: 2141087 - RNA, 17 nt, Staphylococcus aureus subsp. aureus N315
aguguauucauuuuaaa

SEQ ID NO: 2141088 - RNA, 14 nt, Staphylococcus aureus subsp. aureus N315
agugucacaaagaa

SEQ ID NO: 2141089 - RNA, 16 nt, Staphylococcus aureus subsp. aureus N315
agugucacaaagaaau

SEQ ID NO: 2141090 - RNA, 15 nt, Staphylococcus aureus subsp. aureus N315
aguucuauauaauuu

SEQ ID NO: 2141091 - RNA, 21 nt, Staphylococcus aureus subsp. aureus N315
aguucuagauuauuuaaaaau

SEQ ID NO: 2141092 - RNA, 18 nt, Staphylococcus aureus subsp. aureus N315
aguucggaugagaaaugu

SEQ ID NO: 2141093 - RNA, 22 nt, Staphylococcus aureus subsp. aureus N315
aguucggaugagaaauguuaac

SEQ ID NO: 2141094 - RNA, 12 nt, Staphylococcus aureus subsp. aureus N315
aguugauaaugu

SEQ ID NO: 2141095 - RNA, 22 nt, Staphylococcus aureus subsp. aureus N315
aguugaucaaaaauguuaucua

SEQ ID NO: 2141096 - RNA, 22 nt, Staphylococcus aureus subsp. aureus N315
aguugauuuaagauuuaauaaa

SEQ ID NO: 2141097 - RNA, 21 nt, Staphylococcus aureus subsp. aureus N315
aguugcacauuauaaagcugc

SEQ ID NO: 2141098 - RNA, 14 nt, Staphylococcus aureus subsp. aureus N315
aguucuuagauuuu

SEQ ID NO: 2141099 - RNA, 22 nt, Staphylococcus aureus subsp. aureus N315
aguuucugacuuuuaaaaaaca

SEQ ID NO: 2141100 - RNA, 14 nt, Staphylococcus aureus subsp. aureus N315
aguuucguuuucaa

SEQ ID NO: 2141101 - RNA, 20 nt, Staphylococcus aureus subsp. aureus N315
aguuucggaaaaagaugaaa

SEQ ID NO: 2141102 - RNA, 18 nt, Staphylococcus aureus subsp. aureus N315
aguuucaucuucaacuuu

SEQ ID NO: 2141103 - RNA, 22 nt, Staphylococcus aureus subsp. aureus N315
aguuucaucaaguauaaauguu

SEQ ID NO: 2141104 - RNA, 20 nt, Staphylococcus aureus subsp. aureus N315
aguuuccauaaauaaaaugc

SEQ ID NO: 2141105 - RNA, 22 nt, Staphylococcus aureus subsp. aureus N315
aguuuccauaaauaaaaugcua

SEQ ID NO: 2141106 - RNA, 21 nt, Staphylococcus aureus subsp. aureus N315
aguuucaucaaguauaaaugu

SEQ ID NO: 2141107 - RNA, 14 nt, Staphylococcus aureus subsp. aureus N315
aguuugacaucuau

SEQ ID NO: 2141108 - RNA, 17 nt, Staphylococcus aureus subsp. aureus N315
aguuugaaggugauaau

SEQ ID NO: 2141109 - RNA, 19 nt, Staphylococcus aureus subsp. aureus N315
aguuugaaggugauaaugu

SEQ ID NO: 2141110 - RNA, 15 nt, Staphylococcus aureus subsp. aureus N315
aguuuuaaaugaaac

SEQ ID NO: 2141111 - RNA, 14 nt, Staphylococcus aureus subsp. aureus N315
aguuuuaaugaacu

SEQ ID NO: 2141112 - RNA, 18 nt, Staphylococcus aureus subsp. aureus N315
aguuuguuggucuuucuu

SEQ ID NO: 2141113 - RNA, 15 nt, Staphylococcus aureus subsp. aureus N315
aguuuguuucuaaau

SEQ ID NO: 2141114 - RNA, 16 nt, Staphylococcus aureus subsp. aureus N315
aguuuguuuucuuucg

SEQ ID NO: 2141115 - RNA, 21 nt, Staphylococcus aureus subsp. aureus N315
aguuuaaucguauuagccaau

SEQ ID NO: 2141116 - RNA, 17 nt, Staphylococcus aureus subsp. aureus N315
aguuuaagucuaacuuu

SEQ ID NO: 2141117 - RNA, 20 nt, Staphylococcus aureus subsp. aureus N315
aguuuacgaucauaaauauu

SEQ ID NO: 2141118 - RNA, 21 nt, Staphylococcus aureus subsp. aureus N315
aguuguuucuccaguuuuugg

SEQ ID NO: 2141119 - RNA, 22 nt, Staphylococcus aureus subsp. aureus N315
aguuguuuuuuguuuucaaaug

SEQ ID NO: 2141120 - RNA, 19 nt, Staphylococcus aureus subsp. aureus N315
aguuucaaucgcauuuugu

SEQ ID NO: 2141121 - RNA, 13 nt, Staphylococcus aureus subsp. aureus N315
aguuuauuaauau

SEQ ID NO: 2141122 - RNA, 23 nt, Staphylococcus aureus subsp. aureus N315
aguuuagauucacuguauaaaua

SEQ ID NO: 2141123 - RNA, 19 nt, Staphylococcus aureus subsp. aureus N315
aguuguacuacuugauucu

SEQ ID NO: 2141124 - RNA, 15 nt, Staphylococcus aureus subsp. aureus N315
aguuguaucauuaau

SEQ ID NO: 2141125 - RNA, 22 nt, Staphylococcus aureus subsp. aureus N315
aguugcgaacucguuauagaua

SEQ ID NO: 2141126 - RNA, 18 nt, Staphylococcus aureus subsp. aureus N315
aguugucaucuaauuaca

SEQ ID NO: 2141127 - RNA, 15 nt, Staphylococcus aureus subsp. aureus N315
aguuguccauuuuau

SEQ ID NO: 2141128 - RNA, 23 nt, Staphylococcus aureus subsp. aureus N315
aguuguggucuaaccaucucaac

SEQ ID NO: 2141129 - RNA, 20 nt, Staphylococcus aureus subsp. aureus N315
aguugugguuguuaauguau

SEQ ID NO: 2141130 - RNA, 14 nt, Staphylococcus aureus subsp. aureus N315
aguuguugcuuugg

SEQ ID NO: 2141131 - RNA, 13 nt, Staphylococcus aureus subsp. aureus N315
aguuguugcaaau

SEQ ID NO: 2141132 - RNA, 15 nt, Staphylococcus aureus subsp. aureus N315
aguuguuaggggcuu

SEQ ID NO: 2141133 - RNA, 14 nt, Staphylococcus aureus subsp. aureus N315
aguuguuauauucu

SEQ ID NO: 2141134 - RNA, 23 nt, Staphylococcus aureus subsp. aureus N315
agugcgaauucaacgaaagugau

SEQ ID NO: 2141135 - RNA, 22 nt, Staphylococcus aureus subsp. aureus N315
agugccuugccaugauuuaagg

SEQ ID NO: 2141136 - RNA, 18 nt, Staphylococcus aureus subsp. aureus N315
agugcucuugcaauagca

SEQ ID NO: 2141137 - RNA, 20 nt, Staphylococcus aureus subsp. aureus N315
agugguaaaaaguuuaaagu

SEQ ID NO: 2141138 - RNA, 19 nt, Staphylococcus aureus subsp. aureus N315
agugcuuccacuucaucua

SEQ ID NO: 2141139 - RNA, 22 nt, Staphylococcus aureus subsp. aureus N315
agugcuuccacuucaucuaaau

SEQ ID NO: 2141140 - RNA, 15 nt, Staphylococcus aureus subsp. aureus N315
aguggcaaacauuuc

SEQ ID NO: 2141141 - RNA, 21 nt, Staphylococcus aureus subsp. aureus N315
agugcauuuuuuauuuuacuu

SEQ ID NO: 2141142 - RNA, 15 nt, Staphylococcus aureus subsp. aureus N315
agugaugaccaauau

SEQ ID NO: 2141143 - RNA, 14 nt, Staphylococcus aureus subsp. aureus N315
agugauuugccaaa

SEQ ID NO: 2141144 - RNA, 22 nt, Staphylococcus aureus subsp. aureus N315
agugaaucuaaacuauaauaau

SEQ ID NO: 2141145 - RNA, 20 nt, Staphylococcus aureus subsp. aureus N315
agugaauuaucuauauauga

SEQ ID NO: 2141146 - RNA, 13 nt, Staphylococcus aureus subsp. aureus N315
aguauuuucucua

SEQ ID NO: 2141147 - RNA, 23 nt, Staphylococcus aureus subsp. aureus N315
agucaaaaaaucgaacaaaugaa

SEQ ID NO: 2141148 - RNA, 16 nt, Staphylococcus aureus subsp. aureus N315
aguauuuuuuauguuc

SEQ ID NO: 2141149 - RNA, 22 nt, Staphylococcus aureus subsp. aureus N315
aguauuuuugcguuaauaauuu

SEQ ID NO: 2141150 - RNA, 22 nt, Staphylococcus aureus subsp. aureus N315
aguccgcguguacuuuaccauc

SEQ ID NO: 2141151 - RNA, 16 nt, Staphylococcus aureus subsp. aureus N315
agucaacaauugcuaa

SEQ ID NO: 2141152 - RNA, 15 nt, Staphylococcus aureus subsp. aureus N315
agucgauaaguuuuu

SEQ ID NO: 2141153 - RNA, 17 nt, Staphylococcus aureus subsp. aureus N315
agucggggccccaacac

SEQ ID NO: 2141154 - RNA, 17 nt, Staphylococcus aureus subsp. aureus N315
agucucuaaaacuuuuu

SEQ ID NO: 2141155 - RNA, 16 nt, Staphylococcus aureus subsp. aureus N315
agucgguguuuucuua

SEQ ID NO: 2141156 - RNA, 18 nt, Staphylococcus aureus subsp. aureus N315
agugaaaacuucucuauc

SEQ ID NO: 2141157 - RNA, 13 nt, Staphylococcus aureus subsp. aureus N315
agugaaaagaaca

SEQ ID NO: 2141158 - RNA, 19 nt, Staphylococcus aureus subsp. aureus N315
agugaaaaaguuucggaaa

SEQ ID NO: 2141159 - RNA, 14 nt, Staphylococcus aureus subsp. aureus N315
agugaaaagaacac

SEQ ID NO: 2141160 - RNA, 18 nt, Staphylococcus aureus subsp. aureus N315
agucuuuacucuacacuc

SEQ ID NO: 2141161 - RNA, 13 nt, Staphylococcus aureus subsp. aureus N315
agucuuuuuuaag

SEQ ID NO: 2141162 - RNA, 22 nt, Staphylococcus aureus subsp. aureus N315
agucuuuuuauuuuaauauuuu

SEQ ID NO: 2141163 - RNA, 22 nt, Staphylococcus aureus subsp. aureus N315
agucugcucuuuuuguaugagu

SEQ ID NO: 2141164 - RNA, 18 nt, Staphylococcus aureus subsp. aureus N315
auacaaaucguaaacaua

SEQ ID NO: 2141165 - RNA, 13 nt, Staphylococcus aureus subsp. aureus N315
auacaaauuuuuu

SEQ ID NO: 2141166 - RNA, 17 nt, Staphylococcus aureus subsp. aureus N315
auacaacaguaaucaug

SEQ ID NO: 2141167 - RNA, 15 nt, Staphylococcus aureus subsp. aureus N315
auacaaagaauuaug

SEQ ID NO: 2141168 - RNA, 13 nt, Staphylococcus aureus subsp. aureus N315
auacacaaauuuu

SEQ ID NO: 2141169 - RNA, 20 nt, Staphylococcus aureus subsp. aureus N315
auacaauuauggauaaaauu

SEQ ID NO: 2141170 - RNA, 21 nt, Staphylococcus aureus subsp. aureus N315
auacaaugaauuucuaauuua

SEQ ID NO: 2141171 - RNA, 15 nt, Staphylococcus aureus subsp. aureus N315
auacaauagaaauga

SEQ ID NO: 2141172 - RNA, 15 nt, Staphylococcus aureus subsp. aureus N315
auacaagucuuuacu

SEQ ID NO: 2141173 - RNA, 18 nt, Staphylococcus aureus subsp. aureus N315
auacagaaccaacaauaa

SEQ ID NO: 2141174 - RNA, 23 nt, Staphylococcus aureus subsp. aureus N315
auacacuuuuugacauauuuuuu

SEQ ID NO: 2141175 - RNA, 18 nt, Staphylococcus aureus subsp. aureus N315
auacacuugauaaaacua

SEQ ID NO: 2141176 - RNA, 22 nt, Staphylococcus aureus subsp. aureus N315
auacacugcacaucauaauaaa

SEQ ID NO: 2141177 - RNA, 16 nt, Staphylococcus aureus subsp. aureus N315
auacacuuacaaauau

SEQ ID NO: 2141178 - RNA, 15 nt, Staphylococcus aureus subsp. aureus N315
auacacuuacaaaua

SEQ ID NO: 2141179 - RNA, 23 nt, Staphylococcus aureus subsp. aureus N315
auacacuaucauuaucaaauaac

SEQ ID NO: 2141180 - RNA, 12 nt, Staphylococcus aureus subsp. aureus N315
auaauuuuaaaa

SEQ ID NO: 2141181 - RNA, 14 nt, Staphylococcus aureus subsp. aureus N315
auaauuuuaaaaau

SEQ ID NO: 2141182 - RNA, 15 nt, Staphylococcus aureus subsp. aureus N315
auaauuuuaaaaaua

SEQ ID NO: 2141183 - RNA, 16 nt, Staphylococcus aureus subsp. aureus N315
auaauuugugugcgau

SEQ ID NO: 2141184 - RNA, 18 nt, Staphylococcus aureus subsp. aureus N315
auaauuuuaauauuaugu

SEQ ID NO: 2141185 - RNA, 11 nt, Staphylococcus aureus subsp. aureus N315
auaauuuuaau

SEQ ID NO: 2141186 - RNA, 16 nt, Staphylococcus aureus subsp. aureus N315
auaauuuuaauauuau

SEQ ID NO: 2141187 - RNA, 20 nt, Staphylococcus aureus subsp. aureus N315
auaauuuuaucuaaagcuau

SEQ ID NO: 2141188 - RNA, 16 nt, Staphylococcus aureus subsp. aureus N315
auaauuuguaauuccu

SEQ ID NO: 2141189 - RNA, 19 nt, Staphylococcus aureus subsp. aureus N315
auaauuugguuaauacguu

SEQ ID NO: 2141190 - RNA, 12 nt, Staphylococcus aureus subsp. aureus N315
auaauuucucaa

SEQ ID NO: 2141191 - RNA, 19 nt, Staphylococcus aureus subsp. aureus N315
auacaaaacaccucgauau

SEQ ID NO: 2141192 - RNA, 19 nt, Staphylococcus aureus subsp. aureus N315
auacaaaacaaauccauua

SEQ ID NO: 2141193 - RNA, 19 nt, Staphylococcus aureus subsp. aureus N315
auacaaacccauauaaaug

SEQ ID NO: 2141194 - RNA, 20 nt, Staphylococcus aureus subsp. aureus N315
auaauuuucuguccaaaaag

SEQ ID NO: 2141195 - RNA, 19 nt, Staphylococcus aureus subsp. aureus N315
auaauuuucaauuagaaaa

SEQ ID NO: 2141196 - RNA, 22 nt, Staphylococcus aureus subsp. aureus N315
auaauuuuuauuuacacacaug

SEQ ID NO: 2141197 - RNA, 20 nt, Staphylococcus aureus subsp. aureus N315
auaauuuuccaucuauccga

SEQ ID NO: 2141198 - RNA, 18 nt, Staphylococcus aureus subsp. aureus N315
auaauuuuguucagauag

SEQ ID NO: 2141199 - RNA, 16 nt, Staphylococcus aureus subsp. aureus N315
auaauguauaaaacag

SEQ ID NO: 2141200 - RNA, 18 nt, Staphylococcus aureus subsp. aureus N315
auaauguacauguauaaa

SEQ ID NO: 2141201 - RNA, 13 nt, Staphylococcus aureus subsp. aureus N315
auaauguacacuu

SEQ ID NO: 2141202 - RNA, 15 nt, Staphylococcus aureus subsp. aureus N315
auaauguacauguau

SEQ ID NO: 2141203 - RNA, 16 nt, Staphylococcus aureus subsp. aureus N315
auaauguacauguaua

SEQ ID NO: 2141204 - RNA, 17 nt, Staphylococcus aureus subsp. aureus N315
auaaugguugaauaaca

SEQ ID NO: 2141205 - RNA, 17 nt, Staphylococcus aureus subsp. aureus N315
auaauuucaguucuuag

SEQ ID NO: 2141206 - RNA, 22 nt, Staphylococcus aureus subsp. aureus N315
auaauuuauuuagcaucuuuac

SEQ ID NO: 2141207 - RNA, 23 nt, Staphylococcus aureus subsp. aureus N315
auaauuuaaaggcauaauaacca

SEQ ID NO: 2141208 - RNA, 13 nt, Staphylococcus aureus subsp. aureus N315
auaauuuaaaaga

SEQ ID NO: 2141209 - RNA, 22 nt, Staphylococcus aureus subsp. aureus N315
auaauugcauagcuaaauaaau

SEQ ID NO: 2141210 - RNA, 18 nt, Staphylococcus aureus subsp. aureus N315
auaauugauaauggauua

SEQ ID NO: 2141211 - RNA, 15 nt, Staphylococcus aureus subsp. aureus N315
auaauugcauuacua

SEQ ID NO: 2141212 - RNA, 15 nt, Staphylococcus aureus subsp. aureus N315
auaauugcuaaaaua

SEQ ID NO: 2141213 - RNA, 13 nt, Staphylococcus aureus subsp. aureus N315
auaaucacauuaa

SEQ ID NO: 2141214 - RNA, 22 nt, Staphylococcus aureus subsp. aureus N315
auaauauauccugccaauauau

SEQ ID NO: 2141215 - RNA, 13 nt, Staphylococcus aureus subsp. aureus N315
auaauauacacaa

SEQ ID NO: 2141216 - RNA, 14 nt, Staphylococcus aureus subsp. aureus N315
auaauauacacaaa

SEQ ID NO: 2141217 - RNA, 17 nt, Staphylococcus aureus subsp. aureus N315
auaauauaaaaacaaaa

SEQ ID NO: 2141218 - RNA, 14 nt, Staphylococcus aureus subsp. aureus N315
auaauauaaauaaa

SEQ ID NO: 2141219 - RNA, 16 nt, Staphylococcus aureus subsp. aureus N315
auaaucgaacagaaaa

SEQ ID NO: 2141220 - RNA, 16 nt, Staphylococcus aureus subsp. aureus N315
auaaucgaacauaaau

SEQ ID NO: 2141221 - RNA, 19 nt, Staphylococcus aureus subsp. aureus N315
auaaucgaacauaaauaaa

SEQ ID NO: 2141222 - RNA, 19 nt, Staphylococcus aureus subsp. aureus N315
auaaucuuacugcuuuuuu

SEQ ID NO: 2141223 - RNA, 14 nt, Staphylococcus aureus subsp. aureus N315
auaaucuucaguau

SEQ ID NO: 2141224 - RNA, 16 nt, Staphylococcus aureus subsp. aureus N315
auaaucuuacugcuuu

SEQ ID NO: 2141225 - RNA, 12 nt, Staphylococcus aureus subsp. aureus N315
auaaucucuuua

SEQ ID NO: 2141226 - RNA, 16 nt, Staphylococcus aureus subsp. aureus N315
auaaucgagguaguac

SEQ ID NO: 2141227 - RNA, 13 nt, Staphylococcus aureus subsp. aureus N315
auaaugauugucu

SEQ ID NO: 2141228 - RNA, 14 nt, Staphylococcus aureus subsp. aureus N315
auaaugauaaauua

SEQ ID NO: 2141229 - RNA, 21 nt, Staphylococcus aureus subsp. aureus N315
auaaugaauucauucaauacg

SEQ ID NO: 2141230 - RNA, 19 nt, Staphylococcus aureus subsp. aureus N315
auaaugaauaauuaaaaaa

SEQ ID NO: 2141231 - RNA, 17 nt, Staphylococcus aureus subsp. aureus N315
auaaucuuuauuaauaa

SEQ ID NO: 2141232 - RNA, 17 nt, Staphylococcus aureus subsp. aureus N315
auaaucuuuuuuacuaa

SEQ ID NO: 2141233 - RNA, 19 nt, Staphylococcus aureus subsp. aureus N315
auaaucuuuuuuacuaaaa

SEQ ID NO: 2141234 - RNA, 15 nt, Staphylococcus aureus subsp. aureus N315
auaaugaauaauuaa

SEQ ID NO: 2141235 - RNA, 16 nt, Staphylococcus aureus subsp. aureus N315
auaaucuuuauuaaua

SEQ ID NO: 2141236 - RNA, 24 nt, Staphylococcus aureus subsp. aureus N315
auaagucugaugucgaaaauagcu

SEQ ID NO: 2141237 - RNA, 22 nt, Staphylococcus aureus subsp. aureus N315
auaagugauuucuucauuauca

SEQ ID NO: 2141238 - RNA, 20 nt, Staphylococcus aureus subsp. aureus N315
auaagaauuaacaacaaaua

SEQ ID NO: 2141239 - RNA, 15 nt, Staphylococcus aureus subsp. aureus N315
auaagaauuguugau

SEQ ID NO: 2141240 - RNA, 12 nt, Staphylococcus aureus subsp. aureus N315
auaagaauguga

SEQ ID NO: 2141241 - RNA, 17 nt, Staphylococcus aureus subsp. aureus N315
auaagaaucaucuaaau

SEQ ID NO: 2141242 - RNA, 15 nt, Staphylococcus aureus subsp. aureus N315
auaagaauuuaaaag

SEQ ID NO: 2141243 - RNA, 18 nt, Staphylococcus aureus subsp. aureus N315
auaagaauuuaaaagaga

SEQ ID NO: 2141244 - RNA, 13 nt, Staphylococcus aureus subsp. aureus N315
auaaguuaaaaau

SEQ ID NO: 2141245 - RNA, 13 nt, Staphylococcus aureus subsp. aureus N315
auaaguuaaaauu

SEQ ID NO: 2141246 - RNA, 17 nt, Staphylococcus aureus subsp. aureus N315
auaaguuacuagcauua

SEQ ID NO: 2141247 - RNA, 21 nt, Staphylococcus aureus subsp. aureus N315
auaaguucuagauuauuuaaa

SEQ ID NO: 2141248 - RNA, 17 nt, Staphylococcus aureus subsp. aureus N315
auaaguugcauauaaaa

SEQ ID NO: 2141249 - RNA, 15 nt, Staphylococcus aureus subsp. aureus N315
auaaguugaauauaa

SEQ ID NO: 2141250 - RNA, 21 nt, Staphylococcus aureus subsp. aureus N315
auaauaaguugaauauaaaaa

SEQ ID NO: 2141251 - RNA, 20 nt, Staphylococcus aureus subsp. aureus N315
auaauaauucauaaaugcuu

SEQ ID NO: 2141252 - RNA, 20 nt, Staphylococcus aureus subsp. aureus N315
auaauaagagguauagcaag

SEQ ID NO: 2141253 - RNA, 19 nt, Staphylococcus aureus subsp. aureus N315
auaauaccuucaauugaca

SEQ ID NO: 2141254 - RNA, 14 nt, Staphylococcus aureus subsp. aureus N315
auaauaccaauugc

SEQ ID NO: 2141255 - RNA, 18 nt, Staphylococcus aureus subsp. aureus N315
auaauaacuggcaaauca

SEQ ID NO: 2141256 - RNA, 14 nt, Staphylococcus aureus subsp. aureus N315
auaauaaauaggau

SEQ ID NO: 2141257 - RNA, 19 nt, Staphylococcus aureus subsp. aureus N315
auaaguuuuugaauaucua

SEQ ID NO: 2141258 - RNA, 14 nt, Staphylococcus aureus subsp. aureus N315
auaauaaaaaggag

SEQ ID NO: 2141259 - RNA, 20 nt, Staphylococcus aureus subsp. aureus N315
auaauaaaacuugugauaua

SEQ ID NO: 2141260 - RNA, 12 nt, Staphylococcus aureus subsp. aureus N315
auaauaaaauag

SEQ ID NO: 2141261 - RNA, 22 nt, Staphylococcus aureus subsp. aureus N315
auaaaauccuaagcaucguaaa

SEQ ID NO: 2141262 - RNA, 13 nt, Staphylococcus aureus subsp. aureus N315
auaaaauacauuu

SEQ ID NO: 2141263 - RNA, 12 nt, Staphylococcus aureus subsp. aureus N315
auaaaauauauu

SEQ ID NO: 2141264 - RNA, 20 nt, Staphylococcus aureus subsp. aureus N315
auaaaauauauuuaauuaca

SEQ ID NO: 2141265 - RNA, 20 nt, Staphylococcus aureus subsp. aureus N315
auaaaaucaucguauuucau

SEQ ID NO: 2141266 - RNA, 15 nt, Staphylococcus aureus subsp. aureus N315
aguuuuauuuauaaa

SEQ ID NO: 2141267 - RNA, 22 nt, Staphylococcus aureus subsp. aureus N315
aguuuuauuuauaaacaauaaa

SEQ ID NO: 2141268 - RNA, 12 nt, Staphylococcus aureus subsp. aureus N315
auaaaauaaaua

SEQ ID NO: 2141269 - RNA, 20 nt, Staphylococcus aureus subsp. aureus N315
auaaaauggugcgaauaaua

SEQ ID NO: 2141270 - RNA, 17 nt, Staphylococcus aureus subsp. aureus N315
auaaaauuagccuaauu

SEQ ID NO: 2141271 - RNA, 13 nt, Staphylococcus aureus subsp. aureus N315
auaaaaugcaauu

SEQ ID NO: 2141272 - RNA, 15 nt, Staphylococcus aureus subsp. aureus N315
auaaaauuuaaaaca

SEQ ID NO: 2141273 - RNA, 14 nt, Staphylococcus aureus subsp. aureus N315
auaaaauuucugcu

SEQ ID NO: 2141274 - RNA, 14 nt, Staphylococcus aureus subsp. aureus N315
auaaaauucaccaa

SEQ ID NO: 2141275 - RNA, 14 nt, Staphylococcus aureus subsp. aureus N315
auaaaccacgcaca

SEQ ID NO: 2141276 - RNA, 19 nt, Staphylococcus aureus subsp. aureus N315
auaaacaauaacuguucuu

SEQ ID NO: 2141277 - RNA, 22 nt, Staphylococcus aureus subsp. aureus N315
auaaaauuucugcuucuuuuaa

SEQ ID NO: 2141278 - RNA, 16 nt, Staphylococcus aureus subsp. aureus N315
auaaaauuuuuuucau

SEQ ID NO: 2141279 - RNA, 15 nt, Staphylococcus aureus subsp. aureus N315
auaaaauuuuuuuca

SEQ ID NO: 2141280 - RNA, 15 nt, Staphylococcus aureus subsp. aureus N315
auaaacaauaaaaaa

SEQ ID NO: 2141281 - RNA, 15 nt, Staphylococcus aureus subsp. aureus N315
auaaagucauauggu

SEQ ID NO: 2141282 - RNA, 18 nt, Staphylococcus aureus subsp. aureus N315
auaaauaaacaacugcaa

SEQ ID NO: 2141283 - RNA, 19 nt, Staphylococcus aureus subsp. aureus N315
auaaauaagugauaaauaa

SEQ ID NO: 2141284 - RNA, 14 nt, Staphylococcus aureus subsp. aureus N315
auaaauacaaauau

SEQ ID NO: 2141285 - RNA, 15 nt, Staphylococcus aureus subsp. aureus N315
auaaauacaaaaaua

SEQ ID NO: 2141286 - RNA, 12 nt, Staphylococcus aureus subsp. aureus N315
auaaauauuaaa

SEQ ID NO: 2141287 - RNA, 18 nt, Staphylococcus aureus subsp. aureus N315
auaaauauggauuuugaa

SEQ ID NO: 2141288 - RNA, 20 nt, Staphylococcus aureus subsp. aureus N315
auaaauaugauguuaaaaaa

SEQ ID NO: 2141289 - RNA, 16 nt, Staphylococcus aureus subsp. aureus N315
auaaauauuaaauuca

SEQ ID NO: 2141290 - RNA, 21 nt, Staphylococcus aureus subsp. aureus N315
auaaaucauucuuuauagaaa

SEQ ID NO: 2141291 - RNA, 15 nt, Staphylococcus aureus subsp. aureus N315
auaaaucaugaaaua

SEQ ID NO: 2141292 - RNA, 17 nt, Staphylococcus aureus subsp. aureus N315
auaaauaucaauaauuc

SEQ ID NO: 2141293 - RNA, 20 nt, Staphylococcus aureus subsp. aureus N315
auaaauaucauaaaugcaua

SEQ ID NO: 2141294 - RNA, 15 nt, Staphylococcus aureus subsp. aureus N315
auaaauauaaaaagu

SEQ ID NO: 2141295 - RNA, 21 nt, Staphylococcus aureus subsp. aureus N315
auaaagccaucuaggucacuu

SEQ ID NO: 2141296 - RNA, 15 nt, Staphylococcus aureus subsp. aureus N315
auaaagcguucucua

SEQ ID NO: 2141297 - RNA, 17 nt, Staphylococcus aureus subsp. aureus N315
auaaagauuauaucuuu

SEQ ID NO: 2141298 - RNA, 16 nt, Staphylococcus aureus subsp. aureus N315
auaaccgcuacaauua

SEQ ID NO: 2141299 - RNA, 14 nt, Staphylococcus aureus subsp. aureus N315
auaaccgaaauauu

SEQ ID NO: 2141300 - RNA, 18 nt, Staphylococcus aureus subsp. aureus N315
auaacccauuuucaaaac

SEQ ID NO: 2141301 - RNA, 14 nt, Staphylococcus aureus subsp. aureus N315
auaaccauuuuuuc

SEQ ID NO: 2141302 - RNA, 17 nt, Staphylococcus aureus subsp. aureus N315
auaaccauuuuuucaaa

SEQ ID NO: 2141303 - RNA, 20 nt, Staphylococcus aureus subsp. aureus N315
auaaccauaguaauaaaaug

SEQ ID NO: 2141304 - RNA, 18 nt, Staphylococcus aureus subsp. aureus N315
auaaccauaguaauaaaa

SEQ ID NO: 2141305 - RNA, 17 nt, Staphylococcus aureus subsp. aureus N315
auaaccauaguaauaaa

SEQ ID NO: 2141306 - RNA, 22 nt, Staphylococcus aureus subsp. aureus N315
auaaccacaccaugcugcacau

SEQ ID NO: 2141307 - RNA, 19 nt, Staphylococcus aureus subsp. aureus N315
auaacgugcuuuuuuagaa

SEQ ID NO: 2141308 - RNA, 16 nt, Staphylococcus aureus subsp. aureus N315
auaacucuaaauauaa

SEQ ID NO: 2141309 - RNA, 15 nt, Staphylococcus aureus subsp. aureus N315
auaacuguaaaacau

SEQ ID NO: 2141310 - RNA, 13 nt, Staphylococcus aureus subsp. aureus N315
auaacuguaaaac

SEQ ID NO: 2141311 - RNA, 19 nt, Staphylococcus aureus subsp. aureus N315
auaacuguagcuccuaaag

SEQ ID NO: 2141312 - RNA, 22 nt, Staphylococcus aureus subsp. aureus N315
auaacuguauaccucuuagcac

SEQ ID NO: 2141313 - RNA, 23 nt, Staphylococcus aureus subsp. aureus N315
auaaccuuccccuucauauuuug

SEQ ID NO: 2141314 - RNA, 23 nt, Staphylococcus aureus subsp. aureus N315
auaaccuuguucuuuacuccaaa

SEQ ID NO: 2141315 - RNA, 15 nt, Staphylococcus aureus subsp. aureus N315
auaaccuuuaaaaca

SEQ ID NO: 2141316 - RNA, 14 nt, Staphylococcus aureus subsp. aureus N315
auaacgugcuuuuu

SEQ ID NO: 2141317 - RNA, 19 nt, Staphylococcus aureus subsp. aureus N315
auaacguuaauauaauuaa

SEQ ID NO: 2141318 - RNA, 16 nt, Staphylococcus aureus subsp. aureus N315
auaacgucauauguuu

SEQ ID NO: 2141319 - RNA, 18 nt, Staphylococcus aureus subsp. aureus N315
auaacaaaauuaaauaug

SEQ ID NO: 2141320 - RNA, 15 nt, Staphylococcus aureus subsp. aureus N315
auaacaaaaucucaa

SEQ ID NO: 2141321 - RNA, 23 nt, Staphylococcus aureus subsp. aureus N315
auaacaaaaauugcuauauuagu

SEQ ID NO: 2141322 - RNA, 16 nt, Staphylococcus aureus subsp. aureus N315
auaacaacuacuuaaa

SEQ ID NO: 2141323 - RNA, 14 nt, Staphylococcus aureus subsp. aureus N315
auaacaagaaguaa

SEQ ID NO: 2141324 - RNA, 18 nt, Staphylococcus aureus subsp. aureus N315
auaacaacuacuuaaauu

SEQ ID NO: 2141325 - RNA, 20 nt, Staphylococcus aureus subsp. aureus N315
auaacaaguauaaaugcagc

SEQ ID NO: 2141326 - RNA, 21 nt, Staphylococcus aureus subsp. aureus N315
auaacaauuuuaaaucuuuua

SEQ ID NO: 2141327 - RNA, 13 nt, Staphylococcus aureus subsp. aureus N315
auaacaauuuuaa

SEQ ID NO: 2141328 - RNA, 14 nt, Staphylococcus aureus subsp. aureus N315
auaacaauuuuaaa

SEQ ID NO: 2141329 - RNA, 14 nt, Staphylococcus aureus subsp. aureus N315
auaaaucuaauacu

SEQ ID NO: 2141330 - RNA, 23 nt, Staphylococcus aureus subsp. aureus N315
auaaauuuucuguuuaauuaaaa

SEQ ID NO: 2141331 - RNA, 19 nt, Staphylococcus aureus subsp. aureus N315
auaaauuuugcgaaaauau

SEQ ID NO: 2141332 - RNA, 16 nt, Staphylococcus aureus subsp. aureus N315
auaaaucauucuuuau

SEQ ID NO: 2141333 - RNA, 20 nt, Staphylococcus aureus subsp. aureus N315
auaaauccuaagucuuuuaa

SEQ ID NO: 2141334 - RNA, 17 nt, Staphylococcus aureus subsp. aureus N315
auaaaucccuaaaaaaa

SEQ ID NO: 2141335 - RNA, 15 nt, Staphylococcus aureus subsp. aureus N315
auaaaucgauaaaau

SEQ ID NO: 2141336 - RNA, 14 nt, Staphylococcus aureus subsp. aureus N315
auaacaccaauuaa

SEQ ID NO: 2141337 - RNA, 15 nt, Staphylococcus aureus subsp. aureus N315
auaacaccaauuaaa

SEQ ID NO: 2141338 - RNA, 17 nt, Staphylococcus aureus subsp. aureus N315
auaacaccaauuaaauc

SEQ ID NO: 2141339 - RNA, 22 nt, Staphylococcus aureus subsp. aureus N315
auaacaggugcuuacuuuuaaa

SEQ ID NO: 2141340 - RNA, 15 nt, Staphylococcus aureus subsp. aureus N315
auaacauuuaagaaa

SEQ ID NO: 2141341 - RNA, 19 nt, Staphylococcus aureus subsp. aureus N315
auaacaguuaauuauaccg

SEQ ID NO: 2141342 - RNA, 19 nt, Staphylococcus aureus subsp. aureus N315
auaacauucuucaaaaaau

SEQ ID NO: 2141343 - RNA, 20 nt, Staphylococcus aureus subsp. aureus N315
auaacauucuucaaaaaaua

SEQ ID NO: 2141344 - RNA, 17 nt, Staphylococcus aureus subsp. aureus N315
auaacauucuucaaaaa

SEQ ID NO: 2141345 - RNA, 17 nt, Staphylococcus aureus subsp. aureus N315
auaacauuaaaaugaua

SEQ ID NO: 2141346 - RNA, 13 nt, Staphylococcus aureus subsp. aureus N315
auaacaucuaaau

SEQ ID NO: 2141347 - RNA, 15 nt, Staphylococcus aureus subsp. aureus N315
auaacaucuaaauuu

SEQ ID NO: 2141348 - RNA, 17 nt, Staphylococcus aureus subsp. aureus N315
aggaagaccacuauuuu

SEQ ID NO: 2141349 - RNA, 14 nt, Staphylococcus aureus subsp. aureus N315
agcuuuucuaaugc

SEQ ID NO: 2141350 - RNA, 17 nt, Staphylococcus aureus subsp. aureus N315
agcuuuguuagcaucug

SEQ ID NO: 2141351 - RNA, 19 nt, Staphylococcus aureus subsp. aureus N315
agcuuugcugcuuuuccag

SEQ ID NO: 2141352 - RNA, 16 nt, Staphylococcus aureus subsp. aureus N315
aggaaaucauauauuu

SEQ ID NO: 2141353 - RNA, 15 nt, Staphylococcus aureus subsp. aureus N315
aggaaauaaaaaaua

SEQ ID NO: 2141354 - RNA, 19 nt, Staphylococcus aureus subsp. aureus N315
aggacacauuuacuuaaga

SEQ ID NO: 2141355 - RNA, 13 nt, Staphylococcus aureus subsp. aureus N315
aggaccaaauaga

SEQ ID NO: 2141356 - RNA, 12 nt, Staphylococcus aureus subsp. aureus N315
aggacuuuaugc

SEQ ID NO: 2141357 - RNA, 22 nt, Staphylococcus aureus subsp. aureus N315
agcuugauuuaacaaccucuga

SEQ ID NO: 2141358 - RNA, 15 nt, Staphylococcus aureus subsp. aureus N315
agcuugauuuaacaa

SEQ ID NO: 2141359 - RNA, 19 nt, Staphylococcus aureus subsp. aureus N315
agcuugaucuaaaugaucu

SEQ ID NO: 2141360 - RNA, 17 nt, Staphylococcus aureus subsp. aureus N315
agcuucucauugaaauc

SEQ ID NO: 2141361 - RNA, 18 nt, Staphylococcus aureus subsp. aureus N315
agcuugaccgccuaugau

SEQ ID NO: 2141362 - RNA, 22 nt, Staphylococcus aureus subsp. aureus N315
agcuucugcaugggcuucugcu

SEQ ID NO: 2141363 - RNA, 14 nt, Staphylococcus aureus subsp. aureus N315
agcuuguaacaagc

SEQ ID NO: 2141364 - RNA, 20 nt, Staphylococcus aureus subsp. aureus N315
agcuuaucaacgauuuuguc

SEQ ID NO: 2141365 - RNA, 21 nt, Staphylococcus aureus subsp. aureus N315
agcuuagucaauguauauuua

SEQ ID NO: 2141366 - RNA, 22 nt, Staphylococcus aureus subsp. aureus N315
agcuucaguuaaaucacugcuu

SEQ ID NO: 2141367 - RNA, 14 nt, Staphylococcus aureus subsp. aureus N315
agcuucaguuaaau

SEQ ID NO: 2141368 - RNA, 18 nt, Staphylococcus aureus subsp. aureus N315
agcuuacaauagugugca

SEQ ID NO: 2141369 - RNA, 13 nt, Staphylococcus aureus subsp. aureus N315
agcuuaauuuuau

SEQ ID NO: 2141370 - RNA, 16 nt, Staphylococcus aureus subsp. aureus N315
agcugucauaccuuuu

SEQ ID NO: 2141371 - RNA, 23 nt, Staphylococcus aureus subsp. aureus N315
agcugugcugucauuuucugcuu

SEQ ID NO: 2141372 - RNA, 17 nt, Staphylococcus aureus subsp. aureus N315
agcugcucgauauaugu

SEQ ID NO: 2141373 - RNA, 20 nt, Staphylococcus aureus subsp. aureus N315
aggauuuccggaacaauacc

SEQ ID NO: 2141374 - RNA, 19 nt, Staphylococcus aureus subsp. aureus N315
aggauuugcaccuauaccu

SEQ ID NO: 2141375 - RNA, 23 nt, Staphylococcus aureus subsp. aureus N315
aggcacagcggaauacagaugau

SEQ ID NO: 2141376 - RNA, 22 nt, Staphylococcus aureus subsp. aureus N315
aggcacagcggaauacagauga

SEQ ID NO: 2141377 - RNA, 11 nt, Staphylococcus aureus subsp. aureus N315
aggcaacuuuu

SEQ ID NO: 2141378 - RNA, 12 nt, Staphylococcus aureus subsp. aureus N315
aggcaacaacuu

SEQ ID NO: 2141379 - RNA, 14 nt, Staphylococcus aureus subsp. aureus N315
aggcaacaacuuuu

SEQ ID NO: 2141380 - RNA, 13 nt, Staphylococcus aureus subsp. aureus N315
aggcaacaaauau

SEQ ID NO: 2141381 - RNA, 15 nt, Staphylococcus aureus subsp. aureus N315
aggcaucucacaauc

SEQ ID NO: 2141382 - RNA, 16 nt, Staphylococcus aureus subsp. aureus N315
aggcccauaaauuacu

SEQ ID NO: 2141383 - RNA, 18 nt, Staphylococcus aureus subsp. aureus N315
aggcccauaaauuacuug

SEQ ID NO: 2141384 - RNA, 23 nt, Staphylococcus aureus subsp. aureus N315
agguaacugcuuuggaguuucuu

SEQ ID NO: 2141385 - RNA, 13 nt, Staphylococcus aureus subsp. aureus N315
agguaacugcuuu

SEQ ID NO: 2141386 - RNA, 15 nt, Staphylococcus aureus subsp. aureus N315
agguaacuaaaaugu

SEQ ID NO: 2141387 - RNA, 15 nt, Staphylococcus aureus subsp. aureus N315
agguaagugcucaaa

SEQ ID NO: 2141388 - RNA, 23 nt, Staphylococcus aureus subsp. aureus N315
agguaaugcaaguuggcggggcc

SEQ ID NO: 2141389 - RNA, 17 nt, Staphylococcus aureus subsp. aureus N315
agguaaugcaaguuggg

SEQ ID NO: 2141390 - RNA, 15 nt, Staphylococcus aureus subsp. aureus N315
agguauacacaaauu

SEQ ID NO: 2141391 - RNA, 15 nt, Staphylococcus aureus subsp. aureus N315
aggugauuauauaua

SEQ ID NO: 2141392 - RNA, 17 nt, Staphylococcus aureus subsp. aureus N315
aggugauugaacaauaa

SEQ ID NO: 2141393 - RNA, 19 nt, Staphylococcus aureus subsp. aureus N315
aggugcaguuaaauuaaac

SEQ ID NO: 2141394 - RNA, 18 nt, Staphylococcus aureus subsp. aureus N315
aggucuacgaucaaaauc

SEQ ID NO: 2141395 - RNA, 18 nt, Staphylococcus aureus subsp. aureus N315
agggccccaacacagaag

SEQ ID NO: 2141396 - RNA, 15 nt, Staphylococcus aureus subsp. aureus N315
agggccccaacacag

SEQ ID NO: 2141397 - RNA, 21 nt, Staphylococcus aureus subsp. aureus N315
agggcggucaauuuuaccaug

SEQ ID NO: 2141398 - RNA, 12 nt, Staphylococcus aureus subsp. aureus N315
aggggccccaac

SEQ ID NO: 2141399 - RNA, 16 nt, Staphylococcus aureus subsp. aureus N315
aggggccccaacacag

SEQ ID NO: 2141400 - RNA, 17 nt, Staphylococcus aureus subsp. aureus N315
aggggccccaacacaga

SEQ ID NO: 2141401 - RNA, 20 nt, Staphylococcus aureus subsp. aureus N315
aggggcuucuuucuaaaaua

SEQ ID NO: 2141402 - RNA, 13 nt, Staphylococcus aureus subsp. aureus N315
aggcuuuaaaauu

SEQ ID NO: 2141403 - RNA, 16 nt, Staphylococcus aureus subsp. aureus N315
agggagugaggugaga

SEQ ID NO: 2141404 - RNA, 20 nt, Staphylococcus aureus subsp. aureus N315
aguauaaaccgccaacuaau

SEQ ID NO: 2141405 - RNA, 12 nt, Staphylococcus aureus subsp. aureus N315
aguauaaauaaa

SEQ ID NO: 2141406 - RNA, 20 nt, Staphylococcus aureus subsp. aureus N315
aguauaaauaaaaauacaua

SEQ ID NO: 2141407 - RNA, 17 nt, Staphylococcus aureus subsp. aureus N315
aguaguuguacuucuuu

SEQ ID NO: 2141408 - RNA, 18 nt, Staphylococcus aureus subsp. aureus N315
aguaguuggaaaauuaca

SEQ ID NO: 2141409 - RNA, 20 nt, Staphylococcus aureus subsp. aureus N315
aguaguuaauugaaugaaaa

SEQ ID NO: 2141410 - RNA, 18 nt, Staphylococcus aureus subsp. aureus N315
aguaguuaucuaaugauc

SEQ ID NO: 2141411 - RNA, 18 nt, Staphylococcus aureus subsp. aureus N315
aguaggauaauuucaauu

SEQ ID NO: 2141412 - RNA, 24 nt, Staphylococcus aureus subsp. aureus N315
aguagcuuguuuagaagcuucugc

SEQ ID NO: 2141413 - RNA, 16 nt, Staphylococcus aureus subsp. aureus N315
aguacccagaaugcga

SEQ ID NO: 2141414 - RNA, 13 nt, Staphylococcus aureus subsp. aureus N315
aguagauuuauua

SEQ ID NO: 2141415 - RNA, 19 nt, Staphylococcus aureus subsp. aureus N315
aguagauuuauuaaauaua

SEQ ID NO: 2141416 - RNA, 18 nt, Staphylococcus aureus subsp. aureus N315
aguauauccgcaucuuuu

SEQ ID NO: 2141417 - RNA, 14 nt, Staphylococcus aureus subsp. aureus N315
aguauaguuuugau

SEQ ID NO: 2141418 - RNA, 21 nt, Staphylococcus aureus subsp. aureus N315
aguauagcgcagcaaaugcuu

SEQ ID NO: 2141419 - RNA, 21 nt, Staphylococcus aureus subsp. aureus N315
aguauaaguagcucaaaacaa

SEQ ID NO: 2141420 - RNA, 18 nt, Staphylococcus aureus subsp. aureus N315
aguauaagguugaagaag

SEQ ID NO: 2141421 - RNA, 15 nt, Staphylococcus aureus subsp. aureus N315
aguauaaaugcagcu

SEQ ID NO: 2141422 - RNA, 22 nt, Staphylococcus aureus subsp. aureus N315
aguaucauguucuuauaaaaaa

SEQ ID NO: 2141423 - RNA, 23 nt, Staphylococcus aureus subsp. aureus N315
aguauuauagccuauccauucaa

SEQ ID NO: 2141424 - RNA, 14 nt, Staphylococcus aureus subsp. aureus N315
aguauuaaauuugu

SEQ ID NO: 2141425 - RNA, 14 nt, Staphylococcus aureus subsp. aureus N315
aguauuaaauuuga

SEQ ID NO: 2141426 - RNA, 23 nt, Staphylococcus aureus subsp. aureus N315
aguaugcauauucauuaguuuua

SEQ ID NO: 2141427 - RNA, 18 nt, Staphylococcus aureus subsp. aureus N315
aguauuugccuuuugaau

SEQ ID NO: 2141428 - RNA, 21 nt, Staphylococcus aureus subsp. aureus N315
aguauuguuuuauauuuaaac

SEQ ID NO: 2141429 - RNA, 14 nt, Staphylococcus aureus subsp. aureus N315
aguauucaaaaaau

SEQ ID NO: 2141430 - RNA, 15 nt, Staphylococcus aureus subsp. aureus N315
aguauucaaaaaaua

SEQ ID NO: 2141431 - RNA, 14 nt, Staphylococcus aureus subsp. aureus N315
aguauucauuuucu

SEQ ID NO: 2141432 - RNA, 17 nt, Staphylococcus aureus subsp. aureus N315
aguaaucaguuacucua

SEQ ID NO: 2141433 - RNA, 22 nt, Staphylococcus aureus subsp. aureus N315
aguaauauguugcuuaucaaca

SEQ ID NO: 2141434 - RNA, 15 nt, Staphylococcus aureus subsp. aureus N315
aguaauucuuaaaaa

SEQ ID NO: 2141435 - RNA, 19 nt, Staphylococcus aureus subsp. aureus N315
aguaauucuucaucuucuu

SEQ ID NO: 2141436 - RNA, 22 nt, Staphylococcus aureus subsp. aureus N315
aguaauuuaauugguucuucuu

SEQ ID NO: 2141437 - RNA, 14 nt, Staphylococcus aureus subsp. aureus N315
aguaaguaauaaaa

SEQ ID NO: 2141438 - RNA, 15 nt, Staphylococcus aureus subsp. aureus N315
aguaauaacaucuaa

SEQ ID NO: 2141439 - RNA, 18 nt, Staphylococcus aureus subsp. aureus N315
aguaauaauauaaauaaa

SEQ ID NO: 2141440 - RNA, 16 nt, Staphylococcus aureus subsp. aureus N315
aguaauaauuuauuga

SEQ ID NO: 2141441 - RNA, 22 nt, Staphylococcus aureus subsp. aureus N315
aguaauaaaagucgauaaauau

SEQ ID NO: 2141442 - RNA, 22 nt, Staphylococcus aureus subsp. aureus N315
aguaauaaaauaaaaaaaugau

SEQ ID NO: 2141443 - RNA, 15 nt, Staphylococcus aureus subsp. aureus N315
aguaacauacuauaa

SEQ ID NO: 2141444 - RNA, 19 nt, Staphylococcus aureus subsp. aureus N315
aguaacauacuauaaaaau

SEQ ID NO: 2141445 - RNA, 16 nt, Staphylococcus aureus subsp. aureus N315
aguaacaauaacaccu

SEQ ID NO: 2141446 - RNA, 21 nt, Staphylococcus aureus subsp. aureus N315
aguaaagggagguauauacaa

SEQ ID NO: 2141447 - RNA, 22 nt, Staphylococcus aureus subsp. aureus N315
aguaaauguuuuauguauuuau

SEQ ID NO: 2141448 - RNA, 14 nt, Staphylococcus aureus subsp. aureus N315
aguaaauguuuuau

SEQ ID NO: 2141449 - RNA, 22 nt, Staphylococcus aureus subsp. aureus N315
aguaaauuaauagagaaagaau

SEQ ID NO: 2141450 - RNA, 23 nt, Staphylococcus aureus subsp. aureus N315
agguuguuuuucaucauuaaaau

SEQ ID NO: 2141451 - RNA, 14 nt, Staphylococcus aureus subsp. aureus N315
aguaaaauaaaaaa

SEQ ID NO: 2141452 - RNA, 14 nt, Staphylococcus aureus subsp. aureus N315
aguaaaacugcaau

SEQ ID NO: 2141453 - RNA, 20 nt, Staphylococcus aureus subsp. aureus N315
aguaaaaucuuuaacauuug

SEQ ID NO: 2141454 - RNA, 15 nt, Staphylococcus aureus subsp. aureus N315
agguuuauaaaaaau

SEQ ID NO: 2141455 - RNA, 18 nt, Staphylococcus aureus subsp. aureus N315
agguuucacaaauucuuu

SEQ ID NO: 2141456 - RNA, 20 nt, Staphylococcus aureus subsp. aureus N315
agguuuauaaaaaaucaguu

SEQ ID NO: 2141457 - RNA, 18 nt, Staphylococcus aureus subsp. aureus N315
agcuacccuauuuuacaa

SEQ ID NO: 2141458 - RNA, 18 nt, Staphylococcus aureus subsp. aureus N315
agcuaaugcaacuaaaac

SEQ ID NO: 2141459 - RNA, 13 nt, Staphylococcus aureus subsp. aureus N315
agcuaaugcaagc

SEQ ID NO: 2141460 - RNA, 22 nt, Staphylococcus aureus subsp. aureus N315
agcuaauguguacuuaaaaaua

SEQ ID NO: 2141461 - RNA, 18 nt, Staphylococcus aureus subsp. aureus N315
agcuaauggcuaauacaa

SEQ ID NO: 2141462 - RNA, 21 nt, Staphylococcus aureus subsp. aureus N315
agcuaauuucuaauacauacu

SEQ ID NO: 2141463 - RNA, 15 nt, Staphylococcus aureus subsp. aureus N315
agcuacaauuaaagu

SEQ ID NO: 2141464 - RNA, 16 nt, Staphylococcus aureus subsp. aureus N315
agcuacaauuuucuca

SEQ ID NO: 2141465 - RNA, 14 nt, Staphylococcus aureus subsp. aureus N315
agcguuuuuauuac

SEQ ID NO: 2141466 - RNA, 18 nt, Staphylococcus aureus subsp. aureus N315
agcuaacucuuuguauaa

SEQ ID NO: 2141467 - RNA, 15 nt, Staphylococcus aureus subsp. aureus N315
agcguucgugauaga

SEQ ID NO: 2141468 - RNA, 19 nt, Staphylococcus aureus subsp. aureus N315
agcucaauaaauuaugaaa

SEQ ID NO: 2141469 - RNA, 22 nt, Staphylococcus aureus subsp. aureus N315
agcuauucauagaccuaugaau

SEQ ID NO: 2141470 - RNA, 15 nt, Staphylococcus aureus subsp. aureus N315
agcuauuacuauaaa

SEQ ID NO: 2141471 - RNA, 18 nt, Staphylococcus aureus subsp. aureus N315
agcuauaaaaguacuuua

SEQ ID NO: 2141472 - RNA, 22 nt, Staphylococcus aureus subsp. aureus N315
agcuauagaaaugauagggcau

SEQ ID NO: 2141473 - RNA, 12 nt, Staphylococcus aureus subsp. aureus N315
agcuauaaaagu

SEQ ID NO: 2141474 - RNA, 18 nt, Staphylococcus aureus subsp. aureus N315
agcuauaaaaaaucuuuu

SEQ ID NO: 2141475 - RNA, 16 nt, Staphylococcus aureus subsp. aureus N315
agcuauaaaaaaucuu

SEQ ID NO: 2141476 - RNA, 22 nt, Staphylococcus aureus subsp. aureus N315
agcuaugcuuuuuuuacaauau

SEQ ID NO: 2141477 - RNA, 15 nt, Staphylococcus aureus subsp. aureus N315
agcuaucguaaacaa

SEQ ID NO: 2141478 - RNA, 19 nt, Staphylococcus aureus subsp. aureus N315
agcucaugaaucagaugau

SEQ ID NO: 2141479 - RNA, 20 nt, Staphylococcus aureus subsp. aureus N315
agcucaauugaaucuuuguu

SEQ ID NO: 2141480 - RNA, 18 nt, Staphylococcus aureus subsp. aureus N315
agcguaauggauuauuau

SEQ ID NO: 2141481 - RNA, 22 nt, Staphylococcus aureus subsp. aureus N315
agcguccucuugugaaauuaga

SEQ ID NO: 2141482 - RNA, 22 nt, Staphylococcus aureus subsp. aureus N315
agcgaaaguaucuaugaaauuu

SEQ ID NO: 2141483 - RNA, 15 nt, Staphylococcus aureus subsp. aureus N315
agccuuuucaaacau

SEQ ID NO: 2141484 - RNA, 12 nt, Staphylococcus aureus subsp. aureus N315
agcgauuaaaug

SEQ ID NO: 2141485 - RNA, 17 nt, Staphylococcus aureus subsp. aureus N315
agcgaugaaaguugcuu

SEQ ID NO: 2141486 - RNA, 20 nt, Staphylococcus aureus subsp. aureus N315
agcaguaagauaauuuucaa

SEQ ID NO: 2141487 - RNA, 20 nt, Staphylococcus aureus subsp. aureus N315
agcaguaagacgauuucaau

SEQ ID NO: 2141488 - RNA, 20 nt, Staphylococcus aureus subsp. aureus N315
agcaugaaucgcauuuaaau

SEQ ID NO: 2141489 - RNA, 17 nt, Staphylococcus aureus subsp. aureus N315
agcaucuacaauauuca

SEQ ID NO: 2141490 - RNA, 17 nt, Staphylococcus aureus subsp. aureus N315
agcaucuuuuacugcuu

SEQ ID NO: 2141491 - RNA, 17 nt, Staphylococcus aureus subsp. aureus N315
agcauaccuacagaaug

SEQ ID NO: 2141492 - RNA, 22 nt, Staphylococcus aureus subsp. aureus N315
agcaguaggauaauuucaauuu

SEQ ID NO: 2141493 - RNA, 19 nt, Staphylococcus aureus subsp. aureus N315
agcagcaguugacuguaaa

SEQ ID NO: 2141494 - RNA, 16 nt, Staphylococcus aureus subsp. aureus N315
agcacuaucuuuugcu

SEQ ID NO: 2141495 - RNA, 18 nt, Staphylococcus aureus subsp. aureus N315
agcacuagccguuauuuu

SEQ ID NO: 2141496 - RNA, 23 nt, Staphylococcus aureus subsp. aureus N315
agcaccguaacauauguacuauu

SEQ ID NO: 2141497 - RNA, 14 nt, Staphylococcus aureus subsp. aureus N315
agcaacauuauuuu

SEQ ID NO: 2141498 - RNA, 14 nt, Staphylococcus aureus subsp. aureus N315
agccaauaaaaugu

SEQ ID NO: 2141499 - RNA, 16 nt, Staphylococcus aureus subsp. aureus N315
agcaugacuguaagua

SEQ ID NO: 2141500 - RNA, 16 nt, Staphylococcus aureus subsp. aureus N315
agccaccuaaaucucc

SEQ ID NO: 2141501 - RNA, 13 nt, Staphylococcus aureus subsp. aureus N315
agccauuaaacca

SEQ ID NO: 2141502 - RNA, 17 nt, Staphylococcus aureus subsp. aureus N315
agccauuuguuguaaac

SEQ ID NO: 2141503 - RNA, 18 nt, Staphylococcus aureus subsp. aureus N315
agccauaccuuauuucag

SEQ ID NO: 2141504 - RNA, 14 nt, Staphylococcus aureus subsp. aureus N315
agccaucuuucuuu

SEQ ID NO: 2141505 - RNA, 16 nt, Staphylococcus aureus subsp. aureus N315
agccccuuacaacuuu

SEQ ID NO: 2141506 - RNA, 18 nt, Staphylococcus aureus subsp. aureus N315
agccccagcaaauacuuc

SEQ ID NO: 2141507 - RNA, 13 nt, Staphylococcus aureus subsp. aureus N315
agcaaaagaugaa

SEQ ID NO: 2141508 - RNA, 15 nt, Staphylococcus aureus subsp. aureus N315
agcaaaagaugaaaa

SEQ ID NO: 2141509 - RNA, 18 nt, Staphylococcus aureus subsp. aureus N315
agcaaaagaugaaaaucu

SEQ ID NO: 2141510 - RNA, 17 nt, Staphylococcus aureus subsp. aureus N315
agcaaaaauauuuaaac

SEQ ID NO: 2141511 - RNA, 15 nt, Staphylococcus aureus subsp. aureus N315
agcaaaaauauuuaa

SEQ ID NO: 2141512 - RNA, 21 nt, Staphylococcus aureus subsp. aureus N315
agcaaaaaauaaaucuccauu

SEQ ID NO: 2141513 - RNA, 16 nt, Staphylococcus aureus subsp. aureus N315
agcaaaauuauguaaa

SEQ ID NO: 2141514 - RNA, 21 nt, Staphylococcus aureus subsp. aureus N315
agcaaaauuauguaaaaaaua

SEQ ID NO: 2141515 - RNA, 15 nt, Staphylococcus aureus subsp. aureus N315
agcaaauaaaaucau

SEQ ID NO: 2141516 - RNA, 17 nt, Staphylococcus aureus subsp. aureus N315
agcaaauacuucaagag

SEQ ID NO: 2141517 - RNA, 17 nt, Staphylococcus aureus subsp. aureus N315
agcaaauauuauuaaau

SEQ ID NO: 2141518 - RNA, 19 nt, Staphylococcus aureus subsp. aureus N315
agcaaaugcuuaagaaauu

SEQ ID NO: 2141519 - RNA, 16 nt, Staphylococcus aureus subsp. aureus N315
agcaaaugcacuguau

SEQ ID NO: 2141520 - RNA, 13 nt, Staphylococcus aureus subsp. aureus N315
agcaaauauuucu

SEQ ID NO: 2141521 - RNA, 22 nt, Staphylococcus aureus subsp. aureus N315
agauuuuaauauugacauuuac

SEQ ID NO: 2141522 - RNA, 14 nt, Staphylococcus aureus subsp. aureus N315
agauuuuauauaaa

SEQ ID NO: 2141523 - RNA, 16 nt, Staphylococcus aureus subsp. aureus N315
agauuuguauuuugcg

SEQ ID NO: 2141524 - RNA, 13 nt, Staphylococcus aureus subsp. aureus N315
agauuugaaauuu

SEQ ID NO: 2141525 - RNA, 19 nt, Staphylococcus aureus subsp. aureus N315
agauuugaaauuuauuaua

SEQ ID NO: 2141526 - RNA, 15 nt, Staphylococcus aureus subsp. aureus N315
agauuugaaauuuau

SEQ ID NO: 2141527 - RNA, 15 nt, Staphylococcus aureus subsp. aureus N315
agauuguauuuaaua

SEQ ID NO: 2141528 - RNA, 22 nt, Staphylococcus aureus subsp. aureus N315
agauuuauaacgacguaauccu

SEQ ID NO: 2141529 - RNA, 14 nt, Staphylococcus aureus subsp. aureus N315
agauuccugcaaaa

SEQ ID NO: 2141530 - RNA, 16 nt, Staphylococcus aureus subsp. aureus N315
agauugaaaaaauaac

SEQ ID NO: 2141531 - RNA, 17 nt, Staphylococcus aureus subsp. aureus N315
agauucuguuugguguu

SEQ ID NO: 2141532 - RNA, 21 nt, Staphylococcus aureus subsp. aureus N315
agauugauauaaauuaucaga

SEQ ID NO: 2141533 - RNA, 16 nt, Staphylococcus aureus subsp. aureus N315
agauugauauaaauua

SEQ ID NO: 2141534 - RNA, 14 nt, Staphylococcus aureus subsp. aureus N315
agauugagaauuca

SEQ ID NO: 2141535 - RNA, 18 nt, Staphylococcus aureus subsp. aureus N315
agaugugaugcuugaaug

SEQ ID NO: 2141536 - RNA, 14 nt, Staphylococcus aureus subsp. aureus N315
agauucauauuuau

SEQ ID NO: 2141537 - RNA, 20 nt, Staphylococcus aureus subsp. aureus N315
agauucauaucuuucaauua

SEQ ID NO: 2141538 - RNA, 17 nt, Staphylococcus aureus subsp. aureus N315
agauuccaucacgauau

SEQ ID NO: 2141539 - RNA, 12 nt, Staphylococcus aureus subsp. aureus N315
agauucaccuaa

SEQ ID NO: 2141540 - RNA, 13 nt, Staphylococcus aureus subsp. aureus N315
agauuagagaaga

SEQ ID NO: 2141541 - RNA, 22 nt, Staphylococcus aureus subsp. aureus N315
agauggacaguuuuuauauuaa

SEQ ID NO: 2141542 - RNA, 16 nt, Staphylococcus aureus subsp. aureus N315
agaugcauaaaaaaag

SEQ ID NO: 2141543 - RNA, 21 nt, Staphylococcus aureus subsp. aureus N315
agaugucacuguuaaagaugu

SEQ ID NO: 2141544 - RNA, 15 nt, Staphylococcus aureus subsp. aureus N315
agauguauaaaacua

SEQ ID NO: 2141545 - RNA, 18 nt, Staphylococcus aureus subsp. aureus N315
agaugucgaaaaguauau

SEQ ID NO: 2141546 - RNA, 18 nt, Staphylococcus aureus subsp. aureus N315
aaaaccgaggaaauccuu

SEQ ID NO: 2141547 - RNA, 20 nt, Staphylococcus aureus subsp. aureus N315
aaaaccgaggaaauccuuaa

SEQ ID NO: 2141548 - RNA, 18 nt, Staphylococcus aureus subsp. aureus N315
aaaaccgaacaucugaaa

SEQ ID NO: 2141549 - RNA, 21 nt, Staphylococcus aureus subsp. aureus N315
aaaaccgaacaucugaaaaaa

SEQ ID NO: 2141550 - RNA, 17 nt, Staphylococcus aureus subsp. aureus N315
aaaaccgaacaucugaa

SEQ ID NO: 2141551 - RNA, 21 nt, Staphylococcus aureus subsp. aureus N315
aaaaccccuguugaacuuuag

SEQ ID NO: 2141552 - RNA, 17 nt, Staphylococcus aureus subsp. aureus N315
agaugagauuucguuag

SEQ ID NO: 2141553 - RNA, 13 nt, Staphylococcus aureus subsp. aureus N315
agaugagaaagua

SEQ ID NO: 2141554 - RNA, 22 nt, Staphylococcus aureus subsp. aureus N315
agaugaaugccuaauuuuguga

SEQ ID NO: 2141555 - RNA, 21 nt, Staphylococcus aureus subsp. aureus N315
agaugaaugccuaauuuugug

SEQ ID NO: 2141556 - RNA, 22 nt, Staphylococcus aureus subsp. aureus N315
aaaaccgcuauaaaauuuugaa

SEQ ID NO: 2141557 - RNA, 21 nt, Staphylococcus aureus subsp. aureus N315
aaaaccgcuauaaaauuuuga

SEQ ID NO: 2141558 - RNA, 14 nt, Staphylococcus aureus subsp. aureus N315
agauaaaucaucau

SEQ ID NO: 2141559 - RNA, 12 nt, Staphylococcus aureus subsp. aureus N315
agauaaaucauc

SEQ ID NO: 2141560 - RNA, 15 nt, Staphylococcus aureus subsp. aureus N315
agauaaauuaauaug

SEQ ID NO: 2141561 - RNA, 21 nt, Staphylococcus aureus subsp. aureus N315
agauaaauaaaaggcauucuu

SEQ ID NO: 2141562 - RNA, 18 nt, Staphylococcus aureus subsp. aureus N315
agauaaagcuucgucaau

SEQ ID NO: 2141563 - RNA, 23 nt, Staphylococcus aureus subsp. aureus N315
agauacuucaguacgguuauuua

SEQ ID NO: 2141564 - RNA, 17 nt, Staphylococcus aureus subsp. aureus N315
agauagauaaaucaaga

SEQ ID NO: 2141565 - RNA, 22 nt, Staphylococcus aureus subsp. aureus N315
agauacugcuucuacccuugca

SEQ ID NO: 2141566 - RNA, 14 nt, Staphylococcus aureus subsp. aureus N315
agaucauuuucaac

SEQ ID NO: 2141567 - RNA, 18 nt, Staphylococcus aureus subsp. aureus N315
agaucauuuucaacauaa

SEQ ID NO: 2141568 - RNA, 15 nt, Staphylococcus aureus subsp. aureus N315
agauauauuugaaag

SEQ ID NO: 2141569 - RNA, 18 nt, Staphylococcus aureus subsp. aureus N315
agauauauaauaccccaa

SEQ ID NO: 2141570 - RNA, 15 nt, Staphylococcus aureus subsp. aureus N315
agauaucauaauauu

SEQ ID NO: 2141571 - RNA, 19 nt, Staphylococcus aureus subsp. aureus N315
agauaucauuuuauccaaa

SEQ ID NO: 2141572 - RNA, 16 nt, Staphylococcus aureus subsp. aureus N315
agauaucuuauaacaa

SEQ ID NO: 2141573 - RNA, 14 nt, Staphylococcus aureus subsp. aureus N315
agauauugaaugga

SEQ ID NO: 2141574 - RNA, 22 nt, Staphylococcus aureus subsp. aureus N315
agauauguuuauauugcaaaaa

SEQ ID NO: 2141575 - RNA, 19 nt, Staphylococcus aureus subsp. aureus N315
agaggauaggcaacugcaa

SEQ ID NO: 2141576 - RNA, 17 nt, Staphylococcus aureus subsp. aureus N315
agaggagaaagcuaaug

SEQ ID NO: 2141577 - RNA, 22 nt, Staphylococcus aureus subsp. aureus N315
agaggaacagcggaauacagau

SEQ ID NO: 2141578 - RNA, 13 nt, Staphylococcus aureus subsp. aureus N315
aaaacauuuugug

SEQ ID NO: 2141579 - RNA, 17 nt, Staphylococcus aureus subsp. aureus N315
agagguaaaucuguuua

SEQ ID NO: 2141580 - RNA, 17 nt, Staphylococcus aureus subsp. aureus N315
agagguacuagaauuaa

SEQ ID NO: 2141581 - RNA, 20 nt, Staphylococcus aureus subsp. aureus N315
agaggcugguggaaagucag

SEQ ID NO: 2141582 - RNA, 21 nt, Staphylococcus aureus subsp. aureus N315
agacuaaaaaacuaacuuuau

SEQ ID NO: 2141583 - RNA, 16 nt, Staphylococcus aureus subsp. aureus N315
agagauguauaaaacu

SEQ ID NO: 2141584 - RNA, 13 nt, Staphylococcus aureus subsp. aureus N315
agagaugggcuaa

SEQ ID NO: 2141585 - RNA, 16 nt, Staphylococcus aureus subsp. aureus N315
agagcacgagaaaugu

SEQ ID NO: 2141586 - RNA, 20 nt, Staphylococcus aureus subsp. aureus N315
aaaacauucccuuaauaaua

SEQ ID NO: 2141587 - RNA, 12 nt, Staphylococcus aureus subsp. aureus N315
agaccaaauauu

SEQ ID NO: 2141588 - RNA, 16 nt, Staphylococcus aureus subsp. aureus N315
agaccaugcaaacuca

SEQ ID NO: 2141589 - RNA, 16 nt, Staphylococcus aureus subsp. aureus N315
agaccacuauuuuuaa

SEQ ID NO: 2141590 - RNA, 18 nt, Staphylococcus aureus subsp. aureus N315
agaccacuauuuuuaaau

SEQ ID NO: 2141591 - RNA, 22 nt, Staphylococcus aureus subsp. aureus N315
agacauauagcggugucaauau

SEQ ID NO: 2141592 - RNA, 18 nt, Staphylococcus aureus subsp. aureus N315
agacauacucacaaaaaa

SEQ ID NO: 2141593 - RNA, 20 nt, Staphylococcus aureus subsp. aureus N315
agacauaaggucuuggacua

SEQ ID NO: 2141594 - RNA, 17 nt, Staphylococcus aureus subsp. aureus N315
agacauaaauauggauu

SEQ ID NO: 2141595 - RNA, 14 nt, Staphylococcus aureus subsp. aureus N315
agacauuacauuua

SEQ ID NO: 2141596 - RNA, 21 nt, Staphylococcus aureus subsp. aureus N315
agacauugaaaggaacauuuc

SEQ ID NO: 2141597 - RNA, 19 nt, Staphylococcus aureus subsp. aureus N315
agacaucaucuauuuuuaa

SEQ ID NO: 2141598 - RNA, 15 nt, Staphylococcus aureus subsp. aureus N315
agacaugagauuauu

SEQ ID NO: 2141599 - RNA, 17 nt, Staphylococcus aureus subsp. aureus N315
aaaacauaaauacaaaa

SEQ ID NO: 2141600 - RNA, 18 nt, Staphylococcus aureus subsp. aureus N315
aaaacagguggaaguguu

SEQ ID NO: 2141601 - RNA, 19 nt, Staphylococcus aureus subsp. aureus N315
agacguaaguguaaaugaa

SEQ ID NO: 2141602 - RNA, 20 nt, Staphylococcus aureus subsp. aureus N315
agacguacaugcuucaauau

SEQ ID NO: 2141603 - RNA, 17 nt, Staphylococcus aureus subsp. aureus N315
agaccuucaauaucuuc

SEQ ID NO: 2141604 - RNA, 15 nt, Staphylococcus aureus subsp. aureus N315
aaaacagcaaauaaa

SEQ ID NO: 2141605 - RNA, 19 nt, Staphylococcus aureus subsp. aureus N315
agaccauuuuauauuuuag

SEQ ID NO: 2141606 - RNA, 15 nt, Staphylococcus aureus subsp. aureus N315
agaaugauacuguau

SEQ ID NO: 2141607 - RNA, 16 nt, Staphylococcus aureus subsp. aureus N315
agaaugaauaauucca

SEQ ID NO: 2141608 - RNA, 18 nt, Staphylococcus aureus subsp. aureus N315
agaaugaauaauuccagu

SEQ ID NO: 2141609 - RNA, 18 nt, Staphylococcus aureus subsp. aureus N315
agaaugaacuucucuuag

SEQ ID NO: 2141610 - RNA, 17 nt, Staphylococcus aureus subsp. aureus N315
agaauguacaauuuuuu

SEQ ID NO: 2141611 - RNA, 17 nt, Staphylococcus aureus subsp. aureus N315
agaaugucgauauuucu

SEQ ID NO: 2141612 - RNA, 20 nt, Staphylococcus aureus subsp. aureus N315
agaauuaacaacaaauauaa

SEQ ID NO: 2141613 - RNA, 15 nt, Staphylococcus aureus subsp. aureus N315
agaauuaacaacaaa

SEQ ID NO: 2141614 - RNA, 12 nt, Staphylococcus aureus subsp. aureus N315
agaauuaacaac

SEQ ID NO: 2141615 - RNA, 13 nt, Staphylococcus aureus subsp. aureus N315
agaauuaaagucu

SEQ ID NO: 2141616 - RNA, 19 nt, Staphylococcus aureus subsp. aureus N315
agaauucuaaaagaauuau

SEQ ID NO: 2141617 - RNA, 15 nt, Staphylococcus aureus subsp. aureus N315
agaauuuaaaagaga

SEQ ID NO: 2141618 - RNA, 17 nt, Staphylococcus aureus subsp. aureus N315
agaauuuaaaagagaau

SEQ ID NO: 2141619 - RNA, 15 nt, Staphylococcus aureus subsp. aureus N315
agacaauauuuuuac

SEQ ID NO: 2141620 - RNA, 16 nt, Staphylococcus aureus subsp. aureus N315
agacaaguauacuuga

SEQ ID NO: 2141621 - RNA, 14 nt, Staphylococcus aureus subsp. aureus N315
agacaauaaaucuu

SEQ ID NO: 2141622 - RNA, 16 nt, Staphylococcus aureus subsp. aureus N315
agacaccuuaucacuu

SEQ ID NO: 2141623 - RNA, 14 nt, Staphylococcus aureus subsp. aureus N315
agacacuuaacuug

SEQ ID NO: 2141624 - RNA, 17 nt, Staphylococcus aureus subsp. aureus N315
agacacggccugcaagu

SEQ ID NO: 2141625 - RNA, 23 nt, Staphylococcus aureus subsp. aureus N315
agaaauucuacaggcaaugcaag

SEQ ID NO: 2141626 - RNA, 21 nt, Staphylococcus aureus subsp. aureus N315
agaaauucgcaagccuucuau

SEQ ID NO: 2141627 - RNA, 13 nt, Staphylococcus aureus subsp. aureus N315
aaaacaaugauua

SEQ ID NO: 2141628 - RNA, 17 nt, Staphylococcus aureus subsp. aureus N315
agaaauaucuaccuuuu

SEQ ID NO: 2141629 - RNA, 21 nt, Staphylococcus aureus subsp. aureus N315
agaaauacuugaauuuaauaa

SEQ ID NO: 2141630 - RNA, 13 nt, Staphylococcus aureus subsp. aureus N315
agaacaaucaaua

SEQ ID NO: 2141631 - RNA, 17 nt, Staphylococcus aureus subsp. aureus N315
agaacaaucaauacaga

SEQ ID NO: 2141632 - RNA, 15 nt, Staphylococcus aureus subsp. aureus N315
agaacguucuaaggu

SEQ ID NO: 2141633 - RNA, 19 nt, Staphylococcus aureus subsp. aureus N315
agaacuaucgauacuaaac

SEQ ID NO: 2141634 - RNA, 13 nt, Staphylococcus aureus subsp. aureus N315
agaacuacaauuc

SEQ ID NO: 2141635 - RNA, 22 nt, Staphylococcus aureus subsp. aureus N315
agaacuacgcauuuuaaauaaa

SEQ ID NO: 2141636 - RNA, 19 nt, Staphylococcus aureus subsp. aureus N315
agaacuaacauaauuuuua

SEQ ID NO: 2141637 - RNA, 21 nt, Staphylococcus aureus subsp. aureus N315
agaacuauuuuaaauuacaac

SEQ ID NO: 2141638 - RNA, 15 nt, Staphylococcus aureus subsp. aureus N315
agaagcuuucuggaa

SEQ ID NO: 2141639 - RNA, 21 nt, Staphylococcus aureus subsp. aureus N315
agaaaagcagucgaacaauga

SEQ ID NO: 2141640 - RNA, 16 nt, Staphylococcus aureus subsp. aureus N315
agaaaacuagaacuua

SEQ ID NO: 2141641 - RNA, 20 nt, Staphylococcus aureus subsp. aureus N315
agaaaaguaaguaaaauaaa

SEQ ID NO: 2141642 - RNA, 15 nt, Staphylococcus aureus subsp. aureus N315
agaaaaguauaaaua

SEQ ID NO: 2141643 - RNA, 22 nt, Staphylococcus aureus subsp. aureus N315
agaaaaguauaaauauaaaaag

SEQ ID NO: 2141644 - RNA, 23 nt, Staphylococcus aureus subsp. aureus N315
agaaaaggcucauuuguuaaauu

SEQ ID NO: 2141645 - RNA, 17 nt, Staphylococcus aureus subsp. aureus N315
agaaaagggcaaaaaag

SEQ ID NO: 2141646 - RNA, 18 nt, Staphylococcus aureus subsp. aureus N315
agaaaaggauuauaggua

SEQ ID NO: 2141647 - RNA, 18 nt, Staphylococcus aureus subsp. aureus N315
agaaacauuauauaacac

SEQ ID NO: 2141648 - RNA, 13 nt, Staphylococcus aureus subsp. aureus N315
agaaacauuauau

SEQ ID NO: 2141649 - RNA, 13 nt, Staphylococcus aureus subsp. aureus N315
agaaaaauaugau

SEQ ID NO: 2141650 - RNA, 18 nt, Staphylococcus aureus subsp. aureus N315
agaaaaaguuuuucugac

SEQ ID NO: 2141651 - RNA, 14 nt, Staphylococcus aureus subsp. aureus N315
agaaaaagugauaa

SEQ ID NO: 2141652 - RNA, 12 nt, Staphylococcus aureus subsp. aureus N315
acuuuuuaaagg

SEQ ID NO: 2141653 - RNA, 14 nt, Staphylococcus aureus subsp. aureus N315
acuuuuuaaaggac

SEQ ID NO: 2141654 - RNA, 17 nt, Staphylococcus aureus subsp. aureus N315
acuuuuuaauuccaaag

SEQ ID NO: 2141655 - RNA, 15 nt, Staphylococcus aureus subsp. aureus N315
acuuuuguuaaaaaa

SEQ ID NO: 2141656 - RNA, 16 nt, Staphylococcus aureus subsp. aureus N315
acuuuugauuuugaau

SEQ ID NO: 2141657 - RNA, 16 nt, Staphylococcus aureus subsp. aureus N315
acuugaugaaacugau

SEQ ID NO: 2141658 - RNA, 16 nt, Staphylococcus aureus subsp. aureus N315
agaaagcuaauaucaa

SEQ ID NO: 2141659 - RNA, 19 nt, Staphylococcus aureus subsp. aureus N315
agaaaggcuagcuaaaauu

SEQ ID NO: 2141660 - RNA, 14 nt, Staphylococcus aureus subsp. aureus N315
agaaaguaaaaguu

SEQ ID NO: 2141661 - RNA, 13 nt, Staphylococcus aureus subsp. aureus N315
agaaagaauaaau

SEQ ID NO: 2141662 - RNA, 18 nt, Staphylococcus aureus subsp. aureus N315
agaaagaauaaauguuaa

SEQ ID NO: 2141663 - RNA, 18 nt, Staphylococcus aureus subsp. aureus N315
agaaagaccauuguauua

SEQ ID NO: 2141664 - RNA, 18 nt, Staphylococcus aureus subsp. aureus N315
acccacaucuuuuuaaaa

SEQ ID NO: 2141665 - RNA, 21 nt, Staphylococcus aureus subsp. aureus N315
acccacauuaaauauuauuuu

SEQ ID NO: 2141666 - RNA, 18 nt, Staphylococcus aureus subsp. aureus N315
acccaccguuaaaauaua

SEQ ID NO: 2141667 - RNA, 19 nt, Staphylococcus aureus subsp. aureus N315
accccauucacuacuuuuu

SEQ ID NO: 2141668 - RNA, 11 nt, Staphylococcus aureus subsp. aureus N315
acccaaucauu

SEQ ID NO: 2141669 - RNA, 16 nt, Staphylococcus aureus subsp. aureus N315
accauuuuauauuuua

SEQ ID NO: 2141670 - RNA, 15 nt, Staphylococcus aureus subsp. aureus N315
accauuaauuacaua

SEQ ID NO: 2141671 - RNA, 14 nt, Staphylococcus aureus subsp. aureus N315
accauuaauaguaa

SEQ ID NO: 2141672 - RNA, 14 nt, Staphylococcus aureus subsp. aureus N315
accauuaugauuaa

SEQ ID NO: 2141673 - RNA, 20 nt, Staphylococcus aureus subsp. aureus N315
accauuaucaagaacuuuaa

SEQ ID NO: 2141674 - RNA, 18 nt, Staphylococcus aureus subsp. aureus N315
accauuccaaaaauugua

SEQ ID NO: 2141675 - RNA, 17 nt, Staphylococcus aureus subsp. aureus N315
accauuuaacucaccuu

SEQ ID NO: 2141676 - RNA, 20 nt, Staphylococcus aureus subsp. aureus N315
accauucuaccaguugauuu

SEQ ID NO: 2141677 - RNA, 14 nt, Staphylococcus aureus subsp. aureus N315
accauugaaugaau

SEQ ID NO: 2141678 - RNA, 21 nt, Staphylococcus aureus subsp. aureus N315
accauugcacaguuucaucuu

SEQ ID NO: 2141679 - RNA, 14 nt, Staphylococcus aureus subsp. aureus N315
accaucaugacagc

SEQ ID NO: 2141680 - RNA, 14 nt, Staphylococcus aureus subsp. aureus N315
accaucauaaaugu

SEQ ID NO: 2141681 - RNA, 22 nt, Staphylococcus aureus subsp. aureus N315
accaugaugagauaaaaucaua

SEQ ID NO: 2141682 - RNA, 19 nt, Staphylococcus aureus subsp. aureus N315
accaugcaaacucauuuau

SEQ ID NO: 2141683 - RNA, 20 nt, Staphylococcus aureus subsp. aureus N315
accaugcugcacauuccauc

SEQ ID NO: 2141684 - RNA, 21 nt, Staphylococcus aureus subsp. aureus N315
accaucaacgccauauuuauu

SEQ ID NO: 2141685 - RNA, 20 nt, Staphylococcus aureus subsp. aureus N315
accauacuaaaacaugauac

SEQ ID NO: 2141686 - RNA, 15 nt, Staphylococcus aureus subsp. aureus N315
accauacucuaacuu

SEQ ID NO: 2141687 - RNA, 18 nt, Staphylococcus aureus subsp. aureus N315
accacuuuuguuaaaaaa

SEQ ID NO: 2141688 - RNA, 15 nt, Staphylococcus aureus subsp. aureus N315
accacuuuuguuaaa

SEQ ID NO: 2141689 - RNA, 19 nt, Staphylococcus aureus subsp. aureus N315
accacuuuuguuaaaaaau

SEQ ID NO: 2141690 - RNA, 18 nt, Staphylococcus aureus subsp. aureus N315
accauaacuuuauauaua

SEQ ID NO: 2141691 - RNA, 17 nt, Staphylococcus aureus subsp. aureus N315
accauaacaauuuuguu

SEQ ID NO: 2141692 - RNA, 20 nt, Staphylococcus aureus subsp. aureus N315
acccucauuuuuauaaauuu

SEQ ID NO: 2141693 - RNA, 17 nt, Staphylococcus aureus subsp. aureus N315
accgcacuucuauauua

SEQ ID NO: 2141694 - RNA, 21 nt, Staphylococcus aureus subsp. aureus N315
accgcacuuucuauuaauaua

SEQ ID NO: 2141695 - RNA, 15 nt, Staphylococcus aureus subsp. aureus N315
acgcauuuuaaauaa

SEQ ID NO: 2141696 - RNA, 15 nt, Staphylococcus aureus subsp. aureus N315
acgcaguugaaaaag

SEQ ID NO: 2141697 - RNA, 18 nt, Staphylococcus aureus subsp. aureus N315
acgcauuauuaagggggu

SEQ ID NO: 2141698 - RNA, 23 nt, Staphylococcus aureus subsp. aureus N315
acgcauuacuuuagaaagugauu

SEQ ID NO: 2141699 - RNA, 17 nt, Staphylococcus aureus subsp. aureus N315
acgcaauacgaauaucu

SEQ ID NO: 2141700 - RNA, 19 nt, Staphylococcus aureus subsp. aureus N315
acgcacguauauacgauug

SEQ ID NO: 2141701 - RNA, 19 nt, Staphylococcus aureus subsp. aureus N315
acgcacuaucaaugacauc

SEQ ID NO: 2141702 - RNA, 14 nt, Staphylococcus aureus subsp. aureus N315
acgcacuauuuuua

SEQ ID NO: 2141703 - RNA, 22 nt, Staphylococcus aureus subsp. aureus N315
acgcaauuaaccuugauuuaau

SEQ ID NO: 2141704 - RNA, 14 nt, Staphylococcus aureus subsp. aureus N315
acgauaagaauuaa

SEQ ID NO: 2141705 - RNA, 18 nt, Staphylococcus aureus subsp. aureus N315
acgauaagaauuaacaac

SEQ ID NO: 2141706 - RNA, 23 nt, Staphylococcus aureus subsp. aureus N315
acgauaauaacuagaacaagaau

SEQ ID NO: 2141707 - RNA, 15 nt, Staphylococcus aureus subsp. aureus N315
acgauaauaauaaga

SEQ ID NO: 2141708 - RNA, 16 nt, Staphylococcus aureus subsp. aureus N315
acgauaauuguuaaag

SEQ ID NO: 2141709 - RNA, 18 nt, Staphylococcus aureus subsp. aureus N315
acgauaccggcaacuggu

SEQ ID NO: 2141710 - RNA, 19 nt, Staphylococcus aureus subsp. aureus N315
acgagcuugggacagaaaa

SEQ ID NO: 2141711 - RNA, 17 nt, Staphylococcus aureus subsp. aureus N315
acgaugaaacucuguuu

SEQ ID NO: 2141712 - RNA, 20 nt, Staphylococcus aureus subsp. aureus N315
acgaugagcgcauaaauuuu

SEQ ID NO: 2141713 - RNA, 15 nt, Staphylococcus aureus subsp. aureus N315
acgauugaacaucuc

SEQ ID NO: 2141714 - RNA, 23 nt, Staphylococcus aureus subsp. aureus N315
acgauugauagacauaaccuugc

SEQ ID NO: 2141715 - RNA, 16 nt, Staphylococcus aureus subsp. aureus N315
acgauugaacaucucu

SEQ ID NO: 2141716 - RNA, 22 nt, Staphylococcus aureus subsp. aureus N315
acgauuacgcucauaugucugu

SEQ ID NO: 2141717 - RNA, 16 nt, Staphylococcus aureus subsp. aureus N315
acgauuuuuaaaaugc

SEQ ID NO: 2141718 - RNA, 15 nt, Staphylococcus aureus subsp. aureus N315
acgauuuugucuuuu

SEQ ID NO: 2141719 - RNA, 17 nt, Staphylococcus aureus subsp. aureus N315
acgcaaaaauacuccuu

SEQ ID NO: 2141720 - RNA, 14 nt, Staphylococcus aureus subsp. aureus N315
accugauaauacaa

SEQ ID NO: 2141721 - RNA, 19 nt, Staphylococcus aureus subsp. aureus N315
accugggacauuaaucgau

SEQ ID NO: 2141722 - RNA, 22 nt, Staphylococcus aureus subsp. aureus N315
accuuaauaggauaugcuaaac

SEQ ID NO: 2141723 - RNA, 18 nt, Staphylococcus aureus subsp. aureus N315
accuuaauaaugaauucu

SEQ ID NO: 2141724 - RNA, 18 nt, Staphylococcus aureus subsp. aureus N315
accuuacauaggauaucu

SEQ ID NO: 2141725 - RNA, 22 nt, Staphylococcus aureus subsp. aureus N315
accuuaaauauaguugccaugu

SEQ ID NO: 2141726 - RNA, 19 nt, Staphylococcus aureus subsp. aureus N315
accuuacuacgcauuauua

SEQ ID NO: 2141727 - RNA, 13 nt, Staphylococcus aureus subsp. aureus N315
accuuauauuuua

SEQ ID NO: 2141728 - RNA, 22 nt, Staphylococcus aureus subsp. aureus N315
accuuauauuuuauuuaaaaau

SEQ ID NO: 2141729 - RNA, 12 nt, Staphylococcus aureus subsp. aureus N315
accuuauauuuu

SEQ ID NO: 2141730 - RNA, 23 nt, Staphylococcus aureus subsp. aureus N315
accuuauauuuuauuuaaaaaua

SEQ ID NO: 2141731 - RNA, 19 nt, Staphylococcus aureus subsp. aureus N315
accuuaucaguguaaguuu

SEQ ID NO: 2141732 - RNA, 20 nt, Staphylococcus aureus subsp. aureus N315
accuugauuuaauuuuuaau

SEQ ID NO: 2141733 - RNA, 17 nt, Staphylococcus aureus subsp. aureus N315
accuucgcauacuuuuu

SEQ ID NO: 2141734 - RNA, 15 nt, Staphylococcus aureus subsp. aureus N315
accuuuaaaacauca

SEQ ID NO: 2141735 - RNA, 19 nt, Staphylococcus aureus subsp. aureus N315
accuuuaaaacaucauuca

SEQ ID NO: 2141736 - RNA, 17 nt, Staphylococcus aureus subsp. aureus N315
accuuuagacaauauuu

SEQ ID NO: 2141737 - RNA, 14 nt, Staphylococcus aureus subsp. aureus N315
accuuuacuuucau

SEQ ID NO: 2141738 - RNA, 13 nt, Staphylococcus aureus subsp. aureus N315
accuuuaauuaca

SEQ ID NO: 2141739 - RNA, 13 nt, Staphylococcus aureus subsp. aureus N315
accuuuaauaucu

SEQ ID NO: 2141740 - RNA, 18 nt, Staphylococcus aureus subsp. aureus N315
accuuucaaauauaucua

SEQ ID NO: 2141741 - RNA, 14 nt, Staphylococcus aureus subsp. aureus N315
accuuuauuauuua

SEQ ID NO: 2141742 - RNA, 16 nt, Staphylococcus aureus subsp. aureus N315
accuuuauuauuuaau

SEQ ID NO: 2141743 - RNA, 12 nt, Staphylococcus aureus subsp. aureus N315
accuuuuuuaag

SEQ ID NO: 2141744 - RNA, 14 nt, Staphylococcus aureus subsp. aureus N315
accuuuuucuacca

SEQ ID NO: 2141745 - RNA, 13 nt, Staphylococcus aureus subsp. aureus N315
accuuuuuucucu

SEQ ID NO: 2141746 - RNA, 14 nt, Staphylococcus aureus subsp. aureus N315
acgaaauaguucaa

SEQ ID NO: 2141747 - RNA, 13 nt, Staphylococcus aureus subsp. aureus N315
accuauaccucgu

SEQ ID NO: 2141748 - RNA, 14 nt, Staphylococcus aureus subsp. aureus N315
accuauauuaagca

SEQ ID NO: 2141749 - RNA, 19 nt, Staphylococcus aureus subsp. aureus N315
accuacuuuuucaauaugu

SEQ ID NO: 2141750 - RNA, 18 nt, Staphylococcus aureus subsp. aureus N315
accuacuuuuucaauaug

SEQ ID NO: 2141751 - RNA, 18 nt, Staphylococcus aureus subsp. aureus N315
accuaugauauaugcugc

SEQ ID NO: 2141752 - RNA, 23 nt, Staphylococcus aureus subsp. aureus N315
accuaugauaugugaaaaagcua

SEQ ID NO: 2141753 - RNA, 16 nt, Staphylococcus aureus subsp. aureus N315
accucuacauuauauu

SEQ ID NO: 2141754 - RNA, 14 nt, Staphylococcus aureus subsp. aureus N315
acguaaguuugcua

SEQ ID NO: 2141755 - RNA, 19 nt, Staphylococcus aureus subsp. aureus N315
acguaauccuuggaaacga

SEQ ID NO: 2141756 - RNA, 16 nt, Staphylococcus aureus subsp. aureus N315
acguaaucuaauacau

SEQ ID NO: 2141757 - RNA, 13 nt, Staphylococcus aureus subsp. aureus N315
acgguuugaaaaa

SEQ ID NO: 2141758 - RNA, 23 nt, Staphylococcus aureus subsp. aureus N315
acgggugguuuuuaauuugagua

SEQ ID NO: 2141759 - RNA, 15 nt, Staphylococcus aureus subsp. aureus N315
acgcuuuuuaaaaaa

SEQ ID NO: 2141760 - RNA, 18 nt, Staphylococcus aureus subsp. aureus N315
acgcuuuauucuucccaa

SEQ ID NO: 2141761 - RNA, 13 nt, Staphylococcus aureus subsp. aureus N315
acgcuugauaaaa

SEQ ID NO: 2141762 - RNA, 14 nt, Staphylococcus aureus subsp. aureus N315
acggaauaacuuuu

SEQ ID NO: 2141763 - RNA, 17 nt, Staphylococcus aureus subsp. aureus N315
acgcuucaauuauuuca

SEQ ID NO: 2141764 - RNA, 22 nt, Staphylococcus aureus subsp. aureus N315
acgcugaaauuuuuuagugaaa

SEQ ID NO: 2141765 - RNA, 15 nt, Staphylococcus aureus subsp. aureus N315
acgccauaagaaaau

SEQ ID NO: 2141766 - RNA, 16 nt, Staphylococcus aureus subsp. aureus N315
acgccauaagaaaaua

SEQ ID NO: 2141767 - RNA, 19 nt, Staphylococcus aureus subsp. aureus N315
acgcuagugcgcgauaaau

SEQ ID NO: 2141768 - RNA, 15 nt, Staphylococcus aureus subsp. aureus N315
acguuuuuuuaaaua

SEQ ID NO: 2141769 - RNA, 23 nt, Staphylococcus aureus subsp. aureus N315
acguuuuuuuauaaauuauagua

SEQ ID NO: 2141770 - RNA, 20 nt, Staphylococcus aureus subsp. aureus N315
acguuuugguuguucuuuuu

SEQ ID NO: 2141771 - RNA, 19 nt, Staphylococcus aureus subsp. aureus N315
acuaaaacgauaauaauaa

SEQ ID NO: 2141772 - RNA, 22 nt, Staphylococcus aureus subsp. aureus N315
acuaaaaagaagcucccauuaa

SEQ ID NO: 2141773 - RNA, 19 nt, Staphylococcus aureus subsp. aureus N315
acuaaaacaaauucauauu

SEQ ID NO: 2141774 - RNA, 14 nt, Staphylococcus aureus subsp. aureus N315
acuaaacauugcuu

SEQ ID NO: 2141775 - RNA, 13 nt, Staphylococcus aureus subsp. aureus N315
acuaaacgauaaa

SEQ ID NO: 2141776 - RNA, 14 nt, Staphylococcus aureus subsp. aureus N315
acuaaacuuuucuu

SEQ ID NO: 2141777 - RNA, 16 nt, Staphylococcus aureus subsp. aureus N315
acuaaacuuuucuuca

SEQ ID NO: 2141778 - RNA, 17 nt, Staphylococcus aureus subsp. aureus N315
acuaaaguaaauaacac

SEQ ID NO: 2141779 - RNA, 18 nt, Staphylococcus aureus subsp. aureus N315
acuaaagguauucuauuu

SEQ ID NO: 2141780 - RNA, 22 nt, Staphylococcus aureus subsp. aureus N315
acuaaaugaauugcuuguucuu

SEQ ID NO: 2141781 - RNA, 14 nt, Staphylococcus aureus subsp. aureus N315
acuaaauuaaaagu

SEQ ID NO: 2141782 - RNA, 20 nt, Staphylococcus aureus subsp. aureus N315
acguugguuuaaaaauugau

SEQ ID NO: 2141783 - RNA, 19 nt, Staphylococcus aureus subsp. aureus N315
acguuuuaaauaaaugacu

SEQ ID NO: 2141784 - RNA, 17 nt, Staphylococcus aureus subsp. aureus N315
acguuuuagacauaaaa

SEQ ID NO: 2141785 - RNA, 17 nt, Staphylococcus aureus subsp. aureus N315
acguuuucacuucgcca

SEQ ID NO: 2141786 - RNA, 18 nt, Staphylococcus aureus subsp. aureus N315
acguuuauccuuuaaauc

SEQ ID NO: 2141787 - RNA, 21 nt, Staphylococcus aureus subsp. aureus N315
acguuuaauaccuaugauaua

SEQ ID NO: 2141788 - RNA, 16 nt, Staphylococcus aureus subsp. aureus N315
acgugcuuuaaaguug

SEQ ID NO: 2141789 - RNA, 20 nt, Staphylococcus aureus subsp. aureus N315
acguuauucguuaacaauca

SEQ ID NO: 2141790 - RNA, 23 nt, Staphylococcus aureus subsp. aureus N315
acguucuugguauuuuuuaaaug

SEQ ID NO: 2141791 - RNA, 22 nt, Staphylococcus aureus subsp. aureus N315
acguucuugguauuuuuuaaau

SEQ ID NO: 2141792 - RNA, 22 nt, Staphylococcus aureus subsp. aureus N315
acgugacauuuucaaguuuaaa

SEQ ID NO: 2141793 - RNA, 13 nt, Staphylococcus aureus subsp. aureus N315
acgugaacaacau

SEQ ID NO: 2141794 - RNA, 21 nt, Staphylococcus aureus subsp. aureus N315
acgucuuuccauuuaucaaca

SEQ ID NO: 2141795 - RNA, 16 nt, Staphylococcus aureus subsp. aureus N315
acgucuuguaucaaca

SEQ ID NO: 2141796 - RNA, 22 nt, Staphylococcus aureus subsp. aureus N315
acgucuuguaucaacauuaaua

SEQ ID NO: 2141797 - RNA, 21 nt, Staphylococcus aureus subsp. aureus N315
acuauugauauucuaaaaaau

SEQ ID NO: 2141798 - RNA, 19 nt, Staphylococcus aureus subsp. aureus N315
acuauuucgcuuuuuuuau

SEQ ID NO: 2141799 - RNA, 14 nt, Staphylococcus aureus subsp. aureus N315
acuauauuuauuag

SEQ ID NO: 2141800 - RNA, 13 nt, Staphylococcus aureus subsp. aureus N315
acuaucaauauaa

SEQ ID NO: 2141801 - RNA, 14 nt, Staphylococcus aureus subsp. aureus N315
acuaucaaugacau

SEQ ID NO: 2141802 - RNA, 15 nt, Staphylococcus aureus subsp. aureus N315
acuauuaucgaagaa

SEQ ID NO: 2141803 - RNA, 13 nt, Staphylococcus aureus subsp. aureus N315
acuauugaaaaua

SEQ ID NO: 2141804 - RNA, 16 nt, Staphylococcus aureus subsp. aureus N315
acuauacugaugaaaa

SEQ ID NO: 2141805 - RNA, 20 nt, Staphylococcus aureus subsp. aureus N315
acuauaauaauuaacugcgg

SEQ ID NO: 2141806 - RNA, 16 nt, Staphylococcus aureus subsp. aureus N315
acuauaauaauuggaa

SEQ ID NO: 2141807 - RNA, 16 nt, Staphylococcus aureus subsp. aureus N315
acuauaauuucuuaau

SEQ ID NO: 2141808 - RNA, 14 nt, Staphylococcus aureus subsp. aureus N315
acuauacaaucaua

SEQ ID NO: 2141809 - RNA, 21 nt, Staphylococcus aureus subsp. aureus N315
acuauaccuagggaugauaua

SEQ ID NO: 2141810 - RNA, 19 nt, Staphylococcus aureus subsp. aureus N315
acuauauuucacacagcuu

SEQ ID NO: 2141811 - RNA, 16 nt, Staphylococcus aureus subsp. aureus N315
acuauaugaaaagaga

SEQ ID NO: 2141812 - RNA, 17 nt, Staphylococcus aureus subsp. aureus N315
acuauaugugucgagua

SEQ ID NO: 2141813 - RNA, 12 nt, Staphylococcus aureus subsp. aureus N315
acuauauauagu

SEQ ID NO: 2141814 - RNA, 16 nt, Staphylococcus aureus subsp. aureus N315
acuauaaaaaacagca

SEQ ID NO: 2141815 - RNA, 17 nt, Staphylococcus aureus subsp. aureus N315
acuauaaaauucaccaa

SEQ ID NO: 2141816 - RNA, 17 nt, Staphylococcus aureus subsp. aureus N315
acuauaaauacaaauau

SEQ ID NO: 2141817 - RNA, 19 nt, Staphylococcus aureus subsp. aureus N315
acuauaacaccaauuaaau

SEQ ID NO: 2141818 - RNA, 19 nt, Staphylococcus aureus subsp. aureus N315
acuauaaccuauuaaaucu

SEQ ID NO: 2141819 - RNA, 19 nt, Staphylococcus aureus subsp. aureus N315
acuagaaaacauaaauaca

SEQ ID NO: 2141820 - RNA, 11 nt, Staphylococcus aureus subsp. aureus N315
acuaauaauug

SEQ ID NO: 2141821 - RNA, 16 nt, Staphylococcus aureus subsp. aureus N315
acuaauaauuuguaau

SEQ ID NO: 2141822 - RNA, 19 nt, Staphylococcus aureus subsp. aureus N315
acuaauauauuaauuuuac

SEQ ID NO: 2141823 - RNA, 19 nt, Staphylococcus aureus subsp. aureus N315
acuaaugucgcacuauaaa

SEQ ID NO: 2141824 - RNA, 15 nt, Staphylococcus aureus subsp. aureus N315
acuaauguuaaaaua

SEQ ID NO: 2141825 - RNA, 14 nt, Staphylococcus aureus subsp. aureus N315
acuaaucaauacua

SEQ ID NO: 2141826 - RNA, 20 nt, Staphylococcus aureus subsp. aureus N315
acuaaucguuccaacaacua

SEQ ID NO: 2141827 - RNA, 21 nt, Staphylococcus aureus subsp. aureus N315
acuacacacguagaaagaugu

SEQ ID NO: 2141828 - RNA, 22 nt, Staphylococcus aureus subsp. aureus N315
acuacacuccccuuaucaaaac

SEQ ID NO: 2141829 - RNA, 20 nt, Staphylococcus aureus subsp. aureus N315
acuaauuucuauagaaaaag

SEQ ID NO: 2141830 - RNA, 17 nt, Staphylococcus aureus subsp. aureus N315
acuaauugaucagcauu

SEQ ID NO: 2141831 - RNA, 21 nt, Staphylococcus aureus subsp. aureus N315
acuaagauaucuggauuaacu

SEQ ID NO: 2141832 - RNA, 19 nt, Staphylococcus aureus subsp. aureus N315
acuaaguaaccaagucuaa

SEQ ID NO: 2141833 - RNA, 18 nt, Staphylococcus aureus subsp. aureus N315
acuaaguuuguuuucuuu

SEQ ID NO: 2141834 - RNA, 20 nt, Staphylococcus aureus subsp. aureus N315
acuaaguuuucuuucuuuug

SEQ ID NO: 2141835 - RNA, 17 nt, Staphylococcus aureus subsp. aureus N315
acuaaguauaguguuaa

SEQ ID NO: 2141836 - RNA, 22 nt, Staphylococcus aureus subsp. aureus N315
acuaagugaacuauuaaaacca

SEQ ID NO: 2141837 - RNA, 20 nt, Staphylococcus aureus subsp. aureus N315
acuaacauaauuuuuauuua

SEQ ID NO: 2141838 - RNA, 18 nt, Staphylococcus aureus subsp. aureus N315
acuaacaaccguuuuaag

SEQ ID NO: 2141839 - RNA, 16 nt, Staphylococcus aureus subsp. aureus N315
acuaaauucaauaauc

SEQ ID NO: 2141840 - RNA, 17 nt, Staphylococcus aureus subsp. aureus N315
acuaaccuauuaaaaua

SEQ ID NO: 2141841 - RNA, 16 nt, Staphylococcus aureus subsp. aureus N315
acuaaccuauuaaaau

SEQ ID NO: 2141842 - RNA, 14 nt, Staphylococcus aureus subsp. aureus N315
acuaacguuuuaaa

SEQ ID NO: 2141843 - RNA, 15 nt, Staphylococcus aureus subsp. aureus N315
acuaacugaagacac

SEQ ID NO: 2141844 - RNA, 13 nt, Staphylococcus aureus subsp. aureus N315
acuuacaagucua

SEQ ID NO: 2141845 - RNA, 13 nt, Staphylococcus aureus subsp. aureus N315
acuuacaaauaua

SEQ ID NO: 2141846 - RNA, 18 nt, Staphylococcus aureus subsp. aureus N315
acuuacaaauauugugga

SEQ ID NO: 2141847 - RNA, 17 nt, Staphylococcus aureus subsp. aureus N315
acuuacauuacauauau

SEQ ID NO: 2141848 - RNA, 12 nt, Staphylococcus aureus subsp. aureus N315
acuuacaaauau

SEQ ID NO: 2141849 - RNA, 23 nt, Staphylococcus aureus subsp. aureus N315
acuuaccaugaugagauaaaauc

SEQ ID NO: 2141850 - RNA, 15 nt, Staphylococcus aureus subsp. aureus N315
acuuaccuaauagga

SEQ ID NO: 2141851 - RNA, 13 nt, Staphylococcus aureus subsp. aureus N315
acuuaaccauuua

SEQ ID NO: 2141852 - RNA, 15 nt, Staphylococcus aureus subsp. aureus N315
acuuaaccauuuaaa

SEQ ID NO: 2141853 - RNA, 18 nt, Staphylococcus aureus subsp. aureus N315
acuuaauuaauaauuuaa

SEQ ID NO: 2141854 - RNA, 22 nt, Staphylococcus aureus subsp. aureus N315
acuuaauuaauaauuuaacuaa

SEQ ID NO: 2141855 - RNA, 14 nt, Staphylococcus aureus subsp. aureus N315
acuguugguuugau

SEQ ID NO: 2141856 - RNA, 20 nt, Staphylococcus aureus subsp. aureus N315
acuguugguuugaucauuug

SEQ ID NO: 2141857 - RNA, 13 nt, Staphylococcus aureus subsp. aureus N315
acuuaaaauuuaa

SEQ ID NO: 2141858 - RNA, 22 nt, Staphylococcus aureus subsp. aureus N315
acuguucuuucgucuuguaaac

SEQ ID NO: 2141859 - RNA, 21 nt, Staphylococcus aureus subsp. aureus N315
acuguucuuucgucuuguaaa

SEQ ID NO: 2141860 - RNA, 22 nt, Staphylococcus aureus subsp. aureus N315
acugugauauuaauugaaaaac

SEQ ID NO: 2141861 - RNA, 19 nt, Staphylococcus aureus subsp. aureus N315
acugugauauuaauugaaa

SEQ ID NO: 2141862 - RNA, 15 nt, Staphylococcus aureus subsp. aureus N315
acugucucaucuucu

SEQ ID NO: 2141863 - RNA, 20 nt, Staphylococcus aureus subsp. aureus N315
acugucgguucaucuaaaau

SEQ ID NO: 2141864 - RNA, 17 nt, Staphylococcus aureus subsp. aureus N315
acuuaugagcaaagcaa

SEQ ID NO: 2141865 - RNA, 13 nt, Staphylococcus aureus subsp. aureus N315
acuuaugauacug

SEQ ID NO: 2141866 - RNA, 15 nt, Staphylococcus aureus subsp. aureus N315
acuuaugauacugau

SEQ ID NO: 2141867 - RNA, 20 nt, Staphylococcus aureus subsp. aureus N315
acuuaugauacugauauuua

SEQ ID NO: 2141868 - RNA, 18 nt, Staphylococcus aureus subsp. aureus N315
acuuacugugaaaauacc

SEQ ID NO: 2141869 - RNA, 22 nt, Staphylococcus aureus subsp. aureus N315
acuuacuuuucuaaacaacuuc

SEQ ID NO: 2141870 - RNA, 20 nt, Staphylococcus aureus subsp. aureus N315
acuuacugugaaaauaccaa

SEQ ID NO: 2141871 - RNA, 14 nt, Staphylococcus aureus subsp. aureus N315
acuuauuaauuaau

SEQ ID NO: 2141872 - RNA, 18 nt, Staphylococcus aureus subsp. aureus N315
acuuauggguucaauauc

SEQ ID NO: 2141873 - RNA, 18 nt, Staphylococcus aureus subsp. aureus N315
acuuauucuucacuuuca

SEQ ID NO: 2141874 - RNA, 12 nt, Staphylococcus aureus subsp. aureus N315
acuuauucuuca

SEQ ID NO: 2141875 - RNA, 15 nt, Staphylococcus aureus subsp. aureus N315
acuuauuauuuugua

SEQ ID NO: 2141876 - RNA, 18 nt, Staphylococcus aureus subsp. aureus N315
acuucaaacguuauguac

SEQ ID NO: 2141877 - RNA, 12 nt, Staphylococcus aureus subsp. aureus N315
acuuauuucaaa

SEQ ID NO: 2141878 - RNA, 13 nt, Staphylococcus aureus subsp. aureus N315
acuuauuucaaaa

SEQ ID NO: 2141879 - RNA, 15 nt, Staphylococcus aureus subsp. aureus N315
acuuauuugaaugca

SEQ ID NO: 2141880 - RNA, 16 nt, Staphylococcus aureus subsp. aureus N315
acuuauuuuucaucau

SEQ ID NO: 2141881 - RNA, 19 nt, Staphylococcus aureus subsp. aureus N315
acuucaacgucaucugcuu

SEQ ID NO: 2141882 - RNA, 17 nt, Staphylococcus aureus subsp. aureus N315
acuucacgcaaaacaau

SEQ ID NO: 2141883 - RNA, 21 nt, Staphylococcus aureus subsp. aureus N315
acuucacuaggaucuuuucca

SEQ ID NO: 2141884 - RNA, 18 nt, Staphylococcus aureus subsp. aureus N315
acuucuuuauauuuauca

SEQ ID NO: 2141885 - RNA, 15 nt, Staphylococcus aureus subsp. aureus N315
acuucuuuugcaaaa

SEQ ID NO: 2141886 - RNA, 17 nt, Staphylococcus aureus subsp. aureus N315
acuucuucuucagacca

SEQ ID NO: 2141887 - RNA, 22 nt, Staphylococcus aureus subsp. aureus N315
acuugaccacuuuuguuaaaaa

SEQ ID NO: 2141888 - RNA, 16 nt, Staphylococcus aureus subsp. aureus N315
acuugaauuuaauaag

SEQ ID NO: 2141889 - RNA, 15 nt, Staphylococcus aureus subsp. aureus N315
acuucuuuuuuguau

SEQ ID NO: 2141890 - RNA, 20 nt, Staphylococcus aureus subsp. aureus N315
acuucuuuuguuuuaccauc

SEQ ID NO: 2141891 - RNA, 17 nt, Staphylococcus aureus subsp. aureus N315
acuucuuuuuuguaucu

SEQ ID NO: 2141892 - RNA, 14 nt, Staphylococcus aureus subsp. aureus N315
acuucuuuuguuuu

SEQ ID NO: 2141893 - RNA, 16 nt, Staphylococcus aureus subsp. aureus N315
acuucuuuuguuuuac

SEQ ID NO: 2141894 - RNA, 18 nt, Staphylococcus aureus subsp. aureus N315
acuugauaaaaaaugaau

SEQ ID NO: 2141895 - RNA, 16 nt, Staphylococcus aureus subsp. aureus N315
acuugauaaaacuaau

SEQ ID NO: 2141896 - RNA, 20 nt, Staphylococcus aureus subsp. aureus N315
acuugauaaaacuaaugaua

SEQ ID NO: 2141897 - RNA, 22 nt, Staphylococcus aureus subsp. aureus N315
acuucuaauuugcaaaaucaac

SEQ ID NO: 2141898 - RNA, 16 nt, Staphylococcus aureus subsp. aureus N315
acuucugauucuucac

SEQ ID NO: 2141899 - RNA, 13 nt, Staphylococcus aureus subsp. aureus N315
acuucuuaaaaua

SEQ ID NO: 2141900 - RNA, 19 nt, Staphylococcus aureus subsp. aureus N315
acuucuuaaaauaugauuu

SEQ ID NO: 2141901 - RNA, 18 nt, Staphylococcus aureus subsp. aureus N315
acuucuuaacuugaaaug

SEQ ID NO: 2141902 - RNA, 16 nt, Staphylococcus aureus subsp. aureus N315
acuucaucacucgcaa

SEQ ID NO: 2141903 - RNA, 11 nt, Staphylococcus aureus subsp. aureus N315
acuucaucuaa

SEQ ID NO: 2141904 - RNA, 14 nt, Staphylococcus aureus subsp. aureus N315
acuuccaacauaua

SEQ ID NO: 2141905 - RNA, 20 nt, Staphylococcus aureus subsp. aureus N315
acuucccuuuggaagcaauu

SEQ ID NO: 2141906 - RNA, 17 nt, Staphylococcus aureus subsp. aureus N315
acuucgccaagccaucu

SEQ ID NO: 2141907 - RNA, 18 nt, Staphylococcus aureus subsp. aureus N315
acuucgauaugauuaaag

SEQ ID NO: 2141908 - RNA, 18 nt, Staphylococcus aureus subsp. aureus N315
acucuuacucauuuuucu

SEQ ID NO: 2141909 - RNA, 22 nt, Staphylococcus aureus subsp. aureus N315
acucuguuugucacuuaacuca

SEQ ID NO: 2141910 - RNA, 19 nt, Staphylococcus aureus subsp. aureus N315
acucugagcacuuagcaau

SEQ ID NO: 2141911 - RNA, 13 nt, Staphylococcus aureus subsp. aureus N315
acucguuuuucca

SEQ ID NO: 2141912 - RNA, 15 nt, Staphylococcus aureus subsp. aureus N315
acucguuuuuccaug

SEQ ID NO: 2141913 - RNA, 12 nt, Staphylococcus aureus subsp. aureus N315
acucuaaaggaa

SEQ ID NO: 2141914 - RNA, 21 nt, Staphylococcus aureus subsp. aureus N315
acucuaaaaguuguaauuuaa

SEQ ID NO: 2141915 - RNA, 23 nt, Staphylococcus aureus subsp. aureus N315
acucguuauagauaaguagugga

SEQ ID NO: 2141916 - RNA, 13 nt, Staphylococcus aureus subsp. aureus N315
acucgaaaccagc

SEQ ID NO: 2141917 - RNA, 15 nt, Staphylococcus aureus subsp. aureus N315
acuccucuauuuuau

SEQ ID NO: 2141918 - RNA, 20 nt, Staphylococcus aureus subsp. aureus N315
acucaaaaagccaacacauu

SEQ ID NO: 2141919 - RNA, 19 nt, Staphylococcus aureus subsp. aureus N315
acuauuuuugaaaagagcg

SEQ ID NO: 2141920 - RNA, 13 nt, Staphylococcus aureus subsp. aureus N315
acuauuuuaaaaa

SEQ ID NO: 2141921 - RNA, 17 nt, Staphylococcus aureus subsp. aureus N315
acuauuuuaaaaaugcu

SEQ ID NO: 2141922 - RNA, 18 nt, Staphylococcus aureus subsp. aureus N315
acucccgcaaauauuaaa

SEQ ID NO: 2141923 - RNA, 20 nt, Staphylococcus aureus subsp. aureus N315
acucccgcauuauuauuaaa

SEQ ID NO: 2141924 - RNA, 16 nt, Staphylococcus aureus subsp. aureus N315
acugcgacauguccau

SEQ ID NO: 2141925 - RNA, 16 nt, Staphylococcus aureus subsp. aureus N315
acugccuuuuuguaau

SEQ ID NO: 2141926 - RNA, 16 nt, Staphylococcus aureus subsp. aureus N315
acugccaauaaaaugc

SEQ ID NO: 2141927 - RNA, 14 nt, Staphylococcus aureus subsp. aureus N315
acugcauauaaagu

SEQ ID NO: 2141928 - RNA, 16 nt, Staphylococcus aureus subsp. aureus N315
acugcauauaaaguca

SEQ ID NO: 2141929 - RNA, 16 nt, Staphylococcus aureus subsp. aureus N315
acugaguuuuaaugaa

SEQ ID NO: 2141930 - RNA, 16 nt, Staphylococcus aureus subsp. aureus N315
acugauaaaaggggaa

SEQ ID NO: 2141931 - RNA, 22 nt, Staphylococcus aureus subsp. aureus N315
acugcaaauacgaguguuuuaa

SEQ ID NO: 2141932 - RNA, 16 nt, Staphylococcus aureus subsp. aureus N315
acucuuuuucuuucau

SEQ ID NO: 2141933 - RNA, 21 nt, Staphylococcus aureus subsp. aureus N315
acucuuuuucuuucauaauua

SEQ ID NO: 2141934 - RNA, 18 nt, Staphylococcus aureus subsp. aureus N315
acugaaacuaaauuaaaa

SEQ ID NO: 2141935 - RNA, 16 nt, Staphylococcus aureus subsp. aureus N315
acugaaacuaaauuaa

SEQ ID NO: 2141936 - RNA, 15 nt, Staphylococcus aureus subsp. aureus N315
aaucgccuacuauaa

SEQ ID NO: 2141937 - RNA, 16 nt, Staphylococcus aureus subsp. aureus N315
aaucgaaaauaucaau

SEQ ID NO: 2141938 - RNA, 23 nt, Staphylococcus aureus subsp. aureus N315
aauccaucaauaccauaauuaaa

SEQ ID NO: 2141939 - RNA, 23 nt, Staphylococcus aureus subsp. aureus N315
aaucccauaccuacaaauaugua

SEQ ID NO: 2141940 - RNA, 19 nt, Staphylococcus aureus subsp. aureus N315
aaucggacagaggagcuca

SEQ ID NO: 2141941 - RNA, 23 nt, Staphylococcus aureus subsp. aureus N315
aaucgcuucgguuaacuguucua

SEQ ID NO: 2141942 - RNA, 19 nt, Staphylococcus aureus subsp. aureus N315
aaucguaaacauaaugaca

SEQ ID NO: 2141943 - RNA, 18 nt, Staphylococcus aureus subsp. aureus N315
aaucggcuauacauugau

SEQ ID NO: 2141944 - RNA, 17 nt, Staphylococcus aureus subsp. aureus N315
aaucuccauuagaacua

SEQ ID NO: 2141945 - RNA, 13 nt, Staphylococcus aureus subsp. aureus N315
aaucuccauuaau

SEQ ID NO: 2141946 - RNA, 16 nt, Staphylococcus aureus subsp. aureus N315
aaucuccauuaaucau

SEQ ID NO: 2141947 - RNA, 18 nt, Staphylococcus aureus subsp. aureus N315
aaucuccauuaaucauuu

SEQ ID NO: 2141948 - RNA, 16 nt, Staphylococcus aureus subsp. aureus N315
aaucuauccuucaaaa

SEQ ID NO: 2141949 - RNA, 19 nt, Staphylococcus aureus subsp. aureus N315
aaucuauccuucaaaaguu

SEQ ID NO: 2141950 - RNA, 12 nt, Staphylococcus aureus subsp. aureus N315
aaucuauauaua

SEQ ID NO: 2141951 - RNA, 18 nt, Staphylococcus aureus subsp. aureus N315
aaucuauggaaaauguua

SEQ ID NO: 2141952 - RNA, 23 nt, Staphylococcus aureus subsp. aureus N315
aaucuccuugcucaugagcacaa

SEQ ID NO: 2141953 - RNA, 15 nt, Staphylococcus aureus subsp. aureus N315
aaucuauaccauucc

SEQ ID NO: 2141954 - RNA, 21 nt, Staphylococcus aureus subsp. aureus N315
aaucuauaccauuccaaaaau

SEQ ID NO: 2141955 - RNA, 18 nt, Staphylococcus aureus subsp. aureus N315
aaucuagaauauaacaac

SEQ ID NO: 2141956 - RNA, 19 nt, Staphylococcus aureus subsp. aureus N315
aaucguuguggcuuuuuau

SEQ ID NO: 2141957 - RNA, 15 nt, Staphylococcus aureus subsp. aureus N315
aaucguuucaugcac

SEQ ID NO: 2141958 - RNA, 14 nt, Staphylococcus aureus subsp. aureus N315
aaaaauuaaaaugu

SEQ ID NO: 2141959 - RNA, 14 nt, Staphylococcus aureus subsp. aureus N315
aaaaauuaaaaauu

SEQ ID NO: 2141960 - RNA, 16 nt, Staphylococcus aureus subsp. aureus N315
aaaaauuaaaaaacaa

SEQ ID NO: 2141961 - RNA, 12 nt, Staphylococcus aureus subsp. aureus N315
aaaaauuaaaaa

SEQ ID NO: 2141962 - RNA, 21 nt, Staphylococcus aureus subsp. aureus N315
aaaaauguguuaaaauauauu

SEQ ID NO: 2141963 - RNA, 18 nt, Staphylococcus aureus subsp. aureus N315
aaaaauguguuaaaauau

SEQ ID NO: 2141964 - RNA, 17 nt, Staphylococcus aureus subsp. aureus N315
aaucauagcauuaagau

SEQ ID NO: 2141965 - RNA, 13 nt, Staphylococcus aureus subsp. aureus N315
aaucauaaugaau

SEQ ID NO: 2141966 - RNA, 23 nt, Staphylococcus aureus subsp. aureus N315
aaucauaccggcaaauaacaaug

SEQ ID NO: 2141967 - RNA, 23 nt, Staphylococcus aureus subsp. aureus N315
aaucauaaugaauaauuaaaaaa

SEQ ID NO: 2141968 - RNA, 14 nt, Staphylococcus aureus subsp. aureus N315
aaucauaaugaaua

SEQ ID NO: 2141969 - RNA, 20 nt, Staphylococcus aureus subsp. aureus N315
aaucauaaugaauaauuaaa

SEQ ID NO: 2141970 - RNA, 16 nt, Staphylococcus aureus subsp. aureus N315
aaucauagcaacaucg

SEQ ID NO: 2141971 - RNA, 20 nt, Staphylococcus aureus subsp. aureus N315
aaucauagaggcacagugga

SEQ ID NO: 2141972 - RNA, 15 nt, Staphylococcus aureus subsp. aureus N315
aaucaguauuuacuu

SEQ ID NO: 2141973 - RNA, 16 nt, Staphylococcus aureus subsp. aureus N315
aaucagucauucacau

SEQ ID NO: 2141974 - RNA, 22 nt, Staphylococcus aureus subsp. aureus N315
aaucagguuuaaacaguuuaau

SEQ ID NO: 2141975 - RNA, 14 nt, Staphylococcus aureus subsp. aureus N315
aaucaguaauaaug

SEQ ID NO: 2141976 - RNA, 17 nt, Staphylococcus aureus subsp. aureus N315
aaucaguaauaucaagg

SEQ ID NO: 2141977 - RNA, 19 nt, Staphylococcus aureus subsp. aureus N315
aaucaguaguuuuaaaagu

SEQ ID NO: 2141978 - RNA, 16 nt, Staphylococcus aureus subsp. aureus N315
aauaugaaucuagaau

SEQ ID NO: 2141979 - RNA, 13 nt, Staphylococcus aureus subsp. aureus N315
aauaugacacaua

SEQ ID NO: 2141980 - RNA, 14 nt, Staphylococcus aureus subsp. aureus N315
aaucaucacacaua

SEQ ID NO: 2141981 - RNA, 12 nt, Staphylococcus aureus subsp. aureus N315
aaucaucauugc

SEQ ID NO: 2141982 - RNA, 14 nt, Staphylococcus aureus subsp. aureus N315
aaaaauuauuaaaa

SEQ ID NO: 2141983 - RNA, 18 nt, Staphylococcus aureus subsp. aureus N315
aaaaauuauuaaaaaaau

SEQ ID NO: 2141984 - RNA, 23 nt, Staphylococcus aureus subsp. aureus N315
aaucauguaaugcuuaaaaacaa

SEQ ID NO: 2141985 - RNA, 16 nt, Staphylococcus aureus subsp. aureus N315
aaucauccauaaaaau

SEQ ID NO: 2141986 - RNA, 21 nt, Staphylococcus aureus subsp. aureus N315
aaucaucgaacaugaaugaua

SEQ ID NO: 2141987 - RNA, 16 nt, Staphylococcus aureus subsp. aureus N315
aauccaagcaaucuua

SEQ ID NO: 2141988 - RNA, 17 nt, Staphylococcus aureus subsp. aureus N315
aauccaagugacaacau

SEQ ID NO: 2141989 - RNA, 22 nt, Staphylococcus aureus subsp. aureus N315
aaucauucuuuauagaaaccaa

SEQ ID NO: 2141990 - RNA, 15 nt, Staphylococcus aureus subsp. aureus N315
aaucauucguuuaau

SEQ ID NO: 2141991 - RNA, 13 nt, Staphylococcus aureus subsp. aureus N315
aauccaguaauca

SEQ ID NO: 2141992 - RNA, 19 nt, Staphylococcus aureus subsp. aureus N315
aauccaguaaucaaagauu

SEQ ID NO: 2141993 - RNA, 20 nt, Staphylococcus aureus subsp. aureus N315
aaugccugcccuuuagucau

SEQ ID NO: 2141994 - RNA, 17 nt, Staphylococcus aureus subsp. aureus N315
aaugcuaaaaguauaaa

SEQ ID NO: 2141995 - RNA, 21 nt, Staphylococcus aureus subsp. aureus N315
aaugcguggauguguuuuaau

SEQ ID NO: 2141996 - RNA, 20 nt, Staphylococcus aureus subsp. aureus N315
aaugcucuauauauccauuc

SEQ ID NO: 2141997 - RNA, 19 nt, Staphylococcus aureus subsp. aureus N315
aaugcucccuucaaaguag

SEQ ID NO: 2141998 - RNA, 20 nt, Staphylococcus aureus subsp. aureus N315
aaugcuauauuuagaaugau

SEQ ID NO: 2141999 - RNA, 15 nt, Staphylococcus aureus subsp. aureus N315
aaugcuacuauuaaa

SEQ ID NO: 2142000 - RNA, 12 nt, Staphylococcus aureus subsp. aureus N315
aaugcuauauuu

SEQ ID NO: 2142001 - RNA, 22 nt, Staphylococcus aureus subsp. aureus N315
aaugggaauuguauuagcaauu

SEQ ID NO: 2142002 - RNA, 18 nt, Staphylococcus aureus subsp. aureus N315
aaugggcgauaaaaguug

SEQ ID NO: 2142003 - RNA, 20 nt, Staphylococcus aureus subsp. aureus N315
aaugggcgugccauuaaaau

SEQ ID NO: 2142004 - RNA, 16 nt, Staphylococcus aureus subsp. aureus N315
aauggcaaucuauaua

SEQ ID NO: 2142005 - RNA, 19 nt, Staphylococcus aureus subsp. aureus N315
aauggcaaucuauauaaau

SEQ ID NO: 2142006 - RNA, 21 nt, Staphylococcus aureus subsp. aureus N315
aauggcaaucuauauaaaugu

SEQ ID NO: 2142007 - RNA, 15 nt, Staphylococcus aureus subsp. aureus N315
aauggaugaauauau

SEQ ID NO: 2142008 - RNA, 19 nt, Staphylococcus aureus subsp. aureus N315
aauggauuauuaugccuuu

SEQ ID NO: 2142009 - RNA, 17 nt, Staphylococcus aureus subsp. aureus N315
aaugcauuacuacuuua

SEQ ID NO: 2142010 - RNA, 13 nt, Staphylococcus aureus subsp. aureus N315
aaugcauagcucu

SEQ ID NO: 2142011 - RNA, 20 nt, Staphylococcus aureus subsp. aureus N315
aaugauugacgauuuaauua

SEQ ID NO: 2142012 - RNA, 22 nt, Staphylococcus aureus subsp. aureus N315
aaugauugacgauuuaauuaaa

SEQ ID NO: 2142013 - RNA, 23 nt, Staphylococcus aureus subsp. aureus N315
aaugauucuuaucuuuaaucaaa

SEQ ID NO: 2142014 - RNA, 22 nt, Staphylococcus aureus subsp. aureus N315
aaugauugaauauuguuguaaa

SEQ ID NO: 2142015 - RNA, 15 nt, Staphylococcus aureus subsp. aureus N315
aaugauugcauugau

SEQ ID NO: 2142016 - RNA, 16 nt, Staphylococcus aureus subsp. aureus N315
aaugccaaauauagua

SEQ ID NO: 2142017 - RNA, 14 nt, Staphylococcus aureus subsp. aureus N315
aaugauuauaaaua

SEQ ID NO: 2142018 - RNA, 21 nt, Staphylococcus aureus subsp. aureus N315
aaugauuacuuuaagauuauu

SEQ ID NO: 2142019 - RNA, 17 nt, Staphylococcus aureus subsp. aureus N315
aaugauuaaaaaucaaa

SEQ ID NO: 2142020 - RNA, 23 nt, Staphylococcus aureus subsp. aureus N315
aaugaugaguauacuuacugaaa

SEQ ID NO: 2142021 - RNA, 21 nt, Staphylococcus aureus subsp. aureus N315
aaugaugcauaagauuuugaa

SEQ ID NO: 2142022 - RNA, 17 nt, Staphylococcus aureus subsp. aureus N315
aaugauagugaauaaug

SEQ ID NO: 2142023 - RNA, 17 nt, Staphylococcus aureus subsp. aureus N315
aaugauaucuuuuccaa

SEQ ID NO: 2142024 - RNA, 16 nt, Staphylococcus aureus subsp. aureus N315
aaugauaauccaccaa

SEQ ID NO: 2142025 - RNA, 20 nt, Staphylococcus aureus subsp. aureus N315
aaugaucaucguauagaugu

SEQ ID NO: 2142026 - RNA, 14 nt, Staphylococcus aureus subsp. aureus N315
aaugaugacaucaa

SEQ ID NO: 2142027 - RNA, 21 nt, Staphylococcus aureus subsp. aureus N315
aaugacauuuaauacuuuucu

SEQ ID NO: 2142028 - RNA, 17 nt, Staphylococcus aureus subsp. aureus N315
aaugacauccauacaaa

SEQ ID NO: 2142029 - RNA, 15 nt, Staphylococcus aureus subsp. aureus N315
aaugaccauugucau

SEQ ID NO: 2142030 - RNA, 17 nt, Staphylococcus aureus subsp. aureus N315
aaugaauucuauccuaa

SEQ ID NO: 2142031 - RNA, 21 nt, Staphylococcus aureus subsp. aureus N315
aaugacagcagacuucuuuca

SEQ ID NO: 2142032 - RNA, 19 nt, Staphylococcus aureus subsp. aureus N315
aaugacuaugcaaaugaaa

SEQ ID NO: 2142033 - RNA, 17 nt, Staphylococcus aureus subsp. aureus N315
aaugacuauaacaccaa

SEQ ID NO: 2142034 - RNA, 23 nt, Staphylococcus aureus subsp. aureus N315
aaugacuauaacaccaauuaaau

SEQ ID NO: 2142035 - RNA, 13 nt, Staphylococcus aureus subsp. aureus N315
aaugacuaaaucg

SEQ ID NO: 2142036 - RNA, 20 nt, Staphylococcus aureus subsp. aureus N315
aaugacgugcuuuuaaaugu

SEQ ID NO: 2142037 - RNA, 15 nt, Staphylococcus aureus subsp. aureus N315
aaugauagcuaaaca

SEQ ID NO: 2142038 - RNA, 14 nt, Staphylococcus aureus subsp. aureus N315
aaugauaauuuaau

SEQ ID NO: 2142039 - RNA, 18 nt, Staphylococcus aureus subsp. aureus N315
aaugagugcuuauuuguu

SEQ ID NO: 2142040 - RNA, 20 nt, Staphylococcus aureus subsp. aureus N315
aaugacuucuuuauauuuau

SEQ ID NO: 2142041 - RNA, 21 nt, Staphylococcus aureus subsp. aureus N315
aaugacuguugguuugaucau

SEQ ID NO: 2142042 - RNA, 16 nt, Staphylococcus aureus subsp. aureus N315
aaugacugagaaaaau

SEQ ID NO: 2142043 - RNA, 14 nt, Staphylococcus aureus subsp. aureus N315
aaugacugaauuaa

SEQ ID NO: 2142044 - RNA, 15 nt, Staphylococcus aureus subsp. aureus N315
aaugagaaugugcuu

SEQ ID NO: 2142045 - RNA, 23 nt, Staphylococcus aureus subsp. aureus N315
aaugagaaugugcuuguaacaag

SEQ ID NO: 2142046 - RNA, 19 nt, Staphylococcus aureus subsp. aureus N315
aaugagcaucuugucuagu

SEQ ID NO: 2142047 - RNA, 18 nt, Staphylococcus aureus subsp. aureus N315
aaugaaaacagguggaag

SEQ ID NO: 2142048 - RNA, 21 nt, Staphylococcus aureus subsp. aureus N315
aaucuuuugagacguuuucca

SEQ ID NO: 2142049 - RNA, 18 nt, Staphylococcus aureus subsp. aureus N315
aaucuuguuggauuuuaa

SEQ ID NO: 2142050 - RNA, 17 nt, Staphylococcus aureus subsp. aureus N315
aaucuuguucuaauugu

SEQ ID NO: 2142051 - RNA, 22 nt, Staphylococcus aureus subsp. aureus N315
aaucuuguuggauuuuaacaag

SEQ ID NO: 2142052 - RNA, 15 nt, Staphylococcus aureus subsp. aureus N315
aaucuuuaucaguuu

SEQ ID NO: 2142053 - RNA, 14 nt, Staphylococcus aureus subsp. aureus N315
aaucuuuauuaaua

SEQ ID NO: 2142054 - RNA, 19 nt, Staphylococcus aureus subsp. aureus N315
aaucuuguuuucauuuaaa

SEQ ID NO: 2142055 - RNA, 21 nt, Staphylococcus aureus subsp. aureus N315
aaucuuuacuuguaauuaaua

SEQ ID NO: 2142056 - RNA, 15 nt, Staphylococcus aureus subsp. aureus N315
aaugaauuauuuaaa

SEQ ID NO: 2142057 - RNA, 13 nt, Staphylococcus aureus subsp. aureus N315
aaugaauguuaag

SEQ ID NO: 2142058 - RNA, 16 nt, Staphylococcus aureus subsp. aureus N315
aaugaaugaagacgaa

SEQ ID NO: 2142059 - RNA, 21 nt, Staphylococcus aureus subsp. aureus N315
aaugaaguaauauauaaaagu

SEQ ID NO: 2142060 - RNA, 18 nt, Staphylococcus aureus subsp. aureus N315
aaugaaguaauauauaaa

SEQ ID NO: 2142061 - RNA, 14 nt, Staphylococcus aureus subsp. aureus N315
aaugaauaauucca

SEQ ID NO: 2142062 - RNA, 12 nt, Staphylococcus aureus subsp. aureus N315
aaugaauaauug

SEQ ID NO: 2142063 - RNA, 19 nt, Staphylococcus aureus subsp. aureus N315
aaugaauaguaaucagcuu

SEQ ID NO: 2142064 - RNA, 23 nt, Staphylococcus aureus subsp. aureus N315
aaugaaccuuuacucauauugaa

SEQ ID NO: 2142065 - RNA, 18 nt, Staphylococcus aureus subsp. aureus N315
aaugaaccagcuaaccaa

SEQ ID NO: 2142066 - RNA, 20 nt, Staphylococcus aureus subsp. aureus N315
aaugaaccagcuaaccaaau

SEQ ID NO: 2142067 - RNA, 18 nt, Staphylococcus aureus subsp. aureus N315
aaugaacuucucuuaguu

SEQ ID NO: 2142068 - RNA, 14 nt, Staphylococcus aureus subsp. aureus N315
aaugaagaauacaa

SEQ ID NO: 2142069 - RNA, 15 nt, Staphylococcus aureus subsp. aureus N315
aaugaagaauacaaa

SEQ ID NO: 2142070 - RNA, 19 nt, Staphylococcus aureus subsp. aureus N315
aaugaagaauacaaauauu

SEQ ID NO: 2142071 - RNA, 23 nt, Staphylococcus aureus subsp. aureus N315
aaugaaaguaccuaaaauagaaa

SEQ ID NO: 2142072 - RNA, 21 nt, Staphylococcus aureus subsp. aureus N315
aauucgcaagccuucuauaua

SEQ ID NO: 2142073 - RNA, 20 nt, Staphylococcus aureus subsp. aureus N315
aauucgauuaucuacuauuu

SEQ ID NO: 2142074 - RNA, 18 nt, Staphylococcus aureus subsp. aureus N315
aauucaaaaugccaagaa

SEQ ID NO: 2142075 - RNA, 16 nt, Staphylococcus aureus subsp. aureus N315
aauucaauaaucuuag

SEQ ID NO: 2142076 - RNA, 17 nt, Staphylococcus aureus subsp. aureus N315
aauucaaguguauuaaa

SEQ ID NO: 2142077 - RNA, 17 nt, Staphylococcus aureus subsp. aureus N315
aauucaauauuaaucau

SEQ ID NO: 2142078 - RNA, 13 nt, Staphylococcus aureus subsp. aureus N315
aauucaagaacag

SEQ ID NO: 2142079 - RNA, 17 nt, Staphylococcus aureus subsp. aureus N315
aauucaagaccaugcaa

SEQ ID NO: 2142080 - RNA, 23 nt, Staphylococcus aureus subsp. aureus N315
aauucaacuuuaaucaaaaaaga

SEQ ID NO: 2142081 - RNA, 19 nt, Staphylococcus aureus subsp. aureus N315
aauucaacgucaucaaaac

SEQ ID NO: 2142082 - RNA, 14 nt, Staphylococcus aureus subsp. aureus N315
aauucuaaaagaau

SEQ ID NO: 2142083 - RNA, 15 nt, Staphylococcus aureus subsp. aureus N315
aauucuaaaagaauu

SEQ ID NO: 2142084 - RNA, 19 nt, Staphylococcus aureus subsp. aureus N315
aauucguuuugcuaaccau

SEQ ID NO: 2142085 - RNA, 13 nt, Staphylococcus aureus subsp. aureus N315
aauucguugauuu

SEQ ID NO: 2142086 - RNA, 22 nt, Staphylococcus aureus subsp. aureus N315
aauucgcucacaugugaaauaa

SEQ ID NO: 2142087 - RNA, 22 nt, Staphylococcus aureus subsp. aureus N315
aauucgccuaaaugguuuugaa

SEQ ID NO: 2142088 - RNA, 20 nt, Staphylococcus aureus subsp. aureus N315
aauucugguuuaaugagcuu

SEQ ID NO: 2142089 - RNA, 21 nt, Staphylococcus aureus subsp. aureus N315
aauucuucaaccauuuguucu

SEQ ID NO: 2142090 - RNA, 15 nt, Staphylococcus aureus subsp. aureus N315
aauucuuaaaaagca

SEQ ID NO: 2142091 - RNA, 22 nt, Staphylococcus aureus subsp. aureus N315
aauucuucaucaauaacuauaa

SEQ ID NO: 2142092 - RNA, 16 nt, Staphylococcus aureus subsp. aureus N315
aauucuucaaauuuaa

SEQ ID NO: 2142093 - RNA, 12 nt, Staphylococcus aureus subsp. aureus N315
aauucuucauca

SEQ ID NO: 2142094 - RNA, 16 nt, Staphylococcus aureus subsp. aureus N315
aauucuucaucuucuu

SEQ ID NO: 2142095 - RNA, 14 nt, Staphylococcus aureus subsp. aureus N315
aauugaauaucacu

SEQ ID NO: 2142096 - RNA, 21 nt, Staphylococcus aureus subsp. aureus N315
aauugaauuucgcacaauguu

SEQ ID NO: 2142097 - RNA, 18 nt, Staphylococcus aureus subsp. aureus N315
aauugaaucuuuguuaua

SEQ ID NO: 2142098 - RNA, 23 nt, Staphylococcus aureus subsp. aureus N315
aauugaauauuuuucaauuaaau

SEQ ID NO: 2142099 - RNA, 18 nt, Staphylococcus aureus subsp. aureus N315
aauugacgcauuaaugau

SEQ ID NO: 2142100 - RNA, 19 nt, Staphylococcus aureus subsp. aureus N315
aauugacgcauuaaugauu

SEQ ID NO: 2142101 - RNA, 19 nt, Staphylococcus aureus subsp. aureus N315
aauugacuuacauuuuaau

SEQ ID NO: 2142102 - RNA, 22 nt, Staphylococcus aureus subsp. aureus N315
aauugacuuacauuuuaauaaa

SEQ ID NO: 2142103 - RNA, 20 nt, Staphylococcus aureus subsp. aureus N315
aauugagagaaguuucuaua

SEQ ID NO: 2142104 - RNA, 14 nt, Staphylococcus aureus subsp. aureus N315
aauugaugauuacu

SEQ ID NO: 2142105 - RNA, 16 nt, Staphylococcus aureus subsp. aureus N315
aauugaguuguugcaa

SEQ ID NO: 2142106 - RNA, 22 nt, Staphylococcus aureus subsp. aureus N315
aauugaguuguugcaacuugug

SEQ ID NO: 2142107 - RNA, 23 nt, Staphylococcus aureus subsp. aureus N315
aauugaguauuaaauuugaaagu

SEQ ID NO: 2142108 - RNA, 14 nt, Staphylococcus aureus subsp. aureus N315
aauugaguauuaaa

SEQ ID NO: 2142109 - RNA, 18 nt, Staphylococcus aureus subsp. aureus N315
aauugauuuugaaucaca

SEQ ID NO: 2142110 - RNA, 13 nt, Staphylococcus aureus subsp. aureus N315
aauugauugcucu

SEQ ID NO: 2142111 - RNA, 20 nt, Staphylococcus aureus subsp. aureus N315
aauugauuguggugaaauaa

SEQ ID NO: 2142112 - RNA, 15 nt, Staphylococcus aureus subsp. aureus N315
aaaacaaaaauaauc

SEQ ID NO: 2142113 - RNA, 15 nt, Staphylococcus aureus subsp. aureus N315
aauugcaauggcaac

SEQ ID NO: 2142114 - RNA, 23 nt, Staphylococcus aureus subsp. aureus N315
aauuaaucaccuuauugaugaaa

SEQ ID NO: 2142115 - RNA, 16 nt, Staphylococcus aureus subsp. aureus N315
aauuaaucaauuuaau

SEQ ID NO: 2142116 - RNA, 13 nt, Staphylococcus aureus subsp. aureus N315
aauuaaugauaaa

SEQ ID NO: 2142117 - RNA, 22 nt, Staphylococcus aureus subsp. aureus N315
aauuaauucgccuaaaugguuu

SEQ ID NO: 2142118 - RNA, 20 nt, Staphylococcus aureus subsp. aureus N315
aauuaauuacuuucauugua

SEQ ID NO: 2142119 - RNA, 18 nt, Staphylococcus aureus subsp. aureus N315
aauuaauugcuuucacau

SEQ ID NO: 2142120 - RNA, 14 nt, Staphylococcus aureus subsp. aureus N315
aauuaauuaucuua

SEQ ID NO: 2142121 - RNA, 21 nt, Staphylococcus aureus subsp. aureus N315
aauuaccuuuccauucguaua

SEQ ID NO: 2142122 - RNA, 16 nt, Staphylococcus aureus subsp. aureus N315
aauuaccguuuauuuc

SEQ ID NO: 2142123 - RNA, 21 nt, Staphylococcus aureus subsp. aureus N315
aauuaccguuuauuucgugga

SEQ ID NO: 2142124 - RNA, 16 nt, Staphylococcus aureus subsp. aureus N315
aauuacgacaagaauu

SEQ ID NO: 2142125 - RNA, 18 nt, Staphylococcus aureus subsp. aureus N315
aauuacagguuuaaacau

SEQ ID NO: 2142126 - RNA, 23 nt, Staphylococcus aureus subsp. aureus N315
aauuacagguuuaaacaucuaua

SEQ ID NO: 2142127 - RNA, 17 nt, Staphylococcus aureus subsp. aureus N315
aauuaccaaugaauaaa

SEQ ID NO: 2142128 - RNA, 22 nt, Staphylococcus aureus subsp. aureus N315
aauguacuuuucugucuguaaa

SEQ ID NO: 2142129 - RNA, 21 nt, Staphylococcus aureus subsp. aureus N315
aauguaggcgccauaaucauu

SEQ ID NO: 2142130 - RNA, 13 nt, Staphylococcus aureus subsp. aureus N315
aauguaucauuuc

SEQ ID NO: 2142131 - RNA, 15 nt, Staphylococcus aureus subsp. aureus N315
aauguauauuuaaca

SEQ ID NO: 2142132 - RNA, 19 nt, Staphylococcus aureus subsp. aureus N315
aauuaauagagacauuuua

SEQ ID NO: 2142133 - RNA, 15 nt, Staphylococcus aureus subsp. aureus N315
aauuaauacaucaau

SEQ ID NO: 2142134 - RNA, 17 nt, Staphylococcus aureus subsp. aureus N315
aauuaauacaucaauau

SEQ ID NO: 2142135 - RNA, 22 nt, Staphylococcus aureus subsp. aureus N315
aauguauucagucaguaaaaau

SEQ ID NO: 2142136 - RNA, 15 nt, Staphylococcus aureus subsp. aureus N315
aauguauuaaacauu

SEQ ID NO: 2142137 - RNA, 19 nt, Staphylococcus aureus subsp. aureus N315
aauguauucagucaguaaa

SEQ ID NO: 2142138 - RNA, 19 nt, Staphylococcus aureus subsp. aureus N315
aauuagaaaaauaugauug

SEQ ID NO: 2142139 - RNA, 13 nt, Staphylococcus aureus subsp. aureus N315
aauuagaaccauc

SEQ ID NO: 2142140 - RNA, 19 nt, Staphylococcus aureus subsp. aureus N315
aauuagaaccaucauucau

SEQ ID NO: 2142141 - RNA, 21 nt, Staphylococcus aureus subsp. aureus N315
aauuacuuuaacaguuguaau

SEQ ID NO: 2142142 - RNA, 13 nt, Staphylococcus aureus subsp. aureus N315
aauuagaaauucu

SEQ ID NO: 2142143 - RNA, 17 nt, Staphylococcus aureus subsp. aureus N315
aauuacuuaauaguaac

SEQ ID NO: 2142144 - RNA, 19 nt, Staphylococcus aureus subsp. aureus N315
aauuacuaaccuaaagaua

SEQ ID NO: 2142145 - RNA, 14 nt, Staphylococcus aureus subsp. aureus N315
aauuacucuuuuuc

SEQ ID NO: 2142146 - RNA, 15 nt, Staphylococcus aureus subsp. aureus N315
aauuauguaaaaaau

SEQ ID NO: 2142147 - RNA, 15 nt, Staphylococcus aureus subsp. aureus N315
aauuauuaauuuaau

SEQ ID NO: 2142148 - RNA, 14 nt, Staphylococcus aureus subsp. aureus N315
aauuauuucaauua

SEQ ID NO: 2142149 - RNA, 16 nt, Staphylococcus aureus subsp. aureus N315
aauuauuaauuuaauc

SEQ ID NO: 2142150 - RNA, 11 nt, Staphylococcus aureus subsp. aureus N315
aauuauuucau

SEQ ID NO: 2142151 - RNA, 13 nt, Staphylococcus aureus subsp. aureus N315
aauuauuucucuu

SEQ ID NO: 2142152 - RNA, 14 nt, Staphylococcus aureus subsp. aureus N315
aauuauuuuaaaaa

SEQ ID NO: 2142153 - RNA, 18 nt, Staphylococcus aureus subsp. aureus N315
aauuauuuuucaaauaua

SEQ ID NO: 2142154 - RNA, 16 nt, Staphylococcus aureus subsp. aureus N315
aauuauuuuucaaaua

SEQ ID NO: 2142155 - RNA, 23 nt, Staphylococcus aureus subsp. aureus N315
aauuaugauuauauuuucucaua

SEQ ID NO: 2142156 - RNA, 18 nt, Staphylococcus aureus subsp. aureus N315
aauuagucccauuaacac

SEQ ID NO: 2142157 - RNA, 14 nt, Staphylococcus aureus subsp. aureus N315
aauuagucccauua

SEQ ID NO: 2142158 - RNA, 19 nt, Staphylococcus aureus subsp. aureus N315
aauuagggugaacaguuag

SEQ ID NO: 2142159 - RNA, 23 nt, Staphylococcus aureus subsp. aureus N315
aauuagguauaguguuugacaag

SEQ ID NO: 2142160 - RNA, 17 nt, Staphylococcus aureus subsp. aureus N315
aauuaggauuaacauaa

SEQ ID NO: 2142161 - RNA, 17 nt, Staphylococcus aureus subsp. aureus N315
aauuuguauuuaaaauc

SEQ ID NO: 2142162 - RNA, 21 nt, Staphylococcus aureus subsp. aureus N315
aauuuguauaaagauuuaagu

SEQ ID NO: 2142163 - RNA, 17 nt, Staphylococcus aureus subsp. aureus N315
aauuuguccauccauuu

SEQ ID NO: 2142164 - RNA, 19 nt, Staphylococcus aureus subsp. aureus N315
aauuugugcauucaucaau

SEQ ID NO: 2142165 - RNA, 15 nt, Staphylococcus aureus subsp. aureus N315
aauuuguuuuaaaua

SEQ ID NO: 2142166 - RNA, 14 nt, Staphylococcus aureus subsp. aureus N315
aauuuguaauuccu

SEQ ID NO: 2142167 - RNA, 17 nt, Staphylococcus aureus subsp. aureus N315
aauuugguuaacauccu

SEQ ID NO: 2142168 - RNA, 21 nt, Staphylococcus aureus subsp. aureus N315
aauuuuaaauauugauauaaa

SEQ ID NO: 2142169 - RNA, 11 nt, Staphylococcus aureus subsp. aureus N315
aauuuuaaauc

SEQ ID NO: 2142170 - RNA, 15 nt, Staphylococcus aureus subsp. aureus N315
aauuuuaauauauuu

SEQ ID NO: 2142171 - RNA, 22 nt, Staphylococcus aureus subsp. aureus N315
aauuuuaaugaguaguuucucu

SEQ ID NO: 2142172 - RNA, 20 nt, Staphylococcus aureus subsp. aureus N315
aauuuuaauuaauuaucaua

SEQ ID NO: 2142173 - RNA, 21 nt, Staphylococcus aureus subsp. aureus N315
aauuugagccauuguuauuau

SEQ ID NO: 2142174 - RNA, 14 nt, Staphylococcus aureus subsp. aureus N315
aauuucuuuaaagu

SEQ ID NO: 2142175 - RNA, 16 nt, Staphylococcus aureus subsp. aureus N315
aauuugcacaaagaua

SEQ ID NO: 2142176 - RNA, 16 nt, Staphylococcus aureus subsp. aureus N315
aauuugcaaaaucaac

SEQ ID NO: 2142177 - RNA, 15 nt, Staphylococcus aureus subsp. aureus N315
aauuuucuugccauc

SEQ ID NO: 2142178 - RNA, 12 nt, Staphylococcus aureus subsp. aureus N315
aauuuucuuuuu

SEQ ID NO: 2142179 - RNA, 15 nt, Staphylococcus aureus subsp. aureus N315
aauuuucuaaauaua

SEQ ID NO: 2142180 - RNA, 18 nt, Staphylococcus aureus subsp. aureus N315
aauuuuuaugcauuauag

SEQ ID NO: 2142181 - RNA, 19 nt, Staphylococcus aureus subsp. aureus N315
aauuuuuaugcauuauaga

SEQ ID NO: 2142182 - RNA, 16 nt, Staphylococcus aureus subsp. aureus N315
aauuuuuauuuuuagu

SEQ ID NO: 2142183 - RNA, 14 nt, Staphylococcus aureus subsp. aureus N315
aauuuuuaacaaaa

SEQ ID NO: 2142184 - RNA, 23 nt, Staphylococcus aureus subsp. aureus N315
aauuuuuaguuagggaaauguag

SEQ ID NO: 2142185 - RNA, 13 nt, Staphylococcus aureus subsp. aureus N315
aauuuuucauuaa

SEQ ID NO: 2142186 - RNA, 20 nt, Staphylococcus aureus subsp. aureus N315
aauuuuucuaaaugauuuau

SEQ ID NO: 2142187 - RNA, 22 nt, Staphylococcus aureus subsp. aureus N315
aauuuuccguguuuauuuuuau

SEQ ID NO: 2142188 - RNA, 16 nt, Staphylococcus aureus subsp. aureus N315
aauuuucaauuagaaa

SEQ ID NO: 2142189 - RNA, 22 nt, Staphylococcus aureus subsp. aureus N315
aauuuuaugucccaaugcugaa

SEQ ID NO: 2142190 - RNA, 17 nt, Staphylococcus aureus subsp. aureus N315
aauuuuauuagguaaua

SEQ ID NO: 2142191 - RNA, 22 nt, Staphylococcus aureus subsp. aureus N315
aauuuuaucuaaagcuauaaaa

SEQ ID NO: 2142192 - RNA, 16 nt, Staphylococcus aureus subsp. aureus N315
aauuuauuauaaaaua

SEQ ID NO: 2142193 - RNA, 13 nt, Staphylococcus aureus subsp. aureus N315
aauuuauuauaaa

SEQ ID NO: 2142194 - RNA, 12 nt, Staphylococcus aureus subsp. aureus N315
aauuuauuauaa

SEQ ID NO: 2142195 - RNA, 22 nt, Staphylococcus aureus subsp. aureus N315
aauuuauguguugugauauaua

SEQ ID NO: 2142196 - RNA, 20 nt, Staphylococcus aureus subsp. aureus N315
aauuuauguugcguuaaaua

SEQ ID NO: 2142197 - RNA, 12 nt, Staphylococcus aureus subsp. aureus N315
aauuucaaaaau

SEQ ID NO: 2142198 - RNA, 21 nt, Staphylococcus aureus subsp. aureus N315
aauuucaagguauacacaaau

SEQ ID NO: 2142199 - RNA, 15 nt, Staphylococcus aureus subsp. aureus N315
aauuucaaaauagua

SEQ ID NO: 2142200 - RNA, 14 nt, Staphylococcus aureus subsp. aureus N315
aauuucaauaaugu

SEQ ID NO: 2142201 - RNA, 18 nt, Staphylococcus aureus subsp. aureus N315
aauuucaaugucugcauc

SEQ ID NO: 2142202 - RNA, 16 nt, Staphylococcus aureus subsp. aureus N315
aauuuagaugcauaaa

SEQ ID NO: 2142203 - RNA, 15 nt, Staphylococcus aureus subsp. aureus N315
aauuuagcaaauauu

SEQ ID NO: 2142204 - RNA, 17 nt, Staphylococcus aureus subsp. aureus N315
aauuuagauauuauaaa

SEQ ID NO: 2142205 - RNA, 12 nt, Staphylococcus aureus subsp. aureus N315
aauuuagaugca

SEQ ID NO: 2142206 - RNA, 15 nt, Staphylococcus aureus subsp. aureus N315
aauuuaucaauuucu

SEQ ID NO: 2142207 - RNA, 18 nt, Staphylococcus aureus subsp. aureus N315
aauuuaucaauuucuauu

SEQ ID NO: 2142208 - RNA, 15 nt, Staphylococcus aureus subsp. aureus N315
aauuuaaagcaucau

SEQ ID NO: 2142209 - RNA, 20 nt, Staphylococcus aureus subsp. aureus N315
aauuuaaagucuucaucuuu

SEQ ID NO: 2142210 - RNA, 18 nt, Staphylococcus aureus subsp. aureus N315
aauuuaaagcaucauaua

SEQ ID NO: 2142211 - RNA, 22 nt, Staphylococcus aureus subsp. aureus N315
aauuuaaagcaucauauacaua

SEQ ID NO: 2142212 - RNA, 11 nt, Staphylococcus aureus subsp. aureus N315
aauuuaaauaa

SEQ ID NO: 2142213 - RNA, 14 nt, Staphylococcus aureus subsp. aureus N315
aauugcguuuaaua

SEQ ID NO: 2142214 - RNA, 19 nt, Staphylococcus aureus subsp. aureus N315
aauugcuaaaaaaauuaaa

SEQ ID NO: 2142215 - RNA, 15 nt, Staphylococcus aureus subsp. aureus N315
aauugcuaaaaaaau

SEQ ID NO: 2142216 - RNA, 14 nt, Staphylococcus aureus subsp. aureus N315
aauuuaacaucuuu

SEQ ID NO: 2142217 - RNA, 10 nt, Staphylococcus aureus subsp. aureus N315
aauuuaaaug

SEQ ID NO: 2142218 - RNA, 21 nt, Staphylococcus aureus subsp. aureus N315
aauuuacucaaaccaucuuau

SEQ ID NO: 2142219 - RNA, 17 nt, Staphylococcus aureus subsp. aureus N315
aauuuacucaaaccauc

SEQ ID NO: 2142220 - RNA, 13 nt, Staphylococcus aureus subsp. aureus N315
aauuucgcacaau

SEQ ID NO: 2142221 - RNA, 23 nt, Staphylococcus aureus subsp. aureus N315
aauuucgacaucuagaugaaauu

SEQ ID NO: 2142222 - RNA, 14 nt, Staphylococcus aureus subsp. aureus N315
aauuucgcaguagc

SEQ ID NO: 2142223 - RNA, 14 nt, Staphylococcus aureus subsp. aureus N315
aauuucgaaaagaa

SEQ ID NO: 2142224 - RNA, 17 nt, Staphylococcus aureus subsp. aureus N315
aauuucuaugaaaaaaa

SEQ ID NO: 2142225 - RNA, 23 nt, Staphylococcus aureus subsp. aureus N315
aauuucuauuuauugagauagaa

SEQ ID NO: 2142226 - RNA, 12 nt, Staphylococcus aureus subsp. aureus N315
aauuucuauuua

SEQ ID NO: 2142227 - RNA, 17 nt, Staphylococcus aureus subsp. aureus N315
aauuucugcuucuuuua

SEQ ID NO: 2142228 - RNA, 19 nt, Staphylococcus aureus subsp. aureus N315
aauuucauuugaaauaguu

SEQ ID NO: 2142229 - RNA, 16 nt, Staphylococcus aureus subsp. aureus N315
aauuuccaauaucuuc

SEQ ID NO: 2142230 - RNA, 16 nt, Staphylococcus aureus subsp. aureus N315
aauuuccaaaguaaua

SEQ ID NO: 2142231 - RNA, 20 nt, Staphylococcus aureus subsp. aureus N315
aauuucauaguuaucgauuu

SEQ ID NO: 2142232 - RNA, 19 nt, Staphylococcus aureus subsp. aureus N315
aauuucauaguuaucgauu

SEQ ID NO: 2142233 - RNA, 19 nt, Staphylococcus aureus subsp. aureus N315
aauuucaguaccauguuuu

SEQ ID NO: 2142234 - RNA, 14 nt, Staphylococcus aureus subsp. aureus N315
aauuucaguaccau

SEQ ID NO: 2142235 - RNA, 23 nt, Staphylococcus aureus subsp. aureus N315
aauuucaauuuggaaauaucuua

SEQ ID NO: 2142236 - RNA, 17 nt, Staphylococcus aureus subsp. aureus N315
aauuucaauuuggaaau

SEQ ID NO: 2142237 - RNA, 17 nt, Staphylococcus aureus subsp. aureus N315
aauuucaccuuguaaau

SEQ ID NO: 2142238 - RNA, 16 nt, Staphylococcus aureus subsp. aureus N315
accacuugaauacuuu

SEQ ID NO: 2142239 - RNA, 14 nt, Staphylococcus aureus subsp. aureus N315
accacuucuucacc

SEQ ID NO: 2142240 - RNA, 17 nt, Staphylococcus aureus subsp. aureus N315
accacuucuucaccugc

SEQ ID NO: 2142241 - RNA, 23 nt, Staphylococcus aureus subsp. aureus N315
accacuugaauacuuuuuaacug

SEQ ID NO: 2142242 - RNA, 19 nt, Staphylococcus aureus subsp. aureus N315
accacuggccuuuaaugau

SEQ ID NO: 2142243 - RNA, 14 nt, Staphylococcus aureus subsp. aureus N315
accacuaagugaac

SEQ ID NO: 2142244 - RNA, 19 nt, Staphylococcus aureus subsp. aureus N315
accacuauaauuucuuaau

SEQ ID NO: 2142245 - RNA, 20 nt, Staphylococcus aureus subsp. aureus N315
accacucaauucucuaacuu

SEQ ID NO: 2142246 - RNA, 15 nt, Staphylococcus aureus subsp. aureus N315
accaccccaacuugc

SEQ ID NO: 2142247 - RNA, 21 nt, Staphylococcus aureus subsp. aureus N315
accaccuacgcccaucaucac

SEQ ID NO: 2142248 - RNA, 17 nt, Staphylococcus aureus subsp. aureus N315
accacacuuuaaacaag

SEQ ID NO: 2142249 - RNA, 23 nt, Staphylococcus aureus subsp. aureus N315
accacacuuuaaacaagcaucau

SEQ ID NO: 2142250 - RNA, 15 nt, Staphylococcus aureus subsp. aureus N315
accacaaauaucaau

SEQ ID NO: 2142251 - RNA, 15 nt, Staphylococcus aureus subsp. aureus N315
accacaccaugcugc

SEQ ID NO: 2142252 - RNA, 16 nt, Staphylococcus aureus subsp. aureus N315
accaauugaaauuaac

SEQ ID NO: 2142253 - RNA, 14 nt, Staphylococcus aureus subsp. aureus N315
accaauugaauauu

SEQ ID NO: 2142254 - RNA, 15 nt, Staphylococcus aureus subsp. aureus N315
accaauugaaauuaa

SEQ ID NO: 2142255 - RNA, 20 nt, Staphylococcus aureus subsp. aureus N315
accaaugauagugaauaaug

SEQ ID NO: 2142256 - RNA, 11 nt, Staphylococcus aureus subsp. aureus N315
accaauaauua

SEQ ID NO: 2142257 - RNA, 17 nt, Staphylococcus aureus subsp. aureus N315
accaaucaauaguuuau

SEQ ID NO: 2142258 - RNA, 22 nt, Staphylococcus aureus subsp. aureus N315
acauuucgguaugauauuucua

SEQ ID NO: 2142259 - RNA, 23 nt, Staphylococcus aureus subsp. aureus N315
acauuucccauuuaucuaacaau

SEQ ID NO: 2142260 - RNA, 14 nt, Staphylococcus aureus subsp. aureus N315
acauuucuauacaa

SEQ ID NO: 2142261 - RNA, 24 nt, Staphylococcus aureus subsp. aureus N315
accaagugcuuuuuuaccagcaug

SEQ ID NO: 2142262 - RNA, 14 nt, Staphylococcus aureus subsp. aureus N315
accaaguucacuaa

SEQ ID NO: 2142263 - RNA, 15 nt, Staphylococcus aureus subsp. aureus N315
acaucgccaauuuga

SEQ ID NO: 2142264 - RNA, 19 nt, Staphylococcus aureus subsp. aureus N315
acaucgcauaauaucuuac

SEQ ID NO: 2142265 - RNA, 15 nt, Staphylococcus aureus subsp. aureus N315
acauccccaaaaaua

SEQ ID NO: 2142266 - RNA, 23 nt, Staphylococcus aureus subsp. aureus N315
acaucuuucgagguaauuucacc

SEQ ID NO: 2142267 - RNA, 20 nt, Staphylococcus aureus subsp. aureus N315
acaucuuuuuaaaaggugug

SEQ ID NO: 2142268 - RNA, 17 nt, Staphylococcus aureus subsp. aureus N315
acaucuuuuguuguuuu

SEQ ID NO: 2142269 - RNA, 14 nt, Staphylococcus aureus subsp. aureus N315
acaugaacaaucag

SEQ ID NO: 2142270 - RNA, 21 nt, Staphylococcus aureus subsp. aureus N315
acaugaacaaucagauaaguu

SEQ ID NO: 2142271 - RNA, 20 nt, Staphylococcus aureus subsp. aureus N315
acauguuuggaugaacaaaa

SEQ ID NO: 2142272 - RNA, 19 nt, Staphylococcus aureus subsp. aureus N315
acauguuuggaugaacaaa

SEQ ID NO: 2142273 - RNA, 14 nt, Staphylococcus aureus subsp. aureus N315
acaugccaauggaa

SEQ ID NO: 2142274 - RNA, 15 nt, Staphylococcus aureus subsp. aureus N315
acaugauacugaaau

SEQ ID NO: 2142275 - RNA, 12 nt, Staphylococcus aureus subsp. aureus N315
acaugauaauuu

SEQ ID NO: 2142276 - RNA, 18 nt, Staphylococcus aureus subsp. aureus N315
acaugauacugaaauuuc

SEQ ID NO: 2142277 - RNA, 17 nt, Staphylococcus aureus subsp. aureus N315
acaugauacugaaauuu

SEQ ID NO: 2142278 - RNA, 13 nt, Staphylococcus aureus subsp. aureus N315
acauuauuaaaua

SEQ ID NO: 2142279 - RNA, 20 nt, Staphylococcus aureus subsp. aureus N315
acauuauguucuucaccagu

SEQ ID NO: 2142280 - RNA, 16 nt, Staphylococcus aureus subsp. aureus N315
acauuaucaagaauaa

SEQ ID NO: 2142281 - RNA, 16 nt, Staphylococcus aureus subsp. aureus N315
acauuauuuauauuua

SEQ ID NO: 2142282 - RNA, 21 nt, Staphylococcus aureus subsp. aureus N315
acauuauuguaaguuggcuua

SEQ ID NO: 2142283 - RNA, 13 nt, Staphylococcus aureus subsp. aureus N315
acauuauugaaau

SEQ ID NO: 2142284 - RNA, 15 nt, Staphylococcus aureus subsp. aureus N315
acauuaaaaugauau

SEQ ID NO: 2142285 - RNA, 23 nt, Staphylococcus aureus subsp. aureus N315
acauuaaagaaaauaucugaaaa

SEQ ID NO: 2142286 - RNA, 20 nt, Staphylococcus aureus subsp. aureus N315
acauucagugcaaugauagc

SEQ ID NO: 2142287 - RNA, 19 nt, Staphylococcus aureus subsp. aureus N315
acauuauuuauauuuagaa

SEQ ID NO: 2142288 - RNA, 22 nt, Staphylococcus aureus subsp. aureus N315
acauucaaauaaaugacauuua

SEQ ID NO: 2142289 - RNA, 21 nt, Staphylococcus aureus subsp. aureus N315
acauucaaauaaaugacauuu

SEQ ID NO: 2142290 - RNA, 12 nt, Staphylococcus aureus subsp. aureus N315
acauuccaucuu

SEQ ID NO: 2142291 - RNA, 17 nt, Staphylococcus aureus subsp. aureus N315
acauucauuuaguuaaa

SEQ ID NO: 2142292 - RNA, 21 nt, Staphylococcus aureus subsp. aureus N315
acauucauuuaguuaaauaca

SEQ ID NO: 2142293 - RNA, 16 nt, Staphylococcus aureus subsp. aureus N315
acauuccucuauugua

SEQ ID NO: 2142294 - RNA, 12 nt, Staphylococcus aureus subsp. aureus N315
acauucuaugua

SEQ ID NO: 2142295 - RNA, 19 nt, Staphylococcus aureus subsp. aureus N315
acauugccacuuuuguguu

SEQ ID NO: 2142296 - RNA, 17 nt, Staphylococcus aureus subsp. aureus N315
acauuucagcauuugcu

SEQ ID NO: 2142297 - RNA, 21 nt, Staphylococcus aureus subsp. aureus N315
acauuguaaauauaguaauaa

SEQ ID NO: 2142298 - RNA, 16 nt, Staphylococcus aureus subsp. aureus N315
acauugguuuuuacua

SEQ ID NO: 2142299 - RNA, 18 nt, Staphylococcus aureus subsp. aureus N315
acauuuaucgugaagaaa

SEQ ID NO: 2142300 - RNA, 21 nt, Staphylococcus aureus subsp. aureus N315
acauuuauucuuucucuauua

SEQ ID NO: 2142301 - RNA, 14 nt, Staphylococcus aureus subsp. aureus N315
acauuuauuuucaa

SEQ ID NO: 2142302 - RNA, 20 nt, Staphylococcus aureus subsp. aureus N315
acauuuauucuuucucuauu

SEQ ID NO: 2142303 - RNA, 17 nt, Staphylococcus aureus subsp. aureus N315
acauuuauucuuucucu

SEQ ID NO: 2142304 - RNA, 19 nt, Staphylococcus aureus subsp. aureus N315
acauaccaguggaaauuau

SEQ ID NO: 2142305 - RNA, 22 nt, Staphylococcus aureus subsp. aureus N315
acauaauuaacuuucuuuuguu

SEQ ID NO: 2142306 - RNA, 20 nt, Staphylococcus aureus subsp. aureus N315
acauaauuuaucaauuucua

SEQ ID NO: 2142307 - RNA, 16 nt, Staphylococcus aureus subsp. aureus N315
acauaauuuaucugca

SEQ ID NO: 2142308 - RNA, 16 nt, Staphylococcus aureus subsp. aureus N315
acauaauuuuuauuua

SEQ ID NO: 2142309 - RNA, 22 nt, Staphylococcus aureus subsp. aureus N315
acauaauuuuuauuuacacaca

SEQ ID NO: 2142310 - RNA, 18 nt, Staphylococcus aureus subsp. aureus N315
acauaauuuuuauuuaca

SEQ ID NO: 2142311 - RNA, 22 nt, Staphylococcus aureus subsp. aureus N315
acaggaugguggggucauaaca

SEQ ID NO: 2142312 - RNA, 15 nt, Staphylococcus aureus subsp. aureus N315
acauacugauuaaac

SEQ ID NO: 2142313 - RNA, 14 nt, Staphylococcus aureus subsp. aureus N315
acauagaaaagcag

SEQ ID NO: 2142314 - RNA, 22 nt, Staphylococcus aureus subsp. aureus N315
acauagaauaacgucauauguu

SEQ ID NO: 2142315 - RNA, 17 nt, Staphylococcus aureus subsp. aureus N315
acauagacacuuaacuu

SEQ ID NO: 2142316 - RNA, 17 nt, Staphylococcus aureus subsp. aureus N315
acauagaugcuucaaaa

SEQ ID NO: 2142317 - RNA, 14 nt, Staphylococcus aureus subsp. aureus N315
acauacuauaaaaa

SEQ ID NO: 2142318 - RNA, 14 nt, Staphylococcus aureus subsp. aureus N315
acauacugauuaaa

SEQ ID NO: 2142319 - RNA, 19 nt, Staphylococcus aureus subsp. aureus N315
acauagguauaaucauuua

SEQ ID NO: 2142320 - RNA, 22 nt, Staphylococcus aureus subsp. aureus N315
acauaguuucuucuauuauauu

SEQ ID NO: 2142321 - RNA, 13 nt, Staphylococcus aureus subsp. aureus N315
acauauaagaauu

SEQ ID NO: 2142322 - RNA, 18 nt, Staphylococcus aureus subsp. aureus N315
acauauaaaaaauuauua

SEQ ID NO: 2142323 - RNA, 16 nt, Staphylococcus aureus subsp. aureus N315
acauauaaaaaauuau

SEQ ID NO: 2142324 - RNA, 19 nt, Staphylococcus aureus subsp. aureus N315
acauaucacgagcuuuuaa

SEQ ID NO: 2142325 - RNA, 18 nt, Staphylococcus aureus subsp. aureus N315
acauaucgucaauuuuaa

SEQ ID NO: 2142326 - RNA, 19 nt, Staphylococcus aureus subsp. aureus N315
acauauuuauacugaucaa

SEQ ID NO: 2142327 - RNA, 19 nt, Staphylococcus aureus subsp. aureus N315
acauauguacuauuaucua

SEQ ID NO: 2142328 - RNA, 23 nt, Staphylococcus aureus subsp. aureus N315
acauaugucuuucuaaguuugaa

SEQ ID NO: 2142329 - RNA, 19 nt, Staphylococcus aureus subsp. aureus N315
acauauguguaugauagaa

SEQ ID NO: 2142330 - RNA, 20 nt, Staphylococcus aureus subsp. aureus N315
acauauguguaugauagaau

SEQ ID NO: 2142331 - RNA, 15 nt, Staphylococcus aureus subsp. aureus N315
acauauuauaaaagu

SEQ ID NO: 2142332 - RNA, 14 nt, Staphylococcus aureus subsp. aureus N315
acaucaaauuuuuc

SEQ ID NO: 2142333 - RNA, 19 nt, Staphylococcus aureus subsp. aureus N315
acaucaaauagacaccaaa

SEQ ID NO: 2142334 - RNA, 21 nt, Staphylococcus aureus subsp. aureus N315
acaucacuauacgcaaucauu

SEQ ID NO: 2142335 - RNA, 21 nt, Staphylococcus aureus subsp. aureus N315
acaucauaauaaaucuaucua

SEQ ID NO: 2142336 - RNA, 23 nt, Staphylococcus aureus subsp. aureus N315
acaucaguaaaaacgaaauuguu

SEQ ID NO: 2142337 - RNA, 21 nt, Staphylococcus aureus subsp. aureus N315
acauccacuuuauaauuuuug

SEQ ID NO: 2142338 - RNA, 12 nt, Staphylococcus aureus subsp. aureus N315
acagaaaacaaa

SEQ ID NO: 2142339 - RNA, 22 nt, Staphylococcus aureus subsp. aureus N315
acagaaaaucguuauaaguaca

SEQ ID NO: 2142340 - RNA, 22 nt, Staphylococcus aureus subsp. aureus N315
acacuuggcuuaggaugaaaau

SEQ ID NO: 2142341 - RNA, 13 nt, Staphylococcus aureus subsp. aureus N315
acagacaaacauu

SEQ ID NO: 2142342 - RNA, 14 nt, Staphylococcus aureus subsp. aureus N315
acagacaaacauua

SEQ ID NO: 2142343 - RNA, 16 nt, Staphylococcus aureus subsp. aureus N315
acagaauuucaucaaa

SEQ ID NO: 2142344 - RNA, 14 nt, Staphylococcus aureus subsp. aureus N315
acagaauuucauca

SEQ ID NO: 2142345 - RNA, 22 nt, Staphylococcus aureus subsp. aureus N315
acagagaaauucgaaaagaaau

SEQ ID NO: 2142346 - RNA, 23 nt, Staphylococcus aureus subsp. aureus N315
acagagaaauucgaaaagaaauu

SEQ ID NO: 2142347 - RNA, 19 nt, Staphylococcus aureus subsp. aureus N315
acacuaaaaccuauuccua

SEQ ID NO: 2142348 - RNA, 23 nt, Staphylococcus aureus subsp. aureus N315
acacguucuugguauuuuuuaaa

SEQ ID NO: 2142349 - RNA, 20 nt, Staphylococcus aureus subsp. aureus N315
acacguucuugguauuuuuu

SEQ ID NO: 2142350 - RNA, 21 nt, Staphylococcus aureus subsp. aureus N315
acacguguauuguauuuuaau

SEQ ID NO: 2142351 - RNA, 21 nt, Staphylococcus aureus subsp. aureus N315
acacuagucuuuuuauuuuaa

SEQ ID NO: 2142352 - RNA, 12 nt, Staphylococcus aureus subsp. aureus N315
acacuauuauag

SEQ ID NO: 2142353 - RNA, 22 nt, Staphylococcus aureus subsp. aureus N315
acacuucaacauauaaaucauu

SEQ ID NO: 2142354 - RNA, 22 nt, Staphylococcus aureus subsp. aureus N315
acacuguuuuauaaaugaauua

SEQ ID NO: 2142355 - RNA, 17 nt, Staphylococcus aureus subsp. aureus N315
acacugcacaucauaau

SEQ ID NO: 2142356 - RNA, 15 nt, Staphylococcus aureus subsp. aureus N315
acacugcacaucaua

SEQ ID NO: 2142357 - RNA, 16 nt, Staphylococcus aureus subsp. aureus N315
acacucggaaacaugu

SEQ ID NO: 2142358 - RNA, 17 nt, Staphylococcus aureus subsp. aureus N315
acacugagaauuucuaa

SEQ ID NO: 2142359 - RNA, 16 nt, Staphylococcus aureus subsp. aureus N315
acagauuuuaaaaauu

SEQ ID NO: 2142360 - RNA, 19 nt, Staphylococcus aureus subsp. aureus N315
acagauuuuaaaaauucau

SEQ ID NO: 2142361 - RNA, 23 nt, Staphylococcus aureus subsp. aureus N315
acagauuuaccucuugauaaaau

SEQ ID NO: 2142362 - RNA, 23 nt, Staphylococcus aureus subsp. aureus N315
acagaucucaauccaauuaaaua

SEQ ID NO: 2142363 - RNA, 16 nt, Staphylococcus aureus subsp. aureus N315
acagaugaugcuucgc

SEQ ID NO: 2142364 - RNA, 16 nt, Staphylococcus aureus subsp. aureus N315
acagaugaugcuucuc

SEQ ID NO: 2142365 - RNA, 22 nt, Staphylococcus aureus subsp. aureus N315
acagagaaucaauuauugaaaa

SEQ ID NO: 2142366 - RNA, 23 nt, Staphylococcus aureus subsp. aureus N315
acagagaauuucgaaaagaaauu

SEQ ID NO: 2142367 - RNA, 15 nt, Staphylococcus aureus subsp. aureus N315
acagauaaagcuucg

SEQ ID NO: 2142368 - RNA, 22 nt, Staphylococcus aureus subsp. aureus N315
acagcguauuuuaaugauuuuu

SEQ ID NO: 2142369 - RNA, 22 nt, Staphylococcus aureus subsp. aureus N315
acagcgugauucaucuauuauu

SEQ ID NO: 2142370 - RNA, 13 nt, Staphylococcus aureus subsp. aureus N315
acagcuucaaaau

SEQ ID NO: 2142371 - RNA, 20 nt, Staphylococcus aureus subsp. aureus N315
acagcauuuccuaugugcug

SEQ ID NO: 2142372 - RNA, 17 nt, Staphylococcus aureus subsp. aureus N315
acagcggaauacagaug

SEQ ID NO: 2142373 - RNA, 13 nt, Staphylococcus aureus subsp. aureus N315
acacaucacuaua

SEQ ID NO: 2142374 - RNA, 16 nt, Staphylococcus aureus subsp. aureus N315
acacaugcacuuuauu

SEQ ID NO: 2142375 - RNA, 16 nt, Staphylococcus aureus subsp. aureus N315
acacagguaaauuuaa

SEQ ID NO: 2142376 - RNA, 20 nt, Staphylococcus aureus subsp. aureus N315
acacagguaaauuuaaaaua

SEQ ID NO: 2142377 - RNA, 22 nt, Staphylococcus aureus subsp. aureus N315
acacagagaauuucgaaaagaa

SEQ ID NO: 2142378 - RNA, 23 nt, Staphylococcus aureus subsp. aureus N315
acacagaagcugacgaaaaguca

SEQ ID NO: 2142379 - RNA, 14 nt, Staphylococcus aureus subsp. aureus N315
acacacuaaaagcu

SEQ ID NO: 2142380 - RNA, 18 nt, Staphylococcus aureus subsp. aureus N315
acacacuaaggaaaauua

SEQ ID NO: 2142381 - RNA, 17 nt, Staphylococcus aureus subsp. aureus N315
acaauuuaaacgcacua

SEQ ID NO: 2142382 - RNA, 17 nt, Staphylococcus aureus subsp. aureus N315
acaauuuauuaaaacga

SEQ ID NO: 2142383 - RNA, 20 nt, Staphylococcus aureus subsp. aureus N315
acacacaugauaauuuuuag

SEQ ID NO: 2142384 - RNA, 21 nt, Staphylococcus aureus subsp. aureus N315
acacacaugauaauuuuuagu

SEQ ID NO: 2142385 - RNA, 22 nt, Staphylococcus aureus subsp. aureus N315
acaauuguauaaugugcgucac

SEQ ID NO: 2142386 - RNA, 14 nt, Staphylococcus aureus subsp. aureus N315
acaauuguaguaau

SEQ ID NO: 2142387 - RNA, 16 nt, Staphylococcus aureus subsp. aureus N315
acaauuauaaaugauu

SEQ ID NO: 2142388 - RNA, 15 nt, Staphylococcus aureus subsp. aureus N315
acaauuauaauaaaa

SEQ ID NO: 2142389 - RNA, 20 nt, Staphylococcus aureus subsp. aureus N315
acaaucuuaucauaaucuuc

SEQ ID NO: 2142390 - RNA, 19 nt, Staphylococcus aureus subsp. aureus N315
acaaucuccauuagaacua

SEQ ID NO: 2142391 - RNA, 15 nt, Staphylococcus aureus subsp. aureus N315
acaaugaaaaaacga

SEQ ID NO: 2142392 - RNA, 22 nt, Staphylococcus aureus subsp. aureus N315
acaaucuuguagggaagauuug

SEQ ID NO: 2142393 - RNA, 21 nt, Staphylococcus aureus subsp. aureus N315
acaauggaugccgcucuuuuu

SEQ ID NO: 2142394 - RNA, 20 nt, Staphylococcus aureus subsp. aureus N315
acaagcaucaugaaauuaga

SEQ ID NO: 2142395 - RNA, 16 nt, Staphylococcus aureus subsp. aureus N315
acaagccaagauaaau

SEQ ID NO: 2142396 - RNA, 15 nt, Staphylococcus aureus subsp. aureus N315
acaagcaucaugaaa

SEQ ID NO: 2142397 - RNA, 17 nt, Staphylococcus aureus subsp. aureus N315
acaagaacuuagaaaug

SEQ ID NO: 2142398 - RNA, 19 nt, Staphylococcus aureus subsp. aureus N315
acaagaacuuagaaaugca

SEQ ID NO: 2142399 - RNA, 22 nt, Staphylococcus aureus subsp. aureus N315
acaagucuuuacucuacacuca

SEQ ID NO: 2142400 - RNA, 23 nt, Staphylococcus aureus subsp. aureus N315
acaagucuaguucgaacacacac

SEQ ID NO: 2142401 - RNA, 13 nt, Staphylococcus aureus subsp. aureus N315
acaagucauuauc

SEQ ID NO: 2142402 - RNA, 20 nt, Staphylococcus aureus subsp. aureus N315
acaaguauaaaugcagcugu

SEQ ID NO: 2142403 - RNA, 18 nt, Staphylococcus aureus subsp. aureus N315
acaaguauacuugaagaa

SEQ ID NO: 2142404 - RNA, 14 nt, Staphylococcus aureus subsp. aureus N315
acaaguauaaaugc

SEQ ID NO: 2142405 - RNA, 15 nt, Staphylococcus aureus subsp. aureus N315
acaaguauaaaugca

SEQ ID NO: 2142406 - RNA, 16 nt, Staphylococcus aureus subsp. aureus N315
acaagucauuauccaa

SEQ ID NO: 2142407 - RNA, 17 nt, Staphylococcus aureus subsp. aureus N315
acaauaacuguucuuuc

SEQ ID NO: 2142408 - RNA, 18 nt, Staphylococcus aureus subsp. aureus N315
acaagucuuuacucuaca

SEQ ID NO: 2142409 - RNA, 15 nt, Staphylococcus aureus subsp. aureus N315
acaauaacuguucuu

SEQ ID NO: 2142410 - RNA, 16 nt, Staphylococcus aureus subsp. aureus N315
acaacuuuaauuuuuc

SEQ ID NO: 2142411 - RNA, 23 nt, Staphylococcus aureus subsp. aureus N315
acaacuucuucuccguauuuacc

SEQ ID NO: 2142412 - RNA, 21 nt, Staphylococcus aureus subsp. aureus N315
acaacuuuguuuucaguaacu

SEQ ID NO: 2142413 - RNA, 13 nt, Staphylococcus aureus subsp. aureus N315
acaacugauuuaa

SEQ ID NO: 2142414 - RNA, 17 nt, Staphylococcus aureus subsp. aureus N315
acaacuaauaacaaaua

SEQ ID NO: 2142415 - RNA, 17 nt, Staphylococcus aureus subsp. aureus N315
aauuuuugggaagaaua

SEQ ID NO: 2142416 - RNA, 16 nt, Staphylococcus aureus subsp. aureus N315
aauuuuuuauuaagac

SEQ ID NO: 2142417 - RNA, 15 nt, Staphylococcus aureus subsp. aureus N315
aauuuuuuauuaaga

SEQ ID NO: 2142418 - RNA, 17 nt, Staphylococcus aureus subsp. aureus N315
aauuuuuugugccucuu

SEQ ID NO: 2142419 - RNA, 14 nt, Staphylococcus aureus subsp. aureus N315
aagccuacuuuguc

SEQ ID NO: 2142420 - RNA, 17 nt, Staphylococcus aureus subsp. aureus N315
aagccuucaauaguuuc

SEQ ID NO: 2142421 - RNA, 14 nt, Staphylococcus aureus subsp. aureus N315
aagccuucuauaua

SEQ ID NO: 2142422 - RNA, 18 nt, Staphylococcus aureus subsp. aureus N315
aagaucauuuucaacaua

SEQ ID NO: 2142423 - RNA, 13 nt, Staphylococcus aureus subsp. aureus N315
aagcgauuuccau

SEQ ID NO: 2142424 - RNA, 14 nt, Staphylococcus aureus subsp. aureus N315
aagcgcaauuaaaa

SEQ ID NO: 2142425 - RNA, 18 nt, Staphylococcus aureus subsp. aureus N315
aagcgcaggcgaaccgaa

SEQ ID NO: 2142426 - RNA, 12 nt, Staphylococcus aureus subsp. aureus N315
aagcgcagugac

SEQ ID NO: 2142427 - RNA, 19 nt, Staphylococcus aureus subsp. aureus N315
aagcgccugucucauuagc

SEQ ID NO: 2142428 - RNA, 23 nt, Staphylococcus aureus subsp. aureus N315
aagcuaauucauauucaaauuua

SEQ ID NO: 2142429 - RNA, 13 nt, Staphylococcus aureus subsp. aureus N315
aagcuaaugcaag

SEQ ID NO: 2142430 - RNA, 17 nt, Staphylococcus aureus subsp. aureus N315
aagcuaauucauauuca

SEQ ID NO: 2142431 - RNA, 18 nt, Staphylococcus aureus subsp. aureus N315
aagcucaauaaauuauga

SEQ ID NO: 2142432 - RNA, 17 nt, Staphylococcus aureus subsp. aureus N315
aagcuaucguaaacaac

SEQ ID NO: 2142433 - RNA, 18 nt, Staphylococcus aureus subsp. aureus N315
aagcuaucguaaacaaca

SEQ ID NO: 2142434 - RNA, 17 nt, Staphylococcus aureus subsp. aureus N315
aagcuaucuucagauuc

SEQ ID NO: 2142435 - RNA, 19 nt, Staphylococcus aureus subsp. aureus N315
aagcuauaaaaaaucuuuu

SEQ ID NO: 2142436 - RNA, 16 nt, Staphylococcus aureus subsp. aureus N315
aagcuauauaugaauu

SEQ ID NO: 2142437 - RNA, 14 nt, Staphylococcus aureus subsp. aureus N315
aagcuauaaaaaau

SEQ ID NO: 2142438 - RNA, 15 nt, Staphylococcus aureus subsp. aureus N315
aagcuuuaguuaaau

SEQ ID NO: 2142439 - RNA, 17 nt, Staphylococcus aureus subsp. aureus N315
aagcuuuaguuaaauag

SEQ ID NO: 2142440 - RNA, 12 nt, Staphylococcus aureus subsp. aureus N315
aaggacaggaau

SEQ ID NO: 2142441 - RNA, 16 nt, Staphylococcus aureus subsp. aureus N315
aaggaugaguuuaaaa

SEQ ID NO: 2142442 - RNA, 15 nt, Staphylococcus aureus subsp. aureus N315
aaggaugaguuuaaa

SEQ ID NO: 2142443 - RNA, 23 nt, Staphylococcus aureus subsp. aureus N315
aaggaauaauuuuaaaaauaaaa

SEQ ID NO: 2142444 - RNA, 21 nt, Staphylococcus aureus subsp. aureus N315
aaggaagucaccauauuuaac

SEQ ID NO: 2142445 - RNA, 22 nt, Staphylococcus aureus subsp. aureus N315
aaggaacguguucuaaaaguug

SEQ ID NO: 2142446 - RNA, 22 nt, Staphylococcus aureus subsp. aureus N315
aaggaaucguaaagcuguuggu

SEQ ID NO: 2142447 - RNA, 22 nt, Staphylococcus aureus subsp. aureus N315
aaggauguacuauaaauccuaa

SEQ ID NO: 2142448 - RNA, 16 nt, Staphylococcus aureus subsp. aureus N315
aaggauguuauaaaau

SEQ ID NO: 2142449 - RNA, 21 nt, Staphylococcus aureus subsp. aureus N315
aaggcaauuuuccguguuuau

SEQ ID NO: 2142450 - RNA, 14 nt, Staphylococcus aureus subsp. aureus N315
aaggcucauuuguu

SEQ ID NO: 2142451 - RNA, 20 nt, Staphylococcus aureus subsp. aureus N315
aaggcuagcuaaaauuugcu

SEQ ID NO: 2142452 - RNA, 15 nt, Staphylococcus aureus subsp. aureus N315
aaguugaauauaaaa

SEQ ID NO: 2142453 - RNA, 20 nt, Staphylococcus aureus subsp. aureus N315
aaguuaaucagaaaagcagu

SEQ ID NO: 2142454 - RNA, 14 nt, Staphylococcus aureus subsp. aureus N315
aaguuaauuaugua

SEQ ID NO: 2142455 - RNA, 15 nt, Staphylococcus aureus subsp. aureus N315
aaguuacaauaucau

SEQ ID NO: 2142456 - RNA, 15 nt, Staphylococcus aureus subsp. aureus N315
aaguuaaucagaaaa

SEQ ID NO: 2142457 - RNA, 18 nt, Staphylococcus aureus subsp. aureus N315
aaguuaagucgccuaacu

SEQ ID NO: 2142458 - RNA, 13 nt, Staphylococcus aureus subsp. aureus N315
aaguuaagucgcc

SEQ ID NO: 2142459 - RNA, 18 nt, Staphylococcus aureus subsp. aureus N315
aaguuauuuggauauuua

SEQ ID NO: 2142460 - RNA, 20 nt, Staphylococcus aureus subsp. aureus N315
aaguuaugaugggaaaaaau

SEQ ID NO: 2142461 - RNA, 19 nt, Staphylococcus aureus subsp. aureus N315
aaguuaucugcuuuucuau

SEQ ID NO: 2142462 - RNA, 14 nt, Staphylococcus aureus subsp. aureus N315
aaguguuauaaaua

SEQ ID NO: 2142463 - RNA, 15 nt, Staphylococcus aureus subsp. aureus N315
aaguguuaaugucuu

SEQ ID NO: 2142464 - RNA, 15 nt, Staphylococcus aureus subsp. aureus N315
aaguguuucaacaua

SEQ ID NO: 2142465 - RNA, 16 nt, Staphylococcus aureus subsp. aureus N315
aaguguugaggcguuu

SEQ ID NO: 2142466 - RNA, 20 nt, Staphylococcus aureus subsp. aureus N315
aaguguuucaacauauuaua

SEQ ID NO: 2142467 - RNA, 19 nt, Staphylococcus aureus subsp. aureus N315
aaguuaaaauugguuugga

SEQ ID NO: 2142468 - RNA, 18 nt, Staphylococcus aureus subsp. aureus N315
aaguuaacuauaacaaua

SEQ ID NO: 2142469 - RNA, 23 nt, Staphylococcus aureus subsp. aureus N315
aaguuaaaaccuuuucaaauuau

SEQ ID NO: 2142470 - RNA, 12 nt, Staphylococcus aureus subsp. aureus N315
aaguuaaaaccu

SEQ ID NO: 2142471 - RNA, 22 nt, Staphylococcus aureus subsp. aureus N315
aaguuaaaaccuuuucaaauua

SEQ ID NO: 2142472 - RNA, 19 nt, Staphylococcus aureus subsp. aureus N315
aagugccuugccaugauuu

SEQ ID NO: 2142473 - RNA, 17 nt, Staphylococcus aureus subsp. aureus N315
aagugcgguuauuuaua

SEQ ID NO: 2142474 - RNA, 23 nt, Staphylococcus aureus subsp. aureus N315
aagugcgguuuaaucuauauaua

SEQ ID NO: 2142475 - RNA, 22 nt, Staphylococcus aureus subsp. aureus N315
aagugcgggggauuauuuauau

SEQ ID NO: 2142476 - RNA, 22 nt, Staphylococcus aureus subsp. aureus N315
aagucucuuuugauaaauuccc

SEQ ID NO: 2142477 - RNA, 17 nt, Staphylococcus aureus subsp. aureus N315
aagugaagauauuuaua

SEQ ID NO: 2142478 - RNA, 18 nt, Staphylococcus aureus subsp. aureus N315
aagugaagauauuuauaa

SEQ ID NO: 2142479 - RNA, 22 nt, Staphylococcus aureus subsp. aureus N315
aagugaacuauuaaaaccaaaa

SEQ ID NO: 2142480 - RNA, 20 nt, Staphylococcus aureus subsp. aureus N315
aagugaaaguauuagauaua

SEQ ID NO: 2142481 - RNA, 19 nt, Staphylococcus aureus subsp. aureus N315
aagucuaguucgaacacac

SEQ ID NO: 2142482 - RNA, 16 nt, Staphylococcus aureus subsp. aureus N315
aagucauuuucauuca

SEQ ID NO: 2142483 - RNA, 13 nt, Staphylococcus aureus subsp. aureus N315
aagucauuaaaug

SEQ ID NO: 2142484 - RNA, 13 nt, Staphylococcus aureus subsp. aureus N315
aagucauuuucau

SEQ ID NO: 2142485 - RNA, 12 nt, Staphylococcus aureus subsp. aureus N315
aagucgaaagua

SEQ ID NO: 2142486 - RNA, 17 nt, Staphylococcus aureus subsp. aureus N315
aaguccggcugaaggga

SEQ ID NO: 2142487 - RNA, 13 nt, Staphylococcus aureus subsp. aureus N315
aaguauaugaauc

SEQ ID NO: 2142488 - RNA, 21 nt, Staphylococcus aureus subsp. aureus N315
aaguauaugaaucgauauaau

SEQ ID NO: 2142489 - RNA, 19 nt, Staphylococcus aureus subsp. aureus N315
aaguauaaguagcucaaaa

SEQ ID NO: 2142490 - RNA, 21 nt, Staphylococcus aureus subsp. aureus N315
aaguauacuugaagaaucagg

SEQ ID NO: 2142491 - RNA, 17 nt, Staphylococcus aureus subsp. aureus N315
aaguauacuaaacuuuu

SEQ ID NO: 2142492 - RNA, 22 nt, Staphylococcus aureus subsp. aureus N315
aaguauggcgaaauguuuugga

SEQ ID NO: 2142493 - RNA, 14 nt, Staphylococcus aureus subsp. aureus N315
aaguauggcaguuu

SEQ ID NO: 2142494 - RNA, 20 nt, Staphylococcus aureus subsp. aureus N315
aaguaucgccaucauucacc

SEQ ID NO: 2142495 - RNA, 17 nt, Staphylococcus aureus subsp. aureus N315
aaguaucggugauuuaa

SEQ ID NO: 2142496 - RNA, 19 nt, Staphylococcus aureus subsp. aureus N315
aaguaucugugaauaugcu

SEQ ID NO: 2142497 - RNA, 20 nt, Staphylococcus aureus subsp. aureus N315
aaguaucugugaauaugcuu

SEQ ID NO: 2142498 - RNA, 21 nt, Staphylococcus aureus subsp. aureus N315
aaguagucgaagaagauuaug

SEQ ID NO: 2142499 - RNA, 18 nt, Staphylococcus aureus subsp. aureus N315
aaguaguuguuauauucu

SEQ ID NO: 2142500 - RNA, 14 nt, Staphylococcus aureus subsp. aureus N315
aaguaguuguuaua

SEQ ID NO: 2142501 - RNA, 17 nt, Staphylococcus aureus subsp. aureus N315
aaguaguuguuauauuc

SEQ ID NO: 2142502 - RNA, 23 nt, Staphylococcus aureus subsp. aureus N315
aaguagcucaaaacaauuuaaaa

SEQ ID NO: 2142503 - RNA, 14 nt, Staphylococcus aureus subsp. aureus N315
aaguagauauugaa

SEQ ID NO: 2142504 - RNA, 13 nt, Staphylococcus aureus subsp. aureus N315
aagucaauuuaaa

SEQ ID NO: 2142505 - RNA, 15 nt, Staphylococcus aureus subsp. aureus N315
aagucaauaauuuua

SEQ ID NO: 2142506 - RNA, 16 nt, Staphylococcus aureus subsp. aureus N315
aaguauuuaaauaaca

SEQ ID NO: 2142507 - RNA, 20 nt, Staphylococcus aureus subsp. aureus N315
aaguaugucaucuucaauuc

SEQ ID NO: 2142508 - RNA, 22 nt, Staphylococcus aureus subsp. aureus N315
aaguaugucaucuucaauucuu

SEQ ID NO: 2142509 - RNA, 15 nt, Staphylococcus aureus subsp. aureus N315
aaguauuagauauau

SEQ ID NO: 2142510 - RNA, 14 nt, Staphylococcus aureus subsp. aureus N315
aaguauuaugauug

SEQ ID NO: 2142511 - RNA, 14 nt, Staphylococcus aureus subsp. aureus N315
aaguaaaauaaaaa

SEQ ID NO: 2142512 - RNA, 12 nt, Staphylococcus aureus subsp. aureus N315
aaguaaaacugc

SEQ ID NO: 2142513 - RNA, 15 nt, Staphylococcus aureus subsp. aureus N315
aaggggguaauacua

SEQ ID NO: 2142514 - RNA, 22 nt, Staphylococcus aureus subsp. aureus N315
aaguacgacgguauaaaaaaau

SEQ ID NO: 2142515 - RNA, 22 nt, Staphylococcus aureus subsp. aureus N315
aaguacuuaccuuucaaauaua

SEQ ID NO: 2142516 - RNA, 20 nt, Staphylococcus aureus subsp. aureus N315
aaguacuuuaaaauuguaua

SEQ ID NO: 2142517 - RNA, 16 nt, Staphylococcus aureus subsp. aureus N315
aaguacuuacaaauau

SEQ ID NO: 2142518 - RNA, 14 nt, Staphylococcus aureus subsp. aureus N315
aaguacuuuaccac

SEQ ID NO: 2142519 - RNA, 13 nt, Staphylococcus aureus subsp. aureus N315
aaguacuuuacca

SEQ ID NO: 2142520 - RNA, 14 nt, Staphylococcus aureus subsp. aureus N315
aaguagaagcaaaa

SEQ ID NO: 2142521 - RNA, 17 nt, Staphylococcus aureus subsp. aureus N315
aaguacaaauaauacag

SEQ ID NO: 2142522 - RNA, 23 nt, Staphylococcus aureus subsp. aureus N315
aaguaauggauugauaauagcuu

SEQ ID NO: 2142523 - RNA, 24 nt, Staphylococcus aureus subsp. aureus N315
aaguaaugcuguacuauauucaau

SEQ ID NO: 2142524 - RNA, 15 nt, Staphylococcus aureus subsp. aureus N315
aaguaauuaaauacu

SEQ ID NO: 2142525 - RNA, 14 nt, Staphylococcus aureus subsp. aureus N315
aaguaauuaaauac

SEQ ID NO: 2142526 - RNA, 14 nt, Staphylococcus aureus subsp. aureus N315
aaguacauaaaugc

SEQ ID NO: 2142527 - RNA, 19 nt, Staphylococcus aureus subsp. aureus N315
aaguaccuaaaauagaaaa

SEQ ID NO: 2142528 - RNA, 15 nt, Staphylococcus aureus subsp. aureus N315
aauauccaaaauccu

SEQ ID NO: 2142529 - RNA, 13 nt, Staphylococcus aureus subsp. aureus N315
aauaucaauuuuu

SEQ ID NO: 2142530 - RNA, 16 nt, Staphylococcus aureus subsp. aureus N315
aauaucauaaaugcau

SEQ ID NO: 2142531 - RNA, 17 nt, Staphylococcus aureus subsp. aureus N315
aauaucauaaaugcaua

SEQ ID NO: 2142532 - RNA, 16 nt, Staphylococcus aureus subsp. aureus N315
aauaucauauucaaaa

SEQ ID NO: 2142533 - RNA, 18 nt, Staphylococcus aureus subsp. aureus N315
aauaucauaccguacaaa

SEQ ID NO: 2142534 - RNA, 19 nt, Staphylococcus aureus subsp. aureus N315
aauaucauauuugaauacu

SEQ ID NO: 2142535 - RNA, 17 nt, Staphylococcus aureus subsp. aureus N315
aauaucaucaaguuuau

SEQ ID NO: 2142536 - RNA, 17 nt, Staphylococcus aureus subsp. aureus N315
aauaucuaccuuuuaau

SEQ ID NO: 2142537 - RNA, 13 nt, Staphylococcus aureus subsp. aureus N315
aauaucuucagcu

SEQ ID NO: 2142538 - RNA, 23 nt, Staphylococcus aureus subsp. aureus N315
aauaucuuacugcuguuuuuuau

SEQ ID NO: 2142539 - RNA, 13 nt, Staphylococcus aureus subsp. aureus N315
aauaucuucuuua

SEQ ID NO: 2142540 - RNA, 20 nt, Staphylococcus aureus subsp. aureus N315
aauauaccaaccaaaaccaa

SEQ ID NO: 2142541 - RNA, 15 nt, Staphylococcus aureus subsp. aureus N315
aauauaccaaccaaa

SEQ ID NO: 2142542 - RNA, 15 nt, Staphylococcus aureus subsp. aureus N315
aauauacacaaaaag

SEQ ID NO: 2142543 - RNA, 18 nt, Staphylococcus aureus subsp. aureus N315
aauauacuaaauuugaaa

SEQ ID NO: 2142544 - RNA, 23 nt, Staphylococcus aureus subsp. aureus N315
aauauacuuuuuaaaugauuuaa

SEQ ID NO: 2142545 - RNA, 17 nt, Staphylococcus aureus subsp. aureus N315
aauauagaaaaugagua

SEQ ID NO: 2142546 - RNA, 21 nt, Staphylococcus aureus subsp. aureus N315
aauauagaagugcgguuuaau

SEQ ID NO: 2142547 - RNA, 15 nt, Staphylococcus aureus subsp. aureus N315
aauauagauuuugua

SEQ ID NO: 2142548 - RNA, 16 nt, Staphylococcus aureus subsp. aureus N315
aauauagcugugauuu

SEQ ID NO: 2142549 - RNA, 22 nt, Staphylococcus aureus subsp. aureus N315
aauauagcuauuacuauaaaaa

SEQ ID NO: 2142550 - RNA, 20 nt, Staphylococcus aureus subsp. aureus N315
aauauacuuaauuuaaaucu

SEQ ID NO: 2142551 - RNA, 15 nt, Staphylococcus aureus subsp. aureus N315
aauauaauagaaaua

SEQ ID NO: 2142552 - RNA, 20 nt, Staphylococcus aureus subsp. aureus N315
aauauaauacuguauuuuaa

SEQ ID NO: 2142553 - RNA, 18 nt, Staphylococcus aureus subsp. aureus N315
aauauaauuaauuuugua

SEQ ID NO: 2142554 - RNA, 13 nt, Staphylococcus aureus subsp. aureus N315
aauauaaugaucc

SEQ ID NO: 2142555 - RNA, 13 nt, Staphylococcus aureus subsp. aureus N315
aauauaauuauua

SEQ ID NO: 2142556 - RNA, 15 nt, Staphylococcus aureus subsp. aureus N315
aauauaauuauuaaa

SEQ ID NO: 2142557 - RNA, 13 nt, Staphylococcus aureus subsp. aureus N315
aauauaauuuuuu

SEQ ID NO: 2142558 - RNA, 18 nt, Staphylococcus aureus subsp. aureus N315
aauauaucuaauacuuuc

SEQ ID NO: 2142559 - RNA, 16 nt, Staphylococcus aureus subsp. aureus N315
aauauauccugccaau

SEQ ID NO: 2142560 - RNA, 23 nt, Staphylococcus aureus subsp. aureus N315
aauauauccugccaauauauuca

SEQ ID NO: 2142561 - RNA, 23 nt, Staphylococcus aureus subsp. aureus N315
aauauauagcgcgcuuauugaaa

SEQ ID NO: 2142562 - RNA, 22 nt, Staphylococcus aureus subsp. aureus N315
aauauauaaggcgcucucuuuu

SEQ ID NO: 2142563 - RNA, 16 nt, Staphylococcus aureus subsp. aureus N315
aauauaguuaaaguua

SEQ ID NO: 2142564 - RNA, 15 nt, Staphylococcus aureus subsp. aureus N315
aauauaguuaaaguu

SEQ ID NO: 2142565 - RNA, 14 nt, Staphylococcus aureus subsp. aureus N315
aauaucaagauguu

SEQ ID NO: 2142566 - RNA, 13 nt, Staphylococcus aureus subsp. aureus N315
aauauauuuauuu

SEQ ID NO: 2142567 - RNA, 20 nt, Staphylococcus aureus subsp. aureus N315
aauauauugucgacuuuuag

SEQ ID NO: 2142568 - RNA, 20 nt, Staphylococcus aureus subsp. aureus N315
aauauaugaauaagucuaau

SEQ ID NO: 2142569 - RNA, 16 nt, Staphylococcus aureus subsp. aureus N315
aauauauuaauuuuac

SEQ ID NO: 2142570 - RNA, 17 nt, Staphylococcus aureus subsp. aureus N315
aauaguuaccaaaauuu

SEQ ID NO: 2142571 - RNA, 23 nt, Staphylococcus aureus subsp. aureus N315
aauaguuaccaaaauuugaaaua

SEQ ID NO: 2142572 - RNA, 18 nt, Staphylococcus aureus subsp. aureus N315
aauagucaauuaaugaua

SEQ ID NO: 2142573 - RNA, 18 nt, Staphylococcus aureus subsp. aureus N315
aauaguucuuuaaauuau

SEQ ID NO: 2142574 - RNA, 17 nt, Staphylococcus aureus subsp. aureus N315
aauaguucuuuaaauua

SEQ ID NO: 2142575 - RNA, 15 nt, Staphylococcus aureus subsp. aureus N315
aauaguuucaaugcc

SEQ ID NO: 2142576 - RNA, 14 nt, Staphylococcus aureus subsp. aureus N315
aauauaaaacgaua

SEQ ID NO: 2142577 - RNA, 13 nt, Staphylococcus aureus subsp. aureus N315
aauauaaaaaaga

SEQ ID NO: 2142578 - RNA, 13 nt, Staphylococcus aureus subsp. aureus N315
aauauaaauaaaa

SEQ ID NO: 2142579 - RNA, 18 nt, Staphylococcus aureus subsp. aureus N315
aauauaaaaggaagcauc

SEQ ID NO: 2142580 - RNA, 12 nt, Staphylococcus aureus subsp. aureus N315
aauauaaaauaa

SEQ ID NO: 2142581 - RNA, 14 nt, Staphylococcus aureus subsp. aureus N315
aauauaaauuuuga

SEQ ID NO: 2142582 - RNA, 14 nt, Staphylococcus aureus subsp. aureus N315
aauauaacaucaaa

SEQ ID NO: 2142583 - RNA, 21 nt, Staphylococcus aureus subsp. aureus N315
aauauaacaacuacuuaaauu

SEQ ID NO: 2142584 - RNA, 20 nt, Staphylococcus aureus subsp. aureus N315
aauagcuuucguuucuuuua

SEQ ID NO: 2142585 - RNA, 21 nt, Staphylococcus aureus subsp. aureus N315
aauagcuuucguuucuuuuau

SEQ ID NO: 2142586 - RNA, 22 nt, Staphylococcus aureus subsp. aureus N315
aauagcuuucguuucuuuuaua

SEQ ID NO: 2142587 - RNA, 20 nt, Staphylococcus aureus subsp. aureus N315
aauaggcaggaaugauauac

SEQ ID NO: 2142588 - RNA, 15 nt, Staphylococcus aureus subsp. aureus N315
aauaggcaggaauga

SEQ ID NO: 2142589 - RNA, 19 nt, Staphylococcus aureus subsp. aureus N315
aauaguaacauaagauaca

SEQ ID NO: 2142590 - RNA, 13 nt, Staphylococcus aureus subsp. aureus N315
aauaguaaaguga

SEQ ID NO: 2142591 - RNA, 16 nt, Staphylococcus aureus subsp. aureus N315
aauagguuauuugaua

SEQ ID NO: 2142592 - RNA, 20 nt, Staphylococcus aureus subsp. aureus N315
aauagguuauuugauaauga

SEQ ID NO: 2142593 - RNA, 19 nt, Staphylococcus aureus subsp. aureus N315
aauagguacaacuaaauau

SEQ ID NO: 2142594 - RNA, 22 nt, Staphylococcus aureus subsp. aureus N315
aauagaagguuauuuuuuaugg

SEQ ID NO: 2142595 - RNA, 20 nt, Staphylococcus aureus subsp. aureus N315
aauagaagguuauuuuuuau

SEQ ID NO: 2142596 - RNA, 23 nt, Staphylococcus aureus subsp. aureus N315
aauaccuaugauauaugcugcaa

SEQ ID NO: 2142597 - RNA, 23 nt, Staphylococcus aureus subsp. aureus N315
aauaccuaucccuguaaaaccau

SEQ ID NO: 2142598 - RNA, 17 nt, Staphylococcus aureus subsp. aureus N315
aauaccuaaccauaaca

SEQ ID NO: 2142599 - RNA, 19 nt, Staphylococcus aureus subsp. aureus N315
aauagacugccaauaaaau

SEQ ID NO: 2142600 - RNA, 17 nt, Staphylococcus aureus subsp. aureus N315
aauagcuauauuuaaaa

SEQ ID NO: 2142601 - RNA, 21 nt, Staphylococcus aureus subsp. aureus N315
aauagcuacaauuaaagugaa

SEQ ID NO: 2142602 - RNA, 20 nt, Staphylococcus aureus subsp. aureus N315
aauagcgucaucuggaauac

SEQ ID NO: 2142603 - RNA, 12 nt, Staphylococcus aureus subsp. aureus N315
aauagcugcaau

SEQ ID NO: 2142604 - RNA, 20 nt, Staphylococcus aureus subsp. aureus N315
aauagcgauuuuaaagaaaa

SEQ ID NO: 2142605 - RNA, 21 nt, Staphylococcus aureus subsp. aureus N315
aauagcgauuuuaaagaaaag

SEQ ID NO: 2142606 - RNA, 16 nt, Staphylococcus aureus subsp. aureus N315
aauaccccaaauagug

SEQ ID NO: 2142607 - RNA, 17 nt, Staphylococcus aureus subsp. aureus N315
aaaaauguaaauaaaaa

SEQ ID NO: 2142608 - RNA, 17 nt, Staphylococcus aureus subsp. aureus N315
aauaccauaauuaaaua

SEQ ID NO: 2142609 - RNA, 21 nt, Staphylococcus aureus subsp. aureus N315
aaaaaugccgagauuauuaug

SEQ ID NO: 2142610 - RNA, 21 nt, Staphylococcus aureus subsp. aureus N315
aaaaauggcgaaaaagcuaaa

SEQ ID NO: 2142611 - RNA, 22 nt, Staphylococcus aureus subsp. aureus N315
aaaaauggaaccacgucuuaau

SEQ ID NO: 2142612 - RNA, 19 nt, Staphylococcus aureus subsp. aureus N315
aaaaaugcugguaaauguu

SEQ ID NO: 2142613 - RNA, 15 nt, Staphylococcus aureus subsp. aureus N315
aauacacuugauaaa

SEQ ID NO: 2142614 - RNA, 16 nt, Staphylococcus aureus subsp. aureus N315
aauacacuugauaaaa

SEQ ID NO: 2142615 - RNA, 15 nt, Staphylococcus aureus subsp. aureus N315
aauacagaugaugcu

SEQ ID NO: 2142616 - RNA, 12 nt, Staphylococcus aureus subsp. aureus N315
aauacagaugau

SEQ ID NO: 2142617 - RNA, 22 nt, Staphylococcus aureus subsp. aureus N315
aauacaugaguaaaacucaugc

SEQ ID NO: 2142618 - RNA, 16 nt, Staphylococcus aureus subsp. aureus N315
aauacauguauuugaa

SEQ ID NO: 2142619 - RNA, 19 nt, Staphylococcus aureus subsp. aureus N315
aauacaugugggauaucuu

SEQ ID NO: 2142620 - RNA, 20 nt, Staphylococcus aureus subsp. aureus N315
aauacaugugggauaucuuc

SEQ ID NO: 2142621 - RNA, 16 nt, Staphylococcus aureus subsp. aureus N315
aauacauuucaaaaaa

SEQ ID NO: 2142622 - RNA, 19 nt, Staphylococcus aureus subsp. aureus N315
aauaauacgcuugauaaaa

SEQ ID NO: 2142623 - RNA, 14 nt, Staphylococcus aureus subsp. aureus N315
aauaauacuacaua

SEQ ID NO: 2142624 - RNA, 16 nt, Staphylococcus aureus subsp. aureus N315
aauaauacuacauaua

SEQ ID NO: 2142625 - RNA, 16 nt, Staphylococcus aureus subsp. aureus N315
aauaauagcaaaauua

SEQ ID NO: 2142626 - RNA, 11 nt, Staphylococcus aureus subsp. aureus N315
aauaaugaaau

SEQ ID NO: 2142627 - RNA, 22 nt, Staphylococcus aureus subsp. aureus N315
aauaauaggauaccacaucgca

SEQ ID NO: 2142628 - RNA, 14 nt, Staphylococcus aureus subsp. aureus N315
aauaauagcaaaau

SEQ ID NO: 2142629 - RNA, 12 nt, Staphylococcus aureus subsp. aureus N315
aaaaauacuuuu

SEQ ID NO: 2142630 - RNA, 23 nt, Staphylococcus aureus subsp. aureus N315
aaaaauagcguaauuauuauaau

SEQ ID NO: 2142631 - RNA, 20 nt, Staphylococcus aureus subsp. aureus N315
aauaaugacgagaauuaaag

SEQ ID NO: 2142632 - RNA, 14 nt, Staphylococcus aureus subsp. aureus N315
aauaauuuugauau

SEQ ID NO: 2142633 - RNA, 17 nt, Staphylococcus aureus subsp. aureus N315
aauaauuuguaauuccu

SEQ ID NO: 2142634 - RNA, 12 nt, Staphylococcus aureus subsp. aureus N315
aauaauuuuguu

SEQ ID NO: 2142635 - RNA, 14 nt, Staphylococcus aureus subsp. aureus N315
aauacaaaaauaua

SEQ ID NO: 2142636 - RNA, 23 nt, Staphylococcus aureus subsp. aureus N315
aauaauuuuuuuccuuucuuuuu

SEQ ID NO: 2142637 - RNA, 15 nt, Staphylococcus aureus subsp. aureus N315
aauaaugugaaaaau

SEQ ID NO: 2142638 - RNA, 16 nt, Staphylococcus aureus subsp. aureus N315
aauaauuuuaaaaaua

SEQ ID NO: 2142639 - RNA, 20 nt, Staphylococcus aureus subsp. aureus N315
aauaauuuuaaaaauaaaaa

SEQ ID NO: 2142640 - RNA, 22 nt, Staphylococcus aureus subsp. aureus N315
aaaaaucuucuccaaucaucau

SEQ ID NO: 2142641 - RNA, 18 nt, Staphylococcus aureus subsp. aureus N315
aaaaaucuucuccaauca

SEQ ID NO: 2142642 - RNA, 19 nt, Staphylococcus aureus subsp. aureus N315
aaaaaugaagaauacaaau

SEQ ID NO: 2142643 - RNA, 17 nt, Staphylococcus aureus subsp. aureus N315
aaaaaucggcuuucuaa

SEQ ID NO: 2142644 - RNA, 21 nt, Staphylococcus aureus subsp. aureus N315
aaaaaucgaacuagacaagau

SEQ ID NO: 2142645 - RNA, 17 nt, Staphylococcus aureus subsp. aureus N315
aaaaaucgaauuuucaa

SEQ ID NO: 2142646 - RNA, 20 nt, Staphylococcus aureus subsp. aureus N315
aaaaauccucacaaauuuga

SEQ ID NO: 2142647 - RNA, 20 nt, Staphylococcus aureus subsp. aureus N315
aaaaauccggaacauuaaaa

SEQ ID NO: 2142648 - RNA, 22 nt, Staphylococcus aureus subsp. aureus N315
aaaaauccggaacauuaaaagg

SEQ ID NO: 2142649 - RNA, 20 nt, Staphylococcus aureus subsp. aureus N315
aauaaugucuuacuuuuaaa

SEQ ID NO: 2142650 - RNA, 16 nt, Staphylococcus aureus subsp. aureus N315
aauaaugucuuacuuu

SEQ ID NO: 2142651 - RNA, 14 nt, Staphylococcus aureus subsp. aureus N315
aaaaaguuucggaa

SEQ ID NO: 2142652 - RNA, 16 nt, Staphylococcus aureus subsp. aureus N315
aaaaauaaaaccgagg

SEQ ID NO: 2142653 - RNA, 12 nt, Staphylococcus aureus subsp. aureus N315
aaaaauaaaucu

SEQ ID NO: 2142654 - RNA, 19 nt, Staphylococcus aureus subsp. aureus N315
aauaagcgcaauuaaaagu

SEQ ID NO: 2142655 - RNA, 17 nt, Staphylococcus aureus subsp. aureus N315
aauaagcgcaauuaaaa

SEQ ID NO: 2142656 - RNA, 20 nt, Staphylococcus aureus subsp. aureus N315
aauaagcgcaauuaaaagua

SEQ ID NO: 2142657 - RNA, 15 nt, Staphylococcus aureus subsp. aureus N315
aauaaguaauaauuu

SEQ ID NO: 2142658 - RNA, 19 nt, Staphylococcus aureus subsp. aureus N315
aauaagcuuguaacaagca

SEQ ID NO: 2142659 - RNA, 14 nt, Staphylococcus aureus subsp. aureus N315
aaaaauaauagcaa

SEQ ID NO: 2142660 - RNA, 13 nt, Staphylococcus aureus subsp. aureus N315
aauaagugauaaa

SEQ ID NO: 2142661 - RNA, 17 nt, Staphylococcus aureus subsp. aureus N315
aauaaguaauaauuuau

SEQ ID NO: 2142662 - RNA, 13 nt, Staphylococcus aureus subsp. aureus N315
aauaauaaaauag

SEQ ID NO: 2142663 - RNA, 11 nt, Staphylococcus aureus subsp. aureus N315
aauaauaaaau

SEQ ID NO: 2142664 - RNA, 12 nt, Staphylococcus aureus subsp. aureus N315
aauaauaaaaua

SEQ ID NO: 2142665 - RNA, 14 nt, Staphylococcus aureus subsp. aureus N315
aauaauaaugggaa

SEQ ID NO: 2142666 - RNA, 15 nt, Staphylococcus aureus subsp. aureus N315
aauaauaaguugaau

SEQ ID NO: 2142667 - RNA, 14 nt, Staphylococcus aureus subsp. aureus N315
aauaaguugucauc

SEQ ID NO: 2142668 - RNA, 23 nt, Staphylococcus aureus subsp. aureus N315
aauaaguugaauauaaaaaagau

SEQ ID NO: 2142669 - RNA, 22 nt, Staphylococcus aureus subsp. aureus N315
aauaaguugaauauaaaaaaga

SEQ ID NO: 2142670 - RNA, 19 nt, Staphylococcus aureus subsp. aureus N315
aauaaguugaauauaaaaa

SEQ ID NO: 2142671 - RNA, 18 nt, Staphylococcus aureus subsp. aureus N315
aauaaccgcacuuucuau

SEQ ID NO: 2142672 - RNA, 19 nt, Staphylococcus aureus subsp. aureus N315
aauaacuggcaaaucaaac

SEQ ID NO: 2142673 - RNA, 23 nt, Staphylococcus aureus subsp. aureus N315
aauaacugaguuuuaaugaacuc

SEQ ID NO: 2142674 - RNA, 23 nt, Staphylococcus aureus subsp. aureus N315
aauaaccauguaaaauuagcaag

SEQ ID NO: 2142675 - RNA, 12 nt, Staphylococcus aureus subsp. aureus N315
aauaagauuauu

SEQ ID NO: 2142676 - RNA, 11 nt, Staphylococcus aureus subsp. aureus N315
aauaagauuau

SEQ ID NO: 2142677 - RNA, 20 nt, Staphylococcus aureus subsp. aureus N315
aauaagagaacuuuucaaac

SEQ ID NO: 2142678 - RNA, 19 nt, Staphylococcus aureus subsp. aureus N315
aauaagaauguguuaauca

SEQ ID NO: 2142679 - RNA, 18 nt, Staphylococcus aureus subsp. aureus N315
aaguuuaaucguauuagc

SEQ ID NO: 2142680 - RNA, 19 nt, Staphylococcus aureus subsp. aureus N315
aaguuguggucuaaccauc

SEQ ID NO: 2142681 - RNA, 16 nt, Staphylococcus aureus subsp. aureus N315
aaguuguugaaauuuc

SEQ ID NO: 2142682 - RNA, 14 nt, Staphylococcus aureus subsp. aureus N315
aaguuggugugcaa

SEQ ID NO: 2142683 - RNA, 14 nt, Staphylococcus aureus subsp. aureus N315
aaguugauuaaaag

SEQ ID NO: 2142684 - RNA, 20 nt, Staphylococcus aureus subsp. aureus N315
aauaaaucauacgagaaauu

SEQ ID NO: 2142685 - RNA, 13 nt, Staphylococcus aureus subsp. aureus N315
aauaaaucauacg

SEQ ID NO: 2142686 - RNA, 19 nt, Staphylococcus aureus subsp. aureus N315
aauaacauccccaaaaaua

SEQ ID NO: 2142687 - RNA, 12 nt, Staphylococcus aureus subsp. aureus N315
aauaacaucuaa

SEQ ID NO: 2142688 - RNA, 16 nt, Staphylococcus aureus subsp. aureus N315
aauaaaucuccauuaa

SEQ ID NO: 2142689 - RNA, 17 nt, Staphylococcus aureus subsp. aureus N315
aauaaaucuccauuaau

SEQ ID NO: 2142690 - RNA, 19 nt, Staphylococcus aureus subsp. aureus N315
aauaaaucuccauuaauca

SEQ ID NO: 2142691 - RNA, 20 nt, Staphylococcus aureus subsp. aureus N315
aauaaaucuccauuaaucau

SEQ ID NO: 2142692 - RNA, 21 nt, Staphylococcus aureus subsp. aureus N315
aauaaaucuccauuaaucauu

SEQ ID NO: 2142693 - RNA, 17 nt, Staphylococcus aureus subsp. aureus N315
aauaaaucuaucuacuc

SEQ ID NO: 2142694 - RNA, 18 nt, Staphylococcus aureus subsp. aureus N315
aauaaaucuaucuacuca

SEQ ID NO: 2142695 - RNA, 22 nt, Staphylococcus aureus subsp. aureus N315
aagaggacaacuaauaacaaau

SEQ ID NO: 2142696 - RNA, 21 nt, Staphylococcus aureus subsp. aureus N315
aagaggcgccacaacauguuu

SEQ ID NO: 2142697 - RNA, 13 nt, Staphylococcus aureus subsp. aureus N315
aagaggagaaagc

SEQ ID NO: 2142698 - RNA, 19 nt, Staphylococcus aureus subsp. aureus N315
aagaggucuccaauacuuu

SEQ ID NO: 2142699 - RNA, 21 nt, Staphylococcus aureus subsp. aureus N315
aagagauacugguuaguaaaa

SEQ ID NO: 2142700 - RNA, 14 nt, Staphylococcus aureus subsp. aureus N315
aagagcaauuaaag

SEQ ID NO: 2142701 - RNA, 17 nt, Staphylococcus aureus subsp. aureus N315
aagagcaauuaaaguca

SEQ ID NO: 2142702 - RNA, 20 nt, Staphylococcus aureus subsp. aureus N315
aagagcaagugucaaauacg

SEQ ID NO: 2142703 - RNA, 22 nt, Staphylococcus aureus subsp. aureus N315
aagagauuuucuucauugaaaa

SEQ ID NO: 2142704 - RNA, 13 nt, Staphylococcus aureus subsp. aureus N315
aagauaaauaaaa

SEQ ID NO: 2142705 - RNA, 21 nt, Staphylococcus aureus subsp. aureus N315
aagauaacuagcaaaugcacu

SEQ ID NO: 2142706 - RNA, 20 nt, Staphylococcus aureus subsp. aureus N315
aagauaaacaagccaagaua

SEQ ID NO: 2142707 - RNA, 21 nt, Staphylococcus aureus subsp. aureus N315
aagauacguugauguaauucu

SEQ ID NO: 2142708 - RNA, 21 nt, Staphylococcus aureus subsp. aureus N315
aagauacaggcugauuuuuua

SEQ ID NO: 2142709 - RNA, 15 nt, Staphylococcus aureus subsp. aureus N315
aagauaccuuuuucu

SEQ ID NO: 2142710 - RNA, 16 nt, Staphylococcus aureus subsp. aureus N315
aagauacuuuuaaauu

SEQ ID NO: 2142711 - RNA, 16 nt, Staphylococcus aureus subsp. aureus N315
aagauaggauuuacac

SEQ ID NO: 2142712 - RNA, 20 nt, Staphylococcus aureus subsp. aureus N315
aagauaggauuugcaccuau

SEQ ID NO: 2142713 - RNA, 23 nt, Staphylococcus aureus subsp. aureus N315
aagauaggauuugcaccuauacc

SEQ ID NO: 2142714 - RNA, 17 nt, Staphylococcus aureus subsp. aureus N315
aagauagguuuauuucu

SEQ ID NO: 2142715 - RNA, 21 nt, Staphylococcus aureus subsp. aureus N315
aagaucacacgacauguaggu

SEQ ID NO: 2142716 - RNA, 14 nt, Staphylococcus aureus subsp. aureus N315
aagauauuuccaaa

SEQ ID NO: 2142717 - RNA, 20 nt, Staphylococcus aureus subsp. aureus N315
aagauauauaacuaugguca

SEQ ID NO: 2142718 - RNA, 15 nt, Staphylococcus aureus subsp. aureus N315
aagauaucuggauua

SEQ ID NO: 2142719 - RNA, 22 nt, Staphylococcus aureus subsp. aureus N315
aagacauacucacaaaaaacac

SEQ ID NO: 2142720 - RNA, 16 nt, Staphylococcus aureus subsp. aureus N315
aagaccaaauauuuua

SEQ ID NO: 2142721 - RNA, 19 nt, Staphylococcus aureus subsp. aureus N315
aagaauuucgaaaagaaau

SEQ ID NO: 2142722 - RNA, 13 nt, Staphylococcus aureus subsp. aureus N315
aagaauuuaaaag

SEQ ID NO: 2142723 - RNA, 16 nt, Staphylococcus aureus subsp. aureus N315
aagaauuuaaaagaga

SEQ ID NO: 2142724 - RNA, 17 nt, Staphylococcus aureus subsp. aureus N315
aagaaugcgaagauuuu

SEQ ID NO: 2142725 - RNA, 17 nt, Staphylococcus aureus subsp. aureus N315
aagaauuguugaucaug

SEQ ID NO: 2142726 - RNA, 20 nt, Staphylococcus aureus subsp. aureus N315
aagaaaucaccagauuuuaa

SEQ ID NO: 2142727 - RNA, 14 nt, Staphylococcus aureus subsp. aureus N315
aagaaaucaacaac

SEQ ID NO: 2142728 - RNA, 16 nt, Staphylococcus aureus subsp. aureus N315
aagaaaucaacaacuu

SEQ ID NO: 2142729 - RNA, 21 nt, Staphylococcus aureus subsp. aureus N315
aagaaauacuaauuucuauag

SEQ ID NO: 2142730 - RNA, 15 nt, Staphylococcus aureus subsp. aureus N315
aagaaauaauuuaaa

SEQ ID NO: 2142731 - RNA, 21 nt, Staphylococcus aureus subsp. aureus N315
aagaccguauccuguguaaaa

SEQ ID NO: 2142732 - RNA, 23 nt, Staphylococcus aureus subsp. aureus N315
aagaccacuauuuuuaaaugauu

SEQ ID NO: 2142733 - RNA, 14 nt, Staphylococcus aureus subsp. aureus N315
aagaccauuuuaua

SEQ ID NO: 2142734 - RNA, 19 nt, Staphylococcus aureus subsp. aureus N315
aagaccauuuuauauuuua

SEQ ID NO: 2142735 - RNA, 20 nt, Staphylococcus aureus subsp. aureus N315
aagaccauuuuauauuuuag

SEQ ID NO: 2142736 - RNA, 19 nt, Staphylococcus aureus subsp. aureus N315
aagaccaugcaaacucauu

SEQ ID NO: 2142737 - RNA, 22 nt, Staphylococcus aureus subsp. aureus N315
aagaccaugcaaacucauuuau

SEQ ID NO: 2142738 - RNA, 17 nt, Staphylococcus aureus subsp. aureus N315
aagaccccgaaaagagg

SEQ ID NO: 2142739 - RNA, 21 nt, Staphylococcus aureus subsp. aureus N315
aagacggugaccuuauauuuu

SEQ ID NO: 2142740 - RNA, 22 nt, Staphylococcus aureus subsp. aureus N315
aagacgauuuauuaguuuuuac

SEQ ID NO: 2142741 - RNA, 11 nt, Staphylococcus aureus subsp. aureus N315
aagacugccau

SEQ ID NO: 2142742 - RNA, 22 nt, Staphylococcus aureus subsp. aureus N315
aagacucccuuuuuaaaauacg

SEQ ID NO: 2142743 - RNA, 16 nt, Staphylococcus aureus subsp. aureus N315
aagacucaauuucauu

SEQ ID NO: 2142744 - RNA, 22 nt, Staphylococcus aureus subsp. aureus N315
aagacuucguugcacuuuaaua

SEQ ID NO: 2142745 - RNA, 22 nt, Staphylococcus aureus subsp. aureus N315
aacucuaaaagccaucuuaccu

SEQ ID NO: 2142746 - RNA, 18 nt, Staphylococcus aureus subsp. aureus N315
aacucuaaaaguuguaau

SEQ ID NO: 2142747 - RNA, 20 nt, Staphylococcus aureus subsp. aureus N315
aacucguuauagauaaguag

SEQ ID NO: 2142748 - RNA, 21 nt, Staphylococcus aureus subsp. aureus N315
aacucguugcacucuuuucuc

SEQ ID NO: 2142749 - RNA, 20 nt, Staphylococcus aureus subsp. aureus N315
aacucgcauugccuguagaa

SEQ ID NO: 2142750 - RNA, 14 nt, Staphylococcus aureus subsp. aureus N315
aacucugagcacuu

SEQ ID NO: 2142751 - RNA, 15 nt, Staphylococcus aureus subsp. aureus N315
aacucucuaaaaagc

SEQ ID NO: 2142752 - RNA, 16 nt, Staphylococcus aureus subsp. aureus N315
aacucuaaauauaaua

SEQ ID NO: 2142753 - RNA, 21 nt, Staphylococcus aureus subsp. aureus N315
aacugaguucaauuaaauuau

SEQ ID NO: 2142754 - RNA, 23 nt, Staphylococcus aureus subsp. aureus N315
aacugaguucaauuaaauuauau

SEQ ID NO: 2142755 - RNA, 17 nt, Staphylococcus aureus subsp. aureus N315
aacucugauauugaucu

SEQ ID NO: 2142756 - RNA, 22 nt, Staphylococcus aureus subsp. aureus N315
aacucugauauugaucugauuu

SEQ ID NO: 2142757 - RNA, 19 nt, Staphylococcus aureus subsp. aureus N315
aacuauuaauggcaccaua

SEQ ID NO: 2142758 - RNA, 16 nt, Staphylococcus aureus subsp. aureus N315
aacuaugaauagauga

SEQ ID NO: 2142759 - RNA, 18 nt, Staphylococcus aureus subsp. aureus N315
aacuauguuacuuauaua

SEQ ID NO: 2142760 - RNA, 17 nt, Staphylococcus aureus subsp. aureus N315
aacuauuaucgaagaaa

SEQ ID NO: 2142761 - RNA, 15 nt, Staphylococcus aureus subsp. aureus N315
aacuaucgauacuaa

SEQ ID NO: 2142762 - RNA, 21 nt, Staphylococcus aureus subsp. aureus N315
aacucaugcauaagaaauacu

SEQ ID NO: 2142763 - RNA, 22 nt, Staphylococcus aureus subsp. aureus N315
aacucaugcauaagaaauacua

SEQ ID NO: 2142764 - RNA, 13 nt, Staphylococcus aureus subsp. aureus N315
aacucauuuauaa

SEQ ID NO: 2142765 - RNA, 16 nt, Staphylococcus aureus subsp. aureus N315
aacucauaccaaaaac

SEQ ID NO: 2142766 - RNA, 16 nt, Staphylococcus aureus subsp. aureus N315
aacuuuuauugccaua

SEQ ID NO: 2142767 - RNA, 16 nt, Staphylococcus aureus subsp. aureus N315
aacuuuuccuuguugg

SEQ ID NO: 2142768 - RNA, 15 nt, Staphylococcus aureus subsp. aureus N315
aacuuuucaaagcca

SEQ ID NO: 2142769 - RNA, 23 nt, Staphylococcus aureus subsp. aureus N315
aacuuuugggaagcgucuuuuuu

SEQ ID NO: 2142770 - RNA, 17 nt, Staphylococcus aureus subsp. aureus N315
aacuuuuuaacugccau

SEQ ID NO: 2142771 - RNA, 23 nt, Staphylococcus aureus subsp. aureus N315
aacuuugucuguauuauuauaau

SEQ ID NO: 2142772 - RNA, 17 nt, Staphylococcus aureus subsp. aureus N315
aacuuugugugcuuuau

SEQ ID NO: 2142773 - RNA, 13 nt, Staphylococcus aureus subsp. aureus N315
aacuuuuacuuuc

SEQ ID NO: 2142774 - RNA, 13 nt, Staphylococcus aureus subsp. aureus N315
aagaaaauacuaa

SEQ ID NO: 2142775 - RNA, 14 nt, Staphylococcus aureus subsp. aureus N315
aagaaaauuucagu

SEQ ID NO: 2142776 - RNA, 15 nt, Staphylococcus aureus subsp. aureus N315
aagaaaauacuaaca

SEQ ID NO: 2142777 - RNA, 14 nt, Staphylococcus aureus subsp. aureus N315
aagaaacauuauau

SEQ ID NO: 2142778 - RNA, 20 nt, Staphylococcus aureus subsp. aureus N315
aacuuucacucauauuacuu

SEQ ID NO: 2142779 - RNA, 20 nt, Staphylococcus aureus subsp. aureus N315
aacuugugauauauaaccau

SEQ ID NO: 2142780 - RNA, 23 nt, Staphylococcus aureus subsp. aureus N315
aacuuguuguuauuuauuugauu

SEQ ID NO: 2142781 - RNA, 13 nt, Staphylococcus aureus subsp. aureus N315
aacuucucuuagu

SEQ ID NO: 2142782 - RNA, 17 nt, Staphylococcus aureus subsp. aureus N315
aacuuuaagcugucaua

SEQ ID NO: 2142783 - RNA, 14 nt, Staphylococcus aureus subsp. aureus N315
aacuuuaauaccag

SEQ ID NO: 2142784 - RNA, 15 nt, Staphylococcus aureus subsp. aureus N315
aacuuuaauauaagu

SEQ ID NO: 2142785 - RNA, 20 nt, Staphylococcus aureus subsp. aureus N315
aacuuuaauauaaguauaau

SEQ ID NO: 2142786 - RNA, 22 nt, Staphylococcus aureus subsp. aureus N315
aacuuuaauuuuucauuaauac

SEQ ID NO: 2142787 - RNA, 20 nt, Staphylococcus aureus subsp. aureus N315
aacuuuaauuaaagcaucuu

SEQ ID NO: 2142788 - RNA, 16 nt, Staphylococcus aureus subsp. aureus N315
aacuuuagacauaaaa

SEQ ID NO: 2142789 - RNA, 23 nt, Staphylococcus aureus subsp. aureus N315
aacugugauauuaauugaaaaac

SEQ ID NO: 2142790 - RNA, 21 nt, Staphylococcus aureus subsp. aureus N315
aacugugcaugacgauaauga

SEQ ID NO: 2142791 - RNA, 23 nt, Staphylococcus aureus subsp. aureus N315
aacuguaugccgccuaauaauaa

SEQ ID NO: 2142792 - RNA, 16 nt, Staphylococcus aureus subsp. aureus N315
aacugguugauaaaua

SEQ ID NO: 2142793 - RNA, 13 nt, Staphylococcus aureus subsp. aureus N315
aacuguaaaacau

SEQ ID NO: 2142794 - RNA, 23 nt, Staphylococcus aureus subsp. aureus N315
aacuguaacgugaggcccauaaa

SEQ ID NO: 2142795 - RNA, 23 nt, Staphylococcus aureus subsp. aureus N315
aacugauaauacuguuuaaauaa

SEQ ID NO: 2142796 - RNA, 17 nt, Staphylococcus aureus subsp. aureus N315
aacugaucauuuucauu

SEQ ID NO: 2142797 - RNA, 20 nt, Staphylococcus aureus subsp. aureus N315
aacugcauguacaucuuuag

SEQ ID NO: 2142798 - RNA, 15 nt, Staphylococcus aureus subsp. aureus N315
aacuguuuaucauga

SEQ ID NO: 2142799 - RNA, 14 nt, Staphylococcus aureus subsp. aureus N315
aacuucauaauaua

SEQ ID NO: 2142800 - RNA, 16 nt, Staphylococcus aureus subsp. aureus N315
aacuucauaauauauc

SEQ ID NO: 2142801 - RNA, 23 nt, Staphylococcus aureus subsp. aureus N315
aacuguucuuucgucuuguaaac

SEQ ID NO: 2142802 - RNA, 22 nt, Staphylococcus aureus subsp. aureus N315
aacuguucuaaccauucguaau

SEQ ID NO: 2142803 - RNA, 13 nt, Staphylococcus aureus subsp. aureus N315
aacuuccuaaaau

SEQ ID NO: 2142804 - RNA, 21 nt, Staphylococcus aureus subsp. aureus N315
aacuuccuaaaauuuacaaau

SEQ ID NO: 2142805 - RNA, 18 nt, Staphylococcus aureus subsp. aureus N315
aacuucuauuaagaaaua

SEQ ID NO: 2142806 - RNA, 16 nt, Staphylococcus aureus subsp. aureus N315
aacgcuaauuuuacuc

SEQ ID NO: 2142807 - RNA, 18 nt, Staphylococcus aureus subsp. aureus N315
aacgcucaacuauauaua

SEQ ID NO: 2142808 - RNA, 21 nt, Staphylococcus aureus subsp. aureus N315
aacgaagucagucaauucaaa

SEQ ID NO: 2142809 - RNA, 21 nt, Staphylococcus aureus subsp. aureus N315
aacgaaucgccuacuauaaau

SEQ ID NO: 2142810 - RNA, 17 nt, Staphylococcus aureus subsp. aureus N315
aacgaauguuccuuguu

SEQ ID NO: 2142811 - RNA, 22 nt, Staphylococcus aureus subsp. aureus N315
aacgagcuggugagaaauugaa

SEQ ID NO: 2142812 - RNA, 15 nt, Staphylococcus aureus subsp. aureus N315
aacgauaccaaauau

SEQ ID NO: 2142813 - RNA, 17 nt, Staphylococcus aureus subsp. aureus N315
aacgauaaauuaacuua

SEQ ID NO: 2142814 - RNA, 18 nt, Staphylococcus aureus subsp. aureus N315
aacgauagacauugagau

SEQ ID NO: 2142815 - RNA, 18 nt, Staphylococcus aureus subsp. aureus N315
aacgcacuauuuuuauaa

SEQ ID NO: 2142816 - RNA, 23 nt, Staphylococcus aureus subsp. aureus N315
aacgauagauucugauacagaac

SEQ ID NO: 2142817 - RNA, 20 nt, Staphylococcus aureus subsp. aureus N315
aacgcauauucuauuguugu

SEQ ID NO: 2142818 - RNA, 13 nt, Staphylococcus aureus subsp. aureus N315
aacgcauuucaug

SEQ ID NO: 2142819 - RNA, 13 nt, Staphylococcus aureus subsp. aureus N315
aaccuaaauucca

SEQ ID NO: 2142820 - RNA, 20 nt, Staphylococcus aureus subsp. aureus N315
aaccuaaagauaauauuaaa

SEQ ID NO: 2142821 - RNA, 20 nt, Staphylococcus aureus subsp. aureus N315
aaccuauuaaaauaaaccac

SEQ ID NO: 2142822 - RNA, 23 nt, Staphylococcus aureus subsp. aureus N315
aaccuagggauaauuuuauugac

SEQ ID NO: 2142823 - RNA, 16 nt, Staphylococcus aureus subsp. aureus N315
aaccuaaugcuuuaau

SEQ ID NO: 2142824 - RNA, 23 nt, Staphylococcus aureus subsp. aureus N315
aaccucugauguguuauguuaga

SEQ ID NO: 2142825 - RNA, 20 nt, Staphylococcus aureus subsp. aureus N315
aaccuguucuuuauuuaaag

SEQ ID NO: 2142826 - RNA, 14 nt, Staphylococcus aureus subsp. aureus N315
aaccuuuaaaacau

SEQ ID NO: 2142827 - RNA, 15 nt, Staphylococcus aureus subsp. aureus N315
aaccuuuaaaaguaa

SEQ ID NO: 2142828 - RNA, 20 nt, Staphylococcus aureus subsp. aureus N315
aaccuugauuuaauuuuuaa

SEQ ID NO: 2142829 - RNA, 24 nt, Staphylococcus aureus subsp. aureus N315
aaccuuccccuucauauuuugccu

SEQ ID NO: 2142830 - RNA, 15 nt, Staphylococcus aureus subsp. aureus N315
aaccuuuucaaauua

SEQ ID NO: 2142831 - RNA, 18 nt, Staphylococcus aureus subsp. aureus N315
aaccagcuaacaaaagug

SEQ ID NO: 2142832 - RNA, 20 nt, Staphylococcus aureus subsp. aureus N315
aacccauuuucaaaacuagc

SEQ ID NO: 2142833 - RNA, 21 nt, Staphylococcus aureus subsp. aureus N315
aaccauagauaauugcuauaa

SEQ ID NO: 2142834 - RNA, 18 nt, Staphylococcus aureus subsp. aureus N315
aaccauaguaauaaaaug

SEQ ID NO: 2142835 - RNA, 21 nt, Staphylococcus aureus subsp. aureus N315
aaccauacucuaacuuaccau

SEQ ID NO: 2142836 - RNA, 20 nt, Staphylococcus aureus subsp. aureus N315
aacaugcuuggacauauacu

SEQ ID NO: 2142837 - RNA, 20 nt, Staphylococcus aureus subsp. aureus N315
aacaugauucaugauauguu

SEQ ID NO: 2142838 - RNA, 16 nt, Staphylococcus aureus subsp. aureus N315
aacaugauacugaaau

SEQ ID NO: 2142839 - RNA, 19 nt, Staphylococcus aureus subsp. aureus N315
aacauuuauucuuucucua

SEQ ID NO: 2142840 - RNA, 16 nt, Staphylococcus aureus subsp. aureus N315
aacauuuaagaaacgu

SEQ ID NO: 2142841 - RNA, 18 nt, Staphylococcus aureus subsp. aureus N315
aacauuuaucgugaagaa

SEQ ID NO: 2142842 - RNA, 16 nt, Staphylococcus aureus subsp. aureus N315
aacauuuguccgauuu

SEQ ID NO: 2142843 - RNA, 20 nt, Staphylococcus aureus subsp. aureus N315
aacauuuucuuauuugauuc

SEQ ID NO: 2142844 - RNA, 21 nt, Staphylococcus aureus subsp. aureus N315
aacauuuucuuauuugauucu

SEQ ID NO: 2142845 - RNA, 13 nt, Staphylococcus aureus subsp. aureus N315
aacauuuugaguc

SEQ ID NO: 2142846 - RNA, 16 nt, Staphylococcus aureus subsp. aureus N315
aacauuuuuagaauca

SEQ ID NO: 2142847 - RNA, 22 nt, Staphylococcus aureus subsp. aureus N315
aaccaccaucccauuaaaccac

SEQ ID NO: 2142848 - RNA, 18 nt, Staphylococcus aureus subsp. aureus N315
aaccaaaaccaaaugaac

SEQ ID NO: 2142849 - RNA, 20 nt, Staphylococcus aureus subsp. aureus N315
aaccaaaagaaauuuaauac

SEQ ID NO: 2142850 - RNA, 20 nt, Staphylococcus aureus subsp. aureus N315
aacauuuuugugcaaaaguu

SEQ ID NO: 2142851 - RNA, 19 nt, Staphylococcus aureus subsp. aureus N315
aacaguuuuauuaucuuug

SEQ ID NO: 2142852 - RNA, 13 nt, Staphylococcus aureus subsp. aureus N315
aacaguuuuaaag

SEQ ID NO: 2142853 - RNA, 12 nt, Staphylococcus aureus subsp. aureus N315
aacaguuuuaaa

SEQ ID NO: 2142854 - RNA, 15 nt, Staphylococcus aureus subsp. aureus N315
aacaguuaauuauac

SEQ ID NO: 2142855 - RNA, 15 nt, Staphylococcus aureus subsp. aureus N315
aacauauaaaucauu

SEQ ID NO: 2142856 - RNA, 18 nt, Staphylococcus aureus subsp. aureus N315
aacauauaaaaaauuauu

SEQ ID NO: 2142857 - RNA, 24 nt, Staphylococcus aureus subsp. aureus N315
aacauaacaugaccuaauauauua

SEQ ID NO: 2142858 - RNA, 13 nt, Staphylococcus aureus subsp. aureus N315
aacauaagauaca

SEQ ID NO: 2142859 - RNA, 18 nt, Staphylococcus aureus subsp. aureus N315
aacauagacacuuaacuu

SEQ ID NO: 2142860 - RNA, 16 nt, Staphylococcus aureus subsp. aureus N315
aacaucacauaaaaua

SEQ ID NO: 2142861 - RNA, 13 nt, Staphylococcus aureus subsp. aureus N315
aacagcuacaaau

SEQ ID NO: 2142862 - RNA, 15 nt, Staphylococcus aureus subsp. aureus N315
aacagcuacaaauaa

SEQ ID NO: 2142863 - RNA, 18 nt, Staphylococcus aureus subsp. aureus N315
aacagcgugaauauaagu

SEQ ID NO: 2142864 - RNA, 15 nt, Staphylococcus aureus subsp. aureus N315
aacagcuucaaaauc

SEQ ID NO: 2142865 - RNA, 14 nt, Staphylococcus aureus subsp. aureus N315
cgcuucaauuauuu

SEQ ID NO: 2142866 - RNA, 14 nt, Staphylococcus aureus subsp. aureus N315
cgcuuauuuuacua

SEQ ID NO: 2142867 - RNA, 22 nt, Staphylococcus aureus subsp. aureus N315
cgcuuagauaaauuaauaugaa

SEQ ID NO: 2142868 - RNA, 21 nt, Staphylococcus aureus subsp. aureus N315
cgcuuagauaaauuaauauga

SEQ ID NO: 2142869 - RNA, 17 nt, Staphylococcus aureus subsp. aureus N315
cgcuguuucaagcguuu

SEQ ID NO: 2142870 - RNA, 14 nt, Staphylococcus aureus subsp. aureus N315
cgcuuaauucuuca

SEQ ID NO: 2142871 - RNA, 20 nt, Staphylococcus aureus subsp. aureus N315
cgcuucauagucacuuuuaa

SEQ ID NO: 2142872 - RNA, 19 nt, Staphylococcus aureus subsp. aureus N315
cgcuguggcucgaaaauaa

SEQ ID NO: 2142873 - RNA, 16 nt, Staphylococcus aureus subsp. aureus N315
cgcuccaagauuauga

SEQ ID NO: 2142874 - RNA, 14 nt, Staphylococcus aureus subsp. aureus N315
cgcucuuuucaaaa

SEQ ID NO: 2142875 - RNA, 22 nt, Staphylococcus aureus subsp. aureus N315
cgcuauauguaaagcuaauuuu

SEQ ID NO: 2142876 - RNA, 21 nt, Staphylococcus aureus subsp. aureus N315
cgauuuauuuauaaaauaaaa

SEQ ID NO: 2142877 - RNA, 15 nt, Staphylococcus aureus subsp. aureus N315
cgauuguuucaccag

SEQ ID NO: 2142878 - RNA, 14 nt, Staphylococcus aureus subsp. aureus N315
cgauuaauuuucuu

SEQ ID NO: 2142879 - RNA, 16 nt, Staphylococcus aureus subsp. aureus N315
cgaucuaacaauugca

SEQ ID NO: 2142880 - RNA, 18 nt, Staphylococcus aureus subsp. aureus N315
cgaucuuuuucaauguga

SEQ ID NO: 2142881 - RNA, 18 nt, Staphylococcus aureus subsp. aureus N315
cgaucauaaauauuuucu

SEQ ID NO: 2142882 - RNA, 12 nt, Staphylococcus aureus subsp. aureus N315
cgauacuuuuug

SEQ ID NO: 2142883 - RNA, 15 nt, Staphylococcus aureus subsp. aureus N315
cgauaccuaaaauac

SEQ ID NO: 2142884 - RNA, 14 nt, Staphylococcus aureus subsp. aureus N315
cgauaauaauaaga

SEQ ID NO: 2142885 - RNA, 14 nt, Staphylococcus aureus subsp. aureus N315
cgauaaguucaucg

SEQ ID NO: 2142886 - RNA, 19 nt, Staphylococcus aureus subsp. aureus N315
cgauaagauagcuauauuu

SEQ ID NO: 2142887 - RNA, 17 nt, Staphylococcus aureus subsp. aureus N315
cgauaagcaaaaauucu

SEQ ID NO: 2142888 - RNA, 18 nt, Staphylococcus aureus subsp. aureus N315
cgcaauacgaauaucugu

SEQ ID NO: 2142889 - RNA, 19 nt, Staphylococcus aureus subsp. aureus N315
cgcaaugauaucuuuucca

SEQ ID NO: 2142890 - RNA, 15 nt, Staphylococcus aureus subsp. aureus N315
cgcaaugauuauaaa

SEQ ID NO: 2142891 - RNA, 14 nt, Staphylococcus aureus subsp. aureus N315
cgcaaugucuugug

SEQ ID NO: 2142892 - RNA, 13 nt, Staphylococcus aureus subsp. aureus N315
cgcauacaggaaa

SEQ ID NO: 2142893 - RNA, 18 nt, Staphylococcus aureus subsp. aureus N315
cgccauaaucuucauuaa

SEQ ID NO: 2142894 - RNA, 12 nt, Staphylococcus aureus subsp. aureus N315
cgccauaaucau

SEQ ID NO: 2142895 - RNA, 13 nt, Staphylococcus aureus subsp. aureus N315
ccaguauaauuuu

SEQ ID NO: 2142896 - RNA, 13 nt, Staphylococcus aureus subsp. aureus N315
ccaguaucucuuu

SEQ ID NO: 2142897 - RNA, 23 nt, Staphylococcus aureus subsp. aureus N315
ccaguacuuucgaguaauacuuu

SEQ ID NO: 2142898 - RNA, 15 nt, Staphylococcus aureus subsp. aureus N315
ccagucaauuuuuuc

SEQ ID NO: 2142899 - RNA, 18 nt, Staphylococcus aureus subsp. aureus N315
ccagucauuguauaaaaa

SEQ ID NO: 2142900 - RNA, 18 nt, Staphylococcus aureus subsp. aureus N315
ccaguugauuuaagauuu

SEQ ID NO: 2142901 - RNA, 18 nt, Staphylococcus aureus subsp. aureus N315
ccauaguaauaaaaugau

SEQ ID NO: 2142902 - RNA, 19 nt, Staphylococcus aureus subsp. aureus N315
ccauaguaauaaaaugaug

SEQ ID NO: 2142903 - RNA, 18 nt, Staphylococcus aureus subsp. aureus N315
ccauacgaucuuuuucaa

SEQ ID NO: 2142904 - RNA, 23 nt, Staphylococcus aureus subsp. aureus N315
ccauacauaugcuauauuuaguu

SEQ ID NO: 2142905 - RNA, 19 nt, Staphylococcus aureus subsp. aureus N315
ccauacauaugcuauauuu

SEQ ID NO: 2142906 - RNA, 21 nt, Staphylococcus aureus subsp. aureus N315
ccauacaaaucguaaacauaa

SEQ ID NO: 2142907 - RNA, 20 nt, Staphylococcus aureus subsp. aureus N315
ccauaauuaaauaacuuuuu

SEQ ID NO: 2142908 - RNA, 17 nt, Staphylococcus aureus subsp. aureus N315
ccauuuuuuuccaagca

SEQ ID NO: 2142909 - RNA, 16 nt, Staphylococcus aureus subsp. aureus N315
cccaacgaugaaacuc

SEQ ID NO: 2142910 - RNA, 14 nt, Staphylococcus aureus subsp. aureus N315
ccauuuuuucaaau

SEQ ID NO: 2142911 - RNA, 20 nt, Staphylococcus aureus subsp. aureus N315
cccaagcccugacaauucau

SEQ ID NO: 2142912 - RNA, 20 nt, Staphylococcus aureus subsp. aureus N315
ccauugcgcuucgucuuuau

SEQ ID NO: 2142913 - RNA, 19 nt, Staphylococcus aureus subsp. aureus N315
ccauuacaaugcgcaauga

SEQ ID NO: 2142914 - RNA, 13 nt, Staphylococcus aureus subsp. aureus N315
ccauuaaucauuu

SEQ ID NO: 2142915 - RNA, 14 nt, Staphylococcus aureus subsp. aureus N315
ccauuaaucauuua

SEQ ID NO: 2142916 - RNA, 16 nt, Staphylococcus aureus subsp. aureus N315
ccauuauuauuuuuuu

SEQ ID NO: 2142917 - RNA, 23 nt, Staphylococcus aureus subsp. aureus N315
ccauucgaaagccaauuaauaaa

SEQ ID NO: 2142918 - RNA, 21 nt, Staphylococcus aureus subsp. aureus N315
ccauauuuguagccuacaacc

SEQ ID NO: 2142919 - RNA, 22 nt, Staphylococcus aureus subsp. aureus N315
cccagcuugaccgccuaugaua

SEQ ID NO: 2142920 - RNA, 20 nt, Staphylococcus aureus subsp. aureus N315
cccagccuauucguuugaau

SEQ ID NO: 2142921 - RNA, 19 nt, Staphylococcus aureus subsp. aureus N315
aaacaaugcgguaaaaacu

SEQ ID NO: 2142922 - RNA, 20 nt, Staphylococcus aureus subsp. aureus N315
aaacaaugcgguaaaaacuc

SEQ ID NO: 2142923 - RNA, 17 nt, Staphylococcus aureus subsp. aureus N315
cccauaccuacaaauau

SEQ ID NO: 2142924 - RNA, 16 nt, Staphylococcus aureus subsp. aureus N315
cccauaccuacaaaua

SEQ ID NO: 2142925 - RNA, 19 nt, Staphylococcus aureus subsp. aureus N315
aaacacagacguuuuugaa

SEQ ID NO: 2142926 - RNA, 15 nt, Staphylococcus aureus subsp. aureus N315
aaacacaaggaauau

SEQ ID NO: 2142927 - RNA, 20 nt, Staphylococcus aureus subsp. aureus N315
aaacacagacguuuuugaau

SEQ ID NO: 2142928 - RNA, 18 nt, Staphylococcus aureus subsp. aureus N315
aaacacaguacaaauaac

SEQ ID NO: 2142929 - RNA, 22 nt, Staphylococcus aureus subsp. aureus N315
aaacacaguacaaauaacaaac

SEQ ID NO: 2142930 - RNA, 16 nt, Staphylococcus aureus subsp. aureus N315
cccaucgcuuuuucca

SEQ ID NO: 2142931 - RNA, 19 nt, Staphylococcus aureus subsp. aureus N315
cccauuuuuaaaauuauga

SEQ ID NO: 2142932 - RNA, 23 nt, Staphylococcus aureus subsp. aureus N315
ccccaacacugagaauuucuaau

SEQ ID NO: 2142933 - RNA, 21 nt, Staphylococcus aureus subsp. aureus N315
cccuccuggugcugcaccaag

SEQ ID NO: 2142934 - RNA, 19 nt, Staphylococcus aureus subsp. aureus N315
aaacacccugcuuaucauu

SEQ ID NO: 2142935 - RNA, 22 nt, Staphylococcus aureus subsp. aureus N315
cccuacaaaguuuauacuuaau

SEQ ID NO: 2142936 - RNA, 15 nt, Staphylococcus aureus subsp. aureus N315
cccuaaagcuaaugc

SEQ ID NO: 2142937 - RNA, 16 nt, Staphylococcus aureus subsp. aureus N315
cccuaugaaauaacua

SEQ ID NO: 2142938 - RNA, 19 nt, Staphylococcus aureus subsp. aureus N315
cccuagguuuauauaucac

SEQ ID NO: 2142939 - RNA, 21 nt, Staphylococcus aureus subsp. aureus N315
cccuacugcaccgauaucaua

SEQ ID NO: 2142940 - RNA, 15 nt, Staphylococcus aureus subsp. aureus N315
aaacauuguccguuu

SEQ ID NO: 2142941 - RNA, 18 nt, Staphylococcus aureus subsp. aureus N315
aaacauuauuaagugagu

SEQ ID NO: 2142942 - RNA, 18 nt, Staphylococcus aureus subsp. aureus N315
ccgacuugauaaaaaaug

SEQ ID NO: 2142943 - RNA, 14 nt, Staphylococcus aureus subsp. aureus N315
aaacauaacaugac

SEQ ID NO: 2142944 - RNA, 20 nt, Staphylococcus aureus subsp. aureus N315
aaacauaaauacaaaaauau

SEQ ID NO: 2142945 - RNA, 13 nt, Staphylococcus aureus subsp. aureus N315
aaacauaucuucu

SEQ ID NO: 2142946 - RNA, 15 nt, Staphylococcus aureus subsp. aureus N315
aaacauaaugacauc

SEQ ID NO: 2142947 - RNA, 16 nt, Staphylococcus aureus subsp. aureus N315
ccgaaaauagacugac

SEQ ID NO: 2142948 - RNA, 23 nt, Staphylococcus aureus subsp. aureus N315
aaacauuaaucuauauaaaaacu

SEQ ID NO: 2142949 - RNA, 15 nt, Staphylococcus aureus subsp. aureus N315
aaacauguuacccua

SEQ ID NO: 2142950 - RNA, 22 nt, Staphylococcus aureus subsp. aureus N315
aaacauguguaugaucaagcug

SEQ ID NO: 2142951 - RNA, 16 nt, Staphylococcus aureus subsp. aureus N315
aaacauuaaaauaauu

SEQ ID NO: 2142952 - RNA, 18 nt, Staphylococcus aureus subsp. aureus N315
aaacauuaaaauaauuaa

SEQ ID NO: 2142953 - RNA, 23 nt, Staphylococcus aureus subsp. aureus N315
aaacaugguuuucuuuuuaucau

SEQ ID NO: 2142954 - RNA, 21 nt, Staphylococcus aureus subsp. aureus N315
aaacauguacaauuuuuaaaa

SEQ ID NO: 2142955 - RNA, 14 nt, Staphylococcus aureus subsp. aureus N315
aaacagcaaauaaa

SEQ ID NO: 2142956 - RNA, 19 nt, Staphylococcus aureus subsp. aureus N315
aaacagcaguaagauuauu

SEQ ID NO: 2142957 - RNA, 16 nt, Staphylococcus aureus subsp. aureus N315
aaacagcaguaagaua

SEQ ID NO: 2142958 - RNA, 20 nt, Staphylococcus aureus subsp. aureus N315
ccgauuuauuuauaaaauaa

SEQ ID NO: 2142959 - RNA, 17 nt, Staphylococcus aureus subsp. aureus N315
ccgauuuugauauaaaa

SEQ ID NO: 2142960 - RNA, 14 nt, Staphylococcus aureus subsp. aureus N315
ccgcagaccacauc

SEQ ID NO: 2142961 - RNA, 20 nt, Staphylococcus aureus subsp. aureus N315
ccgccaacuaauguuaaaau

SEQ ID NO: 2142962 - RNA, 19 nt, Staphylococcus aureus subsp. aureus N315
aaaccauaaguaaaacugc

SEQ ID NO: 2142963 - RNA, 21 nt, Staphylococcus aureus subsp. aureus N315
aaaccauuuucaagaggacaa

SEQ ID NO: 2142964 - RNA, 17 nt, Staphylococcus aureus subsp. aureus N315
aaaccauugaaugaauc

SEQ ID NO: 2142965 - RNA, 19 nt, Staphylococcus aureus subsp. aureus N315
aaacgauaagaauuaacaa

SEQ ID NO: 2142966 - RNA, 22 nt, Staphylococcus aureus subsp. aureus N315
aaacgauauagaccguugaaau

SEQ ID NO: 2142967 - RNA, 15 nt, Staphylococcus aureus subsp. aureus N315
aaacgauaauaauaa

SEQ ID NO: 2142968 - RNA, 17 nt, Staphylococcus aureus subsp. aureus N315
aaacgacauuguuuagu

SEQ ID NO: 2142969 - RNA, 16 nt, Staphylococcus aureus subsp. aureus N315
aaacgagacaucaucu

SEQ ID NO: 2142970 - RNA, 20 nt, Staphylococcus aureus subsp. aureus N315
ccgucgaauauaauuuuuug

SEQ ID NO: 2142971 - RNA, 21 nt, Staphylococcus aureus subsp. aureus N315
ccuaaaccucuaaauaaaauu

SEQ ID NO: 2142972 - RNA, 15 nt, Staphylococcus aureus subsp. aureus N315
ccuaaacgaucaacu

SEQ ID NO: 2142973 - RNA, 21 nt, Staphylococcus aureus subsp. aureus N315
ccguuugaagucuguuuagaa

SEQ ID NO: 2142974 - RNA, 21 nt, Staphylococcus aureus subsp. aureus N315
ccuaaagguaacuuuuuaacu

SEQ ID NO: 2142975 - RNA, 14 nt, Staphylococcus aureus subsp. aureus N315
ccuaaaugauuaau

SEQ ID NO: 2142976 - RNA, 13 nt, Staphylococcus aureus subsp. aureus N315
ccuaauaauaaaa

SEQ ID NO: 2142977 - RNA, 18 nt, Staphylococcus aureus subsp. aureus N315
ccuaaguuaauuuaucgu

SEQ ID NO: 2142978 - RNA, 16 nt, Staphylococcus aureus subsp. aureus N315
ccuaaggacuuuaugc

SEQ ID NO: 2142979 - RNA, 19 nt, Staphylococcus aureus subsp. aureus N315
ccuaacuuuuauuaucagc

SEQ ID NO: 2142980 - RNA, 14 nt, Staphylococcus aureus subsp. aureus N315
ccguguuuauuuuu

SEQ ID NO: 2142981 - RNA, 12 nt, Staphylococcus aureus subsp. aureus N315
ccguuauuuuca

SEQ ID NO: 2142982 - RNA, 18 nt, Staphylococcus aureus subsp. aureus N315
ccuccuggugcugcacca

SEQ ID NO: 2142983 - RNA, 21 nt, Staphylococcus aureus subsp. aureus N315
aaacgcaauacgaauaucugu

SEQ ID NO: 2142984 - RNA, 13 nt, Staphylococcus aureus subsp. aureus N315
ccucaucgaguuu

SEQ ID NO: 2142985 - RNA, 11 nt, Staphylococcus aureus subsp. aureus N315
ccuauuuuuua

SEQ ID NO: 2142986 - RNA, 13 nt, Staphylococcus aureus subsp. aureus N315
ccuauauguaggg

SEQ ID NO: 2142987 - RNA, 18 nt, Staphylococcus aureus subsp. aureus N315
ccuauauuuuuagcuuua

SEQ ID NO: 2142988 - RNA, 11 nt, Staphylococcus aureus subsp. aureus N315
ccuauaauagc

SEQ ID NO: 2142989 - RNA, 21 nt, Staphylococcus aureus subsp. aureus N315
ccuaggaaauaaaaaauaacc

SEQ ID NO: 2142990 - RNA, 17 nt, Staphylococcus aureus subsp. aureus N315
ccuaggaaauaaaaaau

SEQ ID NO: 2142991 - RNA, 19 nt, Staphylococcus aureus subsp. aureus N315
ccuaggaaauaaaaaauaa

SEQ ID NO: 2142992 - RNA, 20 nt, Staphylococcus aureus subsp. aureus N315
ccuaggaguaucuguuucua

SEQ ID NO: 2142993 - RNA, 16 nt, Staphylococcus aureus subsp. aureus N315
ccuacguguguaguag

SEQ ID NO: 2142994 - RNA, 16 nt, Staphylococcus aureus subsp. aureus N315
ccuagcaaaaauacuu

SEQ ID NO: 2142995 - RNA, 17 nt, Staphylococcus aureus subsp. aureus N315
ccuagauaccaaacugc

SEQ ID NO: 2142996 - RNA, 18 nt, Staphylococcus aureus subsp. aureus N315
ccuacuuuucaacuuuag

SEQ ID NO: 2142997 - RNA, 22 nt, Staphylococcus aureus subsp. aureus N315
ccuagaacauugauuauuguuc

SEQ ID NO: 2142998 - RNA, 17 nt, Staphylococcus aureus subsp. aureus N315
ccuaauucgccaucuuu

SEQ ID NO: 2142999 - RNA, 20 nt, Staphylococcus aureus subsp. aureus N315
ccuaauggucgugcuugcgg

SEQ ID NO: 2143000 - RNA, 16 nt, Staphylococcus aureus subsp. aureus N315
ccuaauuauauuaaug

SEQ ID NO: 2143001 - RNA, 21 nt, Staphylococcus aureus subsp. aureus N315
ccuaaugagcccguuaaaaag

SEQ ID NO: 2143002 - RNA, 12 nt, Staphylococcus aureus subsp. aureus N315
ccuaaugcuuua

SEQ ID NO: 2143003 - RNA, 17 nt, Staphylococcus aureus subsp. aureus N315
ccuaaucuaccauguuu

SEQ ID NO: 2143004 - RNA, 14 nt, Staphylococcus aureus subsp. aureus N315
ccuaauauuuuaaa

SEQ ID NO: 2143005 - RNA, 24 nt, Staphylococcus aureus subsp. aureus N315
ccuaauucuugagcaaugucuuua

SEQ ID NO: 2143006 - RNA, 18 nt, Staphylococcus aureus subsp. aureus N315
ccuacaaauauguaauca

SEQ ID NO: 2143007 - RNA, 18 nt, Staphylococcus aureus subsp. aureus N315
ccuacaaauauuucuaaa

SEQ ID NO: 2143008 - RNA, 19 nt, Staphylococcus aureus subsp. aureus N315
ccuacaacaccaauugaaa

SEQ ID NO: 2143009 - RNA, 22 nt, Staphylococcus aureus subsp. aureus N315
ccuacagauuuuaaaaauucau

SEQ ID NO: 2143010 - RNA, 23 nt, Staphylococcus aureus subsp. aureus N315
aaaccgugagggacgucaucaug

SEQ ID NO: 2143011 - RNA, 17 nt, Staphylococcus aureus subsp. aureus N315
aaaccuaaugcuuuaau

SEQ ID NO: 2143012 - RNA, 15 nt, Staphylococcus aureus subsp. aureus N315
cgacaauuccauaag

SEQ ID NO: 2143013 - RNA, 20 nt, Staphylococcus aureus subsp. aureus N315
cgacaauuauaauaaaacuu

SEQ ID NO: 2143014 - RNA, 17 nt, Staphylococcus aureus subsp. aureus N315
cgaauugguaaaaaucu

SEQ ID NO: 2143015 - RNA, 22 nt, Staphylococcus aureus subsp. aureus N315
cgaauucucgauuuuuuuauau

SEQ ID NO: 2143016 - RNA, 18 nt, Staphylococcus aureus subsp. aureus N315
cgaauucuccguuaauuu

SEQ ID NO: 2143017 - RNA, 20 nt, Staphylococcus aureus subsp. aureus N315
cgaauucaccuucccaguca

SEQ ID NO: 2143018 - RNA, 17 nt, Staphylococcus aureus subsp. aureus N315
cgacacguguaaaaaug

SEQ ID NO: 2143019 - RNA, 10 nt, Staphylococcus aureus subsp. aureus N315
cgacaucuag

SEQ ID NO: 2143020 - RNA, 14 nt, Staphylococcus aureus subsp. aureus N315
cgaauuaaaauaac

SEQ ID NO: 2143021 - RNA, 18 nt, Staphylococcus aureus subsp. aureus N315
cgaauuaagaaaaguuac

SEQ ID NO: 2143022 - RNA, 14 nt, Staphylococcus aureus subsp. aureus N315
cgaauucauuaacg

SEQ ID NO: 2143023 - RNA, 22 nt, Staphylococcus aureus subsp. aureus N315
cgaauguuccuuguuuuaaacu

SEQ ID NO: 2143024 - RNA, 16 nt, Staphylococcus aureus subsp. aureus N315
cgaauaacuguuuauc

SEQ ID NO: 2143025 - RNA, 20 nt, Staphylococcus aureus subsp. aureus N315
cgaauaacguuggaaacuuc

SEQ ID NO: 2143026 - RNA, 11 nt, Staphylococcus aureus subsp. aureus N315
ccuuuuuaaaa

SEQ ID NO: 2143027 - RNA, 21 nt, Staphylococcus aureus subsp. aureus N315
cgaccagucgcauauuuugau

SEQ ID NO: 2143028 - RNA, 20 nt, Staphylococcus aureus subsp. aureus N315
cgacauguccauaauauccu

SEQ ID NO: 2143029 - RNA, 18 nt, Staphylococcus aureus subsp. aureus N315
cgacauuuguaaauauuu

SEQ ID NO: 2143030 - RNA, 23 nt, Staphylococcus aureus subsp. aureus N315
cgacgguauaaaaaaauuaacua

SEQ ID NO: 2143031 - RNA, 21 nt, Staphylococcus aureus subsp. aureus N315
ccuugaccuacuuuuucaaua

SEQ ID NO: 2143032 - RNA, 21 nt, Staphylococcus aureus subsp. aureus N315
ccuuguuuaaguuuuucaggg

SEQ ID NO: 2143033 - RNA, 19 nt, Staphylococcus aureus subsp. aureus N315
ccuuuauauucuaauauuc

SEQ ID NO: 2143034 - RNA, 16 nt, Staphylococcus aureus subsp. aureus N315
ccuuuagccaaugcuu

SEQ ID NO: 2143035 - RNA, 14 nt, Staphylococcus aureus subsp. aureus N315
ccuuuauuuuuaug

SEQ ID NO: 2143036 - RNA, 17 nt, Staphylococcus aureus subsp. aureus N315
ccuuuacucauauugaa

SEQ ID NO: 2143037 - RNA, 18 nt, Staphylococcus aureus subsp. aureus N315
ccuuuaauuacacuacgc

SEQ ID NO: 2143038 - RNA, 20 nt, Staphylococcus aureus subsp. aureus N315
ccuuuaauuguuaaaucacc

SEQ ID NO: 2143039 - RNA, 22 nt, Staphylococcus aureus subsp. aureus N315
ccuuuaauuguuaaaucaccaa

SEQ ID NO: 2143040 - RNA, 18 nt, Staphylococcus aureus subsp. aureus N315
ccuuuaaaacaucauuca

SEQ ID NO: 2143041 - RNA, 15 nt, Staphylococcus aureus subsp. aureus N315
ccuuuaauuacacua

SEQ ID NO: 2143042 - RNA, 17 nt, Staphylococcus aureus subsp. aureus N315
ccuuuaauaauauugaa

SEQ ID NO: 2143043 - RNA, 20 nt, Staphylococcus aureus subsp. aureus N315
ccuuucauuuuagcaaaagc

SEQ ID NO: 2143044 - RNA, 14 nt, Staphylococcus aureus subsp. aureus N315
ccuuuugaauaauu

SEQ ID NO: 2143045 - RNA, 22 nt, Staphylococcus aureus subsp. aureus N315
ccuuuugauguuuaugacaaag

SEQ ID NO: 2143046 - RNA, 19 nt, Staphylococcus aureus subsp. aureus N315
ccuucgcauacuuuuucag

SEQ ID NO: 2143047 - RNA, 15 nt, Staphylococcus aureus subsp. aureus N315
ccuguagaauuucuu

SEQ ID NO: 2143048 - RNA, 16 nt, Staphylococcus aureus subsp. aureus N315
ccuucaauccaagcaa

SEQ ID NO: 2143049 - RNA, 18 nt, Staphylococcus aureus subsp. aureus N315
ccuucaaaaguuuuugga

SEQ ID NO: 2143050 - RNA, 20 nt, Staphylococcus aureus subsp. aureus N315
ccuucaauguucaauucacg

SEQ ID NO: 2143051 - RNA, 14 nt, Staphylococcus aureus subsp. aureus N315
ccuggaauauuaac

SEQ ID NO: 2143052 - RNA, 16 nt, Staphylococcus aureus subsp. aureus N315
ccuggaauauuaacac

SEQ ID NO: 2143053 - RNA, 21 nt, Staphylococcus aureus subsp. aureus N315
ccuggaauauuaacaccagau

SEQ ID NO: 2143054 - RNA, 19 nt, Staphylococcus aureus subsp. aureus N315
cauucuugaauaaauuuua

SEQ ID NO: 2143055 - RNA, 15 nt, Staphylococcus aureus subsp. aureus N315
cauucuucaaaaaau

SEQ ID NO: 2143056 - RNA, 13 nt, Staphylococcus aureus subsp. aureus N315
cauucuuauuuga

SEQ ID NO: 2143057 - RNA, 15 nt, Staphylococcus aureus subsp. aureus N315
cauucuuuauagaaa

SEQ ID NO: 2143058 - RNA, 21 nt, Staphylococcus aureus subsp. aureus N315
cauucuuuuucucaaugugag

SEQ ID NO: 2143059 - RNA, 19 nt, Staphylococcus aureus subsp. aureus N315
cauucuuuuucucaaugug

SEQ ID NO: 2143060 - RNA, 19 nt, Staphylococcus aureus subsp. aureus N315
cauugaaaggaacauuuca

SEQ ID NO: 2143061 - RNA, 21 nt, Staphylococcus aureus subsp. aureus N315
cauugaaaucgucuuacugcu

SEQ ID NO: 2143062 - RNA, 21 nt, Staphylococcus aureus subsp. aureus N315
cauugacacacccaaauuuag

SEQ ID NO: 2143063 - RNA, 17 nt, Staphylococcus aureus subsp. aureus N315
cauugaauaaaugaagg

SEQ ID NO: 2143064 - RNA, 22 nt, Staphylococcus aureus subsp. aureus N315
cauugaccaccuuuaucuguaa

SEQ ID NO: 2143065 - RNA, 18 nt, Staphylococcus aureus subsp. aureus N315
cauugaccaccuuuaucu

SEQ ID NO: 2143066 - RNA, 21 nt, Staphylococcus aureus subsp. aureus N315
cauugagauuaucuuuagaca

SEQ ID NO: 2143067 - RNA, 14 nt, Staphylococcus aureus subsp. aureus N315
cauucaucgucuca

SEQ ID NO: 2143068 - RNA, 12 nt, Staphylococcus aureus subsp. aureus N315
cauuccaaaaau

SEQ ID NO: 2143069 - RNA, 13 nt, Staphylococcus aureus subsp. aureus N315
cauuauuaaauag

SEQ ID NO: 2143070 - RNA, 16 nt, Staphylococcus aureus subsp. aureus N315
cauuauuauuuuaaua

SEQ ID NO: 2143071 - RNA, 14 nt, Staphylococcus aureus subsp. aureus N315
cauucaauguuuaa

SEQ ID NO: 2143072 - RNA, 21 nt, Staphylococcus aureus subsp. aureus N315
cauucaccaauauuaaugaau

SEQ ID NO: 2143073 - RNA, 19 nt, Staphylococcus aureus subsp. aureus N315
cauucaccuaaaaagaaaa

SEQ ID NO: 2143074 - RNA, 17 nt, Staphylococcus aureus subsp. aureus N315
cauuauuaagugaguuu

SEQ ID NO: 2143075 - RNA, 12 nt, Staphylococcus aureus subsp. aureus N315
cauuauuaagug

SEQ ID NO: 2143076 - RNA, 15 nt, Staphylococcus aureus subsp. aureus N315
cauuauguucuucac

SEQ ID NO: 2143077 - RNA, 21 nt, Staphylococcus aureus subsp. aureus N315
cauuaauuggauuaaauacgc

SEQ ID NO: 2143078 - RNA, 18 nt, Staphylococcus aureus subsp. aureus N315
cauuauauaauucuucaa

SEQ ID NO: 2143079 - RNA, 20 nt, Staphylococcus aureus subsp. aureus N315
cauuaucaagaauaacuauu

SEQ ID NO: 2143080 - RNA, 15 nt, Staphylococcus aureus subsp. aureus N315
cauuaucaagaacuu

SEQ ID NO: 2143081 - RNA, 16 nt, Staphylococcus aureus subsp. aureus N315
cauuaauccuuuauau

SEQ ID NO: 2143082 - RNA, 14 nt, Staphylococcus aureus subsp. aureus N315
cauuaaauguacau

SEQ ID NO: 2143083 - RNA, 13 nt, Staphylococcus aureus subsp. aureus N315
cauuaaauugcuu

SEQ ID NO: 2143084 - RNA, 18 nt, Staphylococcus aureus subsp. aureus N315
cauuaaaaauaaaagcaa

SEQ ID NO: 2143085 - RNA, 22 nt, Staphylococcus aureus subsp. aureus N315
cauuaaaaggaugugacaaaua

SEQ ID NO: 2143086 - RNA, 21 nt, Staphylococcus aureus subsp. aureus N315
cauuaaaauaauuaaauaaaa

SEQ ID NO: 2143087 - RNA, 23 nt, Staphylococcus aureus subsp. aureus N315
cauuaaaaggaugugacaaauac

SEQ ID NO: 2143088 - RNA, 17 nt, Staphylococcus aureus subsp. aureus N315
cauuaaaaacgauucau

SEQ ID NO: 2143089 - RNA, 22 nt, Staphylococcus aureus subsp. aureus N315
cauuaaaaacgauucauuauau

SEQ ID NO: 2143090 - RNA, 23 nt, Staphylococcus aureus subsp. aureus N315
cauuaaaaaaucgaacuagacaa

SEQ ID NO: 2143091 - RNA, 19 nt, Staphylococcus aureus subsp. aureus N315
cauuaaaauguguuuucaa

SEQ ID NO: 2143092 - RNA, 13 nt, Staphylococcus aureus subsp. aureus N315
cauuaaaaugaua

SEQ ID NO: 2143093 - RNA, 20 nt, Staphylococcus aureus subsp. aureus N315
cauuaaauauuauuuugcaa

SEQ ID NO: 2143094 - RNA, 18 nt, Staphylococcus aureus subsp. aureus N315
cauguugauaaaaaggau

SEQ ID NO: 2143095 - RNA, 18 nt, Staphylococcus aureus subsp. aureus N315
cauguucuuauaaaaaac

SEQ ID NO: 2143096 - RNA, 20 nt, Staphylococcus aureus subsp. aureus N315
cauguuugauucuaaauaau

SEQ ID NO: 2143097 - RNA, 15 nt, Staphylococcus aureus subsp. aureus N315
cauguuuuuuaagua

SEQ ID NO: 2143098 - RNA, 19 nt, Staphylococcus aureus subsp. aureus N315
cauguuuggaugaacaaaa

SEQ ID NO: 2143099 - RNA, 21 nt, Staphylococcus aureus subsp. aureus N315
cauguuuggaugaacaaaaua

SEQ ID NO: 2143100 - RNA, 15 nt, Staphylococcus aureus subsp. aureus N315
cauguauuggccaaa

SEQ ID NO: 2143101 - RNA, 14 nt, Staphylococcus aureus subsp. aureus N315
caugucaauuuuuu

SEQ ID NO: 2143102 - RNA, 15 nt, Staphylococcus aureus subsp. aureus N315
caugucaauuuuuuc

SEQ ID NO: 2143103 - RNA, 12 nt, Staphylococcus aureus subsp. aureus N315
cauguauaaaag

SEQ ID NO: 2143104 - RNA, 21 nt, Staphylococcus aureus subsp. aureus N315
caugucaauuuuuucaugauu

SEQ ID NO: 2143105 - RNA, 22 nt, Staphylococcus aureus subsp. aureus N315
cauguaacaaaauacccugcuu

SEQ ID NO: 2143106 - RNA, 20 nt, Staphylococcus aureus subsp. aureus N315
cauguaaauaguuaguuuau

SEQ ID NO: 2143107 - RNA, 17 nt, Staphylococcus aureus subsp. aureus N315
caugauucaugauaugu

SEQ ID NO: 2143108 - RNA, 16 nt, Staphylococcus aureus subsp. aureus N315
caugauugaaauccuu

SEQ ID NO: 2143109 - RNA, 17 nt, Staphylococcus aureus subsp. aureus N315
caugauacugaaauuuc

SEQ ID NO: 2143110 - RNA, 12 nt, Staphylococcus aureus subsp. aureus N315
caugaugauaaa

SEQ ID NO: 2143111 - RNA, 16 nt, Staphylococcus aureus subsp. aureus N315
caugcacuuuauuaaa

SEQ ID NO: 2143112 - RNA, 12 nt, Staphylococcus aureus subsp. aureus N315
caugauuuacua

SEQ ID NO: 2143113 - RNA, 17 nt, Staphylococcus aureus subsp. aureus N315
caugauuuacuaaugcu

SEQ ID NO: 2143114 - RNA, 19 nt, Staphylococcus aureus subsp. aureus N315
caugcccgagacuauauuc

SEQ ID NO: 2143115 - RNA, 18 nt, Staphylococcus aureus subsp. aureus N315
caugccuuaugucauaua

SEQ ID NO: 2143116 - RNA, 14 nt, Staphylococcus aureus subsp. aureus N315
caugccuucaugaa

SEQ ID NO: 2143117 - RNA, 23 nt, Staphylococcus aureus subsp. aureus N315
caugcgcaaaagcgcaggcgaac

SEQ ID NO: 2143118 - RNA, 20 nt, Staphylococcus aureus subsp. aureus N315
caugacauaaaacuuacauu

SEQ ID NO: 2143119 - RNA, 15 nt, Staphylococcus aureus subsp. aureus N315
caugacauucauuua

SEQ ID NO: 2143120 - RNA, 23 nt, Staphylococcus aureus subsp. aureus N315
caugaaugucagucguuguaaaa

SEQ ID NO: 2143121 - RNA, 20 nt, Staphylococcus aureus subsp. aureus N315
caugaaucaacaauuuaaac

SEQ ID NO: 2143122 - RNA, 21 nt, Staphylococcus aureus subsp. aureus N315
caugaaucaacaauuuaaacg

SEQ ID NO: 2143123 - RNA, 15 nt, Staphylococcus aureus subsp. aureus N315
caugaauaaauacaa

SEQ ID NO: 2143124 - RNA, 18 nt, Staphylococcus aureus subsp. aureus N315
caugaaaaggaaaaacuu

SEQ ID NO: 2143125 - RNA, 13 nt, Staphylococcus aureus subsp. aureus N315
caucuuuuuaaaa

SEQ ID NO: 2143126 - RNA, 14 nt, Staphylococcus aureus subsp. aureus N315
caucuuuuauggug

SEQ ID NO: 2143127 - RNA, 21 nt, Staphylococcus aureus subsp. aureus N315
caucuuuguaaccuaaaaaca

SEQ ID NO: 2143128 - RNA, 20 nt, Staphylococcus aureus subsp. aureus N315
caucuucuugauuguaaaua

SEQ ID NO: 2143129 - RNA, 23 nt, Staphylococcus aureus subsp. aureus N315
caucuucuugauuguaaauaaaa

SEQ ID NO: 2143130 - RNA, 15 nt, Staphylococcus aureus subsp. aureus N315
caucuucuucaaaac

SEQ ID NO: 2143131 - RNA, 18 nt, Staphylococcus aureus subsp. aureus N315
caucguuaucuuuaagua

SEQ ID NO: 2143132 - RNA, 19 nt, Staphylococcus aureus subsp. aureus N315
caucuugcgccuuguucaa

SEQ ID NO: 2143133 - RNA, 18 nt, Staphylococcus aureus subsp. aureus N315
caucuugagauuuucaac

SEQ ID NO: 2143134 - RNA, 12 nt, Staphylococcus aureus subsp. aureus N315
caucuuucaaau

SEQ ID NO: 2143135 - RNA, 14 nt, Staphylococcus aureus subsp. aureus N315
caucuuuauuuaca

SEQ ID NO: 2143136 - RNA, 14 nt, Staphylococcus aureus subsp. aureus N315
caucuuuaaagaaa

SEQ ID NO: 2143137 - RNA, 19 nt, Staphylococcus aureus subsp. aureus N315
cauccaauuauguuuaucu

SEQ ID NO: 2143138 - RNA, 14 nt, Staphylococcus aureus subsp. aureus N315
cauccaauuauguu

SEQ ID NO: 2143139 - RNA, 19 nt, Staphylococcus aureus subsp. aureus N315
cauccacuuuuugccuggc

SEQ ID NO: 2143140 - RNA, 13 nt, Staphylococcus aureus subsp. aureus N315
caucaugcauaau

SEQ ID NO: 2143141 - RNA, 14 nt, Staphylococcus aureus subsp. aureus N315
caucauuuguguuu

SEQ ID NO: 2143142 - RNA, 21 nt, Staphylococcus aureus subsp. aureus N315
caucauuuguguaaaugaauu

SEQ ID NO: 2143143 - RNA, 21 nt, Staphylococcus aureus subsp. aureus N315
caucauuuaauugaugucaca

SEQ ID NO: 2143144 - RNA, 13 nt, Staphylococcus aureus subsp. aureus N315
caucauuaaaauc

SEQ ID NO: 2143145 - RNA, 15 nt, Staphylococcus aureus subsp. aureus N315
caucauuaaauauuu

SEQ ID NO: 2143146 - RNA, 14 nt, Staphylococcus aureus subsp. aureus N315
cauccccagccauu

SEQ ID NO: 2143147 - RNA, 16 nt, Staphylococcus aureus subsp. aureus N315
caucccauuaaaccac

SEQ ID NO: 2143148 - RNA, 15 nt, Staphylococcus aureus subsp. aureus N315
caucccauucaccaa

SEQ ID NO: 2143149 - RNA, 21 nt, Staphylococcus aureus subsp. aureus N315
cauccauauaugccgauugcu

SEQ ID NO: 2143150 - RNA, 13 nt, Staphylococcus aureus subsp. aureus N315
cauccauacaaau

SEQ ID NO: 2143151 - RNA, 14 nt, Staphylococcus aureus subsp. aureus N315
cauccauacaaauc

SEQ ID NO: 2143152 - RNA, 19 nt, Staphylococcus aureus subsp. aureus N315
cauccauaaaaauacgaca

SEQ ID NO: 2143153 - RNA, 13 nt, Staphylococcus aureus subsp. aureus N315
caucgccauccca

SEQ ID NO: 2143154 - RNA, 19 nt, Staphylococcus aureus subsp. aureus N315
caucaauuuaguccuucuu

SEQ ID NO: 2143155 - RNA, 18 nt, Staphylococcus aureus subsp. aureus N315
caucacucgcaaucgaga

SEQ ID NO: 2143156 - RNA, 13 nt, Staphylococcus aureus subsp. aureus N315
caucacuugcugu

SEQ ID NO: 2143157 - RNA, 14 nt, Staphylococcus aureus subsp. aureus N315
cauauaaauauuuu

SEQ ID NO: 2143158 - RNA, 20 nt, Staphylococcus aureus subsp. aureus N315
cauauucauaauaucgauga

SEQ ID NO: 2143159 - RNA, 19 nt, Staphylococcus aureus subsp. aureus N315
caucaaauagacaccaaaa

SEQ ID NO: 2143160 - RNA, 20 nt, Staphylococcus aureus subsp. aureus N315
caucaaguauaaauguuauu

SEQ ID NO: 2143161 - RNA, 13 nt, Staphylococcus aureus subsp. aureus N315
cauauuuuuuaaa

SEQ ID NO: 2143162 - RNA, 21 nt, Staphylococcus aureus subsp. aureus N315
cauauuuuuuaguaauaacau

SEQ ID NO: 2143163 - RNA, 16 nt, Staphylococcus aureus subsp. aureus N315
cauauuuugccucaau

SEQ ID NO: 2143164 - RNA, 20 nt, Staphylococcus aureus subsp. aureus N315
cauauuuguagccuacaacc

SEQ ID NO: 2143165 - RNA, 22 nt, Staphylococcus aureus subsp. aureus N315
cauagcauuaagaugauugucu

SEQ ID NO: 2143166 - RNA, 12 nt, Staphylococcus aureus subsp. aureus N315
cauauaaaaacc

SEQ ID NO: 2143167 - RNA, 19 nt, Staphylococcus aureus subsp. aureus N315
cauauaaagcugcgauaua

SEQ ID NO: 2143168 - RNA, 17 nt, Staphylococcus aureus subsp. aureus N315
cauauaaaaaauuauua

SEQ ID NO: 2143169 - RNA, 23 nt, Staphylococcus aureus subsp. aureus N315
cauauaaauauuuuuaauuauuu

SEQ ID NO: 2143170 - RNA, 12 nt, Staphylococcus aureus subsp. aureus N315
cauauaaaucaa

SEQ ID NO: 2143171 - RNA, 17 nt, Staphylococcus aureus subsp. aureus N315
cauauaaauauuuuuaa

SEQ ID NO: 2143172 - RNA, 23 nt, Staphylococcus aureus subsp. aureus N315
cauauaaaucguaauaauuuugu

SEQ ID NO: 2143173 - RNA, 21 nt, Staphylococcus aureus subsp. aureus N315
cauauaagccccaccaugauu

SEQ ID NO: 2143174 - RNA, 20 nt, Staphylococcus aureus subsp. aureus N315
cauauaugccgauugcucua

SEQ ID NO: 2143175 - RNA, 21 nt, Staphylococcus aureus subsp. aureus N315
cauaggcgcuuuuuuuuauaa

SEQ ID NO: 2143176 - RNA, 16 nt, Staphylococcus aureus subsp. aureus N315
cauagacacuuaacuu

SEQ ID NO: 2143177 - RNA, 14 nt, Staphylococcus aureus subsp. aureus N315
cauagauacaaagu

SEQ ID NO: 2143178 - RNA, 13 nt, Staphylococcus aureus subsp. aureus N315
cauagaugcuuca

SEQ ID NO: 2143179 - RNA, 21 nt, Staphylococcus aureus subsp. aureus N315
cauagaugcuucaaaaauuaa

SEQ ID NO: 2143180 - RNA, 17 nt, Staphylococcus aureus subsp. aureus N315
cauacugauuaaacugu

SEQ ID NO: 2143181 - RNA, 12 nt, Staphylococcus aureus subsp. aureus N315
cauacuucaaac

SEQ ID NO: 2143182 - RNA, 16 nt, Staphylococcus aureus subsp. aureus N315
cauacuucuauuuuau

SEQ ID NO: 2143183 - RNA, 17 nt, Staphylococcus aureus subsp. aureus N315
cauacuucuauuuuaua

SEQ ID NO: 2143184 - RNA, 22 nt, Staphylococcus aureus subsp. aureus N315
ccagcaugaaucgcauuuaaau

SEQ ID NO: 2143185 - RNA, 22 nt, Staphylococcus aureus subsp. aureus N315
ccagccccaauuagccccagua

SEQ ID NO: 2143186 - RNA, 13 nt, Staphylococcus aureus subsp. aureus N315
ccagccacaccaa

SEQ ID NO: 2143187 - RNA, 20 nt, Staphylococcus aureus subsp. aureus N315
ccagaugcaaugauaccuuu

SEQ ID NO: 2143188 - RNA, 14 nt, Staphylococcus aureus subsp. aureus N315
ccagauaucauaau

SEQ ID NO: 2143189 - RNA, 12 nt, Staphylococcus aureus subsp. aureus N315
ccagacuccuaa

SEQ ID NO: 2143190 - RNA, 22 nt, Staphylococcus aureus subsp. aureus N315
ccagaauguguuggcuuuuuga

SEQ ID NO: 2143191 - RNA, 20 nt, Staphylococcus aureus subsp. aureus N315
ccacuuuuucuguaauaauu

SEQ ID NO: 2143192 - RNA, 20 nt, Staphylococcus aureus subsp. aureus N315
ccacuugaauacuuuuuaac

SEQ ID NO: 2143193 - RNA, 16 nt, Staphylococcus aureus subsp. aureus N315
ccacuugaauacuuuu

SEQ ID NO: 2143194 - RNA, 21 nt, Staphylococcus aureus subsp. aureus N315
ccacuugaauacuuuuuaacu

SEQ ID NO: 2143195 - RNA, 12 nt, Staphylococcus aureus subsp. aureus N315
ccacauuuuccu

SEQ ID NO: 2143196 - RNA, 13 nt, Staphylococcus aureus subsp. aureus N315
ccacaacauguuu

SEQ ID NO: 2143197 - RNA, 22 nt, Staphylococcus aureus subsp. aureus N315
ccaauucauuuuauaaaucaaa

SEQ ID NO: 2143198 - RNA, 16 nt, Staphylococcus aureus subsp. aureus N315
ccaaugauuguuaaua

SEQ ID NO: 2143199 - RNA, 14 nt, Staphylococcus aureus subsp. aureus N315
ccaauuaauaaaca

SEQ ID NO: 2143200 - RNA, 22 nt, Staphylococcus aureus subsp. aureus N315
ccaauuaaaucgauuaagaaug

SEQ ID NO: 2143201 - RNA, 19 nt, Staphylococcus aureus subsp. aureus N315
ccaaguuuugcacgcauac

SEQ ID NO: 2143202 - RNA, 13 nt, Staphylococcus aureus subsp. aureus N315
ccaauaaacaacu

SEQ ID NO: 2143203 - RNA, 10 nt, Staphylococcus aureus subsp. aureus N315
ccaauaaucc

SEQ ID NO: 2143204 - RNA, 14 nt, Staphylococcus aureus subsp. aureus N315
ccaauaauaaauca

SEQ ID NO: 2143205 - RNA, 19 nt, Staphylococcus aureus subsp. aureus N315
ccaauaaaaugcaauuuuu

SEQ ID NO: 2143206 - RNA, 20 nt, Staphylococcus aureus subsp. aureus N315
ccaccuacgcccaucaucac

SEQ ID NO: 2143207 - RNA, 21 nt, Staphylococcus aureus subsp. aureus N315
ccaccuuguuuaaguuuuuca

SEQ ID NO: 2143208 - RNA, 14 nt, Staphylococcus aureus subsp. aureus N315
ccaccuuguuuaag

SEQ ID NO: 2143209 - RNA, 14 nt, Staphylococcus aureus subsp. aureus N315
ccaccuuuaucugu

SEQ ID NO: 2143210 - RNA, 22 nt, Staphylococcus aureus subsp. aureus N315
ccaaaugugguggguauauaau

SEQ ID NO: 2143211 - RNA, 13 nt, Staphylococcus aureus subsp. aureus N315
ccaacacauaaau

SEQ ID NO: 2143212 - RNA, 22 nt, Staphylococcus aureus subsp. aureus N315
ccaacacagagaaauucgaaaa

SEQ ID NO: 2143213 - RNA, 16 nt, Staphylococcus aureus subsp. aureus N315
ccaacaccuaauauuu

SEQ ID NO: 2143214 - RNA, 17 nt, Staphylococcus aureus subsp. aureus N315
ccaacauguaacaaaau

SEQ ID NO: 2143215 - RNA, 18 nt, Staphylococcus aureus subsp. aureus N315
ccaaaucuuuaauaaccu

SEQ ID NO: 2143216 - RNA, 13 nt, Staphylococcus aureus subsp. aureus N315
ccaaauauaauuu

SEQ ID NO: 2143217 - RNA, 21 nt, Staphylococcus aureus subsp. aureus N315
ccaaauauaauuucaauuuau

SEQ ID NO: 2143218 - RNA, 13 nt, Staphylococcus aureus subsp. aureus N315
ccaaauaauaucu

SEQ ID NO: 2143219 - RNA, 13 nt, Staphylococcus aureus subsp. aureus N315
ccaaauaaauaua

SEQ ID NO: 2143220 - RNA, 20 nt, Staphylococcus aureus subsp. aureus N315
ccaaauaaauuaaauuuugu

SEQ ID NO: 2143221 - RNA, 21 nt, Staphylococcus aureus subsp. aureus N315
ccaaagaaagcuaauaucaau

SEQ ID NO: 2143222 - RNA, 14 nt, Staphylococcus aureus subsp. aureus N315
ccaacuugcacauu

SEQ ID NO: 2143223 - RNA, 16 nt, Staphylococcus aureus subsp. aureus N315
ccaacuugcacauuau

SEQ ID NO: 2143224 - RNA, 21 nt, Staphylococcus aureus subsp. aureus N315
ccaaacaaccugugauaaaaa

SEQ ID NO: 2143225 - RNA, 20 nt, Staphylococcus aureus subsp. aureus N315
ccaaagaaacggaaaugacu

SEQ ID NO: 2143226 - RNA, 16 nt, Staphylococcus aureus subsp. aureus N315
ccaaaacauuuuguga

SEQ ID NO: 2143227 - RNA, 22 nt, Staphylococcus aureus subsp. aureus N315
ccaaaaauagauugaaaaaaua

SEQ ID NO: 2143228 - RNA, 18 nt, Staphylococcus aureus subsp. aureus N315
ccaaaaugguuaaaaucg

SEQ ID NO: 2143229 - RNA, 21 nt, Staphylococcus aureus subsp. aureus N315
ccaaaagaaauuuaauacaau

SEQ ID NO: 2143230 - RNA, 16 nt, Staphylococcus aureus subsp. aureus N315
cauuuuuucauuauua

SEQ ID NO: 2143231 - RNA, 20 nt, Staphylococcus aureus subsp. aureus N315
cauuuuuauuuaacacuuca

SEQ ID NO: 2143232 - RNA, 21 nt, Staphylococcus aureus subsp. aureus N315
cauuuuuaauuuugacauaaa

SEQ ID NO: 2143233 - RNA, 16 nt, Staphylococcus aureus subsp. aureus N315
cauuuuuauaaauuuu

SEQ ID NO: 2143234 - RNA, 16 nt, Staphylococcus aureus subsp. aureus N315
cauuuuuaauuuugac

SEQ ID NO: 2143235 - RNA, 20 nt, Staphylococcus aureus subsp. aureus N315
cauuuugacgccagaauaaa

SEQ ID NO: 2143236 - RNA, 12 nt, Staphylococcus aureus subsp. aureus N315
cauuuucugcuu

SEQ ID NO: 2143237 - RNA, 15 nt, Staphylococcus aureus subsp. aureus N315
cauugauaaaauaau

SEQ ID NO: 2143238 - RNA, 19 nt, Staphylococcus aureus subsp. aureus N315
cauugaucaacauuacgua

SEQ ID NO: 2143239 - RNA, 20 nt, Staphylococcus aureus subsp. aureus N315
caguaagacgauuucaauga

SEQ ID NO: 2143240 - RNA, 17 nt, Staphylococcus aureus subsp. aureus N315
caguaacaauaacaccu

SEQ ID NO: 2143241 - RNA, 14 nt, Staphylococcus aureus subsp. aureus N315
caguacaaauaaca

SEQ ID NO: 2143242 - RNA, 11 nt, Staphylococcus aureus subsp. aureus N315
caguaauaaug

SEQ ID NO: 2143243 - RNA, 19 nt, Staphylococcus aureus subsp. aureus N315
caguaaguaauaaaauaaa

SEQ ID NO: 2143244 - RNA, 19 nt, Staphylococcus aureus subsp. aureus N315
caguaaucaugcauucuau

SEQ ID NO: 2143245 - RNA, 16 nt, Staphylococcus aureus subsp. aureus N315
caguaaucaaaguauc

SEQ ID NO: 2143246 - RNA, 15 nt, Staphylococcus aureus subsp. aureus N315
cagguuuuaugaauu

SEQ ID NO: 2143247 - RNA, 16 nt, Staphylococcus aureus subsp. aureus N315
aaacaacuucugaaac

SEQ ID NO: 2143248 - RNA, 14 nt, Staphylococcus aureus subsp. aureus N315
aaacaaauaaaugu

SEQ ID NO: 2143249 - RNA, 21 nt, Staphylococcus aureus subsp. aureus N315
aaacaaagcucaauaaauuau

SEQ ID NO: 2143250 - RNA, 21 nt, Staphylococcus aureus subsp. aureus N315
aaacaacaaucaaauuacaaa

SEQ ID NO: 2143251 - RNA, 20 nt, Staphylococcus aureus subsp. aureus N315
aaacaacaucgauuuaucau

SEQ ID NO: 2143252 - RNA, 15 nt, Staphylococcus aureus subsp. aureus N315
aaacaacaaguaaaa

SEQ ID NO: 2143253 - RNA, 17 nt, Staphylococcus aureus subsp. aureus N315
cagguuguuaggggcuu

SEQ ID NO: 2143254 - RNA, 16 nt, Staphylococcus aureus subsp. aureus N315
cagguuuaauaaauuu

SEQ ID NO: 2143255 - RNA, 21 nt, Staphylococcus aureus subsp. aureus N315
cagguuuaaacaucuauaaca

SEQ ID NO: 2143256 - RNA, 22 nt, Staphylococcus aureus subsp. aureus N315
cagguuuaaacaucuauaacaa

SEQ ID NO: 2143257 - RNA, 13 nt, Staphylococcus aureus subsp. aureus N315
cagguuaacauuu

SEQ ID NO: 2143258 - RNA, 12 nt, Staphylococcus aureus subsp. aureus N315
cagguucaaaau

SEQ ID NO: 2143259 - RNA, 15 nt, Staphylococcus aureus subsp. aureus N315
caguaggauaauuuc

SEQ ID NO: 2143260 - RNA, 21 nt, Staphylococcus aureus subsp. aureus N315
caguaguugacugaacgaaaa

SEQ ID NO: 2143261 - RNA, 15 nt, Staphylococcus aureus subsp. aureus N315
caguauaauuuucug

SEQ ID NO: 2143262 - RNA, 15 nt, Staphylococcus aureus subsp. aureus N315
caguauauaucaaau

SEQ ID NO: 2143263 - RNA, 17 nt, Staphylococcus aureus subsp. aureus N315
caguauauaucaaauac

SEQ ID NO: 2143264 - RNA, 22 nt, Staphylococcus aureus subsp. aureus N315
caguacgguuauuuaauaaugc

SEQ ID NO: 2143265 - RNA, 18 nt, Staphylococcus aureus subsp. aureus N315
cagucauuugauuuaaaa

SEQ ID NO: 2143266 - RNA, 23 nt, Staphylococcus aureus subsp. aureus N315
caguauuugccuuuugaauaauu

SEQ ID NO: 2143267 - RNA, 14 nt, Staphylococcus aureus subsp. aureus N315
caguauuuuuugug

SEQ ID NO: 2143268 - RNA, 17 nt, Staphylococcus aureus subsp. aureus N315
cagucaacuacugucaa

SEQ ID NO: 2143269 - RNA, 14 nt, Staphylococcus aureus subsp. aureus N315
cagucaacugcugc

SEQ ID NO: 2143270 - RNA, 20 nt, Staphylococcus aureus subsp. aureus N315
cagucaauuuuuucaucuuu

SEQ ID NO: 2143271 - RNA, 13 nt, Staphylococcus aureus subsp. aureus N315
cagucaacuacug

SEQ ID NO: 2143272 - RNA, 17 nt, Staphylococcus aureus subsp. aureus N315
caguaucucuuuucuau

SEQ ID NO: 2143273 - RNA, 17 nt, Staphylococcus aureus subsp. aureus N315
caguauguggauacaaa

SEQ ID NO: 2143274 - RNA, 17 nt, Staphylococcus aureus subsp. aureus N315
cagucucuuugaagggg

SEQ ID NO: 2143275 - RNA, 12 nt, Staphylococcus aureus subsp. aureus N315
cagugaccucag

SEQ ID NO: 2143276 - RNA, 18 nt, Staphylococcus aureus subsp. aureus N315
cagugaucuuuuuuauau

SEQ ID NO: 2143277 - RNA, 11 nt, Staphylococcus aureus subsp. aureus N315
cagugcaauga

SEQ ID NO: 2143278 - RNA, 22 nt, Staphylococcus aureus subsp. aureus N315
cagugaaucuaaacuauaauaa

SEQ ID NO: 2143279 - RNA, 15 nt, Staphylococcus aureus subsp. aureus N315
cagugaaguuaacua

SEQ ID NO: 2143280 - RNA, 19 nt, Staphylococcus aureus subsp. aureus N315
aaaauuuuuaaaaaaauaa

SEQ ID NO: 2143281 - RNA, 17 nt, Staphylococcus aureus subsp. aureus N315
aaaauuuuuaaaaaaau

SEQ ID NO: 2143282 - RNA, 14 nt, Staphylococcus aureus subsp. aureus N315
aaaauuuugaagaa

SEQ ID NO: 2143283 - RNA, 21 nt, Staphylococcus aureus subsp. aureus N315
caggaauaaauuuugcgaaaa

SEQ ID NO: 2143284 - RNA, 13 nt, Staphylococcus aureus subsp. aureus N315
aaaauuuguauaa

SEQ ID NO: 2143285 - RNA, 22 nt, Staphylococcus aureus subsp. aureus N315
aaaauuugaaauauaccaacca

SEQ ID NO: 2143286 - RNA, 22 nt, Staphylococcus aureus subsp. aureus N315
aaaauuugcucgugaaaagcag

SEQ ID NO: 2143287 - RNA, 12 nt, Staphylococcus aureus subsp. aureus N315
cagcuuuuucua

SEQ ID NO: 2143288 - RNA, 14 nt, Staphylococcus aureus subsp. aureus N315
cagcuuuuucauuc

SEQ ID NO: 2143289 - RNA, 20 nt, Staphylococcus aureus subsp. aureus N315
cagcuugaccgccuaugaua

SEQ ID NO: 2143290 - RNA, 15 nt, Staphylococcus aureus subsp. aureus N315
cagcuucaaaaucaa

SEQ ID NO: 2143291 - RNA, 12 nt, Staphylococcus aureus subsp. aureus N315
cagcuucauuaa

SEQ ID NO: 2143292 - RNA, 19 nt, Staphylococcus aureus subsp. aureus N315
cagcucuuaaaucacuagc

SEQ ID NO: 2143293 - RNA, 13 nt, Staphylococcus aureus subsp. aureus N315
cagcuaauugucg

SEQ ID NO: 2143294 - RNA, 23 nt, Staphylococcus aureus subsp. aureus N315
aaaauugugccauuugcaacaau

SEQ ID NO: 2143295 - RNA, 16 nt, Staphylococcus aureus subsp. aureus N315
aaaauugcuaaaaaaa

SEQ ID NO: 2143296 - RNA, 17 nt, Staphylococcus aureus subsp. aureus N315
aaaauugcuauauuagu

SEQ ID NO: 2143297 - RNA, 22 nt, Staphylococcus aureus subsp. aureus N315
aaaauugguuuggauaaaauga

SEQ ID NO: 2143298 - RNA, 21 nt, Staphylococcus aureus subsp. aureus N315
aaaauugguuuggauaaaaug

SEQ ID NO: 2143299 - RNA, 21 nt, Staphylococcus aureus subsp. aureus N315
aaaauugauauugcaaaacuu

SEQ ID NO: 2143300 - RNA, 18 nt, Staphylococcus aureus subsp. aureus N315
aaaauuuauucaaaucau

SEQ ID NO: 2143301 - RNA, 16 nt, Staphylococcus aureus subsp. aureus N315
aaaauuuauucaaaau

SEQ ID NO: 2143302 - RNA, 19 nt, Staphylococcus aureus subsp. aureus N315
aaaauuuauucaaaauuca

SEQ ID NO: 2143303 - RNA, 19 nt, Staphylococcus aureus subsp. aureus N315
aaaauuuacaaauguauaa

SEQ ID NO: 2143304 - RNA, 23 nt, Staphylococcus aureus subsp. aureus N315
aaaauuuaaauaauaauucauaa

SEQ ID NO: 2143305 - RNA, 18 nt, Staphylococcus aureus subsp. aureus N315
cacuuucaaugacaucua

SEQ ID NO: 2143306 - RNA, 20 nt, Staphylococcus aureus subsp. aureus N315
cacuuuuugacauauuuuuu

SEQ ID NO: 2143307 - RNA, 13 nt, Staphylococcus aureus subsp. aureus N315
cacuuuuuaaacg

SEQ ID NO: 2143308 - RNA, 18 nt, Staphylococcus aureus subsp. aureus N315
cacuuuuguuaaaaaaug

SEQ ID NO: 2143309 - RNA, 14 nt, Staphylococcus aureus subsp. aureus N315
cacuuuuguuaaaa

SEQ ID NO: 2143310 - RNA, 16 nt, Staphylococcus aureus subsp. aureus N315
cacuuuuguuaaaaaa

SEQ ID NO: 2143311 - RNA, 17 nt, Staphylococcus aureus subsp. aureus N315
cacuuuuguuaaaaaau

SEQ ID NO: 2143312 - RNA, 20 nt, Staphylococcus aureus subsp. aureus N315
cacuuuuuuuaaaucuucua

SEQ ID NO: 2143313 - RNA, 15 nt, Staphylococcus aureus subsp. aureus N315
cagaaauuuaauauu

SEQ ID NO: 2143314 - RNA, 14 nt, Staphylococcus aureus subsp. aureus N315
aaaauauuuacauu

SEQ ID NO: 2143315 - RNA, 16 nt, Staphylococcus aureus subsp. aureus N315
aaaaucaacuuuucua

SEQ ID NO: 2143316 - RNA, 16 nt, Staphylococcus aureus subsp. aureus N315
cagagaaauucgaaaa

SEQ ID NO: 2143317 - RNA, 15 nt, Staphylococcus aureus subsp. aureus N315
cagagaauuucgaaa

SEQ ID NO: 2143318 - RNA, 20 nt, Staphylococcus aureus subsp. aureus N315
cagagaauuucgaaaagaaa

SEQ ID NO: 2143319 - RNA, 23 nt, Staphylococcus aureus subsp. aureus N315
cagagaaauucgaaaagaaauuc

SEQ ID NO: 2143320 - RNA, 21 nt, Staphylococcus aureus subsp. aureus N315
aaaaucauucaccuaaaaaga

SEQ ID NO: 2143321 - RNA, 16 nt, Staphylococcus aureus subsp. aureus N315
aaaaucaucauuauac

SEQ ID NO: 2143322 - RNA, 21 nt, Staphylococcus aureus subsp. aureus N315
aaaaucauccauaaaaauacg

SEQ ID NO: 2143323 - RNA, 14 nt, Staphylococcus aureus subsp. aureus N315
aaaaucauaaauaa

SEQ ID NO: 2143324 - RNA, 15 nt, Staphylococcus aureus subsp. aureus N315
cagagccauaaugag

SEQ ID NO: 2143325 - RNA, 23 nt, Staphylococcus aureus subsp. aureus N315
cagauguugguucaucaaacaac

SEQ ID NO: 2143326 - RNA, 17 nt, Staphylococcus aureus subsp. aureus N315
cagauguugguucauca

SEQ ID NO: 2143327 - RNA, 18 nt, Staphylococcus aureus subsp. aureus N315
cagauguugguucaucaa

SEQ ID NO: 2143328 - RNA, 15 nt, Staphylococcus aureus subsp. aureus N315
cagauuuuaaaaauu

SEQ ID NO: 2143329 - RNA, 13 nt, Staphylococcus aureus subsp. aureus N315
cagauuuuaagug

SEQ ID NO: 2143330 - RNA, 18 nt, Staphylococcus aureus subsp. aureus N315
aaaaugaauaauugcuaa

SEQ ID NO: 2143331 - RNA, 20 nt, Staphylococcus aureus subsp. aureus N315
aaaaugaauaauugcuaaaa

SEQ ID NO: 2143332 - RNA, 12 nt, Staphylococcus aureus subsp. aureus N315
aaaaucuuuacu

SEQ ID NO: 2143333 - RNA, 17 nt, Staphylococcus aureus subsp. aureus N315
aaaaucuuuaacauuug

SEQ ID NO: 2143334 - RNA, 15 nt, Staphylococcus aureus subsp. aureus N315
aaaaucuuuaacucu

SEQ ID NO: 2143335 - RNA, 16 nt, Staphylococcus aureus subsp. aureus N315
cagaugaaccaaaaaa

SEQ ID NO: 2143336 - RNA, 21 nt, Staphylococcus aureus subsp. aureus N315
cagaucucaauccaauuaaau

SEQ ID NO: 2143337 - RNA, 21 nt, Staphylococcus aureus subsp. aureus N315
cagaugaugcuucgcaucacu

SEQ ID NO: 2143338 - RNA, 18 nt, Staphylococcus aureus subsp. aureus N315
cagauaagaauauuuaag

SEQ ID NO: 2143339 - RNA, 17 nt, Staphylococcus aureus subsp. aureus N315
aaaauggcaucuggcaa

SEQ ID NO: 2143340 - RNA, 19 nt, Staphylococcus aureus subsp. aureus N315
aaaaugacgugcuuuuaaa

SEQ ID NO: 2143341 - RNA, 17 nt, Staphylococcus aureus subsp. aureus N315
cagcacagcgauuaaau

SEQ ID NO: 2143342 - RNA, 20 nt, Staphylococcus aureus subsp. aureus N315
cagcauuaaucguauuuuua

SEQ ID NO: 2143343 - RNA, 19 nt, Staphylococcus aureus subsp. aureus N315
cagcauuaaucguauuuuu

SEQ ID NO: 2143344 - RNA, 23 nt, Staphylococcus aureus subsp. aureus N315
cagcaugaaucgcauuuaaauau

SEQ ID NO: 2143345 - RNA, 17 nt, Staphylococcus aureus subsp. aureus N315
cagcaguaagauuauuu

SEQ ID NO: 2143346 - RNA, 18 nt, Staphylococcus aureus subsp. aureus N315
cagcaguaagauuauuuu

SEQ ID NO: 2143347 - RNA, 14 nt, Staphylococcus aureus subsp. aureus N315
cagcaguaggauaa

SEQ ID NO: 2143348 - RNA, 14 nt, Staphylococcus aureus subsp. aureus N315
cagcgaaauuugua

SEQ ID NO: 2143349 - RNA, 15 nt, Staphylococcus aureus subsp. aureus N315
cagccucuauaagua

SEQ ID NO: 2143350 - RNA, 20 nt, Staphylococcus aureus subsp. aureus N315
cagccgaggcaauauugaac

SEQ ID NO: 2143351 - RNA, 13 nt, Staphylococcus aureus subsp. aureus N315
uuuuuuaaaguuu

SEQ ID NO: 2143352 - RNA, 12 nt, Staphylococcus aureus subsp. aureus N315
uuuuuuaaauac

SEQ ID NO: 2143353 - RNA, 16 nt, Staphylococcus aureus subsp. aureus N315
uuuuuuacauucguuu

SEQ ID NO: 2143354 - RNA, 11 nt, Staphylococcus aureus subsp. aureus N315
uuuuuuaauuu

SEQ ID NO: 2143355 - RNA, 21 nt, Staphylococcus aureus subsp. aureus N315
uuuuuguccccagcccuuuuc

SEQ ID NO: 2143356 - RNA, 18 nt, Staphylococcus aureus subsp. aureus N315
uuuuuguugcaauugccu

SEQ ID NO: 2143357 - RNA, 22 nt, Staphylococcus aureus subsp. aureus N315
uuuuuguuuucaaaugaaaaua

SEQ ID NO: 2143358 - RNA, 15 nt, Staphylococcus aureus subsp. aureus N315
uuuuuguaauacauc

SEQ ID NO: 2143359 - RNA, 15 nt, Staphylococcus aureus subsp. aureus N315
uuuuuggucaccaaa

SEQ ID NO: 2143360 - RNA, 14 nt, Staphylococcus aureus subsp. aureus N315
uuuuugaauuuaau

SEQ ID NO: 2143361 - RNA, 20 nt, Staphylococcus aureus subsp. aureus N315
uuuuugaaauuucgacaucu

SEQ ID NO: 2143362 - RNA, 18 nt, Staphylococcus aureus subsp. aureus N315
uuuuucuuucucuaacau

SEQ ID NO: 2143363 - RNA, 23 nt, Staphylococcus aureus subsp. aureus N315
uuuugaugugaaaauuuauucaa

SEQ ID NO: 2143364 - RNA, 9 nt, Staphylococcus aureus subsp. aureus N315
uuuugauug

SEQ ID NO: 2143365 - RNA, 20 nt, Staphylococcus aureus subsp. aureus N315
uuuugauuguuuaaacaugu

SEQ ID NO: 2143366 - RNA, 14 nt, Staphylococcus aureus subsp. aureus N315
uuuuuccauuuuuu

SEQ ID NO: 2143367 - RNA, 13 nt, Staphylococcus aureus subsp. aureus N315
uuuuucgcauuaa

SEQ ID NO: 2143368 - RNA, 13 nt, Staphylococcus aureus subsp. aureus N315
uuuuucguuguuc

SEQ ID NO: 2143369 - RNA, 21 nt, Staphylococcus aureus subsp. aureus N315
uuuuucuguaauaauuauuaa

SEQ ID NO: 2143370 - RNA, 22 nt, Staphylococcus aureus subsp. aureus N315
uuuuucucaaugugagauauaa

SEQ ID NO: 2143371 - RNA, 13 nt, Staphylococcus aureus subsp. aureus N315
uuuuauaguaaua

SEQ ID NO: 2143372 - RNA, 23 nt, Staphylococcus aureus subsp. aureus N315
uuuuauaguaauagcuauauuuu

SEQ ID NO: 2143373 - RNA, 16 nt, Staphylococcus aureus subsp. aureus N315
uuuuauaaguuaaaaa

SEQ ID NO: 2143374 - RNA, 14 nt, Staphylococcus aureus subsp. aureus N315
uuuuauaaucuuuu

SEQ ID NO: 2143375 - RNA, 16 nt, Staphylococcus aureus subsp. aureus N315
uuuuauaccaauaauu

SEQ ID NO: 2143376 - RNA, 12 nt, Staphylococcus aureus subsp. aureus N315
uuuuauaaauua

SEQ ID NO: 2143377 - RNA, 16 nt, Staphylococcus aureus subsp. aureus N315
uuuuauaaaauauauu

SEQ ID NO: 2143378 - RNA, 13 nt, Staphylococcus aureus subsp. aureus N315
uuuuauaaauuuu

SEQ ID NO: 2143379 - RNA, 15 nt, Staphylococcus aureus subsp. aureus N315
uuuuagcuuguuguu

SEQ ID NO: 2143380 - RNA, 20 nt, Staphylococcus aureus subsp. aureus N315
uuuuaggaugcauauauaua

SEQ ID NO: 2143381 - RNA, 15 nt, Staphylococcus aureus subsp. aureus N315
uuuuagguaauaauu

SEQ ID NO: 2143382 - RNA, 23 nt, Staphylococcus aureus subsp. aureus N315
uuuuaguuagaaaguauuuauuu

SEQ ID NO: 2143383 - RNA, 23 nt, Staphylococcus aureus subsp. aureus N315
uuuuaguuagggaaauguagauu

SEQ ID NO: 2143384 - RNA, 15 nt, Staphylococcus aureus subsp. aureus N315
uuuuaguuaaaguga

SEQ ID NO: 2143385 - RNA, 21 nt, Staphylococcus aureus subsp. aureus N315
uuuuagugacaaacauuuguu

SEQ ID NO: 2143386 - RNA, 21 nt, Staphylococcus aureus subsp. aureus N315
uuuuaugaauugaguauuaaa

SEQ ID NO: 2143387 - RNA, 20 nt, Staphylococcus aureus subsp. aureus N315
uuuuaugagcuucuuuaaau

SEQ ID NO: 2143388 - RNA, 18 nt, Staphylococcus aureus subsp. aureus N315
uuuuaugacguaauuaau

SEQ ID NO: 2143389 - RNA, 17 nt, Staphylococcus aureus subsp. aureus N315
uuuuaugaauugaguau

SEQ ID NO: 2143390 - RNA, 23 nt, Staphylococcus aureus subsp. aureus N315
uuuuaugcacaaaaaaaucuccu

SEQ ID NO: 2143391 - RNA, 15 nt, Staphylococcus aureus subsp. aureus N315
uuuuaugauuuucuu

SEQ ID NO: 2143392 - RNA, 24 nt, Staphylococcus aureus subsp. aureus N315
uuuuaugcauuauagaugacugua

SEQ ID NO: 2143393 - RNA, 18 nt, Staphylococcus aureus subsp. aureus N315
uuuuaucugaaaauauca

SEQ ID NO: 2143394 - RNA, 17 nt, Staphylococcus aureus subsp. aureus N315
uuuuaucugaaaauauc

SEQ ID NO: 2143395 - RNA, 21 nt, Staphylococcus aureus subsp. aureus N315
uuuuaucuaucgguaauuuuu

SEQ ID NO: 2143396 - RNA, 13 nt, Staphylococcus aureus subsp. aureus N315
uuuuauauuuuua

SEQ ID NO: 2143397 - RNA, 22 nt, Staphylococcus aureus subsp. aureus N315
uuuuauauugcgaaaaauaauu

SEQ ID NO: 2143398 - RNA, 21 nt, Staphylococcus aureus subsp. aureus N315
uuuuauauuuaaacucucuaa

SEQ ID NO: 2143399 - RNA, 21 nt, Staphylococcus aureus subsp. aureus N315
uuuuauauucaacuuauuauu

SEQ ID NO: 2143400 - RNA, 16 nt, Staphylococcus aureus subsp. aureus N315
uuuuauauccaucucc

SEQ ID NO: 2143401 - RNA, 22 nt, Staphylococcus aureus subsp. aureus N315
uuuuaaugggcgauaaaaguug

SEQ ID NO: 2143402 - RNA, 20 nt, Staphylococcus aureus subsp. aureus N315
uuuuaauguauucuucuaau

SEQ ID NO: 2143403 - RNA, 20 nt, Staphylococcus aureus subsp. aureus N315
uuuuaaucuauccuucaaaa

SEQ ID NO: 2143404 - RNA, 12 nt, Staphylococcus aureus subsp. aureus N315
uuuuaauuuuuu

SEQ ID NO: 2143405 - RNA, 19 nt, Staphylococcus aureus subsp. aureus N315
uuuuaauuguuuaauaaca

SEQ ID NO: 2143406 - RNA, 16 nt, Staphylococcus aureus subsp. aureus N315
uuuuacauuuucaaaa

SEQ ID NO: 2143407 - RNA, 20 nt, Staphylococcus aureus subsp. aureus N315
uuuuaccauugugaauaauu

SEQ ID NO: 2143408 - RNA, 15 nt, Staphylococcus aureus subsp. aureus N315
uuuuacaaagugauu

SEQ ID NO: 2143409 - RNA, 23 nt, Staphylococcus aureus subsp. aureus N315
uuuuacaaaauauggaauuucau

SEQ ID NO: 2143410 - RNA, 19 nt, Staphylococcus aureus subsp. aureus N315
uuuuacuaggaauauaaaa

SEQ ID NO: 2143411 - RNA, 21 nt, Staphylococcus aureus subsp. aureus N315
uuuuacuaggaauauaaaacu

SEQ ID NO: 2143412 - RNA, 23 nt, Staphylococcus aureus subsp. aureus N315
uuuuaccuucgcauacuuuuuca

SEQ ID NO: 2143413 - RNA, 14 nt, Staphylococcus aureus subsp. aureus N315
uuuuaccuuuaauu

SEQ ID NO: 2143414 - RNA, 17 nt, Staphylococcus aureus subsp. aureus N315
uuuuaccuuuaauuaca

SEQ ID NO: 2143415 - RNA, 20 nt, Staphylococcus aureus subsp. aureus N315
uuuuagacauaaaaaaagag

SEQ ID NO: 2143416 - RNA, 23 nt, Staphylococcus aureus subsp. aureus N315
uuuuagauuuaguuuuuuuaaag

SEQ ID NO: 2143417 - RNA, 17 nt, Staphylococcus aureus subsp. aureus N315
uuuuagauuaucuuuca

SEQ ID NO: 2143418 - RNA, 12 nt, Staphylococcus aureus subsp. aureus N315
uuuucuguaaua

SEQ ID NO: 2143419 - RNA, 14 nt, Staphylococcus aureus subsp. aureus N315
uuuucuauucaaaa

SEQ ID NO: 2143420 - RNA, 17 nt, Staphylococcus aureus subsp. aureus N315
uuuucuuauaaaaaucu

SEQ ID NO: 2143421 - RNA, 11 nt, Staphylococcus aureus subsp. aureus N315
uuuucuuaauu

SEQ ID NO: 2143422 - RNA, 12 nt, Staphylococcus aureus subsp. aureus N315
uuuugaauauuu

SEQ ID NO: 2143423 - RNA, 13 nt, Staphylococcus aureus subsp. aureus N315
uuuugauauaaaa

SEQ ID NO: 2143424 - RNA, 18 nt, Staphylococcus aureus subsp. aureus N315
uuuugauacguaaacacu

SEQ ID NO: 2143425 - RNA, 14 nt, Staphylococcus aureus subsp. aureus N315
uuuugaaccuaaau

SEQ ID NO: 2143426 - RNA, 15 nt, Staphylococcus aureus subsp. aureus N315
uuuucuaaauauaua

SEQ ID NO: 2143427 - RNA, 12 nt, Staphylococcus aureus subsp. aureus N315
uuuucuaaauga

SEQ ID NO: 2143428 - RNA, 13 nt, Staphylococcus aureus subsp. aureus N315
uuuucuauggcac

SEQ ID NO: 2143429 - RNA, 13 nt, Staphylococcus aureus subsp. aureus N315
uuuucuauucaaa

SEQ ID NO: 2143430 - RNA, 16 nt, Staphylococcus aureus subsp. aureus N315
uuuucuagcuauaucc

SEQ ID NO: 2143431 - RNA, 14 nt, Staphylococcus aureus subsp. aureus N315
uuuuauguuuuaau

SEQ ID NO: 2143432 - RNA, 21 nt, Staphylococcus aureus subsp. aureus N315
uuuuauguucagaaauuuaau

SEQ ID NO: 2143433 - RNA, 15 nt, Staphylococcus aureus subsp. aureus N315
uuuuaugcuuuaaau

SEQ ID NO: 2143434 - RNA, 15 nt, Staphylococcus aureus subsp. aureus N315
uuuuauguuuuaauu

SEQ ID NO: 2143435 - RNA, 19 nt, Staphylococcus aureus subsp. aureus N315
uuuuauuacuuauuucuuu

SEQ ID NO: 2143436 - RNA, 16 nt, Staphylococcus aureus subsp. aureus N315
uuuuauuaauuaaaaa

SEQ ID NO: 2143437 - RNA, 19 nt, Staphylococcus aureus subsp. aureus N315
uuuuauuaucuuuguaaau

SEQ ID NO: 2143438 - RNA, 15 nt, Staphylococcus aureus subsp. aureus N315
uuuuauuauguguuu

SEQ ID NO: 2143439 - RNA, 22 nt, Staphylococcus aureus subsp. aureus N315
uuuuauuaucagcccaaucagu

SEQ ID NO: 2143440 - RNA, 17 nt, Staphylococcus aureus subsp. aureus N315
uuuuauuagaauauuca

SEQ ID NO: 2143441 - RNA, 16 nt, Staphylococcus aureus subsp. aureus N315
uuuuauuuaaaaauag

SEQ ID NO: 2143442 - RNA, 14 nt, Staphylococcus aureus subsp. aureus N315
uuuuauuuaaaaau

SEQ ID NO: 2143443 - RNA, 11 nt, Staphylococcus aureus subsp. aureus N315
uuuuauuuauc

SEQ ID NO: 2143444 - RNA, 13 nt, Staphylococcus aureus subsp. aureus N315
uuuuauuuauauu

SEQ ID NO: 2143445 - RNA, 16 nt, Staphylococcus aureus subsp. aureus N315
uuuuauuuacacacau

SEQ ID NO: 2143446 - RNA, 15 nt, Staphylococcus aureus subsp. aureus N315
uuuucaauaaauuuu

SEQ ID NO: 2143447 - RNA, 21 nt, Staphylococcus aureus subsp. aureus N315
uuuucaauaauugauucucug

SEQ ID NO: 2143448 - RNA, 16 nt, Staphylococcus aureus subsp. aureus N315
uuuucaaaaauagucg

SEQ ID NO: 2143449 - RNA, 21 nt, Staphylococcus aureus subsp. aureus N315
uuuucaauuagaaaauaucuu

SEQ ID NO: 2143450 - RNA, 19 nt, Staphylococcus aureus subsp. aureus N315
uuuuccauaaauauuuaaa

SEQ ID NO: 2143451 - RNA, 19 nt, Staphylococcus aureus subsp. aureus N315
uuuggauuucuuuuuaaaa

SEQ ID NO: 2143452 - RNA, 24 nt, Staphylococcus aureus subsp. aureus N315
uuuggcacauaaaucaauguacua

SEQ ID NO: 2143453 - RNA, 17 nt, Staphylococcus aureus subsp. aureus N315
uuugcuuaaaccuuaau

SEQ ID NO: 2143454 - RNA, 14 nt, Staphylococcus aureus subsp. aureus N315
uuuggaaauaucuu

SEQ ID NO: 2143455 - RNA, 15 nt, Staphylococcus aureus subsp. aureus N315
uuuggaacauauuca

SEQ ID NO: 2143456 - RNA, 16 nt, Staphylococcus aureus subsp. aureus N315
uuugcuuuuuguaaug

SEQ ID NO: 2143457 - RNA, 17 nt, Staphylococcus aureus subsp. aureus N315
uuuggaaaccguuuaga

SEQ ID NO: 2143458 - RNA, 19 nt, Staphylococcus aureus subsp. aureus N315
uuugcuuuggcuauuuuau

SEQ ID NO: 2143459 - RNA, 14 nt, Staphylococcus aureus subsp. aureus N315
uuugcguuuuaauu

SEQ ID NO: 2143460 - RNA, 14 nt, Staphylococcus aureus subsp. aureus N315
uuugcgguguggcg

SEQ ID NO: 2143461 - RNA, 20 nt, Staphylococcus aureus subsp. aureus N315
uuugcugguugcuucuuauc

SEQ ID NO: 2143462 - RNA, 22 nt, Staphylococcus aureus subsp. aureus N315
uuugcucuaaacuucuauuaau

SEQ ID NO: 2143463 - RNA, 20 nt, Staphylococcus aureus subsp. aureus N315
uuugcucaaaaaugcuuaua

SEQ ID NO: 2143464 - RNA, 16 nt, Staphylococcus aureus subsp. aureus N315
uuuguauuuuucaaau

SEQ ID NO: 2143465 - RNA, 22 nt, Staphylococcus aureus subsp. aureus N315
uuuguauuuauguuuucuaguu

SEQ ID NO: 2143466 - RNA, 14 nt, Staphylococcus aureus subsp. aureus N315
uuuguauuagcauc

SEQ ID NO: 2143467 - RNA, 17 nt, Staphylococcus aureus subsp. aureus N315
uuuguaugauaaccauu

SEQ ID NO: 2143468 - RNA, 21 nt, Staphylococcus aureus subsp. aureus N315
uuuguaguccuucuuugaaau

SEQ ID NO: 2143469 - RNA, 13 nt, Staphylococcus aureus subsp. aureus N315
uuuguaugaguuc

SEQ ID NO: 2143470 - RNA, 13 nt, Staphylococcus aureus subsp. aureus N315
uuuguacauuucu

SEQ ID NO: 2143471 - RNA, 14 nt, Staphylococcus aureus subsp. aureus N315
uuuguaaauuuuua

SEQ ID NO: 2143472 - RNA, 20 nt, Staphylococcus aureus subsp. aureus N315
uuuguaaauauuuuuuaaaa

SEQ ID NO: 2143473 - RNA, 13 nt, Staphylococcus aureus subsp. aureus N315
uuuguaauacauc

SEQ ID NO: 2143474 - RNA, 20 nt, Staphylococcus aureus subsp. aureus N315
uuuguaaucccauuuuaaag

SEQ ID NO: 2143475 - RNA, 16 nt, Staphylococcus aureus subsp. aureus N315
uuuguaauaauugcau

SEQ ID NO: 2143476 - RNA, 13 nt, Staphylococcus aureus subsp. aureus N315
uuuguaauuagga

SEQ ID NO: 2143477 - RNA, 16 nt, Staphylococcus aureus subsp. aureus N315
uuugguucuucuaucu

SEQ ID NO: 2143478 - RNA, 19 nt, Staphylococcus aureus subsp. aureus N315
uuugguguuuaacuaaacc

SEQ ID NO: 2143479 - RNA, 17 nt, Staphylococcus aureus subsp. aureus N315
uuuuaagaucaauauca

SEQ ID NO: 2143480 - RNA, 21 nt, Staphylococcus aureus subsp. aureus N315
uuuuaacuuccuaaaauuuac

SEQ ID NO: 2143481 - RNA, 20 nt, Staphylococcus aureus subsp. aureus N315
uuuuaacugguugauaaaua

SEQ ID NO: 2143482 - RNA, 23 nt, Staphylococcus aureus subsp. aureus N315
uuuuaacuuuaacaucugaaucu

SEQ ID NO: 2143483 - RNA, 23 nt, Staphylococcus aureus subsp. aureus N315
uuuuaagugaugaccaauauucu

SEQ ID NO: 2143484 - RNA, 21 nt, Staphylococcus aureus subsp. aureus N315
uuuuaauauauuuauuuuuga

SEQ ID NO: 2143485 - RNA, 20 nt, Staphylococcus aureus subsp. aureus N315
uuuuaauauugaaaugagcu

SEQ ID NO: 2143486 - RNA, 17 nt, Staphylococcus aureus subsp. aureus N315
uuuuaacaaaauauacu

SEQ ID NO: 2143487 - RNA, 15 nt, Staphylococcus aureus subsp. aureus N315
uuuuaacagcugcag

SEQ ID NO: 2143488 - RNA, 21 nt, Staphylococcus aureus subsp. aureus N315
uuuuaacauagcuuaauaauu

SEQ ID NO: 2143489 - RNA, 17 nt, Staphylococcus aureus subsp. aureus N315
uuuuaaauguauuuuua

SEQ ID NO: 2143490 - RNA, 13 nt, Staphylococcus aureus subsp. aureus N315
uuuuaaauuuaag

SEQ ID NO: 2143491 - RNA, 17 nt, Staphylococcus aureus subsp. aureus N315
uuuuaaauuuaauuucg

SEQ ID NO: 2143492 - RNA, 21 nt, Staphylococcus aureus subsp. aureus N315
uuuuaaauuuaguaucucauu

SEQ ID NO: 2143493 - RNA, 17 nt, Staphylococcus aureus subsp. aureus N315
uuuuaaaucuauauaaa

SEQ ID NO: 2143494 - RNA, 13 nt, Staphylococcus aureus subsp. aureus N315
uuuuaaaucuuuu

SEQ ID NO: 2143495 - RNA, 23 nt, Staphylococcus aureus subsp. aureus N315
uuuuaaacucauccauugaucuu

SEQ ID NO: 2143496 - RNA, 16 nt, Staphylococcus aureus subsp. aureus N315
uuuuaaauaaaaugca

SEQ ID NO: 2143497 - RNA, 17 nt, Staphylococcus aureus subsp. aureus N315
uuuuaaaucauaaauua

SEQ ID NO: 2143498 - RNA, 11 nt, Staphylococcus aureus subsp. aureus N315
uuuuaaaggac

SEQ ID NO: 2143499 - RNA, 14 nt, Staphylococcus aureus subsp. aureus N315
uuuuaaaguuuaaa

SEQ ID NO: 2143500 - RNA, 16 nt, Staphylococcus aureus subsp. aureus N315
uuuuaaaguuuaaaua

SEQ ID NO: 2143501 - RNA, 20 nt, Staphylococcus aureus subsp. aureus N315
uuuuaaaguuuaaauauuca

SEQ ID NO: 2143502 - RNA, 16 nt, Staphylococcus aureus subsp. aureus N315
uuuuaaagguuaaaua

SEQ ID NO: 2143503 - RNA, 12 nt, Staphylococcus aureus subsp. aureus N315
uuuuaaaauacg

SEQ ID NO: 2143504 - RNA, 17 nt, Staphylococcus aureus subsp. aureus N315
uuuuaaaagauaaauaa

SEQ ID NO: 2143505 - RNA, 12 nt, Staphylococcus aureus subsp. aureus N315
uuuuaaaaaccu

SEQ ID NO: 2143506 - RNA, 19 nt, Staphylococcus aureus subsp. aureus N315
uuuuaaaaaauuuaaauaa

SEQ ID NO: 2143507 - RNA, 15 nt, Staphylococcus aureus subsp. aureus N315
uuuuaaaaaaugaug

SEQ ID NO: 2143508 - RNA, 15 nt, Staphylococcus aureus subsp. aureus N315
uuuuaaaaaacauac

SEQ ID NO: 2143509 - RNA, 17 nt, Staphylococcus aureus subsp. aureus N315
uuuuaaaaaauuuaaau

SEQ ID NO: 2143510 - RNA, 17 nt, Staphylococcus aureus subsp. aureus N315
uuuguucaaucacuaua

SEQ ID NO: 2143511 - RNA, 14 nt, Staphylococcus aureus subsp. aureus N315
uuuguucaaucacu

SEQ ID NO: 2143512 - RNA, 21 nt, Staphylococcus aureus subsp. aureus N315
uuuguuaccaaacaauacaua

SEQ ID NO: 2143513 - RNA, 16 nt, Staphylococcus aureus subsp. aureus N315
uuuguuauaucuaauu

SEQ ID NO: 2143514 - RNA, 19 nt, Staphylococcus aureus subsp. aureus N315
uuuguuguuuuaauuucac

SEQ ID NO: 2143515 - RNA, 21 nt, Staphylococcus aureus subsp. aureus N315
uuuguugguguuuagucuuuu

SEQ ID NO: 2143516 - RNA, 13 nt, Staphylococcus aureus subsp. aureus N315
uuuguuucuaaau

SEQ ID NO: 2143517 - RNA, 12 nt, Staphylococcus aureus subsp. aureus N315
uuuguuuuaaaa

SEQ ID NO: 2143518 - RNA, 12 nt, Staphylococcus aureus subsp. aureus N315
uuuguuuguaag

SEQ ID NO: 2143519 - RNA, 13 nt, Staphylococcus aureus subsp. aureus N315
uuuguuuuuauau

SEQ ID NO: 2143520 - RNA, 16 nt, Staphylococcus aureus subsp. aureus N315
uuuguuuuaaauacuu

SEQ ID NO: 2143521 - RNA, 14 nt, Staphylococcus aureus subsp. aureus N315
uuuguuuucacugu

SEQ ID NO: 2143522 - RNA, 13 nt, Staphylococcus aureus subsp. aureus N315
uuuguuuucagua

SEQ ID NO: 2143523 - RNA, 14 nt, Staphylococcus aureus subsp. aureus N315
uuuguuuucaguaa

SEQ ID NO: 2143524 - RNA, 16 nt, Staphylococcus aureus subsp. aureus N315
uuuguguaucuguaac

SEQ ID NO: 2143525 - RNA, 21 nt, Staphylococcus aureus subsp. aureus N315
uuugugaauuuauuuuguagu

SEQ ID NO: 2143526 - RNA, 15 nt, Staphylococcus aureus subsp. aureus N315
uuuacgugcauugua

SEQ ID NO: 2143527 - RNA, 14 nt, Staphylococcus aureus subsp. aureus N315
uuuacuaaaugaau

SEQ ID NO: 2143528 - RNA, 15 nt, Staphylococcus aureus subsp. aureus N315
uuuacuaaacuuuug

SEQ ID NO: 2143529 - RNA, 19 nt, Staphylococcus aureus subsp. aureus N315
uuuacagaacguucauaua

SEQ ID NO: 2143530 - RNA, 16 nt, Staphylococcus aureus subsp. aureus N315
uuuacagguugaauaa

SEQ ID NO: 2143531 - RNA, 16 nt, Staphylococcus aureus subsp. aureus N315
uuuacagucaacugcu

SEQ ID NO: 2143532 - RNA, 22 nt, Staphylococcus aureus subsp. aureus N315
uuuacucauauugaauacuucu

SEQ ID NO: 2143533 - RNA, 16 nt, Staphylococcus aureus subsp. aureus N315
uuuacucauauugaau

SEQ ID NO: 2143534 - RNA, 16 nt, Staphylococcus aureus subsp. aureus N315
uuuacucaaaccaucu

SEQ ID NO: 2143535 - RNA, 14 nt, Staphylococcus aureus subsp. aureus N315
uuuacucuaaagga

SEQ ID NO: 2143536 - RNA, 17 nt, Staphylococcus aureus subsp. aureus N315
uuuacuuacuuuucuaa

SEQ ID NO: 2143537 - RNA, 16 nt, Staphylococcus aureus subsp. aureus N315
uuuacuguaaucaauc

SEQ ID NO: 2143538 - RNA, 19 nt, Staphylococcus aureus subsp. aureus N315
uuuagucauuacaaaucau

SEQ ID NO: 2143539 - RNA, 18 nt, Staphylococcus aureus subsp. aureus N315
uuuagucgguguuuucuu

SEQ ID NO: 2143540 - RNA, 15 nt, Staphylococcus aureus subsp. aureus N315
uuuagugaaaaaguu

SEQ ID NO: 2143541 - RNA, 17 nt, Staphylococcus aureus subsp. aureus N315
uuuagugaaaagaacac

SEQ ID NO: 2143542 - RNA, 15 nt, Staphylococcus aureus subsp. aureus N315
uuuaguuaaauacaa

SEQ ID NO: 2143543 - RNA, 16 nt, Staphylococcus aureus subsp. aureus N315
uuuaguuaaauaguaa

SEQ ID NO: 2143544 - RNA, 13 nt, Staphylococcus aureus subsp. aureus N315
uuuaguuaaauag

SEQ ID NO: 2143545 - RNA, 21 nt, Staphylococcus aureus subsp. aureus N315
uuuaguucaccauuucguguu

SEQ ID NO: 2143546 - RNA, 17 nt, Staphylococcus aureus subsp. aureus N315
uuuauaaaaaaaucccu

SEQ ID NO: 2143547 - RNA, 22 nt, Staphylococcus aureus subsp. aureus N315
uuuagguucuucaucuuuuaug

SEQ ID NO: 2143548 - RNA, 14 nt, Staphylococcus aureus subsp. aureus N315
uuuaguauaaauaa

SEQ ID NO: 2143549 - RNA, 15 nt, Staphylococcus aureus subsp. aureus N315
uuuaguauaaauaaa

SEQ ID NO: 2143550 - RNA, 19 nt, Staphylococcus aureus subsp. aureus N315
uuuagcuauguaaaauuau

SEQ ID NO: 2143551 - RNA, 14 nt, Staphylococcus aureus subsp. aureus N315
uuuagacauaaaaa

SEQ ID NO: 2143552 - RNA, 15 nt, Staphylococcus aureus subsp. aureus N315
uuuagacaauauuuu

SEQ ID NO: 2143553 - RNA, 18 nt, Staphylococcus aureus subsp. aureus N315
uuuagaaagaauacaguu

SEQ ID NO: 2143554 - RNA, 18 nt, Staphylococcus aureus subsp. aureus N315
uuuagaauaagaaauaaa

SEQ ID NO: 2143555 - RNA, 17 nt, Staphylococcus aureus subsp. aureus N315
uuuagaauaagaaauaa

SEQ ID NO: 2143556 - RNA, 12 nt, Staphylococcus aureus subsp. aureus N315
uuuagcauugcc

SEQ ID NO: 2143557 - RNA, 22 nt, Staphylococcus aureus subsp. aureus N315
uuuagcauacauuaagcuaugc

SEQ ID NO: 2143558 - RNA, 13 nt, Staphylococcus aureus subsp. aureus N315
uuuagauuuauaa

SEQ ID NO: 2143559 - RNA, 17 nt, Staphylococcus aureus subsp. aureus N315
uuuagaugcauaaaaaa

SEQ ID NO: 2143560 - RNA, 21 nt, Staphylococcus aureus subsp. aureus N315
uuuagcaacaguauuugccuu

SEQ ID NO: 2143561 - RNA, 15 nt, Staphylococcus aureus subsp. aureus N315
uuuagaugcauaaaa

SEQ ID NO: 2143562 - RNA, 16 nt, Staphylococcus aureus subsp. aureus N315
uuuauaauucuaaguc

SEQ ID NO: 2143563 - RNA, 13 nt, Staphylococcus aureus subsp. aureus N315
uuuauaauucuaa

SEQ ID NO: 2143564 - RNA, 10 nt, Staphylococcus aureus subsp. aureus N315
uuuauacauu

SEQ ID NO: 2143565 - RNA, 13 nt, Staphylococcus aureus subsp. aureus N315
uuuauacauaaau

SEQ ID NO: 2143566 - RNA, 14 nt, Staphylococcus aureus subsp. aureus N315
uuuauagaaaauua

SEQ ID NO: 2143567 - RNA, 14 nt, Staphylococcus aureus subsp. aureus N315
uuuauaguucuauu

SEQ ID NO: 2143568 - RNA, 13 nt, Staphylococcus aureus subsp. aureus N315
uuuauaaaauaua

SEQ ID NO: 2143569 - RNA, 12 nt, Staphylococcus aureus subsp. aureus N315
uuuauaaauuaa

SEQ ID NO: 2143570 - RNA, 23 nt, Staphylococcus aureus subsp. aureus N315
uuuauaaaugaauuauuuaaaau

SEQ ID NO: 2143571 - RNA, 15 nt, Staphylococcus aureus subsp. aureus N315
uuuauaauaaauuuc

SEQ ID NO: 2143572 - RNA, 15 nt, Staphylococcus aureus subsp. aureus N315
uuuauaauaaauguc

SEQ ID NO: 2143573 - RNA, 12 nt, Staphylococcus aureus subsp. aureus N315
uuuauaaguauu

SEQ ID NO: 2143574 - RNA, 14 nt, Staphylococcus aureus subsp. aureus N315
uuuauaaauuauag

SEQ ID NO: 2143575 - RNA, 22 nt, Staphylococcus aureus subsp. aureus N315
uuuauaagccuuuucaaacaua

SEQ ID NO: 2143576 - RNA, 18 nt, Staphylococcus aureus subsp. aureus N315
uuuauaacauuuaagaaa

SEQ ID NO: 2143577 - RNA, 19 nt, Staphylococcus aureus subsp. aureus N315
uuuaucagcgaaauuugua

SEQ ID NO: 2143578 - RNA, 19 nt, Staphylococcus aureus subsp. aureus N315
uuuaucaaauucaucagua

SEQ ID NO: 2143579 - RNA, 16 nt, Staphylococcus aureus subsp. aureus N315
uuuaucaacaaauuua

SEQ ID NO: 2143580 - RNA, 15 nt, Staphylococcus aureus subsp. aureus N315
uuuaucaauuucuau

SEQ ID NO: 2143581 - RNA, 21 nt, Staphylococcus aureus subsp. aureus N315
uuuaucaauuucuauuucacu

SEQ ID NO: 2143582 - RNA, 14 nt, Staphylococcus aureus subsp. aureus N315
uuuaucaauuucua

SEQ ID NO: 2143583 - RNA, 12 nt, Staphylococcus aureus subsp. aureus N315
uuuaucaauauu

SEQ ID NO: 2143584 - RNA, 16 nt, Staphylococcus aureus subsp. aureus N315
uuuaucaacaaauuuu

SEQ ID NO: 2143585 - RNA, 19 nt, Staphylococcus aureus subsp. aureus N315
uuuauauauaaagaaauaa

SEQ ID NO: 2143586 - RNA, 14 nt, Staphylococcus aureus subsp. aureus N315
uuuauaucaaaaaa

SEQ ID NO: 2143587 - RNA, 16 nt, Staphylococcus aureus subsp. aureus N315
uuuauaucaaaaaaua

SEQ ID NO: 2143588 - RNA, 13 nt, Staphylococcus aureus subsp. aureus N315
uuuauauaaguga

SEQ ID NO: 2143589 - RNA, 13 nt, Staphylococcus aureus subsp. aureus N315
uuuauauccaucu

SEQ ID NO: 2143590 - RNA, 23 nt, Staphylococcus aureus subsp. aureus N315
uuuauauuuuaguucacaugaau

SEQ ID NO: 2143591 - RNA, 13 nt, Staphylococcus aureus subsp. aureus N315
uuuauauuuauuu

SEQ ID NO: 2143592 - RNA, 14 nt, Staphylococcus aureus subsp. aureus N315
uuuauauuuaucag

SEQ ID NO: 2143593 - RNA, 21 nt, Staphylococcus aureus subsp. aureus N315
uuuauauuaaauacuauauau

SEQ ID NO: 2143594 - RNA, 22 nt, Staphylococcus aureus subsp. aureus N315
uuuaucuguagaaacacuuuua

SEQ ID NO: 2143595 - RNA, 15 nt, Staphylococcus aureus subsp. aureus N315
uuuaucugcaaaaug

SEQ ID NO: 2143596 - RNA, 19 nt, Staphylococcus aureus subsp. aureus N315
uuuaucuacauuaaagaaa

SEQ ID NO: 2143597 - RNA, 18 nt, Staphylococcus aureus subsp. aureus N315
uuuaucgugaagaaaaaa

SEQ ID NO: 2143598 - RNA, 13 nt, Staphylococcus aureus subsp. aureus N315
uuuaucauuauuu

SEQ ID NO: 2143599 - RNA, 20 nt, Staphylococcus aureus subsp. aureus N315
uuuaucauuauuugauaaau

SEQ ID NO: 2143600 - RNA, 15 nt, Staphylococcus aureus subsp. aureus N315
uuuaucgccaauuaa

SEQ ID NO: 2143601 - RNA, 22 nt, Staphylococcus aureus subsp. aureus N315
uuuauccuuuaaaucauugcgu

SEQ ID NO: 2143602 - RNA, 16 nt, Staphylococcus aureus subsp. aureus N315
uuuaucgaaauauuua

SEQ ID NO: 2143603 - RNA, 20 nt, Staphylococcus aureus subsp. aureus N315
uuuauccgucgaauauaauu

SEQ ID NO: 2143604 - RNA, 18 nt, Staphylococcus aureus subsp. aureus N315
uuuauguuuuaauuucuu

SEQ ID NO: 2143605 - RNA, 13 nt, Staphylococcus aureus subsp. aureus N315
uuuauguugcguu

SEQ ID NO: 2143606 - RNA, 17 nt, Staphylococcus aureus subsp. aureus N315
uuuauggcgguuugaaa

SEQ ID NO: 2143607 - RNA, 16 nt, Staphylococcus aureus subsp. aureus N315
uuuauuaauucugauu

SEQ ID NO: 2143608 - RNA, 12 nt, Staphylococcus aureus subsp. aureus N315
uuuauuacuuau

SEQ ID NO: 2143609 - RNA, 18 nt, Staphylococcus aureus subsp. aureus N315
uuuauuaauaaauucucu

SEQ ID NO: 2143610 - RNA, 12 nt, Staphylococcus aureus subsp. aureus N315
uuuauuaaauaa

SEQ ID NO: 2143611 - RNA, 20 nt, Staphylococcus aureus subsp. aureus N315
uuuaugauaauaagaauauu

SEQ ID NO: 2143612 - RNA, 17 nt, Staphylococcus aureus subsp. aureus N315
uuuaugauaauaagaau

SEQ ID NO: 2143613 - RNA, 22 nt, Staphylococcus aureus subsp. aureus N315
uuuaugagcuucuuuaaauaca

SEQ ID NO: 2143614 - RNA, 16 nt, Staphylococcus aureus subsp. aureus N315
uuuaugacaaaguucu

SEQ ID NO: 2143615 - RNA, 20 nt, Staphylococcus aureus subsp. aureus N315
uuuaugacaaaguucugcaa

SEQ ID NO: 2143616 - RNA, 19 nt, Staphylococcus aureus subsp. aureus N315
uuuaugcaugcgcaaaagc

SEQ ID NO: 2143617 - RNA, 13 nt, Staphylococcus aureus subsp. aureus N315
uuuaugcuuuaaa

SEQ ID NO: 2143618 - RNA, 16 nt, Staphylococcus aureus subsp. aureus N315
uuuauggagugauaua

SEQ ID NO: 2143619 - RNA, 13 nt, Staphylococcus aureus subsp. aureus N315
uuuccaauaucuu

SEQ ID NO: 2143620 - RNA, 15 nt, Staphylococcus aureus subsp. aureus N315
uuuccaauaucuucu

SEQ ID NO: 2143621 - RNA, 15 nt, Staphylococcus aureus subsp. aureus N315
uuucauuuuuauccc

SEQ ID NO: 2143622 - RNA, 18 nt, Staphylococcus aureus subsp. aureus N315
uuucauuuuuucaauguc

SEQ ID NO: 2143623 - RNA, 18 nt, Staphylococcus aureus subsp. aureus N315
uuuccaaauugcaaagua

SEQ ID NO: 2143624 - RNA, 22 nt, Staphylococcus aureus subsp. aureus N315
uuucaugugucacaaugaccau

SEQ ID NO: 2143625 - RNA, 20 nt, Staphylococcus aureus subsp. aureus N315
uuucauguuugauucuaaau

SEQ ID NO: 2143626 - RNA, 11 nt, Staphylococcus aureus subsp. aureus N315
uuucaucuuuc

SEQ ID NO: 2143627 - RNA, 15 nt, Staphylococcus aureus subsp. aureus N315
uuucaucauuaguuu

SEQ ID NO: 2143628 - RNA, 16 nt, Staphylococcus aureus subsp. aureus N315
uuucaucguucauaua

SEQ ID NO: 2143629 - RNA, 17 nt, Staphylococcus aureus subsp. aureus N315
uuucacuugaccacuuu

SEQ ID NO: 2143630 - RNA, 15 nt, Staphylococcus aureus subsp. aureus N315
uuucaguauacucau

SEQ ID NO: 2143631 - RNA, 23 nt, Staphylococcus aureus subsp. aureus N315
uuucauauaaauagcuucuuaaa

SEQ ID NO: 2143632 - RNA, 18 nt, Staphylococcus aureus subsp. aureus N315
uuucauagaugcauaaaa

SEQ ID NO: 2143633 - RNA, 22 nt, Staphylococcus aureus subsp. aureus N315
uuucauaguuauuaaaucuuuu

SEQ ID NO: 2143634 - RNA, 19 nt, Staphylococcus aureus subsp. aureus N315
uuucauauucacaucuuua

SEQ ID NO: 2143635 - RNA, 17 nt, Staphylococcus aureus subsp. aureus N315
uuucauauuguuuagga

SEQ ID NO: 2143636 - RNA, 16 nt, Staphylococcus aureus subsp. aureus N315
uuucauauggugaacu

SEQ ID NO: 2143637 - RNA, 20 nt, Staphylococcus aureus subsp. aureus N315
uuucauaugcaucaacagau

SEQ ID NO: 2143638 - RNA, 16 nt, Staphylococcus aureus subsp. aureus N315
uuucauaaaguuuauu

SEQ ID NO: 2143639 - RNA, 23 nt, Staphylococcus aureus subsp. aureus N315
uuucauaauuaacacauucaaau

SEQ ID NO: 2143640 - RNA, 18 nt, Staphylococcus aureus subsp. aureus N315
uuucauaauuaauaacau

SEQ ID NO: 2143641 - RNA, 17 nt, Staphylococcus aureus subsp. aureus N315
uuucaaguuuaaaauac

SEQ ID NO: 2143642 - RNA, 19 nt, Staphylococcus aureus subsp. aureus N315
uuucaaguuuaaaauacga

SEQ ID NO: 2143643 - RNA, 13 nt, Staphylococcus aureus subsp. aureus N315
uuucaauaaauuu

SEQ ID NO: 2143644 - RNA, 13 nt, Staphylococcus aureus subsp. aureus N315
uuucaauaaauaa

SEQ ID NO: 2143645 - RNA, 11 nt, Staphylococcus aureus subsp. aureus N315
uuucaacauuu

SEQ ID NO: 2143646 - RNA, 16 nt, Staphylococcus aureus subsp. aureus N315
uuucaacauaauauuu

SEQ ID NO: 2143647 - RNA, 18 nt, Staphylococcus aureus subsp. aureus N315
uuucaacgcauauucuau

SEQ ID NO: 2143648 - RNA, 19 nt, Staphylococcus aureus subsp. aureus N315
uuucaacgcauauucuauu

SEQ ID NO: 2143649 - RNA, 14 nt, Staphylococcus aureus subsp. aureus N315
uuucaagaccaaau

SEQ ID NO: 2143650 - RNA, 17 nt, Staphylococcus aureus subsp. aureus N315
uuucaagaccaaauauu

SEQ ID NO: 2143651 - RNA, 17 nt, Staphylococcus aureus subsp. aureus N315
uuucacucauauuacuu

SEQ ID NO: 2143652 - RNA, 22 nt, Staphylococcus aureus subsp. aureus N315
uuucacuacgucaagcuuugcu

SEQ ID NO: 2143653 - RNA, 14 nt, Staphylococcus aureus subsp. aureus N315
uuucaauuagaaaa

SEQ ID NO: 2143654 - RNA, 12 nt, Staphylococcus aureus subsp. aureus N315
uuuauuucuaua

SEQ ID NO: 2143655 - RNA, 19 nt, Staphylococcus aureus subsp. aureus N315
uuuauuuagaauaaacuuu

SEQ ID NO: 2143656 - RNA, 16 nt, Staphylococcus aureus subsp. aureus N315
uuuauugccgguuaaa

SEQ ID NO: 2143657 - RNA, 21 nt, Staphylococcus aureus subsp. aureus N315
uuuauugagcuuuguuugaaa

SEQ ID NO: 2143658 - RNA, 12 nt, Staphylococcus aureus subsp. aureus N315
uuuauucuuccc

SEQ ID NO: 2143659 - RNA, 14 nt, Staphylococcus aureus subsp. aureus N315
uuuauucuucaguu

SEQ ID NO: 2143660 - RNA, 15 nt, Staphylococcus aureus subsp. aureus N315
uuuauuauaaaauag

SEQ ID NO: 2143661 - RNA, 19 nt, Staphylococcus aureus subsp. aureus N315
uuuauuaguauucaaaaaa

SEQ ID NO: 2143662 - RNA, 21 nt, Staphylococcus aureus subsp. aureus N315
uuuauuacuuuaauuuaguga

SEQ ID NO: 2143663 - RNA, 14 nt, Staphylococcus aureus subsp. aureus N315
uuuauuacuuuaau

SEQ ID NO: 2143664 - RNA, 16 nt, Staphylococcus aureus subsp. aureus N315
uuuauuaucuuuaauu

SEQ ID NO: 2143665 - RNA, 15 nt, Staphylococcus aureus subsp. aureus N315
uuuauucuaaauaua

SEQ ID NO: 2143666 - RNA, 15 nt, Staphylococcus aureus subsp. aureus N315
uuuauucaaaucaua

SEQ ID NO: 2143667 - RNA, 17 nt, Staphylococcus aureus subsp. aureus N315
uuuauucagauauuaau

SEQ ID NO: 2143668 - RNA, 13 nt, Staphylococcus aureus subsp. aureus N315
uuuauuuugauua

SEQ ID NO: 2143669 - RNA, 19 nt, Staphylococcus aureus subsp. aureus N315
uuuauuuucaauaaauaaa

SEQ ID NO: 2143670 - RNA, 14 nt, Staphylococcus aureus subsp. aureus N315
uuuauuuuauaaga

SEQ ID NO: 2143671 - RNA, 16 nt, Staphylococcus aureus subsp. aureus N315
uuuauuuuaauauuuu

SEQ ID NO: 2143672 - RNA, 24 nt, Staphylococcus aureus subsp. aureus N315
uuucaaaacuagcaguaauauguu

SEQ ID NO: 2143673 - RNA, 15 nt, Staphylococcus aureus subsp. aureus N315
uuucaaaaccaauua

SEQ ID NO: 2143674 - RNA, 23 nt, Staphylococcus aureus subsp. aureus N315
uuucaaagcugucaacuugucua

SEQ ID NO: 2143675 - RNA, 14 nt, Staphylococcus aureus subsp. aureus N315
uuucaaauaagaau

SEQ ID NO: 2143676 - RNA, 15 nt, Staphylococcus aureus subsp. aureus N315
uuucaaauaauauaa

SEQ ID NO: 2143677 - RNA, 20 nt, Staphylococcus aureus subsp. aureus N315
uuucaaacgugauuuuauca

SEQ ID NO: 2143678 - RNA, 18 nt, Staphylococcus aureus subsp. aureus N315
uuucuggccacuaaugca

SEQ ID NO: 2143679 - RNA, 14 nt, Staphylococcus aureus subsp. aureus N315
uuucuguaccaaau

SEQ ID NO: 2143680 - RNA, 15 nt, Staphylococcus aureus subsp. aureus N315
uuucuguuucaucac

SEQ ID NO: 2143681 - RNA, 15 nt, Staphylococcus aureus subsp. aureus N315
uuucuucaauugucu

SEQ ID NO: 2143682 - RNA, 20 nt, Staphylococcus aureus subsp. aureus N315
uuucuucagaaccuugaaug

SEQ ID NO: 2143683 - RNA, 13 nt, Staphylococcus aureus subsp. aureus N315
uuucuuauuuauu

SEQ ID NO: 2143684 - RNA, 14 nt, Staphylococcus aureus subsp. aureus N315
uuucuuagauacuc

SEQ ID NO: 2143685 - RNA, 15 nt, Staphylococcus aureus subsp. aureus N315
uuucuuaacauaaaa

SEQ ID NO: 2143686 - RNA, 10 nt, Staphylococcus aureus subsp. aureus N315
uuucuuaauu

SEQ ID NO: 2143687 - RNA, 23 nt, Staphylococcus aureus subsp. aureus N315
uuucuugccaucaauuucuguaa

SEQ ID NO: 2143688 - RNA, 17 nt, Staphylococcus aureus subsp. aureus N315
uuucuuguguauuuuua

SEQ ID NO: 2143689 - RNA, 23 nt, Staphylococcus aureus subsp. aureus N315
uuucuugaugaauuaaacugauc

SEQ ID NO: 2143690 - RNA, 15 nt, Staphylococcus aureus subsp. aureus N315
uuucuuuauuuuaaa

SEQ ID NO: 2143691 - RNA, 18 nt, Staphylococcus aureus subsp. aureus N315
uuucuuguucuaaaauaa

SEQ ID NO: 2143692 - RNA, 21 nt, Staphylococcus aureus subsp. aureus N315
uuucuucauuuucauuguaug

SEQ ID NO: 2143693 - RNA, 12 nt, Staphylococcus aureus subsp. aureus N315
uuucuucauuug

SEQ ID NO: 2143694 - RNA, 19 nt, Staphylococcus aureus subsp. aureus N315
uuucuucauaguucaaauu

SEQ ID NO: 2143695 - RNA, 23 nt, Staphylococcus aureus subsp. aureus N315
uuugaacaacaucuuuuguuguu

SEQ ID NO: 2143696 - RNA, 15 nt, Staphylococcus aureus subsp. aureus N315
uuugaacauauuaua

SEQ ID NO: 2143697 - RNA, 21 nt, Staphylococcus aureus subsp. aureus N315
uuugaaguuacuauauuuauu

SEQ ID NO: 2143698 - RNA, 17 nt, Staphylococcus aureus subsp. aureus N315
uuugaagaauguuucau

SEQ ID NO: 2143699 - RNA, 14 nt, Staphylococcus aureus subsp. aureus N315
uuucuuucuuuucu

SEQ ID NO: 2143700 - RNA, 14 nt, Staphylococcus aureus subsp. aureus N315
uuucuuucauaauu

SEQ ID NO: 2143701 - RNA, 20 nt, Staphylococcus aureus subsp. aureus N315
uuucuuuuuugcuguauaua

SEQ ID NO: 2143702 - RNA, 14 nt, Staphylococcus aureus subsp. aureus N315
uuucuuuuuuaauu

SEQ ID NO: 2143703 - RNA, 12 nt, Staphylococcus aureus subsp. aureus N315
uuugaauauacu

SEQ ID NO: 2143704 - RNA, 16 nt, Staphylococcus aureus subsp. aureus N315
uuugaauacuuuauuu

SEQ ID NO: 2143705 - RNA, 16 nt, Staphylococcus aureus subsp. aureus N315
uuugaauauacuuaau

SEQ ID NO: 2143706 - RNA, 16 nt, Staphylococcus aureus subsp. aureus N315
uuugaauauuugcuuu

SEQ ID NO: 2143707 - RNA, 22 nt, Staphylococcus aureus subsp. aureus N315
uuugaaugcaaaucaaauacau

SEQ ID NO: 2143708 - RNA, 12 nt, Staphylococcus aureus subsp. aureus N315
uuugaaugcaaa

SEQ ID NO: 2143709 - RNA, 15 nt, Staphylococcus aureus subsp. aureus N315
uuugaauugacuuac

SEQ ID NO: 2143710 - RNA, 19 nt, Staphylococcus aureus subsp. aureus N315
uuugacacauuauugaaau

SEQ ID NO: 2143711 - RNA, 12 nt, Staphylococcus aureus subsp. aureus N315
uuugaauuggga

SEQ ID NO: 2143712 - RNA, 16 nt, Staphylococcus aureus subsp. aureus N315
uuugacuauucucagu

SEQ ID NO: 2143713 - RNA, 19 nt, Staphylococcus aureus subsp. aureus N315
uuugacauauuuuuuaaau

SEQ ID NO: 2143714 - RNA, 16 nt, Staphylococcus aureus subsp. aureus N315
uuugacaucuauuucu

SEQ ID NO: 2143715 - RNA, 20 nt, Staphylococcus aureus subsp. aureus N315
uuugacaguuuuaaaugaaa

SEQ ID NO: 2143716 - RNA, 14 nt, Staphylococcus aureus subsp. aureus N315
uuugagagauuauu

SEQ ID NO: 2143717 - RNA, 20 nt, Staphylococcus aureus subsp. aureus N315
uuugaguuauauuuuuagga

SEQ ID NO: 2143718 - RNA, 17 nt, Staphylococcus aureus subsp. aureus N315
uuugaguauccaauacu

SEQ ID NO: 2143719 - RNA, 23 nt, Staphylococcus aureus subsp. aureus N315
uuugaguauuugccuuuuuuauu

SEQ ID NO: 2143720 - RNA, 15 nt, Staphylococcus aureus subsp. aureus N315
uuugaguaaauuaau

SEQ ID NO: 2143721 - RNA, 19 nt, Staphylococcus aureus subsp. aureus N315
uuugauaacaauuuuaaau

SEQ ID NO: 2143722 - RNA, 23 nt, Staphylococcus aureus subsp. aureus N315
uuugauaaaugcgguugaugguu

SEQ ID NO: 2143723 - RNA, 23 nt, Staphylococcus aureus subsp. aureus N315
uuugauauaaaaagugaaaguau

SEQ ID NO: 2143724 - RNA, 17 nt, Staphylococcus aureus subsp. aureus N315
uuugauaucacuauaca

SEQ ID NO: 2143725 - RNA, 17 nt, Staphylococcus aureus subsp. aureus N315
uuugauaguaauaguua

SEQ ID NO: 2143726 - RNA, 22 nt, Staphylococcus aureus subsp. aureus N315
uuugauauaaaaagugaaagua

SEQ ID NO: 2143727 - RNA, 22 nt, Staphylococcus aureus subsp. aureus N315
uuugauagaugauacauucuau

SEQ ID NO: 2143728 - RNA, 20 nt, Staphylococcus aureus subsp. aureus N315
uuugauuuggguaauguuuu

SEQ ID NO: 2143729 - RNA, 12 nt, Staphylococcus aureus subsp. aureus N315
uuugauugauau

SEQ ID NO: 2143730 - RNA, 15 nt, Staphylococcus aureus subsp. aureus N315
uuugauugcaaaaaa

SEQ ID NO: 2143731 - RNA, 15 nt, Staphylococcus aureus subsp. aureus N315
uuugauucuauuucu

SEQ ID NO: 2143732 - RNA, 20 nt, Staphylococcus aureus subsp. aureus N315
uuugauccaaaguacucaag

SEQ ID NO: 2143733 - RNA, 16 nt, Staphylococcus aureus subsp. aureus N315
uuugauguucacuaaa

SEQ ID NO: 2143734 - RNA, 17 nt, Staphylococcus aureus subsp. aureus N315
uuugcagauugauauaa

SEQ ID NO: 2143735 - RNA, 22 nt, Staphylococcus aureus subsp. aureus N315
uuugcacgggugguuuuuaauu

SEQ ID NO: 2143736 - RNA, 14 nt, Staphylococcus aureus subsp. aureus N315
uuugcaaucaucug

SEQ ID NO: 2143737 - RNA, 19 nt, Staphylococcus aureus subsp. aureus N315
uuugcaaauuggaaaaaua

SEQ ID NO: 2143738 - RNA, 21 nt, Staphylococcus aureus subsp. aureus N315
uuugcaacauauuuucacaau

SEQ ID NO: 2143739 - RNA, 17 nt, Staphylococcus aureus subsp. aureus N315
uuugcacaaagauaugu

SEQ ID NO: 2143740 - RNA, 20 nt, Staphylococcus aureus subsp. aureus N315
uuugcaauugcaaugaauaa

SEQ ID NO: 2143741 - RNA, 15 nt, Staphylococcus aureus subsp. aureus N315
uuugcaucacagaua

SEQ ID NO: 2143742 - RNA, 16 nt, Staphylococcus aureus subsp. aureus N315
uuugcauacauaucuu

SEQ ID NO: 2143743 - RNA, 18 nt, Staphylococcus aureus subsp. aureus N315
uuuccuguuacuuucaca

SEQ ID NO: 2143744 - RNA, 14 nt, Staphylococcus aureus subsp. aureus N315
uuuccuaauucuug

SEQ ID NO: 2143745 - RNA, 13 nt, Staphylococcus aureus subsp. aureus N315
uuuccuaauucuu

SEQ ID NO: 2143746 - RNA, 23 nt, Staphylococcus aureus subsp. aureus N315
uuuccuuggacucagugcuaugu

SEQ ID NO: 2143747 - RNA, 22 nt, Staphylococcus aureus subsp. aureus N315
uuucgaaaagaaauucuacagg

SEQ ID NO: 2143748 - RNA, 18 nt, Staphylococcus aureus subsp. aureus N315
uuucgaacgcuugaaaaa

SEQ ID NO: 2143749 - RNA, 21 nt, Staphylococcus aureus subsp. aureus N315
uuucgacaucuagaugaaauu

SEQ ID NO: 2143750 - RNA, 13 nt, Staphylococcus aureus subsp. aureus N315
uuucgauauuugu

SEQ ID NO: 2143751 - RNA, 22 nt, Staphylococcus aureus subsp. aureus N315
uuucgacguaccaauuagcaug

SEQ ID NO: 2143752 - RNA, 21 nt, Staphylococcus aureus subsp. aureus N315
uuuccauaaauauuuaaaaua

SEQ ID NO: 2143753 - RNA, 17 nt, Staphylococcus aureus subsp. aureus N315
uuucccuacugcuugug

SEQ ID NO: 2143754 - RNA, 14 nt, Staphylococcus aureus subsp. aureus N315
uuucccauuuaucu

SEQ ID NO: 2143755 - RNA, 23 nt, Staphylococcus aureus subsp. aureus N315
uuucuaauugaaaucaucuuaug

SEQ ID NO: 2143756 - RNA, 19 nt, Staphylococcus aureus subsp. aureus N315
uuucuaauugaaaucaucu

SEQ ID NO: 2143757 - RNA, 15 nt, Staphylococcus aureus subsp. aureus N315
uuucuaaugcucauu

SEQ ID NO: 2143758 - RNA, 19 nt, Staphylococcus aureus subsp. aureus N315
uuucuaaauucuuuuuguu

SEQ ID NO: 2143759 - RNA, 23 nt, Staphylococcus aureus subsp. aureus N315
uuucuaaaugauuuauucuaaau

SEQ ID NO: 2143760 - RNA, 15 nt, Staphylococcus aureus subsp. aureus N315
uuucuaaaauaacua

SEQ ID NO: 2143761 - RNA, 21 nt, Staphylococcus aureus subsp. aureus N315
uuucuacaccuacaacuguug

SEQ ID NO: 2143762 - RNA, 17 nt, Staphylococcus aureus subsp. aureus N315
uuucuacuguauaagug

SEQ ID NO: 2143763 - RNA, 19 nt, Staphylococcus aureus subsp. aureus N315
uuucuacuguauaagugcu

SEQ ID NO: 2143764 - RNA, 22 nt, Staphylococcus aureus subsp. aureus N315
uuucuaggccacuaagaccaug

SEQ ID NO: 2143765 - RNA, 22 nt, Staphylococcus aureus subsp. aureus N315
uuucuagcuuguuuguuacaua

SEQ ID NO: 2143766 - RNA, 17 nt, Staphylococcus aureus subsp. aureus N315
uuucuaggccacuaaga

SEQ ID NO: 2143767 - RNA, 12 nt, Staphylococcus aureus subsp. aureus N315
uuucuagcaugu

SEQ ID NO: 2143768 - RNA, 21 nt, Staphylococcus aureus subsp. aureus N315
uuucuagcuauauccaguaaa

SEQ ID NO: 2143769 - RNA, 19 nt, Staphylococcus aureus subsp. aureus N315
uuucguguuccaauuuuau

SEQ ID NO: 2143770 - RNA, 17 nt, Staphylococcus aureus subsp. aureus N315
uuucgucuacuauuuuu

SEQ ID NO: 2143771 - RNA, 14 nt, Staphylococcus aureus subsp. aureus N315
uuucgucagauuca

SEQ ID NO: 2143772 - RNA, 19 nt, Staphylococcus aureus subsp. aureus N315
uuucguaacauuuaaaaaa

SEQ ID NO: 2143773 - RNA, 16 nt, Staphylococcus aureus subsp. aureus N315
uuucguauaauuuuaa

SEQ ID NO: 2143774 - RNA, 22 nt, Staphylococcus aureus subsp. aureus N315
uuucucaaacguucaucuaauu

SEQ ID NO: 2143775 - RNA, 16 nt, Staphylococcus aureus subsp. aureus N315
uuucucaaugugagau

SEQ ID NO: 2143776 - RNA, 14 nt, Staphylococcus aureus subsp. aureus N315
uuucuauucaaaaa

SEQ ID NO: 2143777 - RNA, 14 nt, Staphylococcus aureus subsp. aureus N315
uuucuauuaauaua

SEQ ID NO: 2143778 - RNA, 14 nt, Staphylococcus aureus subsp. aureus N315
uuucuaucaaauaa

SEQ ID NO: 2143779 - RNA, 23 nt, Staphylococcus aureus subsp. aureus N315
uuucuauagaaaaaguauuacuu

SEQ ID NO: 2143780 - RNA, 14 nt, Staphylococcus aureus subsp. aureus N315
uuucucacugcugu

SEQ ID NO: 2143781 - RNA, 19 nt, Staphylococcus aureus subsp. aureus N315
uuucucgauuaauuuucuu

SEQ ID NO: 2143782 - RNA, 22 nt, Staphylococcus aureus subsp. aureus N315
uuucugacuuuuaaaaaacaua

SEQ ID NO: 2143783 - RNA, 19 nt, Staphylococcus aureus subsp. aureus N315
uuucugagaagaaauauau

SEQ ID NO: 2143784 - RNA, 12 nt, Staphylococcus aureus subsp. aureus N315
uuucucuaaaua

SEQ ID NO: 2143785 - RNA, 22 nt, Staphylococcus aureus subsp. aureus N315
uuucugacugugaagcugugcu

SEQ ID NO: 2143786 - RNA, 13 nt, Staphylococcus aureus subsp. aureus N315
uugcgaaaauauc

SEQ ID NO: 2143787 - RNA, 23 nt, Staphylococcus aureus subsp. aureus N315
uugcuauuucaacaaacauaaau

SEQ ID NO: 2143788 - RNA, 18 nt, Staphylococcus aureus subsp. aureus N315
uugcuaaaaaaauuaaaa

SEQ ID NO: 2143789 - RNA, 22 nt, Staphylococcus aureus subsp. aureus N315
uugcuaaaaaaauuaaaauguu

SEQ ID NO: 2143790 - RNA, 17 nt, Staphylococcus aureus subsp. aureus N315
uugcguuuaauaacauu

SEQ ID NO: 2143791 - RNA, 16 nt, Staphylococcus aureus subsp. aureus N315
uugcacuaugcauaau

SEQ ID NO: 2143792 - RNA, 18 nt, Staphylococcus aureus subsp. aureus N315
uugcacucuuuucucguu

SEQ ID NO: 2143793 - RNA, 18 nt, Staphylococcus aureus subsp. aureus N315
uugcagauuuugcaaucu

SEQ ID NO: 2143794 - RNA, 14 nt, Staphylococcus aureus subsp. aureus N315
uugcauguaaaauu

SEQ ID NO: 2143795 - RNA, 15 nt, Staphylococcus aureus subsp. aureus N315
uugcauguaaaauua

SEQ ID NO: 2143796 - RNA, 14 nt, Staphylococcus aureus subsp. aureus N315
uugcauugauuuca

SEQ ID NO: 2143797 - RNA, 21 nt, Staphylococcus aureus subsp. aureus N315
uugccaaaaguuauauaaauu

SEQ ID NO: 2143798 - RNA, 14 nt, Staphylococcus aureus subsp. aureus N315
uugcauccaugcug

SEQ ID NO: 2143799 - RNA, 22 nt, Staphylococcus aureus subsp. aureus N315
uugcauauccuucaaagauuuu

SEQ ID NO: 2143800 - RNA, 22 nt, Staphylococcus aureus subsp. aureus N315
uugccaaaaguuauauaaauuu

SEQ ID NO: 2143801 - RNA, 18 nt, Staphylococcus aureus subsp. aureus N315
uugguauucaucuucaaa

SEQ ID NO: 2143802 - RNA, 23 nt, Staphylococcus aureus subsp. aureus N315
uugguauacaguuuuacuauaau

SEQ ID NO: 2143803 - RNA, 22 nt, Staphylococcus aureus subsp. aureus N315
uuggucaccuacagauaaagcu

SEQ ID NO: 2143804 - RNA, 16 nt, Staphylococcus aureus subsp. aureus N315
uuggucaaguaaaugu

SEQ ID NO: 2143805 - RNA, 23 nt, Staphylococcus aureus subsp. aureus N315
uugguggaugucaugucuagauu

SEQ ID NO: 2143806 - RNA, 16 nt, Staphylococcus aureus subsp. aureus N315
uugguguuuagucuuu

SEQ ID NO: 2143807 - RNA, 21 nt, Staphylococcus aureus subsp. aureus N315
uugggcgcuuuuuaauuugua

SEQ ID NO: 2143808 - RNA, 21 nt, Staphylococcus aureus subsp. aureus N315
uuggcggggccccaacacaga

SEQ ID NO: 2143809 - RNA, 18 nt, Staphylococcus aureus subsp. aureus N315
uuggcguauuuuuuguuc

SEQ ID NO: 2143810 - RNA, 14 nt, Staphylococcus aureus subsp. aureus N315
uugggauauagaaa

SEQ ID NO: 2143811 - RNA, 17 nt, Staphylococcus aureus subsp. aureus N315
uuggagcguaaaguuuu

SEQ ID NO: 2143812 - RNA, 15 nt, Staphylococcus aureus subsp. aureus N315
uuggaggugaugaga

SEQ ID NO: 2143813 - RNA, 13 nt, Staphylococcus aureus subsp. aureus N315
uugcuuuuuacua

SEQ ID NO: 2143814 - RNA, 14 nt, Staphylococcus aureus subsp. aureus N315
uuggaaaaauugug

SEQ ID NO: 2143815 - RNA, 21 nt, Staphylococcus aureus subsp. aureus N315
uugcuuuaauuugauuaaauu

SEQ ID NO: 2143816 - RNA, 23 nt, Staphylococcus aureus subsp. aureus N315
uugcuuaaucgggcuauauuuga

SEQ ID NO: 2143817 - RNA, 22 nt, Staphylococcus aureus subsp. aureus N315
uugcuuaaaccuuaauaaugaa

SEQ ID NO: 2143818 - RNA, 15 nt, Staphylococcus aureus subsp. aureus N315
uuuaaaacaaugauu

SEQ ID NO: 2143819 - RNA, 16 nt, Staphylococcus aureus subsp. aureus N315
uuguuuuuaaaaucuc

SEQ ID NO: 2143820 - RNA, 21 nt, Staphylococcus aureus subsp. aureus N315
uuguuuuucacuguuaaaguc

SEQ ID NO: 2143821 - RNA, 12 nt, Staphylococcus aureus subsp. aureus N315
uuguuuucacug

SEQ ID NO: 2143822 - RNA, 16 nt, Staphylococcus aureus subsp. aureus N315
uuguuuuccaauaaua

SEQ ID NO: 2143823 - RNA, 19 nt, Staphylococcus aureus subsp. aureus N315
uuguuuagaagcuucugca

SEQ ID NO: 2143824 - RNA, 13 nt, Staphylococcus aureus subsp. aureus N315
uuguuuagaaaag

SEQ ID NO: 2143825 - RNA, 20 nt, Staphylococcus aureus subsp. aureus N315
uuguuuucaaaugaaaauac

SEQ ID NO: 2143826 - RNA, 21 nt, Staphylococcus aureus subsp. aureus N315
uuguucuccgaucaugccuuc

SEQ ID NO: 2143827 - RNA, 14 nt, Staphylococcus aureus subsp. aureus N315
uuguucuaauuguu

SEQ ID NO: 2143828 - RNA, 22 nt, Staphylococcus aureus subsp. aureus N315
uuguucuccgaucaugccuuca

SEQ ID NO: 2143829 - RNA, 23 nt, Staphylococcus aureus subsp. aureus N315
uuguuggucuaucgccuaaaaau

SEQ ID NO: 2143830 - RNA, 15 nt, Staphylococcus aureus subsp. aureus N315
uuguuggggcccaca

SEQ ID NO: 2143831 - RNA, 17 nt, Staphylococcus aureus subsp. aureus N315
uuguuuaaguuuuucag

SEQ ID NO: 2143832 - RNA, 14 nt, Staphylococcus aureus subsp. aureus N315
uuguuuaauaacaa

SEQ ID NO: 2143833 - RNA, 15 nt, Staphylococcus aureus subsp. aureus N315
uuguuuaagaaugua

SEQ ID NO: 2143834 - RNA, 24 nt, Staphylococcus aureus subsp. aureus N315
uuuaacauuuauucuuucucuauu

SEQ ID NO: 2143835 - RNA, 16 nt, Staphylococcus aureus subsp. aureus N315
uuuaacacuucaguua

SEQ ID NO: 2143836 - RNA, 20 nt, Staphylococcus aureus subsp. aureus N315
uuuaaaucuguacuucuaau

SEQ ID NO: 2143837 - RNA, 16 nt, Staphylococcus aureus subsp. aureus N315
uuuaaaucuauauaaa

SEQ ID NO: 2143838 - RNA, 18 nt, Staphylococcus aureus subsp. aureus N315
uuuaaaucuuguucuaau

SEQ ID NO: 2143839 - RNA, 18 nt, Staphylococcus aureus subsp. aureus N315
uuuaaaucuuuuagcuuu

SEQ ID NO: 2143840 - RNA, 19 nt, Staphylococcus aureus subsp. aureus N315
uuuaaaucuuguucuaauu

SEQ ID NO: 2143841 - RNA, 24 nt, Staphylococcus aureus subsp. aureus N315
uuuaacaagauaacuagcaaaugc

SEQ ID NO: 2143842 - RNA, 15 nt, Staphylococcus aureus subsp. aureus N315
uuuaaaucauaaauu

SEQ ID NO: 2143843 - RNA, 18 nt, Staphylococcus aureus subsp. aureus N315
uuuaaauaaaugacuuca

SEQ ID NO: 2143844 - RNA, 16 nt, Staphylococcus aureus subsp. aureus N315
uuuaaaaucucauaau

SEQ ID NO: 2143845 - RNA, 23 nt, Staphylococcus aureus subsp. aureus N315
uuuaaauaauaauucauaaaugc

SEQ ID NO: 2143846 - RNA, 13 nt, Staphylococcus aureus subsp. aureus N315
uuuaaaauauuau

SEQ ID NO: 2143847 - RNA, 21 nt, Staphylococcus aureus subsp. aureus N315
uuuaaaauacgacaccaacau

SEQ ID NO: 2143848 - RNA, 15 nt, Staphylococcus aureus subsp. aureus N315
uuuaacggaaauaca

SEQ ID NO: 2143849 - RNA, 16 nt, Staphylococcus aureus subsp. aureus N315
uuuaacccacauuaaa

SEQ ID NO: 2143850 - RNA, 21 nt, Staphylococcus aureus subsp. aureus N315
uuuaacccacauuaaauauua

SEQ ID NO: 2143851 - RNA, 22 nt, Staphylococcus aureus subsp. aureus N315
uuuaacuuauauacguugauua

SEQ ID NO: 2143852 - RNA, 18 nt, Staphylococcus aureus subsp. aureus N315
uuuaacugguugauaaau

SEQ ID NO: 2143853 - RNA, 18 nt, Staphylococcus aureus subsp. aureus N315
uuuaacguuauucauuug

SEQ ID NO: 2143854 - RNA, 21 nt, Staphylococcus aureus subsp. aureus N315
uuuaacuauguuacuuauaua

SEQ ID NO: 2143855 - RNA, 16 nt, Staphylococcus aureus subsp. aureus N315
uuuaauaaaucguguu

SEQ ID NO: 2143856 - RNA, 20 nt, Staphylococcus aureus subsp. aureus N315
uuuaauaacguacauuuaug

SEQ ID NO: 2143857 - RNA, 13 nt, Staphylococcus aureus subsp. aureus N315
uuuaauaacuaaa

SEQ ID NO: 2143858 - RNA, 19 nt, Staphylococcus aureus subsp. aureus N315
uuuaauaaccuuuaaaaca

SEQ ID NO: 2143859 - RNA, 17 nt, Staphylococcus aureus subsp. aureus N315
uuuaauaacaaaauuaa

SEQ ID NO: 2143860 - RNA, 14 nt, Staphylococcus aureus subsp. aureus N315
uuuaauaacaaaau

SEQ ID NO: 2143861 - RNA, 23 nt, Staphylococcus aureus subsp. aureus N315
uuuaaguuauuuuguccagacaa

SEQ ID NO: 2143862 - RNA, 14 nt, Staphylococcus aureus subsp. aureus N315
uuuaaguuuauaau

SEQ ID NO: 2143863 - RNA, 19 nt, Staphylococcus aureus subsp. aureus N315
uuuaagugaugaccaauau

SEQ ID NO: 2143864 - RNA, 17 nt, Staphylococcus aureus subsp. aureus N315
uuuaauaaaaucaucuu

SEQ ID NO: 2143865 - RNA, 23 nt, Staphylococcus aureus subsp. aureus N315
uuuaauaaaaaccaauauuucug

SEQ ID NO: 2143866 - RNA, 17 nt, Staphylococcus aureus subsp. aureus N315
uuuaaguuuauaaucag

SEQ ID NO: 2143867 - RNA, 21 nt, Staphylococcus aureus subsp. aureus N315
uuuaauaaaaaccaauauuuc

SEQ ID NO: 2143868 - RNA, 12 nt, Staphylococcus aureus subsp. aureus N315
uuuaauaaaaac

SEQ ID NO: 2143869 - RNA, 22 nt, Staphylococcus aureus subsp. aureus N315
uuuaauucuauuuuugauuuaa

SEQ ID NO: 2143870 - RNA, 16 nt, Staphylococcus aureus subsp. aureus N315
uuuaauuauuuucucg

SEQ ID NO: 2143871 - RNA, 14 nt, Staphylococcus aureus subsp. aureus N315
uuuaauuccaaaga

SEQ ID NO: 2143872 - RNA, 17 nt, Staphylococcus aureus subsp. aureus N315
uuuaauagacauuaacu

SEQ ID NO: 2143873 - RNA, 15 nt, Staphylococcus aureus subsp. aureus N315
uuuaauuaauuauua

SEQ ID NO: 2143874 - RNA, 21 nt, Staphylococcus aureus subsp. aureus N315
uuuaauuauuucccuggaaaa

SEQ ID NO: 2143875 - RNA, 21 nt, Staphylococcus aureus subsp. aureus N315
uuuaauaauguaucauuucag

SEQ ID NO: 2143876 - RNA, 14 nt, Staphylococcus aureus subsp. aureus N315
uuuaauaauuaaau

SEQ ID NO: 2143877 - RNA, 16 nt, Staphylococcus aureus subsp. aureus N315
uuuaauuaauuaucau

SEQ ID NO: 2143878 - RNA, 14 nt, Staphylococcus aureus subsp. aureus N315
uuuaauuaaaguua

SEQ ID NO: 2143879 - RNA, 14 nt, Staphylococcus aureus subsp. aureus N315
uuuaauugcuguaa

SEQ ID NO: 2143880 - RNA, 13 nt, Staphylococcus aureus subsp. aureus N315
uuuaauuguuuaa

SEQ ID NO: 2143881 - RNA, 14 nt, Staphylococcus aureus subsp. aureus N315
uuuaauugguucuu

SEQ ID NO: 2143882 - RNA, 16 nt, Staphylococcus aureus subsp. aureus N315
uuuaauugguucuucu

SEQ ID NO: 2143883 - RNA, 17 nt, Staphylococcus aureus subsp. aureus N315
uuuaauugucucaucau

SEQ ID NO: 2143884 - RNA, 14 nt, Staphylococcus aureus subsp. aureus N315
uuuaauuuucuaaa

SEQ ID NO: 2143885 - RNA, 21 nt, Staphylococcus aureus subsp. aureus N315
uuuaauuuaguuauaauuucu

SEQ ID NO: 2143886 - RNA, 16 nt, Staphylococcus aureus subsp. aureus N315
uuuaauuuacaauuaa

SEQ ID NO: 2143887 - RNA, 18 nt, Staphylococcus aureus subsp. aureus N315
uuuaauuuaguacucaau

SEQ ID NO: 2143888 - RNA, 19 nt, Staphylococcus aureus subsp. aureus N315
uuguaauaauugcauguaa

SEQ ID NO: 2143889 - RNA, 21 nt, Staphylococcus aureus subsp. aureus N315
uuguaagcucaugaaucagau

SEQ ID NO: 2143890 - RNA, 21 nt, Staphylococcus aureus subsp. aureus N315
uuguaaucccauuuuaaaguc

SEQ ID NO: 2143891 - RNA, 18 nt, Staphylococcus aureus subsp. aureus N315
uuguaaucccauuuuaaa

SEQ ID NO: 2143892 - RNA, 14 nt, Staphylococcus aureus subsp. aureus N315
uugguuacuuagua

SEQ ID NO: 2143893 - RNA, 22 nt, Staphylococcus aureus subsp. aureus N315
uuguaagucgcucuagacauua

SEQ ID NO: 2143894 - RNA, 16 nt, Staphylococcus aureus subsp. aureus N315
uuguaauugaaaugau

SEQ ID NO: 2143895 - RNA, 20 nt, Staphylococcus aureus subsp. aureus N315
uuguacacauccucauaauu

SEQ ID NO: 2143896 - RNA, 21 nt, Staphylococcus aureus subsp. aureus N315
uuguaccaaauaaauuaaauu

SEQ ID NO: 2143897 - RNA, 22 nt, Staphylococcus aureus subsp. aureus N315
uuguaccaaauaaauuaaauuu

SEQ ID NO: 2143898 - RNA, 23 nt, Staphylococcus aureus subsp. aureus N315
uuguacaguaauauucaacuugu

SEQ ID NO: 2143899 - RNA, 16 nt, Staphylococcus aureus subsp. aureus N315
uuguacauauguguau

SEQ ID NO: 2143900 - RNA, 18 nt, Staphylococcus aureus subsp. aureus N315
uuguacaucauuaaauau

SEQ ID NO: 2143901 - RNA, 12 nt, Staphylococcus aureus subsp. aureus N315
uugucaucuuuu

SEQ ID NO: 2143902 - RNA, 19 nt, Staphylococcus aureus subsp. aureus N315
uugucauuugaacaucauu

SEQ ID NO: 2143903 - RNA, 13 nt, Staphylococcus aureus subsp. aureus N315
uugucaugccuuc

SEQ ID NO: 2143904 - RNA, 14 nt, Staphylococcus aureus subsp. aureus N315
uugucaugccuuca

SEQ ID NO: 2143905 - RNA, 16 nt, Staphylococcus aureus subsp. aureus N315
uugucauuuugauuaa

SEQ ID NO: 2143906 - RNA, 14 nt, Staphylococcus aureus subsp. aureus N315
uuguccaugccuua

SEQ ID NO: 2143907 - RNA, 17 nt, Staphylococcus aureus subsp. aureus N315
uuguccaugccuuaugu

SEQ ID NO: 2143908 - RNA, 19 nt, Staphylococcus aureus subsp. aureus N315
uugucacgauagauuuauc

SEQ ID NO: 2143909 - RNA, 19 nt, Staphylococcus aureus subsp. aureus N315
uuguauaccuauuccuauu

SEQ ID NO: 2143910 - RNA, 17 nt, Staphylococcus aureus subsp. aureus N315
uuguauagaauguguau

SEQ ID NO: 2143911 - RNA, 21 nt, Staphylococcus aureus subsp. aureus N315
uuguauaugauuaaauaauca

SEQ ID NO: 2143912 - RNA, 16 nt, Staphylococcus aureus subsp. aureus N315
uugucucaauaauguu

SEQ ID NO: 2143913 - RNA, 20 nt, Staphylococcus aureus subsp. aureus N315
uugucucaucauuuaaaauu

SEQ ID NO: 2143914 - RNA, 21 nt, Staphylococcus aureus subsp. aureus N315
uugucucaucauuuaaaauuu

SEQ ID NO: 2143915 - RNA, 17 nt, Staphylococcus aureus subsp. aureus N315
uugugauuuuuaauaau

SEQ ID NO: 2143916 - RNA, 15 nt, Staphylococcus aureus subsp. aureus N315
uugugcuuuuccaua

SEQ ID NO: 2143917 - RNA, 23 nt, Staphylococcus aureus subsp. aureus N315
uuguggcguaguuugaauuggga

SEQ ID NO: 2143918 - RNA, 13 nt, Staphylococcus aureus subsp. aureus N315
uuguguuugcuuu

SEQ ID NO: 2143919 - RNA, 13 nt, Staphylococcus aureus subsp. aureus N315
uuguuccagacuc

SEQ ID NO: 2143920 - RNA, 22 nt, Staphylococcus aureus subsp. aureus N315
uuguuaccaaacaauacauaau

SEQ ID NO: 2143921 - RNA, 13 nt, Staphylococcus aureus subsp. aureus N315
uuguuagcaucug

SEQ ID NO: 2143922 - RNA, 19 nt, Staphylococcus aureus subsp. aureus N315
uuguucaguuaaaucugua

SEQ ID NO: 2143923 - RNA, 17 nt, Staphylococcus aureus subsp. aureus N315
uuguuaccaaacaauac

SEQ ID NO: 2143924 - RNA, 23 nt, Staphylococcus aureus subsp. aureus N315
uuguuaauucaacggaacuacua

SEQ ID NO: 2143925 - RNA, 18 nt, Staphylococcus aureus subsp. aureus N315
uuguuaauuuaaagucuu

SEQ ID NO: 2143926 - RNA, 13 nt, Staphylococcus aureus subsp. aureus N315
uuguuaauuucaa

SEQ ID NO: 2143927 - RNA, 20 nt, Staphylococcus aureus subsp. aureus N315
uucuacaggcaaugcaaguu

SEQ ID NO: 2143928 - RNA, 23 nt, Staphylococcus aureus subsp. aureus N315
uucuacaguuggagguccauaau

SEQ ID NO: 2143929 - RNA, 14 nt, Staphylococcus aureus subsp. aureus N315
uucuacagguaaug

SEQ ID NO: 2143930 - RNA, 18 nt, Staphylococcus aureus subsp. aureus N315
uucuacagguaaugcaag

SEQ ID NO: 2143931 - RNA, 21 nt, Staphylococcus aureus subsp. aureus N315
uucuacccauaauuuaaauga

SEQ ID NO: 2143932 - RNA, 21 nt, Staphylococcus aureus subsp. aureus N315
uucuacagcacugaaaucuag

SEQ ID NO: 2143933 - RNA, 22 nt, Staphylococcus aureus subsp. aureus N315
uucuacaacuucauuaguugcc

SEQ ID NO: 2143934 - RNA, 12 nt, Staphylococcus aureus subsp. aureus N315
uucuaaauaaac

SEQ ID NO: 2143935 - RNA, 23 nt, Staphylococcus aureus subsp. aureus N315
uucuaaagcgauuuccaucauuu

SEQ ID NO: 2143936 - RNA, 19 nt, Staphylococcus aureus subsp. aureus N315
uucuaauuguuguaauucu

SEQ ID NO: 2143937 - RNA, 14 nt, Staphylococcus aureus subsp. aureus N315
uucuaauucugaaa

SEQ ID NO: 2143938 - RNA, 13 nt, Staphylococcus aureus subsp. aureus N315
uucuaauuuuuca

SEQ ID NO: 2143939 - RNA, 14 nt, Staphylococcus aureus subsp. aureus N315
uucuaauuuuucac

SEQ ID NO: 2143940 - RNA, 17 nt, Staphylococcus aureus subsp. aureus N315
uucuaaaagaauuauuc

SEQ ID NO: 2143941 - RNA, 12 nt, Staphylococcus aureus subsp. aureus N315
uucuauauuaau

SEQ ID NO: 2143942 - RNA, 18 nt, Staphylococcus aureus subsp. aureus N315
uucuauauaguaaaauaa

SEQ ID NO: 2143943 - RNA, 13 nt, Staphylococcus aureus subsp. aureus N315
uucuauagaaaaa

SEQ ID NO: 2143944 - RNA, 17 nt, Staphylococcus aureus subsp. aureus N315
uucuauauaauuuauuu

SEQ ID NO: 2143945 - RNA, 18 nt, Staphylococcus aureus subsp. aureus N315
uucuaugcucuacgaagu

SEQ ID NO: 2143946 - RNA, 13 nt, Staphylococcus aureus subsp. aureus N315
uucuaucuucaca

SEQ ID NO: 2143947 - RNA, 23 nt, Staphylococcus aureus subsp. aureus N315
uucuaucacacgcauacaggaaa

SEQ ID NO: 2143948 - RNA, 16 nt, Staphylococcus aureus subsp. aureus N315
uucuauuuucauagau

SEQ ID NO: 2143949 - RNA, 21 nt, Staphylococcus aureus subsp. aureus N315
uucuauuccuucuaacauauc

SEQ ID NO: 2143950 - RNA, 19 nt, Staphylococcus aureus subsp. aureus N315
uucuauuaaacauuuuuga

SEQ ID NO: 2143951 - RNA, 12 nt, Staphylococcus aureus subsp. aureus N315
uucuauucaaaa

SEQ ID NO: 2143952 - RNA, 15 nt, Staphylococcus aureus subsp. aureus N315
uucuauucaaaaagg

SEQ ID NO: 2143953 - RNA, 13 nt, Staphylococcus aureus subsp. aureus N315
uucuauuaagaaa

SEQ ID NO: 2143954 - RNA, 19 nt, Staphylococcus aureus subsp. aureus N315
uucguagcaugacauuaag

SEQ ID NO: 2143955 - RNA, 12 nt, Staphylococcus aureus subsp. aureus N315
uucguuuuacua

SEQ ID NO: 2143956 - RNA, 19 nt, Staphylococcus aureus subsp. aureus N315
uucuaaaaaauuaaaaauu

SEQ ID NO: 2143957 - RNA, 17 nt, Staphylococcus aureus subsp. aureus N315
uucguuucuguuucauc

SEQ ID NO: 2143958 - RNA, 15 nt, Staphylococcus aureus subsp. aureus N315
uucguuugaauuauu

SEQ ID NO: 2143959 - RNA, 22 nt, Staphylococcus aureus subsp. aureus N315
uuaucagcauuaaucguauuuu

SEQ ID NO: 2143960 - RNA, 18 nt, Staphylococcus aureus subsp. aureus N315
uuaucagcgaaauuugua

SEQ ID NO: 2143961 - RNA, 13 nt, Staphylococcus aureus subsp. aureus N315
uucucuacuaaua

SEQ ID NO: 2143962 - RNA, 23 nt, Staphylococcus aureus subsp. aureus N315
uucucuacuaauauucuaggcaa

SEQ ID NO: 2143963 - RNA, 17 nt, Staphylococcus aureus subsp. aureus N315
uucucacugcuguucuu

SEQ ID NO: 2143964 - RNA, 17 nt, Staphylococcus aureus subsp. aureus N315
uucucacaacugcauau

SEQ ID NO: 2143965 - RNA, 23 nt, Staphylococcus aureus subsp. aureus N315
uucuguguuggggcccacacccc

SEQ ID NO: 2143966 - RNA, 19 nt, Staphylococcus aureus subsp. aureus N315
uucuguugcaguuucaauc

SEQ ID NO: 2143967 - RNA, 12 nt, Staphylococcus aureus subsp. aureus N315
uucuguuucauc

SEQ ID NO: 2143968 - RNA, 15 nt, Staphylococcus aureus subsp. aureus N315
uucuguuucaucacc

SEQ ID NO: 2143969 - RNA, 22 nt, Staphylococcus aureus subsp. aureus N315
uucuuaaaucaacaucaucuuu

SEQ ID NO: 2143970 - RNA, 16 nt, Staphylococcus aureus subsp. aureus N315
uucuuaaaucaacauc

SEQ ID NO: 2143971 - RNA, 20 nt, Staphylococcus aureus subsp. aureus N315
uucuuaaaauaugauuuaaa

SEQ ID NO: 2143972 - RNA, 13 nt, Staphylococcus aureus subsp. aureus N315
uucugucuguaaa

SEQ ID NO: 2143973 - RNA, 12 nt, Staphylococcus aureus subsp. aureus N315
uucuucugcuaa

SEQ ID NO: 2143974 - RNA, 16 nt, Staphylococcus aureus subsp. aureus N315
uucuuauaaaaaucuu

SEQ ID NO: 2143975 - RNA, 13 nt, Staphylococcus aureus subsp. aureus N315
uucuuauaaaaua

SEQ ID NO: 2143976 - RNA, 14 nt, Staphylococcus aureus subsp. aureus N315
uucuuauaaaaauc

SEQ ID NO: 2143977 - RNA, 13 nt, Staphylococcus aureus subsp. aureus N315
uucuuauaaaaau

SEQ ID NO: 2143978 - RNA, 11 nt, Staphylococcus aureus subsp. aureus N315
uucuuauaaaa

SEQ ID NO: 2143979 - RNA, 18 nt, Staphylococcus aureus subsp. aureus N315
uucuuaguuugacaucua

SEQ ID NO: 2143980 - RNA, 13 nt, Staphylococcus aureus subsp. aureus N315
uucuuauucaaau

SEQ ID NO: 2143981 - RNA, 22 nt, Staphylococcus aureus subsp. aureus N315
uucuuaucuguaccguuuuuua

SEQ ID NO: 2143982 - RNA, 24 nt, Staphylococcus aureus subsp. aureus N315
uucuuaugcggucuaaaugcucua

SEQ ID NO: 2143983 - RNA, 17 nt, Staphylococcus aureus subsp. aureus N315
uucuuaucauuucaaau

SEQ ID NO: 2143984 - RNA, 13 nt, Staphylococcus aureus subsp. aureus N315
uugauauauauuu

SEQ ID NO: 2143985 - RNA, 14 nt, Staphylococcus aureus subsp. aureus N315
uugaucauaauuca

SEQ ID NO: 2143986 - RNA, 18 nt, Staphylococcus aureus subsp. aureus N315
uugaucauuugacauaau

SEQ ID NO: 2143987 - RNA, 19 nt, Staphylococcus aureus subsp. aureus N315
uugaucauuugacauaauc

SEQ ID NO: 2143988 - RNA, 12 nt, Staphylococcus aureus subsp. aureus N315
uugauuaaaauc

SEQ ID NO: 2143989 - RNA, 15 nt, Staphylococcus aureus subsp. aureus N315
uugauuaaaaguguu

SEQ ID NO: 2143990 - RNA, 14 nt, Staphylococcus aureus subsp. aureus N315
uugauguguugcau

SEQ ID NO: 2143991 - RNA, 16 nt, Staphylococcus aureus subsp. aureus N315
uugauggauauucaau

SEQ ID NO: 2143992 - RNA, 15 nt, Staphylococcus aureus subsp. aureus N315
uugaugucacauaug

SEQ ID NO: 2143993 - RNA, 18 nt, Staphylococcus aureus subsp. aureus N315
uugauuauucuuugauua

SEQ ID NO: 2143994 - RNA, 22 nt, Staphylococcus aureus subsp. aureus N315
uugcaaaacgcauuucaugugu

SEQ ID NO: 2143995 - RNA, 20 nt, Staphylococcus aureus subsp. aureus N315
uugcaaaacgcauuucaugu

SEQ ID NO: 2143996 - RNA, 20 nt, Staphylococcus aureus subsp. aureus N315
uugcaaauuaucauuaaauu

SEQ ID NO: 2143997 - RNA, 19 nt, Staphylococcus aureus subsp. aureus N315
uugcaaauuaucauuaaau

SEQ ID NO: 2143998 - RNA, 15 nt, Staphylococcus aureus subsp. aureus N315
uugcaaaguaacaau

SEQ ID NO: 2143999 - RNA, 15 nt, Staphylococcus aureus subsp. aureus N315
uugcaacauauuuuc

SEQ ID NO: 2144000 - RNA, 19 nt, Staphylococcus aureus subsp. aureus N315
uugcacaaagauauguuua

SEQ ID NO: 2144001 - RNA, 21 nt, Staphylococcus aureus subsp. aureus N315
uugcacaguuucaucuucaac

SEQ ID NO: 2144002 - RNA, 21 nt, Staphylococcus aureus subsp. aureus N315
uugauaaguagaaaauaugac

SEQ ID NO: 2144003 - RNA, 13 nt, Staphylococcus aureus subsp. aureus N315
uugauaagucuug

SEQ ID NO: 2144004 - RNA, 12 nt, Staphylococcus aureus subsp. aureus N315
uugauaauagcc

SEQ ID NO: 2144005 - RNA, 15 nt, Staphylococcus aureus subsp. aureus N315
uugauagauagaaau

SEQ ID NO: 2144006 - RNA, 22 nt, Staphylococcus aureus subsp. aureus N315
uugauacguaaacacuuuagua

SEQ ID NO: 2144007 - RNA, 17 nt, Staphylococcus aureus subsp. aureus N315
uugauaguaauaguuaa

SEQ ID NO: 2144008 - RNA, 22 nt, Staphylococcus aureus subsp. aureus N315
uugauaguaaucucucgcuaaa

SEQ ID NO: 2144009 - RNA, 11 nt, Staphylococcus aureus subsp. aureus N315
uugauagucac

SEQ ID NO: 2144010 - RNA, 21 nt, Staphylococcus aureus subsp. aureus N315
uugauauaguuauaugugcuu

SEQ ID NO: 2144011 - RNA, 23 nt, Staphylococcus aureus subsp. aureus N315
uugauauaaaaagugaaaguauu

SEQ ID NO: 2144012 - RNA, 12 nt, Staphylococcus aureus subsp. aureus N315
uugauauaaaaa

SEQ ID NO: 2144013 - RNA, 20 nt, Staphylococcus aureus subsp. aureus N315
uugacucaaagauauacuua

SEQ ID NO: 2144014 - RNA, 18 nt, Staphylococcus aureus subsp. aureus N315
uugagagauuauuuaaaa

SEQ ID NO: 2144015 - RNA, 16 nt, Staphylococcus aureus subsp. aureus N315
uugagacguuuuccau

SEQ ID NO: 2144016 - RNA, 18 nt, Staphylococcus aureus subsp. aureus N315
uugagacaauucguaaau

SEQ ID NO: 2144017 - RNA, 18 nt, Staphylococcus aureus subsp. aureus N315
uugagcaaugucuuuaau

SEQ ID NO: 2144018 - RNA, 13 nt, Staphylococcus aureus subsp. aureus N315
uugaaauuaaauu

SEQ ID NO: 2144019 - RNA, 17 nt, Staphylococcus aureus subsp. aureus N315
uugaaauaaucuaguau

SEQ ID NO: 2144020 - RNA, 13 nt, Staphylococcus aureus subsp. aureus N315
uugaaaaugacgu

SEQ ID NO: 2144021 - RNA, 16 nt, Staphylococcus aureus subsp. aureus N315
uugaaaagauaaacaa

SEQ ID NO: 2144022 - RNA, 12 nt, Staphylococcus aureus subsp. aureus N315
uugaaaaguuug

SEQ ID NO: 2144023 - RNA, 23 nt, Staphylococcus aureus subsp. aureus N315
uugaaaauaaucgaacagaaaau

SEQ ID NO: 2144024 - RNA, 23 nt, Staphylococcus aureus subsp. aureus N315
uucuuuuguaauugaaaugauag

SEQ ID NO: 2144025 - RNA, 13 nt, Staphylococcus aureus subsp. aureus N315
uucuuuuguaaua

SEQ ID NO: 2144026 - RNA, 18 nt, Staphylococcus aureus subsp. aureus N315
uucuuuuguaauaauugc

SEQ ID NO: 2144027 - RNA, 21 nt, Staphylococcus aureus subsp. aureus N315
uucuuuuguaauaauugcaug

SEQ ID NO: 2144028 - RNA, 17 nt, Staphylococcus aureus subsp. aureus N315
uucuuuucgaaaaucuc

SEQ ID NO: 2144029 - RNA, 17 nt, Staphylococcus aureus subsp. aureus N315
uucuuuuauaucgcuuu

SEQ ID NO: 2144030 - RNA, 17 nt, Staphylococcus aureus subsp. aureus N315
uucuuuucaaaauaaua

SEQ ID NO: 2144031 - RNA, 14 nt, Staphylococcus aureus subsp. aureus N315
uucuucuuuuuuau

SEQ ID NO: 2144032 - RNA, 23 nt, Staphylococcus aureus subsp. aureus N315
uucuucuuguuuagggaauccca

SEQ ID NO: 2144033 - RNA, 12 nt, Staphylococcus aureus subsp. aureus N315
uucuuuaacaau

SEQ ID NO: 2144034 - RNA, 15 nt, Staphylococcus aureus subsp. aureus N315
uucuuuacuaaagau

SEQ ID NO: 2144035 - RNA, 12 nt, Staphylococcus aureus subsp. aureus N315
uucuuucuaaaa

SEQ ID NO: 2144036 - RNA, 13 nt, Staphylococcus aureus subsp. aureus N315
uucuuucuaaaau

SEQ ID NO: 2144037 - RNA, 16 nt, Staphylococcus aureus subsp. aureus N315
uucuuucuaaaauaac

SEQ ID NO: 2144038 - RNA, 13 nt, Staphylococcus aureus subsp. aureus N315
uucuuucauaauu

SEQ ID NO: 2144039 - RNA, 14 nt, Staphylococcus aureus subsp. aureus N315
uucuuucauaauua

SEQ ID NO: 2144040 - RNA, 24 nt, Staphylococcus aureus subsp. aureus N315
uucuuucaggcuuuguuuuucacu

SEQ ID NO: 2144041 - RNA, 18 nt, Staphylococcus aureus subsp. aureus N315
uugacauguguuaaacca

SEQ ID NO: 2144042 - RNA, 15 nt, Staphylococcus aureus subsp. aureus N315
uugacauuugaccaa

SEQ ID NO: 2144043 - RNA, 17 nt, Staphylococcus aureus subsp. aureus N315
uugacauuugaccaagu

SEQ ID NO: 2144044 - RNA, 16 nt, Staphylococcus aureus subsp. aureus N315
uugaccacuuuuguua

SEQ ID NO: 2144045 - RNA, 19 nt, Staphylococcus aureus subsp. aureus N315
uugaccaccugauaaugca

SEQ ID NO: 2144046 - RNA, 17 nt, Staphylococcus aureus subsp. aureus N315
uugaccacaacuucuuu

SEQ ID NO: 2144047 - RNA, 15 nt, Staphylococcus aureus subsp. aureus N315
uugaauauaaaaaac

SEQ ID NO: 2144048 - RNA, 12 nt, Staphylococcus aureus subsp. aureus N315
uugaauauaaaa

SEQ ID NO: 2144049 - RNA, 15 nt, Staphylococcus aureus subsp. aureus N315
uugaauauaguccuu

SEQ ID NO: 2144050 - RNA, 17 nt, Staphylococcus aureus subsp. aureus N315
uugaaucaguauaauca

SEQ ID NO: 2144051 - RNA, 23 nt, Staphylococcus aureus subsp. aureus N315
uugaauauggaaaauguauuauu

SEQ ID NO: 2144052 - RNA, 16 nt, Staphylococcus aureus subsp. aureus N315
uugaauauuugcuuuu

SEQ ID NO: 2144053 - RNA, 23 nt, Staphylococcus aureus subsp. aureus N315
uugaauaucacuuuagauaaacu

SEQ ID NO: 2144054 - RNA, 20 nt, Staphylococcus aureus subsp. aureus N315
uugaaucauacgaauuugug

SEQ ID NO: 2144055 - RNA, 17 nt, Staphylococcus aureus subsp. aureus N315
uugaaucuuguugaacu

SEQ ID NO: 2144056 - RNA, 18 nt, Staphylococcus aureus subsp. aureus N315
uugacacauuauugaaau

SEQ ID NO: 2144057 - RNA, 12 nt, Staphylococcus aureus subsp. aureus N315
uugaaguuguuu

SEQ ID NO: 2144058 - RNA, 17 nt, Staphylococcus aureus subsp. aureus N315
uugaagugauuugccaa

SEQ ID NO: 2144059 - RNA, 21 nt, Staphylococcus aureus subsp. aureus N315
uugaaguuacuauauuuauua

SEQ ID NO: 2144060 - RNA, 15 nt, Staphylococcus aureus subsp. aureus N315
uugaauacuuuauuu

SEQ ID NO: 2144061 - RNA, 17 nt, Staphylococcus aureus subsp. aureus N315
uugaauaccuuuuauua

SEQ ID NO: 2144062 - RNA, 14 nt, Staphylococcus aureus subsp. aureus N315
uugaauacauguau

SEQ ID NO: 2144063 - RNA, 19 nt, Staphylococcus aureus subsp. aureus N315
uugaauaauauauuuagga

SEQ ID NO: 2144064 - RNA, 11 nt, Staphylococcus aureus subsp. aureus N315
uugaauaauca

SEQ ID NO: 2144065 - RNA, 17 nt, Staphylococcus aureus subsp. aureus N315
uugaagcuaauucauau

SEQ ID NO: 2144066 - RNA, 13 nt, Staphylococcus aureus subsp. aureus N315
uugaacagauuca

SEQ ID NO: 2144067 - RNA, 18 nt, Staphylococcus aureus subsp. aureus N315
uugaagaugcuuuaauua

SEQ ID NO: 2144068 - RNA, 15 nt, Staphylococcus aureus subsp. aureus N315
uugaacaauucuuca

SEQ ID NO: 2144069 - RNA, 19 nt, Staphylococcus aureus subsp. aureus N315
uugaacaauucuucaucau

SEQ ID NO: 2144070 - RNA, 17 nt, Staphylococcus aureus subsp. aureus N315
uugaacaacaucuuuug

SEQ ID NO: 2144071 - RNA, 13 nt, Staphylococcus aureus subsp. aureus N315
ugauguuaaaaaa

SEQ ID NO: 2144072 - RNA, 13 nt, Staphylococcus aureus subsp. aureus N315
ugauuaucauaug

SEQ ID NO: 2144073 - RNA, 16 nt, Staphylococcus aureus subsp. aureus N315
ugauuaucauuguuca

SEQ ID NO: 2144074 - RNA, 17 nt, Staphylococcus aureus subsp. aureus N315
ugauuauauuuuucuuc

SEQ ID NO: 2144075 - RNA, 20 nt, Staphylococcus aureus subsp. aureus N315
ugauuaaaaaucaaagaggc

SEQ ID NO: 2144076 - RNA, 22 nt, Staphylococcus aureus subsp. aureus N315
ugauucaccagguuuuuuauuu

SEQ ID NO: 2144077 - RNA, 19 nt, Staphylococcus aureus subsp. aureus N315
ugauuuaagggucacaccc

SEQ ID NO: 2144078 - RNA, 21 nt, Staphylococcus aureus subsp. aureus N315
ugauuuaauaaugcuauauuu

SEQ ID NO: 2144079 - RNA, 19 nt, Staphylococcus aureus subsp. aureus N315
ugauuuaaaauauaaauuu

SEQ ID NO: 2144080 - RNA, 16 nt, Staphylococcus aureus subsp. aureus N315
ugauucguauucaaag

SEQ ID NO: 2144081 - RNA, 16 nt, Staphylococcus aureus subsp. aureus N315
ugauucuacagcacug

SEQ ID NO: 2144082 - RNA, 21 nt, Staphylococcus aureus subsp. aureus N315
ugauucucuguagauaucaaa

SEQ ID NO: 2144083 - RNA, 14 nt, Staphylococcus aureus subsp. aureus N315
ugauucuagugaaa

SEQ ID NO: 2144084 - RNA, 14 nt, Staphylococcus aureus subsp. aureus N315
ugauugucauauaa

SEQ ID NO: 2144085 - RNA, 15 nt, Staphylococcus aureus subsp. aureus N315
ugauuguuaauacaa

SEQ ID NO: 2144086 - RNA, 13 nt, Staphylococcus aureus subsp. aureus N315
ugauuuuuuauuc

SEQ ID NO: 2144087 - RNA, 12 nt, Staphylococcus aureus subsp. aureus N315
ugauuuuucaua

SEQ ID NO: 2144088 - RNA, 15 nt, Staphylococcus aureus subsp. aureus N315
ugcaaaaaaacaaau

SEQ ID NO: 2144089 - RNA, 16 nt, Staphylococcus aureus subsp. aureus N315
ugcaaaaaaacaaaua

SEQ ID NO: 2144090 - RNA, 19 nt, Staphylococcus aureus subsp. aureus N315
ugcaaaaaaacaaauauua

SEQ ID NO: 2144091 - RNA, 20 nt, Staphylococcus aureus subsp. aureus N315
ugauuuggaaagaugggauu

SEQ ID NO: 2144092 - RNA, 15 nt, Staphylococcus aureus subsp. aureus N315
ugauuuguuacuucu

SEQ ID NO: 2144093 - RNA, 19 nt, Staphylococcus aureus subsp. aureus N315
ugauuuguuacuucuaaua

SEQ ID NO: 2144094 - RNA, 18 nt, Staphylococcus aureus subsp. aureus N315
ugauuuuacuugaauaua

SEQ ID NO: 2144095 - RNA, 23 nt, Staphylococcus aureus subsp. aureus N315
ugauuuuaaucuauccuucaaaa

SEQ ID NO: 2144096 - RNA, 20 nt, Staphylococcus aureus subsp. aureus N315
ugauuuuaccuguuucuaua

SEQ ID NO: 2144097 - RNA, 17 nt, Staphylococcus aureus subsp. aureus N315
ugauuuuauaauauuau

SEQ ID NO: 2144098 - RNA, 15 nt, Staphylococcus aureus subsp. aureus N315
ugauuuuauaauauu

SEQ ID NO: 2144099 - RNA, 15 nt, Staphylococcus aureus subsp. aureus N315
ugauuuuauaaaguu

SEQ ID NO: 2144100 - RNA, 21 nt, Staphylococcus aureus subsp. aureus N315
ugauuuuaucaaauucaucag

SEQ ID NO: 2144101 - RNA, 22 nt, Staphylococcus aureus subsp. aureus N315
ugauuuuuauuauugucaucau

SEQ ID NO: 2144102 - RNA, 20 nt, Staphylococcus aureus subsp. aureus N315
ugaugaauuguuguacaugu

SEQ ID NO: 2144103 - RNA, 12 nt, Staphylococcus aureus subsp. aureus N315
ugaugacaucaa

SEQ ID NO: 2144104 - RNA, 20 nt, Staphylococcus aureus subsp. aureus N315
ugaugaaguaguuucauugc

SEQ ID NO: 2144105 - RNA, 19 nt, Staphylococcus aureus subsp. aureus N315
ugaugcgcuucuaacucac

SEQ ID NO: 2144106 - RNA, 15 nt, Staphylococcus aureus subsp. aureus N315
ugaugcuugaauguu

SEQ ID NO: 2144107 - RNA, 19 nt, Staphylococcus aureus subsp. aureus N315
ugaugcuucgaauuuaaca

SEQ ID NO: 2144108 - RNA, 15 nt, Staphylococcus aureus subsp. aureus N315
ugaugagauaaaauc

SEQ ID NO: 2144109 - RNA, 20 nt, Staphylococcus aureus subsp. aureus N315
ugauccuggaaucgaaaaua

SEQ ID NO: 2144110 - RNA, 16 nt, Staphylococcus aureus subsp. aureus N315
ugaucagcauuuaagc

SEQ ID NO: 2144111 - RNA, 15 nt, Staphylococcus aureus subsp. aureus N315
ugauauauuacacca

SEQ ID NO: 2144112 - RNA, 18 nt, Staphylococcus aureus subsp. aureus N315
ugauauacuugaagaaaa

SEQ ID NO: 2144113 - RNA, 18 nt, Staphylococcus aureus subsp. aureus N315
ugauauuuaacaaaauua

SEQ ID NO: 2144114 - RNA, 19 nt, Staphylococcus aureus subsp. aureus N315
ugauauugaucugauuuca

SEQ ID NO: 2144115 - RNA, 14 nt, Staphylococcus aureus subsp. aureus N315
ugauauaauagaaa

SEQ ID NO: 2144116 - RNA, 17 nt, Staphylococcus aureus subsp. aureus N315
ugaguguuuaugaaagu

SEQ ID NO: 2144117 - RNA, 21 nt, Staphylococcus aureus subsp. aureus N315
ugagugucaugcuuaauuuau

SEQ ID NO: 2144118 - RNA, 17 nt, Staphylococcus aureus subsp. aureus N315
ugauauauaaccauagu

SEQ ID NO: 2144119 - RNA, 19 nt, Staphylococcus aureus subsp. aureus N315
ugauauaccuugauucauu

SEQ ID NO: 2144120 - RNA, 19 nt, Staphylococcus aureus subsp. aureus N315
ugauauacgacaaucacag

SEQ ID NO: 2144121 - RNA, 19 nt, Staphylococcus aureus subsp. aureus N315
ugagugauuuuaaucuauc

SEQ ID NO: 2144122 - RNA, 16 nt, Staphylococcus aureus subsp. aureus N315
ugcacaucauaauaaa

SEQ ID NO: 2144123 - RNA, 17 nt, Staphylococcus aureus subsp. aureus N315
ugcacaguuucaucuuc

SEQ ID NO: 2144124 - RNA, 20 nt, Staphylococcus aureus subsp. aureus N315
ugcaccuggucguacuuuca

SEQ ID NO: 2144125 - RNA, 21 nt, Staphylococcus aureus subsp. aureus N315
ugcaccuggucguacuuucaa

SEQ ID NO: 2144126 - RNA, 14 nt, Staphylococcus aureus subsp. aureus N315
ugcacauuccaucu

SEQ ID NO: 2144127 - RNA, 15 nt, Staphylococcus aureus subsp. aureus N315
ugcagaacguucuaa

SEQ ID NO: 2144128 - RNA, 19 nt, Staphylococcus aureus subsp. aureus N315
ugcacuuuuuuuaaaucuu

SEQ ID NO: 2144129 - RNA, 17 nt, Staphylococcus aureus subsp. aureus N315
ugcacuuuaacauaacu

SEQ ID NO: 2144130 - RNA, 15 nt, Staphylococcus aureus subsp. aureus N315
ugcacuuuaacauaa

SEQ ID NO: 2144131 - RNA, 17 nt, Staphylococcus aureus subsp. aureus N315
ugcacuugguucauaau

SEQ ID NO: 2144132 - RNA, 23 nt, Staphylococcus aureus subsp. aureus N315
ugcacuugguucauaaugaucaa

SEQ ID NO: 2144133 - RNA, 15 nt, Staphylococcus aureus subsp. aureus N315
ugcacaaauugcaau

SEQ ID NO: 2144134 - RNA, 18 nt, Staphylococcus aureus subsp. aureus N315
ugcaauuuguaauacaag

SEQ ID NO: 2144135 - RNA, 22 nt, Staphylococcus aureus subsp. aureus N315
ugcacaccagccucuauaagua

SEQ ID NO: 2144136 - RNA, 17 nt, Staphylococcus aureus subsp. aureus N315
ugcaaugaauaacaaga

SEQ ID NO: 2144137 - RNA, 15 nt, Staphylococcus aureus subsp. aureus N315
ugcaaucguauguaa

SEQ ID NO: 2144138 - RNA, 14 nt, Staphylococcus aureus subsp. aureus N315
ugcaauuuguaaua

SEQ ID NO: 2144139 - RNA, 11 nt, Staphylococcus aureus subsp. aureus N315
ugcaauuugua

SEQ ID NO: 2144140 - RNA, 15 nt, Staphylococcus aureus subsp. aureus N315
ugcaaugagcaucuu

SEQ ID NO: 2144141 - RNA, 19 nt, Staphylococcus aureus subsp. aureus N315
ugcaaacucauuuauaaac

SEQ ID NO: 2144142 - RNA, 20 nt, Staphylococcus aureus subsp. aureus N315
ugcaaagggcgaaauggauu

SEQ ID NO: 2144143 - RNA, 16 nt, Staphylococcus aureus subsp. aureus N315
ugcaagccaucaauau

SEQ ID NO: 2144144 - RNA, 12 nt, Staphylococcus aureus subsp. aureus N315
ugcaaguauuuu

SEQ ID NO: 2144145 - RNA, 20 nt, Staphylococcus aureus subsp. aureus N315
ugcaaguccaaauaauaucu

SEQ ID NO: 2144146 - RNA, 17 nt, Staphylococcus aureus subsp. aureus N315
ugcaagucguucucuua

SEQ ID NO: 2144147 - RNA, 22 nt, Staphylococcus aureus subsp. aureus N315
ugcaagucguucucuuaaauau

SEQ ID NO: 2144148 - RNA, 18 nt, Staphylococcus aureus subsp. aureus N315
ugcaauaauuacuaaccu

SEQ ID NO: 2144149 - RNA, 22 nt, Staphylococcus aureus subsp. aureus N315
ugcaauaauaaauaggaugaaa

SEQ ID NO: 2144150 - RNA, 21 nt, Staphylococcus aureus subsp. aureus N315
ugcaauaacaccaauugaaua

SEQ ID NO: 2144151 - RNA, 23 nt, Staphylococcus aureus subsp. aureus N315
ugcaauaacaccaauugaauauu

SEQ ID NO: 2144152 - RNA, 20 nt, Staphylococcus aureus subsp. aureus N315
ugcagauucuucaccaacuu

SEQ ID NO: 2144153 - RNA, 23 nt, Staphylococcus aureus subsp. aureus N315
ugcagaagaaaacuauuuuaaaa

SEQ ID NO: 2144154 - RNA, 16 nt, Staphylococcus aureus subsp. aureus N315
ugcagcuguauaacca

SEQ ID NO: 2144155 - RNA, 19 nt, Staphylococcus aureus subsp. aureus N315
ugcaggauaacguucacuu

SEQ ID NO: 2144156 - RNA, 19 nt, Staphylococcus aureus subsp. aureus N315
ugcaggcaucauaucauac

SEQ ID NO: 2144157 - RNA, 20 nt, Staphylococcus aureus subsp. aureus N315
ugagcuguuacacuuuucuu

SEQ ID NO: 2144158 - RNA, 16 nt, Staphylococcus aureus subsp. aureus N315
ugagcuuaauaaauug

SEQ ID NO: 2144159 - RNA, 17 nt, Staphylococcus aureus subsp. aureus N315
ugagcuucuuuaaauac

SEQ ID NO: 2144160 - RNA, 16 nt, Staphylococcus aureus subsp. aureus N315
ugagcuucuuuaaaua

SEQ ID NO: 2144161 - RNA, 17 nt, Staphylococcus aureus subsp. aureus N315
ugagcuuaauaaauugu

SEQ ID NO: 2144162 - RNA, 19 nt, Staphylococcus aureus subsp. aureus N315
ugagcuuuguuugaaacaa

SEQ ID NO: 2144163 - RNA, 17 nt, Staphylococcus aureus subsp. aureus N315
ugagcuuuguuagcauc

SEQ ID NO: 2144164 - RNA, 18 nt, Staphylococcus aureus subsp. aureus N315
ugaggauacauaaaucua

SEQ ID NO: 2144165 - RNA, 14 nt, Staphylococcus aureus subsp. aureus N315
ugagcuauucauag

SEQ ID NO: 2144166 - RNA, 15 nt, Staphylococcus aureus subsp. aureus N315
ugagcguauuauuau

SEQ ID NO: 2144167 - RNA, 16 nt, Staphylococcus aureus subsp. aureus N315
ugaguaggcucuuaau

SEQ ID NO: 2144168 - RNA, 21 nt, Staphylococcus aureus subsp. aureus N315
ugaguacuaaucaauacuaaa

SEQ ID NO: 2144169 - RNA, 19 nt, Staphylococcus aureus subsp. aureus N315
ugaguaucaugcuuuuaau

SEQ ID NO: 2144170 - RNA, 18 nt, Staphylococcus aureus subsp. aureus N315
ugaguauauucaaaagga

SEQ ID NO: 2144171 - RNA, 20 nt, Staphylococcus aureus subsp. aureus N315
ugaguauacuuacugaaacu

SEQ ID NO: 2144172 - RNA, 15 nt, Staphylococcus aureus subsp. aureus N315
ugaguauauucaaaa

SEQ ID NO: 2144173 - RNA, 22 nt, Staphylococcus aureus subsp. aureus N315
ugaguauuugccuuuuuuauuu

SEQ ID NO: 2144174 - RNA, 20 nt, Staphylococcus aureus subsp. aureus N315
ugaguaaauuaauagagaaa

SEQ ID NO: 2144175 - RNA, 18 nt, Staphylococcus aureus subsp. aureus N315
ugaggcccauaaauuacu

SEQ ID NO: 2144176 - RNA, 17 nt, Staphylococcus aureus subsp. aureus N315
ugaggcugggacauaaa

SEQ ID NO: 2144177 - RNA, 19 nt, Staphylococcus aureus subsp. aureus N315
ugagaauauuuauuguuuu

SEQ ID NO: 2144178 - RNA, 19 nt, Staphylococcus aureus subsp. aureus N315
ugagauauauuaauguuug

SEQ ID NO: 2144179 - RNA, 17 nt, Staphylococcus aureus subsp. aureus N315
ugagauaucuuauaaca

SEQ ID NO: 2144180 - RNA, 15 nt, Staphylococcus aureus subsp. aureus N315
ugagaaucuuggaag

SEQ ID NO: 2144181 - RNA, 22 nt, Staphylococcus aureus subsp. aureus N315
ugagauuauuuuuuuaaaucua

SEQ ID NO: 2144182 - RNA, 16 nt, Staphylococcus aureus subsp. aureus N315
ugagauuauuuuuuua

SEQ ID NO: 2144183 - RNA, 16 nt, Staphylococcus aureus subsp. aureus N315
ugagauuaucuuuaga

SEQ ID NO: 2144184 - RNA, 19 nt, Staphylococcus aureus subsp. aureus N315
ugagauuaucuuuagacau

SEQ ID NO: 2144185 - RNA, 23 nt, Staphylococcus aureus subsp. aureus N315
ugagauuauuuuuuuaaaucuau

SEQ ID NO: 2144186 - RNA, 13 nt, Staphylococcus aureus subsp. aureus N315
ugagauggucuuu

SEQ ID NO: 2144187 - RNA, 15 nt, Staphylococcus aureus subsp. aureus N315
ugagcacuuaauaag

SEQ ID NO: 2144188 - RNA, 16 nt, Staphylococcus aureus subsp. aureus N315
ugacuuuaauugcucu

SEQ ID NO: 2144189 - RNA, 19 nt, Staphylococcus aureus subsp. aureus N315
ugacuuuauuucuauaucu

SEQ ID NO: 2144190 - RNA, 15 nt, Staphylococcus aureus subsp. aureus N315
ugacuuuccuaauuc

SEQ ID NO: 2144191 - RNA, 16 nt, Staphylococcus aureus subsp. aureus N315
ugacuuuuaaaaaaca

SEQ ID NO: 2144192 - RNA, 21 nt, Staphylococcus aureus subsp. aureus N315
ugacuuuuaaaaaacauaccu

SEQ ID NO: 2144193 - RNA, 13 nt, Staphylococcus aureus subsp. aureus N315
ugacuuuuuaaua

SEQ ID NO: 2144194 - RNA, 15 nt, Staphylococcus aureus subsp. aureus N315
ugagaagaaauauau

SEQ ID NO: 2144195 - RNA, 14 nt, Staphylococcus aureus subsp. aureus N315
ugacuuuuauaauu

SEQ ID NO: 2144196 - RNA, 16 nt, Staphylococcus aureus subsp. aureus N315
ugacuuuuauaauucu

SEQ ID NO: 2144197 - RNA, 20 nt, Staphylococcus aureus subsp. aureus N315
ugagaaaaauauuucuaaua

SEQ ID NO: 2144198 - RNA, 18 nt, Staphylococcus aureus subsp. aureus N315
ugacucaaagauauacuu

SEQ ID NO: 2144199 - RNA, 20 nt, Staphylococcus aureus subsp. aureus N315
ugacucagaaucuuacauug

SEQ ID NO: 2144200 - RNA, 17 nt, Staphylococcus aureus subsp. aureus N315
ugaccauuaucaagaac

SEQ ID NO: 2144201 - RNA, 22 nt, Staphylococcus aureus subsp. aureus N315
ugaccauuaucaagaacuuuaa

SEQ ID NO: 2144202 - RNA, 17 nt, Staphylococcus aureus subsp. aureus N315
ugaccauugucaugccu

SEQ ID NO: 2144203 - RNA, 14 nt, Staphylococcus aureus subsp. aureus N315
ugaccuacuuuuuc

SEQ ID NO: 2144204 - RNA, 17 nt, Staphylococcus aureus subsp. aureus N315
ugaccuacuuuuucaau

SEQ ID NO: 2144205 - RNA, 17 nt, Staphylococcus aureus subsp. aureus N315
ugacgauaaugaaauac

SEQ ID NO: 2144206 - RNA, 17 nt, Staphylococcus aureus subsp. aureus N315
ugacgaucuucaugaac

SEQ ID NO: 2144207 - RNA, 16 nt, Staphylococcus aureus subsp. aureus N315
ugacgcugguaauauu

SEQ ID NO: 2144208 - RNA, 19 nt, Staphylococcus aureus subsp. aureus N315
ugacaccuaauaccauugu

SEQ ID NO: 2144209 - RNA, 22 nt, Staphylococcus aureus subsp. aureus N315
ugacaccuauauuuuuagcuuu

SEQ ID NO: 2144210 - RNA, 19 nt, Staphylococcus aureus subsp. aureus N315
ugacauaucgauauucucc

SEQ ID NO: 2144211 - RNA, 18 nt, Staphylococcus aureus subsp. aureus N315
ugaccaagauuccaucac

SEQ ID NO: 2144212 - RNA, 23 nt, Staphylococcus aureus subsp. aureus N315
ugacauaauccagccacaccaaa

SEQ ID NO: 2144213 - RNA, 13 nt, Staphylococcus aureus subsp. aureus N315
ugacaguuuccau

SEQ ID NO: 2144214 - RNA, 19 nt, Staphylococcus aureus subsp. aureus N315
ugacauaaaaaauaacucc

SEQ ID NO: 2144215 - RNA, 23 nt, Staphylococcus aureus subsp. aureus N315
ugacaguuuccauaaauaaaaug

SEQ ID NO: 2144216 - RNA, 20 nt, Staphylococcus aureus subsp. aureus N315
ugacaguuuuaaaugaaacu

SEQ ID NO: 2144217 - RNA, 15 nt, Staphylococcus aureus subsp. aureus N315
ugaccaccacuuuca

SEQ ID NO: 2144218 - RNA, 14 nt, Staphylococcus aureus subsp. aureus N315
ugacaacauaacaa

SEQ ID NO: 2144219 - RNA, 18 nt, Staphylococcus aureus subsp. aureus N315
ugaauugguugaucaauu

SEQ ID NO: 2144220 - RNA, 17 nt, Staphylococcus aureus subsp. aureus N315
ugaauuggauuaucgaa

SEQ ID NO: 2144221 - RNA, 13 nt, Staphylococcus aureus subsp. aureus N315
ugaauuguuaguu

SEQ ID NO: 2144222 - RNA, 20 nt, Staphylococcus aureus subsp. aureus N315
ugaauugaguauuaaauuug

SEQ ID NO: 2144223 - RNA, 21 nt, Staphylococcus aureus subsp. aureus N315
ugaauugaguauuaaauuuga

SEQ ID NO: 2144224 - RNA, 15 nt, Staphylococcus aureus subsp. aureus N315
ugaauugauuauaau

SEQ ID NO: 2144225 - RNA, 14 nt, Staphylococcus aureus subsp. aureus N315
ugaauuuagaugca

SEQ ID NO: 2144226 - RNA, 21 nt, Staphylococcus aureus subsp. aureus N315
ugaauuuagaugcauaaaaaa

SEQ ID NO: 2144227 - RNA, 16 nt, Staphylococcus aureus subsp. aureus N315
ugaaugauugcauuga

SEQ ID NO: 2144228 - RNA, 14 nt, Staphylococcus aureus subsp. aureus N315
ugaaugauauuaac

SEQ ID NO: 2144229 - RNA, 15 nt, Staphylococcus aureus subsp. aureus N315
ugaauuaucuauaua

SEQ ID NO: 2144230 - RNA, 18 nt, Staphylococcus aureus subsp. aureus N315
ugaauuauuuaaaaugcu

SEQ ID NO: 2144231 - RNA, 14 nt, Staphylococcus aureus subsp. aureus N315
ugaauucauuuuau

SEQ ID NO: 2144232 - RNA, 18 nt, Staphylococcus aureus subsp. aureus N315
ugaauugaaaaauuaaaa

SEQ ID NO: 2144233 - RNA, 13 nt, Staphylococcus aureus subsp. aureus N315
ucuuuauaacgcu

SEQ ID NO: 2144234 - RNA, 14 nt, Staphylococcus aureus subsp. aureus N315
ucuuucaauuaauc

SEQ ID NO: 2144235 - RNA, 21 nt, Staphylococcus aureus subsp. aureus N315
ucuuuauuuuuuaucauuuuu

SEQ ID NO: 2144236 - RNA, 23 nt, Staphylococcus aureus subsp. aureus N315
ucuuucaauuaauuuaaaugcuu

SEQ ID NO: 2144237 - RNA, 14 nt, Staphylococcus aureus subsp. aureus N315
ugaauaauggaugu

SEQ ID NO: 2144238 - RNA, 15 nt, Staphylococcus aureus subsp. aureus N315
ugaauaauuccagua

SEQ ID NO: 2144239 - RNA, 18 nt, Staphylococcus aureus subsp. aureus N315
ugaauaauguuuucauug

SEQ ID NO: 2144240 - RNA, 17 nt, Staphylococcus aureus subsp. aureus N315
ugaauaauugcuaaaau

SEQ ID NO: 2144241 - RNA, 21 nt, Staphylococcus aureus subsp. aureus N315
ugaauaauuucaguucuuaga

SEQ ID NO: 2144242 - RNA, 19 nt, Staphylococcus aureus subsp. aureus N315
ugaauaauuucaguucuua

SEQ ID NO: 2144243 - RNA, 14 nt, Staphylococcus aureus subsp. aureus N315
ugaauaucuaaugc

SEQ ID NO: 2144244 - RNA, 21 nt, Staphylococcus aureus subsp. aureus N315
ugaauauggaaaauguauuau

SEQ ID NO: 2144245 - RNA, 16 nt, Staphylococcus aureus subsp. aureus N315
ugaauaugauauuaag

SEQ ID NO: 2144246 - RNA, 18 nt, Staphylococcus aureus subsp. aureus N315
ugaaucgcauuuaaauau

SEQ ID NO: 2144247 - RNA, 14 nt, Staphylococcus aureus subsp. aureus N315
ugaaugaaguaaua

SEQ ID NO: 2144248 - RNA, 20 nt, Staphylococcus aureus subsp. aureus N315
ugaaucuuauuuuguuuuaa

SEQ ID NO: 2144249 - RNA, 23 nt, Staphylococcus aureus subsp. aureus N315
ugaaucuuguugaacucugauau

SEQ ID NO: 2144250 - RNA, 15 nt, Staphylococcus aureus subsp. aureus N315
ugaaucuuuguuaua

SEQ ID NO: 2144251 - RNA, 13 nt, Staphylococcus aureus subsp. aureus N315
ugaaugaaaauaa

SEQ ID NO: 2144252 - RNA, 14 nt, Staphylococcus aureus subsp. aureus N315
ugaaugaaaauaag

SEQ ID NO: 2144253 - RNA, 18 nt, Staphylococcus aureus subsp. aureus N315
ugaaucuaaacuauaaua

SEQ ID NO: 2144254 - RNA, 21 nt, Staphylococcus aureus subsp. aureus N315
ugaaucuaaacuauaauaauu

SEQ ID NO: 2144255 - RNA, 16 nt, Staphylococcus aureus subsp. aureus N315
ugccuagcauuacgcc

SEQ ID NO: 2144256 - RNA, 17 nt, Staphylococcus aureus subsp. aureus N315
ugccuuaacuucauaau

SEQ ID NO: 2144257 - RNA, 15 nt, Staphylococcus aureus subsp. aureus N315
ugccuuaucagcauu

SEQ ID NO: 2144258 - RNA, 13 nt, Staphylococcus aureus subsp. aureus N315
ugccuuucucuaa

SEQ ID NO: 2144259 - RNA, 15 nt, Staphylococcus aureus subsp. aureus N315
ugccuuucucuaaau

SEQ ID NO: 2144260 - RNA, 17 nt, Staphylococcus aureus subsp. aureus N315
ugccuugucuauuguaa

SEQ ID NO: 2144261 - RNA, 18 nt, Staphylococcus aureus subsp. aureus N315
ugccggcuuuuucuuuug

SEQ ID NO: 2144262 - RNA, 16 nt, Staphylococcus aureus subsp. aureus N315
ugccguccauuuccau

SEQ ID NO: 2144263 - RNA, 21 nt, Staphylococcus aureus subsp. aureus N315
ugccguauuucaaauguaauu

SEQ ID NO: 2144264 - RNA, 13 nt, Staphylococcus aureus subsp. aureus N315
ugccuuuuuguaa

SEQ ID NO: 2144265 - RNA, 18 nt, Staphylococcus aureus subsp. aureus N315
ugccuuuuuguaauugua

SEQ ID NO: 2144266 - RNA, 16 nt, Staphylococcus aureus subsp. aureus N315
ugccuuuugaauaauu

SEQ ID NO: 2144267 - RNA, 22 nt, Staphylococcus aureus subsp. aureus N315
ugcgaaaccuuucgauaaacua

SEQ ID NO: 2144268 - RNA, 20 nt, Staphylococcus aureus subsp. aureus N315
ugcgaaacaacaaguaaaac

SEQ ID NO: 2144269 - RNA, 16 nt, Staphylococcus aureus subsp. aureus N315
ugcgaaagaaagaaac

SEQ ID NO: 2144270 - RNA, 16 nt, Staphylococcus aureus subsp. aureus N315
ugcgaagauuuuuaac

SEQ ID NO: 2144271 - RNA, 15 nt, Staphylococcus aureus subsp. aureus N315
ugcgaauuguuagau

SEQ ID NO: 2144272 - RNA, 18 nt, Staphylococcus aureus subsp. aureus N315
ugcgauaagcaaaaauuc

SEQ ID NO: 2144273 - RNA, 16 nt, Staphylococcus aureus subsp. aureus N315
ugcgcaaaagcgcagg

SEQ ID NO: 2144274 - RNA, 12 nt, Staphylococcus aureus subsp. aureus N315
ugcccuuaaagc

SEQ ID NO: 2144275 - RNA, 17 nt, Staphylococcus aureus subsp. aureus N315
ugccaauauaacauuua

SEQ ID NO: 2144276 - RNA, 16 nt, Staphylococcus aureus subsp. aureus N315
ugcgcuuauuuuacua

SEQ ID NO: 2144277 - RNA, 12 nt, Staphylococcus aureus subsp. aureus N315
ugcgcuuccaau

SEQ ID NO: 2144278 - RNA, 20 nt, Staphylococcus aureus subsp. aureus N315
ugcguuuguguguuuuaaaa

SEQ ID NO: 2144279 - RNA, 23 nt, Staphylococcus aureus subsp. aureus N315
ugcguggucuauuuuauaaaaua

SEQ ID NO: 2144280 - RNA, 13 nt, Staphylococcus aureus subsp. aureus N315
ugcguuaauaauu

SEQ ID NO: 2144281 - RNA, 21 nt, Staphylococcus aureus subsp. aureus N315
ugcucaaaaaugcuuauauaa

SEQ ID NO: 2144282 - RNA, 17 nt, Staphylococcus aureus subsp. aureus N315
ugcuauuuuggauaaua

SEQ ID NO: 2144283 - RNA, 14 nt, Staphylococcus aureus subsp. aureus N315
ugcuauguauuuuu

SEQ ID NO: 2144284 - RNA, 19 nt, Staphylococcus aureus subsp. aureus N315
ugcuauuucaacaaacaua

SEQ ID NO: 2144285 - RNA, 16 nt, Staphylococcus aureus subsp. aureus N315
ugcuagucauaauuua

SEQ ID NO: 2144286 - RNA, 22 nt, Staphylococcus aureus subsp. aureus N315
ugcuauauuucgguauuuuaaa

SEQ ID NO: 2144287 - RNA, 23 nt, Staphylococcus aureus subsp. aureus N315
ugcuauauuucgguauuuuaaau

SEQ ID NO: 2144288 - RNA, 14 nt, Staphylococcus aureus subsp. aureus N315
ugcuacaauuuccu

SEQ ID NO: 2144289 - RNA, 15 nt, Staphylococcus aureus subsp. aureus N315
ugcuaauuuuuucau

SEQ ID NO: 2144290 - RNA, 17 nt, Staphylococcus aureus subsp. aureus N315
ugcuaauucaagaacag

SEQ ID NO: 2144291 - RNA, 20 nt, Staphylococcus aureus subsp. aureus N315
ugcuaacucugaucuaaaac

SEQ ID NO: 2144292 - RNA, 21 nt, Staphylococcus aureus subsp. aureus N315
ugcuaaaguguagccaaauaa

SEQ ID NO: 2144293 - RNA, 16 nt, Staphylococcus aureus subsp. aureus N315
ugcuaaaaaguuagca

SEQ ID NO: 2144294 - RNA, 20 nt, Staphylococcus aureus subsp. aureus N315
ugcuaaaaaguuagcaaacg

SEQ ID NO: 2144295 - RNA, 14 nt, Staphylococcus aureus subsp. aureus N315
ugcuaaaaauauug

SEQ ID NO: 2144296 - RNA, 13 nt, Staphylococcus aureus subsp. aureus N315
ugcuaaaaauauu

SEQ ID NO: 2144297 - RNA, 13 nt, Staphylococcus aureus subsp. aureus N315
ugcguuuuuaaau

SEQ ID NO: 2144298 - RNA, 20 nt, Staphylococcus aureus subsp. aureus N315
ugcugaaucgaguuugaaau

SEQ ID NO: 2144299 - RNA, 17 nt, Staphylococcus aureus subsp. aureus N315
ugcucuaagcauucagu

SEQ ID NO: 2144300 - RNA, 20 nt, Staphylococcus aureus subsp. aureus N315
uggaccucuugaaaaaguuu

SEQ ID NO: 2144301 - RNA, 15 nt, Staphylococcus aureus subsp. aureus N315
uggacagcuacaauu

SEQ ID NO: 2144302 - RNA, 23 nt, Staphylococcus aureus subsp. aureus N315
uggacagcuacaauuuucucauu

SEQ ID NO: 2144303 - RNA, 22 nt, Staphylococcus aureus subsp. aureus N315
uggaaugauacgccuaaauauu

SEQ ID NO: 2144304 - RNA, 21 nt, Staphylococcus aureus subsp. aureus N315
uggaauuggcauccaggcaac

SEQ ID NO: 2144305 - RNA, 16 nt, Staphylococcus aureus subsp. aureus N315
uggaauacucuucaau

SEQ ID NO: 2144306 - RNA, 16 nt, Staphylococcus aureus subsp. aureus N315
uggaaguuguugcuuu

SEQ ID NO: 2144307 - RNA, 17 nt, Staphylococcus aureus subsp. aureus N315
uggaaguguuuuaaguu

SEQ ID NO: 2144308 - RNA, 16 nt, Staphylococcus aureus subsp. aureus N315
uggaaauuuauuauaa

SEQ ID NO: 2144309 - RNA, 18 nt, Staphylococcus aureus subsp. aureus N315
ugcuuuuuauuaugcuuc

SEQ ID NO: 2144310 - RNA, 20 nt, Staphylococcus aureus subsp. aureus N315
ugcuuuuuguguaucuguaa

SEQ ID NO: 2144311 - RNA, 13 nt, Staphylococcus aureus subsp. aureus N315
ugcuuuuuuaaau

SEQ ID NO: 2144312 - RNA, 21 nt, Staphylococcus aureus subsp. aureus N315
ugcuuuuuuaaauuuaauuuc

SEQ ID NO: 2144313 - RNA, 18 nt, Staphylococcus aureus subsp. aureus N315
ugcuuuuuuauucuaaua

SEQ ID NO: 2144314 - RNA, 14 nt, Staphylococcus aureus subsp. aureus N315
uggaaauuuauuau

SEQ ID NO: 2144315 - RNA, 13 nt, Staphylococcus aureus subsp. aureus N315
uggaaauuuauua

SEQ ID NO: 2144316 - RNA, 19 nt, Staphylococcus aureus subsp. aureus N315
uggaaaguugguuuuauua

SEQ ID NO: 2144317 - RNA, 13 nt, Staphylococcus aureus subsp. aureus N315
uggaaagucagcu

SEQ ID NO: 2144318 - RNA, 19 nt, Staphylococcus aureus subsp. aureus N315
ugcuuugcauacauaucuu

SEQ ID NO: 2144319 - RNA, 12 nt, Staphylococcus aureus subsp. aureus N315
ugcuuguuacac

SEQ ID NO: 2144320 - RNA, 14 nt, Staphylococcus aureus subsp. aureus N315
ugcuguuuuuauua

SEQ ID NO: 2144321 - RNA, 15 nt, Staphylococcus aureus subsp. aureus N315
ugcuguuuuauucaa

SEQ ID NO: 2144322 - RNA, 13 nt, Staphylococcus aureus subsp. aureus N315
ugcuguuuuuauu

SEQ ID NO: 2144323 - RNA, 19 nt, Staphylococcus aureus subsp. aureus N315
ugcuuaauuuguuuuaaau

SEQ ID NO: 2144324 - RNA, 20 nt, Staphylococcus aureus subsp. aureus N315
ugcuucauuauauaauucuu

SEQ ID NO: 2144325 - RNA, 17 nt, Staphylococcus aureus subsp. aureus N315
ugcuucauuauauaauu

SEQ ID NO: 2144326 - RNA, 18 nt, Staphylococcus aureus subsp. aureus N315
ugcuuccacuucaucuaa

SEQ ID NO: 2144327 - RNA, 18 nt, Staphylococcus aureus subsp. aureus N315
ugcuucugguucuucaau

SEQ ID NO: 2144328 - RNA, 22 nt, Staphylococcus aureus subsp. aureus N315
ugcuuccuuuuuguuauaucua

SEQ ID NO: 2144329 - RNA, 20 nt, Staphylococcus aureus subsp. aureus N315
ugcuucgcacaacugcauaa

SEQ ID NO: 2144330 - RNA, 15 nt, Staphylococcus aureus subsp. aureus N315
ugcuucgcuaauauc

SEQ ID NO: 2144331 - RNA, 18 nt, Staphylococcus aureus subsp. aureus N315
ugcugcuaaaauaacaac

SEQ ID NO: 2144332 - RNA, 14 nt, Staphylococcus aureus subsp. aureus N315
ugcugcuaauugau

SEQ ID NO: 2144333 - RNA, 19 nt, Staphylococcus aureus subsp. aureus N315
uuaguagauuuauuaaaua

SEQ ID NO: 2144334 - RNA, 19 nt, Staphylococcus aureus subsp. aureus N315
uuaguaauaacaucuaaau

SEQ ID NO: 2144335 - RNA, 22 nt, Staphylococcus aureus subsp. aureus N315
uuaguacuaaaccgauuaauau

SEQ ID NO: 2144336 - RNA, 14 nt, Staphylococcus aureus subsp. aureus N315
uuaguacaaaauug

SEQ ID NO: 2144337 - RNA, 18 nt, Staphylococcus aureus subsp. aureus N315
uuaguacacguguauugu

SEQ ID NO: 2144338 - RNA, 19 nt, Staphylococcus aureus subsp. aureus N315
uuaggucuacgaucaaaau

SEQ ID NO: 2144339 - RNA, 15 nt, Staphylococcus aureus subsp. aureus N315
uuagguccuuucaca

SEQ ID NO: 2144340 - RNA, 12 nt, Staphylococcus aureus subsp. aureus N315
uuagguauauaa

SEQ ID NO: 2144341 - RNA, 17 nt, Staphylococcus aureus subsp. aureus N315
uuagguugauuucugcu

SEQ ID NO: 2144342 - RNA, 22 nt, Staphylococcus aureus subsp. aureus N315
uuagguaauacaucaucaaguu

SEQ ID NO: 2144343 - RNA, 23 nt, Staphylococcus aureus subsp. aureus N315
uuagugacaaguaugucaucuuc

SEQ ID NO: 2144344 - RNA, 21 nt, Staphylococcus aureus subsp. aureus N315
uuagugauaccuuuaauuguu

SEQ ID NO: 2144345 - RNA, 16 nt, Staphylococcus aureus subsp. aureus N315
uuagugucacaaagaa

SEQ ID NO: 2144346 - RNA, 18 nt, Staphylococcus aureus subsp. aureus N315
uuaguuaauuauuuagau

SEQ ID NO: 2144347 - RNA, 23 nt, Staphylococcus aureus subsp. aureus N315
uuagugaaacaauuuguaacuau

SEQ ID NO: 2144348 - RNA, 14 nt, Staphylococcus aureus subsp. aureus N315
uuagucauguuugg

SEQ ID NO: 2144349 - RNA, 15 nt, Staphylococcus aureus subsp. aureus N315
uuaguuauacuacua

SEQ ID NO: 2144350 - RNA, 14 nt, Staphylococcus aureus subsp. aureus N315
uuaguuuuuuuaaa

SEQ ID NO: 2144351 - RNA, 14 nt, Staphylococcus aureus subsp. aureus N315
uuauaaauaucuuu

SEQ ID NO: 2144352 - RNA, 15 nt, Staphylococcus aureus subsp. aureus N315
uuauaaaaaaucagu

SEQ ID NO: 2144353 - RNA, 21 nt, Staphylococcus aureus subsp. aureus N315
uuauaaaaaaucaguuuuuaa

SEQ ID NO: 2144354 - RNA, 23 nt, Staphylococcus aureus subsp. aureus N315
uuauaaaaaaucaguuuuuaaau

SEQ ID NO: 2144355 - RNA, 15 nt, Staphylococcus aureus subsp. aureus N315
uuauaaaaacagcag

SEQ ID NO: 2144356 - RNA, 17 nt, Staphylococcus aureus subsp. aureus N315
uuauaaaucaaagagga

SEQ ID NO: 2144357 - RNA, 16 nt, Staphylococcus aureus subsp. aureus N315
uuauaaauauuuuuug

SEQ ID NO: 2144358 - RNA, 13 nt, Staphylococcus aureus subsp. aureus N315
uuauaaauauuuu

SEQ ID NO: 2144359 - RNA, 17 nt, Staphylococcus aureus subsp. aureus N315
uuauauuuaaaugucuu

SEQ ID NO: 2144360 - RNA, 14 nt, Staphylococcus aureus subsp. aureus N315
uuauauuuaaacuc

SEQ ID NO: 2144361 - RNA, 16 nt, Staphylococcus aureus subsp. aureus N315
uuauauuguuaaaauu

SEQ ID NO: 2144362 - RNA, 16 nt, Staphylococcus aureus subsp. aureus N315
uuauauuguauuuuau

SEQ ID NO: 2144363 - RNA, 18 nt, Staphylococcus aureus subsp. aureus N315
uuauauuguauuuuauuu

SEQ ID NO: 2144364 - RNA, 18 nt, Staphylococcus aureus subsp. aureus N315
uuauauugcaaaaauaau

SEQ ID NO: 2144365 - RNA, 17 nt, Staphylococcus aureus subsp. aureus N315
uuauauuuuauuuaaaa

SEQ ID NO: 2144366 - RNA, 13 nt, Staphylococcus aureus subsp. aureus N315
uuauauuuuauua

SEQ ID NO: 2144367 - RNA, 11 nt, Staphylococcus aureus subsp. aureus N315
uuauauuuucu

SEQ ID NO: 2144368 - RNA, 18 nt, Staphylococcus aureus subsp. aureus N315
uuauauuuuucuucaguu

SEQ ID NO: 2144369 - RNA, 15 nt, Staphylococcus aureus subsp. aureus N315
uuauauugcaaaaau

SEQ ID NO: 2144370 - RNA, 17 nt, Staphylococcus aureus subsp. aureus N315
uuauauugcaaaaauaa

SEQ ID NO: 2144371 - RNA, 21 nt, Staphylococcus aureus subsp. aureus N315
uuauauguuuuaugauuuucu

SEQ ID NO: 2144372 - RNA, 17 nt, Staphylococcus aureus subsp. aureus N315
uuauauaaacaaaaauc

SEQ ID NO: 2144373 - RNA, 19 nt, Staphylococcus aureus subsp. aureus N315
uuauauaaauuuguaccaa

SEQ ID NO: 2144374 - RNA, 16 nt, Staphylococcus aureus subsp. aureus N315
uuauaucuuaaguaca

SEQ ID NO: 2144375 - RNA, 22 nt, Staphylococcus aureus subsp. aureus N315
uuauaucuuuuauacauguaca

SEQ ID NO: 2144376 - RNA, 17 nt, Staphylococcus aureus subsp. aureus N315
uuauaacauccccuucu

SEQ ID NO: 2144377 - RNA, 18 nt, Staphylococcus aureus subsp. aureus N315
uuauaaaugauuaaagug

SEQ ID NO: 2144378 - RNA, 19 nt, Staphylococcus aureus subsp. aureus N315
uuauaaauucuaucuauaa

SEQ ID NO: 2144379 - RNA, 12 nt, Staphylococcus aureus subsp. aureus N315
uuauaaauuucg

SEQ ID NO: 2144380 - RNA, 22 nt, Staphylococcus aureus subsp. aureus N315
uuauacgaaucacaguuauaua

SEQ ID NO: 2144381 - RNA, 19 nt, Staphylococcus aureus subsp. aureus N315
uuauacauguacauuauca

SEQ ID NO: 2144382 - RNA, 16 nt, Staphylococcus aureus subsp. aureus N315
uuauacauuagccaca

SEQ ID NO: 2144383 - RNA, 12 nt, Staphylococcus aureus subsp. aureus N315
uuauacauguac

SEQ ID NO: 2144384 - RNA, 10 nt, Staphylococcus aureus subsp. aureus N315
uuauacugug

SEQ ID NO: 2144385 - RNA, 13 nt, Staphylococcus aureus subsp. aureus N315
uuauacuacuauu

SEQ ID NO: 2144386 - RNA, 17 nt, Staphylococcus aureus subsp. aureus N315
uuacuugcuuuuucaaa

SEQ ID NO: 2144387 - RNA, 21 nt, Staphylococcus aureus subsp. aureus N315
uuacuugcuuuuucaaauaau

SEQ ID NO: 2144388 - RNA, 18 nt, Staphylococcus aureus subsp. aureus N315
uuacuucuaauaguaaug

SEQ ID NO: 2144389 - RNA, 19 nt, Staphylococcus aureus subsp. aureus N315
uuagaaaguauuuauuucu

SEQ ID NO: 2144390 - RNA, 23 nt, Staphylococcus aureus subsp. aureus N315
uuagaaccaucauucauauggaa

SEQ ID NO: 2144391 - RNA, 15 nt, Staphylococcus aureus subsp. aureus N315
uuaccuuuaauuaca

SEQ ID NO: 2144392 - RNA, 15 nt, Staphylococcus aureus subsp. aureus N315
uuaccuuuauguuca

SEQ ID NO: 2144393 - RNA, 14 nt, Staphylococcus aureus subsp. aureus N315
uuaccuuuccauuc

SEQ ID NO: 2144394 - RNA, 23 nt, Staphylococcus aureus subsp. aureus N315
uuacgacauacuugucguauucu

SEQ ID NO: 2144395 - RNA, 23 nt, Staphylococcus aureus subsp. aureus N315
uuacuuaaucuggguuguaaucu

SEQ ID NO: 2144396 - RNA, 16 nt, Staphylococcus aureus subsp. aureus N315
uuacuuauauauucaa

SEQ ID NO: 2144397 - RNA, 14 nt, Staphylococcus aureus subsp. aureus N315
uuagauaaauuaau

SEQ ID NO: 2144398 - RNA, 22 nt, Staphylococcus aureus subsp. aureus N315
uuagauaaacucuaaauaaaca

SEQ ID NO: 2144399 - RNA, 21 nt, Staphylococcus aureus subsp. aureus N315
uuagauaaauuaauaugaaca

SEQ ID NO: 2144400 - RNA, 17 nt, Staphylococcus aureus subsp. aureus N315
uuagauauuauaaaaac

SEQ ID NO: 2144401 - RNA, 19 nt, Staphylococcus aureus subsp. aureus N315
uuagaugcauaaaaaaaga

SEQ ID NO: 2144402 - RNA, 18 nt, Staphylococcus aureus subsp. aureus N315
uuagauuuuauauaaaaa

SEQ ID NO: 2144403 - RNA, 19 nt, Staphylococcus aureus subsp. aureus N315
uuagauuuucacuaauauu

SEQ ID NO: 2144404 - RNA, 21 nt, Staphylococcus aureus subsp. aureus N315
uuagauuuuauauaaaaagaa

SEQ ID NO: 2144405 - RNA, 16 nt, Staphylococcus aureus subsp. aureus N315
uuagauuaucuuucaa

SEQ ID NO: 2144406 - RNA, 21 nt, Staphylococcus aureus subsp. aureus N315
uuagauugacuaaguuuguuu

SEQ ID NO: 2144407 - RNA, 13 nt, Staphylococcus aureus subsp. aureus N315
uuagacauuaaaa

SEQ ID NO: 2144408 - RNA, 18 nt, Staphylococcus aureus subsp. aureus N315
uuagacucacuucuuaaa

SEQ ID NO: 2144409 - RNA, 17 nt, Staphylococcus aureus subsp. aureus N315
uuagacucacuucuuaa

SEQ ID NO: 2144410 - RNA, 16 nt, Staphylococcus aureus subsp. aureus N315
uuagacuaaaaaacua

SEQ ID NO: 2144411 - RNA, 13 nt, Staphylococcus aureus subsp. aureus N315
uuagaagaaacuu

SEQ ID NO: 2144412 - RNA, 23 nt, Staphylococcus aureus subsp. aureus N315
uuagaagaacaauaauugaugaa

SEQ ID NO: 2144413 - RNA, 19 nt, Staphylococcus aureus subsp. aureus N315
uuagcauuaaauuccaugu

SEQ ID NO: 2144414 - RNA, 19 nt, Staphylococcus aureus subsp. aureus N315
uuagccaauaccgaauaau

SEQ ID NO: 2144415 - RNA, 19 nt, Staphylococcus aureus subsp. aureus N315
uuagcgcaccaauuaucaa

SEQ ID NO: 2144416 - RNA, 15 nt, Staphylococcus aureus subsp. aureus N315
uuaggaaugaauaaa

SEQ ID NO: 2144417 - RNA, 23 nt, Staphylococcus aureus subsp. aureus N315
uuagcuuuuguaaagcuuuaguu

SEQ ID NO: 2144418 - RNA, 21 nt, Staphylococcus aureus subsp. aureus N315
uuaggaauaauucgauuaucu

SEQ ID NO: 2144419 - RNA, 22 nt, Staphylococcus aureus subsp. aureus N315
uuaggauguucagcuaacucuu

SEQ ID NO: 2144420 - RNA, 12 nt, Staphylococcus aureus subsp. aureus N315
uuaagugaguuu

SEQ ID NO: 2144421 - RNA, 22 nt, Staphylococcus aureus subsp. aureus N315
uuaagugcaauaacaccaauug

SEQ ID NO: 2144422 - RNA, 12 nt, Staphylococcus aureus subsp. aureus N315
uuaagucaucaa

SEQ ID NO: 2144423 - RNA, 22 nt, Staphylococcus aureus subsp. aureus N315
uuaagucgccuaacuuuuauua

SEQ ID NO: 2144424 - RNA, 21 nt, Staphylococcus aureus subsp. aureus N315
uuaagucauuacguaacauca

SEQ ID NO: 2144425 - RNA, 13 nt, Staphylococcus aureus subsp. aureus N315
uuaaguacuuuua

SEQ ID NO: 2144426 - RNA, 18 nt, Staphylococcus aureus subsp. aureus N315
uuaaguacaacaguugca

SEQ ID NO: 2144427 - RNA, 14 nt, Staphylococcus aureus subsp. aureus N315
uuaaguauaucuuu

SEQ ID NO: 2144428 - RNA, 19 nt, Staphylococcus aureus subsp. aureus N315
uuaaguaguuguuauauuc

SEQ ID NO: 2144429 - RNA, 15 nt, Staphylococcus aureus subsp. aureus N315
uuaaguauagcuuuu

SEQ ID NO: 2144430 - RNA, 19 nt, Staphylococcus aureus subsp. aureus N315
uuaaguagaugauuagugu

SEQ ID NO: 2144431 - RNA, 14 nt, Staphylococcus aureus subsp. aureus N315
uuaaguaguuguua

SEQ ID NO: 2144432 - RNA, 21 nt, Staphylococcus aureus subsp. aureus N315
uuaagacugauuaauuauuga

SEQ ID NO: 2144433 - RNA, 13 nt, Staphylococcus aureus subsp. aureus N315
uuaagaauguaca

SEQ ID NO: 2144434 - RNA, 20 nt, Staphylococcus aureus subsp. aureus N315
uuaacugccauauagauauu

SEQ ID NO: 2144435 - RNA, 14 nt, Staphylococcus aureus subsp. aureus N315
uuaacugccauaua

SEQ ID NO: 2144436 - RNA, 22 nt, Staphylococcus aureus subsp. aureus N315
uuaacugguugauaaauaaacu

SEQ ID NO: 2144437 - RNA, 21 nt, Staphylococcus aureus subsp. aureus N315
uuaacuguaugccgccuaaua

SEQ ID NO: 2144438 - RNA, 18 nt, Staphylococcus aureus subsp. aureus N315
uuaaauccgcuuguucaa

SEQ ID NO: 2144439 - RNA, 15 nt, Staphylococcus aureus subsp. aureus N315
uuaaauaaaugacuu

SEQ ID NO: 2144440 - RNA, 19 nt, Staphylococcus aureus subsp. aureus N315
uuaaaucacugcuuucaag

SEQ ID NO: 2144441 - RNA, 17 nt, Staphylococcus aureus subsp. aureus N315
uuaaaucuaauuauuca

SEQ ID NO: 2144442 - RNA, 19 nt, Staphylococcus aureus subsp. aureus N315
uuaaaucugauucauuaaa

SEQ ID NO: 2144443 - RNA, 15 nt, Staphylococcus aureus subsp. aureus N315
uuaaaucuacuuugu

SEQ ID NO: 2144444 - RNA, 23 nt, Staphylococcus aureus subsp. aureus N315
uuaaaucuuuuacuaaaugaauu

SEQ ID NO: 2144445 - RNA, 17 nt, Staphylococcus aureus subsp. aureus N315
uuaauaaugaauucuau

SEQ ID NO: 2144446 - RNA, 17 nt, Staphylococcus aureus subsp. aureus N315
uuaagugggacuuuuua

SEQ ID NO: 2144447 - RNA, 15 nt, Staphylococcus aureus subsp. aureus N315
uuaauacaucaauau

SEQ ID NO: 2144448 - RNA, 20 nt, Staphylococcus aureus subsp. aureus N315
uuaauacaucaauaucuucu

SEQ ID NO: 2144449 - RNA, 19 nt, Staphylococcus aureus subsp. aureus N315
uuaauacaagucuuuacuc

SEQ ID NO: 2144450 - RNA, 14 nt, Staphylococcus aureus subsp. aureus N315
uuaauacauaucgg

SEQ ID NO: 2144451 - RNA, 17 nt, Staphylococcus aureus subsp. aureus N315
uuaauaguguuauauug

SEQ ID NO: 2144452 - RNA, 19 nt, Staphylococcus aureus subsp. aureus N315
uuaauaggauuauuaucaa

SEQ ID NO: 2144453 - RNA, 13 nt, Staphylococcus aureus subsp. aureus N315
uuaauagaucuuu

SEQ ID NO: 2144454 - RNA, 13 nt, Staphylococcus aureus subsp. aureus N315
uuaauacaauuca

SEQ ID NO: 2144455 - RNA, 18 nt, Staphylococcus aureus subsp. aureus N315
uuaauauaacuucuauua

SEQ ID NO: 2144456 - RNA, 13 nt, Staphylococcus aureus subsp. aureus N315
uuaauauaaauuu

SEQ ID NO: 2144457 - RNA, 13 nt, Staphylococcus aureus subsp. aureus N315
uuaauauaaguau

SEQ ID NO: 2144458 - RNA, 14 nt, Staphylococcus aureus subsp. aureus N315
uuaauauaauuaau

SEQ ID NO: 2144459 - RNA, 14 nt, Staphylococcus aureus subsp. aureus N315
uuaauauaauuauu

SEQ ID NO: 2144460 - RNA, 18 nt, Staphylococcus aureus subsp. aureus N315
uuaaucagcuauaaaagu

SEQ ID NO: 2144461 - RNA, 19 nt, Staphylococcus aureus subsp. aureus N315
uuaaucagcuauaaaagua

SEQ ID NO: 2144462 - RNA, 16 nt, Staphylococcus aureus subsp. aureus N315
uuaaucaauuuaauua

SEQ ID NO: 2144463 - RNA, 14 nt, Staphylococcus aureus subsp. aureus N315
uuaaucaauuuaau

SEQ ID NO: 2144464 - RNA, 14 nt, Staphylococcus aureus subsp. aureus N315
uuaauccaauuuaa

SEQ ID NO: 2144465 - RNA, 23 nt, Staphylococcus aureus subsp. aureus N315
uuaauaucacgaucuuuaaaguc

SEQ ID NO: 2144466 - RNA, 17 nt, Staphylococcus aureus subsp. aureus N315
uuaauaucauauucaaa

SEQ ID NO: 2144467 - RNA, 19 nt, Staphylococcus aureus subsp. aureus N315
uuaauaucacgaucuuuaa

SEQ ID NO: 2144468 - RNA, 18 nt, Staphylococcus aureus subsp. aureus N315
uuaauauuugauaacaaa

SEQ ID NO: 2144469 - RNA, 12 nt, Staphylococcus aureus subsp. aureus N315
uuaauuuuauua

SEQ ID NO: 2144470 - RNA, 18 nt, Staphylococcus aureus subsp. aureus N315
uuaauuuuaugucccaau

SEQ ID NO: 2144471 - RNA, 23 nt, Staphylococcus aureus subsp. aureus N315
uuaauuuuaugucccaaugcuga

SEQ ID NO: 2144472 - RNA, 14 nt, Staphylococcus aureus subsp. aureus N315
uuaauuuugacaua

SEQ ID NO: 2144473 - RNA, 19 nt, Staphylococcus aureus subsp. aureus N315
uuaauuuugauauuuuuca

SEQ ID NO: 2144474 - RNA, 17 nt, Staphylococcus aureus subsp. aureus N315
uuaauuuucuaaauaua

SEQ ID NO: 2144475 - RNA, 23 nt, Staphylococcus aureus subsp. aureus N315
uuacaauaagcgcaauuaaaagu

SEQ ID NO: 2144476 - RNA, 11 nt, Staphylococcus aureus subsp. aureus N315
uuacaauaagg

SEQ ID NO: 2144477 - RNA, 14 nt, Staphylococcus aureus subsp. aureus N315
uuaauuuuuuauua

SEQ ID NO: 2144478 - RNA, 17 nt, Staphylococcus aureus subsp. aureus N315
uuaauuuuucuaaauga

SEQ ID NO: 2144479 - RNA, 14 nt, Staphylococcus aureus subsp. aureus N315
uuaauugcagguaa

SEQ ID NO: 2144480 - RNA, 20 nt, Staphylococcus aureus subsp. aureus N315
uuaauugcagguaaacggaa

SEQ ID NO: 2144481 - RNA, 17 nt, Staphylococcus aureus subsp. aureus N315
uuaauugcguuuaauaa

SEQ ID NO: 2144482 - RNA, 19 nt, Staphylococcus aureus subsp. aureus N315
uuaauuuguuuuaaauacu

SEQ ID NO: 2144483 - RNA, 15 nt, Staphylococcus aureus subsp. aureus N315
uuaauuuuaaauauu

SEQ ID NO: 2144484 - RNA, 11 nt, Staphylococcus aureus subsp. aureus N315
uuaauguguaa

SEQ ID NO: 2144485 - RNA, 14 nt, Staphylococcus aureus subsp. aureus N315
uuaauguuugcuuu

SEQ ID NO: 2144486 - RNA, 13 nt, Staphylococcus aureus subsp. aureus N315
uuaauuaaaauac

SEQ ID NO: 2144487 - RNA, 16 nt, Staphylococcus aureus subsp. aureus N315
uuaauuaaaauucucu

SEQ ID NO: 2144488 - RNA, 14 nt, Staphylococcus aureus subsp. aureus N315
uuaauuaauuauca

SEQ ID NO: 2144489 - RNA, 20 nt, Staphylococcus aureus subsp. aureus N315
uuaauuacgucauaaaauac

SEQ ID NO: 2144490 - RNA, 22 nt, Staphylococcus aureus subsp. aureus N315
uuaauuacagcgugauucaucu

SEQ ID NO: 2144491 - RNA, 18 nt, Staphylococcus aureus subsp. aureus N315
uuaauuacagguuuaauu

SEQ ID NO: 2144492 - RNA, 17 nt, Staphylococcus aureus subsp. aureus N315
uuaauucugauuauguu

SEQ ID NO: 2144493 - RNA, 13 nt, Staphylococcus aureus subsp. aureus N315
uuaauucuuaauc

SEQ ID NO: 2144494 - RNA, 16 nt, Staphylococcus aureus subsp. aureus N315
uuaaugucuaaaaaug

SEQ ID NO: 2144495 - RNA, 19 nt, Staphylococcus aureus subsp. aureus N315
uuaaucggaucauuauuua

SEQ ID NO: 2144496 - RNA, 22 nt, Staphylococcus aureus subsp. aureus N315
uuaaucguauuagccaauaaaa

SEQ ID NO: 2144497 - RNA, 16 nt, Staphylococcus aureus subsp. aureus N315
uuaaucgcucuaaaua

SEQ ID NO: 2144498 - RNA, 18 nt, Staphylococcus aureus subsp. aureus N315
uuaaucgcucuaaauagu

SEQ ID NO: 2144499 - RNA, 23 nt, Staphylococcus aureus subsp. aureus N315
uuaauccgauuuugauauaaaaa

SEQ ID NO: 2144500 - RNA, 19 nt, Staphylococcus aureus subsp. aureus N315
uuaauccgauuuugauaua

SEQ ID NO: 2144501 - RNA, 21 nt, Staphylococcus aureus subsp. aureus N315
uuaauccuucuccaaaaauaa

SEQ ID NO: 2144502 - RNA, 21 nt, Staphylococcus aureus subsp. aureus N315
uuaccacaaauaucaauuuca

SEQ ID NO: 2144503 - RNA, 15 nt, Staphylococcus aureus subsp. aureus N315
uuacagucaacugcu

SEQ ID NO: 2144504 - RNA, 16 nt, Staphylococcus aureus subsp. aureus N315
uuacacaaauuaaaac

SEQ ID NO: 2144505 - RNA, 19 nt, Staphylococcus aureus subsp. aureus N315
uuacaaucaucacacauaa

SEQ ID NO: 2144506 - RNA, 19 nt, Staphylococcus aureus subsp. aureus N315
uuaccuaauaggauuuccu

SEQ ID NO: 2144507 - RNA, 18 nt, Staphylococcus aureus subsp. aureus N315
uuaccuguuucuauauua

SEQ ID NO: 2144508 - RNA, 23 nt, Staphylococcus aureus subsp. aureus N315
uuaccuguuucuauauuaauaau

SEQ ID NO: 2144509 - RNA, 20 nt, Staphylococcus aureus subsp. aureus N315
uguguccauaaauauuaaau

SEQ ID NO: 2144510 - RNA, 22 nt, Staphylococcus aureus subsp. aureus N315
ugugucauaauccauucuucuu

SEQ ID NO: 2144511 - RNA, 11 nt, Staphylococcus aureus subsp. aureus N315
ugugucaacuu

SEQ ID NO: 2144512 - RNA, 22 nt, Staphylococcus aureus subsp. aureus N315
ugugucaaauaggcauaaugaa

SEQ ID NO: 2144513 - RNA, 21 nt, Staphylococcus aureus subsp. aureus N315
uguguaugguuuuguacauau

SEQ ID NO: 2144514 - RNA, 16 nt, Staphylococcus aureus subsp. aureus N315
uguguauuuuuauugu

SEQ ID NO: 2144515 - RNA, 13 nt, Staphylococcus aureus subsp. aureus N315
uguguuucuuuua

SEQ ID NO: 2144516 - RNA, 16 nt, Staphylococcus aureus subsp. aureus N315
uguguuucuuuuauuu

SEQ ID NO: 2144517 - RNA, 21 nt, Staphylococcus aureus subsp. aureus N315
uguguuucuuuuauuuucaua

SEQ ID NO: 2144518 - RNA, 11 nt, Staphylococcus aureus subsp. aureus N315
uguguuuucaa

SEQ ID NO: 2144519 - RNA, 18 nt, Staphylococcus aureus subsp. aureus N315
uguguuuucaacaguuuu

SEQ ID NO: 2144520 - RNA, 17 nt, Staphylococcus aureus subsp. aureus N315
uguguuugcuuuuauuu

SEQ ID NO: 2144521 - RNA, 12 nt, Staphylococcus aureus subsp. aureus N315
uguguuugcuuu

SEQ ID NO: 2144522 - RNA, 18 nt, Staphylococcus aureus subsp. aureus N315
uguuaaaauuugaauuga

SEQ ID NO: 2144523 - RNA, 16 nt, Staphylococcus aureus subsp. aureus N315
uguuaaaauaaugucu

SEQ ID NO: 2144524 - RNA, 16 nt, Staphylococcus aureus subsp. aureus N315
uguuaaauucuaaaac

SEQ ID NO: 2144525 - RNA, 23 nt, Staphylococcus aureus subsp. aureus N315
uguuaaaggauggauacuuaaag

SEQ ID NO: 2144526 - RNA, 22 nt, Staphylococcus aureus subsp. aureus N315
uguuaaacgcugauuuuauaaa

SEQ ID NO: 2144527 - RNA, 21 nt, Staphylococcus aureus subsp. aureus N315
uguuaaacccucauuuuuaua

SEQ ID NO: 2144528 - RNA, 12 nt, Staphylococcus aureus subsp. aureus N315
ugugacauacca

SEQ ID NO: 2144529 - RNA, 17 nt, Staphylococcus aureus subsp. aureus N315
ugugacuuguaucaucg

SEQ ID NO: 2144530 - RNA, 20 nt, Staphylococcus aureus subsp. aureus N315
ugucacuaauggauaugaua

SEQ ID NO: 2144531 - RNA, 14 nt, Staphylococcus aureus subsp. aureus N315
ugugcauucaucaa

SEQ ID NO: 2144532 - RNA, 13 nt, Staphylococcus aureus subsp. aureus N315
ugugcaucauuua

SEQ ID NO: 2144533 - RNA, 23 nt, Staphylococcus aureus subsp. aureus N315
ugugcaauuagaauauauguaua

SEQ ID NO: 2144534 - RNA, 18 nt, Staphylococcus aureus subsp. aureus N315
ugugccggcuuuuucuuu

SEQ ID NO: 2144535 - RNA, 20 nt, Staphylococcus aureus subsp. aureus N315
ugugccuuugcuuuuuauuu

SEQ ID NO: 2144536 - RNA, 16 nt, Staphylococcus aureus subsp. aureus N315
uguuggcuuuuugagu

SEQ ID NO: 2144537 - RNA, 11 nt, Staphylococcus aureus subsp. aureus N315
uguuguuuuaa

SEQ ID NO: 2144538 - RNA, 21 nt, Staphylococcus aureus subsp. aureus N315
uguugucguuucuagcaacug

SEQ ID NO: 2144539 - RNA, 15 nt, Staphylococcus aureus subsp. aureus N315
uguugcaaaauacga

SEQ ID NO: 2144540 - RNA, 15 nt, Staphylococcus aureus subsp. aureus N315
uguucucauuauaau

SEQ ID NO: 2144541 - RNA, 18 nt, Staphylococcus aureus subsp. aureus N315
uguucucgucuuucgucc

SEQ ID NO: 2144542 - RNA, 18 nt, Staphylococcus aureus subsp. aureus N315
uguucucauuauaaugau

SEQ ID NO: 2144543 - RNA, 23 nt, Staphylococcus aureus subsp. aureus N315
uguucucuauuuauaacacuucg

SEQ ID NO: 2144544 - RNA, 18 nt, Staphylococcus aureus subsp. aureus N315
uguucucuauuuauacaa

SEQ ID NO: 2144545 - RNA, 22 nt, Staphylococcus aureus subsp. aureus N315
uguucuaaguuugcguuuuaau

SEQ ID NO: 2144546 - RNA, 18 nt, Staphylococcus aureus subsp. aureus N315
uguuggaauaccuuuuuc

SEQ ID NO: 2144547 - RNA, 20 nt, Staphylococcus aureus subsp. aureus N315
uguuggaauaccuuuuucua

SEQ ID NO: 2144548 - RNA, 18 nt, Staphylococcus aureus subsp. aureus N315
uguuggauucaucucagc

SEQ ID NO: 2144549 - RNA, 21 nt, Staphylococcus aureus subsp. aureus N315
uguuccgcuacaaaacauauu

SEQ ID NO: 2144550 - RNA, 18 nt, Staphylococcus aureus subsp. aureus N315
uguuccgcuacaaaacau

SEQ ID NO: 2144551 - RNA, 17 nt, Staphylococcus aureus subsp. aureus N315
uguuccgcuacaaaaca

SEQ ID NO: 2144552 - RNA, 17 nt, Staphylococcus aureus subsp. aureus N315
uguucccauuuuuaaaa

SEQ ID NO: 2144553 - RNA, 14 nt, Staphylococcus aureus subsp. aureus N315
uguucuaaugcugc

SEQ ID NO: 2144554 - RNA, 23 nt, Staphylococcus aureus subsp. aureus N315
uguuccugcuacaacuucuucuc

SEQ ID NO: 2144555 - RNA, 15 nt, Staphylococcus aureus subsp. aureus N315
uguuauguaugaaag

SEQ ID NO: 2144556 - RNA, 14 nt, Staphylococcus aureus subsp. aureus N315
uguucacuaaaugu

SEQ ID NO: 2144557 - RNA, 15 nt, Staphylococcus aureus subsp. aureus N315
uguuauuaaccauca

SEQ ID NO: 2144558 - RNA, 21 nt, Staphylococcus aureus subsp. aureus N315
uguuaacugauaaaaggggaa

SEQ ID NO: 2144559 - RNA, 15 nt, Staphylococcus aureus subsp. aureus N315
uguuaacugauaaaa

SEQ ID NO: 2144560 - RNA, 16 nt, Staphylococcus aureus subsp. aureus N315
uguuaacugauaaaag

SEQ ID NO: 2144561 - RNA, 19 nt, Staphylococcus aureus subsp. aureus N315
uguuuuuaauguuugcuuu

SEQ ID NO: 2144562 - RNA, 12 nt, Staphylococcus aureus subsp. aureus N315
uguuuuuaaaau

SEQ ID NO: 2144563 - RNA, 18 nt, Staphylococcus aureus subsp. aureus N315
uguuuuucaucauuaaaa

SEQ ID NO: 2144564 - RNA, 19 nt, Staphylococcus aureus subsp. aureus N315
uguuuuucaucauuaaaau

SEQ ID NO: 2144565 - RNA, 20 nt, Staphylococcus aureus subsp. aureus N315
uguuuuugauaguaauaguu

SEQ ID NO: 2144566 - RNA, 10 nt, Staphylococcus aureus subsp. aureus N315
uuaaaaaaau

SEQ ID NO: 2144567 - RNA, 15 nt, Staphylococcus aureus subsp. aureus N315
uuaaaaaacagugua

SEQ ID NO: 2144568 - RNA, 19 nt, Staphylococcus aureus subsp. aureus N315
uuaaaaaacauaccugcau

SEQ ID NO: 2144569 - RNA, 18 nt, Staphylococcus aureus subsp. aureus N315
uuaaaaaaccugaaacaa

SEQ ID NO: 2144570 - RNA, 13 nt, Staphylococcus aureus subsp. aureus N315
uguuuuuuaagua

SEQ ID NO: 2144571 - RNA, 23 nt, Staphylococcus aureus subsp. aureus N315
uuaaaaagguacuaauguuaauc

SEQ ID NO: 2144572 - RNA, 19 nt, Staphylococcus aureus subsp. aureus N315
uuaaaaaauauguauguuu

SEQ ID NO: 2144573 - RNA, 23 nt, Staphylococcus aureus subsp. aureus N315
uuaaaaaaucauucaccuaaaaa

SEQ ID NO: 2144574 - RNA, 16 nt, Staphylococcus aureus subsp. aureus N315
uuaaaaaauuuaaugu

SEQ ID NO: 2144575 - RNA, 12 nt, Staphylococcus aureus subsp. aureus N315
uuaaaaacagca

SEQ ID NO: 2144576 - RNA, 15 nt, Staphylococcus aureus subsp. aureus N315
uuaaaacaucauuca

SEQ ID NO: 2144577 - RNA, 19 nt, Staphylococcus aureus subsp. aureus N315
uuaaaacaaugauuaaaau

SEQ ID NO: 2144578 - RNA, 17 nt, Staphylococcus aureus subsp. aureus N315
uuaaaacuauaaccuau

SEQ ID NO: 2144579 - RNA, 15 nt, Staphylococcus aureus subsp. aureus N315
uuaaaaccuuuucaa

SEQ ID NO: 2144580 - RNA, 15 nt, Staphylococcus aureus subsp. aureus N315
uuaaaaaucaaagag

SEQ ID NO: 2144581 - RNA, 17 nt, Staphylococcus aureus subsp. aureus N315
uuaaaaaucaaagaggc

SEQ ID NO: 2144582 - RNA, 17 nt, Staphylococcus aureus subsp. aureus N315
uuaaaaauacagcuaca

SEQ ID NO: 2144583 - RNA, 18 nt, Staphylococcus aureus subsp. aureus N315
uuaaaaauagccuucaaa

SEQ ID NO: 2144584 - RNA, 19 nt, Staphylococcus aureus subsp. aureus N315
uuaaaaauugaaggaaaau

SEQ ID NO: 2144585 - RNA, 16 nt, Staphylococcus aureus subsp. aureus N315
uuaaaaauuucaauaa

SEQ ID NO: 2144586 - RNA, 15 nt, Staphylococcus aureus subsp. aureus N315
uuaaaaaugaaauga

SEQ ID NO: 2144587 - RNA, 13 nt, Staphylococcus aureus subsp. aureus N315
uuaaagcaucaua

SEQ ID NO: 2144588 - RNA, 21 nt, Staphylococcus aureus subsp. aureus N315
uuaaagcaaauuauauagaaa

SEQ ID NO: 2144589 - RNA, 14 nt, Staphylococcus aureus subsp. aureus N315
uuaaagucuucauc

SEQ ID NO: 2144590 - RNA, 14 nt, Staphylococcus aureus subsp. aureus N315
uuaaaguguuucaa

SEQ ID NO: 2144591 - RNA, 16 nt, Staphylococcus aureus subsp. aureus N315
uuaaauaaaaauauug

SEQ ID NO: 2144592 - RNA, 17 nt, Staphylococcus aureus subsp. aureus N315
uuaaaguuuuguucaau

SEQ ID NO: 2144593 - RNA, 22 nt, Staphylococcus aureus subsp. aureus N315
uuaaacgugaauucgaugacuu

SEQ ID NO: 2144594 - RNA, 17 nt, Staphylococcus aureus subsp. aureus N315
uuaaacuacgaauucuc

SEQ ID NO: 2144595 - RNA, 20 nt, Staphylococcus aureus subsp. aureus N315
uuaaacuuauuaauuaauag

SEQ ID NO: 2144596 - RNA, 15 nt, Staphylococcus aureus subsp. aureus N315
uuaaagauuaaaaua

SEQ ID NO: 2144597 - RNA, 19 nt, Staphylococcus aureus subsp. aureus N315
uuaaagauggcugcaucaa

SEQ ID NO: 2144598 - RNA, 19 nt, Staphylococcus aureus subsp. aureus N315
uuaaagaugucgaaaagua

SEQ ID NO: 2144599 - RNA, 14 nt, Staphylococcus aureus subsp. aureus N315
uuaaagauuaaaau

SEQ ID NO: 2144600 - RNA, 18 nt, Staphylococcus aureus subsp. aureus N315
uuaaaauuaaaccuacaa

SEQ ID NO: 2144601 - RNA, 22 nt, Staphylococcus aureus subsp. aureus N315
uuaaaauuguauagaaugugua

SEQ ID NO: 2144602 - RNA, 11 nt, Staphylococcus aureus subsp. aureus N315
uuaaaauuauu

SEQ ID NO: 2144603 - RNA, 14 nt, Staphylococcus aureus subsp. aureus N315
uuaaacguaucauu

SEQ ID NO: 2144604 - RNA, 15 nt, Staphylococcus aureus subsp. aureus N315
uuaaaauuuaaauau

SEQ ID NO: 2144605 - RNA, 21 nt, Staphylococcus aureus subsp. aureus N315
uuaaaaucucauaauaauuca

SEQ ID NO: 2144606 - RNA, 19 nt, Staphylococcus aureus subsp. aureus N315
uuaaaaugauaucugacau

SEQ ID NO: 2144607 - RNA, 20 nt, Staphylococcus aureus subsp. aureus N315
uuaaaaugauaucugacauu

SEQ ID NO: 2144608 - RNA, 18 nt, Staphylococcus aureus subsp. aureus N315
uuaaaauauuauuuuuaa

SEQ ID NO: 2144609 - RNA, 23 nt, Staphylococcus aureus subsp. aureus N315
uuaaaaucggacaacugagaaau

SEQ ID NO: 2144610 - RNA, 18 nt, Staphylococcus aureus subsp. aureus N315
uuaaaauaaccauuuuuu

SEQ ID NO: 2144611 - RNA, 22 nt, Staphylococcus aureus subsp. aureus N315
uuaaaauaaccauuuuuucaaa

SEQ ID NO: 2144612 - RNA, 17 nt, Staphylococcus aureus subsp. aureus N315
uuaaaaguaacauacua

SEQ ID NO: 2144613 - RNA, 13 nt, Staphylococcus aureus subsp. aureus N315
uuaaaagugcaag

SEQ ID NO: 2144614 - RNA, 19 nt, Staphylococcus aureus subsp. aureus N315
uguuuaucuguaucaaaau

SEQ ID NO: 2144615 - RNA, 22 nt, Staphylococcus aureus subsp. aureus N315
uguuuaugagcuuaauaaauug

SEQ ID NO: 2144616 - RNA, 16 nt, Staphylococcus aureus subsp. aureus N315
uguuuauuacauaauu

SEQ ID NO: 2144617 - RNA, 20 nt, Staphylococcus aureus subsp. aureus N315
uguuuauuacauaauuuauc

SEQ ID NO: 2144618 - RNA, 16 nt, Staphylococcus aureus subsp. aureus N315
uguuuauuuagaauaa

SEQ ID NO: 2144619 - RNA, 14 nt, Staphylococcus aureus subsp. aureus N315
uguuuauuuagaau

SEQ ID NO: 2144620 - RNA, 19 nt, Staphylococcus aureus subsp. aureus N315
uguuucaacauauuauaua

SEQ ID NO: 2144621 - RNA, 23 nt, Staphylococcus aureus subsp. aureus N315
uguuucaacauauuauauauauu

SEQ ID NO: 2144622 - RNA, 19 nt, Staphylococcus aureus subsp. aureus N315
uguuuauuuagaauaaacu

SEQ ID NO: 2144623 - RNA, 14 nt, Staphylococcus aureus subsp. aureus N315
uguuuauuuuuaua

SEQ ID NO: 2144624 - RNA, 15 nt, Staphylococcus aureus subsp. aureus N315
uguuuauuuuuauau

SEQ ID NO: 2144625 - RNA, 16 nt, Staphylococcus aureus subsp. aureus N315
uguuuauuuuuauaua

SEQ ID NO: 2144626 - RNA, 21 nt, Staphylococcus aureus subsp. aureus N315
uguuucauaugcaucaacaga

SEQ ID NO: 2144627 - RNA, 15 nt, Staphylococcus aureus subsp. aureus N315
uguuucauauauauu

SEQ ID NO: 2144628 - RNA, 21 nt, Staphylococcus aureus subsp. aureus N315
uguuucagcuuguccauagua

SEQ ID NO: 2144629 - RNA, 12 nt, Staphylococcus aureus subsp. aureus N315
uguuucagcuug

SEQ ID NO: 2144630 - RNA, 14 nt, Staphylococcus aureus subsp. aureus N315
uguuuccucuuuaa

SEQ ID NO: 2144631 - RNA, 13 nt, Staphylococcus aureus subsp. aureus N315
uguuuaaaugcua

SEQ ID NO: 2144632 - RNA, 22 nt, Staphylococcus aureus subsp. aureus N315
uguuuaagaauguacaauuuuu

SEQ ID NO: 2144633 - RNA, 13 nt, Staphylococcus aureus subsp. aureus N315
uguuuaaauuuaa

SEQ ID NO: 2144634 - RNA, 15 nt, Staphylococcus aureus subsp. aureus N315
uguuuaaauaaaauu

SEQ ID NO: 2144635 - RNA, 16 nt, Staphylococcus aureus subsp. aureus N315
uguuuaauuaaaauac

SEQ ID NO: 2144636 - RNA, 18 nt, Staphylococcus aureus subsp. aureus N315
uguuuaucuguaucaaaa

SEQ ID NO: 2144637 - RNA, 22 nt, Staphylococcus aureus subsp. aureus N315
uguuuaucaugaugauaaauug

SEQ ID NO: 2144638 - RNA, 16 nt, Staphylococcus aureus subsp. aureus N315
uguuuauauugcaaaa

SEQ ID NO: 2144639 - RNA, 15 nt, Staphylococcus aureus subsp. aureus N315
uguuuauauugcaaa

SEQ ID NO: 2144640 - RNA, 17 nt, Staphylococcus aureus subsp. aureus N315
uguuuauaucuuuuaua

SEQ ID NO: 2144641 - RNA, 21 nt, Staphylococcus aureus subsp. aureus N315
uguuuucaacaguuuuaaaga

SEQ ID NO: 2144642 - RNA, 16 nt, Staphylococcus aureus subsp. aureus N315
uguuuucauuuaaaag

SEQ ID NO: 2144643 - RNA, 19 nt, Staphylococcus aureus subsp. aureus N315
uguuuuaugauuuucuuua

SEQ ID NO: 2144644 - RNA, 17 nt, Staphylococcus aureus subsp. aureus N315
uguuuuccaauaauaaa

SEQ ID NO: 2144645 - RNA, 14 nt, Staphylococcus aureus subsp. aureus N315
uguuuuauagcauu

SEQ ID NO: 2144646 - RNA, 15 nt, Staphylococcus aureus subsp. aureus N315
uguuuuaucaauauu

SEQ ID NO: 2144647 - RNA, 12 nt, Staphylococcus aureus subsp. aureus N315
uguuuuaaaauu

SEQ ID NO: 2144648 - RNA, 14 nt, Staphylococcus aureus subsp. aureus N315
uguuuuaaauacuu

SEQ ID NO: 2144649 - RNA, 12 nt, Staphylococcus aureus subsp. aureus N315
uguuuuaaauuu

SEQ ID NO: 2144650 - RNA, 18 nt, Staphylococcus aureus subsp. aureus N315
uguuucuaaauucuuuuu

SEQ ID NO: 2144651 - RNA, 15 nt, Staphylococcus aureus subsp. aureus N315
uguuucuaaauucuu

SEQ ID NO: 2144652 - RNA, 14 nt, Staphylococcus aureus subsp. aureus N315
uguuucuaaugcuc

SEQ ID NO: 2144653 - RNA, 23 nt, Staphylococcus aureus subsp. aureus N315
uguuucuuagcuagcauguuuug

SEQ ID NO: 2144654 - RNA, 22 nt, Staphylococcus aureus subsp. aureus N315
uguuucuuuacuucuuucaaaa

SEQ ID NO: 2144655 - RNA, 22 nt, Staphylococcus aureus subsp. aureus N315
uguuugcccugcuguuuuauuc

SEQ ID NO: 2144656 - RNA, 17 nt, Staphylococcus aureus subsp. aureus N315
uguuugcaacauauuuu

SEQ ID NO: 2144657 - RNA, 13 nt, Staphylococcus aureus subsp. aureus N315
uguuuggcauaau

SEQ ID NO: 2144658 - RNA, 18 nt, Staphylococcus aureus subsp. aureus N315
uguuugaauguuuuugau

SEQ ID NO: 2144659 - RNA, 13 nt, Staphylococcus aureus subsp. aureus N315
uggauuucuuauu

SEQ ID NO: 2144660 - RNA, 16 nt, Staphylococcus aureus subsp. aureus N315
uggauucucuuuauau

SEQ ID NO: 2144661 - RNA, 17 nt, Staphylococcus aureus subsp. aureus N315
uggauucuuuuguaaua

SEQ ID NO: 2144662 - RNA, 22 nt, Staphylococcus aureus subsp. aureus N315
uggauugccccuaauuuauaaa

SEQ ID NO: 2144663 - RNA, 23 nt, Staphylococcus aureus subsp. aureus N315
uggauucaaaugacauuuuaaau

SEQ ID NO: 2144664 - RNA, 15 nt, Staphylococcus aureus subsp. aureus N315
uggauuuuaauuauu

SEQ ID NO: 2144665 - RNA, 20 nt, Staphylococcus aureus subsp. aureus N315
uggauuuuucuuauaaaaau

SEQ ID NO: 2144666 - RNA, 16 nt, Staphylococcus aureus subsp. aureus N315
uggauuucuuuuuaaa

SEQ ID NO: 2144667 - RNA, 14 nt, Staphylococcus aureus subsp. aureus N315
uggauuucuuuuua

SEQ ID NO: 2144668 - RNA, 21 nt, Staphylococcus aureus subsp. aureus N315
uggauuuuaacaagauaacua

SEQ ID NO: 2144669 - RNA, 14 nt, Staphylococcus aureus subsp. aureus N315
uggauuuuaacaag

SEQ ID NO: 2144670 - RNA, 14 nt, Staphylococcus aureus subsp. aureus N315
uggcaaagaauccu

SEQ ID NO: 2144671 - RNA, 20 nt, Staphylococcus aureus subsp. aureus N315
uggcaauauacuuuuuaaau

SEQ ID NO: 2144672 - RNA, 11 nt, Staphylococcus aureus subsp. aureus N315
uggcaccagua

SEQ ID NO: 2144673 - RNA, 23 nt, Staphylococcus aureus subsp. aureus N315
uggcauaucgauaaauguauuaa

SEQ ID NO: 2144674 - RNA, 19 nt, Staphylococcus aureus subsp. aureus N315
uggcauaucgauaaaugua

SEQ ID NO: 2144675 - RNA, 20 nt, Staphylococcus aureus subsp. aureus N315
uggaucagguccaauucucu

SEQ ID NO: 2144676 - RNA, 16 nt, Staphylococcus aureus subsp. aureus N315
uggauguguuuuaaua

SEQ ID NO: 2144677 - RNA, 20 nt, Staphylococcus aureus subsp. aureus N315
uggauguaggcuuuuuuauu

SEQ ID NO: 2144678 - RNA, 17 nt, Staphylococcus aureus subsp. aureus N315
uggauaaaaugauaucu

SEQ ID NO: 2144679 - RNA, 14 nt, Staphylococcus aureus subsp. aureus N315
uggauaaaaugaua

SEQ ID NO: 2144680 - RNA, 15 nt, Staphylococcus aureus subsp. aureus N315
uggauaugauaacca

SEQ ID NO: 2144681 - RNA, 24 nt, Staphylococcus aureus subsp. aureus N315
uggauagguaacuaaaaugucuuu

SEQ ID NO: 2144682 - RNA, 17 nt, Staphylococcus aureus subsp. aureus N315
uggacuaacgucauuau

SEQ ID NO: 2144683 - RNA, 15 nt, Staphylococcus aureus subsp. aureus N315
uggagaaccuuuaaa

SEQ ID NO: 2144684 - RNA, 17 nt, Staphylococcus aureus subsp. aureus N315
uggagcggaagauagga

SEQ ID NO: 2144685 - RNA, 19 nt, Staphylococcus aureus subsp. aureus N315
uggagccccuuguucuccg

SEQ ID NO: 2144686 - RNA, 22 nt, Staphylococcus aureus subsp. aureus N315
uggagauucucgguuuuuucgg

SEQ ID NO: 2144687 - RNA, 18 nt, Staphylococcus aureus subsp. aureus N315
uggcgcaauuuuuaacaa

SEQ ID NO: 2144688 - RNA, 18 nt, Staphylococcus aureus subsp. aureus N315
uggcgauuccaaucuauu

SEQ ID NO: 2144689 - RNA, 23 nt, Staphylococcus aureus subsp. aureus N315
uggccaaacaaccugugauaaaa

SEQ ID NO: 2144690 - RNA, 21 nt, Staphylococcus aureus subsp. aureus N315
uguaccaucacuaaaguaaau

SEQ ID NO: 2144691 - RNA, 16 nt, Staphylococcus aureus subsp. aureus N315
uguaccguauuuuaau

SEQ ID NO: 2144692 - RNA, 17 nt, Staphylococcus aureus subsp. aureus N315
uguaccgucuuaucuaa

SEQ ID NO: 2144693 - RNA, 16 nt, Staphylococcus aureus subsp. aureus N315
uguaccgaauccuuca

SEQ ID NO: 2144694 - RNA, 16 nt, Staphylococcus aureus subsp. aureus N315
uguacuacuugauucu

SEQ ID NO: 2144695 - RNA, 15 nt, Staphylococcus aureus subsp. aureus N315
uguacguuuuuuuaa

SEQ ID NO: 2144696 - RNA, 22 nt, Staphylococcus aureus subsp. aureus N315
uguacguuuaauaccuaugaua

SEQ ID NO: 2144697 - RNA, 20 nt, Staphylococcus aureus subsp. aureus N315
uguacuuaaaccuaacauaa

SEQ ID NO: 2144698 - RNA, 19 nt, Staphylococcus aureus subsp. aureus N315
uguacuuaaaccuaacaua

SEQ ID NO: 2144699 - RNA, 22 nt, Staphylococcus aureus subsp. aureus N315
uguacuuaaaccuaacauaacu

SEQ ID NO: 2144700 - RNA, 19 nt, Staphylococcus aureus subsp. aureus N315
uguaccaauugauuuugcu

SEQ ID NO: 2144701 - RNA, 19 nt, Staphylococcus aureus subsp. aureus N315
uguaccaucacuaaaguaa

SEQ ID NO: 2144702 - RNA, 13 nt, Staphylococcus aureus subsp. aureus N315
uguaccaaauuug

SEQ ID NO: 2144703 - RNA, 17 nt, Staphylococcus aureus subsp. aureus N315
uguacauuucuauacaa

SEQ ID NO: 2144704 - RNA, 15 nt, Staphylococcus aureus subsp. aureus N315
uguacauguauaaaa

SEQ ID NO: 2144705 - RNA, 14 nt, Staphylococcus aureus subsp. aureus N315
uguacaauuuuuaa

SEQ ID NO: 2144706 - RNA, 16 nt, Staphylococcus aureus subsp. aureus N315
uguacaauuuuuaaaa

SEQ ID NO: 2144707 - RNA, 17 nt, Staphylococcus aureus subsp. aureus N315
uguacaauaauuaguca

SEQ ID NO: 2144708 - RNA, 12 nt, Staphylococcus aureus subsp. aureus N315
uguacaauaauu

SEQ ID NO: 2144709 - RNA, 23 nt, Staphylococcus aureus subsp. aureus N315
uguacaaccuuugcuuaaaccuu

SEQ ID NO: 2144710 - RNA, 15 nt, Staphylococcus aureus subsp. aureus N315
uguaauacaucuaau

SEQ ID NO: 2144711 - RNA, 22 nt, Staphylococcus aureus subsp. aureus N315
uguaauaauugcauguaaaauu

SEQ ID NO: 2144712 - RNA, 21 nt, Staphylococcus aureus subsp. aureus N315
uguaauaccaauuuuuagcau

SEQ ID NO: 2144713 - RNA, 22 nt, Staphylococcus aureus subsp. aureus N315
uguaauaccuuuacuuucauua

SEQ ID NO: 2144714 - RNA, 18 nt, Staphylococcus aureus subsp. aureus N315
uguaauaauaucaccuuu

SEQ ID NO: 2144715 - RNA, 22 nt, Staphylococcus aureus subsp. aureus N315
uguaauaauaucaccuuuuuua

SEQ ID NO: 2144716 - RNA, 14 nt, Staphylococcus aureus subsp. aureus N315
uguaauacaagcaa

SEQ ID NO: 2144717 - RNA, 20 nt, Staphylococcus aureus subsp. aureus N315
uguaauuguuuuuucuuauu

SEQ ID NO: 2144718 - RNA, 13 nt, Staphylococcus aureus subsp. aureus N315
uguaauuuaaaau

SEQ ID NO: 2144719 - RNA, 21 nt, Staphylococcus aureus subsp. aureus N315
uguaacgugaggcccauaaau

SEQ ID NO: 2144720 - RNA, 18 nt, Staphylococcus aureus subsp. aureus N315
uguaacucaauaugaaac

SEQ ID NO: 2144721 - RNA, 21 nt, Staphylococcus aureus subsp. aureus N315
uguaaauaaaaauuauauaaa

SEQ ID NO: 2144722 - RNA, 17 nt, Staphylococcus aureus subsp. aureus N315
uguaaaucacgauuuuc

SEQ ID NO: 2144723 - RNA, 23 nt, Staphylococcus aureus subsp. aureus N315
uguaaaucacgauuuucaaguaa

SEQ ID NO: 2144724 - RNA, 14 nt, Staphylococcus aureus subsp. aureus N315
uguaaauauaguaa

SEQ ID NO: 2144725 - RNA, 15 nt, Staphylococcus aureus subsp. aureus N315
uguaaauauaaauau

SEQ ID NO: 2144726 - RNA, 23 nt, Staphylococcus aureus subsp. aureus N315
uguaaagcaugaauagcuuguug

SEQ ID NO: 2144727 - RNA, 21 nt, Staphylococcus aureus subsp. aureus N315
uguaaagcuaauuuuuuauuu

SEQ ID NO: 2144728 - RNA, 20 nt, Staphylococcus aureus subsp. aureus N315
uguaaagcaugaauagcuug

SEQ ID NO: 2144729 - RNA, 16 nt, Staphylococcus aureus subsp. aureus N315
ugguucaucaaacaac

SEQ ID NO: 2144730 - RNA, 17 nt, Staphylococcus aureus subsp. aureus N315
ugguucaucaaacaaca

SEQ ID NO: 2144731 - RNA, 20 nt, Staphylococcus aureus subsp. aureus N315
ugguucauaaugaucaagua

SEQ ID NO: 2144732 - RNA, 22 nt, Staphylococcus aureus subsp. aureus N315
uguaaaacauucccuuaauaau

SEQ ID NO: 2144733 - RNA, 22 nt, Staphylococcus aureus subsp. aureus N315
uguaaaaccuuacccaaaaaau

SEQ ID NO: 2144734 - RNA, 17 nt, Staphylococcus aureus subsp. aureus N315
ugguuauuaaaauuaaa

SEQ ID NO: 2144735 - RNA, 16 nt, Staphylococcus aureus subsp. aureus N315
ugguucaaaaaucaua

SEQ ID NO: 2144736 - RNA, 19 nt, Staphylococcus aureus subsp. aureus N315
uguaaaacuaaguuauuua

SEQ ID NO: 2144737 - RNA, 12 nt, Staphylococcus aureus subsp. aureus N315
uguaaaaugcuc

SEQ ID NO: 2144738 - RNA, 19 nt, Staphylococcus aureus subsp. aureus N315
uguaaacaugguuuucuuu

SEQ ID NO: 2144739 - RNA, 14 nt, Staphylococcus aureus subsp. aureus N315
uguaaaauuaaaug

SEQ ID NO: 2144740 - RNA, 11 nt, Staphylococcus aureus subsp. aureus N315
uguaaagacac

SEQ ID NO: 2144741 - RNA, 18 nt, Staphylococcus aureus subsp. aureus N315
uguaaacuucuuuucuuu

SEQ ID NO: 2144742 - RNA, 21 nt, Staphylococcus aureus subsp. aureus N315
uguaguuaagauaccuuuuuc

SEQ ID NO: 2144743 - RNA, 21 nt, Staphylococcus aureus subsp. aureus N315
uguauaaaagauauaaacauu

SEQ ID NO: 2144744 - RNA, 16 nt, Staphylococcus aureus subsp. aureus N315
uguauaaaacagaauu

SEQ ID NO: 2144745 - RNA, 13 nt, Staphylococcus aureus subsp. aureus N315
uguauaaauguca

SEQ ID NO: 2144746 - RNA, 14 nt, Staphylococcus aureus subsp. aureus N315
uguauaaauaauaa

SEQ ID NO: 2144747 - RNA, 16 nt, Staphylococcus aureus subsp. aureus N315
uguaguacuauaguca

SEQ ID NO: 2144748 - RNA, 21 nt, Staphylococcus aureus subsp. aureus N315
uguagugcgcuuauuuuacua

SEQ ID NO: 2144749 - RNA, 22 nt, Staphylococcus aureus subsp. aureus N315
uguaguaguuccguugaauuaa

SEQ ID NO: 2144750 - RNA, 18 nt, Staphylococcus aureus subsp. aureus N315
uguaggcuuuuuuauuau

SEQ ID NO: 2144751 - RNA, 12 nt, Staphylococcus aureus subsp. aureus N315
uguagcuccuaa

SEQ ID NO: 2144752 - RNA, 18 nt, Staphylococcus aureus subsp. aureus N315
uguaggaagaccacuauu

SEQ ID NO: 2144753 - RNA, 22 nt, Staphylococcus aureus subsp. aureus N315
uguaggaagaccacuauuuuua

SEQ ID NO: 2144754 - RNA, 12 nt, Staphylococcus aureus subsp. aureus N315
uguagagaugug

SEQ ID NO: 2144755 - RNA, 22 nt, Staphylococcus aureus subsp. aureus N315
uguagacaauuguaguaaugaa

SEQ ID NO: 2144756 - RNA, 20 nt, Staphylococcus aureus subsp. aureus N315
uguauaugaauuuuauaaau

SEQ ID NO: 2144757 - RNA, 17 nt, Staphylococcus aureus subsp. aureus N315
uguauagauuguauuua

SEQ ID NO: 2144758 - RNA, 14 nt, Staphylococcus aureus subsp. aureus N315
uguauaacauuauu

SEQ ID NO: 2144759 - RNA, 15 nt, Staphylococcus aureus subsp. aureus N315
uguauauggcauuaa

SEQ ID NO: 2144760 - RNA, 15 nt, Staphylococcus aureus subsp. aureus N315
uguauauucuuuuua

SEQ ID NO: 2144761 - RNA, 17 nt, Staphylococcus aureus subsp. aureus N315
uguauauuuaacaucaa

SEQ ID NO: 2144762 - RNA, 19 nt, Staphylococcus aureus subsp. aureus N315
uguaucaagaucaacaaug

SEQ ID NO: 2144763 - RNA, 17 nt, Staphylococcus aureus subsp. aureus N315
uguaucaucauaaucaa

SEQ ID NO: 2144764 - RNA, 18 nt, Staphylococcus aureus subsp. aureus N315
uguauauuuaacaucaau

SEQ ID NO: 2144765 - RNA, 18 nt, Staphylococcus aureus subsp. aureus N315
uguauucauuuuaaauuu

SEQ ID NO: 2144766 - RNA, 21 nt, Staphylococcus aureus subsp. aureus N315
uguauuauugaaacuaauaau

SEQ ID NO: 2144767 - RNA, 12 nt, Staphylococcus aureus subsp. aureus N315
uguauuuauuac

SEQ ID NO: 2144768 - RNA, 14 nt, Staphylococcus aureus subsp. aureus N315
uguauggcauaacc

SEQ ID NO: 2144769 - RNA, 20 nt, Staphylococcus aureus subsp. aureus N315
uguaucucugaaaaacuucu

SEQ ID NO: 2144770 - RNA, 13 nt, Staphylococcus aureus subsp. aureus N315
uguauuuuucuua

SEQ ID NO: 2144771 - RNA, 14 nt, Staphylococcus aureus subsp. aureus N315
uguauuuuucaaau

SEQ ID NO: 2144772 - RNA, 23 nt, Staphylococcus aureus subsp. aureus N315
ugucacauguaccacauuuuccu

SEQ ID NO: 2144773 - RNA, 21 nt, Staphylococcus aureus subsp. aureus N315
uguauuuuaacgucauuuuua

SEQ ID NO: 2144774 - RNA, 20 nt, Staphylococcus aureus subsp. aureus N315
uguauuuuaacgucauuuuu

SEQ ID NO: 2144775 - RNA, 16 nt, Staphylococcus aureus subsp. aureus N315
ugguaaaaaugaacca

SEQ ID NO: 2144776 - RNA, 17 nt, Staphylococcus aureus subsp. aureus N315
ugguaaaucaugacaua

SEQ ID NO: 2144777 - RNA, 13 nt, Staphylococcus aureus subsp. aureus N315
ugguauuaauuac

SEQ ID NO: 2144778 - RNA, 22 nt, Staphylococcus aureus subsp. aureus N315
uggucaccuacagauaaagcuu

SEQ ID NO: 2144779 - RNA, 17 nt, Staphylococcus aureus subsp. aureus N315
ugguauaucgaaaggua

SEQ ID NO: 2144780 - RNA, 19 nt, Staphylococcus aureus subsp. aureus N315
ugguacuacuauccagucc

SEQ ID NO: 2144781 - RNA, 15 nt, Staphylococcus aureus subsp. aureus N315
ugguggaugucaugu

SEQ ID NO: 2144782 - RNA, 16 nt, Staphylococcus aureus subsp. aureus N315
uggugagaaauugaau

SEQ ID NO: 2144783 - RNA, 18 nt, Staphylococcus aureus subsp. aureus N315
uggucuaaagcuuauuaa

SEQ ID NO: 2144784 - RNA, 20 nt, Staphylococcus aureus subsp. aureus N315
uggucuaaagcuuauuaaau

SEQ ID NO: 2144785 - RNA, 14 nt, Staphylococcus aureus subsp. aureus N315
uggucuauuuuaua

SEQ ID NO: 2144786 - RNA, 17 nt, Staphylococcus aureus subsp. aureus N315
uggucuauuuuauaaaa

SEQ ID NO: 2144787 - RNA, 14 nt, Staphylococcus aureus subsp. aureus N315
uggguaauguuuuu

SEQ ID NO: 2144788 - RNA, 15 nt, Staphylococcus aureus subsp. aureus N315
ugggcguucugcuaa

SEQ ID NO: 2144789 - RNA, 18 nt, Staphylococcus aureus subsp. aureus N315
uggggcccacaccccaac

SEQ ID NO: 2144790 - RNA, 17 nt, Staphylococcus aureus subsp. aureus N315
uggggcccacaccccaa

SEQ ID NO: 2144791 - RNA, 21 nt, Staphylococcus aureus subsp. aureus N315
ugggcaggugacuuuccuaau

SEQ ID NO: 2144792 - RNA, 19 nt, Staphylococcus aureus subsp. aureus N315
uggcuuuuuuuauggugug

SEQ ID NO: 2144793 - RNA, 18 nt, Staphylococcus aureus subsp. aureus N315
ugggauauagaaaaggga

SEQ ID NO: 2144794 - RNA, 13 nt, Staphylococcus aureus subsp. aureus N315
uggcuuuuuuaau

SEQ ID NO: 2144795 - RNA, 21 nt, Staphylococcus aureus subsp. aureus N315
uggcuuuuuauaccaauaauu

SEQ ID NO: 2144796 - RNA, 18 nt, Staphylococcus aureus subsp. aureus N315
uggcuuuuuuauuuuaua

SEQ ID NO: 2144797 - RNA, 21 nt, Staphylococcus aureus subsp. aureus N315
uggcuuuuuaauuguuuaaua

SEQ ID NO: 2144798 - RNA, 14 nt, Staphylococcus aureus subsp. aureus N315
ucuggcacauuacu

SEQ ID NO: 2144799 - RNA, 14 nt, Staphylococcus aureus subsp. aureus N315
ucugcuucuuuuaa

SEQ ID NO: 2144800 - RNA, 16 nt, Staphylococcus aureus subsp. aureus N315
ucugcuuuauuuuauc

SEQ ID NO: 2144801 - RNA, 11 nt, Staphylococcus aureus subsp. aureus N315
ucugcuuuauu

SEQ ID NO: 2144802 - RNA, 12 nt, Staphylococcus aureus subsp. aureus N315
ucuguacuucua

SEQ ID NO: 2144803 - RNA, 20 nt, Staphylococcus aureus subsp. aureus N315
ucuguacguuuuaaauaaau

SEQ ID NO: 2144804 - RNA, 22 nt, Staphylococcus aureus subsp. aureus N315
ucugguauuuuaugacguaauu

SEQ ID NO: 2144805 - RNA, 21 nt, Staphylococcus aureus subsp. aureus N315
ucuguauccucgguauuuaau

SEQ ID NO: 2144806 - RNA, 11 nt, Staphylococcus aureus subsp. aureus N315
ucuuaaaacaa

SEQ ID NO: 2144807 - RNA, 20 nt, Staphylococcus aureus subsp. aureus N315
ucuguugaagucaauaauuu

SEQ ID NO: 2144808 - RNA, 19 nt, Staphylococcus aureus subsp. aureus N315
ucugcaugggcuucugcua

SEQ ID NO: 2144809 - RNA, 18 nt, Staphylococcus aureus subsp. aureus N315
ucugauuucacuucuaaa

SEQ ID NO: 2144810 - RNA, 22 nt, Staphylococcus aureus subsp. aureus N315
ucugauucuucacuaaaaauau

SEQ ID NO: 2144811 - RNA, 17 nt, Staphylococcus aureus subsp. aureus N315
ucugauucuucacuaaa

SEQ ID NO: 2144812 - RNA, 23 nt, Staphylococcus aureus subsp. aureus N315
ucugauuucacuucuaaaacuaa

SEQ ID NO: 2144813 - RNA, 15 nt, Staphylococcus aureus subsp. aureus N315
ucugcccugcaaugc

SEQ ID NO: 2144814 - RNA, 19 nt, Staphylococcus aureus subsp. aureus N315
ucugaacauaaaaaauacu

SEQ ID NO: 2144815 - RNA, 20 nt, Staphylococcus aureus subsp. aureus N315
ucucgcuaaauuuauauagu

SEQ ID NO: 2144816 - RNA, 18 nt, Staphylococcus aureus subsp. aureus N315
ucugaaacuuuaauacua

SEQ ID NO: 2144817 - RNA, 19 nt, Staphylococcus aureus subsp. aureus N315
ucugaaacuuuaauacuac

SEQ ID NO: 2144818 - RNA, 13 nt, Staphylococcus aureus subsp. aureus N315
ucuccuuuuuuaa

SEQ ID NO: 2144819 - RNA, 19 nt, Staphylococcus aureus subsp. aureus N315
ucucgcauacugucaucuu

SEQ ID NO: 2144820 - RNA, 23 nt, Staphylococcus aureus subsp. aureus N315
ucucgcauacugucaucuuucaa

SEQ ID NO: 2144821 - RNA, 20 nt, Staphylococcus aureus subsp. aureus N315
ucugaugucgaaaauagcua

SEQ ID NO: 2144822 - RNA, 14 nt, Staphylococcus aureus subsp. aureus N315
ucugauguguuaug

SEQ ID NO: 2144823 - RNA, 22 nt, Staphylococcus aureus subsp. aureus N315
ucugauacuucaccaucuuuaa

SEQ ID NO: 2144824 - RNA, 19 nt, Staphylococcus aureus subsp. aureus N315
ucugauaauucgaaaucaa

SEQ ID NO: 2144825 - RNA, 20 nt, Staphylococcus aureus subsp. aureus N315
ucugacauuguugcuaaucu

SEQ ID NO: 2144826 - RNA, 13 nt, Staphylococcus aureus subsp. aureus N315
ucuucuuuuaaua

SEQ ID NO: 2144827 - RNA, 19 nt, Staphylococcus aureus subsp. aureus N315
ucuucuuuuuguccccagc

SEQ ID NO: 2144828 - RNA, 19 nt, Staphylococcus aureus subsp. aureus N315
ucuugagcaaugucuuuaa

SEQ ID NO: 2144829 - RNA, 13 nt, Staphylococcus aureus subsp. aureus N315
ucuugauauucau

SEQ ID NO: 2144830 - RNA, 14 nt, Staphylococcus aureus subsp. aureus N315
ucuugauaaaauaa

SEQ ID NO: 2144831 - RNA, 15 nt, Staphylococcus aureus subsp. aureus N315
ucuugaugaauuaaa

SEQ ID NO: 2144832 - RNA, 15 nt, Staphylococcus aureus subsp. aureus N315
ucuugauuauauuuu

SEQ ID NO: 2144833 - RNA, 19 nt, Staphylococcus aureus subsp. aureus N315
ucuugauuauauuuuucuu

SEQ ID NO: 2144834 - RNA, 17 nt, Staphylococcus aureus subsp. aureus N315
ucuuuagauugaucagc

SEQ ID NO: 2144835 - RNA, 16 nt, Staphylococcus aureus subsp. aureus N315
ucuuuacuaaagauag

SEQ ID NO: 2144836 - RNA, 18 nt, Staphylococcus aureus subsp. aureus N315
ucuuuacuuguaauuaau

SEQ ID NO: 2144837 - RNA, 16 nt, Staphylococcus aureus subsp. aureus N315
ucuuuaccauauaauu

SEQ ID NO: 2144838 - RNA, 20 nt, Staphylococcus aureus subsp. aureus N315
ucuuuaaacucguaaauuuu

SEQ ID NO: 2144839 - RNA, 21 nt, Staphylococcus aureus subsp. aureus N315
ucuuuaaagaaaauuucagua

SEQ ID NO: 2144840 - RNA, 19 nt, Staphylococcus aureus subsp. aureus N315
ucuuuaaagaaaauuucag

SEQ ID NO: 2144841 - RNA, 22 nt, Staphylococcus aureus subsp. aureus N315
ucuugguucagcuuuacguucu

SEQ ID NO: 2144842 - RNA, 20 nt, Staphylococcus aureus subsp. aureus N315
ucuugucauuucaaucauuu

SEQ ID NO: 2144843 - RNA, 14 nt, Staphylococcus aureus subsp. aureus N315
ucuugauuguaaau

SEQ ID NO: 2144844 - RNA, 13 nt, Staphylococcus aureus subsp. aureus N315
ucuugauuuaaac

SEQ ID NO: 2144845 - RNA, 16 nt, Staphylococcus aureus subsp. aureus N315
ucuugcaauagcaaca

SEQ ID NO: 2144846 - RNA, 15 nt, Staphylococcus aureus subsp. aureus N315
ucuugcaaguauuuu

SEQ ID NO: 2144847 - RNA, 13 nt, Staphylococcus aureus subsp. aureus N315
ucuucuaauucug

SEQ ID NO: 2144848 - RNA, 17 nt, Staphylococcus aureus subsp. aureus N315
ucuucuaauucugaaau

SEQ ID NO: 2144849 - RNA, 20 nt, Staphylococcus aureus subsp. aureus N315
ucuucuauuaaacauuuuug

SEQ ID NO: 2144850 - RNA, 23 nt, Staphylococcus aureus subsp. aureus N315
ucuucuauuaaacauuuuugaau

SEQ ID NO: 2144851 - RNA, 15 nt, Staphylococcus aureus subsp. aureus N315
ucuucucauaaaaua

SEQ ID NO: 2144852 - RNA, 13 nt, Staphylococcus aureus subsp. aureus N315
ucuucgucaaauu

SEQ ID NO: 2144853 - RNA, 16 nt, Staphylococcus aureus subsp. aureus N315
ucuucuaaaucaauau

SEQ ID NO: 2144854 - RNA, 17 nt, Staphylococcus aureus subsp. aureus N315
ucuucaggugauucauu

SEQ ID NO: 2144855 - RNA, 13 nt, Staphylococcus aureus subsp. aureus N315
ucuucaguuauuu

SEQ ID NO: 2144856 - RNA, 14 nt, Staphylococcus aureus subsp. aureus N315
ucuuaauguacuuu

SEQ ID NO: 2144857 - RNA, 21 nt, Staphylococcus aureus subsp. aureus N315
ucuuaaucgagugauucagga

SEQ ID NO: 2144858 - RNA, 13 nt, Staphylococcus aureus subsp. aureus N315
ucuuaaguacaua

SEQ ID NO: 2144859 - RNA, 14 nt, Staphylococcus aureus subsp. aureus N315
ucuucauuuucauu

SEQ ID NO: 2144860 - RNA, 15 nt, Staphylococcus aureus subsp. aureus N315
ucuuccaaucaacuu

SEQ ID NO: 2144861 - RNA, 23 nt, Staphylococcus aureus subsp. aureus N315
ucgucuucuuuuuguccccagcc

SEQ ID NO: 2144862 - RNA, 21 nt, Staphylococcus aureus subsp. aureus N315
ucgucuuguaaacuucuuuuc

SEQ ID NO: 2144863 - RNA, 13 nt, Staphylococcus aureus subsp. aureus N315
ucgucauuaugug

SEQ ID NO: 2144864 - RNA, 16 nt, Staphylococcus aureus subsp. aureus N315
ucgguucaucuaaaau

SEQ ID NO: 2144865 - RNA, 15 nt, Staphylococcus aureus subsp. aureus N315
ucgguuuauuuaaua

SEQ ID NO: 2144866 - RNA, 13 nt, Staphylococcus aureus subsp. aureus N315
ucguacuuucaaa

SEQ ID NO: 2144867 - RNA, 14 nt, Staphylococcus aureus subsp. aureus N315
ucguacuuucaaau

SEQ ID NO: 2144868 - RNA, 20 nt, Staphylococcus aureus subsp. aureus N315
ucgucacauauaaauauuuu

SEQ ID NO: 2144869 - RNA, 15 nt, Staphylococcus aureus subsp. aureus N315
ucgucaauuuuaaug

SEQ ID NO: 2144870 - RNA, 13 nt, Staphylococcus aureus subsp. aureus N315
ucguauuucauau

SEQ ID NO: 2144871 - RNA, 13 nt, Staphylococcus aureus subsp. aureus N315
ucguauuuuuaag

SEQ ID NO: 2144872 - RNA, 19 nt, Staphylococcus aureus subsp. aureus N315
ucguauuuuucuuggaauu

SEQ ID NO: 2144873 - RNA, 13 nt, Staphylococcus aureus subsp. aureus N315
ucgucaaauucaa

SEQ ID NO: 2144874 - RNA, 18 nt, Staphylococcus aureus subsp. aureus N315
ucguugaaaaauauccug

SEQ ID NO: 2144875 - RNA, 18 nt, Staphylococcus aureus subsp. aureus N315
ucguuaaaacacccugcu

SEQ ID NO: 2144876 - RNA, 15 nt, Staphylococcus aureus subsp. aureus N315
ucguguuccaauuuu

SEQ ID NO: 2144877 - RNA, 18 nt, Staphylococcus aureus subsp. aureus N315
ucguuugaauuauuuaau

SEQ ID NO: 2144878 - RNA, 21 nt, Staphylococcus aureus subsp. aureus N315
ucguuuugcuaaccaucauaa

SEQ ID NO: 2144879 - RNA, 18 nt, Staphylococcus aureus subsp. aureus N315
ucguuuugcuaaccauca

SEQ ID NO: 2144880 - RNA, 14 nt, Staphylococcus aureus subsp. aureus N315
ucuaaccacuucuu

SEQ ID NO: 2144881 - RNA, 16 nt, Staphylococcus aureus subsp. aureus N315
ucuaacagcuuaauuu

SEQ ID NO: 2144882 - RNA, 20 nt, Staphylococcus aureus subsp. aureus N315
ucuaaauucuuuuuguucgg

SEQ ID NO: 2144883 - RNA, 23 nt, Staphylococcus aureus subsp. aureus N315
ucuaacaccugauugacaaugua

SEQ ID NO: 2144884 - RNA, 17 nt, Staphylococcus aureus subsp. aureus N315
ucuaaagcuauaaaaaa

SEQ ID NO: 2144885 - RNA, 15 nt, Staphylococcus aureus subsp. aureus N315
ucuaaagcuauaaaa

SEQ ID NO: 2144886 - RNA, 16 nt, Staphylococcus aureus subsp. aureus N315
ucuaaagcuauaaaaa

SEQ ID NO: 2144887 - RNA, 18 nt, Staphylococcus aureus subsp. aureus N315
ucuaaacuucuauuaaua

SEQ ID NO: 2144888 - RNA, 21 nt, Staphylococcus aureus subsp. aureus N315
ucuaaacuucuauuaauaauu

SEQ ID NO: 2144889 - RNA, 17 nt, Staphylococcus aureus subsp. aureus N315
ucuaaacuucuauuaau

SEQ ID NO: 2144890 - RNA, 23 nt, Staphylococcus aureus subsp. aureus N315
ucuaaaauaaaacgugcaaauaa

SEQ ID NO: 2144891 - RNA, 13 nt, Staphylococcus aureus subsp. aureus N315
ucuaaacaauucc

SEQ ID NO: 2144892 - RNA, 19 nt, Staphylococcus aureus subsp. aureus N315
ucuaaaccuuuuuuaaguu

SEQ ID NO: 2144893 - RNA, 16 nt, Staphylococcus aureus subsp. aureus N315
ucuaaaacuuuuucaa

SEQ ID NO: 2144894 - RNA, 11 nt, Staphylococcus aureus subsp. aureus N315
ucuaaaaguug

SEQ ID NO: 2144895 - RNA, 21 nt, Staphylococcus aureus subsp. aureus N315
ucuaaaaguuguaauuuaaaa

SEQ ID NO: 2144896 - RNA, 12 nt, Staphylococcus aureus subsp. aureus N315
ucuaaaauaacu

SEQ ID NO: 2144897 - RNA, 22 nt, Staphylococcus aureus subsp. aureus N315
ucuacaauauuaaaauuaaaac

SEQ ID NO: 2144898 - RNA, 18 nt, Staphylococcus aureus subsp. aureus N315
ucuacaauauuaaaauua

SEQ ID NO: 2144899 - RNA, 19 nt, Staphylococcus aureus subsp. aureus N315
ucuacaauauuaaaauuaa

SEQ ID NO: 2144900 - RNA, 19 nt, Staphylococcus aureus subsp. aureus N315
ucuaaugcucauuaauggu

SEQ ID NO: 2144901 - RNA, 21 nt, Staphylococcus aureus subsp. aureus N315
ucuaauucaaugauuuuuaaa

SEQ ID NO: 2144902 - RNA, 13 nt, Staphylococcus aureus subsp. aureus N315
ucuaauucguaau

SEQ ID NO: 2144903 - RNA, 12 nt, Staphylococcus aureus subsp. aureus N315
ucuaaccaucuc

SEQ ID NO: 2144904 - RNA, 20 nt, Staphylococcus aureus subsp. aureus N315
ucuaauacuuucaaacaaau

SEQ ID NO: 2144905 - RNA, 15 nt, Staphylococcus aureus subsp. aureus N315
ucuaauacuuucacu

SEQ ID NO: 2144906 - RNA, 13 nt, Staphylococcus aureus subsp. aureus N315
ucuaauauuuugg

SEQ ID NO: 2144907 - RNA, 15 nt, Staphylococcus aureus subsp. aureus N315
ucuacccuugcaaau

SEQ ID NO: 2144908 - RNA, 23 nt, Staphylococcus aureus subsp. aureus N315
ucuacacccauuugucuuaauuu

SEQ ID NO: 2144909 - RNA, 12 nt, Staphylococcus aureus subsp. aureus N315
ucuacagcacug

SEQ ID NO: 2144910 - RNA, 22 nt, Staphylococcus aureus subsp. aureus N315
ucuaccaauaauucccuaggaa

SEQ ID NO: 2144911 - RNA, 18 nt, Staphylococcus aureus subsp. aureus N315
ucuacgaucaaaaucaug

SEQ ID NO: 2144912 - RNA, 13 nt, Staphylococcus aureus subsp. aureus N315
ucuacuaaaaaug

SEQ ID NO: 2144913 - RNA, 16 nt, Staphylococcus aureus subsp. aureus N315
ucuacucaaauauaaa

SEQ ID NO: 2144914 - RNA, 18 nt, Staphylococcus aureus subsp. aureus N315
ucuacuauuuaaucuuaa

SEQ ID NO: 2144915 - RNA, 14 nt, Staphylococcus aureus subsp. aureus N315
ucuacuauuuuuuc

SEQ ID NO: 2144916 - RNA, 23 nt, Staphylococcus aureus subsp. aureus N315
ucuauaccauuccaaaaauugua

SEQ ID NO: 2144917 - RNA, 15 nt, Staphylococcus aureus subsp. aureus N315
ucuauaauuugugug

SEQ ID NO: 2144918 - RNA, 14 nt, Staphylococcus aureus subsp. aureus N315
ucuauacaacagua

SEQ ID NO: 2144919 - RNA, 22 nt, Staphylococcus aureus subsp. aureus N315
ucuauaccauuccaaaaauugu

SEQ ID NO: 2144920 - RNA, 12 nt, Staphylococcus aureus subsp. aureus N315
ucuauaaauauc

SEQ ID NO: 2144921 - RNA, 20 nt, Staphylococcus aureus subsp. aureus N315
ucuauaaauaucaauaauuc

SEQ ID NO: 2144922 - RNA, 13 nt, Staphylococcus aureus subsp. aureus N315
ucuauaaauacuu

SEQ ID NO: 2144923 - RNA, 18 nt, Staphylococcus aureus subsp. aureus N315
ucuauaaauagaauuuuu

SEQ ID NO: 2144924 - RNA, 18 nt, Staphylococcus aureus subsp. aureus N315
ucuauaacaaaaucucaa

SEQ ID NO: 2144925 - RNA, 22 nt, Staphylococcus aureus subsp. aureus N315
ucuaguacaccucuaaguucac

SEQ ID NO: 2144926 - RNA, 20 nt, Staphylococcus aureus subsp. aureus N315
ucuaguagcuagaacagaua

SEQ ID NO: 2144927 - RNA, 19 nt, Staphylococcus aureus subsp. aureus N315
ucuaguucgaacacacacu

SEQ ID NO: 2144928 - RNA, 17 nt, Staphylococcus aureus subsp. aureus N315
ucuacuuaguaauaaga

SEQ ID NO: 2144929 - RNA, 21 nt, Staphylococcus aureus subsp. aureus N315
ucuagauucauauuuauauuu

SEQ ID NO: 2144930 - RNA, 15 nt, Staphylococcus aureus subsp. aureus N315
ucuagauuauuuaaa

SEQ ID NO: 2144931 - RNA, 15 nt, Staphylococcus aureus subsp. aureus N315
ucuagauucauauuu

SEQ ID NO: 2144932 - RNA, 24 nt, Staphylococcus aureus subsp. aureus N315
ucuagacuuauuugaaugcaaauc

SEQ ID NO: 2144933 - RNA, 16 nt, Staphylococcus aureus subsp. aureus N315
ucuauauaauuuauuu

SEQ ID NO: 2144934 - RNA, 13 nt, Staphylococcus aureus subsp. aureus N315
ucuauauuuaauu

SEQ ID NO: 2144935 - RNA, 16 nt, Staphylococcus aureus subsp. aureus N315
ucuauaugcauauauu

SEQ ID NO: 2144936 - RNA, 21 nt, Staphylococcus aureus subsp. aureus N315
ucuauacuauuccguuucauu

SEQ ID NO: 2144937 - RNA, 17 nt, Staphylococcus aureus subsp. aureus N315
ucuauagaauuuuucau

SEQ ID NO: 2144938 - RNA, 20 nt, Staphylococcus aureus subsp. aureus N315
ucuauagaauuuuucauaua

SEQ ID NO: 2144939 - RNA, 14 nt, Staphylococcus aureus subsp. aureus N315
ucuauagaauuuuu

SEQ ID NO: 2144940 - RNA, 21 nt, Staphylococcus aureus subsp. aureus N315
ucuauauaaaguugacaauac

SEQ ID NO: 2144941 - RNA, 19 nt, Staphylococcus aureus subsp. aureus N315
ucuauauaaauguuuauau

SEQ ID NO: 2144942 - RNA, 18 nt, Staphylococcus aureus subsp. aureus N315
ucuauagguuuauaaaaa

SEQ ID NO: 2144943 - RNA, 18 nt, Staphylococcus aureus subsp. aureus N315
ucuauauuaauaaucuuc

SEQ ID NO: 2144944 - RNA, 18 nt, Staphylococcus aureus subsp. aureus N315
ucuauauuuaauuuugau

SEQ ID NO: 2144945 - RNA, 14 nt, Staphylococcus aureus subsp. aureus N315
ucuaucgccuaaaa

SEQ ID NO: 2144946 - RNA, 17 nt, Staphylococcus aureus subsp. aureus N315
ucuaucgccuaaaaaua

SEQ ID NO: 2144947 - RNA, 21 nt, Staphylococcus aureus subsp. aureus N315
ucuaucgccuaaaaauaaaau

SEQ ID NO: 2144948 - RNA, 14 nt, Staphylococcus aureus subsp. aureus N315
ucuauccuucaaaa

SEQ ID NO: 2144949 - RNA, 21 nt, Staphylococcus aureus subsp. aureus N315
ucuaucguuguguauuguuug

SEQ ID NO: 2144950 - RNA, 19 nt, Staphylococcus aureus subsp. aureus N315
ucuaucuacucaaauauaa

SEQ ID NO: 2144951 - RNA, 17 nt, Staphylococcus aureus subsp. aureus N315
ucuaucuauaaacguca

SEQ ID NO: 2144952 - RNA, 13 nt, Staphylococcus aureus subsp. aureus N315
ucuaugauuguau

SEQ ID NO: 2144953 - RNA, 14 nt, Staphylococcus aureus subsp. aureus N315
ucuaugaaauuuuu

SEQ ID NO: 2144954 - RNA, 16 nt, Staphylococcus aureus subsp. aureus N315
ucuaugaaauuuuuua

SEQ ID NO: 2144955 - RNA, 15 nt, Staphylococcus aureus subsp. aureus N315
ucuauucaaaaaggu

SEQ ID NO: 2144956 - RNA, 23 nt, Staphylococcus aureus subsp. aureus N315
ucuauuauauugaauugaaaaau

SEQ ID NO: 2144957 - RNA, 16 nt, Staphylococcus aureus subsp. aureus N315
ucuauggaaaauguua

SEQ ID NO: 2144958 - RNA, 13 nt, Staphylococcus aureus subsp. aureus N315
ucuauuaauaauu

SEQ ID NO: 2144959 - RNA, 21 nt, Staphylococcus aureus subsp. aureus N315
ucucaacaaaucuauaaauau

SEQ ID NO: 2144960 - RNA, 15 nt, Staphylococcus aureus subsp. aureus N315
ucucaacagcaaaaa

SEQ ID NO: 2144961 - RNA, 18 nt, Staphylococcus aureus subsp. aureus N315
ucucaaauuaaaucaccu

SEQ ID NO: 2144962 - RNA, 22 nt, Staphylococcus aureus subsp. aureus N315
ucucaaagguuuacuauuaaag

SEQ ID NO: 2144963 - RNA, 14 nt, Staphylococcus aureus subsp. aureus N315
ucuauuuuugauuu

SEQ ID NO: 2144964 - RNA, 13 nt, Staphylococcus aureus subsp. aureus N315
ucuauuuaauaau

SEQ ID NO: 2144965 - RNA, 22 nt, Staphylococcus aureus subsp. aureus N315
ucuauuucacucuacaauccua

SEQ ID NO: 2144966 - RNA, 17 nt, Staphylococcus aureus subsp. aureus N315
ucuauuuuauaaaauau

SEQ ID NO: 2144967 - RNA, 12 nt, Staphylococcus aureus subsp. aureus N315
ucuauuuuauga

SEQ ID NO: 2144968 - RNA, 16 nt, Staphylococcus aureus subsp. aureus N315
ucucacuuaauaaaua

SEQ ID NO: 2144969 - RNA, 23 nt, Staphylococcus aureus subsp. aureus N315
ucucaccagcucguuuuuucauu

SEQ ID NO: 2144970 - RNA, 16 nt, Staphylococcus aureus subsp. aureus N315
ucuccguauuuaccuu

SEQ ID NO: 2144971 - RNA, 21 nt, Staphylococcus aureus subsp. aureus N315
ucucagcaauacuaacugaag

SEQ ID NO: 2144972 - RNA, 19 nt, Staphylococcus aureus subsp. aureus N315
ucucauaucuauuuuucga

SEQ ID NO: 2144973 - RNA, 15 nt, Staphylococcus aureus subsp. aureus N315
ucucaucauuuaaaa

SEQ ID NO: 2144974 - RNA, 19 nt, Staphylococcus aureus subsp. aureus N315
ucucaucauuuucaauacu

SEQ ID NO: 2144975 - RNA, 16 nt, Staphylococcus aureus subsp. aureus N315
uccgcuuguucaacua

SEQ ID NO: 2144976 - RNA, 16 nt, Staphylococcus aureus subsp. aureus N315
uccgcacugccuuuuu

SEQ ID NO: 2144977 - RNA, 21 nt, Staphylococcus aureus subsp. aureus N315
uccgcacugccuuuuuguaau

SEQ ID NO: 2144978 - RNA, 13 nt, Staphylococcus aureus subsp. aureus N315
uccgcauaaauua

SEQ ID NO: 2144979 - RNA, 14 nt, Staphylococcus aureus subsp. aureus N315
uccggcugaaggga

SEQ ID NO: 2144980 - RNA, 14 nt, Staphylococcus aureus subsp. aureus N315
uccggggccccaac

SEQ ID NO: 2144981 - RNA, 14 nt, Staphylococcus aureus subsp. aureus N315
uccgugauaaauug

SEQ ID NO: 2144982 - RNA, 23 nt, Staphylococcus aureus subsp. aureus N315
uccgucgaauauaauuuuuugac

SEQ ID NO: 2144983 - RNA, 23 nt, Staphylococcus aureus subsp. aureus N315
uccguugaauuaacaauauuaaa

SEQ ID NO: 2144984 - RNA, 18 nt, Staphylococcus aureus subsp. aureus N315
uccguuaaaauuuuaauu

SEQ ID NO: 2144985 - RNA, 15 nt, Staphylococcus aureus subsp. aureus N315
uccguuaauuauaau

SEQ ID NO: 2144986 - RNA, 13 nt, Staphylococcus aureus subsp. aureus N315
uccuacugcuguc

SEQ ID NO: 2144987 - RNA, 17 nt, Staphylococcus aureus subsp. aureus N315
uccuaauucuugagcaa

SEQ ID NO: 2144988 - RNA, 16 nt, Staphylococcus aureus subsp. aureus N315
uccuaaauuauaaaua

SEQ ID NO: 2144989 - RNA, 14 nt, Staphylococcus aureus subsp. aureus N315
uccuaaauuauugu

SEQ ID NO: 2144990 - RNA, 18 nt, Staphylococcus aureus subsp. aureus N315
uccuaagcaucguaaaaa

SEQ ID NO: 2144991 - RNA, 19 nt, Staphylococcus aureus subsp. aureus N315
uccuaagcaucguaaaaaa

SEQ ID NO: 2144992 - RNA, 17 nt, Staphylococcus aureus subsp. aureus N315
uccucauaauuaucaua

SEQ ID NO: 2144993 - RNA, 15 nt, Staphylococcus aureus subsp. aureus N315
uccucauuaauaaau

SEQ ID NO: 2144994 - RNA, 13 nt, Staphylococcus aureus subsp. aureus N315
uccuccaaagcua

SEQ ID NO: 2144995 - RNA, 19 nt, Staphylococcus aureus subsp. aureus N315
uccuauuacuacauaauuu

SEQ ID NO: 2144996 - RNA, 16 nt, Staphylococcus aureus subsp. aureus N315
uccuauuacuacauaa

SEQ ID NO: 2144997 - RNA, 21 nt, Staphylococcus aureus subsp. aureus N315
uccuauggcgcaauuuuuaac

SEQ ID NO: 2144998 - RNA, 14 nt, Staphylococcus aureus subsp. aureus N315
uccucaaauauauu

SEQ ID NO: 2144999 - RNA, 20 nt, Staphylococcus aureus subsp. aureus N315
uccucuauuuuaugauuuga

SEQ ID NO: 2145000 - RNA, 21 nt, Staphylococcus aureus subsp. aureus N315
uccucgguauuuaauguuuua

SEQ ID NO: 2145001 - RNA, 19 nt, Staphylococcus aureus subsp. aureus N315
uccucgguuuuauuuuuau

SEQ ID NO: 2145002 - RNA, 19 nt, Staphylococcus aureus subsp. aureus N315
uccucgguauuuaauguuu

SEQ ID NO: 2145003 - RNA, 16 nt, Staphylococcus aureus subsp. aureus N315
uccugaaauuaacguc

SEQ ID NO: 2145004 - RNA, 22 nt, Staphylococcus aureus subsp. aureus N315
uccugcaaaauguuacacaaau

SEQ ID NO: 2145005 - RNA, 17 nt, Staphylococcus aureus subsp. aureus N315
uccugauacaaugauua

SEQ ID NO: 2145006 - RNA, 23 nt, Staphylococcus aureus subsp. aureus N315
ucgauaacguugccauacccaua

SEQ ID NO: 2145007 - RNA, 23 nt, Staphylococcus aureus subsp. aureus N315
ucgauaaguuuuugaauaucuaa

SEQ ID NO: 2145008 - RNA, 14 nt, Staphylococcus aureus subsp. aureus N315
ucgauaauauaacu

SEQ ID NO: 2145009 - RNA, 17 nt, Staphylococcus aureus subsp. aureus N315
ucgauaccuaaaauacc

SEQ ID NO: 2145010 - RNA, 22 nt, Staphylococcus aureus subsp. aureus N315
ucgauuuuuuaaugucuaaaaa

SEQ ID NO: 2145011 - RNA, 14 nt, Staphylococcus aureus subsp. aureus N315
ucgauuuuuuaaug

SEQ ID NO: 2145012 - RNA, 20 nt, Staphylococcus aureus subsp. aureus N315
ucgauuauucuuaauuuaag

SEQ ID NO: 2145013 - RNA, 15 nt, Staphylococcus aureus subsp. aureus N315
ucgauuaauuuaauu

SEQ ID NO: 2145014 - RNA, 15 nt, Staphylococcus aureus subsp. aureus N315
ucgcagcuucuuuaa

SEQ ID NO: 2145015 - RNA, 22 nt, Staphylococcus aureus subsp. aureus N315
ucgcauucuugguuuuuuagau

SEQ ID NO: 2145016 - RNA, 21 nt, Staphylococcus aureus subsp. aureus N315
ucgcaucguucccugcagcaa

SEQ ID NO: 2145017 - RNA, 20 nt, Staphylococcus aureus subsp. aureus N315
ucgacaucuagaugaaauug

SEQ ID NO: 2145018 - RNA, 19 nt, Staphylococcus aureus subsp. aureus N315
ucgacaucuagaugaaauu

SEQ ID NO: 2145019 - RNA, 17 nt, Staphylococcus aureus subsp. aureus N315
uccuuaaacaaauaaau

SEQ ID NO: 2145020 - RNA, 22 nt, Staphylococcus aureus subsp. aureus N315
uccuuaaaccguauagucauua

SEQ ID NO: 2145021 - RNA, 15 nt, Staphylococcus aureus subsp. aureus N315
ucgaauuaagaaaag

SEQ ID NO: 2145022 - RNA, 15 nt, Staphylococcus aureus subsp. aureus N315
ucgagaggguacacu

SEQ ID NO: 2145023 - RNA, 16 nt, Staphylococcus aureus subsp. aureus N315
ucgcgcucuucuucag

SEQ ID NO: 2145024 - RNA, 19 nt, Staphylococcus aureus subsp. aureus N315
ucgcgaacguuauuuucaa

SEQ ID NO: 2145025 - RNA, 14 nt, Staphylococcus aureus subsp. aureus N315
ucgccuacuauaaa

SEQ ID NO: 2145026 - RNA, 19 nt, Staphylococcus aureus subsp. aureus N315
ucggaaaaagaugaaaaag

SEQ ID NO: 2145027 - RNA, 13 nt, Staphylococcus aureus subsp. aureus N315
ucggaauaaaaua

SEQ ID NO: 2145028 - RNA, 21 nt, Staphylococcus aureus subsp. aureus N315
ucgcuugcaaagacucaauuu

SEQ ID NO: 2145029 - RNA, 17 nt, Staphylococcus aureus subsp. aureus N315
ucgcucauccucauuaa

SEQ ID NO: 2145030 - RNA, 19 nt, Staphylococcus aureus subsp. aureus N315
uccgauuuugauauaaaaa

SEQ ID NO: 2145031 - RNA, 13 nt, Staphylococcus aureus subsp. aureus N315
uccgaucaugccu

SEQ ID NO: 2145032 - RNA, 19 nt, Staphylococcus aureus subsp. aureus N315
uccgauaucuuuuaauucu

SEQ ID NO: 2145033 - RNA, 15 nt, Staphylococcus aureus subsp. aureus N315
uccgaggcuaauuuu

SEQ ID NO: 2145034 - RNA, 21 nt, Staphylococcus aureus subsp. aureus N315
uccgaaaauugcuaaaaaaau

SEQ ID NO: 2145035 - RNA, 15 nt, Staphylococcus aureus subsp. aureus N315
ucccuuuuuaaaaua

SEQ ID NO: 2145036 - RNA, 20 nt, Staphylococcus aureus subsp. aureus N315
ucccuuccuagggugccguc

SEQ ID NO: 2145037 - RNA, 17 nt, Staphylococcus aureus subsp. aureus N315
ucccuuaaauacaauuu

SEQ ID NO: 2145038 - RNA, 11 nt, Staphylococcus aureus subsp. aureus N315
ucccuuaauaa

SEQ ID NO: 2145039 - RNA, 20 nt, Staphylococcus aureus subsp. aureus N315
ucccuuaaauacaauuucuu

SEQ ID NO: 2145040 - RNA, 17 nt, Staphylococcus aureus subsp. aureus N315
ucccuuaauaauaagua

SEQ ID NO: 2145041 - RNA, 21 nt, Staphylococcus aureus subsp. aureus N315
ucccucuaucaaauuaccauu

SEQ ID NO: 2145042 - RNA, 13 nt, Staphylococcus aureus subsp. aureus N315
ucccuacugcuug

SEQ ID NO: 2145043 - RNA, 15 nt, Staphylococcus aureus subsp. aureus N315
ucccgcuuaaaauga

SEQ ID NO: 2145044 - RNA, 21 nt, Staphylococcus aureus subsp. aureus N315
ucccgaaaguuagacuaaaaa

SEQ ID NO: 2145045 - RNA, 18 nt, Staphylococcus aureus subsp. aureus N315
ucccgcauuauuauuaaa

SEQ ID NO: 2145046 - RNA, 15 nt, Staphylococcus aureus subsp. aureus N315
ucccacgugccucau

SEQ ID NO: 2145047 - RNA, 19 nt, Staphylococcus aureus subsp. aureus N315
ucccacgugccucauccuu

SEQ ID NO: 2145048 - RNA, 17 nt, Staphylococcus aureus subsp. aureus N315
ucccaaugcuugaauuu

SEQ ID NO: 2145049 - RNA, 21 nt, Staphylococcus aureus subsp. aureus N315
ucccaaugcugaauaaauaac

SEQ ID NO: 2145050 - RNA, 14 nt, Staphylococcus aureus subsp. aureus N315
ucccaacuuaauaa

SEQ ID NO: 2145051 - RNA, 19 nt, Staphylococcus aureus subsp. aureus N315
uccauuuucuuuuuuuaug

SEQ ID NO: 2145052 - RNA, 15 nt, Staphylococcus aureus subsp. aureus N315
uccauuuaucaacaa

SEQ ID NO: 2145053 - RNA, 14 nt, Staphylococcus aureus subsp. aureus N315
uccauuaaucauuu

SEQ ID NO: 2145054 - RNA, 17 nt, Staphylococcus aureus subsp. aureus N315
uccauucguauaagaau

SEQ ID NO: 2145055 - RNA, 19 nt, Staphylococcus aureus subsp. aureus N315
uccaucgucaucacuuuuu

SEQ ID NO: 2145056 - RNA, 22 nt, Staphylococcus aureus subsp. aureus N315
uccaucgucaucacuuuuuaaa

SEQ ID NO: 2145057 - RNA, 19 nt, Staphylococcus aureus subsp. aureus N315
ucccauaaaagacagaaau

SEQ ID NO: 2145058 - RNA, 20 nt, Staphylococcus aureus subsp. aureus N315
ucccagauucauaucuuuca

SEQ ID NO: 2145059 - RNA, 21 nt, Staphylococcus aureus subsp. aureus N315
ucccagauucauaucuuucaa

SEQ ID NO: 2145060 - RNA, 23 nt, Staphylococcus aureus subsp. aureus N315
ucccagauucauaucuuucaauu

SEQ ID NO: 2145061 - RNA, 14 nt, Staphylococcus aureus subsp. aureus N315
ucccauuuuaaagu

SEQ ID NO: 2145062 - RNA, 14 nt, Staphylococcus aureus subsp. aureus N315
ucccauuuuuaaaa

SEQ ID NO: 2145063 - RNA, 17 nt, Staphylococcus aureus subsp. aureus N315
ucccauucuuugaggug

SEQ ID NO: 2145064 - RNA, 17 nt, Staphylococcus aureus subsp. aureus N315
ucccauuggcauuuacg

SEQ ID NO: 2145065 - RNA, 22 nt, Staphylococcus aureus subsp. aureus N315
ucccaucuuuuagguaauaauu

SEQ ID NO: 2145066 - RNA, 21 nt, Staphylococcus aureus subsp. aureus N315
ucccauuaacacgaacugcau

SEQ ID NO: 2145067 - RNA, 17 nt, Staphylococcus aureus subsp. aureus N315
ucccauaacaaaaacau

SEQ ID NO: 2145068 - RNA, 19 nt, Staphylococcus aureus subsp. aureus N315
uccccauuaauuaacaaag

SEQ ID NO: 2145069 - RNA, 14 nt, Staphylococcus aureus subsp. aureus N315
uccaauuucucuau

SEQ ID NO: 2145070 - RNA, 11 nt, Staphylococcus aureus subsp. aureus N315
uccaauuucuc

SEQ ID NO: 2145071 - RNA, 18 nt, Staphylococcus aureus subsp. aureus N315
uccaaucaacuucauaua

SEQ ID NO: 2145072 - RNA, 22 nt, Staphylococcus aureus subsp. aureus N315
uccaaucaucauuaaaucugau

SEQ ID NO: 2145073 - RNA, 15 nt, Staphylococcus aureus subsp. aureus N315
uccaaucuauuaaug

SEQ ID NO: 2145074 - RNA, 17 nt, Staphylococcus aureus subsp. aureus N315
uccaaucuuuuuaauug

SEQ ID NO: 2145075 - RNA, 15 nt, Staphylococcus aureus subsp. aureus N315
uccaauuaaauauuu

SEQ ID NO: 2145076 - RNA, 15 nt, Staphylococcus aureus subsp. aureus N315
uccaauuaccaauga

SEQ ID NO: 2145077 - RNA, 23 nt, Staphylococcus aureus subsp. aureus N315
uccaauucauuuuauaaaucaaa

SEQ ID NO: 2145078 - RNA, 13 nt, Staphylococcus aureus subsp. aureus N315
uccaauucucuua

SEQ ID NO: 2145079 - RNA, 18 nt, Staphylococcus aureus subsp. aureus N315
uccaaggauguuauaaaa

SEQ ID NO: 2145080 - RNA, 19 nt, Staphylococcus aureus subsp. aureus N315
uccaaggauguuauaaaau

SEQ ID NO: 2145081 - RNA, 22 nt, Staphylococcus aureus subsp. aureus N315
uccaaggauguuauaaaaugaa

SEQ ID NO: 2145082 - RNA, 19 nt, Staphylococcus aureus subsp. aureus N315
uccaagugacaacauuauu

SEQ ID NO: 2145083 - RNA, 15 nt, Staphylococcus aureus subsp. aureus N315
uccaagugacaacau

SEQ ID NO: 2145084 - RNA, 17 nt, Staphylococcus aureus subsp. aureus N315
uccaauaauaaaccuaa

SEQ ID NO: 2145085 - RNA, 14 nt, Staphylococcus aureus subsp. aureus N315
uccaauaaugaaau

SEQ ID NO: 2145086 - RNA, 18 nt, Staphylococcus aureus subsp. aureus N315
uccaauaaugaaaugaag

SEQ ID NO: 2145087 - RNA, 19 nt, Staphylococcus aureus subsp. aureus N315
uccaauacuuuuuauauaa

SEQ ID NO: 2145088 - RNA, 16 nt, Staphylococcus aureus subsp. aureus N315
uccaagauuaugacaa

SEQ ID NO: 2145089 - RNA, 18 nt, Staphylococcus aureus subsp. aureus N315
uccagacuccuaaauuau

SEQ ID NO: 2145090 - RNA, 15 nt, Staphylococcus aureus subsp. aureus N315
uccagacuccuaaau

SEQ ID NO: 2145091 - RNA, 17 nt, Staphylococcus aureus subsp. aureus N315
uccacuucaucuaaaug

SEQ ID NO: 2145092 - RNA, 13 nt, Staphylococcus aureus subsp. aureus N315
uccacuuuauaau

SEQ ID NO: 2145093 - RNA, 19 nt, Staphylococcus aureus subsp. aureus N315
uccacuuuuugccuggcaa

SEQ ID NO: 2145094 - RNA, 15 nt, Staphylococcus aureus subsp. aureus N315
uccacgcucacauua

SEQ ID NO: 2145095 - RNA, 22 nt, Staphylococcus aureus subsp. aureus N315
uccaccugauaacgagcuaaua

SEQ ID NO: 2145096 - RNA, 14 nt, Staphylococcus aureus subsp. aureus N315
uccaguauuaacug

SEQ ID NO: 2145097 - RNA, 19 nt, Staphylococcus aureus subsp. aureus N315
uccaguuuauaacugggau

SEQ ID NO: 2145098 - RNA, 23 nt, Staphylococcus aureus subsp. aureus N315
uccaguccuuuuuuuauguuuaa

SEQ ID NO: 2145099 - RNA, 23 nt, Staphylococcus aureus subsp. aureus N315
uccaguggaaaugauaauuuaau

SEQ ID NO: 2145100 - RNA, 22 nt, Staphylococcus aureus subsp. aureus N315
uccaguggaaaugauaauuuaa

SEQ ID NO: 2145101 - RNA, 17 nt, Staphylococcus aureus subsp. aureus N315
uccauauaaccuauuuc

SEQ ID NO: 2145102 - RNA, 23 nt, Staphylococcus aureus subsp. aureus N315
uccauauuuuuuaguaauaacau

SEQ ID NO: 2145103 - RNA, 16 nt, Staphylococcus aureus subsp. aureus N315
uccaucaucucugcuu

SEQ ID NO: 2145104 - RNA, 21 nt, Staphylococcus aureus subsp. aureus N315
uccaucauuuguguaaaugaa

SEQ ID NO: 2145105 - RNA, 23 nt, Staphylococcus aureus subsp. aureus N315
uccaguuuucaauuuauuaacug

SEQ ID NO: 2145106 - RNA, 16 nt, Staphylococcus aureus subsp. aureus N315
uccauaaauaaaaugc

SEQ ID NO: 2145107 - RNA, 17 nt, Staphylococcus aureus subsp. aureus N315
uccauaaauauuaaauu

SEQ ID NO: 2145108 - RNA, 18 nt, Staphylococcus aureus subsp. aureus N315
uccauaaauaaaaugcua

SEQ ID NO: 2145109 - RNA, 20 nt, Staphylococcus aureus subsp. aureus N315
uccauaacuguaguuucuua

SEQ ID NO: 2145110 - RNA, 21 nt, Staphylococcus aureus subsp. aureus N315
uccauaaucuuuauuaauaaa

SEQ ID NO: 2145111 - RNA, 21 nt, Staphylococcus aureus subsp. aureus N315
uccauaguaaucgauugguaa

SEQ ID NO: 2145112 - RNA, 21 nt, Staphylococcus aureus subsp. aureus N315
uccauacuucuauuuuauaau

SEQ ID NO: 2145113 - RNA, 17 nt, Staphylococcus aureus subsp. aureus N315
uccagcagucauuugau

SEQ ID NO: 2145114 - RNA, 18 nt, Staphylococcus aureus subsp. aureus N315
uccaggcaacaacuuuuc

SEQ ID NO: 2145115 - RNA, 20 nt, Staphylococcus aureus subsp. aureus N315
ucauuuggcguucaacauua

SEQ ID NO: 2145116 - RNA, 17 nt, Staphylococcus aureus subsp. aureus N315
ucauuuguguaaaugaa

SEQ ID NO: 2145117 - RNA, 24 nt, Staphylococcus aureus subsp. aureus N315
ucauuuguguuuuuaauguuugcu

SEQ ID NO: 2145118 - RNA, 21 nt, Staphylococcus aureus subsp. aureus N315
ucauuuguucaucugauaauu

SEQ ID NO: 2145119 - RNA, 16 nt, Staphylococcus aureus subsp. aureus N315
ucauuuguuguuauua

SEQ ID NO: 2145120 - RNA, 19 nt, Staphylococcus aureus subsp. aureus N315
ucauuucgauuaauuuaau

SEQ ID NO: 2145121 - RNA, 11 nt, Staphylococcus aureus subsp. aureus N315
ucauuuuuaau

SEQ ID NO: 2145122 - RNA, 16 nt, Staphylococcus aureus subsp. aureus N315
ucauuuuuauaaauuu

SEQ ID NO: 2145123 - RNA, 16 nt, Staphylococcus aureus subsp. aureus N315
ucauuuucauuguaug

SEQ ID NO: 2145124 - RNA, 20 nt, Staphylococcus aureus subsp. aureus N315
ucauuuucaacauaauauuu

SEQ ID NO: 2145125 - RNA, 14 nt, Staphylococcus aureus subsp. aureus N315
ucauuuucaacaua

SEQ ID NO: 2145126 - RNA, 16 nt, Staphylococcus aureus subsp. aureus N315
ucauuuucaacauaau

SEQ ID NO: 2145127 - RNA, 14 nt, Staphylococcus aureus subsp. aureus N315
ucauuuucaaauaa

SEQ ID NO: 2145128 - RNA, 22 nt, Staphylococcus aureus subsp. aureus N315
ucauuuuauccaaaccaauuuu

SEQ ID NO: 2145129 - RNA, 23 nt, Staphylococcus aureus subsp. aureus N315
ucauuggcaauauacuuuuuaaa

SEQ ID NO: 2145130 - RNA, 20 nt, Staphylococcus aureus subsp. aureus N315
ucauuggauagguaacuaaa

SEQ ID NO: 2145131 - RNA, 14 nt, Staphylococcus aureus subsp. aureus N315
ucauuguaacucaa

SEQ ID NO: 2145132 - RNA, 15 nt, Staphylococcus aureus subsp. aureus N315
ucauuguauaaaaag

SEQ ID NO: 2145133 - RNA, 12 nt, Staphylococcus aureus subsp. aureus N315
ucauuguauaaa

SEQ ID NO: 2145134 - RNA, 19 nt, Staphylococcus aureus subsp. aureus N315
ucauuguguccauaaauau

SEQ ID NO: 2145135 - RNA, 16 nt, Staphylococcus aureus subsp. aureus N315
ucauugugguauuaau

SEQ ID NO: 2145136 - RNA, 15 nt, Staphylococcus aureus subsp. aureus N315
ucauuuaucuagacu

SEQ ID NO: 2145137 - RNA, 15 nt, Staphylococcus aureus subsp. aureus N315
ucauuuauaaacauu

SEQ ID NO: 2145138 - RNA, 13 nt, Staphylococcus aureus subsp. aureus N315
ucauuuauaacau

SEQ ID NO: 2145139 - RNA, 15 nt, Staphylococcus aureus subsp. aureus N315
ucauuuauaacauuu

SEQ ID NO: 2145140 - RNA, 18 nt, Staphylococcus aureus subsp. aureus N315
ucauuuaguuaaauacaa

SEQ ID NO: 2145141 - RNA, 20 nt, Staphylococcus aureus subsp. aureus N315
ucauuucaaauaagaaugug

SEQ ID NO: 2145142 - RNA, 19 nt, Staphylococcus aureus subsp. aureus N315
ucauuucaauauuaaaaua

SEQ ID NO: 2145143 - RNA, 13 nt, Staphylococcus aureus subsp. aureus N315
ucauuuaaauauu

SEQ ID NO: 2145144 - RNA, 16 nt, Staphylococcus aureus subsp. aureus N315
ucauuuaaaucaauac

SEQ ID NO: 2145145 - RNA, 20 nt, Staphylococcus aureus subsp. aureus N315
ucauuuaacauguauuuagu

SEQ ID NO: 2145146 - RNA, 15 nt, Staphylococcus aureus subsp. aureus N315
ucauuuaaaauauuu

SEQ ID NO: 2145147 - RNA, 14 nt, Staphylococcus aureus subsp. aureus N315
ucauuguuauuuau

SEQ ID NO: 2145148 - RNA, 12 nt, Staphylococcus aureus subsp. aureus N315
ucauuuaaaaua

SEQ ID NO: 2145149 - RNA, 19 nt, Staphylococcus aureus subsp. aureus N315
uccaaaaauuguaaaaccu

SEQ ID NO: 2145150 - RNA, 14 nt, Staphylococcus aureus subsp. aureus N315
uccaaaacauuuug

SEQ ID NO: 2145151 - RNA, 22 nt, Staphylococcus aureus subsp. aureus N315
ucauuuuuucgagaugauauua

SEQ ID NO: 2145152 - RNA, 12 nt, Staphylococcus aureus subsp. aureus N315
ucauuuuuucaa

SEQ ID NO: 2145153 - RNA, 21 nt, Staphylococcus aureus subsp. aureus N315
uccaaagcuugauuuaacaac

SEQ ID NO: 2145154 - RNA, 15 nt, Staphylococcus aureus subsp. aureus N315
uccaaagaaacggaa

SEQ ID NO: 2145155 - RNA, 13 nt, Staphylococcus aureus subsp. aureus N315
uccaaaauccuga

SEQ ID NO: 2145156 - RNA, 14 nt, Staphylococcus aureus subsp. aureus N315
uccaaauaaauaua

SEQ ID NO: 2145157 - RNA, 18 nt, Staphylococcus aureus subsp. aureus N315
uccaaaguacucaaguaa

SEQ ID NO: 2145158 - RNA, 17 nt, Staphylococcus aureus subsp. aureus N315
uccaaaggccaugagcu

SEQ ID NO: 2145159 - RNA, 18 nt, Staphylococcus aureus subsp. aureus N315
uccaacauguaacaaaau

SEQ ID NO: 2145160 - RNA, 23 nt, Staphylococcus aureus subsp. aureus N315
uccaaauguucagguucaaaauu

SEQ ID NO: 2145161 - RNA, 18 nt, Staphylococcus aureus subsp. aureus N315
uccaacacccauauaauu

SEQ ID NO: 2145162 - RNA, 14 nt, Staphylococcus aureus subsp. aureus N315
ucauuaauaaauug

SEQ ID NO: 2145163 - RNA, 13 nt, Staphylococcus aureus subsp. aureus N315
ucauuaaauauuu

SEQ ID NO: 2145164 - RNA, 18 nt, Staphylococcus aureus subsp. aureus N315
ucauguucuuauaaaaaa

SEQ ID NO: 2145165 - RNA, 16 nt, Staphylococcus aureus subsp. aureus N315
ucauguucuuguaauc

SEQ ID NO: 2145166 - RNA, 21 nt, Staphylococcus aureus subsp. aureus N315
ucauuacguaacaucacauaa

SEQ ID NO: 2145167 - RNA, 12 nt, Staphylococcus aureus subsp. aureus N315
ucauuaauacaa

SEQ ID NO: 2145168 - RNA, 18 nt, Staphylococcus aureus subsp. aureus N315
ucaugucuagauuuuaaa

SEQ ID NO: 2145169 - RNA, 22 nt, Staphylococcus aureus subsp. aureus N315
ucaugugcaagugguaaaaaug

SEQ ID NO: 2145170 - RNA, 15 nt, Staphylococcus aureus subsp. aureus N315
ucauucuuuauagaa

SEQ ID NO: 2145171 - RNA, 19 nt, Staphylococcus aureus subsp. aureus N315
ucauucuguguaaauauaa

SEQ ID NO: 2145172 - RNA, 18 nt, Staphylococcus aureus subsp. aureus N315
ucauucguacuuccaaua

SEQ ID NO: 2145173 - RNA, 16 nt, Staphylococcus aureus subsp. aureus N315
ucauuaucaaauaacc

SEQ ID NO: 2145174 - RNA, 19 nt, Staphylococcus aureus subsp. aureus N315
ucauuauauaauucuucaa

SEQ ID NO: 2145175 - RNA, 14 nt, Staphylococcus aureus subsp. aureus N315
ucauuauaaaaugg

SEQ ID NO: 2145176 - RNA, 19 nt, Staphylococcus aureus subsp. aureus N315
ucauuauagucuuaaacau

SEQ ID NO: 2145177 - RNA, 16 nt, Staphylococcus aureus subsp. aureus N315
ucauuauaaugauuuu

SEQ ID NO: 2145178 - RNA, 22 nt, Staphylococcus aureus subsp. aureus N315
ucauuauacgugcuuuaaaguu

SEQ ID NO: 2145179 - RNA, 17 nt, Staphylococcus aureus subsp. aureus N315
ucauuagcauuauuauu

SEQ ID NO: 2145180 - RNA, 18 nt, Staphylococcus aureus subsp. aureus N315
ucauuaguguagaaaaua

SEQ ID NO: 2145181 - RNA, 20 nt, Staphylococcus aureus subsp. aureus N315
ucauuagcgcaagagauaag

SEQ ID NO: 2145182 - RNA, 18 nt, Staphylococcus aureus subsp. aureus N315
ucauucacaaugauugaa

SEQ ID NO: 2145183 - RNA, 13 nt, Staphylococcus aureus subsp. aureus N315
ucauuauuuaaau

SEQ ID NO: 2145184 - RNA, 20 nt, Staphylococcus aureus subsp. aureus N315
ucauuauuuagaauucuaaa

SEQ ID NO: 2145185 - RNA, 23 nt, Staphylococcus aureus subsp. aureus N315
ucauuauuuagaauucuaaaaga

SEQ ID NO: 2145186 - RNA, 15 nt, Staphylococcus aureus subsp. aureus N315
ucaugauuaauuaaa

SEQ ID NO: 2145187 - RNA, 17 nt, Staphylococcus aureus subsp. aureus N315
ucaugagcacaaacuaa

SEQ ID NO: 2145188 - RNA, 12 nt, Staphylococcus aureus subsp. aureus N315
ucaugagcacaa

SEQ ID NO: 2145189 - RNA, 20 nt, Staphylococcus aureus subsp. aureus N315
ucaugaauaaauacaauguu

SEQ ID NO: 2145190 - RNA, 16 nt, Staphylococcus aureus subsp. aureus N315
ucaugaauaaauacaa

SEQ ID NO: 2145191 - RNA, 13 nt, Staphylococcus aureus subsp. aureus N315
ucaugaaauaaaa

SEQ ID NO: 2145192 - RNA, 22 nt, Staphylococcus aureus subsp. aureus N315
ucaucuuucacaauuguauaau

SEQ ID NO: 2145193 - RNA, 13 nt, Staphylococcus aureus subsp. aureus N315
ucaugccuucaug

SEQ ID NO: 2145194 - RNA, 19 nt, Staphylococcus aureus subsp. aureus N315
ucaugcuuaucuguaaaua

SEQ ID NO: 2145195 - RNA, 22 nt, Staphylococcus aureus subsp. aureus N315
ucaugcaaaacuaaucaaauua

SEQ ID NO: 2145196 - RNA, 12 nt, Staphylococcus aureus subsp. aureus N315
ucaugccuucau

SEQ ID NO: 2145197 - RNA, 20 nt, Staphylococcus aureus subsp. aureus N315
ucaucuuaugacugcuuuuu

SEQ ID NO: 2145198 - RNA, 19 nt, Staphylococcus aureus subsp. aureus N315
ucaucuucugaauuuaaua

SEQ ID NO: 2145199 - RNA, 21 nt, Staphylococcus aureus subsp. aureus N315
ucaucuuucaacgcauauucu

SEQ ID NO: 2145200 - RNA, 18 nt, Staphylococcus aureus subsp. aureus N315
ucaucuuucaaaugcuua

SEQ ID NO: 2145201 - RNA, 20 nt, Staphylococcus aureus subsp. aureus N315
ucaucuugcgccuuguucaa

SEQ ID NO: 2145202 - RNA, 18 nt, Staphylococcus aureus subsp. aureus N315
ucaucuugagauuuucaa

SEQ ID NO: 2145203 - RNA, 21 nt, Staphylococcus aureus subsp. aureus N315
ucaucuugagauuuucaacac

SEQ ID NO: 2145204 - RNA, 22 nt, Staphylococcus aureus subsp. aureus N315
ucaucuugcaaguauuuucuua

SEQ ID NO: 2145205 - RNA, 19 nt, Staphylococcus aureus subsp. aureus N315
ucaucuggugcaauauuau

SEQ ID NO: 2145206 - RNA, 22 nt, Staphylococcus aureus subsp. aureus N315
ucaucuauuuuuaacuaauaga

SEQ ID NO: 2145207 - RNA, 23 nt, Staphylococcus aureus subsp. aureus N315
ucaucuauuauuauguuauaaau

SEQ ID NO: 2145208 - RNA, 16 nt, Staphylococcus aureus subsp. aureus N315
ucaucuacuauuuaau

SEQ ID NO: 2145209 - RNA, 19 nt, Staphylococcus aureus subsp. aureus N315
ucaucuauauuuaauuuug

SEQ ID NO: 2145210 - RNA, 21 nt, Staphylococcus aureus subsp. aureus N315
ucaucguucauauauuuuguu

SEQ ID NO: 2145211 - RNA, 20 nt, Staphylococcus aureus subsp. aureus N315
ucaucuaaccuuuucaucag

SEQ ID NO: 2145212 - RNA, 23 nt, Staphylococcus aureus subsp. aureus N315
ucaucuaacgacccaaauuauau

SEQ ID NO: 2145213 - RNA, 12 nt, Staphylococcus aureus subsp. aureus N315
ucaucguauuuc

SEQ ID NO: 2145214 - RNA, 13 nt, Staphylococcus aureus subsp. aureus N315
ucaucaauuggca

SEQ ID NO: 2145215 - RNA, 19 nt, Staphylococcus aureus subsp. aureus N315
ucaucaccuuguuaaaaua

SEQ ID NO: 2145216 - RNA, 14 nt, Staphylococcus aureus subsp. aureus N315
ucaucaugcauaau

SEQ ID NO: 2145217 - RNA, 16 nt, Staphylococcus aureus subsp. aureus N315
ucaucauuuaaauauu

SEQ ID NO: 2145218 - RNA, 15 nt, Staphylococcus aureus subsp. aureus N315
ucaucauuuaaaauu

SEQ ID NO: 2145219 - RNA, 16 nt, Staphylococcus aureus subsp. aureus N315
ucauagugaaauucga

SEQ ID NO: 2145220 - RNA, 16 nt, Staphylococcus aureus subsp. aureus N315
ucauaguucaaauuga

SEQ ID NO: 2145221 - RNA, 20 nt, Staphylococcus aureus subsp. aureus N315
ucauaguucaaauugaacuu

SEQ ID NO: 2145222 - RNA, 11 nt, Staphylococcus aureus subsp. aureus N315
ucauagccuau

SEQ ID NO: 2145223 - RNA, 16 nt, Staphylococcus aureus subsp. aureus N315
ucauagagguuaaccu

SEQ ID NO: 2145224 - RNA, 14 nt, Staphylococcus aureus subsp. aureus N315
ucauacgagaaauu

SEQ ID NO: 2145225 - RNA, 16 nt, Staphylococcus aureus subsp. aureus N315
ucauaccuuuuaauuu

SEQ ID NO: 2145226 - RNA, 17 nt, Staphylococcus aureus subsp. aureus N315
ucauaccgacaccuaua

SEQ ID NO: 2145227 - RNA, 22 nt, Staphylococcus aureus subsp. aureus N315
ucauacgcaaugauuauaaaua

SEQ ID NO: 2145228 - RNA, 21 nt, Staphylococcus aureus subsp. aureus N315
ucauaauauugaugaauaaau

SEQ ID NO: 2145229 - RNA, 13 nt, Staphylococcus aureus subsp. aureus N315
ucauaaucaaguc

SEQ ID NO: 2145230 - RNA, 16 nt, Staphylococcus aureus subsp. aureus N315
ucauaaucaagucugc

SEQ ID NO: 2145231 - RNA, 18 nt, Staphylococcus aureus subsp. aureus N315
ucauaaucaagucugcau

SEQ ID NO: 2145232 - RNA, 15 nt, Staphylococcus aureus subsp. aureus N315
ucauaaucaagaaua

SEQ ID NO: 2145233 - RNA, 14 nt, Staphylococcus aureus subsp. aureus N315
ucauaaugaauaau

SEQ ID NO: 2145234 - RNA, 15 nt, Staphylococcus aureus subsp. aureus N315
ucauaaguuaaaguu

SEQ ID NO: 2145235 - RNA, 22 nt, Staphylococcus aureus subsp. aureus N315
ucauaagucuuaacaaauuaaa

SEQ ID NO: 2145236 - RNA, 22 nt, Staphylococcus aureus subsp. aureus N315
ucauaacgauuguugcaaugau

SEQ ID NO: 2145237 - RNA, 18 nt, Staphylococcus aureus subsp. aureus N315
ucauaccaaaaacauuaa

SEQ ID NO: 2145238 - RNA, 21 nt, Staphylococcus aureus subsp. aureus N315
ucauacacuaucauuaucaaa

SEQ ID NO: 2145239 - RNA, 18 nt, Staphylococcus aureus subsp. aureus N315
ucauacacugcacaucau

SEQ ID NO: 2145240 - RNA, 12 nt, Staphylococcus aureus subsp. aureus N315
ucauaauuuaaa

SEQ ID NO: 2145241 - RNA, 14 nt, Staphylococcus aureus subsp. aureus N315
ucauaauuaauaac

SEQ ID NO: 2145242 - RNA, 21 nt, Staphylococcus aureus subsp. aureus N315
ucauaauuaacacauucaaau

SEQ ID NO: 2145243 - RNA, 11 nt, Staphylococcus aureus subsp. aureus N315
ucauaucuuua

SEQ ID NO: 2145244 - RNA, 17 nt, Staphylococcus aureus subsp. aureus N315
ucauaucuuuauuugau

SEQ ID NO: 2145245 - RNA, 22 nt, Staphylococcus aureus subsp. aureus N315
ucauaucuuuauuugauucuuc

SEQ ID NO: 2145246 - RNA, 19 nt, Staphylococcus aureus subsp. aureus N315
ucauauucaacuaguaaau

SEQ ID NO: 2145247 - RNA, 13 nt, Staphylococcus aureus subsp. aureus N315
ucauauucacauc

SEQ ID NO: 2145248 - RNA, 15 nt, Staphylococcus aureus subsp. aureus N315
ucauauucacaucuu

SEQ ID NO: 2145249 - RNA, 19 nt, Staphylococcus aureus subsp. aureus N315
ucauauucaaaauaacuua

SEQ ID NO: 2145250 - RNA, 14 nt, Staphylococcus aureus subsp. aureus N315
ucauauucaaaaua

SEQ ID NO: 2145251 - RNA, 20 nt, Staphylococcus aureus subsp. aureus N315
ucauauguuuuauaauaaau

SEQ ID NO: 2145252 - RNA, 16 nt, Staphylococcus aureus subsp. aureus N315
ucauaucauaccaaaa

SEQ ID NO: 2145253 - RNA, 17 nt, Staphylococcus aureus subsp. aureus N315
ucauauauuuuguuaau

SEQ ID NO: 2145254 - RNA, 13 nt, Staphylococcus aureus subsp. aureus N315
ucauauaaaucaa

SEQ ID NO: 2145255 - RNA, 23 nt, Staphylococcus aureus subsp. aureus N315
ucauauccuucauuagugacaag

SEQ ID NO: 2145256 - RNA, 13 nt, Staphylococcus aureus subsp. aureus N315
ucauauaaauagc

SEQ ID NO: 2145257 - RNA, 22 nt, Staphylococcus aureus subsp. aureus N315
ucauauaaaucaaauauacuuu

SEQ ID NO: 2145258 - RNA, 14 nt, Staphylococcus aureus subsp. aureus N315
ucauauaaugaaug

SEQ ID NO: 2145259 - RNA, 16 nt, Staphylococcus aureus subsp. aureus N315
ucauauaugucucucu

SEQ ID NO: 2145260 - RNA, 18 nt, Staphylococcus aureus subsp. aureus N315
ucauauuuagguaauaca

SEQ ID NO: 2145261 - RNA, 17 nt, Staphylococcus aureus subsp. aureus N315
ucauauuugaauacuuu

SEQ ID NO: 2145262 - RNA, 11 nt, Staphylococcus aureus subsp. aureus N315
ucauauuuaua

SEQ ID NO: 2145263 - RNA, 14 nt, Staphylococcus aureus subsp. aureus N315
ucaucaaaaguuug

SEQ ID NO: 2145264 - RNA, 18 nt, Staphylococcus aureus subsp. aureus N315
ucaucaaacaacaucacu

SEQ ID NO: 2145265 - RNA, 23 nt, Staphylococcus aureus subsp. aureus N315
ucaucaacacacacaguuuauaa

SEQ ID NO: 2145266 - RNA, 14 nt, Staphylococcus aureus subsp. aureus N315
ucauaaaugacuga

SEQ ID NO: 2145267 - RNA, 19 nt, Staphylococcus aureus subsp. aureus N315
ucauaacgacaacuugaac

SEQ ID NO: 2145268 - RNA, 21 nt, Staphylococcus aureus subsp. aureus N315
ucauaaccgcuucuuuuaagu

SEQ ID NO: 2145269 - RNA, 15 nt, Staphylococcus aureus subsp. aureus N315
ucauaaaucaugaaa

SEQ ID NO: 2145270 - RNA, 22 nt, Staphylococcus aureus subsp. aureus N315
ucauaaaucaugaaauaaaaaa

SEQ ID NO: 2145271 - RNA, 13 nt, Staphylococcus aureus subsp. aureus N315
ucauaaauauuuu

SEQ ID NO: 2145272 - RNA, 15 nt, Staphylococcus aureus subsp. aureus N315
ucauaaauauaaaau

SEQ ID NO: 2145273 - RNA, 18 nt, Staphylococcus aureus subsp. aureus N315
ucauaaaauuuaaaacaa

SEQ ID NO: 2145274 - RNA, 19 nt, Staphylococcus aureus subsp. aureus N315
ucauaaaaaucauaaauaa

SEQ ID NO: 2145275 - RNA, 13 nt, Staphylococcus aureus subsp. aureus N315
ucaguuaauaauu

SEQ ID NO: 2145276 - RNA, 16 nt, Staphylococcus aureus subsp. aureus N315
ucaguuaaaucuuuaa

SEQ ID NO: 2145277 - RNA, 21 nt, Staphylococcus aureus subsp. aureus N315
ucaguuaaaauaaccauuuuu

SEQ ID NO: 2145278 - RNA, 23 nt, Staphylococcus aureus subsp. aureus N315
ucagugcauuuuuuauuuuacuu

SEQ ID NO: 2145279 - RNA, 13 nt, Staphylococcus aureus subsp. aureus N315
ucagugcauuuuu

SEQ ID NO: 2145280 - RNA, 18 nt, Staphylococcus aureus subsp. aureus N315
ucaguauuuacuuuuccu

SEQ ID NO: 2145281 - RNA, 15 nt, Staphylococcus aureus subsp. aureus N315
ucagucaguaaaaau

SEQ ID NO: 2145282 - RNA, 15 nt, Staphylococcus aureus subsp. aureus N315
ucagucauucacaua

SEQ ID NO: 2145283 - RNA, 20 nt, Staphylococcus aureus subsp. aureus N315
ucaguccgcuuuuucauaga

SEQ ID NO: 2145284 - RNA, 15 nt, Staphylococcus aureus subsp. aureus N315
ucaguaccauguuuu

SEQ ID NO: 2145285 - RNA, 16 nt, Staphylococcus aureus subsp. aureus N315
ucaguaaucuuguuuu

SEQ ID NO: 2145286 - RNA, 13 nt, Staphylococcus aureus subsp. aureus N315
ucagcuuauuaag

SEQ ID NO: 2145287 - RNA, 17 nt, Staphylococcus aureus subsp. aureus N315
ucagcuaaguuaaauau

SEQ ID NO: 2145288 - RNA, 15 nt, Staphylococcus aureus subsp. aureus N315
ucagcuaauucgucu

SEQ ID NO: 2145289 - RNA, 13 nt, Staphylococcus aureus subsp. aureus N315
ucagcuauaaaag

SEQ ID NO: 2145290 - RNA, 16 nt, Staphylococcus aureus subsp. aureus N315
ucagcuuuaauaauau

SEQ ID NO: 2145291 - RNA, 14 nt, Staphylococcus aureus subsp. aureus N315
ucagcuuuaauaau

SEQ ID NO: 2145292 - RNA, 15 nt, Staphylococcus aureus subsp. aureus N315
ucagcuuuaauaaua

SEQ ID NO: 2145293 - RNA, 10 nt, Staphylococcus aureus subsp. aureus N315
ucagcuuguu

SEQ ID NO: 2145294 - RNA, 18 nt, Staphylococcus aureus subsp. aureus N315
ucagcuuuggcgacauaa

SEQ ID NO: 2145295 - RNA, 18 nt, Staphylococcus aureus subsp. aureus N315
ucaggaccaaauagagaa

SEQ ID NO: 2145296 - RNA, 15 nt, Staphylococcus aureus subsp. aureus N315
ucagcgucauauguu

SEQ ID NO: 2145297 - RNA, 19 nt, Staphylococcus aureus subsp. aureus N315
uaucuucacacuuuuagaa

SEQ ID NO: 2145298 - RNA, 23 nt, Staphylococcus aureus subsp. aureus N315
ucaggaucacguuuuucuuuaaa

SEQ ID NO: 2145299 - RNA, 16 nt, Staphylococcus aureus subsp. aureus N315
ucagggaaaucaucug

SEQ ID NO: 2145300 - RNA, 14 nt, Staphylococcus aureus subsp. aureus N315
ucagggaaaucauc

SEQ ID NO: 2145301 - RNA, 19 nt, Staphylococcus aureus subsp. aureus N315
ucaggggccccaacacaga

SEQ ID NO: 2145302 - RNA, 13 nt, Staphylococcus aureus subsp. aureus N315
ggauucaaaugac

SEQ ID NO: 2145303 - RNA, 22 nt, Staphylococcus aureus subsp. aureus N315
ggauguuauaaaaugaauaauu

SEQ ID NO: 2145304 - RNA, 19 nt, Staphylococcus aureus subsp. aureus N315
ggaugaguuuaaaaauaug

SEQ ID NO: 2145305 - RNA, 17 nt, Staphylococcus aureus subsp. aureus N315
ggaugaguuuaaaaaua

SEQ ID NO: 2145306 - RNA, 19 nt, Staphylococcus aureus subsp. aureus N315
ggaucacguuuuucuuuaa

SEQ ID NO: 2145307 - RNA, 17 nt, Staphylococcus aureus subsp. aureus N315
ggauuuuuacaaaguga

SEQ ID NO: 2145308 - RNA, 13 nt, Staphylococcus aureus subsp. aureus N315
ggcaaaucaaaca

SEQ ID NO: 2145309 - RNA, 17 nt, Staphylococcus aureus subsp. aureus N315
ggcaacacucggaaaca

SEQ ID NO: 2145310 - RNA, 17 nt, Staphylococcus aureus subsp. aureus N315
ggcaaucuauauaaaug

SEQ ID NO: 2145311 - RNA, 15 nt, Staphylococcus aureus subsp. aureus N315
ggcaaugaaauuacc

SEQ ID NO: 2145312 - RNA, 14 nt, Staphylococcus aureus subsp. aureus N315
ggcaauauacuuuu

SEQ ID NO: 2145313 - RNA, 16 nt, Staphylococcus aureus subsp. aureus N315
ggcaauagcaccauac

SEQ ID NO: 2145314 - RNA, 21 nt, Staphylococcus aureus subsp. aureus N315
ggcaauauugaacaauucuuc

SEQ ID NO: 2145315 - RNA, 16 nt, Staphylococcus aureus subsp. aureus N315
ggagauuagagaagaa

SEQ ID NO: 2145316 - RNA, 14 nt, Staphylococcus aureus subsp. aureus N315
ggagauuagagaag

SEQ ID NO: 2145317 - RNA, 12 nt, Staphylococcus aureus subsp. aureus N315
ggagaaccuuua

SEQ ID NO: 2145318 - RNA, 12 nt, Staphylococcus aureus subsp. aureus N315
ggagaaccuuuu

SEQ ID NO: 2145319 - RNA, 12 nt, Staphylococcus aureus subsp. aureus N315
ggacugaaagaa

SEQ ID NO: 2145320 - RNA, 23 nt, Staphylococcus aureus subsp. aureus N315
ggaguauuuuugcguuaauaauu

SEQ ID NO: 2145321 - RNA, 15 nt, Staphylococcus aureus subsp. aureus N315
ggaguaucuguuucu

SEQ ID NO: 2145322 - RNA, 23 nt, Staphylococcus aureus subsp. aureus N315
ggauauuuuuuaauaaucaaacc

SEQ ID NO: 2145323 - RNA, 10 nt, Staphylococcus aureus subsp. aureus N315
ggacaaguuu

SEQ ID NO: 2145324 - RNA, 20 nt, Staphylococcus aureus subsp. aureus N315
ggacagaaaagggcaaaaaa

SEQ ID NO: 2145325 - RNA, 21 nt, Staphylococcus aureus subsp. aureus N315
ggaauagauguugaugaagua

SEQ ID NO: 2145326 - RNA, 16 nt, Staphylococcus aureus subsp. aureus N315
ggaauaccuuuuucua

SEQ ID NO: 2145327 - RNA, 20 nt, Staphylococcus aureus subsp. aureus N315
ggaauacagaugaugcuucu

SEQ ID NO: 2145328 - RNA, 19 nt, Staphylococcus aureus subsp. aureus N315
ggacaacuaauaacaaaua

SEQ ID NO: 2145329 - RNA, 15 nt, Staphylococcus aureus subsp. aureus N315
ggaauaacuuuuuaa

SEQ ID NO: 2145330 - RNA, 21 nt, Staphylococcus aureus subsp. aureus N315
ggcacuuaagcuuuaaucaua

SEQ ID NO: 2145331 - RNA, 18 nt, Staphylococcus aureus subsp. aureus N315
ggccaaauguugauaaua

SEQ ID NO: 2145332 - RNA, 22 nt, Staphylococcus aureus subsp. aureus N315
ggcauuuugacgccagaauaaa

SEQ ID NO: 2145333 - RNA, 15 nt, Staphylococcus aureus subsp. aureus N315
ggcccacaccccaac

SEQ ID NO: 2145334 - RNA, 12 nt, Staphylococcus aureus subsp. aureus N315
ggcguaaugaua

SEQ ID NO: 2145335 - RNA, 23 nt, Staphylococcus aureus subsp. aureus N315
ggcguuucagaaguuguuuagaa

SEQ ID NO: 2145336 - RNA, 14 nt, Staphylococcus aureus subsp. aureus N315
ggccuuuaaugauu

SEQ ID NO: 2145337 - RNA, 16 nt, Staphylococcus aureus subsp. aureus N315
gucaggggccccaaca

SEQ ID NO: 2145338 - RNA, 14 nt, Staphylococcus aureus subsp. aureus N315
gucaggggccccaa

SEQ ID NO: 2145339 - RNA, 23 nt, Staphylococcus aureus subsp. aureus N315
gucaggggccccaacacagagaa

SEQ ID NO: 2145340 - RNA, 20 nt, Staphylococcus aureus subsp. aureus N315
gucaggggccccaacacaga

SEQ ID NO: 2145341 - RNA, 20 nt, Staphylococcus aureus subsp. aureus N315
gucauguguucaaauaacgc

SEQ ID NO: 2145342 - RNA, 14 nt, Staphylococcus aureus subsp. aureus N315
gucauaccuuuuaa

SEQ ID NO: 2145343 - RNA, 15 nt, Staphylococcus aureus subsp. aureus N315
gucauacuaacuaua

SEQ ID NO: 2145344 - RNA, 21 nt, Staphylococcus aureus subsp. aureus N315
gucauacgcaaugauuauaaa

SEQ ID NO: 2145345 - RNA, 18 nt, Staphylococcus aureus subsp. aureus N315
gucauagaaauuuuaaaa

SEQ ID NO: 2145346 - RNA, 16 nt, Staphylococcus aureus subsp. aureus N315
gucaugaaaauaagca

SEQ ID NO: 2145347 - RNA, 16 nt, Staphylococcus aureus subsp. aureus N315
gucaucuguuaauuca

SEQ ID NO: 2145348 - RNA, 14 nt, Staphylococcus aureus subsp. aureus N315
gucauaauuuaaaa

SEQ ID NO: 2145349 - RNA, 22 nt, Staphylococcus aureus subsp. aureus N315
gucauaauuuaaaagauuagau

SEQ ID NO: 2145350 - RNA, 18 nt, Staphylococcus aureus subsp. aureus N315
gucauaauagauaaugca

SEQ ID NO: 2145351 - RNA, 20 nt, Staphylococcus aureus subsp. aureus N315
gucagcauucauagcugcuu

SEQ ID NO: 2145352 - RNA, 15 nt, Staphylococcus aureus subsp. aureus N315
gucagcuuacaauaa

SEQ ID NO: 2145353 - RNA, 19 nt, Staphylococcus aureus subsp. aureus N315
gucaauuucuuuaaagucu

SEQ ID NO: 2145354 - RNA, 15 nt, Staphylococcus aureus subsp. aureus N315
gucacuuuauuaaau

SEQ ID NO: 2145355 - RNA, 17 nt, Staphylococcus aureus subsp. aureus N315
gucaaguaaauguuuua

SEQ ID NO: 2145356 - RNA, 15 nt, Staphylococcus aureus subsp. aureus N315
guauaccucuuagca

SEQ ID NO: 2145357 - RNA, 17 nt, Staphylococcus aureus subsp. aureus N315
guauauaaguuaaaauu

SEQ ID NO: 2145358 - RNA, 22 nt, Staphylococcus aureus subsp. aureus N315
guauauaaguuaaaauugguuu

SEQ ID NO: 2145359 - RNA, 17 nt, Staphylococcus aureus subsp. aureus N315
guauauggcgauaacaa

SEQ ID NO: 2145360 - RNA, 21 nt, Staphylococcus aureus subsp. aureus N315
guauaauggacgguauuuuca

SEQ ID NO: 2145361 - RNA, 22 nt, Staphylococcus aureus subsp. aureus N315
guauacaguuuuacuauaauga

SEQ ID NO: 2145362 - RNA, 15 nt, Staphylococcus aureus subsp. aureus N315
guauuuuucaaauaa

SEQ ID NO: 2145363 - RNA, 22 nt, Staphylococcus aureus subsp. aureus N315
guauuuuuauuguuuuggcuuu

SEQ ID NO: 2145364 - RNA, 23 nt, Staphylococcus aureus subsp. aureus N315
guauuuuucuuaauuaucauuac

SEQ ID NO: 2145365 - RNA, 18 nt, Staphylococcus aureus subsp. aureus N315
guauauugcuuauguaca

SEQ ID NO: 2145366 - RNA, 21 nt, Staphylococcus aureus subsp. aureus N315
guauauucaacagggguaaaa

SEQ ID NO: 2145367 - RNA, 23 nt, Staphylococcus aureus subsp. aureus N315
gucccacucccauuggcauuuac

SEQ ID NO: 2145368 - RNA, 21 nt, Staphylococcus aureus subsp. aureus N315
gucauugguggagauuguaaa

SEQ ID NO: 2145369 - RNA, 14 nt, Staphylococcus aureus subsp. aureus N315
gucauuucaaucau

SEQ ID NO: 2145370 - RNA, 18 nt, Staphylococcus aureus subsp. aureus N315
guccaucgucaucacuuu

SEQ ID NO: 2145371 - RNA, 20 nt, Staphylococcus aureus subsp. aureus N315
guccauaaucuuuauuaaua

SEQ ID NO: 2145372 - RNA, 20 nt, Staphylococcus aureus subsp. aureus N315
gucauuuguuguuauuauaa

SEQ ID NO: 2145373 - RNA, 18 nt, Staphylococcus aureus subsp. aureus N315
gucauuuguucaucugau

SEQ ID NO: 2145374 - RNA, 15 nt, Staphylococcus aureus subsp. aureus N315
guccucuugugaaau

SEQ ID NO: 2145375 - RNA, 18 nt, Staphylococcus aureus subsp. aureus N315
guccguuuauagauaggu

SEQ ID NO: 2145376 - RNA, 11 nt, Staphylococcus aureus subsp. aureus N315
guccuucccac

SEQ ID NO: 2145377 - RNA, 20 nt, Staphylococcus aureus subsp. aureus N315
guaggggagucuuauuuuua

SEQ ID NO: 2145378 - RNA, 16 nt, Staphylococcus aureus subsp. aureus N315
guagccuacaaccuuu

SEQ ID NO: 2145379 - RNA, 19 nt, Staphylococcus aureus subsp. aureus N315
guauaaccauaaugaacag

SEQ ID NO: 2145380 - RNA, 21 nt, Staphylococcus aureus subsp. aureus N315
guauaagggguauauuaaaaa

SEQ ID NO: 2145381 - RNA, 13 nt, Staphylococcus aureus subsp. aureus N315
guauaaaugcagc

SEQ ID NO: 2145382 - RNA, 15 nt, Staphylococcus aureus subsp. aureus N315
guauaaauaaaaaua

SEQ ID NO: 2145383 - RNA, 18 nt, Staphylococcus aureus subsp. aureus N315
guauaaauaaaaauacau

SEQ ID NO: 2145384 - RNA, 22 nt, Staphylococcus aureus subsp. aureus N315
guaguuaagauaccuuuuucua

SEQ ID NO: 2145385 - RNA, 22 nt, Staphylococcus aureus subsp. aureus N315
guaguuggcugauagaugaaaa

SEQ ID NO: 2145386 - RNA, 20 nt, Staphylococcus aureus subsp. aureus N315
guaguuccucgguauucaau

SEQ ID NO: 2145387 - RNA, 20 nt, Staphylococcus aureus subsp. aureus N315
guaguuucucuacuaauauu

SEQ ID NO: 2145388 - RNA, 19 nt, Staphylococcus aureus subsp. aureus N315
guaguacacgaauucauua

SEQ ID NO: 2145389 - RNA, 16 nt, Staphylococcus aureus subsp. aureus N315
guaguacuauagucau

SEQ ID NO: 2145390 - RNA, 19 nt, Staphylococcus aureus subsp. aureus N315
guacuauuaucuauccauu

SEQ ID NO: 2145391 - RNA, 13 nt, Staphylococcus aureus subsp. aureus N315
guaccuaaaauag

SEQ ID NO: 2145392 - RNA, 12 nt, Staphylococcus aureus subsp. aureus N315
guaccguauuuu

SEQ ID NO: 2145393 - RNA, 13 nt, Staphylococcus aureus subsp. aureus N315
guaccguauuuua

SEQ ID NO: 2145394 - RNA, 20 nt, Staphylococcus aureus subsp. aureus N315
guacggcugcuuuaacugua

SEQ ID NO: 2145395 - RNA, 21 nt, Staphylococcus aureus subsp. aureus N315
guagacguaaguguaaaugaa

SEQ ID NO: 2145396 - RNA, 18 nt, Staphylococcus aureus subsp. aureus N315
guaccaucucuauuuuuu

SEQ ID NO: 2145397 - RNA, 14 nt, Staphylococcus aureus subsp. aureus N315
guaccaauuagcau

SEQ ID NO: 2145398 - RNA, 13 nt, Staphylococcus aureus subsp. aureus N315
guaccaagcuuca

SEQ ID NO: 2145399 - RNA, 20 nt, Staphylococcus aureus subsp. aureus N315
guaauguuccccugaaaaga

SEQ ID NO: 2145400 - RNA, 11 nt, Staphylococcus aureus subsp. aureus N315
guacauguauu

SEQ ID NO: 2145401 - RNA, 16 nt, Staphylococcus aureus subsp. aureus N315
guacauuuauuuucaa

SEQ ID NO: 2145402 - RNA, 24 nt, Staphylococcus aureus subsp. aureus N315
guacauuuaauggucuaauaucaa

SEQ ID NO: 2145403 - RNA, 13 nt, Staphylococcus aureus subsp. aureus N315
guaccaaauaaau

SEQ ID NO: 2145404 - RNA, 15 nt, Staphylococcus aureus subsp. aureus N315
guacauugguuuuua

SEQ ID NO: 2145405 - RNA, 14 nt, Staphylococcus aureus subsp. aureus N315
guaaucuauuuucu

SEQ ID NO: 2145406 - RNA, 23 nt, Staphylococcus aureus subsp. aureus N315
guaaugcuuaaaaacaauauuga

SEQ ID NO: 2145407 - RNA, 23 nt, Staphylococcus aureus subsp. aureus N315
guaaucgauugguaaaucuacua

SEQ ID NO: 2145408 - RNA, 20 nt, Staphylococcus aureus subsp. aureus N315
guaaucuaauacauacggca

SEQ ID NO: 2145409 - RNA, 14 nt, Staphylococcus aureus subsp. aureus N315
guaaaauuaaaugc

SEQ ID NO: 2145410 - RNA, 23 nt, Staphylococcus aureus subsp. aureus N315
guaaaauuuucguguuaauaacc

SEQ ID NO: 2145411 - RNA, 23 nt, Staphylococcus aureus subsp. aureus N315
guaaacaacaucgauuuaucauu

SEQ ID NO: 2145412 - RNA, 21 nt, Staphylococcus aureus subsp. aureus N315
guaaacaacaucgauuuauca

SEQ ID NO: 2145413 - RNA, 14 nt, Staphylococcus aureus subsp. aureus N315
guaaacacuauaaa

SEQ ID NO: 2145414 - RNA, 18 nt, Staphylococcus aureus subsp. aureus N315
gguguuuauaucuuugug

SEQ ID NO: 2145415 - RNA, 23 nt, Staphylococcus aureus subsp. aureus N315
guaaaccgaggugucaauaaauu

SEQ ID NO: 2145416 - RNA, 18 nt, Staphylococcus aureus subsp. aureus N315
guaaaccuacuaauauau

SEQ ID NO: 2145417 - RNA, 17 nt, Staphylococcus aureus subsp. aureus N315
guaaacacuauaaaagc

SEQ ID NO: 2145418 - RNA, 18 nt, Staphylococcus aureus subsp. aureus N315
guaaaccagcuaaaccau

SEQ ID NO: 2145419 - RNA, 14 nt, Staphylococcus aureus subsp. aureus N315
guaaagcaugaaua

SEQ ID NO: 2145420 - RNA, 16 nt, Staphylococcus aureus subsp. aureus N315
guaaacuucuuuucuu

SEQ ID NO: 2145421 - RNA, 19 nt, Staphylococcus aureus subsp. aureus N315
guaaacggaauaacuuuuu

SEQ ID NO: 2145422 - RNA, 16 nt, Staphylococcus aureus subsp. aureus N315
guaaacuaauccucac

SEQ ID NO: 2145423 - RNA, 16 nt, Staphylococcus aureus subsp. aureus N315
guaaauguuaaauucu

SEQ ID NO: 2145424 - RNA, 13 nt, Staphylococcus aureus subsp. aureus N315
guaaauuacaaaa

SEQ ID NO: 2145425 - RNA, 20 nt, Staphylococcus aureus subsp. aureus N315
guaaaucuuguuggauuuua

SEQ ID NO: 2145426 - RNA, 15 nt, Staphylococcus aureus subsp. aureus N315
guaaaugaaauaggc

SEQ ID NO: 2145427 - RNA, 17 nt, Staphylococcus aureus subsp. aureus N315
guaaauuuaucauuuua

SEQ ID NO: 2145428 - RNA, 12 nt, Staphylococcus aureus subsp. aureus N315
guaaauuuauca

SEQ ID NO: 2145429 - RNA, 14 nt, Staphylococcus aureus subsp. aureus N315
guaaauuuaaaaua

SEQ ID NO: 2145430 - RNA, 17 nt, Staphylococcus aureus subsp. aureus N315
guaaauuuaaaauaaua

SEQ ID NO: 2145431 - RNA, 16 nt, Staphylococcus aureus subsp. aureus N315
guaacaauaacaccug

SEQ ID NO: 2145432 - RNA, 18 nt, Staphylococcus aureus subsp. aureus N315
guaacaauuuagcaaaua

SEQ ID NO: 2145433 - RNA, 17 nt, Staphylococcus aureus subsp. aureus N315
guaacauaucagcuuuu

SEQ ID NO: 2145434 - RNA, 23 nt, Staphylococcus aureus subsp. aureus N315
guaacacacuuauaaucuauaaa

SEQ ID NO: 2145435 - RNA, 21 nt, Staphylococcus aureus subsp. aureus N315
guaaauccuuuauauucuaau

SEQ ID NO: 2145436 - RNA, 22 nt, Staphylococcus aureus subsp. aureus N315
guaaauauuuuuuaaaaugaua

SEQ ID NO: 2145437 - RNA, 13 nt, Staphylococcus aureus subsp. aureus N315
guaaaucaucaua

SEQ ID NO: 2145438 - RNA, 21 nt, Staphylococcus aureus subsp. aureus N315
guaaauauaguaauaaaaguc

SEQ ID NO: 2145439 - RNA, 13 nt, Staphylococcus aureus subsp. aureus N315
guaaauaauagua

SEQ ID NO: 2145440 - RNA, 14 nt, Staphylococcus aureus subsp. aureus N315
guaaauaaaacuau

SEQ ID NO: 2145441 - RNA, 20 nt, Staphylococcus aureus subsp. aureus N315
guaaauaaaaauuauauaaa

SEQ ID NO: 2145442 - RNA, 16 nt, Staphylococcus aureus subsp. aureus N315
guaaagccaccuaaau

SEQ ID NO: 2145443 - RNA, 14 nt, Staphylococcus aureus subsp. aureus N315
guaaaggugauauu

SEQ ID NO: 2145444 - RNA, 18 nt, Staphylococcus aureus subsp. aureus N315
guaacauuaaaaauaaaa

SEQ ID NO: 2145445 - RNA, 16 nt, Staphylococcus aureus subsp. aureus N315
guaaccuuuauuuuca

SEQ ID NO: 2145446 - RNA, 22 nt, Staphylococcus aureus subsp. aureus N315
guaacgcucaugaguuucucau

SEQ ID NO: 2145447 - RNA, 15 nt, Staphylococcus aureus subsp. aureus N315
guaacgcgcaaugag

SEQ ID NO: 2145448 - RNA, 17 nt, Staphylococcus aureus subsp. aureus N315
guaacgcgcaaugagua

SEQ ID NO: 2145449 - RNA, 19 nt, Staphylococcus aureus subsp. aureus N315
guaagaccccgaaaagagg

SEQ ID NO: 2145450 - RNA, 17 nt, Staphylococcus aureus subsp. aureus N315
guaacuuuaucacugua

SEQ ID NO: 2145451 - RNA, 13 nt, Staphylococcus aureus subsp. aureus N315
guaacugauuuug

SEQ ID NO: 2145452 - RNA, 17 nt, Staphylococcus aureus subsp. aureus N315
guaaguagaagcaaaag

SEQ ID NO: 2145453 - RNA, 20 nt, Staphylococcus aureus subsp. aureus N315
guaaguuuaguucaaagcga

SEQ ID NO: 2145454 - RNA, 17 nt, Staphylococcus aureus subsp. aureus N315
guaaguuggcuuacugu

SEQ ID NO: 2145455 - RNA, 13 nt, Staphylococcus aureus subsp. aureus N315
guaagugcucaaa

SEQ ID NO: 2145456 - RNA, 23 nt, Staphylococcus aureus subsp. aureus N315
guaauaaaagucgauaaauauga

SEQ ID NO: 2145457 - RNA, 14 nt, Staphylococcus aureus subsp. aureus N315
guaauaaagaaggg

SEQ ID NO: 2145458 - RNA, 18 nt, Staphylococcus aureus subsp. aureus N315
guaauaacaucuaaauuu

SEQ ID NO: 2145459 - RNA, 22 nt, Staphylococcus aureus subsp. aureus N315
guaauaaccaugccagcuucua

SEQ ID NO: 2145460 - RNA, 21 nt, Staphylococcus aureus subsp. aureus N315
guaaguaaaauaaaaaaugca

SEQ ID NO: 2145461 - RNA, 16 nt, Staphylococcus aureus subsp. aureus N315
guaaguaauaaaauaa

SEQ ID NO: 2145462 - RNA, 20 nt, Staphylococcus aureus subsp. aureus N315
guaagguggacuucuaucuu

SEQ ID NO: 2145463 - RNA, 21 nt, Staphylococcus aureus subsp. aureus N315
guaagcuucuguguuggggcc

SEQ ID NO: 2145464 - RNA, 22 nt, Staphylococcus aureus subsp. aureus N315
guaagcaccuguuauugcaaua

SEQ ID NO: 2145465 - RNA, 18 nt, Staphylococcus aureus subsp. aureus N315
ggucuuuuaauuaaaagu

SEQ ID NO: 2145466 - RNA, 23 nt, Staphylococcus aureus subsp. aureus N315
ggugauauuugcuagucauaauu

SEQ ID NO: 2145467 - RNA, 21 nt, Staphylococcus aureus subsp. aureus N315
ggugcuuuuggaugauuggua

SEQ ID NO: 2145468 - RNA, 15 nt, Staphylococcus aureus subsp. aureus N315
gggugagggccccaa

SEQ ID NO: 2145469 - RNA, 14 nt, Staphylococcus aureus subsp. aureus N315
gggugaauuaguaa

SEQ ID NO: 2145470 - RNA, 17 nt, Staphylococcus aureus subsp. aureus N315
ggggacuuaaccauuua

SEQ ID NO: 2145471 - RNA, 18 nt, Staphylococcus aureus subsp. aureus N315
gguaaaaaugaaccauuu

SEQ ID NO: 2145472 - RNA, 22 nt, Staphylococcus aureus subsp. aureus N315
gguaaaucuguuuaaauuuaaa

SEQ ID NO: 2145473 - RNA, 13 nt, Staphylococcus aureus subsp. aureus N315
gguaacuuuuuaa

SEQ ID NO: 2145474 - RNA, 15 nt, Staphylococcus aureus subsp. aureus N315
gguauaaaaaaauua

SEQ ID NO: 2145475 - RNA, 14 nt, Staphylococcus aureus subsp. aureus N315
gguauucaaauaaa

SEQ ID NO: 2145476 - RNA, 10 nt, Staphylococcus aureus subsp. aureus N315
gguaauaauu

SEQ ID NO: 2145477 - RNA, 22 nt, Staphylococcus aureus subsp. aureus N315
gguaauucaccaucauauucaa

SEQ ID NO: 2145478 - RNA, 23 nt, Staphylococcus aureus subsp. aureus N315
gguacacauguacguuuuuuuaa

SEQ ID NO: 2145479 - RNA, 17 nt, Staphylococcus aureus subsp. aureus N315
gguacaacuaaauaugc

SEQ ID NO: 2145480 - RNA, 12 nt, Staphylococcus aureus subsp. aureus N315
gggccccaacac

SEQ ID NO: 2145481 - RNA, 17 nt, Staphylococcus aureus subsp. aureus N315
gggccccaacacagaga

SEQ ID NO: 2145482 - RNA, 13 nt, Staphylococcus aureus subsp. aureus N315
gggcccccaacac

SEQ ID NO: 2145483 - RNA, 14 nt, Staphylococcus aureus subsp. aureus N315
gggcccccaacaca

SEQ ID NO: 2145484 - RNA, 22 nt, Staphylococcus aureus subsp. aureus N315
gggaugggccccaacaaagaga

SEQ ID NO: 2145485 - RNA, 16 nt, Staphylococcus aureus subsp. aureus N315
gggaaauauuugaaaa

SEQ ID NO: 2145486 - RNA, 15 nt, Staphylococcus aureus subsp. aureus N315
gggcuuuuaugcaug

SEQ ID NO: 2145487 - RNA, 13 nt, Staphylococcus aureus subsp. aureus N315
gggcguucugcua

SEQ ID NO: 2145488 - RNA, 11 nt, Staphylococcus aureus subsp. aureus N315
ggcuuuaaaau

SEQ ID NO: 2145489 - RNA, 17 nt, Staphylococcus aureus subsp. aureus N315
ggcuugguuauuuucaa

SEQ ID NO: 2145490 - RNA, 18 nt, Staphylococcus aureus subsp. aureus N315
uaauuagauuuaaaaugu

SEQ ID NO: 2145491 - RNA, 16 nt, Staphylococcus aureus subsp. aureus N315
uaauuaggauuaacau

SEQ ID NO: 2145492 - RNA, 17 nt, Staphylococcus aureus subsp. aureus N315
uaauuaggauuuccgga

SEQ ID NO: 2145493 - RNA, 21 nt, Staphylococcus aureus subsp. aureus N315
uaauuagguauaguguuugac

SEQ ID NO: 2145494 - RNA, 22 nt, Staphylococcus aureus subsp. aureus N315
uaauuagugcaaguaauuuaau

SEQ ID NO: 2145495 - RNA, 19 nt, Staphylococcus aureus subsp. aureus N315
uaauucccuaggaaauaaa

SEQ ID NO: 2145496 - RNA, 19 nt, Staphylococcus aureus subsp. aureus N315
uaauuauacguuacuaaac

SEQ ID NO: 2145497 - RNA, 13 nt, Staphylococcus aureus subsp. aureus N315
uaauucauauuca

SEQ ID NO: 2145498 - RNA, 17 nt, Staphylococcus aureus subsp. aureus N315
uaauucccuguuaugaa

SEQ ID NO: 2145499 - RNA, 16 nt, Staphylococcus aureus subsp. aureus N315
uaauucugguuuaaug

SEQ ID NO: 2145500 - RNA, 16 nt, Staphylococcus aureus subsp. aureus N315
uaauucuuaaucgagu

SEQ ID NO: 2145501 - RNA, 20 nt, Staphylococcus aureus subsp. aureus N315
uaauucuuaaucgagugauu

SEQ ID NO: 2145502 - RNA, 22 nt, Staphylococcus aureus subsp. aureus N315
uaauucugaaaucaguuuuuga

SEQ ID NO: 2145503 - RNA, 14 nt, Staphylococcus aureus subsp. aureus N315
uaauucuucaucaa

SEQ ID NO: 2145504 - RNA, 13 nt, Staphylococcus aureus subsp. aureus N315
uaauucuucauca

SEQ ID NO: 2145505 - RNA, 17 nt, Staphylococcus aureus subsp. aureus N315
uaauucuucaaccauuu

SEQ ID NO: 2145506 - RNA, 23 nt, Staphylococcus aureus subsp. aureus N315
uaauucuuaaucgagugauucag

SEQ ID NO: 2145507 - RNA, 21 nt, Staphylococcus aureus subsp. aureus N315
uaauugcauagcuaaauaaau

SEQ ID NO: 2145508 - RNA, 19 nt, Staphylococcus aureus subsp. aureus N315
uaauugcauagcuaaauaa

SEQ ID NO: 2145509 - RNA, 21 nt, Staphylococcus aureus subsp. aureus N315
uaauugagagaaguuucuaua

SEQ ID NO: 2145510 - RNA, 19 nt, Staphylococcus aureus subsp. aureus N315
uaauugaugaugaugugcu

SEQ ID NO: 2145511 - RNA, 22 nt, Staphylococcus aureus subsp. aureus N315
uaauugaugaugaugugcuuua

SEQ ID NO: 2145512 - RNA, 16 nt, Staphylococcus aureus subsp. aureus N315
uaauugaugaaagacu

SEQ ID NO: 2145513 - RNA, 12 nt, Staphylococcus aureus subsp. aureus N315
uaauugaaugaa

SEQ ID NO: 2145514 - RNA, 22 nt, Staphylococcus aureus subsp. aureus N315
uaauugaaaugauagaugcugg

SEQ ID NO: 2145515 - RNA, 15 nt, Staphylococcus aureus subsp. aureus N315
uaauugaaaaucuaa

SEQ ID NO: 2145516 - RNA, 15 nt, Staphylococcus aureus subsp. aureus N315
uaauugaaaaaccaa

SEQ ID NO: 2145517 - RNA, 17 nt, Staphylococcus aureus subsp. aureus N315
uaauugcguuuaauaac

SEQ ID NO: 2145518 - RNA, 15 nt, Staphylococcus aureus subsp. aureus N315
uaauuggaaucaucu

SEQ ID NO: 2145519 - RNA, 21 nt, Staphylococcus aureus subsp. aureus N315
uaauuggaaucaucuuuuuga

SEQ ID NO: 2145520 - RNA, 13 nt, Staphylococcus aureus subsp. aureus N315
uaauuggcagaua

SEQ ID NO: 2145521 - RNA, 16 nt, Staphylococcus aureus subsp. aureus N315
uaauuguaaucuauuu

SEQ ID NO: 2145522 - RNA, 16 nt, Staphylococcus aureus subsp. aureus N315
uaauuaaauaaaaaua

SEQ ID NO: 2145523 - RNA, 14 nt, Staphylococcus aureus subsp. aureus N315
uaauuaaauaacuu

SEQ ID NO: 2145524 - RNA, 15 nt, Staphylococcus aureus subsp. aureus N315
uaauuaaagcaucuu

SEQ ID NO: 2145525 - RNA, 17 nt, Staphylococcus aureus subsp. aureus N315
uaauuaaagauuaaaau

SEQ ID NO: 2145526 - RNA, 14 nt, Staphylococcus aureus subsp. aureus N315
uaauuaaagauuaa

SEQ ID NO: 2145527 - RNA, 21 nt, Staphylococcus aureus subsp. aureus N315
uaauuaaacgcucaacuauau

SEQ ID NO: 2145528 - RNA, 20 nt, Staphylococcus aureus subsp. aureus N315
uaauuaacacauucaaauaa

SEQ ID NO: 2145529 - RNA, 22 nt, Staphylococcus aureus subsp. aureus N315
uaauuacuuucauuguaaauuu

SEQ ID NO: 2145530 - RNA, 17 nt, Staphylococcus aureus subsp. aureus N315
uaauuaagaaaaucauu

SEQ ID NO: 2145531 - RNA, 20 nt, Staphylococcus aureus subsp. aureus N315
uaauuaagaaaaucauucau

SEQ ID NO: 2145532 - RNA, 16 nt, Staphylococcus aureus subsp. aureus N315
uaauguuaaacacuca

SEQ ID NO: 2145533 - RNA, 22 nt, Staphylococcus aureus subsp. aureus N315
uaauguuaaaauaacugcuaau

SEQ ID NO: 2145534 - RNA, 19 nt, Staphylococcus aureus subsp. aureus N315
uaauguuccccugaaaaga

SEQ ID NO: 2145535 - RNA, 18 nt, Staphylococcus aureus subsp. aureus N315
uaauguuggcaaacuauu

SEQ ID NO: 2145536 - RNA, 17 nt, Staphylococcus aureus subsp. aureus N315
uaauguguuaauacuuc

SEQ ID NO: 2145537 - RNA, 19 nt, Staphylococcus aureus subsp. aureus N315
uaaugucucuuuucacgaa

SEQ ID NO: 2145538 - RNA, 13 nt, Staphylococcus aureus subsp. aureus N315
uaaugucuucaua

SEQ ID NO: 2145539 - RNA, 22 nt, Staphylococcus aureus subsp. aureus N315
uaaugucgcacuauaaaauuca

SEQ ID NO: 2145540 - RNA, 20 nt, Staphylococcus aureus subsp. aureus N315
uaaugcuguacuauauucaa

SEQ ID NO: 2145541 - RNA, 16 nt, Staphylococcus aureus subsp. aureus N315
uaaucuuguuuucauu

SEQ ID NO: 2145542 - RNA, 22 nt, Staphylococcus aureus subsp. aureus N315
uaaucuuguuuucauuuaaaag

SEQ ID NO: 2145543 - RNA, 18 nt, Staphylococcus aureus subsp. aureus N315
uaaucuuuaacauuuauu

SEQ ID NO: 2145544 - RNA, 22 nt, Staphylococcus aureus subsp. aureus N315
uaaucuuuaacauuuauucuuu

SEQ ID NO: 2145545 - RNA, 22 nt, Staphylococcus aureus subsp. aureus N315
uaaucuugauuauauuuuucuu

SEQ ID NO: 2145546 - RNA, 15 nt, Staphylococcus aureus subsp. aureus N315
uaaucuucucauaaa

SEQ ID NO: 2145547 - RNA, 20 nt, Staphylococcus aureus subsp. aureus N315
uaauguaaaguugauaaugu

SEQ ID NO: 2145548 - RNA, 16 nt, Staphylococcus aureus subsp. aureus N315
uaaugucaugaaaaua

SEQ ID NO: 2145549 - RNA, 21 nt, Staphylococcus aureus subsp. aureus N315
uaauguaucauuucagaaaua

SEQ ID NO: 2145550 - RNA, 17 nt, Staphylococcus aureus subsp. aureus N315
uaauguacauguauaaa

SEQ ID NO: 2145551 - RNA, 20 nt, Staphylococcus aureus subsp. aureus N315
uaauguaccaaucaaugacu

SEQ ID NO: 2145552 - RNA, 18 nt, Staphylococcus aureus subsp. aureus N315
uaauggcacuuaauauaa

SEQ ID NO: 2145553 - RNA, 18 nt, Staphylococcus aureus subsp. aureus N315
uaaucugcugcuguugaa

SEQ ID NO: 2145554 - RNA, 18 nt, Staphylococcus aureus subsp. aureus N315
uaaucguguauuauugaa

SEQ ID NO: 2145555 - RNA, 17 nt, Staphylococcus aureus subsp. aureus N315
uaaucguuuuuacugua

SEQ ID NO: 2145556 - RNA, 16 nt, Staphylococcus aureus subsp. aureus N315
uaaucuaaauucaguu

SEQ ID NO: 2145557 - RNA, 15 nt, Staphylococcus aureus subsp. aureus N315
uaaucguauuuuuaa

SEQ ID NO: 2145558 - RNA, 12 nt, Staphylococcus aureus subsp. aureus N315
uaauccauucuu

SEQ ID NO: 2145559 - RNA, 19 nt, Staphylococcus aureus subsp. aureus N315
uaaucccauuuuaaaguca

SEQ ID NO: 2145560 - RNA, 17 nt, Staphylococcus aureus subsp. aureus N315
uaaucccaucgcuuuuu

SEQ ID NO: 2145561 - RNA, 17 nt, Staphylococcus aureus subsp. aureus N315
uaaucccauuuuaaagu

SEQ ID NO: 2145562 - RNA, 13 nt, Staphylococcus aureus subsp. aureus N315
uaauccagccaca

SEQ ID NO: 2145563 - RNA, 20 nt, Staphylococcus aureus subsp. aureus N315
uaaucgauugguaaaucuac

SEQ ID NO: 2145564 - RNA, 15 nt, Staphylococcus aureus subsp. aureus N315
uaaucgcauucuugg

SEQ ID NO: 2145565 - RNA, 13 nt, Staphylococcus aureus subsp. aureus N315
uaaucgcauucuu

SEQ ID NO: 2145566 - RNA, 21 nt, Staphylococcus aureus subsp. aureus N315
uaauccccgaagcacagaaaa

SEQ ID NO: 2145567 - RNA, 12 nt, Staphylococcus aureus subsp. aureus N315
uaauauuauaaa

SEQ ID NO: 2145568 - RNA, 14 nt, Staphylococcus aureus subsp. aureus N315
uaauauuucuuaga

SEQ ID NO: 2145569 - RNA, 15 nt, Staphylococcus aureus subsp. aureus N315
uaauauuucuuagau

SEQ ID NO: 2145570 - RNA, 18 nt, Staphylococcus aureus subsp. aureus N315
uaauauuugauaacaaaa

SEQ ID NO: 2145571 - RNA, 23 nt, Staphylococcus aureus subsp. aureus N315
uaaucaaaaaagacucauacaca

SEQ ID NO: 2145572 - RNA, 13 nt, Staphylococcus aureus subsp. aureus N315
uaaucaaaauuau

SEQ ID NO: 2145573 - RNA, 12 nt, Staphylococcus aureus subsp. aureus N315
uaauauuuucuu

SEQ ID NO: 2145574 - RNA, 15 nt, Staphylococcus aureus subsp. aureus N315
uaauauuuuaaacgu

SEQ ID NO: 2145575 - RNA, 16 nt, Staphylococcus aureus subsp. aureus N315
uaauaugaauuuagau

SEQ ID NO: 2145576 - RNA, 24 nt, Staphylococcus aureus subsp. aureus N315
uaauagagacauuuuaucugaaaa

SEQ ID NO: 2145577 - RNA, 18 nt, Staphylococcus aureus subsp. aureus N315
uaaucagcuauaaaagua

SEQ ID NO: 2145578 - RNA, 21 nt, Staphylococcus aureus subsp. aureus N315
uaaucagcuauaaaaguacuu

SEQ ID NO: 2145579 - RNA, 12 nt, Staphylococcus aureus subsp. aureus N315
uaaucauaaaaa

SEQ ID NO: 2145580 - RNA, 17 nt, Staphylococcus aureus subsp. aureus N315
uaaucauaaugaauaau

SEQ ID NO: 2145581 - RNA, 15 nt, Staphylococcus aureus subsp. aureus N315
uaaucagugaaauau

SEQ ID NO: 2145582 - RNA, 13 nt, Staphylococcus aureus subsp. aureus N315
uaaucaaagauuu

SEQ ID NO: 2145583 - RNA, 15 nt, Staphylococcus aureus subsp. aureus N315
uaaucaaauuaguca

SEQ ID NO: 2145584 - RNA, 22 nt, Staphylococcus aureus subsp. aureus N315
uaaucaacaaagugcaauuauu

SEQ ID NO: 2145585 - RNA, 18 nt, Staphylococcus aureus subsp. aureus N315
uaaucaagcaaugcaugc

SEQ ID NO: 2145586 - RNA, 17 nt, Staphylococcus aureus subsp. aureus N315
uaaguagaaaauaugac

SEQ ID NO: 2145587 - RNA, 14 nt, Staphylococcus aureus subsp. aureus N315
uaaguagaagcaaa

SEQ ID NO: 2145588 - RNA, 20 nt, Staphylococcus aureus subsp. aureus N315
uaaguaguuguuauauucua

SEQ ID NO: 2145589 - RNA, 15 nt, Staphylococcus aureus subsp. aureus N315
uaaguacuuuuacaa

SEQ ID NO: 2145590 - RNA, 18 nt, Staphylococcus aureus subsp. aureus N315
uaaguaagauuuaaacau

SEQ ID NO: 2145591 - RNA, 13 nt, Staphylococcus aureus subsp. aureus N315
uaaguaauauaau

SEQ ID NO: 2145592 - RNA, 16 nt, Staphylococcus aureus subsp. aureus N315
uaaguaauaauauaaa

SEQ ID NO: 2145593 - RNA, 17 nt, Staphylococcus aureus subsp. aureus N315
uaaguacagcauauaau

SEQ ID NO: 2145594 - RNA, 20 nt, Staphylococcus aureus subsp. aureus N315
uaaguaauaauauaaauaaa

SEQ ID NO: 2145595 - RNA, 20 nt, Staphylococcus aureus subsp. aureus N315
uaaggugauugaacaauaau

SEQ ID NO: 2145596 - RNA, 23 nt, Staphylococcus aureus subsp. aureus N315
uaagguaagaccccgaaaagagg

SEQ ID NO: 2145597 - RNA, 23 nt, Staphylococcus aureus subsp. aureus N315
uaagguauuucauugauaagucu

SEQ ID NO: 2145598 - RNA, 15 nt, Staphylococcus aureus subsp. aureus N315
uaagguuugaacucu

SEQ ID NO: 2145599 - RNA, 20 nt, Staphylococcus aureus subsp. aureus N315
uaaguaaaauaaaaaaugca

SEQ ID NO: 2145600 - RNA, 13 nt, Staphylococcus aureus subsp. aureus N315
uaaguaaaacugc

SEQ ID NO: 2145601 - RNA, 16 nt, Staphylococcus aureus subsp. aureus N315
uaaguaaaacugcaau

SEQ ID NO: 2145602 - RNA, 17 nt, Staphylococcus aureus subsp. aureus N315
uaaguguaaaugaaagu

SEQ ID NO: 2145603 - RNA, 21 nt, Staphylococcus aureus subsp. aureus N315
uaagugccuugccaugauuua

SEQ ID NO: 2145604 - RNA, 23 nt, Staphylococcus aureus subsp. aureus N315
uaagugauuucuucauuaucaau

SEQ ID NO: 2145605 - RNA, 23 nt, Staphylococcus aureus subsp. aureus N315
uaagugaugaccaauauucugga

SEQ ID NO: 2145606 - RNA, 15 nt, Staphylococcus aureus subsp. aureus N315
uaagugauaaauaau

SEQ ID NO: 2145607 - RNA, 20 nt, Staphylococcus aureus subsp. aureus N315
uaagugaauuaucuauauau

SEQ ID NO: 2145608 - RNA, 17 nt, Staphylococcus aureus subsp. aureus N315
uaagugaacuauuaaaa

SEQ ID NO: 2145609 - RNA, 16 nt, Staphylococcus aureus subsp. aureus N315
uaagucuuuuaaauga

SEQ ID NO: 2145610 - RNA, 20 nt, Staphylococcus aureus subsp. aureus N315
uaagucugaugucgaaaaua

SEQ ID NO: 2145611 - RNA, 19 nt, Staphylococcus aureus subsp. aureus N315
uaagucuuaacaaauuaaa

SEQ ID NO: 2145612 - RNA, 22 nt, Staphylococcus aureus subsp. aureus N315
uaaguuaauuuuaugucccaau

SEQ ID NO: 2145613 - RNA, 22 nt, Staphylococcus aureus subsp. aureus N315
uaaguuaaaaccuuuucaaauu

SEQ ID NO: 2145614 - RNA, 21 nt, Staphylococcus aureus subsp. aureus N315
uaaguuauuuggauauuuauu

SEQ ID NO: 2145615 - RNA, 15 nt, Staphylococcus aureus subsp. aureus N315
uaaguugauuucuac

SEQ ID NO: 2145616 - RNA, 22 nt, Staphylococcus aureus subsp. aureus N315
uaaguuggcuuacugucaccuu

SEQ ID NO: 2145617 - RNA, 14 nt, Staphylococcus aureus subsp. aureus N315
uaaguuugaaucau

SEQ ID NO: 2145618 - RNA, 19 nt, Staphylococcus aureus subsp. aureus N315
uaaguuuuugaauaucuaa

SEQ ID NO: 2145619 - RNA, 11 nt, Staphylococcus aureus subsp. aureus N315
uaauaaauugu

SEQ ID NO: 2145620 - RNA, 22 nt, Staphylococcus aureus subsp. aureus N315
uaauaaaucauuaguuguauca

SEQ ID NO: 2145621 - RNA, 19 nt, Staphylococcus aureus subsp. aureus N315
uaauaaaucgaauugaugg

SEQ ID NO: 2145622 - RNA, 22 nt, Staphylococcus aureus subsp. aureus N315
uaauaaaucuaucuacucaaau

SEQ ID NO: 2145623 - RNA, 13 nt, Staphylococcus aureus subsp. aureus N315
uaauaaauuuaac

SEQ ID NO: 2145624 - RNA, 22 nt, Staphylococcus aureus subsp. aureus N315
uaauaaauuguuaucguucaau

SEQ ID NO: 2145625 - RNA, 12 nt, Staphylococcus aureus subsp. aureus N315
uaauaacaaaau

SEQ ID NO: 2145626 - RNA, 21 nt, Staphylococcus aureus subsp. aureus N315
uaauaaauaggaugaaaaaga

SEQ ID NO: 2145627 - RNA, 19 nt, Staphylococcus aureus subsp. aureus N315
uaauaaagcugauuuuuca

SEQ ID NO: 2145628 - RNA, 16 nt, Staphylococcus aureus subsp. aureus N315
uaauaaagaauaaaca

SEQ ID NO: 2145629 - RNA, 22 nt, Staphylococcus aureus subsp. aureus N315
uaauaaaucacgccauaaucuu

SEQ ID NO: 2145630 - RNA, 21 nt, Staphylococcus aureus subsp. aureus N315
uaauaaacgacgcaagugacu

SEQ ID NO: 2145631 - RNA, 13 nt, Staphylococcus aureus subsp. aureus N315
uaauaaaccuaaa

SEQ ID NO: 2145632 - RNA, 21 nt, Staphylococcus aureus subsp. aureus N315
uaauaacauccccaaaaauag

SEQ ID NO: 2145633 - RNA, 20 nt, Staphylococcus aureus subsp. aureus N315
uaauaacauccccaaaaaua

SEQ ID NO: 2145634 - RNA, 14 nt, Staphylococcus aureus subsp. aureus N315
uaauaacaucuaaa

SEQ ID NO: 2145635 - RNA, 18 nt, Staphylococcus aureus subsp. aureus N315
uaauaaccauguaaaauu

SEQ ID NO: 2145636 - RNA, 20 nt, Staphylococcus aureus subsp. aureus N315
uaauaacccgaacacaaaaa

SEQ ID NO: 2145637 - RNA, 18 nt, Staphylococcus aureus subsp. aureus N315
uaauaaccuuuaaaacau

SEQ ID NO: 2145638 - RNA, 17 nt, Staphylococcus aureus subsp. aureus N315
uaauaacgcauauaagc

SEQ ID NO: 2145639 - RNA, 18 nt, Staphylococcus aureus subsp. aureus N315
uaauaauauugaauggua

SEQ ID NO: 2145640 - RNA, 15 nt, Staphylococcus aureus subsp. aureus N315
uaauaauauaaauaa

SEQ ID NO: 2145641 - RNA, 13 nt, Staphylococcus aureus subsp. aureus N315
uaauaauaucuuu

SEQ ID NO: 2145642 - RNA, 15 nt, Staphylococcus aureus subsp. aureus N315
uaauaauacuucuaa

SEQ ID NO: 2145643 - RNA, 13 nt, Staphylococcus aureus subsp. aureus N315
uaauaauaaucuu

SEQ ID NO: 2145644 - RNA, 15 nt, Staphylococcus aureus subsp. aureus N315
uaauaaguugaauau

SEQ ID NO: 2145645 - RNA, 19 nt, Staphylococcus aureus subsp. aureus N315
uaauaaguugaauauaaaa

SEQ ID NO: 2145646 - RNA, 16 nt, Staphylococcus aureus subsp. aureus N315
uaauaauuggaaucau

SEQ ID NO: 2145647 - RNA, 22 nt, Staphylococcus aureus subsp. aureus N315
uaauaauugcauguaaaauuaa

SEQ ID NO: 2145648 - RNA, 15 nt, Staphylococcus aureus subsp. aureus N315
uaauaauuauuaaua

SEQ ID NO: 2145649 - RNA, 19 nt, Staphylococcus aureus subsp. aureus N315
uaauaauuuaacuaaucaa

SEQ ID NO: 2145650 - RNA, 12 nt, Staphylococcus aureus subsp. aureus N315
uaauaauuuaac

SEQ ID NO: 2145651 - RNA, 15 nt, Staphylococcus aureus subsp. aureus N315
uaauaauuuaacuaa

SEQ ID NO: 2145652 - RNA, 18 nt, Staphylococcus aureus subsp. aureus N315
uaauaauuggaaucaucu

SEQ ID NO: 2145653 - RNA, 20 nt, Staphylococcus aureus subsp. aureus N315
uaauaaugacgagaauuaaa

SEQ ID NO: 2145654 - RNA, 16 nt, Staphylococcus aureus subsp. aureus N315
uaauaauguaucauuu

SEQ ID NO: 2145655 - RNA, 16 nt, Staphylococcus aureus subsp. aureus N315
uaauaaugaauucuau

SEQ ID NO: 2145656 - RNA, 18 nt, Staphylococcus aureus subsp. aureus N315
uaauaaucuuuaacauuu

SEQ ID NO: 2145657 - RNA, 16 nt, Staphylococcus aureus subsp. aureus N315
uaauaaucuuuaacau

SEQ ID NO: 2145658 - RNA, 16 nt, Staphylococcus aureus subsp. aureus N315
uaauacaucuaauaaa

SEQ ID NO: 2145659 - RNA, 19 nt, Staphylococcus aureus subsp. aureus N315
uaauacacuugauaaaacu

SEQ ID NO: 2145660 - RNA, 14 nt, Staphylococcus aureus subsp. aureus N315
uaauacaagcaaua

SEQ ID NO: 2145661 - RNA, 13 nt, Staphylococcus aureus subsp. aureus N315
uaauaauuuuuuu

SEQ ID NO: 2145662 - RNA, 21 nt, Staphylococcus aureus subsp. aureus N315
uaauaauuugguuaacauccu

SEQ ID NO: 2145663 - RNA, 22 nt, Staphylococcus aureus subsp. aureus N315
uaauacuuuuugaguauccaau

SEQ ID NO: 2145664 - RNA, 15 nt, Staphylococcus aureus subsp. aureus N315
uaauacuuuucucga

SEQ ID NO: 2145665 - RNA, 15 nt, Staphylococcus aureus subsp. aureus N315
uaauagaaauaauca

SEQ ID NO: 2145666 - RNA, 17 nt, Staphylococcus aureus subsp. aureus N315
uaauacuuucaaacaaa

SEQ ID NO: 2145667 - RNA, 20 nt, Staphylococcus aureus subsp. aureus N315
uaauacuuucacuuuuuaua

SEQ ID NO: 2145668 - RNA, 20 nt, Staphylococcus aureus subsp. aureus N315
uaauacuguuuaaauaaaau

SEQ ID NO: 2145669 - RNA, 21 nt, Staphylococcus aureus subsp. aureus N315
uaauacuguuuaaauaaaauu

SEQ ID NO: 2145670 - RNA, 22 nt, Staphylococcus aureus subsp. aureus N315
uaauacuucauauccuucauua

SEQ ID NO: 2145671 - RNA, 17 nt, Staphylococcus aureus subsp. aureus N315
uaauacgucguaaugaa

SEQ ID NO: 2145672 - RNA, 21 nt, Staphylococcus aureus subsp. aureus N315
uaauacguguguuuucuuuuc

SEQ ID NO: 2145673 - RNA, 20 nt, Staphylococcus aureus subsp. aureus N315
uaauacuaccguuuuuauau

SEQ ID NO: 2145674 - RNA, 16 nt, Staphylococcus aureus subsp. aureus N315
uaauacuauaugaaaa

SEQ ID NO: 2145675 - RNA, 22 nt, Staphylococcus aureus subsp. aureus N315
uaauacuguauuuuaacgucau

SEQ ID NO: 2145676 - RNA, 15 nt, Staphylococcus aureus subsp. aureus N315
uaauaccauugugau

SEQ ID NO: 2145677 - RNA, 17 nt, Staphylococcus aureus subsp. aureus N315
uaauaccagcauccauu

SEQ ID NO: 2145678 - RNA, 19 nt, Staphylococcus aureus subsp. aureus N315
uaauaccaauuuuuagcau

SEQ ID NO: 2145679 - RNA, 19 nt, Staphylococcus aureus subsp. aureus N315
uaauaccuuuacuuucauu

SEQ ID NO: 2145680 - RNA, 17 nt, Staphylococcus aureus subsp. aureus N315
uaauaccuuuacuuuca

SEQ ID NO: 2145681 - RNA, 20 nt, Staphylococcus aureus subsp. aureus N315
uaauaccuuuacuuucauua

SEQ ID NO: 2145682 - RNA, 21 nt, Staphylococcus aureus subsp. aureus N315
uacuacacuccccuuaucaaa

SEQ ID NO: 2145683 - RNA, 20 nt, Staphylococcus aureus subsp. aureus N315
uacuacaaacuugauuaugu

SEQ ID NO: 2145684 - RNA, 13 nt, Staphylococcus aureus subsp. aureus N315
uacuacauuauua

SEQ ID NO: 2145685 - RNA, 16 nt, Staphylococcus aureus subsp. aureus N315
uacuacgcauuauuaa

SEQ ID NO: 2145686 - RNA, 23 nt, Staphylococcus aureus subsp. aureus N315
uacuacuugauucuacuucaccu

SEQ ID NO: 2145687 - RNA, 14 nt, Staphylococcus aureus subsp. aureus N315
uacuaauuucuaua

SEQ ID NO: 2145688 - RNA, 21 nt, Staphylococcus aureus subsp. aureus N315
uacuaauauucuaggcaaaua

SEQ ID NO: 2145689 - RNA, 15 nt, Staphylococcus aureus subsp. aureus N315
uacuaaucaauacua

SEQ ID NO: 2145690 - RNA, 17 nt, Staphylococcus aureus subsp. aureus N315
uacuaaacgauaaauua

SEQ ID NO: 2145691 - RNA, 19 nt, Staphylococcus aureus subsp. aureus N315
uacguuuaauaaugguucu

SEQ ID NO: 2145692 - RNA, 17 nt, Staphylococcus aureus subsp. aureus N315
uacuaaaccucaacauu

SEQ ID NO: 2145693 - RNA, 18 nt, Staphylococcus aureus subsp. aureus N315
uacguuauuucaauaaua

SEQ ID NO: 2145694 - RNA, 19 nt, Staphylococcus aureus subsp. aureus N315
uacguuauuucaauaauaa

SEQ ID NO: 2145695 - RNA, 14 nt, Staphylococcus aureus subsp. aureus N315
uacuaaacuuuuuu

SEQ ID NO: 2145696 - RNA, 19 nt, Staphylococcus aureus subsp. aureus N315
uacuaaauaaguaguucag

SEQ ID NO: 2145697 - RNA, 13 nt, Staphylococcus aureus subsp. aureus N315
uacuaaaugaauu

SEQ ID NO: 2145698 - RNA, 14 nt, Staphylococcus aureus subsp. aureus N315
uacuaaauugagaa

SEQ ID NO: 2145699 - RNA, 22 nt, Staphylococcus aureus subsp. aureus N315
uacuaaauugagaaguauuaug

SEQ ID NO: 2145700 - RNA, 15 nt, Staphylococcus aureus subsp. aureus N315
uacuaaauugagaag

SEQ ID NO: 2145701 - RNA, 15 nt, Staphylococcus aureus subsp. aureus N315
uacgguuauggugug

SEQ ID NO: 2145702 - RNA, 16 nt, Staphylococcus aureus subsp. aureus N315
uacguguguuuucuuu

SEQ ID NO: 2145703 - RNA, 16 nt, Staphylococcus aureus subsp. aureus N315
uacguuauuucaauaa

SEQ ID NO: 2145704 - RNA, 16 nt, Staphylococcus aureus subsp. aureus N315
uacgcuuuuuaaaaaa

SEQ ID NO: 2145705 - RNA, 15 nt, Staphylococcus aureus subsp. aureus N315
uacgcucauaugucu

SEQ ID NO: 2145706 - RNA, 20 nt, Staphylococcus aureus subsp. aureus N315
uaccuggguuaccaaguaau

SEQ ID NO: 2145707 - RNA, 20 nt, Staphylococcus aureus subsp. aureus N315
uaccugguucgauuguaaua

SEQ ID NO: 2145708 - RNA, 17 nt, Staphylococcus aureus subsp. aureus N315
uaccuguccaaauaaau

SEQ ID NO: 2145709 - RNA, 11 nt, Staphylococcus aureus subsp. aureus N315
uacgacucucc

SEQ ID NO: 2145710 - RNA, 16 nt, Staphylococcus aureus subsp. aureus N315
uacgauucaauuuaac

SEQ ID NO: 2145711 - RNA, 14 nt, Staphylococcus aureus subsp. aureus N315
uacgauugcaauug

SEQ ID NO: 2145712 - RNA, 20 nt, Staphylococcus aureus subsp. aureus N315
uacgauugaguugaaaauaa

SEQ ID NO: 2145713 - RNA, 15 nt, Staphylococcus aureus subsp. aureus N315
uacgcccaucaucac

SEQ ID NO: 2145714 - RNA, 19 nt, Staphylococcus aureus subsp. aureus N315
uacgccuucuuuauaacuu

SEQ ID NO: 2145715 - RNA, 16 nt, Staphylococcus aureus subsp. aureus N315
uacccauaauuuaaau

SEQ ID NO: 2145716 - RNA, 22 nt, Staphylococcus aureus subsp. aureus N315
uacccauaauuuaaaugauauu

SEQ ID NO: 2145717 - RNA, 18 nt, Staphylococcus aureus subsp. aureus N315
uaccauugugaugauaau

SEQ ID NO: 2145718 - RNA, 16 nt, Staphylococcus aureus subsp. aureus N315
uaccauugugaauaau

SEQ ID NO: 2145719 - RNA, 22 nt, Staphylococcus aureus subsp. aureus N315
uaccaugaugagauaaaaucau

SEQ ID NO: 2145720 - RNA, 19 nt, Staphylococcus aureus subsp. aureus N315
uaccaugaugagauaaaau

SEQ ID NO: 2145721 - RNA, 23 nt, Staphylococcus aureus subsp. aureus N315
uaccaugaugagauaaaaucaua

SEQ ID NO: 2145722 - RNA, 15 nt, Staphylococcus aureus subsp. aureus N315
uaccaucuuuaauac

SEQ ID NO: 2145723 - RNA, 15 nt, Staphylococcus aureus subsp. aureus N315
uaccauauaauucuu

SEQ ID NO: 2145724 - RNA, 11 nt, Staphylococcus aureus subsp. aureus N315
uaccaccccaa

SEQ ID NO: 2145725 - RNA, 15 nt, Staphylococcus aureus subsp. aureus N315
uaccaguucaacaug

SEQ ID NO: 2145726 - RNA, 20 nt, Staphylococcus aureus subsp. aureus N315
uaccacacuuuaaacaagca

SEQ ID NO: 2145727 - RNA, 20 nt, Staphylococcus aureus subsp. aureus N315
uaccacaucgcauaauaucu

SEQ ID NO: 2145728 - RNA, 18 nt, Staphylococcus aureus subsp. aureus N315
uaccuccccaacuuaaua

SEQ ID NO: 2145729 - RNA, 14 nt, Staphylococcus aureus subsp. aureus N315
uaccuaaaauaccc

SEQ ID NO: 2145730 - RNA, 18 nt, Staphylococcus aureus subsp. aureus N315
uaccuaaaauagaaaaau

SEQ ID NO: 2145731 - RNA, 11 nt, Staphylococcus aureus subsp. aureus N315
uaccuaaaaua

SEQ ID NO: 2145732 - RNA, 16 nt, Staphylococcus aureus subsp. aureus N315
uaccucuugauaaaau

SEQ ID NO: 2145733 - RNA, 23 nt, Staphylococcus aureus subsp. aureus N315
uaccucuuguaccgucuuaucua

SEQ ID NO: 2145734 - RNA, 18 nt, Staphylococcus aureus subsp. aureus N315
uaccgucuucucuaucag

SEQ ID NO: 2145735 - RNA, 14 nt, Staphylococcus aureus subsp. aureus N315
uacauauguguaug

SEQ ID NO: 2145736 - RNA, 15 nt, Staphylococcus aureus subsp. aureus N315
uacaucaauuucuag

SEQ ID NO: 2145737 - RNA, 14 nt, Staphylococcus aureus subsp. aureus N315
uacauauuggcuug

SEQ ID NO: 2145738 - RNA, 16 nt, Staphylococcus aureus subsp. aureus N315
uacauauaucaacaug

SEQ ID NO: 2145739 - RNA, 16 nt, Staphylococcus aureus subsp. aureus N315
uacauaggauaucuac

SEQ ID NO: 2145740 - RNA, 13 nt, Staphylococcus aureus subsp. aureus N315
uacauauaagaau

SEQ ID NO: 2145741 - RNA, 17 nt, Staphylococcus aureus subsp. aureus N315
uacauauaagaauuguu

SEQ ID NO: 2145742 - RNA, 21 nt, Staphylococcus aureus subsp. aureus N315
uacaucauuaaauauuuagau

SEQ ID NO: 2145743 - RNA, 14 nt, Staphylococcus aureus subsp. aureus N315
uacaucauuaaaua

SEQ ID NO: 2145744 - RNA, 17 nt, Staphylococcus aureus subsp. aureus N315
uacaugacauucauuua

SEQ ID NO: 2145745 - RNA, 16 nt, Staphylococcus aureus subsp. aureus N315
uacauguauaaaagau

SEQ ID NO: 2145746 - RNA, 19 nt, Staphylococcus aureus subsp. aureus N315
uacaugcaccuuuacaaca

SEQ ID NO: 2145747 - RNA, 15 nt, Staphylococcus aureus subsp. aureus N315
uacauuaauauaaau

SEQ ID NO: 2145748 - RNA, 17 nt, Staphylococcus aureus subsp. aureus N315
uacauuaauauaaauau

SEQ ID NO: 2145749 - RNA, 17 nt, Staphylococcus aureus subsp. aureus N315
uacauuacgcucaucac

SEQ ID NO: 2145750 - RNA, 14 nt, Staphylococcus aureus subsp. aureus N315
uacauugauaaauu

SEQ ID NO: 2145751 - RNA, 14 nt, Staphylococcus aureus subsp. aureus N315
uacauugauaaaau

SEQ ID NO: 2145752 - RNA, 17 nt, Staphylococcus aureus subsp. aureus N315
uacauuguaaauauagu

SEQ ID NO: 2145753 - RNA, 16 nt, Staphylococcus aureus subsp. aureus N315
uacauuguaaauauag

SEQ ID NO: 2145754 - RNA, 16 nt, Staphylococcus aureus subsp. aureus N315
uacauuuaguacauau

SEQ ID NO: 2145755 - RNA, 16 nt, Staphylococcus aureus subsp. aureus N315
uacauuuuaauaaaau

SEQ ID NO: 2145756 - RNA, 21 nt, Staphylococcus aureus subsp. aureus N315
uacauuuugaaacaucuaaau

SEQ ID NO: 2145757 - RNA, 17 nt, Staphylococcus aureus subsp. aureus N315
uacauuuugcucuaaac

SEQ ID NO: 2145758 - RNA, 17 nt, Staphylococcus aureus subsp. aureus N315
uaccaaaaaguauugcc

SEQ ID NO: 2145759 - RNA, 17 nt, Staphylococcus aureus subsp. aureus N315
uaccaauugcuucuucg

SEQ ID NO: 2145760 - RNA, 17 nt, Staphylococcus aureus subsp. aureus N315
uaccaauuguuucagcu

SEQ ID NO: 2145761 - RNA, 19 nt, Staphylococcus aureus subsp. aureus N315
uaccaaugaauaaauugau

SEQ ID NO: 2145762 - RNA, 18 nt, Staphylococcus aureus subsp. aureus N315
uaccaauacguuuccaau

SEQ ID NO: 2145763 - RNA, 14 nt, Staphylococcus aureus subsp. aureus N315
uaccaaauauauuu

SEQ ID NO: 2145764 - RNA, 22 nt, Staphylococcus aureus subsp. aureus N315
uaccaaauauauuuuuauuaau

SEQ ID NO: 2145765 - RNA, 12 nt, Staphylococcus aureus subsp. aureus N315
uaccaaauauau

SEQ ID NO: 2145766 - RNA, 13 nt, Staphylococcus aureus subsp. aureus N315
uaccaaacugccu

SEQ ID NO: 2145767 - RNA, 16 nt, Staphylococcus aureus subsp. aureus N315
uaccaaauaaauuaaa

SEQ ID NO: 2145768 - RNA, 14 nt, Staphylococcus aureus subsp. aureus N315
uaccaaacaauaca

SEQ ID NO: 2145769 - RNA, 17 nt, Staphylococcus aureus subsp. aureus N315
uacaaugaauuucuaau

SEQ ID NO: 2145770 - RNA, 22 nt, Staphylococcus aureus subsp. aureus N315
uacaaugaauuguuaguuuucu

SEQ ID NO: 2145771 - RNA, 23 nt, Staphylococcus aureus subsp. aureus N315
uacaaugaauuguuaguuuucuu

SEQ ID NO: 2145772 - RNA, 13 nt, Staphylococcus aureus subsp. aureus N315
uacaaugaaaaaa

SEQ ID NO: 2145773 - RNA, 17 nt, Staphylococcus aureus subsp. aureus N315
uacaaucaucacacaua

SEQ ID NO: 2145774 - RNA, 19 nt, Staphylococcus aureus subsp. aureus N315
uacaaucauuuauguagau

SEQ ID NO: 2145775 - RNA, 20 nt, Staphylococcus aureus subsp. aureus N315
uacaauauucaauaauucau

SEQ ID NO: 2145776 - RNA, 16 nt, Staphylococcus aureus subsp. aureus N315
uacaauaugauuaaua

SEQ ID NO: 2145777 - RNA, 19 nt, Staphylococcus aureus subsp. aureus N315
uacaauauucaauaauuca

SEQ ID NO: 2145778 - RNA, 15 nt, Staphylococcus aureus subsp. aureus N315
uacaauauagaaaau

SEQ ID NO: 2145779 - RNA, 17 nt, Staphylococcus aureus subsp. aureus N315
uacaauauagaaaauga

SEQ ID NO: 2145780 - RNA, 22 nt, Staphylococcus aureus subsp. aureus N315
uacaaccuuugcuuaaaccuua

SEQ ID NO: 2145781 - RNA, 23 nt, Staphylococcus aureus subsp. aureus N315
uacaacgacacgaacaacauuag

SEQ ID NO: 2145782 - RNA, 22 nt, Staphylococcus aureus subsp. aureus N315
uacaauaaugugcaaguugggg

SEQ ID NO: 2145783 - RNA, 13 nt, Staphylococcus aureus subsp. aureus N315
uacaauaaucacu

SEQ ID NO: 2145784 - RNA, 19 nt, Staphylococcus aureus subsp. aureus N315
uacaauaagcgcaauuaaa

SEQ ID NO: 2145785 - RNA, 20 nt, Staphylococcus aureus subsp. aureus N315
uacaauaagcgcaauuaaaa

SEQ ID NO: 2145786 - RNA, 21 nt, Staphylococcus aureus subsp. aureus N315
uacaauaagcgcaauuaaaag

SEQ ID NO: 2145787 - RNA, 18 nt, Staphylococcus aureus subsp. aureus N315
uacaaaucguaaacauaa

SEQ ID NO: 2145788 - RNA, 18 nt, Staphylococcus aureus subsp. aureus N315
uacaaauguauaaauaau

SEQ ID NO: 2145789 - RNA, 20 nt, Staphylococcus aureus subsp. aureus N315
uacaaaucaugacauaaaac

SEQ ID NO: 2145790 - RNA, 17 nt, Staphylococcus aureus subsp. aureus N315
uacaaauauguaaucag

SEQ ID NO: 2145791 - RNA, 19 nt, Staphylococcus aureus subsp. aureus N315
uacaaauguauaaauaaua

SEQ ID NO: 2145792 - RNA, 18 nt, Staphylococcus aureus subsp. aureus N315
uacaaauuuuuuuuauua

SEQ ID NO: 2145793 - RNA, 18 nt, Staphylococcus aureus subsp. aureus N315
uacaacaccaauugaaau

SEQ ID NO: 2145794 - RNA, 15 nt, Staphylococcus aureus subsp. aureus N315
uacaacaguaaucau

SEQ ID NO: 2145795 - RNA, 21 nt, Staphylococcus aureus subsp. aureus N315
uacaacaccaauugaaauuaa

SEQ ID NO: 2145796 - RNA, 14 nt, Staphylococcus aureus subsp. aureus N315
uacaacauacaugc

SEQ ID NO: 2145797 - RNA, 20 nt, Staphylococcus aureus subsp. aureus N315
uacaaagucauuuucauuca

SEQ ID NO: 2145798 - RNA, 18 nt, Staphylococcus aureus subsp. aureus N315
uacaaaguuauaauggca

SEQ ID NO: 2145799 - RNA, 23 nt, Staphylococcus aureus subsp. aureus N315
uaauuguacuuaaaccuaacaua

SEQ ID NO: 2145800 - RNA, 17 nt, Staphylococcus aureus subsp. aureus N315
uaauuguacuuaaaccu

SEQ ID NO: 2145801 - RNA, 19 nt, Staphylococcus aureus subsp. aureus N315
uaauugucucaucauuuaa

SEQ ID NO: 2145802 - RNA, 21 nt, Staphylococcus aureus subsp. aureus N315
uaauugucucaucauuuaaaa

SEQ ID NO: 2145803 - RNA, 14 nt, Staphylococcus aureus subsp. aureus N315
uaauugucuuuaua

SEQ ID NO: 2145804 - RNA, 14 nt, Staphylococcus aureus subsp. aureus N315
uaauuguuuaauaa

SEQ ID NO: 2145805 - RNA, 17 nt, Staphylococcus aureus subsp. aureus N315
uacaaagccuuaauauc

SEQ ID NO: 2145806 - RNA, 22 nt, Staphylococcus aureus subsp. aureus N315
uacaaagccuuaauaucaugca

SEQ ID NO: 2145807 - RNA, 18 nt, Staphylococcus aureus subsp. aureus N315
uaauuguuaaaucaccaa

SEQ ID NO: 2145808 - RNA, 23 nt, Staphylococcus aureus subsp. aureus N315
uaauuguuauaaguaaauaauag

SEQ ID NO: 2145809 - RNA, 13 nt, Staphylococcus aureus subsp. aureus N315
uaauuguuaaauc

SEQ ID NO: 2145810 - RNA, 18 nt, Staphylococcus aureus subsp. aureus N315
uacagauaaguaauaaua

SEQ ID NO: 2145811 - RNA, 14 nt, Staphylococcus aureus subsp. aureus N315
uacagauaauuauu

SEQ ID NO: 2145812 - RNA, 15 nt, Staphylococcus aureus subsp. aureus N315
uacagauaauuauuu

SEQ ID NO: 2145813 - RNA, 21 nt, Staphylococcus aureus subsp. aureus N315
uacagagaaucaauuauugaa

SEQ ID NO: 2145814 - RNA, 18 nt, Staphylococcus aureus subsp. aureus N315
uacacacuaaggaaaauu

SEQ ID NO: 2145815 - RNA, 22 nt, Staphylococcus aureus subsp. aureus N315
uacacuuggcuuaggaugaaaa

SEQ ID NO: 2145816 - RNA, 16 nt, Staphylococcus aureus subsp. aureus N315
uacacuugauuaucau

SEQ ID NO: 2145817 - RNA, 16 nt, Staphylococcus aureus subsp. aureus N315
uacaauuuuuaaaaac

SEQ ID NO: 2145818 - RNA, 15 nt, Staphylococcus aureus subsp. aureus N315
uacaauuuuuaaaaa

SEQ ID NO: 2145819 - RNA, 15 nt, Staphylococcus aureus subsp. aureus N315
uacacuuuucuuauc

SEQ ID NO: 2145820 - RNA, 21 nt, Staphylococcus aureus subsp. aureus N315
uacagaauggauaccuaaagc

SEQ ID NO: 2145821 - RNA, 16 nt, Staphylococcus aureus subsp. aureus N315
uacagacaaacauuac

SEQ ID NO: 2145822 - RNA, 17 nt, Staphylococcus aureus subsp. aureus N315
uagaauagucaauuaau

SEQ ID NO: 2145823 - RNA, 17 nt, Staphylococcus aureus subsp. aureus N315
uagaauaguuaccaaaa

SEQ ID NO: 2145824 - RNA, 19 nt, Staphylococcus aureus subsp. aureus N315
uagaauagucaauuaauga

SEQ ID NO: 2145825 - RNA, 19 nt, Staphylococcus aureus subsp. aureus N315
uagaauaguuaccaaaauu

SEQ ID NO: 2145826 - RNA, 20 nt, Staphylococcus aureus subsp. aureus N315
uagaaucaaccguuuuauug

SEQ ID NO: 2145827 - RNA, 12 nt, Staphylococcus aureus subsp. aureus N315
uagaauuucuuu

SEQ ID NO: 2145828 - RNA, 18 nt, Staphylococcus aureus subsp. aureus N315
uagaaugucgauauuucu

SEQ ID NO: 2145829 - RNA, 16 nt, Staphylococcus aureus subsp. aureus N315
uagaauucuaaaagaa

SEQ ID NO: 2145830 - RNA, 18 nt, Staphylococcus aureus subsp. aureus N315
uagaauucuaaaagaauu

SEQ ID NO: 2145831 - RNA, 15 nt, Staphylococcus aureus subsp. aureus N315
uagaauuauuuagaa

SEQ ID NO: 2145832 - RNA, 19 nt, Staphylococcus aureus subsp. aureus N315
uagaauuauuuagaaacuu

SEQ ID NO: 2145833 - RNA, 21 nt, Staphylococcus aureus subsp. aureus N315
uagaacgaaauaguucaaaau

SEQ ID NO: 2145834 - RNA, 18 nt, Staphylococcus aureus subsp. aureus N315
uagaagaacaauaauuga

SEQ ID NO: 2145835 - RNA, 20 nt, Staphylococcus aureus subsp. aureus N315
uagaagcaaaagaugaaaau

SEQ ID NO: 2145836 - RNA, 21 nt, Staphylococcus aureus subsp. aureus N315
uagaagaugauuauucucuuu

SEQ ID NO: 2145837 - RNA, 23 nt, Staphylococcus aureus subsp. aureus N315
uagaagguuauuuuuuauggucu

SEQ ID NO: 2145838 - RNA, 16 nt, Staphylococcus aureus subsp. aureus N315
uacuaucuucaucaua

SEQ ID NO: 2145839 - RNA, 19 nt, Staphylococcus aureus subsp. aureus N315
uacuaucuucaucauauuc

SEQ ID NO: 2145840 - RNA, 23 nt, Staphylococcus aureus subsp. aureus N315
uagaaacuuccaacauauaaaaa

SEQ ID NO: 2145841 - RNA, 15 nt, Staphylococcus aureus subsp. aureus N315
uagaaacacuuuuag

SEQ ID NO: 2145842 - RNA, 18 nt, Staphylococcus aureus subsp. aureus N315
uacuaggaauauaaaacu

SEQ ID NO: 2145843 - RNA, 23 nt, Staphylococcus aureus subsp. aureus N315
uacuagaaagcacaccuaauuca

SEQ ID NO: 2145844 - RNA, 16 nt, Staphylococcus aureus subsp. aureus N315
uacuacuuaauuaaua

SEQ ID NO: 2145845 - RNA, 24 nt, Staphylococcus aureus subsp. aureus N315
uacuauaaaaucaucguauuucau

SEQ ID NO: 2145846 - RNA, 20 nt, Staphylococcus aureus subsp. aureus N315
uacuauaaaaucaucguauu

SEQ ID NO: 2145847 - RNA, 22 nt, Staphylococcus aureus subsp. aureus N315
uacuauaaauacgucaucuuua

SEQ ID NO: 2145848 - RNA, 17 nt, Staphylococcus aureus subsp. aureus N315
uacuauaaauccuaagu

SEQ ID NO: 2145849 - RNA, 15 nt, Staphylococcus aureus subsp. aureus N315
uacuauaauaauuaa

SEQ ID NO: 2145850 - RNA, 13 nt, Staphylococcus aureus subsp. aureus N315
uacuauacugaug

SEQ ID NO: 2145851 - RNA, 13 nt, Staphylococcus aureus subsp. aureus N315
uacuauauauaau

SEQ ID NO: 2145852 - RNA, 15 nt, Staphylococcus aureus subsp. aureus N315
uacuauauucaauga

SEQ ID NO: 2145853 - RNA, 13 nt, Staphylococcus aureus subsp. aureus N315
uacuauaugaaaa

SEQ ID NO: 2145854 - RNA, 16 nt, Staphylococcus aureus subsp. aureus N315
uacuauauuuaaauug

SEQ ID NO: 2145855 - RNA, 16 nt, Staphylococcus aureus subsp. aureus N315
uagaacauuuaucgug

SEQ ID NO: 2145856 - RNA, 14 nt, Staphylococcus aureus subsp. aureus N315
uagaaauuuuaaaa

SEQ ID NO: 2145857 - RNA, 18 nt, Staphylococcus aureus subsp. aureus N315
uagaaagugauucccaaa

SEQ ID NO: 2145858 - RNA, 15 nt, Staphylococcus aureus subsp. aureus N315
uagaaaggcaggcau

SEQ ID NO: 2145859 - RNA, 22 nt, Staphylococcus aureus subsp. aureus N315
uagaaagcacaccuaauucaua

SEQ ID NO: 2145860 - RNA, 15 nt, Staphylococcus aureus subsp. aureus N315
uagaaagaaauuguu

SEQ ID NO: 2145861 - RNA, 15 nt, Staphylococcus aureus subsp. aureus N315
uagaaaguugugguc

SEQ ID NO: 2145862 - RNA, 12 nt, Staphylococcus aureus subsp. aureus N315
uagauaauauau

SEQ ID NO: 2145863 - RNA, 19 nt, Staphylococcus aureus subsp. aureus N315
uagauaaacucuaaauaaa

SEQ ID NO: 2145864 - RNA, 19 nt, Staphylococcus aureus subsp. aureus N315
uagauaaaucgauaaaaug

SEQ ID NO: 2145865 - RNA, 23 nt, Staphylococcus aureus subsp. aureus N315
uagagcccgagacauaaauuaau

SEQ ID NO: 2145866 - RNA, 14 nt, Staphylococcus aureus subsp. aureus N315
uagagcguuuugcu

SEQ ID NO: 2145867 - RNA, 14 nt, Staphylococcus aureus subsp. aureus N315
uagagguaaaucua

SEQ ID NO: 2145868 - RNA, 13 nt, Staphylococcus aureus subsp. aureus N315
uagagaaagaaua

SEQ ID NO: 2145869 - RNA, 19 nt, Staphylococcus aureus subsp. aureus N315
uagagaaauacuauucuuu

SEQ ID NO: 2145870 - RNA, 13 nt, Staphylococcus aureus subsp. aureus N315
uagagaacagcag

SEQ ID NO: 2145871 - RNA, 18 nt, Staphylococcus aureus subsp. aureus N315
uagacucaaggaaaucau

SEQ ID NO: 2145872 - RNA, 20 nt, Staphylococcus aureus subsp. aureus N315
uagacucaaggaaaucauau

SEQ ID NO: 2145873 - RNA, 20 nt, Staphylococcus aureus subsp. aureus N315
uagacuaacuguacuuugcc

SEQ ID NO: 2145874 - RNA, 22 nt, Staphylococcus aureus subsp. aureus N315
uagacugccaauaaaaugcaau

SEQ ID NO: 2145875 - RNA, 17 nt, Staphylococcus aureus subsp. aureus N315
uagacugccaauaaaau

SEQ ID NO: 2145876 - RNA, 20 nt, Staphylococcus aureus subsp. aureus N315
uagacguaaguguaaaugaa

SEQ ID NO: 2145877 - RNA, 15 nt, Staphylococcus aureus subsp. aureus N315
uagacgguaucaucu

SEQ ID NO: 2145878 - RNA, 23 nt, Staphylococcus aureus subsp. aureus N315
uagacauaaauauggauuuugaa

SEQ ID NO: 2145879 - RNA, 19 nt, Staphylococcus aureus subsp. aureus N315
uagacauugaauaaaugaa

SEQ ID NO: 2145880 - RNA, 18 nt, Staphylococcus aureus subsp. aureus N315
uagacaguaguuaauuga

SEQ ID NO: 2145881 - RNA, 20 nt, Staphylococcus aureus subsp. aureus N315
uagacaauauuuuuacauau

SEQ ID NO: 2145882 - RNA, 20 nt, Staphylococcus aureus subsp. aureus N315
uagacaauuguaguaaugaa

SEQ ID NO: 2145883 - RNA, 13 nt, Staphylococcus aureus subsp. aureus N315
uagacaccaaaaa

SEQ ID NO: 2145884 - RNA, 20 nt, Staphylococcus aureus subsp. aureus N315
uaggaguaucuguuucuauu

SEQ ID NO: 2145885 - RNA, 21 nt, Staphylococcus aureus subsp. aureus N315
uaggaucuucuuguuuuaaau

SEQ ID NO: 2145886 - RNA, 16 nt, Staphylococcus aureus subsp. aureus N315
uaggaucuuuuccauu

SEQ ID NO: 2145887 - RNA, 16 nt, Staphylococcus aureus subsp. aureus N315
uagggauaauuuuauu

SEQ ID NO: 2145888 - RNA, 23 nt, Staphylococcus aureus subsp. aureus N315
uaggggcuucuuucuaaaauaac

SEQ ID NO: 2145889 - RNA, 17 nt, Staphylococcus aureus subsp. aureus N315
uaggggcuucuuucuaa

SEQ ID NO: 2145890 - RNA, 16 nt, Staphylococcus aureus subsp. aureus N315
uagcuuucuuuuucau

SEQ ID NO: 2145891 - RNA, 15 nt, Staphylococcus aureus subsp. aureus N315
uagcuugaauaauau

SEQ ID NO: 2145892 - RNA, 21 nt, Staphylococcus aureus subsp. aureus N315
uagcuugagcaucuuuuacug

SEQ ID NO: 2145893 - RNA, 15 nt, Staphylococcus aureus subsp. aureus N315
uagcuuuaguuacua

SEQ ID NO: 2145894 - RNA, 16 nt, Staphylococcus aureus subsp. aureus N315
uagcuuucguuucuuu

SEQ ID NO: 2145895 - RNA, 18 nt, Staphylococcus aureus subsp. aureus N315
uagcuuucguuucuuuua

SEQ ID NO: 2145896 - RNA, 18 nt, Staphylococcus aureus subsp. aureus N315
uagcuucgucacguaaaa

SEQ ID NO: 2145897 - RNA, 16 nt, Staphylococcus aureus subsp. aureus N315
uagcucaauugaaucu

SEQ ID NO: 2145898 - RNA, 16 nt, Staphylococcus aureus subsp. aureus N315
uagcgugauuuuucau

SEQ ID NO: 2145899 - RNA, 19 nt, Staphylococcus aureus subsp. aureus N315
uagcgugauuuuucauauu

SEQ ID NO: 2145900 - RNA, 19 nt, Staphylococcus aureus subsp. aureus N315
uagcguuagauaccucuug

SEQ ID NO: 2145901 - RNA, 15 nt, Staphylococcus aureus subsp. aureus N315
uagcgauuuuaaaga

SEQ ID NO: 2145902 - RNA, 14 nt, Staphylococcus aureus subsp. aureus N315
uagcaauaucauca

SEQ ID NO: 2145903 - RNA, 22 nt, Staphylococcus aureus subsp. aureus N315
uagauacucacugcacuuauga

SEQ ID NO: 2145904 - RNA, 20 nt, Staphylococcus aureus subsp. aureus N315
uagauaggauauuuuuuaau

SEQ ID NO: 2145905 - RNA, 14 nt, Staphylococcus aureus subsp. aureus N315
uagauauuauaaaa

SEQ ID NO: 2145906 - RNA, 16 nt, Staphylococcus aureus subsp. aureus N315
uagccaauaucauauu

SEQ ID NO: 2145907 - RNA, 12 nt, Staphylococcus aureus subsp. aureus N315
uagcauaaaauu

SEQ ID NO: 2145908 - RNA, 19 nt, Staphylococcus aureus subsp. aureus N315
uagcauauucgcuuaaaaa

SEQ ID NO: 2145909 - RNA, 18 nt, Staphylococcus aureus subsp. aureus N315
uagcacuuggauuuuaau

SEQ ID NO: 2145910 - RNA, 18 nt, Staphylococcus aureus subsp. aureus N315
uagcaguaauauguugcu

SEQ ID NO: 2145911 - RNA, 19 nt, Staphylococcus aureus subsp. aureus N315
uagcaguuucugagaagaa

SEQ ID NO: 2145912 - RNA, 23 nt, Staphylococcus aureus subsp. aureus N315
uagccaaugcuuccaucacauca

SEQ ID NO: 2145913 - RNA, 16 nt, Staphylococcus aureus subsp. aureus N315
uagccuagauaccaaa

SEQ ID NO: 2145914 - RNA, 13 nt, Staphylococcus aureus subsp. aureus N315
uagccuucauuug

SEQ ID NO: 2145915 - RNA, 19 nt, Staphylococcus aureus subsp. aureus N315
uaucuaaagcuauaaaaaa

SEQ ID NO: 2145916 - RNA, 22 nt, Staphylococcus aureus subsp. aureus N315
uaucuaaagcuauaaaaaaucu

SEQ ID NO: 2145917 - RNA, 17 nt, Staphylococcus aureus subsp. aureus N315
uaucuaaagcuauaaaa

SEQ ID NO: 2145918 - RNA, 13 nt, Staphylococcus aureus subsp. aureus N315
uaucgauaaaugu

SEQ ID NO: 2145919 - RNA, 14 nt, Staphylococcus aureus subsp. aureus N315
uaucgauaguucua

SEQ ID NO: 2145920 - RNA, 22 nt, Staphylococcus aureus subsp. aureus N315
uaucgauucgauuauuuagaua

SEQ ID NO: 2145921 - RNA, 23 nt, Staphylococcus aureus subsp. aureus N315
uaucuacaugguuuucaccagac

SEQ ID NO: 2145922 - RNA, 12 nt, Staphylococcus aureus subsp. aureus N315
uaucuacagaga

SEQ ID NO: 2145923 - RNA, 11 nt, Staphylococcus aureus subsp. aureus N315
uaucuaagucg

SEQ ID NO: 2145924 - RNA, 19 nt, Staphylococcus aureus subsp. aureus N315
uaucuacucaaauauaaau

SEQ ID NO: 2145925 - RNA, 16 nt, Staphylococcus aureus subsp. aureus N315
uaucuacauuaaagaa

SEQ ID NO: 2145926 - RNA, 22 nt, Staphylococcus aureus subsp. aureus N315
uaucuacauuaaagaaaauauc

SEQ ID NO: 2145927 - RNA, 22 nt, Staphylococcus aureus subsp. aureus N315
uaucuacgccuugaccuacuuu

SEQ ID NO: 2145928 - RNA, 16 nt, Staphylococcus aureus subsp. aureus N315
uaucuaccuuuuaauu

SEQ ID NO: 2145929 - RNA, 13 nt, Staphylococcus aureus subsp. aureus N315
uaucuauaaaaag

SEQ ID NO: 2145930 - RNA, 17 nt, Staphylococcus aureus subsp. aureus N315
uaucuaguguucucauu

SEQ ID NO: 2145931 - RNA, 16 nt, Staphylococcus aureus subsp. aureus N315
uaucuagccugaaaua

SEQ ID NO: 2145932 - RNA, 19 nt, Staphylococcus aureus subsp. aureus N315
uaucuguaaauaacuuaug

SEQ ID NO: 2145933 - RNA, 13 nt, Staphylococcus aureus subsp. aureus N315
uaucuguugucau

SEQ ID NO: 2145934 - RNA, 17 nt, Staphylococcus aureus subsp. aureus N315
uaucuguugucaucaug

SEQ ID NO: 2145935 - RNA, 16 nt, Staphylococcus aureus subsp. aureus N315
uaucuguuguuauaua

SEQ ID NO: 2145936 - RNA, 19 nt, Staphylococcus aureus subsp. aureus N315
uaucuguuguuauauaaau

SEQ ID NO: 2145937 - RNA, 22 nt, Staphylococcus aureus subsp. aureus N315
uaucuuaaucagcuauaaaagu

SEQ ID NO: 2145938 - RNA, 19 nt, Staphylococcus aureus subsp. aureus N315
uaucuuaguaagacugcca

SEQ ID NO: 2145939 - RNA, 14 nt, Staphylococcus aureus subsp. aureus N315
uaucuuauauucuu

SEQ ID NO: 2145940 - RNA, 18 nt, Staphylococcus aureus subsp. aureus N315
uaucuuauaacaaaaauu

SEQ ID NO: 2145941 - RNA, 18 nt, Staphylococcus aureus subsp. aureus N315
uaucuguuucuauuauua

SEQ ID NO: 2145942 - RNA, 22 nt, Staphylococcus aureus subsp. aureus N315
uaucugaguuauagaaacuuuc

SEQ ID NO: 2145943 - RNA, 24 nt, Staphylococcus aureus subsp. aureus N315
uaucuauacaauuauggauaaaau

SEQ ID NO: 2145944 - RNA, 15 nt, Staphylococcus aureus subsp. aureus N315
uaucuauaugcauau

SEQ ID NO: 2145945 - RNA, 13 nt, Staphylococcus aureus subsp. aureus N315
uaucuaugaaauu

SEQ ID NO: 2145946 - RNA, 13 nt, Staphylococcus aureus subsp. aureus N315
uaucauuaucaaa

SEQ ID NO: 2145947 - RNA, 18 nt, Staphylococcus aureus subsp. aureus N315
uaucauuaucaaauaacc

SEQ ID NO: 2145948 - RNA, 17 nt, Staphylococcus aureus subsp. aureus N315
uaucauguucuuauaaa

SEQ ID NO: 2145949 - RNA, 15 nt, Staphylococcus aureus subsp. aureus N315
uaucauguucuuaua

SEQ ID NO: 2145950 - RNA, 19 nt, Staphylococcus aureus subsp. aureus N315
uaucauguucuuauaaaaa

SEQ ID NO: 2145951 - RNA, 15 nt, Staphylococcus aureus subsp. aureus N315
uaucaugcaaaauaa

SEQ ID NO: 2145952 - RNA, 14 nt, Staphylococcus aureus subsp. aureus N315
uaucaugauuaauu

SEQ ID NO: 2145953 - RNA, 16 nt, Staphylococcus aureus subsp. aureus N315
uaucaugcuuaucugu

SEQ ID NO: 2145954 - RNA, 21 nt, Staphylococcus aureus subsp. aureus N315
uaucaugcuuaucuguaaaua

SEQ ID NO: 2145955 - RNA, 14 nt, Staphylococcus aureus subsp. aureus N315
uaucaugcuuuuaa

SEQ ID NO: 2145956 - RNA, 23 nt, Staphylococcus aureus subsp. aureus N315
uaucaucaaucguuaauuuccaa

SEQ ID NO: 2145957 - RNA, 21 nt, Staphylococcus aureus subsp. aureus N315
uaucaucaugacuauuucgcu

SEQ ID NO: 2145958 - RNA, 19 nt, Staphylococcus aureus subsp. aureus N315
uaucaucauacuucaauaa

SEQ ID NO: 2145959 - RNA, 12 nt, Staphylococcus aureus subsp. aureus N315
uaucauauuuga

SEQ ID NO: 2145960 - RNA, 21 nt, Staphylococcus aureus subsp. aureus N315
uauccgaaaauugcuaaaaaa

SEQ ID NO: 2145961 - RNA, 20 nt, Staphylococcus aureus subsp. aureus N315
uauccuguuucauaugguga

SEQ ID NO: 2145962 - RNA, 14 nt, Staphylococcus aureus subsp. aureus N315
uauccuuuuugacu

SEQ ID NO: 2145963 - RNA, 15 nt, Staphylococcus aureus subsp. aureus N315
uauccuuuuugacuc

SEQ ID NO: 2145964 - RNA, 21 nt, Staphylococcus aureus subsp. aureus N315
uauaucuauuuaucauacuuc

SEQ ID NO: 2145965 - RNA, 24 nt, Staphylococcus aureus subsp. aureus N315
uauaucuaauucguaauuuaugau

SEQ ID NO: 2145966 - RNA, 16 nt, Staphylococcus aureus subsp. aureus N315
uauaucuaaaugauca

SEQ ID NO: 2145967 - RNA, 18 nt, Staphylococcus aureus subsp. aureus N315
uauauauccuguuucaua

SEQ ID NO: 2145968 - RNA, 21 nt, Staphylococcus aureus subsp. aureus N315
uauauaucacaacacauaaau

SEQ ID NO: 2145969 - RNA, 18 nt, Staphylococcus aureus subsp. aureus N315
uauauaucacaacacaua

SEQ ID NO: 2145970 - RNA, 13 nt, Staphylococcus aureus subsp. aureus N315
uauauauauuaaa

SEQ ID NO: 2145971 - RNA, 13 nt, Staphylococcus aureus subsp. aureus N315
uauauauauauua

SEQ ID NO: 2145972 - RNA, 20 nt, Staphylococcus aureus subsp. aureus N315
uauauaguaggguauugaaa

SEQ ID NO: 2145973 - RNA, 16 nt, Staphylococcus aureus subsp. aureus N315
uauauagauugccauu

SEQ ID NO: 2145974 - RNA, 21 nt, Staphylococcus aureus subsp. aureus N315
uauauagcgcgcuuauugaaa

SEQ ID NO: 2145975 - RNA, 23 nt, Staphylococcus aureus subsp. aureus N315
uauauagcgcgcuuauugaaaag

SEQ ID NO: 2145976 - RNA, 14 nt, Staphylococcus aureus subsp. aureus N315
uauauuaguauaau

SEQ ID NO: 2145977 - RNA, 22 nt, Staphylococcus aureus subsp. aureus N315
uauauuacuaaccuauuaaaau

SEQ ID NO: 2145978 - RNA, 17 nt, Staphylococcus aureus subsp. aureus N315
uauauuaaauacuauau

SEQ ID NO: 2145979 - RNA, 16 nt, Staphylococcus aureus subsp. aureus N315
uauauuaauguuugau

SEQ ID NO: 2145980 - RNA, 15 nt, Staphylococcus aureus subsp. aureus N315
uauauuaauaaucuu

SEQ ID NO: 2145981 - RNA, 15 nt, Staphylococcus aureus subsp. aureus N315
uauauuaauguuuga

SEQ ID NO: 2145982 - RNA, 14 nt, Staphylococcus aureus subsp. aureus N315
uauaugaauuuuau

SEQ ID NO: 2145983 - RNA, 15 nt, Staphylococcus aureus subsp. aureus N315
uauaugaauuuuaua

SEQ ID NO: 2145984 - RNA, 12 nt, Staphylococcus aureus subsp. aureus N315
uauaucuucauu

SEQ ID NO: 2145985 - RNA, 14 nt, Staphylococcus aureus subsp. aureus N315
uauaugaaaagaga

SEQ ID NO: 2145986 - RNA, 15 nt, Staphylococcus aureus subsp. aureus N315
uauauuaaaguaaaa

SEQ ID NO: 2145987 - RNA, 20 nt, Staphylococcus aureus subsp. aureus N315
uauauuaaaaauuucaauaa

SEQ ID NO: 2145988 - RNA, 16 nt, Staphylococcus aureus subsp. aureus N315
uauauuaaaaauuuca

SEQ ID NO: 2145989 - RNA, 19 nt, Staphylococcus aureus subsp. aureus N315
uauauuaaaaauuucaaua

SEQ ID NO: 2145990 - RNA, 18 nt, Staphylococcus aureus subsp. aureus N315
uauauuccacgcucacau

SEQ ID NO: 2145991 - RNA, 16 nt, Staphylococcus aureus subsp. aureus N315
uauauucaucucuuau

SEQ ID NO: 2145992 - RNA, 12 nt, Staphylococcus aureus subsp. aureus N315
uauauucaauuu

SEQ ID NO: 2145993 - RNA, 22 nt, Staphylococcus aureus subsp. aureus N315
uaucaauagaugaaaauuuaau

SEQ ID NO: 2145994 - RNA, 23 nt, Staphylococcus aureus subsp. aureus N315
uaucaagauguuugcaacauauu

SEQ ID NO: 2145995 - RNA, 12 nt, Staphylococcus aureus subsp. aureus N315
uaucaauaaauc

SEQ ID NO: 2145996 - RNA, 19 nt, Staphylococcus aureus subsp. aureus N315
uaucaauugaaugaaguaa

SEQ ID NO: 2145997 - RNA, 21 nt, Staphylococcus aureus subsp. aureus N315
uaucaauuucaacuuauaaaa

SEQ ID NO: 2145998 - RNA, 22 nt, Staphylococcus aureus subsp. aureus N315
uaucaauuucaacuuauaaaau

SEQ ID NO: 2145999 - RNA, 15 nt, Staphylococcus aureus subsp. aureus N315
uauauuuaaaugucu

SEQ ID NO: 2146000 - RNA, 12 nt, Staphylococcus aureus subsp. aureus N315
uauauuuaaacu

SEQ ID NO: 2146001 - RNA, 21 nt, Staphylococcus aureus subsp. aureus N315
uauauuguauuuuauuuauuu

SEQ ID NO: 2146002 - RNA, 20 nt, Staphylococcus aureus subsp. aureus N315
uauauugucgacuuuuagau

SEQ ID NO: 2146003 - RNA, 21 nt, Staphylococcus aureus subsp. aureus N315
uauauugaaauuaaauuuguu

SEQ ID NO: 2146004 - RNA, 23 nt, Staphylococcus aureus subsp. aureus N315
uauauuuaguuaauuauuuagau

SEQ ID NO: 2146005 - RNA, 14 nt, Staphylococcus aureus subsp. aureus N315
uauauuuacacaga

SEQ ID NO: 2146006 - RNA, 22 nt, Staphylococcus aureus subsp. aureus N315
uauauuuacacagaaugauaua

SEQ ID NO: 2146007 - RNA, 16 nt, Staphylococcus aureus subsp. aureus N315
uaucagcuuuuucauu

SEQ ID NO: 2146008 - RNA, 14 nt, Staphylococcus aureus subsp. aureus N315
uaucaauuucuauu

SEQ ID NO: 2146009 - RNA, 15 nt, Staphylococcus aureus subsp. aureus N315
uaucaguaauaauac

SEQ ID NO: 2146010 - RNA, 15 nt, Staphylococcus aureus subsp. aureus N315
uaucauaauauugau

SEQ ID NO: 2146011 - RNA, 17 nt, Staphylococcus aureus subsp. aureus N315
uaucauaaagauaagau

SEQ ID NO: 2146012 - RNA, 22 nt, Staphylococcus aureus subsp. aureus N315
uaucauaauauugaugaauaaa

SEQ ID NO: 2146013 - RNA, 12 nt, Staphylococcus aureus subsp. aureus N315
uaucauaaucuu

SEQ ID NO: 2146014 - RNA, 23 nt, Staphylococcus aureus subsp. aureus N315
uaucauaccgacaccuauacaua

SEQ ID NO: 2146015 - RNA, 22 nt, Staphylococcus aureus subsp. aureus N315
uaucauauaaugguugaauaac

SEQ ID NO: 2146016 - RNA, 14 nt, Staphylococcus aureus subsp. aureus N315
uaucauauucaaaa

SEQ ID NO: 2146017 - RNA, 19 nt, Staphylococcus aureus subsp. aureus N315
uaucauauucaaaauaacu

SEQ ID NO: 2146018 - RNA, 19 nt, Staphylococcus aureus subsp. aureus N315
uaguucaaauugaacuucu

SEQ ID NO: 2146019 - RNA, 23 nt, Staphylococcus aureus subsp. aureus N315
uaguucaaauugaacuucuuuuu

SEQ ID NO: 2146020 - RNA, 20 nt, Staphylococcus aureus subsp. aureus N315
uaguucacaugaauuuuaau

SEQ ID NO: 2146021 - RNA, 21 nt, Staphylococcus aureus subsp. aureus N315
uaguucacaugaauuuuaaua

SEQ ID NO: 2146022 - RNA, 17 nt, Staphylococcus aureus subsp. aureus N315
uaguuaugugcuaaucu

SEQ ID NO: 2146023 - RNA, 18 nt, Staphylococcus aureus subsp. aureus N315
uaguuucugacuuuuaaa

SEQ ID NO: 2146024 - RNA, 20 nt, Staphylococcus aureus subsp. aureus N315
uaguuugacaucuauuucuu

SEQ ID NO: 2146025 - RNA, 21 nt, Staphylococcus aureus subsp. aureus N315
uaguuugauaugcucucuuca

SEQ ID NO: 2146026 - RNA, 16 nt, Staphylococcus aureus subsp. aureus N315
uaguuuucuuaaaaga

SEQ ID NO: 2146027 - RNA, 21 nt, Staphylococcus aureus subsp. aureus N315
uaguuuucuuaaaagagcaag

SEQ ID NO: 2146028 - RNA, 21 nt, Staphylococcus aureus subsp. aureus N315
uauaaaaaagaucacugccaa

SEQ ID NO: 2146029 - RNA, 22 nt, Staphylococcus aureus subsp. aureus N315
uauaaaaaaccguaauuuuaau

SEQ ID NO: 2146030 - RNA, 19 nt, Staphylococcus aureus subsp. aureus N315
uauaaauguuuauaucuuu

SEQ ID NO: 2146031 - RNA, 16 nt, Staphylococcus aureus subsp. aureus N315
uauaaauguuauugcu

SEQ ID NO: 2146032 - RNA, 22 nt, Staphylococcus aureus subsp. aureus N315
uauaaauguuuauaucuuuuau

SEQ ID NO: 2146033 - RNA, 19 nt, Staphylococcus aureus subsp. aureus N315
uauaaaugaaucgcuuuga

SEQ ID NO: 2146034 - RNA, 14 nt, Staphylococcus aureus subsp. aureus N315
uauaaauauaaaaa

SEQ ID NO: 2146035 - RNA, 15 nt, Staphylococcus aureus subsp. aureus N315
uauaaauauaaaaag

SEQ ID NO: 2146036 - RNA, 13 nt, Staphylococcus aureus subsp. aureus N315
uauaaauaucaau

SEQ ID NO: 2146037 - RNA, 13 nt, Staphylococcus aureus subsp. aureus N315
uauaaauacaaau

SEQ ID NO: 2146038 - RNA, 18 nt, Staphylococcus aureus subsp. aureus N315
uauaaauauuuuuaauua

SEQ ID NO: 2146039 - RNA, 15 nt, Staphylococcus aureus subsp. aureus N315
uauaaaucaaauaua

SEQ ID NO: 2146040 - RNA, 18 nt, Staphylococcus aureus subsp. aureus N315
uauaaaucaaauauacuu

SEQ ID NO: 2146041 - RNA, 19 nt, Staphylococcus aureus subsp. aureus N315
uauaaaucaaauauacuuu

SEQ ID NO: 2146042 - RNA, 17 nt, Staphylococcus aureus subsp. aureus N315
uauaaauauuuuuaauu

SEQ ID NO: 2146043 - RNA, 16 nt, Staphylococcus aureus subsp. aureus N315
uauaaacauaucuucu

SEQ ID NO: 2146044 - RNA, 13 nt, Staphylococcus aureus subsp. aureus N315
uauaaaaacaaaa

SEQ ID NO: 2146045 - RNA, 12 nt, Staphylococcus aureus subsp. aureus N315
uauaaaauucac

SEQ ID NO: 2146046 - RNA, 17 nt, Staphylococcus aureus subsp. aureus N315
uauaaaccgccaacuaa

SEQ ID NO: 2146047 - RNA, 22 nt, Staphylococcus aureus subsp. aureus N315
uauaaaccuaaugcuuuaauaa

SEQ ID NO: 2146048 - RNA, 21 nt, Staphylococcus aureus subsp. aureus N315
uauaaauaauaaaugcuauau

SEQ ID NO: 2146049 - RNA, 14 nt, Staphylococcus aureus subsp. aureus N315
uauaaauaaaaaua

SEQ ID NO: 2146050 - RNA, 18 nt, Staphylococcus aureus subsp. aureus N315
uaguuauacuacuauuga

SEQ ID NO: 2146051 - RNA, 17 nt, Staphylococcus aureus subsp. aureus N315
uaguuagcccuauucaa

SEQ ID NO: 2146052 - RNA, 17 nt, Staphylococcus aureus subsp. aureus N315
uaguuagggaaauguag

SEQ ID NO: 2146053 - RNA, 17 nt, Staphylococcus aureus subsp. aureus N315
uaguuaauuauuuagau

SEQ ID NO: 2146054 - RNA, 12 nt, Staphylococcus aureus subsp. aureus N315
uaguuaaauaca

SEQ ID NO: 2146055 - RNA, 21 nt, Staphylococcus aureus subsp. aureus N315
uaguuaagauaccuuuuucua

SEQ ID NO: 2146056 - RNA, 16 nt, Staphylococcus aureus subsp. aureus N315
uaguuaaguauuuaaa

SEQ ID NO: 2146057 - RNA, 12 nt, Staphylococcus aureus subsp. aureus N315
uagugcuuguuu

SEQ ID NO: 2146058 - RNA, 18 nt, Staphylococcus aureus subsp. aureus N315
uaguguucucauuauaau

SEQ ID NO: 2146059 - RNA, 18 nt, Staphylococcus aureus subsp. aureus N315
uagugucacaaagaaauu

SEQ ID NO: 2146060 - RNA, 16 nt, Staphylococcus aureus subsp. aureus N315
uagucucguaauaaug

SEQ ID NO: 2146061 - RNA, 17 nt, Staphylococcus aureus subsp. aureus N315
uagugaaauaccuccug

SEQ ID NO: 2146062 - RNA, 18 nt, Staphylococcus aureus subsp. aureus N315
uagugaaaaaguuucgga

SEQ ID NO: 2146063 - RNA, 21 nt, Staphylococcus aureus subsp. aureus N315
uagugaaaaaguuucggaaaa

SEQ ID NO: 2146064 - RNA, 23 nt, Staphylococcus aureus subsp. aureus N315
uagucuuuuuauuuuaauauuuu

SEQ ID NO: 2146065 - RNA, 15 nt, Staphylococcus aureus subsp. aureus N315
uagucuuuuuaagua

SEQ ID NO: 2146066 - RNA, 20 nt, Staphylococcus aureus subsp. aureus N315
uagucuucggcuuuguaaaa

SEQ ID NO: 2146067 - RNA, 21 nt, Staphylococcus aureus subsp. aureus N315
uagucggggccccaacacaga

SEQ ID NO: 2146068 - RNA, 19 nt, Staphylococcus aureus subsp. aureus N315
uagguauaguguuugacaa

SEQ ID NO: 2146069 - RNA, 12 nt, Staphylococcus aureus subsp. aureus N315
uagguaauaauu

SEQ ID NO: 2146070 - RNA, 16 nt, Staphylococcus aureus subsp. aureus N315
uagguacaacuaaaua

SEQ ID NO: 2146071 - RNA, 15 nt, Staphylococcus aureus subsp. aureus N315
uauaauauacacaaa

SEQ ID NO: 2146072 - RNA, 21 nt, Staphylococcus aureus subsp. aureus N315
uauaauacguguguuuucuuu

SEQ ID NO: 2146073 - RNA, 21 nt, Staphylococcus aureus subsp. aureus N315
uauaauacuguauuuuaacgu

SEQ ID NO: 2146074 - RNA, 21 nt, Staphylococcus aureus subsp. aureus N315
uauaauaaccuaaguuaauuu

SEQ ID NO: 2146075 - RNA, 17 nt, Staphylococcus aureus subsp. aureus N315
uauaauucuaagucucu

SEQ ID NO: 2146076 - RNA, 12 nt, Staphylococcus aureus subsp. aureus N315
uauaauuaauuu

SEQ ID NO: 2146077 - RNA, 14 nt, Staphylococcus aureus subsp. aureus N315
uauaauguauaaaa

SEQ ID NO: 2146078 - RNA, 21 nt, Staphylococcus aureus subsp. aureus N315
uauaauuaaacauuuagauuu

SEQ ID NO: 2146079 - RNA, 13 nt, Staphylococcus aureus subsp. aureus N315
uauaauuaaacau

SEQ ID NO: 2146080 - RNA, 19 nt, Staphylococcus aureus subsp. aureus N315
uauacauaacccuaaaaug

SEQ ID NO: 2146081 - RNA, 16 nt, Staphylococcus aureus subsp. aureus N315
uauacagguuuaauaa

SEQ ID NO: 2146082 - RNA, 18 nt, Staphylococcus aureus subsp. aureus N315
uauacacuuuuugacaua

SEQ ID NO: 2146083 - RNA, 21 nt, Staphylococcus aureus subsp. aureus N315
uauacacacuaaggaaaauua

SEQ ID NO: 2146084 - RNA, 17 nt, Staphylococcus aureus subsp. aureus N315
uauacacacuaaggaaa

SEQ ID NO: 2146085 - RNA, 22 nt, Staphylococcus aureus subsp. aureus N315
uauacaauacuucguauugaau

SEQ ID NO: 2146086 - RNA, 13 nt, Staphylococcus aureus subsp. aureus N315
uauaauuuaaaga

SEQ ID NO: 2146087 - RNA, 19 nt, Staphylococcus aureus subsp. aureus N315
uauaauucuuguuugauuu

SEQ ID NO: 2146088 - RNA, 23 nt, Staphylococcus aureus subsp. aureus N315
uauaauugauugucauauaaaac

SEQ ID NO: 2146089 - RNA, 22 nt, Staphylococcus aureus subsp. aureus N315
uauaauuuauuuagcaucuuua

SEQ ID NO: 2146090 - RNA, 14 nt, Staphylococcus aureus subsp. aureus N315
uauaauuucaauuu

SEQ ID NO: 2146091 - RNA, 12 nt, Staphylococcus aureus subsp. aureus N315
uauaauuuauuu

SEQ ID NO: 2146092 - RNA, 13 nt, Staphylococcus aureus subsp. aureus N315
uauaauuuccuaa

SEQ ID NO: 2146093 - RNA, 23 nt, Staphylococcus aureus subsp. aureus N315
uauaauuucaguaggacauauaa

SEQ ID NO: 2146094 - RNA, 17 nt, Staphylococcus aureus subsp. aureus N315
uauacaacauguguaug

SEQ ID NO: 2146095 - RNA, 20 nt, Staphylococcus aureus subsp. aureus N315
uauaauuucuguuuacgcca

SEQ ID NO: 2146096 - RNA, 13 nt, Staphylococcus aureus subsp. aureus N315
uauacauuuuacc

SEQ ID NO: 2146097 - RNA, 17 nt, Staphylococcus aureus subsp. aureus N315
uauaccauuccaaaaau

SEQ ID NO: 2146098 - RNA, 15 nt, Staphylococcus aureus subsp. aureus N315
uauacugaugaaaac

SEQ ID NO: 2146099 - RNA, 16 nt, Staphylococcus aureus subsp. aureus N315
uauacuugaagaaaag

SEQ ID NO: 2146100 - RNA, 17 nt, Staphylococcus aureus subsp. aureus N315
uauacuacuauugauau

SEQ ID NO: 2146101 - RNA, 15 nt, Staphylococcus aureus subsp. aureus N315
uauacuaaacuuuuu

SEQ ID NO: 2146102 - RNA, 12 nt, Staphylococcus aureus subsp. aureus N315
uauacuaaauug

SEQ ID NO: 2146103 - RNA, 23 nt, Staphylococcus aureus subsp. aureus N315
uauagaaaaugaguacaacauag

SEQ ID NO: 2146104 - RNA, 16 nt, Staphylococcus aureus subsp. aureus N315
uauagaaaauuaacuc

SEQ ID NO: 2146105 - RNA, 15 nt, Staphylococcus aureus subsp. aureus N315
uauacuuuuggucug

SEQ ID NO: 2146106 - RNA, 18 nt, Staphylococcus aureus subsp. aureus N315
uauacuuuuuaaaugauu

SEQ ID NO: 2146107 - RNA, 15 nt, Staphylococcus aureus subsp. aureus N315
uauacuuuuauagaa

SEQ ID NO: 2146108 - RNA, 16 nt, Staphylococcus aureus subsp. aureus N315
uauacuuuuauagaaa

SEQ ID NO: 2146109 - RNA, 14 nt, Staphylococcus aureus subsp. aureus N315
uauacuuuuuaaau

SEQ ID NO: 2146110 - RNA, 22 nt, Staphylococcus aureus subsp. aureus N315
uauagaccguugaaauguucaa

SEQ ID NO: 2146111 - RNA, 19 nt, Staphylococcus aureus subsp. aureus N315
uauagacuaacuguacuuu

SEQ ID NO: 2146112 - RNA, 16 nt, Staphylococcus aureus subsp. aureus N315
uauagcaucuaugauu

SEQ ID NO: 2146113 - RNA, 21 nt, Staphylococcus aureus subsp. aureus N315
uauagccaaaggcaaaaugua

SEQ ID NO: 2146114 - RNA, 20 nt, Staphylococcus aureus subsp. aureus N315
uauagauuuuguauuagcau

SEQ ID NO: 2146115 - RNA, 20 nt, Staphylococcus aureus subsp. aureus N315
uauagauucauguaaauagu

SEQ ID NO: 2146116 - RNA, 21 nt, Staphylococcus aureus subsp. aureus N315
uauagaugacuguagaaaaca

SEQ ID NO: 2146117 - RNA, 13 nt, Staphylococcus aureus subsp. aureus N315
uauagauuaaaaa

SEQ ID NO: 2146118 - RNA, 14 nt, Staphylococcus aureus subsp. aureus N315
uauagauuaaaaaa

SEQ ID NO: 2146119 - RNA, 15 nt, Staphylococcus aureus subsp. aureus N315
uauagauuaaaaaau

SEQ ID NO: 2146120 - RNA, 19 nt, Staphylococcus aureus subsp. aureus N315
uauagauggcguaagcagu

SEQ ID NO: 2146121 - RNA, 18 nt, Staphylococcus aureus subsp. aureus N315
uauagaugacuguagaaa

SEQ ID NO: 2146122 - RNA, 22 nt, Staphylococcus aureus subsp. aureus N315
uauagagccaugaaaaggaaaa

SEQ ID NO: 2146123 - RNA, 16 nt, Staphylococcus aureus subsp. aureus N315
uauagagccaugaaaa

SEQ ID NO: 2146124 - RNA, 19 nt, Staphylococcus aureus subsp. aureus N315
uauagauagguaugcgugg

SEQ ID NO: 2146125 - RNA, 16 nt, Staphylococcus aureus subsp. aureus N315
uaagaggagaaagcua

SEQ ID NO: 2146126 - RNA, 14 nt, Staphylococcus aureus subsp. aureus N315
uaagagauuuucuu

SEQ ID NO: 2146127 - RNA, 15 nt, Staphylococcus aureus subsp. aureus N315
uaagauagauaaauc

SEQ ID NO: 2146128 - RNA, 23 nt, Staphylococcus aureus subsp. aureus N315
uaagauaauuuucaauuagaaaa

SEQ ID NO: 2146129 - RNA, 12 nt, Staphylococcus aureus subsp. aureus N315
uaagaauuuaaa

SEQ ID NO: 2146130 - RNA, 13 nt, Staphylococcus aureus subsp. aureus N315
uaagaauuuaaaa

SEQ ID NO: 2146131 - RNA, 22 nt, Staphylococcus aureus subsp. aureus N315
uaagaaugugagauacguuauu

SEQ ID NO: 2146132 - RNA, 13 nt, Staphylococcus aureus subsp. aureus N315
uaagaauuaacaa

SEQ ID NO: 2146133 - RNA, 15 nt, Staphylococcus aureus subsp. aureus N315
uaagaauuaacaaca

SEQ ID NO: 2146134 - RNA, 20 nt, Staphylococcus aureus subsp. aureus N315
uaagaaugcaccaacaauag

SEQ ID NO: 2146135 - RNA, 20 nt, Staphylococcus aureus subsp. aureus N315
uaagaauguacaauuuuuua

SEQ ID NO: 2146136 - RNA, 22 nt, Staphylococcus aureus subsp. aureus N315
uaagaauauuuaaguuuccuau

SEQ ID NO: 2146137 - RNA, 13 nt, Staphylococcus aureus subsp. aureus N315
uaagacgauuuca

SEQ ID NO: 2146138 - RNA, 22 nt, Staphylococcus aureus subsp. aureus N315
uaagagaacuuuucaaacaaua

SEQ ID NO: 2146139 - RNA, 17 nt, Staphylococcus aureus subsp. aureus N315
uaagacagcuucucauu

SEQ ID NO: 2146140 - RNA, 23 nt, Staphylococcus aureus subsp. aureus N315
uaagaccacaucgauaucuaagu

SEQ ID NO: 2146141 - RNA, 17 nt, Staphylococcus aureus subsp. aureus N315
uaacuucugauucuuca

SEQ ID NO: 2146142 - RNA, 16 nt, Staphylococcus aureus subsp. aureus N315
uaacuucguuuuaaua

SEQ ID NO: 2146143 - RNA, 21 nt, Staphylococcus aureus subsp. aureus N315
uaacuuccuaaaauuuacaaa

SEQ ID NO: 2146144 - RNA, 15 nt, Staphylococcus aureus subsp. aureus N315
uaacuuccuaaaauu

SEQ ID NO: 2146145 - RNA, 16 nt, Staphylococcus aureus subsp. aureus N315
uaacuucauaauauau

SEQ ID NO: 2146146 - RNA, 10 nt, Staphylococcus aureus subsp. aureus N315
uaacuuccua

SEQ ID NO: 2146147 - RNA, 16 nt, Staphylococcus aureus subsp. aureus N315
uaacuugauaucaucu

SEQ ID NO: 2146148 - RNA, 14 nt, Staphylococcus aureus subsp. aureus N315
uaacuugauaucau

SEQ ID NO: 2146149 - RNA, 17 nt, Staphylococcus aureus subsp. aureus N315
uaacuuguaauauaaca

SEQ ID NO: 2146150 - RNA, 14 nt, Staphylococcus aureus subsp. aureus N315
uaacuuuaccaaua

SEQ ID NO: 2146151 - RNA, 21 nt, Staphylococcus aureus subsp. aureus N315
uaacuuuaauauaaguauaau

SEQ ID NO: 2146152 - RNA, 16 nt, Staphylococcus aureus subsp. aureus N315
uaacuguucuuucguc

SEQ ID NO: 2146153 - RNA, 19 nt, Staphylococcus aureus subsp. aureus N315
uaacuuaagcucauuucaa

SEQ ID NO: 2146154 - RNA, 13 nt, Staphylococcus aureus subsp. aureus N315
uaacuuaccauga

SEQ ID NO: 2146155 - RNA, 19 nt, Staphylococcus aureus subsp. aureus N315
uaacuucauaauauauccu

SEQ ID NO: 2146156 - RNA, 20 nt, Staphylococcus aureus subsp. aureus N315
uaacuucauaauauauccug

SEQ ID NO: 2146157 - RNA, 17 nt, Staphylococcus aureus subsp. aureus N315
uaagaaaaucauucauu

SEQ ID NO: 2146158 - RNA, 15 nt, Staphylococcus aureus subsp. aureus N315
uaagaagaaauacuu

SEQ ID NO: 2146159 - RNA, 22 nt, Staphylococcus aureus subsp. aureus N315
uaacuuuccgccuucaauccaa

SEQ ID NO: 2146160 - RNA, 16 nt, Staphylococcus aureus subsp. aureus N315
uaacuuucagcaccag

SEQ ID NO: 2146161 - RNA, 13 nt, Staphylococcus aureus subsp. aureus N315
uaacuuucuuuug

SEQ ID NO: 2146162 - RNA, 22 nt, Staphylococcus aureus subsp. aureus N315
uaacuuucuaauuguuucauug

SEQ ID NO: 2146163 - RNA, 20 nt, Staphylococcus aureus subsp. aureus N315
uaacuuucuuuuguuuuuau

SEQ ID NO: 2146164 - RNA, 15 nt, Staphylococcus aureus subsp. aureus N315
uaagaaaauacuaac

SEQ ID NO: 2146165 - RNA, 23 nt, Staphylococcus aureus subsp. aureus N315
uaagaaaaauguguuaaaauaua

SEQ ID NO: 2146166 - RNA, 13 nt, Staphylococcus aureus subsp. aureus N315
uaacuuuuuaaua

SEQ ID NO: 2146167 - RNA, 16 nt, Staphylococcus aureus subsp. aureus N315
uaacuuuuuaaaggac

SEQ ID NO: 2146168 - RNA, 12 nt, Staphylococcus aureus subsp. aureus N315
uaagcaaaaauu

SEQ ID NO: 2146169 - RNA, 15 nt, Staphylococcus aureus subsp. aureus N315
uaagauuuaaacauc

SEQ ID NO: 2146170 - RNA, 22 nt, Staphylococcus aureus subsp. aureus N315
uaagauuuuuuauguuuaauuu

SEQ ID NO: 2146171 - RNA, 19 nt, Staphylococcus aureus subsp. aureus N315
uaagauuuugaauuuuaua

SEQ ID NO: 2146172 - RNA, 14 nt, Staphylococcus aureus subsp. aureus N315
uaagaugacuacaa

SEQ ID NO: 2146173 - RNA, 19 nt, Staphylococcus aureus subsp. aureus N315
uaagaugacugaaccaauc

SEQ ID NO: 2146174 - RNA, 19 nt, Staphylococcus aureus subsp. aureus N315
uaagcaguuaauaagaaac

SEQ ID NO: 2146175 - RNA, 20 nt, Staphylococcus aureus subsp. aureus N315
uaagcaguuaauaagaaacu

SEQ ID NO: 2146176 - RNA, 15 nt, Staphylococcus aureus subsp. aureus N315
uaagcauaauucaac

SEQ ID NO: 2146177 - RNA, 22 nt, Staphylococcus aureus subsp. aureus N315
uaagcagagccauaaugagagu

SEQ ID NO: 2146178 - RNA, 20 nt, Staphylococcus aureus subsp. aureus N315
uaagcauuaauguucaauuu

SEQ ID NO: 2146179 - RNA, 23 nt, Staphylococcus aureus subsp. aureus N315
uaagcauuaauguucaauuuaua

SEQ ID NO: 2146180 - RNA, 23 nt, Staphylococcus aureus subsp. aureus N315
uaagcuaguguuuuuauuuuuau

SEQ ID NO: 2146181 - RNA, 16 nt, Staphylococcus aureus subsp. aureus N315
uaagcguuuaaucaca

SEQ ID NO: 2146182 - RNA, 17 nt, Staphylococcus aureus subsp. aureus N315
uaagccuuuucaaacau

SEQ ID NO: 2146183 - RNA, 23 nt, Staphylococcus aureus subsp. aureus N315
uaagcgcaauggccauuugauuu

SEQ ID NO: 2146184 - RNA, 15 nt, Staphylococcus aureus subsp. aureus N315
uaagcgcaauuaaaa

SEQ ID NO: 2146185 - RNA, 18 nt, Staphylococcus aureus subsp. aureus N315
uaagcgcaauuaaaagua

SEQ ID NO: 2146186 - RNA, 12 nt, Staphylococcus aureus subsp. aureus N315
uaagcugaaaua

SEQ ID NO: 2146187 - RNA, 23 nt, Staphylococcus aureus subsp. aureus N315
uaagcucguuaauuuuauuuuag

SEQ ID NO: 2146188 - RNA, 21 nt, Staphylococcus aureus subsp. aureus N315
uaagcucauuucaauauuaaa

SEQ ID NO: 2146189 - RNA, 17 nt, Staphylococcus aureus subsp. aureus N315
uaagcucauuucaauau

SEQ ID NO: 2146190 - RNA, 21 nt, Staphylococcus aureus subsp. aureus N315
uaagcugaaaaucaucauuau

SEQ ID NO: 2146191 - RNA, 18 nt, Staphylococcus aureus subsp. aureus N315
uaagcuuuuucuuucucu

SEQ ID NO: 2146192 - RNA, 21 nt, Staphylococcus aureus subsp. aureus N315
uaagcuuuuucuuucucuaac

SEQ ID NO: 2146193 - RNA, 17 nt, Staphylococcus aureus subsp. aureus N315
uaagcuuguaacaagca

SEQ ID NO: 2146194 - RNA, 21 nt, Staphylococcus aureus subsp. aureus N315
uaagcuuaucaacgauuuugu

SEQ ID NO: 2146195 - RNA, 13 nt, Staphylococcus aureus subsp. aureus N315
uaagcuuaucaac

SEQ ID NO: 2146196 - RNA, 15 nt, Staphylococcus aureus subsp. aureus N315
uaaccccuccuggug

SEQ ID NO: 2146197 - RNA, 16 nt, Staphylococcus aureus subsp. aureus N315
uaaccccuccuggugc

SEQ ID NO: 2146198 - RNA, 16 nt, Staphylococcus aureus subsp. aureus N315
uaaccauuuuuucaaa

SEQ ID NO: 2146199 - RNA, 17 nt, Staphylococcus aureus subsp. aureus N315
uaacgcaguugaaaaag

SEQ ID NO: 2146200 - RNA, 15 nt, Staphylococcus aureus subsp. aureus N315
uaaccuuuaaaacau

SEQ ID NO: 2146201 - RNA, 15 nt, Staphylococcus aureus subsp. aureus N315
uaaccuuguucuuua

SEQ ID NO: 2146202 - RNA, 12 nt, Staphylococcus aureus subsp. aureus N315
uaacggcucgcg

SEQ ID NO: 2146203 - RNA, 21 nt, Staphylococcus aureus subsp. aureus N315
uaacuaaaaugucuuugaaaa

SEQ ID NO: 2146204 - RNA, 23 nt, Staphylococcus aureus subsp. aureus N315
uaacuaaaaugucuuugaaaaac

SEQ ID NO: 2146205 - RNA, 17 nt, Staphylococcus aureus subsp. aureus N315
uaacucaauaugauaau

SEQ ID NO: 2146206 - RNA, 23 nt, Staphylococcus aureus subsp. aureus N315
uaacuauauugugcuaaguuagg

SEQ ID NO: 2146207 - RNA, 17 nt, Staphylococcus aureus subsp. aureus N315
uaacucaaagaaacuau

SEQ ID NO: 2146208 - RNA, 18 nt, Staphylococcus aureus subsp. aureus N315
uaacucaaagaaacuaua

SEQ ID NO: 2146209 - RNA, 22 nt, Staphylococcus aureus subsp. aureus N315
uaacucaaauaucuaaacaauu

SEQ ID NO: 2146210 - RNA, 22 nt, Staphylococcus aureus subsp. aureus N315
uaacuagauguucacauucuug

SEQ ID NO: 2146211 - RNA, 19 nt, Staphylococcus aureus subsp. aureus N315
uaacugcaaacuugauuca

SEQ ID NO: 2146212 - RNA, 12 nt, Staphylococcus aureus subsp. aureus N315
uaacugauuuug

SEQ ID NO: 2146213 - RNA, 13 nt, Staphylococcus aureus subsp. aureus N315
uaacugauaaaag

SEQ ID NO: 2146214 - RNA, 15 nt, Staphylococcus aureus subsp. aureus N315
uaacugaccuaacaa

SEQ ID NO: 2146215 - RNA, 14 nt, Staphylococcus aureus subsp. aureus N315
uaacucuucaguac

SEQ ID NO: 2146216 - RNA, 15 nt, Staphylococcus aureus subsp. aureus N315
uaacucuuuaauuuu

SEQ ID NO: 2146217 - RNA, 20 nt, Staphylococcus aureus subsp. aureus N315
uaacuggcaaaucaaacaau

SEQ ID NO: 2146218 - RNA, 21 nt, Staphylococcus aureus subsp. aureus N315
uaacugccauauagauauuag

SEQ ID NO: 2146219 - RNA, 23 nt, Staphylococcus aureus subsp. aureus N315
uaacugguugauaaauaaacuca

SEQ ID NO: 2146220 - RNA, 17 nt, Staphylococcus aureus subsp. aureus N315
uaacuguagcuccuaaa

SEQ ID NO: 2146221 - RNA, 22 nt, Staphylococcus aureus subsp. aureus N315
uaacugugauauuaauugaaaa

SEQ ID NO: 2146222 - RNA, 14 nt, Staphylococcus aureus subsp. aureus N315
uaacuguaaaacau

SEQ ID NO: 2146223 - RNA, 23 nt, Staphylococcus aureus subsp. aureus N315
uaaccaccaucccauuaaaccac

SEQ ID NO: 2146224 - RNA, 22 nt, Staphylococcus aureus subsp. aureus N315
uaaccaaucaucgcaaauacau

SEQ ID NO: 2146225 - RNA, 18 nt, Staphylococcus aureus subsp. aureus N315
uaaccacuccuuaaacaa

SEQ ID NO: 2146226 - RNA, 19 nt, Staphylococcus aureus subsp. aureus N315
uaacauccugcuuauuaau

SEQ ID NO: 2146227 - RNA, 20 nt, Staphylococcus aureus subsp. aureus N315
uaacauccugcuuauuaauu

SEQ ID NO: 2146228 - RNA, 21 nt, Staphylococcus aureus subsp. aureus N315
uaacaggugcuuacuuuuaaa

SEQ ID NO: 2146229 - RNA, 20 nt, Staphylococcus aureus subsp. aureus N315
uaacagcuuaauuuuauuau

SEQ ID NO: 2146230 - RNA, 15 nt, Staphylococcus aureus subsp. aureus N315
uaacagcuaaaaauu

SEQ ID NO: 2146231 - RNA, 16 nt, Staphylococcus aureus subsp. aureus N315
uaacagcuacaaauaa

SEQ ID NO: 2146232 - RNA, 18 nt, Staphylococcus aureus subsp. aureus N315
uaacagcuacaaauaaug

SEQ ID NO: 2146233 - RNA, 20 nt, Staphylococcus aureus subsp. aureus N315
uaacauaucgucaauuuuaa

SEQ ID NO: 2146234 - RNA, 16 nt, Staphylococcus aureus subsp. aureus N315
uaacaucaaauagaca

SEQ ID NO: 2146235 - RNA, 22 nt, Staphylococcus aureus subsp. aureus N315
uaacaucaaauagacaccaaaa

SEQ ID NO: 2146236 - RNA, 16 nt, Staphylococcus aureus subsp. aureus N315
uaacaucacauaaaau

SEQ ID NO: 2146237 - RNA, 21 nt, Staphylococcus aureus subsp. aureus N315
uaacaucacauaaaauacauu

SEQ ID NO: 2146238 - RNA, 17 nt, Staphylococcus aureus subsp. aureus N315
uaacaucaauuacucuu

SEQ ID NO: 2146239 - RNA, 14 nt, Staphylococcus aureus subsp. aureus N315
uaacauaccuaaua

SEQ ID NO: 2146240 - RNA, 17 nt, Staphylococcus aureus subsp. aureus N315
uaacauacuauaaaaau

SEQ ID NO: 2146241 - RNA, 18 nt, Staphylococcus aureus subsp. aureus N315
uaacauacuauaaaaauu

SEQ ID NO: 2146242 - RNA, 20 nt, Staphylococcus aureus subsp. aureus N315
uaacauacuauaaaaauuua

SEQ ID NO: 2146243 - RNA, 20 nt, Staphylococcus aureus subsp. aureus N315
uaaaugcccaccauguacau

SEQ ID NO: 2146244 - RNA, 16 nt, Staphylococcus aureus subsp. aureus N315
uaaaugucacugcaaa

SEQ ID NO: 2146245 - RNA, 19 nt, Staphylococcus aureus subsp. aureus N315
uaaaugucacugcaaacac

SEQ ID NO: 2146246 - RNA, 21 nt, Staphylococcus aureus subsp. aureus N315
uaaaugucacugcaaacacag

SEQ ID NO: 2146247 - RNA, 13 nt, Staphylococcus aureus subsp. aureus N315
uaaaugugacuuu

SEQ ID NO: 2146248 - RNA, 14 nt, Staphylococcus aureus subsp. aureus N315
uaaaugugcaauua

SEQ ID NO: 2146249 - RNA, 16 nt, Staphylococcus aureus subsp. aureus N315
uaaaugugacuuuaaa

SEQ ID NO: 2146250 - RNA, 17 nt, Staphylococcus aureus subsp. aureus N315
uaaaugugcaauuagaa

SEQ ID NO: 2146251 - RNA, 13 nt, Staphylococcus aureus subsp. aureus N315
uaaauguuauuaa

SEQ ID NO: 2146252 - RNA, 15 nt, Staphylococcus aureus subsp. aureus N315
uaaauguuaaagauu

SEQ ID NO: 2146253 - RNA, 17 nt, Staphylococcus aureus subsp. aureus N315
uaaauguuaaauucuaa

SEQ ID NO: 2146254 - RNA, 17 nt, Staphylococcus aureus subsp. aureus N315
uaaauguuauuaaccau

SEQ ID NO: 2146255 - RNA, 16 nt, Staphylococcus aureus subsp. aureus N315
uaaauguuauugcuua

SEQ ID NO: 2146256 - RNA, 15 nt, Staphylococcus aureus subsp. aureus N315
uaaauuuuguauaac

SEQ ID NO: 2146257 - RNA, 15 nt, Staphylococcus aureus subsp. aureus N315
uaaauuuuguuagga

SEQ ID NO: 2146258 - RNA, 17 nt, Staphylococcus aureus subsp. aureus N315
uaacaacacuacccaca

SEQ ID NO: 2146259 - RNA, 20 nt, Staphylococcus aureus subsp. aureus N315
uaacaaccgucccauaaaag

SEQ ID NO: 2146260 - RNA, 18 nt, Staphylococcus aureus subsp. aureus N315
uaacacgcucuuuucaaa

SEQ ID NO: 2146261 - RNA, 16 nt, Staphylococcus aureus subsp. aureus N315
uaacacgauaauuaua

SEQ ID NO: 2146262 - RNA, 20 nt, Staphylococcus aureus subsp. aureus N315
uaacaauauucguaaauccu

SEQ ID NO: 2146263 - RNA, 20 nt, Staphylococcus aureus subsp. aureus N315
uaacaauagugacuuuuaua

SEQ ID NO: 2146264 - RNA, 16 nt, Staphylococcus aureus subsp. aureus N315
uaacaaguauaaaugc

SEQ ID NO: 2146265 - RNA, 20 nt, Staphylococcus aureus subsp. aureus N315
uaacaaguacaauaauaccu

SEQ ID NO: 2146266 - RNA, 20 nt, Staphylococcus aureus subsp. aureus N315
uaacaagcuuuuuucaauuc

SEQ ID NO: 2146267 - RNA, 17 nt, Staphylococcus aureus subsp. aureus N315
uaacaaguacaauaaua

SEQ ID NO: 2146268 - RNA, 20 nt, Staphylococcus aureus subsp. aureus N315
uaacaagcauuuuucaauua

SEQ ID NO: 2146269 - RNA, 23 nt, Staphylococcus aureus subsp. aureus N315
uaacaagcauuuuucaauuauag

SEQ ID NO: 2146270 - RNA, 13 nt, Staphylococcus aureus subsp. aureus N315
uaaacuuaagaau

SEQ ID NO: 2146271 - RNA, 13 nt, Staphylococcus aureus subsp. aureus N315
uaaacuuauuaau

SEQ ID NO: 2146272 - RNA, 16 nt, Staphylococcus aureus subsp. aureus N315
uaaagaaauaauuuaa

SEQ ID NO: 2146273 - RNA, 21 nt, Staphylococcus aureus subsp. aureus N315
uaaagaguuauguuugucguu

SEQ ID NO: 2146274 - RNA, 16 nt, Staphylococcus aureus subsp. aureus N315
uaaagauaagaugguu

SEQ ID NO: 2146275 - RNA, 19 nt, Staphylococcus aureus subsp. aureus N315
uaaagaucauuuucaacau

SEQ ID NO: 2146276 - RNA, 14 nt, Staphylococcus aureus subsp. aureus N315
uaaaggcaacaaau

SEQ ID NO: 2146277 - RNA, 16 nt, Staphylococcus aureus subsp. aureus N315
uaaagcuuuaguuaaa

SEQ ID NO: 2146278 - RNA, 21 nt, Staphylococcus aureus subsp. aureus N315
uaaagcuucgucaaugacuaa

SEQ ID NO: 2146279 - RNA, 16 nt, Staphylococcus aureus subsp. aureus N315
uaaaggaaaucaaucc

SEQ ID NO: 2146280 - RNA, 22 nt, Staphylococcus aureus subsp. aureus N315
uaaaggaauagcuacaauuaaa

SEQ ID NO: 2146281 - RNA, 16 nt, Staphylococcus aureus subsp. aureus N315
uaaagcaauguugcau

SEQ ID NO: 2146282 - RNA, 15 nt, Staphylococcus aureus subsp. aureus N315
uaaagcugcaauuau

SEQ ID NO: 2146283 - RNA, 21 nt, Staphylococcus aureus subsp. aureus N315
uaaagcugcaauuaugccaac

SEQ ID NO: 2146284 - RNA, 18 nt, Staphylococcus aureus subsp. aureus N315
uaaagaugucgaaaagua

SEQ ID NO: 2146285 - RNA, 17 nt, Staphylococcus aureus subsp. aureus N315
uaaagauuuacccauua

SEQ ID NO: 2146286 - RNA, 24 nt, Staphylococcus aureus subsp. aureus N315
uaaacucaaaaagccaacacauuc

SEQ ID NO: 2146287 - RNA, 14 nt, Staphylococcus aureus subsp. aureus N315
uaaacucauaccaa

SEQ ID NO: 2146288 - RNA, 15 nt, Staphylococcus aureus subsp. aureus N315
uaaacucauaccaaa

SEQ ID NO: 2146289 - RNA, 18 nt, Staphylococcus aureus subsp. aureus N315
uaaacggaauaacuuuuu

SEQ ID NO: 2146290 - RNA, 16 nt, Staphylococcus aureus subsp. aureus N315
uaaacuauaauaauug

SEQ ID NO: 2146291 - RNA, 14 nt, Staphylococcus aureus subsp. aureus N315
uaaacuaguaauag

SEQ ID NO: 2146292 - RNA, 23 nt, Staphylococcus aureus subsp. aureus N315
uaaacuagaaaacauaaauacaa

SEQ ID NO: 2146293 - RNA, 19 nt, Staphylococcus aureus subsp. aureus N315
uaaacgcugauuuuauaaa

SEQ ID NO: 2146294 - RNA, 17 nt, Staphylococcus aureus subsp. aureus N315
uaaacauaaugacauca

SEQ ID NO: 2146295 - RNA, 19 nt, Staphylococcus aureus subsp. aureus N315
uaaacaucuauaacaaaau

SEQ ID NO: 2146296 - RNA, 18 nt, Staphylococcus aureus subsp. aureus N315
uaaaccgauuaauauaau

SEQ ID NO: 2146297 - RNA, 23 nt, Staphylococcus aureus subsp. aureus N315
uaaaccgcacuucuauauuaaua

SEQ ID NO: 2146298 - RNA, 20 nt, Staphylococcus aureus subsp. aureus N315
uaaaccaucugugucagcau

SEQ ID NO: 2146299 - RNA, 19 nt, Staphylococcus aureus subsp. aureus N315
uaaaccagcugauuccauu

SEQ ID NO: 2146300 - RNA, 19 nt, Staphylococcus aureus subsp. aureus N315
uaaacaugggcaaucacuc

SEQ ID NO: 2146301 - RNA, 21 nt, Staphylococcus aureus subsp. aureus N315
uaaacaugggcaaucacuccu

SEQ ID NO: 2146302 - RNA, 21 nt, Staphylococcus aureus subsp. aureus N315
uaaaguauaagguugaagaag

SEQ ID NO: 2146303 - RNA, 16 nt, Staphylococcus aureus subsp. aureus N315
uaaaguauguugucau

SEQ ID NO: 2146304 - RNA, 17 nt, Staphylococcus aureus subsp. aureus N315
uaaaguauguugucaua

SEQ ID NO: 2146305 - RNA, 17 nt, Staphylococcus aureus subsp. aureus N315
uaaaguguuucaacaua

SEQ ID NO: 2146306 - RNA, 14 nt, Staphylococcus aureus subsp. aureus N315
uaaaguuaaagacu

SEQ ID NO: 2146307 - RNA, 18 nt, Staphylococcus aureus subsp. aureus N315
uaaaguuacaugcucuuu

SEQ ID NO: 2146308 - RNA, 19 nt, Staphylococcus aureus subsp. aureus N315
uaaaguuccaaguuaaugc

SEQ ID NO: 2146309 - RNA, 17 nt, Staphylococcus aureus subsp. aureus N315
uaaagugcguuuuucga

SEQ ID NO: 2146310 - RNA, 19 nt, Staphylococcus aureus subsp. aureus N315
uaaauaggugauuauauau

SEQ ID NO: 2146311 - RNA, 21 nt, Staphylococcus aureus subsp. aureus N315
uaaauaggguaauagaucuau

SEQ ID NO: 2146312 - RNA, 13 nt, Staphylococcus aureus subsp. aureus N315
uaaauaggaugaa

SEQ ID NO: 2146313 - RNA, 13 nt, Staphylococcus aureus subsp. aureus N315
uaaauacaucgga

SEQ ID NO: 2146314 - RNA, 19 nt, Staphylococcus aureus subsp. aureus N315
uaaauaagcaaucauaaua

SEQ ID NO: 2146315 - RNA, 13 nt, Staphylococcus aureus subsp. aureus N315
uaaauaacuucgu

SEQ ID NO: 2146316 - RNA, 12 nt, Staphylococcus aureus subsp. aureus N315
uaaauaaguagu

SEQ ID NO: 2146317 - RNA, 17 nt, Staphylococcus aureus subsp. aureus N315
uaaauaagugauaaaua

SEQ ID NO: 2146318 - RNA, 16 nt, Staphylococcus aureus subsp. aureus N315
uaaaucauagaggcac

SEQ ID NO: 2146319 - RNA, 12 nt, Staphylococcus aureus subsp. aureus N315
uaaaucaucauu

SEQ ID NO: 2146320 - RNA, 14 nt, Staphylococcus aureus subsp. aureus N315
uaaaucauucuuua

SEQ ID NO: 2146321 - RNA, 15 nt, Staphylococcus aureus subsp. aureus N315
uaaaucaguaguuuu

SEQ ID NO: 2146322 - RNA, 16 nt, Staphylococcus aureus subsp. aureus N315
uaaauauuaaauucau

SEQ ID NO: 2146323 - RNA, 18 nt, Staphylococcus aureus subsp. aureus N315
uaaauaguuuuucauauu

SEQ ID NO: 2146324 - RNA, 14 nt, Staphylococcus aureus subsp. aureus N315
uaaauauaaaaagu

SEQ ID NO: 2146325 - RNA, 20 nt, Staphylococcus aureus subsp. aureus N315
uaaauauaaaccagcugauu

SEQ ID NO: 2146326 - RNA, 15 nt, Staphylococcus aureus subsp. aureus N315
uaaauauugauauaa

SEQ ID NO: 2146327 - RNA, 21 nt, Staphylococcus aureus subsp. aureus N315
uaaauauuuaaaauauuauuu

SEQ ID NO: 2146328 - RNA, 18 nt, Staphylococcus aureus subsp. aureus N315
uaaauauuuaauuggauu

SEQ ID NO: 2146329 - RNA, 14 nt, Staphylococcus aureus subsp. aureus N315
uaaauauugauaua

SEQ ID NO: 2146330 - RNA, 20 nt, Staphylococcus aureus subsp. aureus N315
uaaaucgaauugauggaaaa

SEQ ID NO: 2146331 - RNA, 17 nt, Staphylococcus aureus subsp. aureus N315
uaaaucgauaaaaugua

SEQ ID NO: 2146332 - RNA, 21 nt, Staphylococcus aureus subsp. aureus N315
uaaaucccuaaaaaaacagca

SEQ ID NO: 2146333 - RNA, 22 nt, Staphylococcus aureus subsp. aureus N315
uaaaugcaauacauuaauauaa

SEQ ID NO: 2146334 - RNA, 21 nt, Staphylococcus aureus subsp. aureus N315
uaaaugcacgagcaacaucuu

SEQ ID NO: 2146335 - RNA, 16 nt, Staphylococcus aureus subsp. aureus N315
uaaaugauuuaauaaa

SEQ ID NO: 2146336 - RNA, 12 nt, Staphylococcus aureus subsp. aureus N315
uaaaugauuuau

SEQ ID NO: 2146337 - RNA, 17 nt, Staphylococcus aureus subsp. aureus N315
uaaaugauucuuuauaa

SEQ ID NO: 2146338 - RNA, 20 nt, Staphylococcus aureus subsp. aureus N315
uaaaugaugcaguaaaacca

SEQ ID NO: 2146339 - RNA, 18 nt, Staphylococcus aureus subsp. aureus N315
uaaaugaugcaguaaaac

SEQ ID NO: 2146340 - RNA, 23 nt, Staphylococcus aureus subsp. aureus N315
uaaaugauggguaguuaauauaa

SEQ ID NO: 2146341 - RNA, 17 nt, Staphylococcus aureus subsp. aureus N315
uaaaugaugcaguaaaa

SEQ ID NO: 2146342 - RNA, 16 nt, Staphylococcus aureus subsp. aureus N315
uaaaucgggcaaccuc

SEQ ID NO: 2146343 - RNA, 20 nt, Staphylococcus aureus subsp. aureus N315
uaaaucgugcuguuaucaug

SEQ ID NO: 2146344 - RNA, 15 nt, Staphylococcus aureus subsp. aureus N315
uaaaauaucaaaaua

SEQ ID NO: 2146345 - RNA, 20 nt, Staphylococcus aureus subsp. aureus N315
uaaaauaucaaaauauaaaa

SEQ ID NO: 2146346 - RNA, 13 nt, Staphylococcus aureus subsp. aureus N315
uaaaauauaucuu

SEQ ID NO: 2146347 - RNA, 14 nt, Staphylococcus aureus subsp. aureus N315
uaaaauauaucuua

SEQ ID NO: 2146348 - RNA, 16 nt, Staphylococcus aureus subsp. aureus N315
uaaaauauauuuaauu

SEQ ID NO: 2146349 - RNA, 21 nt, Staphylococcus aureus subsp. aureus N315
uaaaauauauuuguaguaagu

SEQ ID NO: 2146350 - RNA, 13 nt, Staphylococcus aureus subsp. aureus N315
uaaaauaauuaaa

SEQ ID NO: 2146351 - RNA, 15 nt, Staphylococcus aureus subsp. aureus N315
uaaaauaauuaaaua

SEQ ID NO: 2146352 - RNA, 20 nt, Staphylococcus aureus subsp. aureus N315
uaaaauaaucgguaauuacu

SEQ ID NO: 2146353 - RNA, 20 nt, Staphylococcus aureus subsp. aureus N315
uaaaaggaugugacaaauac

SEQ ID NO: 2146354 - RNA, 21 nt, Staphylococcus aureus subsp. aureus N315
uaaaaggcgaaacauuaaaau

SEQ ID NO: 2146355 - RNA, 17 nt, Staphylococcus aureus subsp. aureus N315
uaaaaggcuuuguuaaa

SEQ ID NO: 2146356 - RNA, 22 nt, Staphylococcus aureus subsp. aureus N315
uaaaaggcgaaacauuaaaaua

SEQ ID NO: 2146357 - RNA, 11 nt, Staphylococcus aureus subsp. aureus N315
uaaaauaacua

SEQ ID NO: 2146358 - RNA, 13 nt, Staphylococcus aureus subsp. aureus N315
uaaaauaaccauu

SEQ ID NO: 2146359 - RNA, 15 nt, Staphylococcus aureus subsp. aureus N315
uaaaauaagauauau

SEQ ID NO: 2146360 - RNA, 14 nt, Staphylococcus aureus subsp. aureus N315
uaaaauaacuaagu

SEQ ID NO: 2146361 - RNA, 13 nt, Staphylococcus aureus subsp. aureus N315
uaaaauaaucggu

SEQ ID NO: 2146362 - RNA, 16 nt, Staphylococcus aureus subsp. aureus N315
uaaaauaaucgguaau

SEQ ID NO: 2146363 - RNA, 11 nt, Staphylococcus aureus subsp. aureus N315
uaaaauaauga

SEQ ID NO: 2146364 - RNA, 18 nt, Staphylococcus aureus subsp. aureus N315
uaaaaugcuacaauuucc

SEQ ID NO: 2146365 - RNA, 16 nt, Staphylococcus aureus subsp. aureus N315
uaaaaucuauaccauu

SEQ ID NO: 2146366 - RNA, 22 nt, Staphylococcus aureus subsp. aureus N315
uaaaaucuauaccauuccaaaa

SEQ ID NO: 2146367 - RNA, 23 nt, Staphylococcus aureus subsp. aureus N315
uaaaauccuaagcaucguaaaaa

SEQ ID NO: 2146368 - RNA, 15 nt, Staphylococcus aureus subsp. aureus N315
uaaaaucgcagcaau

SEQ ID NO: 2146369 - RNA, 18 nt, Staphylococcus aureus subsp. aureus N315
uaaaauggcaucuggcaa

SEQ ID NO: 2146370 - RNA, 19 nt, Staphylococcus aureus subsp. aureus N315
uaaaaugucuuugaaaaac

SEQ ID NO: 2146371 - RNA, 14 nt, Staphylococcus aureus subsp. aureus N315
uaaaauuaaaacag

SEQ ID NO: 2146372 - RNA, 14 nt, Staphylococcus aureus subsp. aureus N315
uaaaauuaaaacuu

SEQ ID NO: 2146373 - RNA, 17 nt, Staphylococcus aureus subsp. aureus N315
uaaaauuaacuuaaaau

SEQ ID NO: 2146374 - RNA, 14 nt, Staphylococcus aureus subsp. aureus N315
uaaaauucucuuuu

SEQ ID NO: 2146375 - RNA, 16 nt, Staphylococcus aureus subsp. aureus N315
uaaaauucuauaaaua

SEQ ID NO: 2146376 - RNA, 14 nt, Staphylococcus aureus subsp. aureus N315
uaaaauucuuucag

SEQ ID NO: 2146377 - RNA, 23 nt, Staphylococcus aureus subsp. aureus N315
uaaaauugaauaucacuuuagau

SEQ ID NO: 2146378 - RNA, 16 nt, Staphylococcus aureus subsp. aureus N315
uaaaauuguauagaau

SEQ ID NO: 2146379 - RNA, 18 nt, Staphylococcus aureus subsp. aureus N315
uaaaauuaugauuauauu

SEQ ID NO: 2146380 - RNA, 12 nt, Staphylococcus aureus subsp. aureus N315
uaaaauuaucaa

SEQ ID NO: 2146381 - RNA, 18 nt, Staphylococcus aureus subsp. aureus N315
uaaaauuuaaauauugaa

SEQ ID NO: 2146382 - RNA, 15 nt, Staphylococcus aureus subsp. aureus N315
uaaaauuuaaauauu

SEQ ID NO: 2146383 - RNA, 23 nt, Staphylococcus aureus subsp. aureus N315
uaaaauuuuuuucauaauuaaua

SEQ ID NO: 2146384 - RNA, 22 nt, Staphylococcus aureus subsp. aureus N315
uaaaauuuugaagaagugccgu

SEQ ID NO: 2146385 - RNA, 18 nt, Staphylococcus aureus subsp. aureus N315
uaaaauuuuuaaaaaaau

SEQ ID NO: 2146386 - RNA, 21 nt, Staphylococcus aureus subsp. aureus N315
uaaaauuuucguguuaauaac

SEQ ID NO: 2146387 - RNA, 18 nt, Staphylococcus aureus subsp. aureus N315
uaaaauuuugaagaagug

SEQ ID NO: 2146388 - RNA, 14 nt, Staphylococcus aureus subsp. aureus N315
uaaaauuuuaauua

SEQ ID NO: 2146389 - RNA, 22 nt, Staphylococcus aureus subsp. aureus N315
uaaacacgcgguaaaacgaagu

SEQ ID NO: 2146390 - RNA, 17 nt, Staphylococcus aureus subsp. aureus N315
uaaacacuauaaaagcc

SEQ ID NO: 2146391 - RNA, 15 nt, Staphylococcus aureus subsp. aureus N315
uaaacaaauaaaugu

SEQ ID NO: 2146392 - RNA, 17 nt, Staphylococcus aureus subsp. aureus N315
uaaacaauacguuuucg

SEQ ID NO: 2146393 - RNA, 15 nt, Staphylococcus aureus subsp. aureus N315
uaaacaacuucugaa

SEQ ID NO: 2146394 - RNA, 20 nt, Staphylococcus aureus subsp. aureus N315
uaaacaagcaucaugaaauu

SEQ ID NO: 2146395 - RNA, 18 nt, Staphylococcus aureus subsp. aureus N315
uaaaaccauagagcauuu

SEQ ID NO: 2146396 - RNA, 18 nt, Staphylococcus aureus subsp. aureus N315
uaaaacaaauucauauua

SEQ ID NO: 2146397 - RNA, 21 nt, Staphylococcus aureus subsp. aureus N315
uaaaaauuucgccucaucuaa

SEQ ID NO: 2146398 - RNA, 24 nt, Staphylococcus aureus subsp. aureus N315
uaaaaauuuauucaaaauucaaua

SEQ ID NO: 2146399 - RNA, 15 nt, Staphylococcus aureus subsp. aureus N315
uaaaaauuuaugucu

SEQ ID NO: 2146400 - RNA, 17 nt, Staphylococcus aureus subsp. aureus N315
uaaaaauuuauucaaaa

SEQ ID NO: 2146401 - RNA, 16 nt, Staphylococcus aureus subsp. aureus N315
uaaaaauuaaguaaua

SEQ ID NO: 2146402 - RNA, 13 nt, Staphylococcus aureus subsp. aureus N315
uaaaaauguaaau

SEQ ID NO: 2146403 - RNA, 15 nt, Staphylococcus aureus subsp. aureus N315
uaaaaauuauauaaa

SEQ ID NO: 2146404 - RNA, 16 nt, Staphylococcus aureus subsp. aureus N315
uaaaacuaaugauagu

SEQ ID NO: 2146405 - RNA, 15 nt, Staphylococcus aureus subsp. aureus N315
uaaaacuaaguuauu

SEQ ID NO: 2146406 - RNA, 20 nt, Staphylococcus aureus subsp. aureus N315
uaaaacuacugauuuauuga

SEQ ID NO: 2146407 - RNA, 15 nt, Staphylococcus aureus subsp. aureus N315
uaaaacugcaauaau

SEQ ID NO: 2146408 - RNA, 20 nt, Staphylococcus aureus subsp. aureus N315
uaaaacgugcaaauaaaaaa

SEQ ID NO: 2146409 - RNA, 15 nt, Staphylococcus aureus subsp. aureus N315
uaaaacgcuucauau

SEQ ID NO: 2146410 - RNA, 19 nt, Staphylococcus aureus subsp. aureus N315
uaaaagacauccacagaau

SEQ ID NO: 2146411 - RNA, 14 nt, Staphylococcus aureus subsp. aureus N315
uaaaagacagaaau

SEQ ID NO: 2146412 - RNA, 19 nt, Staphylococcus aureus subsp. aureus N315
uaaaagagaauuuuaauua

SEQ ID NO: 2146413 - RNA, 22 nt, Staphylococcus aureus subsp. aureus N315
uaaaagagaauuuuaauuaauu

SEQ ID NO: 2146414 - RNA, 22 nt, Staphylococcus aureus subsp. aureus N315
uaaaaggaaggauuuuagauuu

SEQ ID NO: 2146415 - RNA, 15 nt, Staphylococcus aureus subsp. aureus N315
uaaaagcugauguga

SEQ ID NO: 2146416 - RNA, 16 nt, Staphylococcus aureus subsp. aureus N315
uaaaaaguaauuaauu

SEQ ID NO: 2146417 - RNA, 21 nt, Staphylococcus aureus subsp. aureus N315
uaaaaagguacuaauguuaau

SEQ ID NO: 2146418 - RNA, 17 nt, Staphylococcus aureus subsp. aureus N315
uaaaaagaucauuaaaa

SEQ ID NO: 2146419 - RNA, 18 nt, Staphylococcus aureus subsp. aureus N315
uaaaaagagaugggcuaa

SEQ ID NO: 2146420 - RNA, 14 nt, Staphylococcus aureus subsp. aureus N315
uaaaaaucuuggug

SEQ ID NO: 2146421 - RNA, 17 nt, Staphylococcus aureus subsp. aureus N315
uaaaaauaggaauacau

SEQ ID NO: 2146422 - RNA, 16 nt, Staphylococcus aureus subsp. aureus N315
uaaaaaucuuaugaug

SEQ ID NO: 2146423 - RNA, 20 nt, Staphylococcus aureus subsp. aureus N315
uaaaaauacauaauaaaaag

SEQ ID NO: 2146424 - RNA, 17 nt, Staphylococcus aureus subsp. aureus N315
uaaaaagugaagauauu

SEQ ID NO: 2146425 - RNA, 14 nt, Staphylococcus aureus subsp. aureus N315
uaaaaauaaaaccg

SEQ ID NO: 2146426 - RNA, 12 nt, Staphylococcus aureus subsp. aureus N315
uaaaaaguuuaa

SEQ ID NO: 2146427 - RNA, 13 nt, Staphylococcus aureus subsp. aureus N315
guuugaucauaau

SEQ ID NO: 2146428 - RNA, 16 nt, Staphylococcus aureus subsp. aureus N315
guuugaucauaauuca

SEQ ID NO: 2146429 - RNA, 15 nt, Staphylococcus aureus subsp. aureus N315
guuugauuaaaaucu

SEQ ID NO: 2146430 - RNA, 14 nt, Staphylococcus aureus subsp. aureus N315
guuugauuaaaauc

SEQ ID NO: 2146431 - RNA, 12 nt, Staphylococcus aureus subsp. aureus N315
uaaaaagaaaau

SEQ ID NO: 2146432 - RNA, 18 nt, Staphylococcus aureus subsp. aureus N315
uaaaaagacggugaccuu

SEQ ID NO: 2146433 - RNA, 13 nt, Staphylococcus aureus subsp. aureus N315
uaaaaacuguuca

SEQ ID NO: 2146434 - RNA, 14 nt, Staphylococcus aureus subsp. aureus N315
uaaaaaccuauucc

SEQ ID NO: 2146435 - RNA, 23 nt, Staphylococcus aureus subsp. aureus N315
uaaaaacggacaaguugcacauu

SEQ ID NO: 2146436 - RNA, 18 nt, Staphylococcus aureus subsp. aureus N315
uaaaaacucuaaaaguug

SEQ ID NO: 2146437 - RNA, 13 nt, Staphylococcus aureus subsp. aureus N315
guuuaaacauuuu

SEQ ID NO: 2146438 - RNA, 18 nt, Staphylococcus aureus subsp. aureus N315
guuguuuuuuguuuucaa

SEQ ID NO: 2146439 - RNA, 15 nt, Staphylococcus aureus subsp. aureus N315
guuuaaaguauaagg

SEQ ID NO: 2146440 - RNA, 16 nt, Staphylococcus aureus subsp. aureus N315
guuguugaaauuaaau

SEQ ID NO: 2146441 - RNA, 13 nt, Staphylococcus aureus subsp. aureus N315
guuguuucuccag

SEQ ID NO: 2146442 - RNA, 15 nt, Staphylococcus aureus subsp. aureus N315
guuguaauuuaaaau

SEQ ID NO: 2146443 - RNA, 18 nt, Staphylococcus aureus subsp. aureus N315
guugucacgaucaaauuu

SEQ ID NO: 2146444 - RNA, 15 nt, Staphylococcus aureus subsp. aureus N315
guuguucuuuuuguu

SEQ ID NO: 2146445 - RNA, 14 nt, Staphylococcus aureus subsp. aureus N315
guuuaauuuuaaau

SEQ ID NO: 2146446 - RNA, 18 nt, Staphylococcus aureus subsp. aureus N315
guuuaccgucuuuugcaa

SEQ ID NO: 2146447 - RNA, 20 nt, Staphylococcus aureus subsp. aureus N315
guuuaaaugugcaauuagaa

SEQ ID NO: 2146448 - RNA, 13 nt, Staphylococcus aureus subsp. aureus N315
guuuaaauucauu

SEQ ID NO: 2146449 - RNA, 18 nt, Staphylococcus aureus subsp. aureus N315
guuuaaaugugcaauuag

SEQ ID NO: 2146450 - RNA, 15 nt, Staphylococcus aureus subsp. aureus N315
guuuaacaacacuac

SEQ ID NO: 2146451 - RNA, 19 nt, Staphylococcus aureus subsp. aureus N315
guuuaaauuuaaaagaaaa

SEQ ID NO: 2146452 - RNA, 20 nt, Staphylococcus aureus subsp. aureus N315
guuuaauuugauuaaauuca

SEQ ID NO: 2146453 - RNA, 23 nt, Staphylococcus aureus subsp. aureus N315
guuuaauuugauuaaauucaucu

SEQ ID NO: 2146454 - RNA, 19 nt, Staphylococcus aureus subsp. aureus N315
guuuauauugcaaaaauaa

SEQ ID NO: 2146455 - RNA, 18 nt, Staphylococcus aureus subsp. aureus N315
guuuauaaauuaauugcu

SEQ ID NO: 2146456 - RNA, 15 nt, Staphylococcus aureus subsp. aureus N315
guuuauaaucaguuu

SEQ ID NO: 2146457 - RNA, 16 nt, Staphylococcus aureus subsp. aureus N315
guuuauauugcaaaaa

SEQ ID NO: 2146458 - RNA, 19 nt, Staphylococcus aureus subsp. aureus N315
guuuacgaucauaaauauu

SEQ ID NO: 2146459 - RNA, 15 nt, Staphylococcus aureus subsp. aureus N315
guuuauaaaaaauca

SEQ ID NO: 2146460 - RNA, 20 nt, Staphylococcus aureus subsp. aureus N315
guuucuccuacuauaaaauc

SEQ ID NO: 2146461 - RNA, 14 nt, Staphylococcus aureus subsp. aureus N315
guuucuccaguuuu

SEQ ID NO: 2146462 - RNA, 20 nt, Staphylococcus aureus subsp. aureus N315
guuucggaaaaagaugaaaa

SEQ ID NO: 2146463 - RNA, 15 nt, Staphylococcus aureus subsp. aureus N315
guuugaaucauuuga

SEQ ID NO: 2146464 - RNA, 20 nt, Staphylococcus aureus subsp. aureus N315
guuugaaggagauauuuucu

SEQ ID NO: 2146465 - RNA, 21 nt, Staphylococcus aureus subsp. aureus N315
guuugaauguuuuugauagua

SEQ ID NO: 2146466 - RNA, 19 nt, Staphylococcus aureus subsp. aureus N315
guuugaacaacaucuuuug

SEQ ID NO: 2146467 - RNA, 17 nt, Staphylococcus aureus subsp. aureus N315
guuuauuacauaauuua

SEQ ID NO: 2146468 - RNA, 20 nt, Staphylococcus aureus subsp. aureus N315
guuuauuacauaauuuaucu

SEQ ID NO: 2146469 - RNA, 22 nt, Staphylococcus aureus subsp. aureus N315
guuuaucgaucgguauuuucau

SEQ ID NO: 2146470 - RNA, 16 nt, Staphylococcus aureus subsp. aureus N315
guuuauccauauauga

SEQ ID NO: 2146471 - RNA, 22 nt, Staphylococcus aureus subsp. aureus N315
guuuauccauauaugaugauuu

SEQ ID NO: 2146472 - RNA, 15 nt, Staphylococcus aureus subsp. aureus N315
guuuauccuuuaaau

SEQ ID NO: 2146473 - RNA, 19 nt, Staphylococcus aureus subsp. aureus N315
guuucgaacgcuugaaaaa

SEQ ID NO: 2146474 - RNA, 16 nt, Staphylococcus aureus subsp. aureus N315
guugcguuaaauaugg

SEQ ID NO: 2146475 - RNA, 14 nt, Staphylococcus aureus subsp. aureus N315
guuggaaaauuaca

SEQ ID NO: 2146476 - RNA, 16 nt, Staphylococcus aureus subsp. aureus N315
guugguucaucaaaca

SEQ ID NO: 2146477 - RNA, 18 nt, Staphylococcus aureus subsp. aureus N315
guugguuuuauuaauucu

SEQ ID NO: 2146478 - RNA, 21 nt, Staphylococcus aureus subsp. aureus N315
guuguaaucauugguuucauc

SEQ ID NO: 2146479 - RNA, 18 nt, Staphylococcus aureus subsp. aureus N315
guuggggcccacacccca

SEQ ID NO: 2146480 - RNA, 20 nt, Staphylococcus aureus subsp. aureus N315
guuggggaugggccccaaca

SEQ ID NO: 2146481 - RNA, 19 nt, Staphylococcus aureus subsp. aureus N315
guugauauauauuuugcaa

SEQ ID NO: 2146482 - RNA, 16 nt, Staphylococcus aureus subsp. aureus N315
guugacuguaaaacaa

SEQ ID NO: 2146483 - RNA, 23 nt, Staphylococcus aureus subsp. aureus N315
guugacguugugucaugcugaau

SEQ ID NO: 2146484 - RNA, 21 nt, Staphylococcus aureus subsp. aureus N315
guugaucuuugacauguguua

SEQ ID NO: 2146485 - RNA, 21 nt, Staphylococcus aureus subsp. aureus N315
guugauugcaugacagcaaau

SEQ ID NO: 2146486 - RNA, 16 nt, Staphylococcus aureus subsp. aureus N315
guugauguguugcauu

SEQ ID NO: 2146487 - RNA, 22 nt, Staphylococcus aureus subsp. aureus N315
guugcaaauuggauaauuucuu

SEQ ID NO: 2146488 - RNA, 19 nt, Staphylococcus aureus subsp. aureus N315
guugcauaaucaauuucac

SEQ ID NO: 2146489 - RNA, 21 nt, Staphylococcus aureus subsp. aureus N315
guugcaauugaagugaaauug

SEQ ID NO: 2146490 - RNA, 19 nt, Staphylococcus aureus subsp. aureus N315
guugaauguggaacaugau

SEQ ID NO: 2146491 - RNA, 16 nt, Staphylococcus aureus subsp. aureus N315
guugaauuaacaauau

SEQ ID NO: 2146492 - RNA, 13 nt, Staphylococcus aureus subsp. aureus N315
guucuuuuuguug

SEQ ID NO: 2146493 - RNA, 18 nt, Staphylococcus aureus subsp. aureus N315
guucuuucuuguucuaaa

SEQ ID NO: 2146494 - RNA, 12 nt, Staphylococcus aureus subsp. aureus N315
guucuaaaucuu

SEQ ID NO: 2146495 - RNA, 14 nt, Staphylococcus aureus subsp. aureus N315
guucuuucuuucuu

SEQ ID NO: 2146496 - RNA, 18 nt, Staphylococcus aureus subsp. aureus N315
guucuugguauuuuuuaa

SEQ ID NO: 2146497 - RNA, 16 nt, Staphylococcus aureus subsp. aureus N315
guucuuuacuccaaag

SEQ ID NO: 2146498 - RNA, 13 nt, Staphylococcus aureus subsp. aureus N315
guucuugagcugu

SEQ ID NO: 2146499 - RNA, 13 nt, Staphylococcus aureus subsp. aureus N315
guucaucaaacaa

SEQ ID NO: 2146500 - RNA, 22 nt, Staphylococcus aureus subsp. aureus N315
guucauuggcaauauacuuuuu

SEQ ID NO: 2146501 - RNA, 12 nt, Staphylococcus aureus subsp. aureus N315
guucaguuguuu

SEQ ID NO: 2146502 - RNA, 20 nt, Staphylococcus aureus subsp. aureus N315
guuagacucacuucuuaaaa

SEQ ID NO: 2146503 - RNA, 16 nt, Staphylococcus aureus subsp. aureus N315
guuacuucuaauagua

SEQ ID NO: 2146504 - RNA, 18 nt, Staphylococcus aureus subsp. aureus N315
guucagaacuacaauuca

SEQ ID NO: 2146505 - RNA, 14 nt, Staphylococcus aureus subsp. aureus N315
guucggaugagaaa

SEQ ID NO: 2146506 - RNA, 14 nt, Staphylococcus aureus subsp. aureus N315
guuccaaucuuuuu

SEQ ID NO: 2146507 - RNA, 18 nt, Staphylococcus aureus subsp. aureus N315
guuccaacaacuaagaua

SEQ ID NO: 2146508 - RNA, 18 nt, Staphylococcus aureus subsp. aureus N315
guuccaccgaauccuguu

SEQ ID NO: 2146509 - RNA, 14 nt, Staphylococcus aureus subsp. aureus N315
guucccauucuuug

SEQ ID NO: 2146510 - RNA, 13 nt, Staphylococcus aureus subsp. aureus N315
guuaaauauggau

SEQ ID NO: 2146511 - RNA, 16 nt, Staphylococcus aureus subsp. aureus N315
guuaaguauuuaaaua

SEQ ID NO: 2146512 - RNA, 19 nt, Staphylococcus aureus subsp. aureus N315
guuaaaguacuuacaaaua

SEQ ID NO: 2146513 - RNA, 15 nt, Staphylococcus aureus subsp. aureus N315
guuaaaguuuuguuc

SEQ ID NO: 2146514 - RNA, 19 nt, Staphylococcus aureus subsp. aureus N315
guuaaacuagaaaacauaa

SEQ ID NO: 2146515 - RNA, 18 nt, Staphylococcus aureus subsp. aureus N315
guuaaacuagaaaacaua

SEQ ID NO: 2146516 - RNA, 21 nt, Staphylococcus aureus subsp. aureus N315
guuaaacgcugauuuuauaaa

SEQ ID NO: 2146517 - RNA, 21 nt, Staphylococcus aureus subsp. aureus N315
guuaauacaaccaucagcauu

SEQ ID NO: 2146518 - RNA, 18 nt, Staphylococcus aureus subsp. aureus N315
guuaauauaacuucuauu

SEQ ID NO: 2146519 - RNA, 18 nt, Staphylococcus aureus subsp. aureus N315
guuaauauaauuaaacau

SEQ ID NO: 2146520 - RNA, 21 nt, Staphylococcus aureus subsp. aureus N315
guuaauauaauuaaacauuua

SEQ ID NO: 2146521 - RNA, 19 nt, Staphylococcus aureus subsp. aureus N315
guuaauaucaugcuuaucu

SEQ ID NO: 2146522 - RNA, 21 nt, Staphylococcus aureus subsp. aureus N315
guuaccuacuacauucuaugu

SEQ ID NO: 2146523 - RNA, 18 nt, Staphylococcus aureus subsp. aureus N315
guuacagguuuuaaaauu

SEQ ID NO: 2146524 - RNA, 20 nt, Staphylococcus aureus subsp. aureus N315
guuacuaaacuuuucuucaa

SEQ ID NO: 2146525 - RNA, 23 nt, Staphylococcus aureus subsp. aureus N315
guuacuauacaugguacugcuuc

SEQ ID NO: 2146526 - RNA, 20 nt, Staphylococcus aureus subsp. aureus N315
guguaaauauaaauaugaau

SEQ ID NO: 2146527 - RNA, 20 nt, Staphylococcus aureus subsp. aureus N315
gugugcaggauaacguucac

SEQ ID NO: 2146528 - RNA, 16 nt, Staphylococcus aureus subsp. aureus N315
gugugccggcuuuuuc

SEQ ID NO: 2146529 - RNA, 19 nt, Staphylococcus aureus subsp. aureus N315
guguuaccgauuuagggau

SEQ ID NO: 2146530 - RNA, 21 nt, Staphylococcus aureus subsp. aureus N315
guguuaaaccaacuuucucaa

SEQ ID NO: 2146531 - RNA, 19 nt, Staphylococcus aureus subsp. aureus N315
guguuggggcccacacccc

SEQ ID NO: 2146532 - RNA, 13 nt, Staphylococcus aureus subsp. aureus N315
guguuuauuuuua

SEQ ID NO: 2146533 - RNA, 14 nt, Staphylococcus aureus subsp. aureus N315
guguuucuuuuauu

SEQ ID NO: 2146534 - RNA, 11 nt, Staphylococcus aureus subsp. aureus N315
guguuugcuuu

SEQ ID NO: 2146535 - RNA, 21 nt, Staphylococcus aureus subsp. aureus N315
guguuuuaauaauaucuuuug

SEQ ID NO: 2146536 - RNA, 16 nt, Staphylococcus aureus subsp. aureus N315
gugguaugacugcaaa

SEQ ID NO: 2146537 - RNA, 21 nt, Staphylococcus aureus subsp. aureus N315
guggcuacuugaauaccuuuu

SEQ ID NO: 2146538 - RNA, 15 nt, Staphylococcus aureus subsp. aureus N315
gugcuguuaucaugg

SEQ ID NO: 2146539 - RNA, 18 nt, Staphylococcus aureus subsp. aureus N315
gugcuuauuuguuuauua

SEQ ID NO: 2146540 - RNA, 20 nt, Staphylococcus aureus subsp. aureus N315
guggauuacagaugaugcuu

SEQ ID NO: 2146541 - RNA, 15 nt, Staphylococcus aureus subsp. aureus N315
gugcauucaucaaug

SEQ ID NO: 2146542 - RNA, 17 nt, Staphylococcus aureus subsp. aureus N315
gugauuuaaaaaauuua

SEQ ID NO: 2146543 - RNA, 20 nt, Staphylococcus aureus subsp. aureus N315
gugcaauuaauguaaugaua

SEQ ID NO: 2146544 - RNA, 18 nt, Staphylococcus aureus subsp. aureus N315
gugauuacauucuauacu

SEQ ID NO: 2146545 - RNA, 12 nt, Staphylococcus aureus subsp. aureus N315
gugauuauaaau

SEQ ID NO: 2146546 - RNA, 14 nt, Staphylococcus aureus subsp. aureus N315
gugaugguaaauca

SEQ ID NO: 2146547 - RNA, 19 nt, Staphylococcus aureus subsp. aureus N315
gugaucuuuuuuauauuca

SEQ ID NO: 2146548 - RNA, 20 nt, Staphylococcus aureus subsp. aureus N315
gugcucuugcaauagcaaca

SEQ ID NO: 2146549 - RNA, 16 nt, Staphylococcus aureus subsp. aureus N315
gugcuaccuacuuguu

SEQ ID NO: 2146550 - RNA, 15 nt, Staphylococcus aureus subsp. aureus N315
gugcgugaagagaug

SEQ ID NO: 2146551 - RNA, 15 nt, Staphylococcus aureus subsp. aureus N315
gugcuaaguuagggc

SEQ ID NO: 2146552 - RNA, 15 nt, Staphylococcus aureus subsp. aureus N315
gugccuuugcuuuuu

SEQ ID NO: 2146553 - RNA, 14 nt, Staphylococcus aureus subsp. aureus N315
gccuuguucaauuc

SEQ ID NO: 2146554 - RNA, 17 nt, Staphylococcus aureus subsp. aureus N315
gccuucuaucucuuuag

SEQ ID NO: 2146555 - RNA, 21 nt, Staphylococcus aureus subsp. aureus N315
gccuucuauauaguaaaauaa

SEQ ID NO: 2146556 - RNA, 19 nt, Staphylococcus aureus subsp. aureus N315
gccuugauuuuuugaaaug

SEQ ID NO: 2146557 - RNA, 14 nt, Staphylococcus aureus subsp. aureus N315
gccuuuugaauaau

SEQ ID NO: 2146558 - RNA, 11 nt, Staphylococcus aureus subsp. aureus N315
gccuuucucua

SEQ ID NO: 2146559 - RNA, 18 nt, Staphylococcus aureus subsp. aureus N315
gccuuucucuaaauaauu

SEQ ID NO: 2146560 - RNA, 20 nt, Staphylococcus aureus subsp. aureus N315
gccuuuccauuguugauaaa

SEQ ID NO: 2146561 - RNA, 23 nt, Staphylococcus aureus subsp. aureus N315
gcgaaaacguugaguauuacuug

SEQ ID NO: 2146562 - RNA, 17 nt, Staphylococcus aureus subsp. aureus N315
gccuuuuuuauuguaau

SEQ ID NO: 2146563 - RNA, 15 nt, Staphylococcus aureus subsp. aureus N315
gcgaagaaaccuuuu

SEQ ID NO: 2146564 - RNA, 16 nt, Staphylococcus aureus subsp. aureus N315
gcgacuuaacuuaagc

SEQ ID NO: 2146565 - RNA, 15 nt, Staphylococcus aureus subsp. aureus N315
gcgauacguuuauau

SEQ ID NO: 2146566 - RNA, 21 nt, Staphylococcus aureus subsp. aureus N315
gcguucgugauagaaguuuuu

SEQ ID NO: 2146567 - RNA, 11 nt, Staphylococcus aureus subsp. aureus N315
gcuaaaaaaau

SEQ ID NO: 2146568 - RNA, 18 nt, Staphylococcus aureus subsp. aureus N315
gcguauccccauuuaugu

SEQ ID NO: 2146569 - RNA, 19 nt, Staphylococcus aureus subsp. aureus N315
gcgugcuuaauuacaauau

SEQ ID NO: 2146570 - RNA, 15 nt, Staphylococcus aureus subsp. aureus N315
gcuacuauuaaauaa

SEQ ID NO: 2146571 - RNA, 18 nt, Staphylococcus aureus subsp. aureus N315
gcuaaugcauuauuauaa

SEQ ID NO: 2146572 - RNA, 23 nt, Staphylococcus aureus subsp. aureus N315
gcuaaugcauuauuauaauagcu

SEQ ID NO: 2146573 - RNA, 21 nt, Staphylococcus aureus subsp. aureus N315
gcuaauguguacuuaaaaaua

SEQ ID NO: 2146574 - RNA, 18 nt, Staphylococcus aureus subsp. aureus N315
gcuaacauucagugcaau

SEQ ID NO: 2146575 - RNA, 16 nt, Staphylococcus aureus subsp. aureus N315
gcuaacauaccuaaua

SEQ ID NO: 2146576 - RNA, 14 nt, Staphylococcus aureus subsp. aureus N315
gcuaaaaguauaaa

SEQ ID NO: 2146577 - RNA, 11 nt, Staphylococcus aureus subsp. aureus N315
gcuaaaaauau

SEQ ID NO: 2146578 - RNA, 18 nt, Staphylococcus aureus subsp. aureus N315
gcuaaacaaugaugggaa

SEQ ID NO: 2146579 - RNA, 18 nt, Staphylococcus aureus subsp. aureus N315
gcuaaacgcaauacgaau

SEQ ID NO: 2146580 - RNA, 18 nt, Staphylococcus aureus subsp. aureus N315
gcuaauacaaaacaaauc

SEQ ID NO: 2146581 - RNA, 18 nt, Staphylococcus aureus subsp. aureus N315
gcuaauaacgcugcaccu

SEQ ID NO: 2146582 - RNA, 23 nt, Staphylococcus aureus subsp. aureus N315
gcuaaugcaacuaaaacuaucug

SEQ ID NO: 2146583 - RNA, 20 nt, Staphylococcus aureus subsp. aureus N315
gcuaaugcaacuaaaacuau

SEQ ID NO: 2146584 - RNA, 16 nt, Staphylococcus aureus subsp. aureus N315
gcuaaucuauuuagcu

SEQ ID NO: 2146585 - RNA, 13 nt, Staphylococcus aureus subsp. aureus N315
gcuccuacuuuuc

SEQ ID NO: 2146586 - RNA, 15 nt, Staphylococcus aureus subsp. aureus N315
gcucauccucauuaa

SEQ ID NO: 2146587 - RNA, 19 nt, Staphylococcus aureus subsp. aureus N315
gcucauccucauuaauaaa

SEQ ID NO: 2146588 - RNA, 15 nt, Staphylococcus aureus subsp. aureus N315
gcucauugugcuuga

SEQ ID NO: 2146589 - RNA, 19 nt, Staphylococcus aureus subsp. aureus N315
gcuacuugaauaccuuuua

SEQ ID NO: 2146590 - RNA, 17 nt, Staphylococcus aureus subsp. aureus N315
gcuagcuuucuuuuuca

SEQ ID NO: 2146591 - RNA, 19 nt, Staphylococcus aureus subsp. aureus N315
gcuagucauaauuuaaaag

SEQ ID NO: 2146592 - RNA, 20 nt, Staphylococcus aureus subsp. aureus N315
gcuagucauaauuuaaaaga

SEQ ID NO: 2146593 - RNA, 18 nt, Staphylococcus aureus subsp. aureus N315
gcuagggugaauuaguaa

SEQ ID NO: 2146594 - RNA, 19 nt, Staphylococcus aureus subsp. aureus N315
gcggggccccaacacagag

SEQ ID NO: 2146595 - RNA, 23 nt, Staphylococcus aureus subsp. aureus N315
gcguacuuggcucaaaacuuuua

SEQ ID NO: 2146596 - RNA, 23 nt, Staphylococcus aureus subsp. aureus N315
gcggucaauuuuaccauguuuua

SEQ ID NO: 2146597 - RNA, 16 nt, Staphylococcus aureus subsp. aureus N315
gccuguagaauuucuu

SEQ ID NO: 2146598 - RNA, 23 nt, Staphylococcus aureus subsp. aureus N315
gccugcaucaccugaugaauaga

SEQ ID NO: 2146599 - RNA, 13 nt, Staphylococcus aureus subsp. aureus N315
gccuaauaauaaa

SEQ ID NO: 2146600 - RNA, 17 nt, Staphylococcus aureus subsp. aureus N315
gccuaauaauaaaauag

SEQ ID NO: 2146601 - RNA, 19 nt, Staphylococcus aureus subsp. aureus N315
gccuaauaauaaaauagcu

SEQ ID NO: 2146602 - RNA, 15 nt, Staphylococcus aureus subsp. aureus N315
gccucaauaucuuua

SEQ ID NO: 2146603 - RNA, 20 nt, Staphylococcus aureus subsp. aureus N315
gccuacuguuucacguaaug

SEQ ID NO: 2146604 - RNA, 12 nt, Staphylococcus aureus subsp. aureus N315
gccucguccauu

SEQ ID NO: 2146605 - RNA, 23 nt, Staphylococcus aureus subsp. aureus N315
gccauauguuuuagaauaguuac

SEQ ID NO: 2146606 - RNA, 19 nt, Staphylococcus aureus subsp. aureus N315
gccauauucauauuacuuc

SEQ ID NO: 2146607 - RNA, 16 nt, Staphylococcus aureus subsp. aureus N315
gccauaguaauaaugg

SEQ ID NO: 2146608 - RNA, 13 nt, Staphylococcus aureus subsp. aureus N315
gccaugauuuaag

SEQ ID NO: 2146609 - RNA, 19 nt, Staphylococcus aureus subsp. aureus N315
gccccuuacaacuuuaguu

SEQ ID NO: 2146610 - RNA, 17 nt, Staphylococcus aureus subsp. aureus N315
gccccaucuauuagaaa

SEQ ID NO: 2146611 - RNA, 16 nt, Staphylococcus aureus subsp. aureus N315
gcccccaacacaaaga

SEQ ID NO: 2146612 - RNA, 15 nt, Staphylococcus aureus subsp. aureus N315
gccccaacaaagaga

SEQ ID NO: 2146613 - RNA, 12 nt, Staphylococcus aureus subsp. aureus N315
gccccaacacag

SEQ ID NO: 2146614 - RNA, 13 nt, Staphylococcus aureus subsp. aureus N315
gccccaacacaga

SEQ ID NO: 2146615 - RNA, 15 nt, Staphylococcus aureus subsp. aureus N315
gccccaacacagaag

SEQ ID NO: 2146616 - RNA, 15 nt, Staphylococcus aureus subsp. aureus N315
gcccaucaucacugu

SEQ ID NO: 2146617 - RNA, 20 nt, Staphylococcus aureus subsp. aureus N315
gcaaaacuugcgcaugcuuu

SEQ ID NO: 2146618 - RNA, 16 nt, Staphylococcus aureus subsp. aureus N315
gcaaaacgcauuucau

SEQ ID NO: 2146619 - RNA, 15 nt, Staphylococcus aureus subsp. aureus N315
gcaauacuaacugaa

SEQ ID NO: 2146620 - RNA, 14 nt, Staphylococcus aureus subsp. aureus N315
gcaaguuggcgggg

SEQ ID NO: 2146621 - RNA, 12 nt, Staphylococcus aureus subsp. aureus N315
gcaacuaagaug

SEQ ID NO: 2146622 - RNA, 21 nt, Staphylococcus aureus subsp. aureus N315
gcaacuaaaacuaucugauua

SEQ ID NO: 2146623 - RNA, 21 nt, Staphylococcus aureus subsp. aureus N315
gcaagaauagauugauuguau

SEQ ID NO: 2146624 - RNA, 14 nt, Staphylococcus aureus subsp. aureus N315
gcaccaaugacgac

SEQ ID NO: 2146625 - RNA, 18 nt, Staphylococcus aureus subsp. aureus N315
gcacauuccaucuuaaaa

SEQ ID NO: 2146626 - RNA, 19 nt, Staphylococcus aureus subsp. aureus N315
gcacauucccguuaauauc

SEQ ID NO: 2146627 - RNA, 16 nt, Staphylococcus aureus subsp. aureus N315
gcacauuacuguaaaa

SEQ ID NO: 2146628 - RNA, 13 nt, Staphylococcus aureus subsp. aureus N315
gcaccaugugccu

SEQ ID NO: 2146629 - RNA, 14 nt, Staphylococcus aureus subsp. aureus N315
gcaaugcauauugu

SEQ ID NO: 2146630 - RNA, 18 nt, Staphylococcus aureus subsp. aureus N315
gcaaugauuauaaauaca

SEQ ID NO: 2146631 - RNA, 16 nt, Staphylococcus aureus subsp. aureus N315
gcaccgacaauuauaa

SEQ ID NO: 2146632 - RNA, 15 nt, Staphylococcus aureus subsp. aureus N315
gcaccuccaaccgcu

SEQ ID NO: 2146633 - RNA, 20 nt, Staphylococcus aureus subsp. aureus N315
gcaccuggucguacuuucaa

SEQ ID NO: 2146634 - RNA, 22 nt, Staphylococcus aureus subsp. aureus N315
gcaguaagauaauuuucaauua

SEQ ID NO: 2146635 - RNA, 22 nt, Staphylococcus aureus subsp. aureus N315
gcagugaaguuaacuauaacaa

SEQ ID NO: 2146636 - RNA, 14 nt, Staphylococcus aureus subsp. aureus N315
gcauaauuuuuuaa

SEQ ID NO: 2146637 - RNA, 14 nt, Staphylococcus aureus subsp. aureus N315
gcauaagaaauacu

SEQ ID NO: 2146638 - RNA, 14 nt, Staphylococcus aureus subsp. aureus N315
gcaguuaauaagaa

SEQ ID NO: 2146639 - RNA, 13 nt, Staphylococcus aureus subsp. aureus N315
gcagggugcuaaa

SEQ ID NO: 2146640 - RNA, 18 nt, Staphylococcus aureus subsp. aureus N315
gcacuucuauauuaauag

SEQ ID NO: 2146641 - RNA, 20 nt, Staphylococcus aureus subsp. aureus N315
gcacuugucucaaauuaaau

SEQ ID NO: 2146642 - RNA, 14 nt, Staphylococcus aureus subsp. aureus N315
gcacuuuauuaaaa

SEQ ID NO: 2146643 - RNA, 23 nt, Staphylococcus aureus subsp. aureus N315
gcagaagaaaacuauuuuaaaaa

SEQ ID NO: 2146644 - RNA, 15 nt, Staphylococcus aureus subsp. aureus N315
gcagcaaugacacua

SEQ ID NO: 2146645 - RNA, 19 nt, Staphylococcus aureus subsp. aureus N315
gaguuggcaucagacuaaa

SEQ ID NO: 2146646 - RNA, 19 nt, Staphylococcus aureus subsp. aureus N315
gaguguguccaucauuugu

SEQ ID NO: 2146647 - RNA, 16 nt, Staphylococcus aureus subsp. aureus N315
gauaaaugaauugucu

SEQ ID NO: 2146648 - RNA, 20 nt, Staphylococcus aureus subsp. aureus N315
gauaaauucccauguauucu

SEQ ID NO: 2146649 - RNA, 16 nt, Staphylococcus aureus subsp. aureus N315
gauaaauuaauaugaa

SEQ ID NO: 2146650 - RNA, 14 nt, Staphylococcus aureus subsp. aureus N315
gauaaacuacacac

SEQ ID NO: 2146651 - RNA, 15 nt, Staphylococcus aureus subsp. aureus N315
gauaaacuacacacg

SEQ ID NO: 2146652 - RNA, 14 nt, Staphylococcus aureus subsp. aureus N315
gauaaaucaucauu

SEQ ID NO: 2146653 - RNA, 20 nt, Staphylococcus aureus subsp. aureus N315
gauaacuacacuuaauauau

SEQ ID NO: 2146654 - RNA, 16 nt, Staphylococcus aureus subsp. aureus N315
gauaacagcuacaaau

SEQ ID NO: 2146655 - RNA, 21 nt, Staphylococcus aureus subsp. aureus N315
gauaacaagaaguaauguuaa

SEQ ID NO: 2146656 - RNA, 22 nt, Staphylococcus aureus subsp. aureus N315
gauaacaauuuuaaaucuuuua

SEQ ID NO: 2146657 - RNA, 21 nt, Staphylococcus aureus subsp. aureus N315
gauaagaaucaucuaaaugca

SEQ ID NO: 2146658 - RNA, 13 nt, Staphylococcus aureus subsp. aureus N315
gauaagaaaauac

SEQ ID NO: 2146659 - RNA, 21 nt, Staphylococcus aureus subsp. aureus N315
gauaacuguaacgugaggccc

SEQ ID NO: 2146660 - RNA, 19 nt, Staphylococcus aureus subsp. aureus N315
gagguguggaguaaagauc

SEQ ID NO: 2146661 - RNA, 16 nt, Staphylococcus aureus subsp. aureus N315
gaggucuccaauacuu

SEQ ID NO: 2146662 - RNA, 22 nt, Staphylococcus aureus subsp. aureus N315
gaguaccaagaaauacucaguu

SEQ ID NO: 2146663 - RNA, 15 nt, Staphylococcus aureus subsp. aureus N315
gauagaauacuaaaa

SEQ ID NO: 2146664 - RNA, 15 nt, Staphylococcus aureus subsp. aureus N315
gauagaaguuuuuug

SEQ ID NO: 2146665 - RNA, 21 nt, Staphylococcus aureus subsp. aureus N315
gauagaauacuaaaaguguua

SEQ ID NO: 2146666 - RNA, 14 nt, Staphylococcus aureus subsp. aureus N315
gauagaaaggcagg

SEQ ID NO: 2146667 - RNA, 23 nt, Staphylococcus aureus subsp. aureus N315
gauaccucauccgccaauuaaaa

SEQ ID NO: 2146668 - RNA, 21 nt, Staphylococcus aureus subsp. aureus N315
gauacgugguuuuauuugauu

SEQ ID NO: 2146669 - RNA, 20 nt, Staphylococcus aureus subsp. aureus N315
gauacuaaacgauaaauuaa

SEQ ID NO: 2146670 - RNA, 17 nt, Staphylococcus aureus subsp. aureus N315
gauacuaauaucuucuu

SEQ ID NO: 2146671 - RNA, 14 nt, Staphylococcus aureus subsp. aureus N315
gauaccuaaaauac

SEQ ID NO: 2146672 - RNA, 14 nt, Staphylococcus aureus subsp. aureus N315
gauagugaauaaug

SEQ ID NO: 2146673 - RNA, 16 nt, Staphylococcus aureus subsp. aureus N315
gauauaaugaaguuau

SEQ ID NO: 2146674 - RNA, 20 nt, Staphylococcus aureus subsp. aureus N315
gauauagaccguugaaaugu

SEQ ID NO: 2146675 - RNA, 18 nt, Staphylococcus aureus subsp. aureus N315
gauauaaugaaguuauga

SEQ ID NO: 2146676 - RNA, 15 nt, Staphylococcus aureus subsp. aureus N315
gauauagaaaaggga

SEQ ID NO: 2146677 - RNA, 15 nt, Staphylococcus aureus subsp. aureus N315
gauaggauauuuuuu

SEQ ID NO: 2146678 - RNA, 14 nt, Staphylococcus aureus subsp. aureus N315
gauagcuaaacauu

SEQ ID NO: 2146679 - RNA, 13 nt, Staphylococcus aureus subsp. aureus N315
gaucaugccuuca

SEQ ID NO: 2146680 - RNA, 14 nt, Staphylococcus aureus subsp. aureus N315
gaucaucguauaga

SEQ ID NO: 2146681 - RNA, 17 nt, Staphylococcus aureus subsp. aureus N315
gaucaugccuucaugaa

SEQ ID NO: 2146682 - RNA, 12 nt, Staphylococcus aureus subsp. aureus N315
gaucccaaaauc

SEQ ID NO: 2146683 - RNA, 15 nt, Staphylococcus aureus subsp. aureus N315
gauauugaaaacacg

SEQ ID NO: 2146684 - RNA, 20 nt, Staphylococcus aureus subsp. aureus N315
gauauuuuuuaauaaucaaa

SEQ ID NO: 2146685 - RNA, 23 nt, Staphylococcus aureus subsp. aureus N315
gauauauaacuauggucaucaau

SEQ ID NO: 2146686 - RNA, 22 nt, Staphylococcus aureus subsp. aureus N315
gauauagugcuuguuuauuaca

SEQ ID NO: 2146687 - RNA, 20 nt, Staphylococcus aureus subsp. aureus N315
gauauagauggcuuuuuuug

SEQ ID NO: 2146688 - RNA, 21 nt, Staphylococcus aureus subsp. aureus N315
gauauuauaaaaacagcagug

SEQ ID NO: 2146689 - RNA, 21 nt, Staphylococcus aureus subsp. aureus N315
gauaucaaaguacuaacguuu

SEQ ID NO: 2146690 - RNA, 17 nt, Staphylococcus aureus subsp. aureus N315
gauauucaacuugauua

SEQ ID NO: 2146691 - RNA, 16 nt, Staphylococcus aureus subsp. aureus N315
gaucaagcugagcuuu

SEQ ID NO: 2146692 - RNA, 19 nt, Staphylococcus aureus subsp. aureus N315
gaucacaguacacuaaguu

SEQ ID NO: 2146693 - RNA, 14 nt, Staphylococcus aureus subsp. aureus N315
gaucacacgacaug

SEQ ID NO: 2146694 - RNA, 18 nt, Staphylococcus aureus subsp. aureus N315
gaucuucaugaacagcau

SEQ ID NO: 2146695 - RNA, 12 nt, Staphylococcus aureus subsp. aureus N315
gaugaaaaagau

SEQ ID NO: 2146696 - RNA, 17 nt, Staphylococcus aureus subsp. aureus N315
gaucuuuuuuauauuca

SEQ ID NO: 2146697 - RNA, 21 nt, Staphylococcus aureus subsp. aureus N315
gaugaaauuguguugaaucaa

SEQ ID NO: 2146698 - RNA, 12 nt, Staphylococcus aureus subsp. aureus N315
gaugaaaacaaa

SEQ ID NO: 2146699 - RNA, 22 nt, Staphylococcus aureus subsp. aureus N315
gaugaaaacuuaaaaaugaaau

SEQ ID NO: 2146700 - RNA, 17 nt, Staphylococcus aureus subsp. aureus N315
gaugaaaaucuuuaacu

SEQ ID NO: 2146701 - RNA, 21 nt, Staphylococcus aureus subsp. aureus N315
gaugaacuuaaugcuucaaau

SEQ ID NO: 2146702 - RNA, 18 nt, Staphylococcus aureus subsp. aureus N315
gaugaacuuaaugcuuca

SEQ ID NO: 2146703 - RNA, 18 nt, Staphylococcus aureus subsp. aureus N315
gaugauuuauaaaaacuu

SEQ ID NO: 2146704 - RNA, 19 nt, Staphylococcus aureus subsp. aureus N315
gaugauuuauuaacucaug

SEQ ID NO: 2146705 - RNA, 15 nt, Staphylococcus aureus subsp. aureus N315
gaugauauucaacuu

SEQ ID NO: 2146706 - RNA, 14 nt, Staphylococcus aureus subsp. aureus N315
gaugcgcuucuaac

SEQ ID NO: 2146707 - RNA, 14 nt, Staphylococcus aureus subsp. aureus N315
gauugcaaaaaaac

SEQ ID NO: 2146708 - RNA, 17 nt, Staphylococcus aureus subsp. aureus N315
gauugcaaaaaaacaaa

SEQ ID NO: 2146709 - RNA, 12 nt, Staphylococcus aureus subsp. aureus N315
gauucuauuucu

SEQ ID NO: 2146710 - RNA, 23 nt, Staphylococcus aureus subsp. aureus N315
gauucguauucaaaguuuucauu

SEQ ID NO: 2146711 - RNA, 15 nt, Staphylococcus aureus subsp. aureus N315
gauuuauaaauguuu

SEQ ID NO: 2146712 - RNA, 20 nt, Staphylococcus aureus subsp. aureus N315
gauuuaguuuuuuuaaaguu

SEQ ID NO: 2146713 - RNA, 16 nt, Staphylococcus aureus subsp. aureus N315
gauuuagcauacauua

SEQ ID NO: 2146714 - RNA, 21 nt, Staphylococcus aureus subsp. aureus N315
gauuuaauugaaauagaaacu

SEQ ID NO: 2146715 - RNA, 21 nt, Staphylococcus aureus subsp. aureus N315
gauuuaccucuugauaaaaua

SEQ ID NO: 2146716 - RNA, 21 nt, Staphylococcus aureus subsp. aureus N315
gauuggcuugaaguuguuucu

SEQ ID NO: 2146717 - RNA, 16 nt, Staphylococcus aureus subsp. aureus N315
gauuguaccaguaaca

SEQ ID NO: 2146718 - RNA, 17 nt, Staphylococcus aureus subsp. aureus N315
gauuucuaucaaauaau

SEQ ID NO: 2146719 - RNA, 15 nt, Staphylococcus aureus subsp. aureus N315
gauuucuaucaaaua

SEQ ID NO: 2146720 - RNA, 20 nt, Staphylococcus aureus subsp. aureus N315
gauuucuaauugaaaucauc

SEQ ID NO: 2146721 - RNA, 15 nt, Staphylococcus aureus subsp. aureus N315
gauuuccucgguuuu

SEQ ID NO: 2146722 - RNA, 20 nt, Staphylococcus aureus subsp. aureus N315
gauuucccacgugccucauc

SEQ ID NO: 2146723 - RNA, 15 nt, Staphylococcus aureus subsp. aureus N315
gauuuuuugguuucu

SEQ ID NO: 2146724 - RNA, 22 nt, Staphylococcus aureus subsp. aureus N315
gcaaaaaaacaaauauuagaac

SEQ ID NO: 2146725 - RNA, 20 nt, Staphylococcus aureus subsp. aureus N315
gauuuucuuuaauaacuaaa

SEQ ID NO: 2146726 - RNA, 10 nt, Staphylococcus aureus subsp. aureus N315
gauuuugcuu

SEQ ID NO: 2146727 - RNA, 22 nt, Staphylococcus aureus subsp. aureus N315
gauuuugcugccaaaaaguauu

SEQ ID NO: 2146728 - RNA, 17 nt, Staphylococcus aureus subsp. aureus N315
gauuuuaaaagauaaau

SEQ ID NO: 2146729 - RNA, 22 nt, Staphylococcus aureus subsp. aureus N315
gauuuucgagugugucaacuua

SEQ ID NO: 2146730 - RNA, 17 nt, Staphylococcus aureus subsp. aureus N315
gauucauaucuuucaau

SEQ ID NO: 2146731 - RNA, 12 nt, Staphylococcus aureus subsp. aureus N315
gauucauauuua

SEQ ID NO: 2146732 - RNA, 15 nt, Staphylococcus aureus subsp. aureus N315
gauucauauuuaucg

SEQ ID NO: 2146733 - RNA, 19 nt, Staphylococcus aureus subsp. aureus N315
gauucauuuaaaaaucaaa

SEQ ID NO: 2146734 - RNA, 13 nt, Staphylococcus aureus subsp. aureus N315
gauucaaccuuaa

SEQ ID NO: 2146735 - RNA, 22 nt, Staphylococcus aureus subsp. aureus N315
gauucaaauaaaucaaacuuuu

SEQ ID NO: 2146736 - RNA, 14 nt, Staphylococcus aureus subsp. aureus N315
gauuauauuuuucu

SEQ ID NO: 2146737 - RNA, 11 nt, Staphylococcus aureus subsp. aureus N315
gauuauauaua

SEQ ID NO: 2146738 - RNA, 21 nt, Staphylococcus aureus subsp. aureus N315
gauuauauuuagauuuauaac

SEQ ID NO: 2146739 - RNA, 21 nt, Staphylococcus aureus subsp. aureus N315
gauuagugucacaaagaaauu

SEQ ID NO: 2146740 - RNA, 20 nt, Staphylococcus aureus subsp. aureus N315
gauucaggauuguagaaucu

SEQ ID NO: 2146741 - RNA, 16 nt, Staphylococcus aureus subsp. aureus N315
gauucauaaaauuuaa

SEQ ID NO: 2146742 - RNA, 15 nt, Staphylococcus aureus subsp. aureus N315
gauucaccagguuuu

SEQ ID NO: 2146743 - RNA, 13 nt, Staphylococcus aureus subsp. aureus N315
gauucaaaugaca

SEQ ID NO: 2146744 - RNA, 18 nt, Staphylococcus aureus subsp. aureus N315
gaugugaauguuuugugu

SEQ ID NO: 2146745 - RNA, 22 nt, Staphylococcus aureus subsp. aureus N315
gauuaauccuacacggacugca

SEQ ID NO: 2146746 - RNA, 22 nt, Staphylococcus aureus subsp. aureus N315
gauuaauuaaagauuaaaauau

SEQ ID NO: 2146747 - RNA, 14 nt, Staphylococcus aureus subsp. aureus N315
gauuacuuugcuaa

SEQ ID NO: 2146748 - RNA, 17 nt, Staphylococcus aureus subsp. aureus N315
gauuacauucuauacuu

SEQ ID NO: 2146749 - RNA, 23 nt, Staphylococcus aureus subsp. aureus N315
gauuacagcguacuaaagaauga

SEQ ID NO: 2146750 - RNA, 16 nt, Staphylococcus aureus subsp. aureus N315
gauguugguucaucaa

SEQ ID NO: 2146751 - RNA, 16 nt, Staphylococcus aureus subsp. aureus N315
gauguucacuaaaugu

SEQ ID NO: 2146752 - RNA, 14 nt, Staphylococcus aureus subsp. aureus N315
gauguuaaaaaaua

SEQ ID NO: 2146753 - RNA, 13 nt, Staphylococcus aureus subsp. aureus N315
gauguguugaaac

SEQ ID NO: 2146754 - RNA, 18 nt, Staphylococcus aureus subsp. aureus N315
gagccauuauuauuuuuu

SEQ ID NO: 2146755 - RNA, 21 nt, Staphylococcus aureus subsp. aureus N315
gagcccgagacauaaauuaau

SEQ ID NO: 2146756 - RNA, 22 nt, Staphylococcus aureus subsp. aureus N315
gagcaguauauaucaaauacau

SEQ ID NO: 2146757 - RNA, 21 nt, Staphylococcus aureus subsp. aureus N315
gagcauuuuuauauccaucuc

SEQ ID NO: 2146758 - RNA, 14 nt, Staphylococcus aureus subsp. aureus N315
gagauugagaauuc

SEQ ID NO: 2146759 - RNA, 21 nt, Staphylococcus aureus subsp. aureus N315
gagauuauuuuuuuaaaucua

SEQ ID NO: 2146760 - RNA, 16 nt, Staphylococcus aureus subsp. aureus N315
gagaugaaagauacug

SEQ ID NO: 2146761 - RNA, 20 nt, Staphylococcus aureus subsp. aureus N315
gagcaaagcuuuuuugcuuu

SEQ ID NO: 2146762 - RNA, 14 nt, Staphylococcus aureus subsp. aureus N315
gagauuuucuucau

SEQ ID NO: 2146763 - RNA, 19 nt, Staphylococcus aureus subsp. aureus N315
gagcaagucuucuaaaaaa

SEQ ID NO: 2146764 - RNA, 14 nt, Staphylococcus aureus subsp. aureus N315
gagcaauucuucaa

SEQ ID NO: 2146765 - RNA, 19 nt, Staphylococcus aureus subsp. aureus N315
gagcaauucuucaauuuca

SEQ ID NO: 2146766 - RNA, 17 nt, Staphylococcus aureus subsp. aureus N315
gagcuuuucuaaugcua

SEQ ID NO: 2146767 - RNA, 14 nt, Staphylococcus aureus subsp. aureus N315
gagcuuuaauuuuu

SEQ ID NO: 2146768 - RNA, 20 nt, Staphylococcus aureus subsp. aureus N315
gagcuugggacagaaaacaa

SEQ ID NO: 2146769 - RNA, 15 nt, Staphylococcus aureus subsp. aureus N315
gaggauauuuauucu

SEQ ID NO: 2146770 - RNA, 21 nt, Staphylococcus aureus subsp. aureus N315
gaggauaauuauuaggggaga

SEQ ID NO: 2146771 - RNA, 22 nt, Staphylococcus aureus subsp. aureus N315
gaggcacagcggaauacagaug

SEQ ID NO: 2146772 - RNA, 22 nt, Staphylococcus aureus subsp. aureus N315
gaggcacaguggauuacagaug

SEQ ID NO: 2146773 - RNA, 13 nt, Staphylococcus aureus subsp. aureus N315
gagcguaaaguuu

SEQ ID NO: 2146774 - RNA, 15 nt, Staphylococcus aureus subsp. aureus N315
gagcggaaauaugau

SEQ ID NO: 2146775 - RNA, 14 nt, Staphylococcus aureus subsp. aureus N315
gacguaauuaauag

SEQ ID NO: 2146776 - RNA, 17 nt, Staphylococcus aureus subsp. aureus N315
gacguugugucaugcug

SEQ ID NO: 2146777 - RNA, 17 nt, Staphylococcus aureus subsp. aureus N315
gacguuuugguuguucu

SEQ ID NO: 2146778 - RNA, 20 nt, Staphylococcus aureus subsp. aureus N315
gacuauuuuugaaaagagcg

SEQ ID NO: 2146779 - RNA, 20 nt, Staphylococcus aureus subsp. aureus N315
gacuaguguaccuuguuuca

SEQ ID NO: 2146780 - RNA, 14 nt, Staphylococcus aureus subsp. aureus N315
gacuauauaacaca

SEQ ID NO: 2146781 - RNA, 18 nt, Staphylococcus aureus subsp. aureus N315
gacugccaauaaaaugca

SEQ ID NO: 2146782 - RNA, 21 nt, Staphylococcus aureus subsp. aureus N315
gacugaaugagaaugugcuug

SEQ ID NO: 2146783 - RNA, 14 nt, Staphylococcus aureus subsp. aureus N315
gagaagcugucuua

SEQ ID NO: 2146784 - RNA, 17 nt, Staphylococcus aureus subsp. aureus N315
gagacauuuuaucugaa

SEQ ID NO: 2146785 - RNA, 14 nt, Staphylococcus aureus subsp. aureus N315
gagaauuuuaauua

SEQ ID NO: 2146786 - RNA, 15 nt, Staphylococcus aureus subsp. aureus N315
gagacaauaaugcac

SEQ ID NO: 2146787 - RNA, 14 nt, Staphylococcus aureus subsp. aureus N315
gagaaucuccauuu

SEQ ID NO: 2146788 - RNA, 17 nt, Staphylococcus aureus subsp. aureus N315
gagaauuucgaaaagaa

SEQ ID NO: 2146789 - RNA, 16 nt, Staphylococcus aureus subsp. aureus N315
gagaaugugcuuguaa

SEQ ID NO: 2146790 - RNA, 22 nt, Staphylococcus aureus subsp. aureus N315
gagagauuauuuaaaacuugua

SEQ ID NO: 2146791 - RNA, 16 nt, Staphylococcus aureus subsp. aureus N315
gagaguaauguuccau

SEQ ID NO: 2146792 - RNA, 15 nt, Staphylococcus aureus subsp. aureus N315
gagacuguuuuuuug

SEQ ID NO: 2146793 - RNA, 16 nt, Staphylococcus aureus subsp. aureus N315
gagacguuuuccauga

SEQ ID NO: 2146794 - RNA, 15 nt, Staphylococcus aureus subsp. aureus N315
gagacuauauucaau

SEQ ID NO: 2146795 - RNA, 20 nt, Staphylococcus aureus subsp. aureus N315
gagaaccauccauaggauuc

SEQ ID NO: 2146796 - RNA, 13 nt, Staphylococcus aureus subsp. aureus N315
gagaaauuagaac

SEQ ID NO: 2146797 - RNA, 19 nt, Staphylococcus aureus subsp. aureus N315
gagaaauucgaaaagaaau

SEQ ID NO: 2146798 - RNA, 16 nt, Staphylococcus aureus subsp. aureus N315
gagaaauacuauucuu

SEQ ID NO: 2146799 - RNA, 16 nt, Staphylococcus aureus subsp. aureus N315
gacuuucuugaugaau

SEQ ID NO: 2146800 - RNA, 18 nt, Staphylococcus aureus subsp. aureus N315
gacuuuuaaaaaacauac

SEQ ID NO: 2146801 - RNA, 23 nt, Staphylococcus aureus subsp. aureus N315
gacuuuuacagaacguucauaua

SEQ ID NO: 2146802 - RNA, 22 nt, Staphylococcus aureus subsp. aureus N315
gacuugugcgcgacguuuaaau

SEQ ID NO: 2146803 - RNA, 15 nt, Staphylococcus aureus subsp. aureus N315
gacuggguuguuauu

SEQ ID NO: 2146804 - RNA, 23 nt, Staphylococcus aureus subsp. aureus N315
gacuguuuuuuuguuugguguga

SEQ ID NO: 2146805 - RNA, 18 nt, Staphylococcus aureus subsp. aureus N315
gacuuauuugaaugcaaa

SEQ ID NO: 2146806 - RNA, 16 nt, Staphylococcus aureus subsp. aureus N315
gacuuaucguaagcuu

SEQ ID NO: 2146807 - RNA, 20 nt, Staphylococcus aureus subsp. aureus N315
gacuuauucaacguauaagu

SEQ ID NO: 2146808 - RNA, 19 nt, Staphylococcus aureus subsp. aureus N315
gacuucuuucaauuaaucg

SEQ ID NO: 2146809 - RNA, 15 nt, Staphylococcus aureus subsp. aureus N315
gacuucuuucaauua

SEQ ID NO: 2146810 - RNA, 15 nt, Staphylococcus aureus subsp. aureus N315
gacuugauaaaaaau

SEQ ID NO: 2146811 - RNA, 17 nt, Staphylococcus aureus subsp. aureus N315
gacuugauaaaaaauga

SEQ ID NO: 2146812 - RNA, 23 nt, Staphylococcus aureus subsp. aureus N315
gacauaaaauuaacuuaaaauuu

SEQ ID NO: 2146813 - RNA, 18 nt, Staphylococcus aureus subsp. aureus N315
gacaguuuuaaaugaaac

SEQ ID NO: 2146814 - RNA, 13 nt, Staphylococcus aureus subsp. aureus N315
gacauaaauaugg

SEQ ID NO: 2146815 - RNA, 18 nt, Staphylococcus aureus subsp. aureus N315
gacaguuuccauaaauaa

SEQ ID NO: 2146816 - RNA, 22 nt, Staphylococcus aureus subsp. aureus N315
gacauacucacaaaaaacacua

SEQ ID NO: 2146817 - RNA, 14 nt, Staphylococcus aureus subsp. aureus N315
gacauaaggucuug

SEQ ID NO: 2146818 - RNA, 22 nt, Staphylococcus aureus subsp. aureus N315
gacauacuugucguauucuuca

SEQ ID NO: 2146819 - RNA, 18 nt, Staphylococcus aureus subsp. aureus N315
gacauagaucaauauucu

SEQ ID NO: 2146820 - RNA, 15 nt, Staphylococcus aureus subsp. aureus N315
gacauauaaauguug

SEQ ID NO: 2146821 - RNA, 18 nt, Staphylococcus aureus subsp. aureus N315
gacaucaauaucuucuuc

SEQ ID NO: 2146822 - RNA, 12 nt, Staphylococcus aureus subsp. aureus N315
gacaucuagaug

SEQ ID NO: 2146823 - RNA, 18 nt, Staphylococcus aureus subsp. aureus N315
gacauuacauuuaguaca

SEQ ID NO: 2146824 - RNA, 17 nt, Staphylococcus aureus subsp. aureus N315
gacauguccauaauauc

SEQ ID NO: 2146825 - RNA, 16 nt, Staphylococcus aureus subsp. aureus N315
gacauuuguaaauauu

SEQ ID NO: 2146826 - RNA, 15 nt, Staphylococcus aureus subsp. aureus N315
gacauuucaucaaua

SEQ ID NO: 2146827 - RNA, 14 nt, Staphylococcus aureus subsp. aureus N315
gaccaauagcaauu

SEQ ID NO: 2146828 - RNA, 14 nt, Staphylococcus aureus subsp. aureus N315
gaccaaguaugaga

SEQ ID NO: 2146829 - RNA, 23 nt, Staphylococcus aureus subsp. aureus N315
gacauuuuuggcuuaucaagcac

SEQ ID NO: 2146830 - RNA, 21 nt, Staphylococcus aureus subsp. aureus N315
gaccacucaauucucuaacuu

SEQ ID NO: 2146831 - RNA, 14 nt, Staphylococcus aureus subsp. aureus N315
gaccacuauuuuua

SEQ ID NO: 2146832 - RNA, 18 nt, Staphylococcus aureus subsp. aureus N315
gaccacucaauucucuaa

SEQ ID NO: 2146833 - RNA, 22 nt, Staphylococcus aureus subsp. aureus N315
gaccacuuuuguuaaaaaaugg

SEQ ID NO: 2146834 - RNA, 17 nt, Staphylococcus aureus subsp. aureus N315
gaccaccuuuaucugua

SEQ ID NO: 2146835 - RNA, 14 nt, Staphylococcus aureus subsp. aureus N315
cuuuguaaauuuuu

SEQ ID NO: 2146836 - RNA, 18 nt, Staphylococcus aureus subsp. aureus N315
cuuuguaaccuaaaaaca

SEQ ID NO: 2146837 - RNA, 20 nt, Staphylococcus aureus subsp. aureus N315
cuuuguaaccuaaaaacaaa

SEQ ID NO: 2146838 - RNA, 15 nt, Staphylococcus aureus subsp. aureus N315
gacaaaacuuguaau

SEQ ID NO: 2146839 - RNA, 13 nt, Staphylococcus aureus subsp. aureus N315
gacaaauguucua

SEQ ID NO: 2146840 - RNA, 21 nt, Staphylococcus aureus subsp. aureus N315
gacaaaguucacaacaaagug

SEQ ID NO: 2146841 - RNA, 15 nt, Staphylococcus aureus subsp. aureus N315
gacaaggauugaaaa

SEQ ID NO: 2146842 - RNA, 14 nt, Staphylococcus aureus subsp. aureus N315
gacaacugauuuaa

SEQ ID NO: 2146843 - RNA, 22 nt, Staphylococcus aureus subsp. aureus N315
gacaaguugcugaauaaaauau

SEQ ID NO: 2146844 - RNA, 23 nt, Staphylococcus aureus subsp. aureus N315
gacaaguauacuugaagaaucag

SEQ ID NO: 2146845 - RNA, 19 nt, Staphylococcus aureus subsp. aureus N315
gacaauuauaauaaaacuu

SEQ ID NO: 2146846 - RNA, 17 nt, Staphylococcus aureus subsp. aureus N315
gacaaucuuaucauaau

SEQ ID NO: 2146847 - RNA, 13 nt, Staphylococcus aureus subsp. aureus N315
gacagcuacaauu

SEQ ID NO: 2146848 - RNA, 17 nt, Staphylococcus aureus subsp. aureus N315
gacacguguaaaaauga

SEQ ID NO: 2146849 - RNA, 23 nt, Staphylococcus aureus subsp. aureus N315
gacacgcccgacaucauaaauga

SEQ ID NO: 2146850 - RNA, 13 nt, Staphylococcus aureus subsp. aureus N315
gacaccuauauuu

SEQ ID NO: 2146851 - RNA, 17 nt, Staphylococcus aureus subsp. aureus N315
gacacauuuacuuaaga

SEQ ID NO: 2146852 - RNA, 19 nt, Staphylococcus aureus subsp. aureus N315
gacacauuuacuuaagaac

SEQ ID NO: 2146853 - RNA, 18 nt, Staphylococcus aureus subsp. aureus N315
gacaccaacauauuuuaa

SEQ ID NO: 2146854 - RNA, 21 nt, Staphylococcus aureus subsp. aureus N315
gacgaucuucaugaacagcau

SEQ ID NO: 2146855 - RNA, 19 nt, Staphylococcus aureus subsp. aureus N315
gacgauuuauuaguuuuua

SEQ ID NO: 2146856 - RNA, 20 nt, Staphylococcus aureus subsp. aureus N315
gacgauuuauuaguuuuuac

SEQ ID NO: 2146857 - RNA, 19 nt, Staphylococcus aureus subsp. aureus N315
gacgaaacacacuaaaagc

SEQ ID NO: 2146858 - RNA, 23 nt, Staphylococcus aureus subsp. aureus N315
gaccuuaucugaccaguauacga

SEQ ID NO: 2146859 - RNA, 17 nt, Staphylococcus aureus subsp. aureus N315
gaccauuuuauauuuua

SEQ ID NO: 2146860 - RNA, 19 nt, Staphylococcus aureus subsp. aureus N315
gaccaugcaaacucauuua

SEQ ID NO: 2146861 - RNA, 23 nt, Staphylococcus aureus subsp. aureus N315
gaccaugcaaacucauuuauaaa

SEQ ID NO: 2146862 - RNA, 14 nt, Staphylococcus aureus subsp. aureus N315
gaccuuauauuuua

SEQ ID NO: 2146863 - RNA, 15 nt, Staphylococcus aureus subsp. aureus N315
cguuauagauaagua

SEQ ID NO: 2146864 - RNA, 19 nt, Staphylococcus aureus subsp. aureus N315
cguuauaaguacaaauaau

SEQ ID NO: 2146865 - RNA, 20 nt, Staphylococcus aureus subsp. aureus N315
cguuaucuuuaaguaauuca

SEQ ID NO: 2146866 - RNA, 19 nt, Staphylococcus aureus subsp. aureus N315
cguucgaaguagcuuguuu

SEQ ID NO: 2146867 - RNA, 18 nt, Staphylococcus aureus subsp. aureus N315
cguugcaccuauuuuuug

SEQ ID NO: 2146868 - RNA, 16 nt, Staphylococcus aureus subsp. aureus N315
cguugaccuuguucuu

SEQ ID NO: 2146869 - RNA, 15 nt, Staphylococcus aureus subsp. aureus N315
cguugaccuuguucu

SEQ ID NO: 2146870 - RNA, 15 nt, Staphylococcus aureus subsp. aureus N315
cuaaaauaucaaaau

SEQ ID NO: 2146871 - RNA, 21 nt, Staphylococcus aureus subsp. aureus N315
cuaaaauagaaaaauuucaaa

SEQ ID NO: 2146872 - RNA, 17 nt, Staphylococcus aureus subsp. aureus N315
cuaaaauucuuucagcu

SEQ ID NO: 2146873 - RNA, 14 nt, Staphylococcus aureus subsp. aureus N315
cuaaaauuuccuca

SEQ ID NO: 2146874 - RNA, 19 nt, Staphylococcus aureus subsp. aureus N315
cuaaaguguagccaaauaa

SEQ ID NO: 2146875 - RNA, 15 nt, Staphylococcus aureus subsp. aureus N315
cuaaaguaaauaaca

SEQ ID NO: 2146876 - RNA, 13 nt, Staphylococcus aureus subsp. aureus N315
cuaaaguaaauaa

SEQ ID NO: 2146877 - RNA, 19 nt, Staphylococcus aureus subsp. aureus N315
cuaaagguauucuauuuuu

SEQ ID NO: 2146878 - RNA, 14 nt, Staphylococcus aureus subsp. aureus N315
cuaaauaaaauuaa

SEQ ID NO: 2146879 - RNA, 16 nt, Staphylococcus aureus subsp. aureus N315
cuaaauaaaauuaaaa

SEQ ID NO: 2146880 - RNA, 17 nt, Staphylococcus aureus subsp. aureus N315
cuaaauaauuucucaaa

SEQ ID NO: 2146881 - RNA, 17 nt, Staphylococcus aureus subsp. aureus N315
cuaaagcgauuuccauc

SEQ ID NO: 2146882 - RNA, 17 nt, Staphylococcus aureus subsp. aureus N315
cuaaagcuauaaaaaau

SEQ ID NO: 2146883 - RNA, 20 nt, Staphylococcus aureus subsp. aureus N315
cuaaacucguugcacucuuu

SEQ ID NO: 2146884 - RNA, 19 nt, Staphylococcus aureus subsp. aureus N315
cguuugaagaauguuucau

SEQ ID NO: 2146885 - RNA, 17 nt, Staphylococcus aureus subsp. aureus N315
cguuucuguuucaucac

SEQ ID NO: 2146886 - RNA, 14 nt, Staphylococcus aureus subsp. aureus N315
cguuuuauauuuau

SEQ ID NO: 2146887 - RNA, 12 nt, Staphylococcus aureus subsp. aureus N315
cguuuuccauga

SEQ ID NO: 2146888 - RNA, 16 nt, Staphylococcus aureus subsp. aureus N315
cguuuuccaugaguuu

SEQ ID NO: 2146889 - RNA, 19 nt, Staphylococcus aureus subsp. aureus N315
cguuuugcuaaccaucaua

SEQ ID NO: 2146890 - RNA, 21 nt, Staphylococcus aureus subsp. aureus N315
cguuucagaaguuguuuagaa

SEQ ID NO: 2146891 - RNA, 22 nt, Staphylococcus aureus subsp. aureus N315
cuaagguaagaccccgaaaaga

SEQ ID NO: 2146892 - RNA, 15 nt, Staphylococcus aureus subsp. aureus N315
cuaaggcuaaugaua

SEQ ID NO: 2146893 - RNA, 14 nt, Staphylococcus aureus subsp. aureus N315
cuaaggcuaaugau

SEQ ID NO: 2146894 - RNA, 16 nt, Staphylococcus aureus subsp. aureus N315
cuaaggacuuuaugcc

SEQ ID NO: 2146895 - RNA, 14 nt, Staphylococcus aureus subsp. aureus N315
cuaauaacaaauag

SEQ ID NO: 2146896 - RNA, 22 nt, Staphylococcus aureus subsp. aureus N315
cuaacguuuuaaagguuaaaua

SEQ ID NO: 2146897 - RNA, 17 nt, Staphylococcus aureus subsp. aureus N315
cuaacuaaguauagugu

SEQ ID NO: 2146898 - RNA, 15 nt, Staphylococcus aureus subsp. aureus N315
cuaauaucaauuuuu

SEQ ID NO: 2146899 - RNA, 21 nt, Staphylococcus aureus subsp. aureus N315
cuaauaugucuagacuuauuu

SEQ ID NO: 2146900 - RNA, 16 nt, Staphylococcus aureus subsp. aureus N315
cuaaucuuaauugucu

SEQ ID NO: 2146901 - RNA, 18 nt, Staphylococcus aureus subsp. aureus N315
cuaaucuugguucagcuu

SEQ ID NO: 2146902 - RNA, 20 nt, Staphylococcus aureus subsp. aureus N315
cuaaucuugguucagcuuua

SEQ ID NO: 2146903 - RNA, 16 nt, Staphylococcus aureus subsp. aureus N315
cuaaucgacuuuuaca

SEQ ID NO: 2146904 - RNA, 16 nt, Staphylococcus aureus subsp. aureus N315
cuaaucuauuuagcuu

SEQ ID NO: 2146905 - RNA, 13 nt, Staphylococcus aureus subsp. aureus N315
cuaaucuaaauuc

SEQ ID NO: 2146906 - RNA, 11 nt, Staphylococcus aureus subsp. aureus N315
cuaaucuauuu

SEQ ID NO: 2146907 - RNA, 21 nt, Staphylococcus aureus subsp. aureus N315
cuaauugaaggccauuuuuau

SEQ ID NO: 2146908 - RNA, 23 nt, Staphylococcus aureus subsp. aureus N315
cuaauugaaggccauuuuuauuu

SEQ ID NO: 2146909 - RNA, 14 nt, Staphylococcus aureus subsp. aureus N315
cuaauucugaaauc

SEQ ID NO: 2146910 - RNA, 15 nt, Staphylococcus aureus subsp. aureus N315
cuaaugcuaauuuaa

SEQ ID NO: 2146911 - RNA, 16 nt, Staphylococcus aureus subsp. aureus N315
cuaaugcuuuaauaaa

SEQ ID NO: 2146912 - RNA, 18 nt, Staphylococcus aureus subsp. aureus N315
cuaaugcuaauuuaacug

SEQ ID NO: 2146913 - RNA, 14 nt, Staphylococcus aureus subsp. aureus N315
cuaaugcuauauua

SEQ ID NO: 2146914 - RNA, 14 nt, Staphylococcus aureus subsp. aureus N315
cuaaugauuuauua

SEQ ID NO: 2146915 - RNA, 13 nt, Staphylococcus aureus subsp. aureus N315
cuaaugauuuauu

SEQ ID NO: 2146916 - RNA, 19 nt, Staphylococcus aureus subsp. aureus N315
cuaauggcuaauacaaaac

SEQ ID NO: 2146917 - RNA, 20 nt, Staphylococcus aureus subsp. aureus N315
cuaauguuaaaauaacugcu

SEQ ID NO: 2146918 - RNA, 19 nt, Staphylococcus aureus subsp. aureus N315
cuaauguguggauuuaauu

SEQ ID NO: 2146919 - RNA, 21 nt, Staphylococcus aureus subsp. aureus N315
cuaauguguacuuaaaaauag

SEQ ID NO: 2146920 - RNA, 16 nt, Staphylococcus aureus subsp. aureus N315
cuacaauuuucucauu

SEQ ID NO: 2146921 - RNA, 16 nt, Staphylococcus aureus subsp. aureus N315
cuacaauauagaaaau

SEQ ID NO: 2146922 - RNA, 19 nt, Staphylococcus aureus subsp. aureus N315
cuacacgaguauuaucaca

SEQ ID NO: 2146923 - RNA, 15 nt, Staphylococcus aureus subsp. aureus N315
cuacacggucccaag

SEQ ID NO: 2146924 - RNA, 14 nt, Staphylococcus aureus subsp. aureus N315
cuacaacuucuucu

SEQ ID NO: 2146925 - RNA, 23 nt, Staphylococcus aureus subsp. aureus N315
cuacaacuucuucuccguauuua

SEQ ID NO: 2146926 - RNA, 18 nt, Staphylococcus aureus subsp. aureus N315
cuacaauucauaagaaaa

SEQ ID NO: 2146927 - RNA, 20 nt, Staphylococcus aureus subsp. aureus N315
cuacaauucauaagaaaaau

SEQ ID NO: 2146928 - RNA, 22 nt, Staphylococcus aureus subsp. aureus N315
cuacaauccuauggcgcaauuu

SEQ ID NO: 2146929 - RNA, 23 nt, Staphylococcus aureus subsp. aureus N315
cuaauuuugugaauuuauuuugu

SEQ ID NO: 2146930 - RNA, 17 nt, Staphylococcus aureus subsp. aureus N315
cuaauuugcaaaaucaa

SEQ ID NO: 2146931 - RNA, 18 nt, Staphylococcus aureus subsp. aureus N315
cuaauuugcaaaaucaac

SEQ ID NO: 2146932 - RNA, 21 nt, Staphylococcus aureus subsp. aureus N315
cuaauuuaaaugauuucacuu

SEQ ID NO: 2146933 - RNA, 20 nt, Staphylococcus aureus subsp. aureus N315
cuaauuuaguaucuauacaa

SEQ ID NO: 2146934 - RNA, 16 nt, Staphylococcus aureus subsp. aureus N315
cuacauuaaagaaaau

SEQ ID NO: 2146935 - RNA, 13 nt, Staphylococcus aureus subsp. aureus N315
cuaccaauaauuc

SEQ ID NO: 2146936 - RNA, 14 nt, Staphylococcus aureus subsp. aureus N315
cuaccaauaauucc

SEQ ID NO: 2146937 - RNA, 22 nt, Staphylococcus aureus subsp. aureus N315
cuacacuuggcuuaggaugaaa

SEQ ID NO: 2146938 - RNA, 19 nt, Staphylococcus aureus subsp. aureus N315
cuacacuguuuuauaaaug

SEQ ID NO: 2146939 - RNA, 18 nt, Staphylococcus aureus subsp. aureus N315
cuacagauuuuaaaaauu

SEQ ID NO: 2146940 - RNA, 15 nt, Staphylococcus aureus subsp. aureus N315
cuacagagaaucaau

SEQ ID NO: 2146941 - RNA, 13 nt, Staphylococcus aureus subsp. aureus N315
cuacagcacugaa

SEQ ID NO: 2146942 - RNA, 23 nt, Staphylococcus aureus subsp. aureus N315
cuacagcacugaaaucuagaccu

SEQ ID NO: 2146943 - RNA, 19 nt, Staphylococcus aureus subsp. aureus N315
cuacauaauuuaucaauuu

SEQ ID NO: 2146944 - RNA, 23 nt, Staphylococcus aureus subsp. aureus N315
cuacauaauuuaucaauuucuau

SEQ ID NO: 2146945 - RNA, 18 nt, Staphylococcus aureus subsp. aureus N315
cuacauacaacucguuuu

SEQ ID NO: 2146946 - RNA, 22 nt, Staphylococcus aureus subsp. aureus N315
cuacauacaacucguuuuucca

SEQ ID NO: 2146947 - RNA, 16 nt, Staphylococcus aureus subsp. aureus N315
cuacaugaaucaacaa

SEQ ID NO: 2146948 - RNA, 15 nt, Staphylococcus aureus subsp. aureus N315
cuacauauuggcuug

SEQ ID NO: 2146949 - RNA, 16 nt, Staphylococcus aureus subsp. aureus N315
cucauaccaaaaacau

SEQ ID NO: 2146950 - RNA, 15 nt, Staphylococcus aureus subsp. aureus N315
cucauacaaauuuuu

SEQ ID NO: 2146951 - RNA, 19 nt, Staphylococcus aureus subsp. aureus N315
cucauaauuaucauauaaa

SEQ ID NO: 2146952 - RNA, 14 nt, Staphylococcus aureus subsp. aureus N315
cucauacaaauuuu

SEQ ID NO: 2146953 - RNA, 13 nt, Staphylococcus aureus subsp. aureus N315
cucagugcauuuu

SEQ ID NO: 2146954 - RNA, 13 nt, Staphylococcus aureus subsp. aureus N315
cucauaaaucaug

SEQ ID NO: 2146955 - RNA, 14 nt, Staphylococcus aureus subsp. aureus N315
cucauuagcgcaag

SEQ ID NO: 2146956 - RNA, 16 nt, Staphylococcus aureus subsp. aureus N315
cucauauugaauacuu

SEQ ID NO: 2146957 - RNA, 16 nt, Staphylococcus aureus subsp. aureus N315
cucauaucuauuuuuc

SEQ ID NO: 2146958 - RNA, 11 nt, Staphylococcus aureus subsp. aureus N315
cucaucauuua

SEQ ID NO: 2146959 - RNA, 15 nt, Staphylococcus aureus subsp. aureus N315
cucaucauuuaaaau

SEQ ID NO: 2146960 - RNA, 17 nt, Staphylococcus aureus subsp. aureus N315
cucauuuauaaacauug

SEQ ID NO: 2146961 - RNA, 19 nt, Staphylococcus aureus subsp. aureus N315
cucaugcugaaauguagac

SEQ ID NO: 2146962 - RNA, 12 nt, Staphylococcus aureus subsp. aureus N315
cuccaaauauug

SEQ ID NO: 2146963 - RNA, 14 nt, Staphylococcus aureus subsp. aureus N315
cuccaauacuuuuu

SEQ ID NO: 2146964 - RNA, 15 nt, Staphylococcus aureus subsp. aureus N315
cuccaaucaucauua

SEQ ID NO: 2146965 - RNA, 22 nt, Staphylococcus aureus subsp. aureus N315
cuccaagauuaugacaacauaa

SEQ ID NO: 2146966 - RNA, 17 nt, Staphylococcus aureus subsp. aureus N315
cucacgauuaauaaaau

SEQ ID NO: 2146967 - RNA, 16 nt, Staphylococcus aureus subsp. aureus N315
cucaccuuuaucauua

SEQ ID NO: 2146968 - RNA, 15 nt, Staphylococcus aureus subsp. aureus N315
cucaauaucuuuaau

SEQ ID NO: 2146969 - RNA, 16 nt, Staphylococcus aureus subsp. aureus N315
cucaauaucuuuaauu

SEQ ID NO: 2146970 - RNA, 18 nt, Staphylococcus aureus subsp. aureus N315
cucaacgggaacaucaua

SEQ ID NO: 2146971 - RNA, 17 nt, Staphylococcus aureus subsp. aureus N315
cucaacacgauagucau

SEQ ID NO: 2146972 - RNA, 12 nt, Staphylococcus aureus subsp. aureus N315
cucaacagcaaa

SEQ ID NO: 2146973 - RNA, 18 nt, Staphylococcus aureus subsp. aureus N315
cucaacagcaaaaaauaa

SEQ ID NO: 2146974 - RNA, 17 nt, Staphylococcus aureus subsp. aureus N315
cucaacuugccuggcaa

SEQ ID NO: 2146975 - RNA, 23 nt, Staphylococcus aureus subsp. aureus N315
cuauugauauucuaaaaaauuaa

SEQ ID NO: 2146976 - RNA, 17 nt, Staphylococcus aureus subsp. aureus N315
cuauugauauucuaaaa

SEQ ID NO: 2146977 - RNA, 19 nt, Staphylococcus aureus subsp. aureus N315
cuauugauauucuaaaaaa

SEQ ID NO: 2146978 - RNA, 15 nt, Staphylococcus aureus subsp. aureus N315
cucaaaacaauuuaa

SEQ ID NO: 2146979 - RNA, 19 nt, Staphylococcus aureus subsp. aureus N315
cuauagguuuauaaaaaau

SEQ ID NO: 2146980 - RNA, 16 nt, Staphylococcus aureus subsp. aureus N315
cuauauucaauuuaau

SEQ ID NO: 2146981 - RNA, 22 nt, Staphylococcus aureus subsp. aureus N315
cuauauuucgguauuuuaaauu

SEQ ID NO: 2146982 - RNA, 21 nt, Staphylococcus aureus subsp. aureus N315
cuaguuuaacaauacuacuua

SEQ ID NO: 2146983 - RNA, 12 nt, Staphylococcus aureus subsp. aureus N315
cuaguuguuuua

SEQ ID NO: 2146984 - RNA, 16 nt, Staphylococcus aureus subsp. aureus N315
cuaguucgauuuuuua

SEQ ID NO: 2146985 - RNA, 14 nt, Staphylococcus aureus subsp. aureus N315
cuaguucagcuucu

SEQ ID NO: 2146986 - RNA, 12 nt, Staphylococcus aureus subsp. aureus N315
cuaucaaauaau

SEQ ID NO: 2146987 - RNA, 18 nt, Staphylococcus aureus subsp. aureus N315
cuaucaauauaauuuggu

SEQ ID NO: 2146988 - RNA, 14 nt, Staphylococcus aureus subsp. aureus N315
cuaucaaugacauc

SEQ ID NO: 2146989 - RNA, 17 nt, Staphylococcus aureus subsp. aureus N315
cuaucaaugacauccau

SEQ ID NO: 2146990 - RNA, 16 nt, Staphylococcus aureus subsp. aureus N315
cuauccgauuuaaguu

SEQ ID NO: 2146991 - RNA, 22 nt, Staphylococcus aureus subsp. aureus N315
cuauuauuauguuauaaauucu

SEQ ID NO: 2146992 - RNA, 22 nt, Staphylococcus aureus subsp. aureus N315
cuauuaaacuuccuuuuuuuau

SEQ ID NO: 2146993 - RNA, 19 nt, Staphylococcus aureus subsp. aureus N315
cuauuaaacauuuuugaau

SEQ ID NO: 2146994 - RNA, 13 nt, Staphylococcus aureus subsp. aureus N315
cuauuaaaggaaa

SEQ ID NO: 2146995 - RNA, 21 nt, Staphylococcus aureus subsp. aureus N315
cuauuaaaggaaaucaaucca

SEQ ID NO: 2146996 - RNA, 20 nt, Staphylococcus aureus subsp. aureus N315
cuauuccuauuacuacauaa

SEQ ID NO: 2146997 - RNA, 17 nt, Staphylococcus aureus subsp. aureus N315
cuauguguugcaccgac

SEQ ID NO: 2146998 - RNA, 16 nt, Staphylococcus aureus subsp. aureus N315
cuauguaaaauuauug

SEQ ID NO: 2146999 - RNA, 16 nt, Staphylococcus aureus subsp. aureus N315
cuaugcauaauaccaa

SEQ ID NO: 2147000 - RNA, 14 nt, Staphylococcus aureus subsp. aureus N315
cuaucuauaaacgu

SEQ ID NO: 2147001 - RNA, 21 nt, Staphylococcus aureus subsp. aureus N315
cuaucgccuaaaaauaaaauc

SEQ ID NO: 2147002 - RNA, 21 nt, Staphylococcus aureus subsp. aureus N315
cuagcaaaaauacuuuuugau

SEQ ID NO: 2147003 - RNA, 22 nt, Staphylococcus aureus subsp. aureus N315
cuagcaaaaauacuuuuugaug

SEQ ID NO: 2147004 - RNA, 17 nt, Staphylococcus aureus subsp. aureus N315
cuagcaaaaauacuuuu

SEQ ID NO: 2147005 - RNA, 14 nt, Staphylococcus aureus subsp. aureus N315
cuaguagcuugaau

SEQ ID NO: 2147006 - RNA, 18 nt, Staphylococcus aureus subsp. aureus N315
cuagucaggggccccaac

SEQ ID NO: 2147007 - RNA, 23 nt, Staphylococcus aureus subsp. aureus N315
cuagucaggggccccaacacaga

SEQ ID NO: 2147008 - RNA, 18 nt, Staphylococcus aureus subsp. aureus N315
cuagugcgcgauaaauaa

SEQ ID NO: 2147009 - RNA, 16 nt, Staphylococcus aureus subsp. aureus N315
cuaguaauucuucauc

SEQ ID NO: 2147010 - RNA, 17 nt, Staphylococcus aureus subsp. aureus N315
cuagguuagaauuauuu

SEQ ID NO: 2147011 - RNA, 23 nt, Staphylococcus aureus subsp. aureus N315
cuaguaacucaacauuuuuucua

SEQ ID NO: 2147012 - RNA, 14 nt, Staphylococcus aureus subsp. aureus N315
cuagaaaacauaaa

SEQ ID NO: 2147013 - RNA, 15 nt, Staphylococcus aureus subsp. aureus N315
cuacuuuuucaucuu

SEQ ID NO: 2147014 - RNA, 22 nt, Staphylococcus aureus subsp. aureus N315
cuagaaaacauaaauacaaaaa

SEQ ID NO: 2147015 - RNA, 21 nt, Staphylococcus aureus subsp. aureus N315
cuacuugauucuacuucaccu

SEQ ID NO: 2147016 - RNA, 14 nt, Staphylococcus aureus subsp. aureus N315
cuacuuguucaaua

SEQ ID NO: 2147017 - RNA, 20 nt, Staphylococcus aureus subsp. aureus N315
cuacuuuauaaauaucuuuu

SEQ ID NO: 2147018 - RNA, 15 nt, Staphylococcus aureus subsp. aureus N315
cuacuuugucugcaa

SEQ ID NO: 2147019 - RNA, 21 nt, Staphylococcus aureus subsp. aureus N315
cuacuuugauauguuuccucu

SEQ ID NO: 2147020 - RNA, 23 nt, Staphylococcus aureus subsp. aureus N315
cuacugcaccgauaucauauaau

SEQ ID NO: 2147021 - RNA, 14 nt, Staphylococcus aureus subsp. aureus N315
cuacugcuugugug

SEQ ID NO: 2147022 - RNA, 18 nt, Staphylococcus aureus subsp. aureus N315
cuacugucucaucuucua

SEQ ID NO: 2147023 - RNA, 22 nt, Staphylococcus aureus subsp. aureus N315
cuaccgauuguuaauuuaaagu

SEQ ID NO: 2147024 - RNA, 18 nt, Staphylococcus aureus subsp. aureus N315
cuacccuugcaaauauau

SEQ ID NO: 2147025 - RNA, 13 nt, Staphylococcus aureus subsp. aureus N315
cugaaaaacuucu

SEQ ID NO: 2147026 - RNA, 23 nt, Staphylococcus aureus subsp. aureus N315
cucuuugaagggguuuuuucuua

SEQ ID NO: 2147027 - RNA, 21 nt, Staphylococcus aureus subsp. aureus N315
cucuuuguuggggcccacacc

SEQ ID NO: 2147028 - RNA, 23 nt, Staphylococcus aureus subsp. aureus N315
cucuuuuaccucugauaaaugaa

SEQ ID NO: 2147029 - RNA, 15 nt, Staphylococcus aureus subsp. aureus N315
cugaaacaaauuagu

SEQ ID NO: 2147030 - RNA, 17 nt, Staphylococcus aureus subsp. aureus N315
cugaaacuuuaauacua

SEQ ID NO: 2147031 - RNA, 17 nt, Staphylococcus aureus subsp. aureus N315
cugaagcgcuuggauuu

SEQ ID NO: 2147032 - RNA, 18 nt, Staphylococcus aureus subsp. aureus N315
cugaaaucaguuuuugaa

SEQ ID NO: 2147033 - RNA, 16 nt, Staphylococcus aureus subsp. aureus N315
cugaaaucuagaccuu

SEQ ID NO: 2147034 - RNA, 12 nt, Staphylococcus aureus subsp. aureus N315
cugaaauuuuuu

SEQ ID NO: 2147035 - RNA, 16 nt, Staphylococcus aureus subsp. aureus N315
cucuugauaaaauaaa

SEQ ID NO: 2147036 - RNA, 14 nt, Staphylococcus aureus subsp. aureus N315
cucuugcaauagca

SEQ ID NO: 2147037 - RNA, 22 nt, Staphylococcus aureus subsp. aureus N315
cucuuuaaacucguaaauuuua

SEQ ID NO: 2147038 - RNA, 17 nt, Staphylococcus aureus subsp. aureus N315
cucuuuacaccauugca

SEQ ID NO: 2147039 - RNA, 11 nt, Staphylococcus aureus subsp. aureus N315
cucuucaaucu

SEQ ID NO: 2147040 - RNA, 23 nt, Staphylococcus aureus subsp. aureus N315
cucuucaguacgaacaacuaaca

SEQ ID NO: 2147041 - RNA, 21 nt, Staphylococcus aureus subsp. aureus N315
cucuucaaaguagauauugaa

SEQ ID NO: 2147042 - RNA, 16 nt, Staphylococcus aureus subsp. aureus N315
cucuucaaaguagaua

SEQ ID NO: 2147043 - RNA, 22 nt, Staphylococcus aureus subsp. aureus N315
cucuuauaaagacaccuucaau

SEQ ID NO: 2147044 - RNA, 23 nt, Staphylococcus aureus subsp. aureus N315
cugagcaacaaaagauguugcuc

SEQ ID NO: 2147045 - RNA, 18 nt, Staphylococcus aureus subsp. aureus N315
cugagauugagaauucag

SEQ ID NO: 2147046 - RNA, 13 nt, Staphylococcus aureus subsp. aureus N315
cugagauugagaa

SEQ ID NO: 2147047 - RNA, 18 nt, Staphylococcus aureus subsp. aureus N315
cugacuuuccaccagccu

SEQ ID NO: 2147048 - RNA, 18 nt, Staphylococcus aureus subsp. aureus N315
cugaccuaacaauuugag

SEQ ID NO: 2147049 - RNA, 12 nt, Staphylococcus aureus subsp. aureus N315
cugacuaauaaa

SEQ ID NO: 2147050 - RNA, 22 nt, Staphylococcus aureus subsp. aureus N315
cugacucguugaccuuguucuu

SEQ ID NO: 2147051 - RNA, 20 nt, Staphylococcus aureus subsp. aureus N315
cugaaggagacauuucccau

SEQ ID NO: 2147052 - RNA, 21 nt, Staphylococcus aureus subsp. aureus N315
cugaauaaauaacuucguuuu

SEQ ID NO: 2147053 - RNA, 21 nt, Staphylococcus aureus subsp. aureus N315
cugaaucugaagguaauuuaa

SEQ ID NO: 2147054 - RNA, 18 nt, Staphylococcus aureus subsp. aureus N315
cugaaucugcuaauuuau

SEQ ID NO: 2147055 - RNA, 17 nt, Staphylococcus aureus subsp. aureus N315
cugaaugcuaauacuaa

SEQ ID NO: 2147056 - RNA, 18 nt, Staphylococcus aureus subsp. aureus N315
cugaauuaauauccaaaa

SEQ ID NO: 2147057 - RNA, 23 nt, Staphylococcus aureus subsp. aureus N315
cugaauguucgaagauuuuuuuc

SEQ ID NO: 2147058 - RNA, 17 nt, Staphylococcus aureus subsp. aureus N315
cugacauuuuuggcuua

SEQ ID NO: 2147059 - RNA, 17 nt, Staphylococcus aureus subsp. aureus N315
cucuauuuuuuauguuu

SEQ ID NO: 2147060 - RNA, 16 nt, Staphylococcus aureus subsp. aureus N315
cucucaacauuuugau

SEQ ID NO: 2147061 - RNA, 17 nt, Staphylococcus aureus subsp. aureus N315
cucuccuuuuuuaaaga

SEQ ID NO: 2147062 - RNA, 14 nt, Staphylococcus aureus subsp. aureus N315
cucugauauugauc

SEQ ID NO: 2147063 - RNA, 17 nt, Staphylococcus aureus subsp. aureus N315
cucugauauugaucuga

SEQ ID NO: 2147064 - RNA, 17 nt, Staphylococcus aureus subsp. aureus N315
cucugaaaaacuucuua

SEQ ID NO: 2147065 - RNA, 15 nt, Staphylococcus aureus subsp. aureus N315
cucugaaaaacuucu

SEQ ID NO: 2147066 - RNA, 19 nt, Staphylococcus aureus subsp. aureus N315
cucugauacuucaccaucu

SEQ ID NO: 2147067 - RNA, 22 nt, Staphylococcus aureus subsp. aureus N315
cucuggauuuuucuuauaaaaa

SEQ ID NO: 2147068 - RNA, 21 nt, Staphylococcus aureus subsp. aureus N315
cucuggauuuuucuuauaaaa

SEQ ID NO: 2147069 - RNA, 18 nt, Staphylococcus aureus subsp. aureus N315
cucuaacuuuaccaauau

SEQ ID NO: 2147070 - RNA, 18 nt, Staphylococcus aureus subsp. aureus N315
cucuaacguuaacaauau

SEQ ID NO: 2147071 - RNA, 13 nt, Staphylococcus aureus subsp. aureus N315
cucuaacauuuuc

SEQ ID NO: 2147072 - RNA, 16 nt, Staphylococcus aureus subsp. aureus N315
cucuaauccaaaauaa

SEQ ID NO: 2147073 - RNA, 13 nt, Staphylococcus aureus subsp. aureus N315
cucguuaauuuua

SEQ ID NO: 2147074 - RNA, 13 nt, Staphylococcus aureus subsp. aureus N315
cuccuuacaauaa

SEQ ID NO: 2147075 - RNA, 15 nt, Staphylococcus aureus subsp. aureus N315
cuccguugaauucaa

SEQ ID NO: 2147076 - RNA, 23 nt, Staphylococcus aureus subsp. aureus N315
cuguggcucgaaaauaaaacaaa

SEQ ID NO: 2147077 - RNA, 21 nt, Staphylococcus aureus subsp. aureus N315
cuguguaaauauaaauaugaa

SEQ ID NO: 2147078 - RNA, 14 nt, Staphylococcus aureus subsp. aureus N315
cugugugcuguucu

SEQ ID NO: 2147079 - RNA, 15 nt, Staphylococcus aureus subsp. aureus N315
cugugucagcauuca

SEQ ID NO: 2147080 - RNA, 16 nt, Staphylococcus aureus subsp. aureus N315
cuguuauugcaauaaa

SEQ ID NO: 2147081 - RNA, 15 nt, Staphylococcus aureus subsp. aureus N315
cuguuccaaauucau

SEQ ID NO: 2147082 - RNA, 14 nt, Staphylococcus aureus subsp. aureus N315
cuguuaaacucaua

SEQ ID NO: 2147083 - RNA, 15 nt, Staphylococcus aureus subsp. aureus N315
cuguguuggggccca

SEQ ID NO: 2147084 - RNA, 22 nt, Staphylococcus aureus subsp. aureus N315
cuguguuggggcccacacccca

SEQ ID NO: 2147085 - RNA, 22 nt, Staphylococcus aureus subsp. aureus N315
cuguuaaacucauacaaauuuu

SEQ ID NO: 2147086 - RNA, 16 nt, Staphylococcus aureus subsp. aureus N315
cuguuaauaaaucauu

SEQ ID NO: 2147087 - RNA, 15 nt, Staphylococcus aureus subsp. aureus N315
cugugauaaaaaucu

SEQ ID NO: 2147088 - RNA, 13 nt, Staphylococcus aureus subsp. aureus N315
cuguagauaucaa

SEQ ID NO: 2147089 - RNA, 14 nt, Staphylococcus aureus subsp. aureus N315
cuguagauaucaaa

SEQ ID NO: 2147090 - RNA, 16 nt, Staphylococcus aureus subsp. aureus N315
cuguaaucaauccucu

SEQ ID NO: 2147091 - RNA, 13 nt, Staphylococcus aureus subsp. aureus N315
cuguacuauauuc

SEQ ID NO: 2147092 - RNA, 18 nt, Staphylococcus aureus subsp. aureus N315
cuguacguuuuaaauaaa

SEQ ID NO: 2147093 - RNA, 20 nt, Staphylococcus aureus subsp. aureus N315
cuguaugcgguuauaucauu

SEQ ID NO: 2147094 - RNA, 20 nt, Staphylococcus aureus subsp. aureus N315
cuguaugccgccuaauaaua

SEQ ID NO: 2147095 - RNA, 22 nt, Staphylococcus aureus subsp. aureus N315
cuguauacgacgucgcaacagg

SEQ ID NO: 2147096 - RNA, 23 nt, Staphylococcus aureus subsp. aureus N315
cuguauaguaaccuuuauuuuca

SEQ ID NO: 2147097 - RNA, 21 nt, Staphylococcus aureus subsp. aureus N315
cuggugguaacguaaacaugg

SEQ ID NO: 2147098 - RNA, 13 nt, Staphylococcus aureus subsp. aureus N315
cugggacauuaau

SEQ ID NO: 2147099 - RNA, 16 nt, Staphylococcus aureus subsp. aureus N315
cugcuucgcuaauauc

SEQ ID NO: 2147100 - RNA, 19 nt, Staphylococcus aureus subsp. aureus N315
cugcuucaacuacuucauc

SEQ ID NO: 2147101 - RNA, 20 nt, Staphylococcus aureus subsp. aureus N315
cuggaucgcccauacuaaau

SEQ ID NO: 2147102 - RNA, 20 nt, Staphylococcus aureus subsp. aureus N315
cuggauuuuucuuauaaaaa

SEQ ID NO: 2147103 - RNA, 22 nt, Staphylococcus aureus subsp. aureus N315
cugaugcuagcuuucuuuuuca

SEQ ID NO: 2147104 - RNA, 23 nt, Staphylococcus aureus subsp. aureus N315
cugaugcuagcuuucuuuuucau

SEQ ID NO: 2147105 - RNA, 20 nt, Staphylococcus aureus subsp. aureus N315
cugaugcuucgaauuuaaca

SEQ ID NO: 2147106 - RNA, 13 nt, Staphylococcus aureus subsp. aureus N315
cugauucauuaaa

SEQ ID NO: 2147107 - RNA, 19 nt, Staphylococcus aureus subsp. aureus N315
cugauucuucacuaaaaau

SEQ ID NO: 2147108 - RNA, 11 nt, Staphylococcus aureus subsp. aureus N315
cugauuuuuua

SEQ ID NO: 2147109 - RNA, 13 nt, Staphylococcus aureus subsp. aureus N315
cugcagcaauuac

SEQ ID NO: 2147110 - RNA, 16 nt, Staphylococcus aureus subsp. aureus N315
cugcaaaugccucuuu

SEQ ID NO: 2147111 - RNA, 13 nt, Staphylococcus aureus subsp. aureus N315
cugcaccaagaaa

SEQ ID NO: 2147112 - RNA, 16 nt, Staphylococcus aureus subsp. aureus N315
cugccaaaaugguuaa

SEQ ID NO: 2147113 - RNA, 15 nt, Staphylococcus aureus subsp. aureus N315
cugccaaaccuuuau

SEQ ID NO: 2147114 - RNA, 13 nt, Staphylococcus aureus subsp. aureus N315
cugccaaaaagua

SEQ ID NO: 2147115 - RNA, 23 nt, Staphylococcus aureus subsp. aureus N315
cugccaauaaaaugcaauuuuuc

SEQ ID NO: 2147116 - RNA, 21 nt, Staphylococcus aureus subsp. aureus N315
cugccaaauauaauuucaauu

SEQ ID NO: 2147117 - RNA, 18 nt, Staphylococcus aureus subsp. aureus N315
cugcauuacgcugucuca

SEQ ID NO: 2147118 - RNA, 13 nt, Staphylococcus aureus subsp. aureus N315
cugcauauaaagu

SEQ ID NO: 2147119 - RNA, 19 nt, Staphylococcus aureus subsp. aureus N315
cugcauagcgcucuggauu

SEQ ID NO: 2147120 - RNA, 21 nt, Staphylococcus aureus subsp. aureus N315
cugcaucaauaugaccuuuau

SEQ ID NO: 2147121 - RNA, 20 nt, Staphylococcus aureus subsp. aureus N315
cugccauuaaacgaaugauu

SEQ ID NO: 2147122 - RNA, 15 nt, Staphylococcus aureus subsp. aureus N315
cuucaucuuuaaaga

SEQ ID NO: 2147123 - RNA, 18 nt, Staphylococcus aureus subsp. aureus N315
cuuccaaucaacuucaua

SEQ ID NO: 2147124 - RNA, 17 nt, Staphylococcus aureus subsp. aureus N315
cuuccaauaauaaauca

SEQ ID NO: 2147125 - RNA, 21 nt, Staphylococcus aureus subsp. aureus N315
cuuccaaucaacuucauauaa

SEQ ID NO: 2147126 - RNA, 14 nt, Staphylococcus aureus subsp. aureus N315
cuucccaucuuuua

SEQ ID NO: 2147127 - RNA, 22 nt, Staphylococcus aureus subsp. aureus N315
cuuccuuacagacaaacauuac

SEQ ID NO: 2147128 - RNA, 12 nt, Staphylococcus aureus subsp. aureus N315
cuucguuuuaau

SEQ ID NO: 2147129 - RNA, 21 nt, Staphylococcus aureus subsp. aureus N315
cuucuacccauaauuuaaaug

SEQ ID NO: 2147130 - RNA, 17 nt, Staphylococcus aureus subsp. aureus N315
cuucuaacucaccugca

SEQ ID NO: 2147131 - RNA, 19 nt, Staphylococcus aureus subsp. aureus N315
cuucuaaaacuaaagguau

SEQ ID NO: 2147132 - RNA, 14 nt, Staphylococcus aureus subsp. aureus N315
cuucuaguaauucu

SEQ ID NO: 2147133 - RNA, 13 nt, Staphylococcus aureus subsp. aureus N315
cuucuauauuaau

SEQ ID NO: 2147134 - RNA, 19 nt, Staphylococcus aureus subsp. aureus N315
cuucuaucuucacacuuuu

SEQ ID NO: 2147135 - RNA, 14 nt, Staphylococcus aureus subsp. aureus N315
cuucuauuaagaaa

SEQ ID NO: 2147136 - RNA, 16 nt, Staphylococcus aureus subsp. aureus N315
cuucuauuaauaauuu

SEQ ID NO: 2147137 - RNA, 14 nt, Staphylococcus aureus subsp. aureus N315
cuucuauuauauug

SEQ ID NO: 2147138 - RNA, 17 nt, Staphylococcus aureus subsp. aureus N315
cuucuauuuuauaauaa

SEQ ID NO: 2147139 - RNA, 18 nt, Staphylococcus aureus subsp. aureus N315
cuucgcuaauaucaucuu

SEQ ID NO: 2147140 - RNA, 20 nt, Staphylococcus aureus subsp. aureus N315
cuucgauaguuuauuaauau

SEQ ID NO: 2147141 - RNA, 23 nt, Staphylococcus aureus subsp. aureus N315
cuucgaagucauaugcauacacu

SEQ ID NO: 2147142 - RNA, 23 nt, Staphylococcus aureus subsp. aureus N315
cuuccuuuuuuuaugucuuuuuu

SEQ ID NO: 2147143 - RNA, 22 nt, Staphylococcus aureus subsp. aureus N315
cuucaacauagacacuuaacuu

SEQ ID NO: 2147144 - RNA, 17 nt, Staphylococcus aureus subsp. aureus N315
cuucaaccauuuguucu

SEQ ID NO: 2147145 - RNA, 22 nt, Staphylococcus aureus subsp. aureus N315
cuucaacuucgauaugauuaaa

SEQ ID NO: 2147146 - RNA, 19 nt, Staphylococcus aureus subsp. aureus N315
cuucaagagaaccaccuac

SEQ ID NO: 2147147 - RNA, 19 nt, Staphylococcus aureus subsp. aureus N315
cuucaagugccauuuuuaa

SEQ ID NO: 2147148 - RNA, 12 nt, Staphylococcus aureus subsp. aureus N315
cuucaauuauuu

SEQ ID NO: 2147149 - RNA, 22 nt, Staphylococcus aureus subsp. aureus N315
cuucaauuuaauguauugagaa

SEQ ID NO: 2147150 - RNA, 18 nt, Staphylococcus aureus subsp. aureus N315
cuucaauucuuacaccug

SEQ ID NO: 2147151 - RNA, 19 nt, Staphylococcus aureus subsp. aureus N315
cuucaaucgucacaucacg

SEQ ID NO: 2147152 - RNA, 13 nt, Staphylococcus aureus subsp. aureus N315
cuucaauauuuaa

SEQ ID NO: 2147153 - RNA, 14 nt, Staphylococcus aureus subsp. aureus N315
cuucaccaucuuua

SEQ ID NO: 2147154 - RNA, 19 nt, Staphylococcus aureus subsp. aureus N315
cuucaccaucuguaacuaa

SEQ ID NO: 2147155 - RNA, 18 nt, Staphylococcus aureus subsp. aureus N315
cuucacugaaaauuugua

SEQ ID NO: 2147156 - RNA, 14 nt, Staphylococcus aureus subsp. aureus N315
cuuauuucuuuuca

SEQ ID NO: 2147157 - RNA, 13 nt, Staphylococcus aureus subsp. aureus N315
cuuauuuauuuua

SEQ ID NO: 2147158 - RNA, 19 nt, Staphylococcus aureus subsp. aureus N315
cuuauuuuguuuuaaaaaa

SEQ ID NO: 2147159 - RNA, 12 nt, Staphylococcus aureus subsp. aureus N315
cuuauuuuucau

SEQ ID NO: 2147160 - RNA, 18 nt, Staphylococcus aureus subsp. aureus N315
cuucaaaguuuucauuuu

SEQ ID NO: 2147161 - RNA, 19 nt, Staphylococcus aureus subsp. aureus N315
cuucaaaguagauauugaa

SEQ ID NO: 2147162 - RNA, 14 nt, Staphylococcus aureus subsp. aureus N315
cuucaaaguuuuca

SEQ ID NO: 2147163 - RNA, 13 nt, Staphylococcus aureus subsp. aureus N315
cuucaaaaaauaa

SEQ ID NO: 2147164 - RNA, 17 nt, Staphylococcus aureus subsp. aureus N315
cuucaaaaaauaauagc

SEQ ID NO: 2147165 - RNA, 17 nt, Staphylococcus aureus subsp. aureus N315
cuucaaaaguuuuugga

SEQ ID NO: 2147166 - RNA, 18 nt, Staphylococcus aureus subsp. aureus N315
cuuaugggggauuuuuuu

SEQ ID NO: 2147167 - RNA, 21 nt, Staphylococcus aureus subsp. aureus N315
cuuauugauauaagauucaua

SEQ ID NO: 2147168 - RNA, 17 nt, Staphylococcus aureus subsp. aureus N315
cuuauugaaaagauaaa

SEQ ID NO: 2147169 - RNA, 18 nt, Staphylococcus aureus subsp. aureus N315
cuuauuccgcaacuugua

SEQ ID NO: 2147170 - RNA, 17 nt, Staphylococcus aureus subsp. aureus N315
cuuauucgcaccacugg

SEQ ID NO: 2147171 - RNA, 15 nt, Staphylococcus aureus subsp. aureus N315
cuuaugacugcuuuu

SEQ ID NO: 2147172 - RNA, 15 nt, Staphylococcus aureus subsp. aureus N315
cuuaugcauagcucu

SEQ ID NO: 2147173 - RNA, 13 nt, Staphylococcus aureus subsp. aureus N315
cuuaugacugcuu

SEQ ID NO: 2147174 - RNA, 18 nt, Staphylococcus aureus subsp. aureus N315
cuuaugauacugauauuu

SEQ ID NO: 2147175 - RNA, 16 nt, Staphylococcus aureus subsp. aureus N315
cuuaguuugacaucua

SEQ ID NO: 2147176 - RNA, 15 nt, Staphylococcus aureus subsp. aureus N315
cuuauaacauucuuc

SEQ ID NO: 2147177 - RNA, 17 nt, Staphylococcus aureus subsp. aureus N315
cuuauaagauauagaag

SEQ ID NO: 2147178 - RNA, 21 nt, Staphylococcus aureus subsp. aureus N315
cuuauaacauucuucaaaaaa

SEQ ID NO: 2147179 - RNA, 17 nt, Staphylococcus aureus subsp. aureus N315
cuuauaacauucuucaa

SEQ ID NO: 2147180 - RNA, 16 nt, Staphylococcus aureus subsp. aureus N315
cuuaacauaaaaugag

SEQ ID NO: 2147181 - RNA, 22 nt, Staphylococcus aureus subsp. aureus N315
cuuaaccauuuaaaaauugaag

SEQ ID NO: 2147182 - RNA, 18 nt, Staphylococcus aureus subsp. aureus N315
cuuaaccauuuaaaaauu

SEQ ID NO: 2147183 - RNA, 15 nt, Staphylococcus aureus subsp. aureus N315
cuuaaauuacuuaau

SEQ ID NO: 2147184 - RNA, 20 nt, Staphylococcus aureus subsp. aureus N315
cuuaacaacaugauuucuuc

SEQ ID NO: 2147185 - RNA, 23 nt, Staphylococcus aureus subsp. aureus N315
cuuaaauggagauucucgguuuu

SEQ ID NO: 2147186 - RNA, 15 nt, Staphylococcus aureus subsp. aureus N315
cuuaaauggaugaua

SEQ ID NO: 2147187 - RNA, 11 nt, Staphylococcus aureus subsp. aureus N315
cuuaaauauuc

SEQ ID NO: 2147188 - RNA, 20 nt, Staphylococcus aureus subsp. aureus N315
cuuaauacgauaauaacuag

SEQ ID NO: 2147189 - RNA, 18 nt, Staphylococcus aureus subsp. aureus N315
cuuaauacgauaauaacu

SEQ ID NO: 2147190 - RNA, 16 nt, Staphylococcus aureus subsp. aureus N315
cuuaauaagcugaaau

SEQ ID NO: 2147191 - RNA, 17 nt, Staphylococcus aureus subsp. aureus N315
cuuaauaagcugaaaua

SEQ ID NO: 2147192 - RNA, 22 nt, Staphylococcus aureus subsp. aureus N315
cuuaauaauuaauaagcauuaa

SEQ ID NO: 2147193 - RNA, 16 nt, Staphylococcus aureus subsp. aureus N315
cuuaacguugcagaga

SEQ ID NO: 2147194 - RNA, 16 nt, Staphylococcus aureus subsp. aureus N315
cuuaacucaaagaaac

SEQ ID NO: 2147195 - RNA, 23 nt, Staphylococcus aureus subsp. aureus N315
cuuaagcucauuucaauauuaaa

SEQ ID NO: 2147196 - RNA, 13 nt, Staphylococcus aureus subsp. aureus N315
cuuaacuugaaau

SEQ ID NO: 2147197 - RNA, 21 nt, Staphylococcus aureus subsp. aureus N315
cuuaaugguaaacaaaaaacu

SEQ ID NO: 2147198 - RNA, 18 nt, Staphylococcus aureus subsp. aureus N315
cuuacauugauaaaauaa

SEQ ID NO: 2147199 - RNA, 14 nt, Staphylococcus aureus subsp. aureus N315
cuuaaugcuucaaa

SEQ ID NO: 2147200 - RNA, 21 nt, Staphylococcus aureus subsp. aureus N315
cuuaaugacuucuuuauauuu

SEQ ID NO: 2147201 - RNA, 15 nt, Staphylococcus aureus subsp. aureus N315
cuuacuuuuaaauua

SEQ ID NO: 2147202 - RNA, 16 nt, Staphylococcus aureus subsp. aureus N315
cuuacauuuuaauaaa

SEQ ID NO: 2147203 - RNA, 19 nt, Staphylococcus aureus subsp. aureus N315
cuuacauuuuaauaaaauc

SEQ ID NO: 2147204 - RNA, 18 nt, Staphylococcus aureus subsp. aureus N315
cuuaguaaggaauauuuc

SEQ ID NO: 2147205 - RNA, 18 nt, Staphylococcus aureus subsp. aureus N315
cuuaggugucaucgcuuu

SEQ ID NO: 2147206 - RNA, 13 nt, Staphylococcus aureus subsp. aureus N315
cuuaguacaaaau

SEQ ID NO: 2147207 - RNA, 18 nt, Staphylococcus aureus subsp. aureus N315
cuuagucaauguauauuu

SEQ ID NO: 2147208 - RNA, 22 nt, Staphylococcus aureus subsp. aureus N315
cuuaguagauuuauuaaauaua

SEQ ID NO: 2147209 - RNA, 16 nt, Staphylococcus aureus subsp. aureus N315
cuuagaauuuacaagu

SEQ ID NO: 2147210 - RNA, 21 nt, Staphylococcus aureus subsp. aureus N315
cuuucuaagauguguugaaac

SEQ ID NO: 2147211 - RNA, 20 nt, Staphylococcus aureus subsp. aureus N315
cuuucguuucuguuucauca

SEQ ID NO: 2147212 - RNA, 13 nt, Staphylococcus aureus subsp. aureus N315
cuuucauuuuagc

SEQ ID NO: 2147213 - RNA, 13 nt, Staphylococcus aureus subsp. aureus N315
cuuuccaccauau

SEQ ID NO: 2147214 - RNA, 22 nt, Staphylococcus aureus subsp. aureus N315
cuuugacguuuugguuguucuu

SEQ ID NO: 2147215 - RNA, 18 nt, Staphylococcus aureus subsp. aureus N315
cuuugaaagaaggaauaa

SEQ ID NO: 2147216 - RNA, 19 nt, Staphylococcus aureus subsp. aureus N315
cuuugaacauauuauaaaa

SEQ ID NO: 2147217 - RNA, 18 nt, Staphylococcus aureus subsp. aureus N315
cuuugaagggguuuuuuc

SEQ ID NO: 2147218 - RNA, 20 nt, Staphylococcus aureus subsp. aureus N315
cuuugaauggcucguuuuuu

SEQ ID NO: 2147219 - RNA, 14 nt, Staphylococcus aureus subsp. aureus N315
cuuuggcaccagua

SEQ ID NO: 2147220 - RNA, 14 nt, Staphylococcus aureus subsp. aureus N315
cuuuggcuauuuua

SEQ ID NO: 2147221 - RNA, 15 nt, Staphylococcus aureus subsp. aureus N315
cuuuggauuucuuuu

SEQ ID NO: 2147222 - RNA, 20 nt, Staphylococcus aureus subsp. aureus N315
cuuuggauuucuuuuuaaaa

SEQ ID NO: 2147223 - RNA, 23 nt, Staphylococcus aureus subsp. aureus N315
cuuuggaaauuuauuauaaaaua

SEQ ID NO: 2147224 - RNA, 22 nt, Staphylococcus aureus subsp. aureus N315
cuuuggaaauuuauuauaaaau

SEQ ID NO: 2147225 - RNA, 21 nt, Staphylococcus aureus subsp. aureus N315
cuuugcuuaaaccuuaauaau

SEQ ID NO: 2147226 - RNA, 23 nt, Staphylococcus aureus subsp. aureus N315
cuuugcccgucuggcacauuacu

SEQ ID NO: 2147227 - RNA, 20 nt, Staphylococcus aureus subsp. aureus N315
cuuugccguauuucaaaugu

SEQ ID NO: 2147228 - RNA, 19 nt, Staphylococcus aureus subsp. aureus N315
cuuugauaacaauuuuaaa

SEQ ID NO: 2147229 - RNA, 17 nt, Staphylococcus aureus subsp. aureus N315
cuuugauauguuuccuc

SEQ ID NO: 2147230 - RNA, 20 nt, Staphylococcus aureus subsp. aureus N315
cuuugauauguuuccucuuu

SEQ ID NO: 2147231 - RNA, 20 nt, Staphylococcus aureus subsp. aureus N315
cuuugcauacauaucuuuug

SEQ ID NO: 2147232 - RNA, 15 nt, Staphylococcus aureus subsp. aureus N315
cuuuaacucuugaaa

SEQ ID NO: 2147233 - RNA, 18 nt, Staphylococcus aureus subsp. aureus N315
cuuuaauuaaaguuaaag

SEQ ID NO: 2147234 - RNA, 20 nt, Staphylococcus aureus subsp. aureus N315
cuuuaaguaauucauuugcu

SEQ ID NO: 2147235 - RNA, 14 nt, Staphylococcus aureus subsp. aureus N315
cuuuaaguuauuuu

SEQ ID NO: 2147236 - RNA, 21 nt, Staphylococcus aureus subsp. aureus N315
cuuuaauuguuaaaucaccaa

SEQ ID NO: 2147237 - RNA, 16 nt, Staphylococcus aureus subsp. aureus N315
cuuuaauuguuaaauc

SEQ ID NO: 2147238 - RNA, 13 nt, Staphylococcus aureus subsp. aureus N315
cuuuaauuuucuu

SEQ ID NO: 2147239 - RNA, 14 nt, Staphylococcus aureus subsp. aureus N315
cuuuaauugcucuu

SEQ ID NO: 2147240 - RNA, 14 nt, Staphylococcus aureus subsp. aureus N315
cuuuaauugucuca

SEQ ID NO: 2147241 - RNA, 16 nt, Staphylococcus aureus subsp. aureus N315
cuuuaagcccuucccc

SEQ ID NO: 2147242 - RNA, 14 nt, Staphylococcus aureus subsp. aureus N315
cuuuaagcuuaaau

SEQ ID NO: 2147243 - RNA, 18 nt, Staphylococcus aureus subsp. aureus N315
cuuuaaguaauucauuug

SEQ ID NO: 2147244 - RNA, 17 nt, Staphylococcus aureus subsp. aureus N315
cuuuaacuuuaauuaaa

SEQ ID NO: 2147245 - RNA, 17 nt, Staphylococcus aureus subsp. aureus N315
cuuuaacuucuuuuguu

SEQ ID NO: 2147246 - RNA, 19 nt, Staphylococcus aureus subsp. aureus N315
cuuuaacuucuuuuguuuu

SEQ ID NO: 2147247 - RNA, 20 nt, Staphylococcus aureus subsp. aureus N315
cuuuacauucuuuguauuua

SEQ ID NO: 2147248 - RNA, 19 nt, Staphylococcus aureus subsp. aureus N315
cuuuacuccaaaguaacau

SEQ ID NO: 2147249 - RNA, 15 nt, Staphylococcus aureus subsp. aureus N315
cuuuagcucuuuuuu

SEQ ID NO: 2147250 - RNA, 22 nt, Staphylococcus aureus subsp. aureus N315
cuuuagcauauucgcuuaaaaa

SEQ ID NO: 2147251 - RNA, 14 nt, Staphylococcus aureus subsp. aureus N315
cuuuagcaauugaa

SEQ ID NO: 2147252 - RNA, 21 nt, Staphylococcus aureus subsp. aureus N315
cuuuacuugcuuuuucaaaua

SEQ ID NO: 2147253 - RNA, 21 nt, Staphylococcus aureus subsp. aureus N315
cuuuagaaagugauucccaaa

SEQ ID NO: 2147254 - RNA, 13 nt, Staphylococcus aureus subsp. aureus N315
cuuuaucuauaug

SEQ ID NO: 2147255 - RNA, 14 nt, Staphylococcus aureus subsp. aureus N315
cuuuaugauaauaa

SEQ ID NO: 2147256 - RNA, 21 nt, Staphylococcus aureus subsp. aureus N315
cuuuaguaguguauucauuuu

SEQ ID NO: 2147257 - RNA, 17 nt, Staphylococcus aureus subsp. aureus N315
cuuuaggguucauugcu

SEQ ID NO: 2147258 - RNA, 15 nt, Staphylococcus aureus subsp. aureus N315
cuuuagguaaaagag

SEQ ID NO: 2147259 - RNA, 20 nt, Staphylococcus aureus subsp. aureus N315
cuuuaucgaauucuucuuua

SEQ ID NO: 2147260 - RNA, 12 nt, Staphylococcus aureus subsp. aureus N315
cuuuauuuuuug

SEQ ID NO: 2147261 - RNA, 16 nt, Staphylococcus aureus subsp. aureus N315
cuuuauuuuaaacaug

SEQ ID NO: 2147262 - RNA, 20 nt, Staphylococcus aureus subsp. aureus N315
cuuuauuugauucuucacca

SEQ ID NO: 2147263 - RNA, 23 nt, Staphylococcus aureus subsp. aureus N315
cuuucaaauauaucuaauacuuu

SEQ ID NO: 2147264 - RNA, 22 nt, Staphylococcus aureus subsp. aureus N315
cuuucagcaccagaacaauuca

SEQ ID NO: 2147265 - RNA, 15 nt, Staphylococcus aureus subsp. aureus N315
cuuucaauuaauuua

SEQ ID NO: 2147266 - RNA, 14 nt, Staphylococcus aureus subsp. aureus N315
cuugccuuuuuagg

SEQ ID NO: 2147267 - RNA, 20 nt, Staphylococcus aureus subsp. aureus N315
cuugccuucaaauucucaau

SEQ ID NO: 2147268 - RNA, 20 nt, Staphylococcus aureus subsp. aureus N315
cuugcuggauuacaccuuug

SEQ ID NO: 2147269 - RNA, 23 nt, Staphylococcus aureus subsp. aureus N315
cuuggcaaugaaauuaccaacac

SEQ ID NO: 2147270 - RNA, 17 nt, Staphylococcus aureus subsp. aureus N315
cuuggauucaaaugaca

SEQ ID NO: 2147271 - RNA, 18 nt, Staphylococcus aureus subsp. aureus N315
cuuguauuuccuuaauau

SEQ ID NO: 2147272 - RNA, 17 nt, Staphylococcus aureus subsp. aureus N315
cuugguauuuuuuaaau

SEQ ID NO: 2147273 - RNA, 23 nt, Staphylococcus aureus subsp. aureus N315
cuuggcggggccccaacaaaaag

SEQ ID NO: 2147274 - RNA, 20 nt, Staphylococcus aureus subsp. aureus N315
cuuggcguauuuuuuguucu

SEQ ID NO: 2147275 - RNA, 18 nt, Staphylococcus aureus subsp. aureus N315
cuugggacagaaaacaaa

SEQ ID NO: 2147276 - RNA, 13 nt, Staphylococcus aureus subsp. aureus N315
cuugguauuuuuu

SEQ ID NO: 2147277 - RNA, 23 nt, Staphylococcus aureus subsp. aureus N315
cuugguacaccuacaaauauuuc

SEQ ID NO: 2147278 - RNA, 17 nt, Staphylococcus aureus subsp. aureus N315
cuugggcugacauuuuu

SEQ ID NO: 2147279 - RNA, 21 nt, Staphylococcus aureus subsp. aureus N315
cuugcaaauauaucaucucua

SEQ ID NO: 2147280 - RNA, 22 nt, Staphylococcus aureus subsp. aureus N315
cuugcaaauauaucaucucuau

SEQ ID NO: 2147281 - RNA, 18 nt, Staphylococcus aureus subsp. aureus N315
cuugcaaauauaucaucu

SEQ ID NO: 2147282 - RNA, 16 nt, Staphylococcus aureus subsp. aureus N315
cuugaugaaacugauu

SEQ ID NO: 2147283 - RNA, 15 nt, Staphylococcus aureus subsp. aureus N315
cuugauuuaauuuuu

SEQ ID NO: 2147284 - RNA, 13 nt, Staphylococcus aureus subsp. aureus N315
cuucucaucauuu

SEQ ID NO: 2147285 - RNA, 22 nt, Staphylococcus aureus subsp. aureus N315
cuucucaauuuaguauaaauaa

SEQ ID NO: 2147286 - RNA, 18 nt, Staphylococcus aureus subsp. aureus N315
cuucuauuuuauaauaaa

SEQ ID NO: 2147287 - RNA, 14 nt, Staphylococcus aureus subsp. aureus N315
cuucuaucuuuauu

SEQ ID NO: 2147288 - RNA, 22 nt, Staphylococcus aureus subsp. aureus N315
cuucuuuguuuuuaauuuuuaa

SEQ ID NO: 2147289 - RNA, 19 nt, Staphylococcus aureus subsp. aureus N315
cuucuuuuguuuuaccauc

SEQ ID NO: 2147290 - RNA, 19 nt, Staphylococcus aureus subsp. aureus N315
cuucuuuugcaaaacgcau

SEQ ID NO: 2147291 - RNA, 20 nt, Staphylococcus aureus subsp. aureus N315
cuucuuuuuguccccagccc

SEQ ID NO: 2147292 - RNA, 18 nt, Staphylococcus aureus subsp. aureus N315
cuugaccacuuuuguuaa

SEQ ID NO: 2147293 - RNA, 15 nt, Staphylococcus aureus subsp. aureus N315
cuugaauuuaauaag

SEQ ID NO: 2147294 - RNA, 16 nt, Staphylococcus aureus subsp. aureus N315
cuugaauuuaauaagu

SEQ ID NO: 2147295 - RNA, 16 nt, Staphylococcus aureus subsp. aureus N315
cuugaauaauauauuu

SEQ ID NO: 2147296 - RNA, 22 nt, Staphylococcus aureus subsp. aureus N315
cuugaaguuguuucuccaguuu

SEQ ID NO: 2147297 - RNA, 15 nt, Staphylococcus aureus subsp. aureus N315
cgcgauaaauaauaa

SEQ ID NO: 2147298 - RNA, 20 nt, Staphylococcus aureus subsp. aureus N315
cgcgacguuuaaaugcccac

SEQ ID NO: 2147299 - RNA, 14 nt, Staphylococcus aureus subsp. aureus N315
cgccacuaugugaa

SEQ ID NO: 2147300 - RNA, 19 nt, Staphylococcus aureus subsp. aureus N315
cgauauaacauuaaaauga

SEQ ID NO: 2147301 - RNA, 14 nt, Staphylococcus aureus subsp. aureus N315
cgauaguuuauuaa

SEQ ID NO: 2147302 - RNA, 23 nt, Staphylococcus aureus subsp. aureus N315
cgauauagugcuuguuuauuaca

SEQ ID NO: 2147303 - RNA, 17 nt, Staphylococcus aureus subsp. aureus N315
cgauaaaaguuguauuc

SEQ ID NO: 2147304 - RNA, 17 nt, Staphylococcus aureus subsp. aureus N315
cgauaaauguauuaaac

SEQ ID NO: 2147305 - RNA, 11 nt, Staphylococcus aureus subsp. aureus N315
cgauaaauaau

SEQ ID NO: 2147306 - RNA, 14 nt, Staphylococcus aureus subsp. aureus N315
cgauaaacuacaca

SEQ ID NO: 2147307 - RNA, 13 nt, Staphylococcus aureus subsp. aureus N315
ccuucaucacuau

SEQ ID NO: 2147308 - RNA, 21 nt, Staphylococcus aureus subsp. aureus N315
ccuucauuagccaaaucuuua

SEQ ID NO: 2147309 - RNA, 17 nt, Staphylococcus aureus subsp. aureus N315
ccuucauuagccaaauc

SEQ ID NO: 2147310 - RNA, 15 nt, Staphylococcus aureus subsp. aureus N315
ccuucauuagccaaa

SEQ ID NO: 2147311 - RNA, 15 nt, Staphylococcus aureus subsp. aureus N315
cgaucaugccuucau

SEQ ID NO: 2147312 - RNA, 22 nt, Staphylococcus aureus subsp. aureus N315
cgaucuucaugaacagcaucuu

SEQ ID NO: 2147313 - RNA, 19 nt, Staphylococcus aureus subsp. aureus N315
cgaucuuuuuuauuuaauu

SEQ ID NO: 2147314 - RNA, 14 nt, Staphylococcus aureus subsp. aureus N315
cgaugucagacgaa

SEQ ID NO: 2147315 - RNA, 14 nt, Staphylococcus aureus subsp. aureus N315
cgaugacuuuuuaa

SEQ ID NO: 2147316 - RNA, 17 nt, Staphylococcus aureus subsp. aureus N315
cgauuaauaaaauucua

SEQ ID NO: 2147317 - RNA, 19 nt, Staphylococcus aureus subsp. aureus N315
cgauuaagaaugcaccaac

SEQ ID NO: 2147318 - RNA, 13 nt, Staphylococcus aureus subsp. aureus N315
cggaaauacaaug

SEQ ID NO: 2147319 - RNA, 16 nt, Staphylococcus aureus subsp. aureus N315
cggcacauucauaccg

SEQ ID NO: 2147320 - RNA, 19 nt, Staphylococcus aureus subsp. aureus N315
cgcgugccaacaucuucaa

SEQ ID NO: 2147321 - RNA, 11 nt, Staphylococcus aureus subsp. aureus N315
cgcuuaauucu

SEQ ID NO: 2147322 - RNA, 23 nt, Staphylococcus aureus subsp. aureus N315
cgcuuaacccuaaagcuaaugca

SEQ ID NO: 2147323 - RNA, 13 nt, Staphylococcus aureus subsp. aureus N315
cgcuguuuuaaau

SEQ ID NO: 2147324 - RNA, 18 nt, Staphylococcus aureus subsp. aureus N315
cgcugguaauauuuuugu

SEQ ID NO: 2147325 - RNA, 22 nt, Staphylococcus aureus subsp. aureus N315
cgcuguaauaccuuuacuuuca

SEQ ID NO: 2147326 - RNA, 11 nt, Staphylococcus aureus subsp. aureus N315
cgcuuuauuac

SEQ ID NO: 2147327 - RNA, 17 nt, Staphylococcus aureus subsp. aureus N315
cggaaaaagaugaaaaa

SEQ ID NO: 2147328 - RNA, 17 nt, Staphylococcus aureus subsp. aureus N315
cgcuuuuuccauuuuuu

SEQ ID NO: 2147329 - RNA, 23 nt, Staphylococcus aureus subsp. aureus N315
cgcuuuuuuuauuuuucuuuuug

SEQ ID NO: 2147330 - RNA, 22 nt, Staphylococcus aureus subsp. aureus N315
cgcuuuugaaguugguccaaau

SEQ ID NO: 2147331 - RNA, 15 nt, Staphylococcus aureus subsp. aureus N315
cgcuuuuaauuuuuu

SEQ ID NO: 2147332 - RNA, 12 nt, Staphylococcus aureus subsp. aureus N315
cgcuuuuuaaaa

SEQ ID NO: 2147333 - RNA, 14 nt, Staphylococcus aureus subsp. aureus N315
cgcugcuacaccac

SEQ ID NO: 2147334 - RNA, 13 nt, Staphylococcus aureus subsp. aureus N315
cgcucucuuuuua

SEQ ID NO: 2147335 - RNA, 13 nt, Staphylococcus aureus subsp. aureus N315
cggcuuuguaaaa

SEQ ID NO: 2147336 - RNA, 16 nt, Staphylococcus aureus subsp. aureus N315
cgggcccccaacacaa

SEQ ID NO: 2147337 - RNA, 23 nt, Staphylococcus aureus subsp. aureus N315
cgucacaugccaucuuuguaacc

SEQ ID NO: 2147338 - RNA, 17 nt, Staphylococcus aureus subsp. aureus N315
cgucacauauaaauauu

SEQ ID NO: 2147339 - RNA, 14 nt, Staphylococcus aureus subsp. aureus N315
cgucacuuuauuaa

SEQ ID NO: 2147340 - RNA, 14 nt, Staphylococcus aureus subsp. aureus N315
cguauugaaugaau

SEQ ID NO: 2147341 - RNA, 17 nt, Staphylococcus aureus subsp. aureus N315
cguauuucaaauguaau

SEQ ID NO: 2147342 - RNA, 15 nt, Staphylococcus aureus subsp. aureus N315
cguauuuaccuucuu

SEQ ID NO: 2147343 - RNA, 14 nt, Staphylococcus aureus subsp. aureus N315
cguaucuguuuaug

SEQ ID NO: 2147344 - RNA, 19 nt, Staphylococcus aureus subsp. aureus N315
cguaugcccucauaaauca

SEQ ID NO: 2147345 - RNA, 18 nt, Staphylococcus aureus subsp. aureus N315
cguauuagccaauaaaau

SEQ ID NO: 2147346 - RNA, 12 nt, Staphylococcus aureus subsp. aureus N315
cguauguuucuu

SEQ ID NO: 2147347 - RNA, 16 nt, Staphylococcus aureus subsp. aureus N315
cguaucauuuaaaaua

SEQ ID NO: 2147348 - RNA, 14 nt, Staphylococcus aureus subsp. aureus N315
cguaucaagaaaaa

SEQ ID NO: 2147349 - RNA, 20 nt, Staphylococcus aureus subsp. aureus N315
cguauauauauauuaaaaca

SEQ ID NO: 2147350 - RNA, 14 nt, Staphylococcus aureus subsp. aureus N315
cguaguuguccauu

SEQ ID NO: 2147351 - RNA, 16 nt, Staphylococcus aureus subsp. aureus N315
cguagcuuuucauuua

SEQ ID NO: 2147352 - RNA, 14 nt, Staphylococcus aureus subsp. aureus N315
cguaacuauaugaa

SEQ ID NO: 2147353 - RNA, 17 nt, Staphylococcus aureus subsp. aureus N315
cggugaccuuauauuuu

SEQ ID NO: 2147354 - RNA, 15 nt, Staphylococcus aureus subsp. aureus N315
cgguuaaauuauuua

SEQ ID NO: 2147355 - RNA, 12 nt, Staphylococcus aureus subsp. aureus N315
cguaaaaucaug

SEQ ID NO: 2147356 - RNA, 20 nt, Staphylococcus aureus subsp. aureus N315
cguaaaaucagucauucaca

SEQ ID NO: 2147357 - RNA, 18 nt, Staphylococcus aureus subsp. aureus N315
cguaaacauaaugacauc

SEQ ID NO: 2147358 - RNA, 23 nt, Staphylococcus aureus subsp. aureus N315
cccuagcaaaaauacuuuuugau

SEQ ID NO: 2147359 - RNA, 19 nt, Staphylococcus aureus subsp. aureus N315
ccauuuaacucaccuuuau

SEQ ID NO: 2147360 - RNA, 17 nt, Staphylococcus aureus subsp. aureus N315
ccauuguugauaaaugg

SEQ ID NO: 2147361 - RNA, 21 nt, Staphylococcus aureus subsp. aureus N315
ccauuguuauccaaaacauuu

SEQ ID NO: 2147362 - RNA, 22 nt, Staphylococcus aureus subsp. aureus N315
ccaucuuuguaaccuaaaaaca

SEQ ID NO: 2147363 - RNA, 23 nt, Staphylococcus aureus subsp. aureus N315
ccaucuuuguaaccuaaaaacaa

SEQ ID NO: 2147364 - RNA, 20 nt, Staphylococcus aureus subsp. aureus N315
ccaucuuuuagguaauaauu

SEQ ID NO: 2147365 - RNA, 22 nt, Staphylococcus aureus subsp. aureus N315
ccauugcacaguuucaucuuca

SEQ ID NO: 2147366 - RNA, 22 nt, Staphylococcus aureus subsp. aureus N315
ccauuucgauaccuaaaauacc

SEQ ID NO: 2147367 - RNA, 16 nt, Staphylococcus aureus subsp. aureus N315
ccauuugcaacaauau

SEQ ID NO: 2147368 - RNA, 18 nt, Staphylococcus aureus subsp. aureus N315
ccauuuuuuuccaagcau

SEQ ID NO: 2147369 - RNA, 23 nt, Staphylococcus aureus subsp. aureus N315
ccauuuuuuugacaguuuuaaau

SEQ ID NO: 2147370 - RNA, 12 nt, Staphylococcus aureus subsp. aureus N315
ccauuuuuucaa

SEQ ID NO: 2147371 - RNA, 14 nt, Staphylococcus aureus subsp. aureus N315
cccaaaaaauugua

SEQ ID NO: 2147372 - RNA, 13 nt, Staphylococcus aureus subsp. aureus N315
cccacaccccaac

SEQ ID NO: 2147373 - RNA, 16 nt, Staphylococcus aureus subsp. aureus N315
cccauguauaaggaua

SEQ ID NO: 2147374 - RNA, 13 nt, Staphylococcus aureus subsp. aureus N315
cccauuuuaaagu

SEQ ID NO: 2147375 - RNA, 17 nt, Staphylococcus aureus subsp. aureus N315
cccauucaccaauauua

SEQ ID NO: 2147376 - RNA, 17 nt, Staphylococcus aureus subsp. aureus N315
cccauucacuacuuuuu

SEQ ID NO: 2147377 - RNA, 15 nt, Staphylococcus aureus subsp. aureus N315
ccccaacuugcauug

SEQ ID NO: 2147378 - RNA, 20 nt, Staphylococcus aureus subsp. aureus N315
ccccaacuugcauugucugu

SEQ ID NO: 2147379 - RNA, 16 nt, Staphylococcus aureus subsp. aureus N315
ccccaacacagagaau

SEQ ID NO: 2147380 - RNA, 15 nt, Staphylococcus aureus subsp. aureus N315
ccccaacucgcauug

SEQ ID NO: 2147381 - RNA, 16 nt, Staphylococcus aureus subsp. aureus N315
ccccaacacagagaaa

SEQ ID NO: 2147382 - RNA, 11 nt, Staphylococcus aureus subsp. aureus N315
ccccaacacag

SEQ ID NO: 2147383 - RNA, 16 nt, Staphylococcus aureus subsp. aureus N315
cccccgccacuaugug

SEQ ID NO: 2147384 - RNA, 16 nt, Staphylococcus aureus subsp. aureus N315
ccagcuaaaccaucug

SEQ ID NO: 2147385 - RNA, 18 nt, Staphylococcus aureus subsp. aureus N315
ccagucguaaugaugaca

SEQ ID NO: 2147386 - RNA, 23 nt, Staphylococcus aureus subsp. aureus N315
ccaguauacgaguuauaucuuuu

SEQ ID NO: 2147387 - RNA, 13 nt, Staphylococcus aureus subsp. aureus N315
ccagucauguccc

SEQ ID NO: 2147388 - RNA, 14 nt, Staphylococcus aureus subsp. aureus N315
ccauaaauauuaaa

SEQ ID NO: 2147389 - RNA, 17 nt, Staphylococcus aureus subsp. aureus N315
ccauaaauauuuaaaau

SEQ ID NO: 2147390 - RNA, 13 nt, Staphylococcus aureus subsp. aureus N315
ccauaacaauuuu

SEQ ID NO: 2147391 - RNA, 21 nt, Staphylococcus aureus subsp. aureus N315
ccauaaauaaaaugcuacaau

SEQ ID NO: 2147392 - RNA, 13 nt, Staphylococcus aureus subsp. aureus N315
ccaguuucaagug

SEQ ID NO: 2147393 - RNA, 15 nt, Staphylococcus aureus subsp. aureus N315
ccaguggaaaugaua

SEQ ID NO: 2147394 - RNA, 18 nt, Staphylococcus aureus subsp. aureus N315
ccaucuucuugauuguaa

SEQ ID NO: 2147395 - RNA, 20 nt, Staphylococcus aureus subsp. aureus N315
ccaucguagcgcuuagauaa

SEQ ID NO: 2147396 - RNA, 20 nt, Staphylococcus aureus subsp. aureus N315
ccaucaauaccauaauuaaa

SEQ ID NO: 2147397 - RNA, 23 nt, Staphylococcus aureus subsp. aureus N315
ccaucaauccaacuacugcaaca

SEQ ID NO: 2147398 - RNA, 13 nt, Staphylococcus aureus subsp. aureus N315
ccauaauuuaaau

SEQ ID NO: 2147399 - RNA, 17 nt, Staphylococcus aureus subsp. aureus N315
ccauaugugguggcuau

SEQ ID NO: 2147400 - RNA, 23 nt, Staphylococcus aureus subsp. aureus N315
ccauaugugguggcuauauaauu

SEQ ID NO: 2147401 - RNA, 11 nt, Staphylococcus aureus subsp. aureus N315
ccagaauaaau

SEQ ID NO: 2147402 - RNA, 15 nt, Staphylococcus aureus subsp. aureus N315
ccagccucuguguug

SEQ ID NO: 2147403 - RNA, 14 nt, Staphylococcus aureus subsp. aureus N315
ccacuuaaucguuc

SEQ ID NO: 2147404 - RNA, 13 nt, Staphylococcus aureus subsp. aureus N315
ccacuucaucuaa

SEQ ID NO: 2147405 - RNA, 19 nt, Staphylococcus aureus subsp. aureus N315
ccacuucuucaccugcguc

SEQ ID NO: 2147406 - RNA, 14 nt, Staphylococcus aureus subsp. aureus N315
ccacuucuucaccu

SEQ ID NO: 2147407 - RNA, 13 nt, Staphylococcus aureus subsp. aureus N315
ccacgguuuacca

SEQ ID NO: 2147408 - RNA, 19 nt, Staphylococcus aureus subsp. aureus N315
ccacguuugaccacaacuu

SEQ ID NO: 2147409 - RNA, 23 nt, Staphylococcus aureus subsp. aureus N315
ccacuccuuaaacaaauaaaugu

SEQ ID NO: 2147410 - RNA, 12 nt, Staphylococcus aureus subsp. aureus N315
ccacucaauucu

SEQ ID NO: 2147411 - RNA, 19 nt, Staphylococcus aureus subsp. aureus N315
ccacucaauucucuaacuu

SEQ ID NO: 2147412 - RNA, 16 nt, Staphylococcus aureus subsp. aureus N315
ccacuccuuaaacaaa

SEQ ID NO: 2147413 - RNA, 20 nt, Staphylococcus aureus subsp. aureus N315
cauuuuuuuccaagcaucau

SEQ ID NO: 2147414 - RNA, 16 nt, Staphylococcus aureus subsp. aureus N315
cauuuuuucuaucuuc

SEQ ID NO: 2147415 - RNA, 17 nt, Staphylococcus aureus subsp. aureus N315
ccgacuuaauauugaau

SEQ ID NO: 2147416 - RNA, 15 nt, Staphylococcus aureus subsp. aureus N315
ccgaagcgcagugac

SEQ ID NO: 2147417 - RNA, 17 nt, Staphylococcus aureus subsp. aureus N315
ccgaccaacuugcacau

SEQ ID NO: 2147418 - RNA, 23 nt, Staphylococcus aureus subsp. aureus N315
ccuggaaucgaaaauaucaauuu

SEQ ID NO: 2147419 - RNA, 15 nt, Staphylococcus aureus subsp. aureus N315
ccugcuuuuuuuaua

SEQ ID NO: 2147420 - RNA, 12 nt, Staphylococcus aureus subsp. aureus N315
ccuucaaaaugc

SEQ ID NO: 2147421 - RNA, 18 nt, Staphylococcus aureus subsp. aureus N315
ccuucaauguucaauuca

SEQ ID NO: 2147422 - RNA, 16 nt, Staphylococcus aureus subsp. aureus N315
ccuuaauaauaaguau

SEQ ID NO: 2147423 - RNA, 15 nt, Staphylococcus aureus subsp. aureus N315
ccuuaauaucaugca

SEQ ID NO: 2147424 - RNA, 18 nt, Staphylococcus aureus subsp. aureus N315
ccuuacccaaaaaauugu

SEQ ID NO: 2147425 - RNA, 18 nt, Staphylococcus aureus subsp. aureus N315
ccuuaacuucauaauaua

SEQ ID NO: 2147426 - RNA, 15 nt, Staphylococcus aureus subsp. aureus N315
ccuguugaauauacu

SEQ ID NO: 2147427 - RNA, 19 nt, Staphylococcus aureus subsp. aureus N315
ccuguucuuuauuuaaagg

SEQ ID NO: 2147428 - RNA, 22 nt, Staphylococcus aureus subsp. aureus N315
ccuguuauugcaauaaaauuag

SEQ ID NO: 2147429 - RNA, 13 nt, Staphylococcus aureus subsp. aureus N315
ccugugauaaaaa

SEQ ID NO: 2147430 - RNA, 21 nt, Staphylococcus aureus subsp. aureus N315
ccucuaacgguauaucaucca

SEQ ID NO: 2147431 - RNA, 23 nt, Staphylococcus aureus subsp. aureus N315
ccucuaacgguauaucauccaca

SEQ ID NO: 2147432 - RNA, 18 nt, Staphylococcus aureus subsp. aureus N315
ccucauaauuaucauaua

SEQ ID NO: 2147433 - RNA, 14 nt, Staphylococcus aureus subsp. aureus N315
ccucauaauuauca

SEQ ID NO: 2147434 - RNA, 14 nt, Staphylococcus aureus subsp. aureus N315
ccucauaaaucaug

SEQ ID NO: 2147435 - RNA, 21 nt, Staphylococcus aureus subsp. aureus N315
ccugauauuucaacuuuuuaa

SEQ ID NO: 2147436 - RNA, 22 nt, Staphylococcus aureus subsp. aureus N315
ccugauuccacuacaaucauac

SEQ ID NO: 2147437 - RNA, 20 nt, Staphylococcus aureus subsp. aureus N315
ccugcaaaauguuacacaaa

SEQ ID NO: 2147438 - RNA, 13 nt, Staphylococcus aureus subsp. aureus N315
ccguauuucaaau

SEQ ID NO: 2147439 - RNA, 22 nt, Staphylococcus aureus subsp. aureus N315
ccucacuagauaguuuauacuu

SEQ ID NO: 2147440 - RNA, 15 nt, Staphylococcus aureus subsp. aureus N315
ccucacuaacucaau

SEQ ID NO: 2147441 - RNA, 18 nt, Staphylococcus aureus subsp. aureus N315
ccucaauuaguucuggca

SEQ ID NO: 2147442 - RNA, 14 nt, Staphylococcus aureus subsp. aureus N315
ccucaauaucuuua

SEQ ID NO: 2147443 - RNA, 18 nt, Staphylococcus aureus subsp. aureus N315
ccucaacauuaaaaugug

SEQ ID NO: 2147444 - RNA, 16 nt, Staphylococcus aureus subsp. aureus N315
ccuauuguuuuuuaua

SEQ ID NO: 2147445 - RNA, 17 nt, Staphylococcus aureus subsp. aureus N315
ccuauucccaaaaugau

SEQ ID NO: 2147446 - RNA, 22 nt, Staphylococcus aureus subsp. aureus N315
ccuauuccuaauaaauaucuua

SEQ ID NO: 2147447 - RNA, 18 nt, Staphylococcus aureus subsp. aureus N315
ccuauuacacuaaaaccu

SEQ ID NO: 2147448 - RNA, 19 nt, Staphylococcus aureus subsp. aureus N315
ccuauuaaaucugcuugug

SEQ ID NO: 2147449 - RNA, 11 nt, Staphylococcus aureus subsp. aureus N315
ccuauucccaa

SEQ ID NO: 2147450 - RNA, 20 nt, Staphylococcus aureus subsp. aureus N315
ccuaugccaaauaacguuaa

SEQ ID NO: 2147451 - RNA, 12 nt, Staphylococcus aureus subsp. aureus N315
ccuacugcuguc

SEQ ID NO: 2147452 - RNA, 19 nt, Staphylococcus aureus subsp. aureus N315
ccuacugcugucuuuuuga

SEQ ID NO: 2147453 - RNA, 23 nt, Staphylococcus aureus subsp. aureus N315
ccuacuuugauauguuuccucuu

SEQ ID NO: 2147454 - RNA, 21 nt, Staphylococcus aureus subsp. aureus N315
ccuagcaaaaauacuuuuuga

SEQ ID NO: 2147455 - RNA, 13 nt, Staphylococcus aureus subsp. aureus N315
ccuagcaaaaaua

SEQ ID NO: 2147456 - RNA, 15 nt, Staphylococcus aureus subsp. aureus N315
ccuagauaccaaacu

SEQ ID NO: 2147457 - RNA, 16 nt, Staphylococcus aureus subsp. aureus N315
ccuaugccaaauaacg

SEQ ID NO: 2147458 - RNA, 18 nt, Staphylococcus aureus subsp. aureus N315
ccuaugauauaugcugca

SEQ ID NO: 2147459 - RNA, 16 nt, Staphylococcus aureus subsp. aureus N315
ccuagguuuauauauc

SEQ ID NO: 2147460 - RNA, 18 nt, Staphylococcus aureus subsp. aureus N315
ccuagguuuauauaucac

SEQ ID NO: 2147461 - RNA, 20 nt, Staphylococcus aureus subsp. aureus N315
ccuagguuuauauaucacau

SEQ ID NO: 2147462 - RNA, 17 nt, Staphylococcus aureus subsp. aureus N315
ccuauacauaacccuaa

SEQ ID NO: 2147463 - RNA, 14 nt, Staphylococcus aureus subsp. aureus N315
ccuauaagucucuu

SEQ ID NO: 2147464 - RNA, 14 nt, Staphylococcus aureus subsp. aureus N315
ccuaauaaauaucu

SEQ ID NO: 2147465 - RNA, 14 nt, Staphylococcus aureus subsp. aureus N315
ccuacaacaccaau

SEQ ID NO: 2147466 - RNA, 20 nt, Staphylococcus aureus subsp. aureus N315
ccuacaacaccaauugaaau

SEQ ID NO: 2147467 - RNA, 17 nt, Staphylococcus aureus subsp. aureus N315
ccuaaguuaugacuaac

SEQ ID NO: 2147468 - RNA, 12 nt, Staphylococcus aureus subsp. aureus N315
ccuaaaucuccu

SEQ ID NO: 2147469 - RNA, 22 nt, Staphylococcus aureus subsp. aureus N315
ccuaagcucguuaauuuuauuu

SEQ ID NO: 2147470 - RNA, 19 nt, Staphylococcus aureus subsp. aureus N315
ccuaaaccucuaaauaaaa

SEQ ID NO: 2147471 - RNA, 18 nt, Staphylococcus aureus subsp. aureus N315
ccuaaagcuaaugcaagc

SEQ ID NO: 2147472 - RNA, 19 nt, Staphylococcus aureus subsp. aureus N315
ccuaaagguaacuuuuuaa

SEQ ID NO: 2147473 - RNA, 12 nt, Staphylococcus aureus subsp. aureus N315
ccuaaaaacaaa

SEQ ID NO: 2147474 - RNA, 14 nt, Staphylococcus aureus subsp. aureus N315
ccguuuuuuauaaa

SEQ ID NO: 2147475 - RNA, 18 nt, Staphylococcus aureus subsp. aureus N315
ccguuuuuuauaaaucau

SEQ ID NO: 2147476 - RNA, 22 nt, Staphylococcus aureus subsp. aureus N315
ccguuuuuuauaaaucauucuu

SEQ ID NO: 2147477 - RNA, 16 nt, Staphylococcus aureus subsp. aureus N315
ccguuaaaaagacggu

SEQ ID NO: 2147478 - RNA, 21 nt, Staphylococcus aureus subsp. aureus N315
ccguguuuugauuuauuaucu

SEQ ID NO: 2147479 - RNA, 16 nt, Staphylococcus aureus subsp. aureus N315
caucgaacaugaauga

SEQ ID NO: 2147480 - RNA, 14 nt, Staphylococcus aureus subsp. aureus N315
cauccucauaauua

SEQ ID NO: 2147481 - RNA, 23 nt, Staphylococcus aureus subsp. aureus N315
caucuucuggauagguaucacua

SEQ ID NO: 2147482 - RNA, 18 nt, Staphylococcus aureus subsp. aureus N315
caucuuuaagcuuaaaua

SEQ ID NO: 2147483 - RNA, 15 nt, Staphylococcus aureus subsp. aureus N315
caucuuguuguucug

SEQ ID NO: 2147484 - RNA, 17 nt, Staphylococcus aureus subsp. aureus N315
caucuuuauuuacaaug

SEQ ID NO: 2147485 - RNA, 19 nt, Staphylococcus aureus subsp. aureus N315
caucuuucacaauuguaua

SEQ ID NO: 2147486 - RNA, 17 nt, Staphylococcus aureus subsp. aureus N315
caucuuucaaaugcuua

SEQ ID NO: 2147487 - RNA, 23 nt, Staphylococcus aureus subsp. aureus N315
caucuucaagacgcauuguugua

SEQ ID NO: 2147488 - RNA, 21 nt, Staphylococcus aureus subsp. aureus N315
caucuuaugacugcuuuuuau

SEQ ID NO: 2147489 - RNA, 18 nt, Staphylococcus aureus subsp. aureus N315
caucuuaacaacuuuaau

SEQ ID NO: 2147490 - RNA, 16 nt, Staphylococcus aureus subsp. aureus N315
caucugaaaaaauuaa

SEQ ID NO: 2147491 - RNA, 22 nt, Staphylococcus aureus subsp. aureus N315
caucugaaaaaauuaauaauuu

SEQ ID NO: 2147492 - RNA, 13 nt, Staphylococcus aureus subsp. aureus N315
caucugacugauu

SEQ ID NO: 2147493 - RNA, 17 nt, Staphylococcus aureus subsp. aureus N315
caucuacuauuuaaucu

SEQ ID NO: 2147494 - RNA, 18 nt, Staphylococcus aureus subsp. aureus N315
caucuauaacaaaaucuc

SEQ ID NO: 2147495 - RNA, 20 nt, Staphylococcus aureus subsp. aureus N315
caucuauauuuaauuuugau

SEQ ID NO: 2147496 - RNA, 14 nt, Staphylococcus aureus subsp. aureus N315
caucuauauuuaau

SEQ ID NO: 2147497 - RNA, 23 nt, Staphylococcus aureus subsp. aureus N315
caucaguugagugauuuuaaucu

SEQ ID NO: 2147498 - RNA, 22 nt, Staphylococcus aureus subsp. aureus N315
caucaguaccaaagaaaucacc

SEQ ID NO: 2147499 - RNA, 12 nt, Staphylococcus aureus subsp. aureus N315
caucaguaccaa

SEQ ID NO: 2147500 - RNA, 17 nt, Staphylococcus aureus subsp. aureus N315
caucauuuucaauacuu

SEQ ID NO: 2147501 - RNA, 17 nt, Staphylococcus aureus subsp. aureus N315
caucauuuguguuuuua

SEQ ID NO: 2147502 - RNA, 20 nt, Staphylococcus aureus subsp. aureus N315
caucauuuguguaaaugaau

SEQ ID NO: 2147503 - RNA, 23 nt, Staphylococcus aureus subsp. aureus N315
caucauuuucaauacuugaaaga

SEQ ID NO: 2147504 - RNA, 16 nt, Staphylococcus aureus subsp. aureus N315
caucauuuaaauauuu

SEQ ID NO: 2147505 - RNA, 20 nt, Staphylococcus aureus subsp. aureus N315
caucaugacuauuucgcuuu

SEQ ID NO: 2147506 - RNA, 15 nt, Staphylococcus aureus subsp. aureus N315
caucaugacuauuuc

SEQ ID NO: 2147507 - RNA, 14 nt, Staphylococcus aureus subsp. aureus N315
caucauaaucugcu

SEQ ID NO: 2147508 - RNA, 13 nt, Staphylococcus aureus subsp. aureus N315
caucaucaccaua

SEQ ID NO: 2147509 - RNA, 17 nt, Staphylococcus aureus subsp. aureus N315
caucaucaccauacuaa

SEQ ID NO: 2147510 - RNA, 19 nt, Staphylococcus aureus subsp. aureus N315
caucaucacuguagauuca

SEQ ID NO: 2147511 - RNA, 14 nt, Staphylococcus aureus subsp. aureus N315
caucaucaaguuca

SEQ ID NO: 2147512 - RNA, 18 nt, Staphylococcus aureus subsp. aureus N315
caucaacgccauauuuau

SEQ ID NO: 2147513 - RNA, 22 nt, Staphylococcus aureus subsp. aureus N315
caucaaguauaaauguuauugc

SEQ ID NO: 2147514 - RNA, 17 nt, Staphylococcus aureus subsp. aureus N315
caucaauaccauaauua

SEQ ID NO: 2147515 - RNA, 18 nt, Staphylococcus aureus subsp. aureus N315
caucaauaaauauugauu

SEQ ID NO: 2147516 - RNA, 14 nt, Staphylococcus aureus subsp. aureus N315
caucaaaaauaaaa

SEQ ID NO: 2147517 - RNA, 13 nt, Staphylococcus aureus subsp. aureus N315
caucaaaaaugag

SEQ ID NO: 2147518 - RNA, 13 nt, Staphylococcus aureus subsp. aureus N315
caucaaacaacau

SEQ ID NO: 2147519 - RNA, 14 nt, Staphylococcus aureus subsp. aureus N315
caucaaacaacauc

SEQ ID NO: 2147520 - RNA, 17 nt, Staphylococcus aureus subsp. aureus N315
caucaaacaacaucacu

SEQ ID NO: 2147521 - RNA, 15 nt, Staphylococcus aureus subsp. aureus N315
cauauuuugauuuac

SEQ ID NO: 2147522 - RNA, 17 nt, Staphylococcus aureus subsp. aureus N315
cauauuuuuuaaauuua

SEQ ID NO: 2147523 - RNA, 11 nt, Staphylococcus aureus subsp. aureus N315
cauauucacau

SEQ ID NO: 2147524 - RNA, 11 nt, Staphylococcus aureus subsp. aureus N315
cauauuuugau

SEQ ID NO: 2147525 - RNA, 20 nt, Staphylococcus aureus subsp. aureus N315
cauauauuuuguuaauaagc

SEQ ID NO: 2147526 - RNA, 13 nt, Staphylococcus aureus subsp. aureus N315
cauauauuuuguu

SEQ ID NO: 2147527 - RNA, 14 nt, Staphylococcus aureus subsp. aureus N315
cauauaucaacaug

SEQ ID NO: 2147528 - RNA, 21 nt, Staphylococcus aureus subsp. aureus N315
cauauacacacuaaggaaaau

SEQ ID NO: 2147529 - RNA, 16 nt, Staphylococcus aureus subsp. aureus N315
cauauaugucucucuu

SEQ ID NO: 2147530 - RNA, 18 nt, Staphylococcus aureus subsp. aureus N315
cauauaugauaaauauug

SEQ ID NO: 2147531 - RNA, 13 nt, Staphylococcus aureus subsp. aureus N315
cauauaaauguug

SEQ ID NO: 2147532 - RNA, 23 nt, Staphylococcus aureus subsp. aureus N315
cauauaaugguugaauaacacua

SEQ ID NO: 2147533 - RNA, 22 nt, Staphylococcus aureus subsp. aureus N315
cauauaaaucaaauauacuuuu

SEQ ID NO: 2147534 - RNA, 22 nt, Staphylococcus aureus subsp. aureus N315
cauacuuuuagcaacaguauuu

SEQ ID NO: 2147535 - RNA, 15 nt, Staphylococcus aureus subsp. aureus N315
cauaucgucaauuuu

SEQ ID NO: 2147536 - RNA, 21 nt, Staphylococcus aureus subsp. aureus N315
cauaucggcccauaauagcua

SEQ ID NO: 2147537 - RNA, 13 nt, Staphylococcus aureus subsp. aureus N315
cauaucuuucaau

SEQ ID NO: 2147538 - RNA, 15 nt, Staphylococcus aureus subsp. aureus N315
cauauguacuauuau

SEQ ID NO: 2147539 - RNA, 23 nt, Staphylococcus aureus subsp. aureus N315
cauauggugaacuguuaaacuca

SEQ ID NO: 2147540 - RNA, 18 nt, Staphylococcus aureus subsp. aureus N315
cauaugucuguuccucaa

SEQ ID NO: 2147541 - RNA, 16 nt, Staphylococcus aureus subsp. aureus N315
cauauguaauacaaaa

SEQ ID NO: 2147542 - RNA, 18 nt, Staphylococcus aureus subsp. aureus N315
cauauguaauacaaaaga

SEQ ID NO: 2147543 - RNA, 22 nt, Staphylococcus aureus subsp. aureus N315
cauauuacuucucaucgaauuc

SEQ ID NO: 2147544 - RNA, 14 nt, Staphylococcus aureus subsp. aureus N315
cauauuaacuguua

SEQ ID NO: 2147545 - RNA, 19 nt, Staphylococcus aureus subsp. aureus N315
cauauguguaugauagaau

SEQ ID NO: 2147546 - RNA, 14 nt, Staphylococcus aureus subsp. aureus N315
cauaugugguggcu

SEQ ID NO: 2147547 - RNA, 14 nt, Staphylococcus aureus subsp. aureus N315
cauauguuggauuc

SEQ ID NO: 2147548 - RNA, 22 nt, Staphylococcus aureus subsp. aureus N315
cauugcuuaacuuccuuuuuau

SEQ ID NO: 2147549 - RNA, 16 nt, Staphylococcus aureus subsp. aureus N315
cauugaucuuuuauaa

SEQ ID NO: 2147550 - RNA, 23 nt, Staphylococcus aureus subsp. aureus N315
cauugcacuugucucaaauuaaa

SEQ ID NO: 2147551 - RNA, 18 nt, Staphylococcus aureus subsp. aureus N315
cauugaugucaauuucac

SEQ ID NO: 2147552 - RNA, 15 nt, Staphylococcus aureus subsp. aureus N315
cauuggauucuuuug

SEQ ID NO: 2147553 - RNA, 22 nt, Staphylococcus aureus subsp. aureus N315
cauuggcaauauacuuuuuaaa

SEQ ID NO: 2147554 - RNA, 16 nt, Staphylococcus aureus subsp. aureus N315
cauuguguauuguuuu

SEQ ID NO: 2147555 - RNA, 12 nt, Staphylococcus aureus subsp. aureus N315
cauuuaaaaaau

SEQ ID NO: 2147556 - RNA, 17 nt, Staphylococcus aureus subsp. aureus N315
cauuguuuuacagucaa

SEQ ID NO: 2147557 - RNA, 18 nt, Staphylococcus aureus subsp. aureus N315
cauuuaaaauauuuuuuc

SEQ ID NO: 2147558 - RNA, 20 nt, Staphylococcus aureus subsp. aureus N315
cauuuaaaauauuuuuucug

SEQ ID NO: 2147559 - RNA, 22 nt, Staphylococcus aureus subsp. aureus N315
cauuguggcuuuuuuuauggug

SEQ ID NO: 2147560 - RNA, 17 nt, Staphylococcus aureus subsp. aureus N315
cauuguucauacgcuca

SEQ ID NO: 2147561 - RNA, 21 nt, Staphylococcus aureus subsp. aureus N315
cauuguuauuaucguaaaaaa

SEQ ID NO: 2147562 - RNA, 13 nt, Staphylococcus aureus subsp. aureus N315
cauuguuauuuau

SEQ ID NO: 2147563 - RNA, 15 nt, Staphylococcus aureus subsp. aureus N315
cauuguuauuuauac

SEQ ID NO: 2147564 - RNA, 15 nt, Staphylococcus aureus subsp. aureus N315
cauuguuauccaaaa

SEQ ID NO: 2147565 - RNA, 17 nt, Staphylococcus aureus subsp. aureus N315
cauucuauacuuuuaau

SEQ ID NO: 2147566 - RNA, 14 nt, Staphylococcus aureus subsp. aureus N315
cauucuauacuuuu

SEQ ID NO: 2147567 - RNA, 17 nt, Staphylococcus aureus subsp. aureus N315
cauucuaguagcuagaa

SEQ ID NO: 2147568 - RNA, 21 nt, Staphylococcus aureus subsp. aureus N315
cauuaucaagaacuuuaaaaa

SEQ ID NO: 2147569 - RNA, 19 nt, Staphylococcus aureus subsp. aureus N315
cauuaucaagaauaacuau

SEQ ID NO: 2147570 - RNA, 20 nt, Staphylococcus aureus subsp. aureus N315
cauuaucaagaacuuuaaaa

SEQ ID NO: 2147571 - RNA, 13 nt, Staphylococcus aureus subsp. aureus N315
cauuaucauuaag

SEQ ID NO: 2147572 - RNA, 18 nt, Staphylococcus aureus subsp. aureus N315
cauucuguguaaauauaa

SEQ ID NO: 2147573 - RNA, 20 nt, Staphylococcus aureus subsp. aureus N315
cauucuguguaaauauaaau

SEQ ID NO: 2147574 - RNA, 21 nt, Staphylococcus aureus subsp. aureus N315
cauugagauaucuuauaacaa

SEQ ID NO: 2147575 - RNA, 13 nt, Staphylococcus aureus subsp. aureus N315
cauugauaaaaua

SEQ ID NO: 2147576 - RNA, 21 nt, Staphylococcus aureus subsp. aureus N315
cauugauaaauuuuuaguuaa

SEQ ID NO: 2147577 - RNA, 18 nt, Staphylococcus aureus subsp. aureus N315
cauugauaaauuuuuagu

SEQ ID NO: 2147578 - RNA, 19 nt, Staphylococcus aureus subsp. aureus N315
cauuugcaacaauauaaua

SEQ ID NO: 2147579 - RNA, 15 nt, Staphylococcus aureus subsp. aureus N315
cauuugacauaaucc

SEQ ID NO: 2147580 - RNA, 16 nt, Staphylococcus aureus subsp. aureus N315
cauuuaauacuuuucu

SEQ ID NO: 2147581 - RNA, 23 nt, Staphylococcus aureus subsp. aureus N315
cauuuaauacuuuucucgauuaa

SEQ ID NO: 2147582 - RNA, 22 nt, Staphylococcus aureus subsp. aureus N315
cauuuaaggauuuccucgguuu

SEQ ID NO: 2147583 - RNA, 15 nt, Staphylococcus aureus subsp. aureus N315
cauuuaauccuucuc

SEQ ID NO: 2147584 - RNA, 20 nt, Staphylococcus aureus subsp. aureus N315
cauuuaauuggaguucaucu

SEQ ID NO: 2147585 - RNA, 18 nt, Staphylococcus aureus subsp. aureus N315
cauuuguguuccugcuac

SEQ ID NO: 2147586 - RNA, 13 nt, Staphylococcus aureus subsp. aureus N315
cauuuguguaaau

SEQ ID NO: 2147587 - RNA, 23 nt, Staphylococcus aureus subsp. aureus N315
cauuugucauaauagauaaugca

SEQ ID NO: 2147588 - RNA, 17 nt, Staphylococcus aureus subsp. aureus N315
cauuugucuuaauuuuu

SEQ ID NO: 2147589 - RNA, 15 nt, Staphylococcus aureus subsp. aureus N315
cauuuguauuaauuu

SEQ ID NO: 2147590 - RNA, 23 nt, Staphylococcus aureus subsp. aureus N315
cauuuguuaaauucaucuuauca

SEQ ID NO: 2147591 - RNA, 10 nt, Staphylococcus aureus subsp. aureus N315
cauuuuaaag

SEQ ID NO: 2147592 - RNA, 22 nt, Staphylococcus aureus subsp. aureus N315
cauuugcgauuucuucugcuaa

SEQ ID NO: 2147593 - RNA, 21 nt, Staphylococcus aureus subsp. aureus N315
cauuugcgauuucuucugcua

SEQ ID NO: 2147594 - RNA, 23 nt, Staphylococcus aureus subsp. aureus N315
cauuugguggagaaccuuuaaaa

SEQ ID NO: 2147595 - RNA, 20 nt, Staphylococcus aureus subsp. aureus N315
cauuuuagcaaaagcuuuua

SEQ ID NO: 2147596 - RNA, 21 nt, Staphylococcus aureus subsp. aureus N315
cauuuuagauugacuaaguuu

SEQ ID NO: 2147597 - RNA, 12 nt, Staphylococcus aureus subsp. aureus N315
cauuuuaaauaa

SEQ ID NO: 2147598 - RNA, 19 nt, Staphylococcus aureus subsp. aureus N315
cauuuuaaauaaaaugcau

SEQ ID NO: 2147599 - RNA, 17 nt, Staphylococcus aureus subsp. aureus N315
cauuuucaaaacuagca

SEQ ID NO: 2147600 - RNA, 16 nt, Staphylococcus aureus subsp. aureus N315
cauuuuaguuauacua

SEQ ID NO: 2147601 - RNA, 15 nt, Staphylococcus aureus subsp. aureus N315
cauuuuauauuuuag

SEQ ID NO: 2147602 - RNA, 19 nt, Staphylococcus aureus subsp. aureus N315
cauuuucaaguuuaaaaua

SEQ ID NO: 2147603 - RNA, 11 nt, Staphylococcus aureus subsp. aureus N315
cauuuuuaaaa

SEQ ID NO: 2147604 - RNA, 19 nt, Staphylococcus aureus subsp. aureus N315
cauuuuuaaauuacuauau

SEQ ID NO: 2147605 - RNA, 20 nt, Staphylococcus aureus subsp. aureus N315
cauuuugagucguagauacu

SEQ ID NO: 2147606 - RNA, 15 nt, Staphylococcus aureus subsp. aureus N315
cauuuugauuaagug

SEQ ID NO: 2147607 - RNA, 14 nt, Staphylococcus aureus subsp. aureus N315
cauuuuuaguuaga

SEQ ID NO: 2147608 - RNA, 14 nt, Staphylococcus aureus subsp. aureus N315
cauuaaguacuuuu

SEQ ID NO: 2147609 - RNA, 15 nt, Staphylococcus aureus subsp. aureus N315
cauuaauaaauaaua

SEQ ID NO: 2147610 - RNA, 20 nt, Staphylococcus aureus subsp. aureus N315
cauuaauacaagucuuuacu

SEQ ID NO: 2147611 - RNA, 21 nt, Staphylococcus aureus subsp. aureus N315
cauuaaucuauauaaaaacug

SEQ ID NO: 2147612 - RNA, 20 nt, Staphylococcus aureus subsp. aureus N315
cauuaaucuauauaaaaacu

SEQ ID NO: 2147613 - RNA, 17 nt, Staphylococcus aureus subsp. aureus N315
cauuaaucuauauaaaa

SEQ ID NO: 2147614 - RNA, 16 nt, Staphylococcus aureus subsp. aureus N315
cauuaaucauuuaucu

SEQ ID NO: 2147615 - RNA, 14 nt, Staphylococcus aureus subsp. aureus N315
cauuacagauaauu

SEQ ID NO: 2147616 - RNA, 16 nt, Staphylococcus aureus subsp. aureus N315
cauuacagauaauuau

SEQ ID NO: 2147617 - RNA, 22 nt, Staphylococcus aureus subsp. aureus N315
cauuacaaaucaugacauaaaa

SEQ ID NO: 2147618 - RNA, 20 nt, Staphylococcus aureus subsp. aureus N315
cauuaauuggauuuuuacaa

SEQ ID NO: 2147619 - RNA, 15 nt, Staphylococcus aureus subsp. aureus N315
cauuagcaugauaaa

SEQ ID NO: 2147620 - RNA, 16 nt, Staphylococcus aureus subsp. aureus N315
cauuagcaugauaaag

SEQ ID NO: 2147621 - RNA, 23 nt, Staphylococcus aureus subsp. aureus N315
cauuagccaaaucuuuaauaacc

SEQ ID NO: 2147622 - RNA, 14 nt, Staphylococcus aureus subsp. aureus N315
cauuacccuuuaaa

SEQ ID NO: 2147623 - RNA, 23 nt, Staphylococcus aureus subsp. aureus N315
caugugcaagugguaaaaaugaa

SEQ ID NO: 2147624 - RNA, 16 nt, Staphylococcus aureus subsp. aureus N315
cauguucuuauaaaaa

SEQ ID NO: 2147625 - RNA, 19 nt, Staphylococcus aureus subsp. aureus N315
cauguuccgcuacaaaaca

SEQ ID NO: 2147626 - RNA, 21 nt, Staphylococcus aureus subsp. aureus N315
cauuaaaaaaucgaacuagac

SEQ ID NO: 2147627 - RNA, 14 nt, Staphylococcus aureus subsp. aureus N315
cauuaaaauaauua

SEQ ID NO: 2147628 - RNA, 13 nt, Staphylococcus aureus subsp. aureus N315
cauuaaaauaauu

SEQ ID NO: 2147629 - RNA, 12 nt, Staphylococcus aureus subsp. aureus N315
cauuaaaaaauc

SEQ ID NO: 2147630 - RNA, 14 nt, Staphylococcus aureus subsp. aureus N315
cauuaaaaauaaaa

SEQ ID NO: 2147631 - RNA, 12 nt, Staphylococcus aureus subsp. aureus N315
cauuaaaccacu

SEQ ID NO: 2147632 - RNA, 16 nt, Staphylococcus aureus subsp. aureus N315
cauguuggcaauuguu

SEQ ID NO: 2147633 - RNA, 14 nt, Staphylococcus aureus subsp. aureus N315
caugauuucuucuc

SEQ ID NO: 2147634 - RNA, 12 nt, Staphylococcus aureus subsp. aureus N315
caugaaauaaaa

SEQ ID NO: 2147635 - RNA, 16 nt, Staphylococcus aureus subsp. aureus N315
caugaaauaaaaaaac

SEQ ID NO: 2147636 - RNA, 19 nt, Staphylococcus aureus subsp. aureus N315
caugcaccuuuacaacaua

SEQ ID NO: 2147637 - RNA, 18 nt, Staphylococcus aureus subsp. aureus N315
caucuuuugguuuaucug

SEQ ID NO: 2147638 - RNA, 19 nt, Staphylococcus aureus subsp. aureus N315
caucuuuugguuuaucugu

SEQ ID NO: 2147639 - RNA, 17 nt, Staphylococcus aureus subsp. aureus N315
caucuuuugguuuaucu

SEQ ID NO: 2147640 - RNA, 19 nt, Staphylococcus aureus subsp. aureus N315
caucuuuuugauaauguuc

SEQ ID NO: 2147641 - RNA, 18 nt, Staphylococcus aureus subsp. aureus N315
caugcgauugaugcguuu

SEQ ID NO: 2147642 - RNA, 15 nt, Staphylococcus aureus subsp. aureus N315
caugcgauucaaucu

SEQ ID NO: 2147643 - RNA, 18 nt, Staphylococcus aureus subsp. aureus N315
caugcccgauaaaaccac

SEQ ID NO: 2147644 - RNA, 15 nt, Staphylococcus aureus subsp. aureus N315
caugggcuucugcua

SEQ ID NO: 2147645 - RNA, 12 nt, Staphylococcus aureus subsp. aureus N315
cauggaaaagug

SEQ ID NO: 2147646 - RNA, 17 nt, Staphylococcus aureus subsp. aureus N315
cauggaaaagugcgauu

SEQ ID NO: 2147647 - RNA, 15 nt, Staphylococcus aureus subsp. aureus N315
caugcuuuuaauauu

SEQ ID NO: 2147648 - RNA, 18 nt, Staphylococcus aureus subsp. aureus N315
cauacuucuauuuuauaa

SEQ ID NO: 2147649 - RNA, 22 nt, Staphylococcus aureus subsp. aureus N315
cauacuugucguauucuucaau

SEQ ID NO: 2147650 - RNA, 13 nt, Staphylococcus aureus subsp. aureus N315
cauacuucaauaa

SEQ ID NO: 2147651 - RNA, 13 nt, Staphylococcus aureus subsp. aureus N315
cauacuauaaaaa

SEQ ID NO: 2147652 - RNA, 15 nt, Staphylococcus aureus subsp. aureus N315
cauacuauaaaaauu

SEQ ID NO: 2147653 - RNA, 15 nt, Staphylococcus aureus subsp. aureus N315
cauacucacaaaaaa

SEQ ID NO: 2147654 - RNA, 17 nt, Staphylococcus aureus subsp. aureus N315
cauaccguacaaaggua

SEQ ID NO: 2147655 - RNA, 16 nt, Staphylococcus aureus subsp. aureus N315
cauaccggcaaauaac

SEQ ID NO: 2147656 - RNA, 13 nt, Staphylococcus aureus subsp. aureus N315
cauaccuacaaau

SEQ ID NO: 2147657 - RNA, 20 nt, Staphylococcus aureus subsp. aureus N315
cauaccuaauaacgcauaua

SEQ ID NO: 2147658 - RNA, 17 nt, Staphylococcus aureus subsp. aureus N315
cauaccuuuauuauuua

SEQ ID NO: 2147659 - RNA, 21 nt, Staphylococcus aureus subsp. aureus N315
cauaccaguggaaauuaugua

SEQ ID NO: 2147660 - RNA, 19 nt, Staphylococcus aureus subsp. aureus N315
cauacccauauuaaauuuu

SEQ ID NO: 2147661 - RNA, 17 nt, Staphylococcus aureus subsp. aureus N315
cauacccauauuaaauu

SEQ ID NO: 2147662 - RNA, 15 nt, Staphylococcus aureus subsp. aureus N315
cauacccauauuaaa

SEQ ID NO: 2147663 - RNA, 23 nt, Staphylococcus aureus subsp. aureus N315
cauacacuaucauuaucaaauaa

SEQ ID NO: 2147664 - RNA, 16 nt, Staphylococcus aureus subsp. aureus N315
cauacaggaaauugaa

SEQ ID NO: 2147665 - RNA, 15 nt, Staphylococcus aureus subsp. aureus N315
cauacauaacacaag

SEQ ID NO: 2147666 - RNA, 15 nt, Staphylococcus aureus subsp. aureus N315
cauacauaugcuaua

SEQ ID NO: 2147667 - RNA, 21 nt, Staphylococcus aureus subsp. aureus N315
cauaaugaauaauuaaaaaac

SEQ ID NO: 2147668 - RNA, 17 nt, Staphylococcus aureus subsp. aureus N315
cauaaugaauucauuca

SEQ ID NO: 2147669 - RNA, 20 nt, Staphylococcus aureus subsp. aureus N315
cauaaucgggaugauaacca

SEQ ID NO: 2147670 - RNA, 20 nt, Staphylococcus aureus subsp. aureus N315
cauaaucucuuuacaccauu

SEQ ID NO: 2147671 - RNA, 14 nt, Staphylococcus aureus subsp. aureus N315
caguucuuagauuu

SEQ ID NO: 2147672 - RNA, 22 nt, Staphylococcus aureus subsp. aureus N315
caguucuauagguuuauaaaaa

SEQ ID NO: 2147673 - RNA, 19 nt, Staphylococcus aureus subsp. aureus N315
caguguuauaauggcgggc

SEQ ID NO: 2147674 - RNA, 17 nt, Staphylococcus aureus subsp. aureus N315
caguguugaauuucaaa

SEQ ID NO: 2147675 - RNA, 20 nt, Staphylococcus aureus subsp. aureus N315
caguguugggggccagccaa

SEQ ID NO: 2147676 - RNA, 18 nt, Staphylococcus aureus subsp. aureus N315
caguguuugacugaauga

SEQ ID NO: 2147677 - RNA, 22 nt, Staphylococcus aureus subsp. aureus N315
caguuaaaauaaccauuuuuuc

SEQ ID NO: 2147678 - RNA, 18 nt, Staphylococcus aureus subsp. aureus N315
caguuguuauuuuugcua

SEQ ID NO: 2147679 - RNA, 21 nt, Staphylococcus aureus subsp. aureus N315
caguugcacaaauugcaaugg

SEQ ID NO: 2147680 - RNA, 13 nt, Staphylococcus aureus subsp. aureus N315
cauaaaaaaagag

SEQ ID NO: 2147681 - RNA, 14 nt, Staphylococcus aureus subsp. aureus N315
caguuguuuuuuug

SEQ ID NO: 2147682 - RNA, 16 nt, Staphylococcus aureus subsp. aureus N315
cauaaauauaaaauau

SEQ ID NO: 2147683 - RNA, 19 nt, Staphylococcus aureus subsp. aureus N315
cauaaauauuggaauacuc

SEQ ID NO: 2147684 - RNA, 23 nt, Staphylococcus aureus subsp. aureus N315
cauaaauagugaaauuauagccu

SEQ ID NO: 2147685 - RNA, 14 nt, Staphylococcus aureus subsp. aureus N315
cauaaauauaaaau

SEQ ID NO: 2147686 - RNA, 13 nt, Staphylococcus aureus subsp. aureus N315
cauaaauauaaaa

SEQ ID NO: 2147687 - RNA, 21 nt, Staphylococcus aureus subsp. aureus N315
cauaaauuaggucauuuuuau

SEQ ID NO: 2147688 - RNA, 14 nt, Staphylococcus aureus subsp. aureus N315
cauaaaugacugaa

SEQ ID NO: 2147689 - RNA, 18 nt, Staphylococcus aureus subsp. aureus N315
cauaaaucaugaaauaaa

SEQ ID NO: 2147690 - RNA, 18 nt, Staphylococcus aureus subsp. aureus N315
cauaacaaaaacaucuac

SEQ ID NO: 2147691 - RNA, 16 nt, Staphylococcus aureus subsp. aureus N315
caguaguuuuaaaagu

SEQ ID NO: 2147692 - RNA, 21 nt, Staphylococcus aureus subsp. aureus N315
caguaguuaauugaaugaaaa

SEQ ID NO: 2147693 - RNA, 18 nt, Staphylococcus aureus subsp. aureus N315
caguaguuaauugaauga

SEQ ID NO: 2147694 - RNA, 15 nt, Staphylococcus aureus subsp. aureus N315
caguagucacuguuu

SEQ ID NO: 2147695 - RNA, 18 nt, Staphylococcus aureus subsp. aureus N315
caguauauaucaaauaca

SEQ ID NO: 2147696 - RNA, 18 nt, Staphylococcus aureus subsp. aureus N315
cagucaauuuuuucaucu

SEQ ID NO: 2147697 - RNA, 23 nt, Staphylococcus aureus subsp. aureus N315
cagucaacugcugcuaaaauaaa

SEQ ID NO: 2147698 - RNA, 15 nt, Staphylococcus aureus subsp. aureus N315
cagucaacugcugcu

SEQ ID NO: 2147699 - RNA, 23 nt, Staphylococcus aureus subsp. aureus N315
cagucaacuacugucaauauaac

SEQ ID NO: 2147700 - RNA, 17 nt, Staphylococcus aureus subsp. aureus N315
caguauuuuuugugccu

SEQ ID NO: 2147701 - RNA, 17 nt, Staphylococcus aureus subsp. aureus N315
caguggauuacagauga

SEQ ID NO: 2147702 - RNA, 13 nt, Staphylococcus aureus subsp. aureus N315
caguguaugauga

SEQ ID NO: 2147703 - RNA, 18 nt, Staphylococcus aureus subsp. aureus N315
cagugaaguuaacuauaa

SEQ ID NO: 2147704 - RNA, 20 nt, Staphylococcus aureus subsp. aureus N315
cagucucuaaaacuuuuuca

SEQ ID NO: 2147705 - RNA, 15 nt, Staphylococcus aureus subsp. aureus N315
cagucucuaaaacuu

SEQ ID NO: 2147706 - RNA, 16 nt, Staphylococcus aureus subsp. aureus N315
cagucaguaaaaauac

SEQ ID NO: 2147707 - RNA, 15 nt, Staphylococcus aureus subsp. aureus N315
cagucaguaaaaaua

SEQ ID NO: 2147708 - RNA, 17 nt, Staphylococcus aureus subsp. aureus N315
caggcgcuccuacuuuu

SEQ ID NO: 2147709 - RNA, 22 nt, Staphylococcus aureus subsp. aureus N315
caggagcgagccauuauuauuu

SEQ ID NO: 2147710 - RNA, 14 nt, Staphylococcus aureus subsp. aureus N315
caggaauuguuaaa

SEQ ID NO: 2147711 - RNA, 13 nt, Staphylococcus aureus subsp. aureus N315
caggaauagaugu

SEQ ID NO: 2147712 - RNA, 14 nt, Staphylococcus aureus subsp. aureus N315
cagcuucuuuaaca

SEQ ID NO: 2147713 - RNA, 17 nt, Staphylococcus aureus subsp. aureus N315
cagcuucuuuaacaauu

SEQ ID NO: 2147714 - RNA, 17 nt, Staphylococcus aureus subsp. aureus N315
cagcuguauuuaauaaa

SEQ ID NO: 2147715 - RNA, 14 nt, Staphylococcus aureus subsp. aureus N315
cagcuguauuuaau

SEQ ID NO: 2147716 - RNA, 12 nt, Staphylococcus aureus subsp. aureus N315
cacuuucuacuc

SEQ ID NO: 2147717 - RNA, 19 nt, Staphylococcus aureus subsp. aureus N315
cacuuuaaacaagcaucau

SEQ ID NO: 2147718 - RNA, 16 nt, Staphylococcus aureus subsp. aureus N315
cacuuuauaauuuuug

SEQ ID NO: 2147719 - RNA, 22 nt, Staphylococcus aureus subsp. aureus N315
cacuugguacaccuacaaauau

SEQ ID NO: 2147720 - RNA, 17 nt, Staphylococcus aureus subsp. aureus N315
cacuuggauucaaauga

SEQ ID NO: 2147721 - RNA, 18 nt, Staphylococcus aureus subsp. aureus N315
cacuuggauucaaaugac

SEQ ID NO: 2147722 - RNA, 23 nt, Staphylococcus aureus subsp. aureus N315
cacuuggcuuaggaugaaaauau

SEQ ID NO: 2147723 - RNA, 20 nt, Staphylococcus aureus subsp. aureus N315
cacuuuuucuguaauaauua

SEQ ID NO: 2147724 - RNA, 22 nt, Staphylococcus aureus subsp. aureus N315
cagaaaagcagucgaacaauga

SEQ ID NO: 2147725 - RNA, 14 nt, Staphylococcus aureus subsp. aureus N315
cacuuuucaugaug

SEQ ID NO: 2147726 - RNA, 15 nt, Staphylococcus aureus subsp. aureus N315
cacuuucuacucuga

SEQ ID NO: 2147727 - RNA, 19 nt, Staphylococcus aureus subsp. aureus N315
cacuucgccaagccaucuu

SEQ ID NO: 2147728 - RNA, 23 nt, Staphylococcus aureus subsp. aureus N315
cacuucgccaagccaucuuucuu

SEQ ID NO: 2147729 - RNA, 14 nt, Staphylococcus aureus subsp. aureus N315
cacuucgccaagcc

SEQ ID NO: 2147730 - RNA, 17 nt, Staphylococcus aureus subsp. aureus N315
cacuugaccacuuuugu

SEQ ID NO: 2147731 - RNA, 14 nt, Staphylococcus aureus subsp. aureus N315
cacuucaaaagaaa

SEQ ID NO: 2147732 - RNA, 12 nt, Staphylococcus aureus subsp. aureus N315
cacuuauuauuu

SEQ ID NO: 2147733 - RNA, 13 nt, Staphylococcus aureus subsp. aureus N315
cacuucaaguuau

SEQ ID NO: 2147734 - RNA, 19 nt, Staphylococcus aureus subsp. aureus N315
cacuuacugugaaaauacc

SEQ ID NO: 2147735 - RNA, 21 nt, Staphylococcus aureus subsp. aureus N315
cacuuacugugaaaauaccaa

SEQ ID NO: 2147736 - RNA, 18 nt, Staphylococcus aureus subsp. aureus N315
cacuuauaaacaaaagau

SEQ ID NO: 2147737 - RNA, 18 nt, Staphylococcus aureus subsp. aureus N315
cacuuaugauacugauau

SEQ ID NO: 2147738 - RNA, 17 nt, Staphylococcus aureus subsp. aureus N315
cacuucaguuaaaccuu

SEQ ID NO: 2147739 - RNA, 17 nt, Staphylococcus aureus subsp. aureus N315
cacuuccaucaauccaa

SEQ ID NO: 2147740 - RNA, 18 nt, Staphylococcus aureus subsp. aureus N315
cacuucaucuaaaugaug

SEQ ID NO: 2147741 - RNA, 16 nt, Staphylococcus aureus subsp. aureus N315
cacuuacugugaaaau

SEQ ID NO: 2147742 - RNA, 17 nt, Staphylococcus aureus subsp. aureus N315
cacuuaauaaauaauuu

SEQ ID NO: 2147743 - RNA, 14 nt, Staphylococcus aureus subsp. aureus N315
cacuuaacucaaag

SEQ ID NO: 2147744 - RNA, 16 nt, Staphylococcus aureus subsp. aureus N315
caauguuaucuugcuu

SEQ ID NO: 2147745 - RNA, 17 nt, Staphylococcus aureus subsp. aureus N315
caaugugagauauaaag

SEQ ID NO: 2147746 - RNA, 13 nt, Staphylococcus aureus subsp. aureus N315
caauguugcuugu

SEQ ID NO: 2147747 - RNA, 13 nt, Staphylococcus aureus subsp. aureus N315
caauguuuuaaau

SEQ ID NO: 2147748 - RNA, 16 nt, Staphylococcus aureus subsp. aureus N315
cacugccaaucauucg

SEQ ID NO: 2147749 - RNA, 14 nt, Staphylococcus aureus subsp. aureus N315
cacugccuuuuugu

SEQ ID NO: 2147750 - RNA, 15 nt, Staphylococcus aureus subsp. aureus N315
cagaauuucaucaaa

SEQ ID NO: 2147751 - RNA, 20 nt, Staphylococcus aureus subsp. aureus N315
cagaaaagggcaaaaaagga

SEQ ID NO: 2147752 - RNA, 18 nt, Staphylococcus aureus subsp. aureus N315
cagaaaagggcaaaaaag

SEQ ID NO: 2147753 - RNA, 14 nt, Staphylococcus aureus subsp. aureus N315
cagaacuaugaaua

SEQ ID NO: 2147754 - RNA, 19 nt, Staphylococcus aureus subsp. aureus N315
cagaacuaugaauagauga

SEQ ID NO: 2147755 - RNA, 21 nt, Staphylococcus aureus subsp. aureus N315
cagaagaaaacuauuuuaaaa

SEQ ID NO: 2147756 - RNA, 19 nt, Staphylococcus aureus subsp. aureus N315
cagagaauuucgaaaagaa

SEQ ID NO: 2147757 - RNA, 23 nt, Staphylococcus aureus subsp. aureus N315
cagagaauuucgaaaagaaauuc

SEQ ID NO: 2147758 - RNA, 16 nt, Staphylococcus aureus subsp. aureus N315
cagagaauuucgaaaa

SEQ ID NO: 2147759 - RNA, 20 nt, Staphylococcus aureus subsp. aureus N315
cagagaaauucgaaaagaaa

SEQ ID NO: 2147760 - RNA, 15 nt, Staphylococcus aureus subsp. aureus N315
cagagaaauucgaaa

SEQ ID NO: 2147761 - RNA, 17 nt, Staphylococcus aureus subsp. aureus N315
cagagccauaaugagag

SEQ ID NO: 2147762 - RNA, 12 nt, Staphylococcus aureus subsp. aureus N315
cagacuccuaaa

SEQ ID NO: 2147763 - RNA, 16 nt, Staphylococcus aureus subsp. aureus N315
cagacguaucaucaaa

SEQ ID NO: 2147764 - RNA, 23 nt, Staphylococcus aureus subsp. aureus N315
cagacgaaacacacuaaaagcug

SEQ ID NO: 2147765 - RNA, 15 nt, Staphylococcus aureus subsp. aureus N315
cagauccauaaggau

SEQ ID NO: 2147766 - RNA, 21 nt, Staphylococcus aureus subsp. aureus N315
cagauaaguaauaauauaaau

SEQ ID NO: 2147767 - RNA, 14 nt, Staphylococcus aureus subsp. aureus N315
cagauaauuauuuc

SEQ ID NO: 2147768 - RNA, 14 nt, Staphylococcus aureus subsp. aureus N315
cagauaauugaaaa

SEQ ID NO: 2147769 - RNA, 16 nt, Staphylococcus aureus subsp. aureus N315
cagauaagaauauuua

SEQ ID NO: 2147770 - RNA, 22 nt, Staphylococcus aureus subsp. aureus N315
cagauagaaugucgauauuucu

SEQ ID NO: 2147771 - RNA, 19 nt, Staphylococcus aureus subsp. aureus N315
cagaggagcucauguuuca

SEQ ID NO: 2147772 - RNA, 11 nt, Staphylococcus aureus subsp. aureus N315
cagcaaauaaa

SEQ ID NO: 2147773 - RNA, 20 nt, Staphylococcus aureus subsp. aureus N315
cagcaaaugcuuaagaaauu

SEQ ID NO: 2147774 - RNA, 14 nt, Staphylococcus aureus subsp. aureus N315
cagcacauuuuuag

SEQ ID NO: 2147775 - RNA, 21 nt, Staphylococcus aureus subsp. aureus N315
cagauuuuaaaaauucauaau

SEQ ID NO: 2147776 - RNA, 21 nt, Staphylococcus aureus subsp. aureus N315
cagauuuuaagugguuaucac

SEQ ID NO: 2147777 - RNA, 14 nt, Staphylococcus aureus subsp. aureus N315
cagauguugguuca

SEQ ID NO: 2147778 - RNA, 17 nt, Staphylococcus aureus subsp. aureus N315
cagauucauaucuuuca

SEQ ID NO: 2147779 - RNA, 22 nt, Staphylococcus aureus subsp. aureus N315
cagauucauaucuuucaauuaa

SEQ ID NO: 2147780 - RNA, 15 nt, Staphylococcus aureus subsp. aureus N315
cagauucuucaccaa

SEQ ID NO: 2147781 - RNA, 14 nt, Staphylococcus aureus subsp. aureus N315
cagauugauauaaa

SEQ ID NO: 2147782 - RNA, 22 nt, Staphylococcus aureus subsp. aureus N315
cagauucaaacguuuucacuuc

SEQ ID NO: 2147783 - RNA, 22 nt, Staphylococcus aureus subsp. aureus N315
cagaugaauaauguuuccauuu

SEQ ID NO: 2147784 - RNA, 14 nt, Staphylococcus aureus subsp. aureus N315
cagaugaauaaugu

SEQ ID NO: 2147785 - RNA, 13 nt, Staphylococcus aureus subsp. aureus N315
cagaugaauaaug

SEQ ID NO: 2147786 - RNA, 17 nt, Staphylococcus aureus subsp. aureus N315
cagcauugggacauaaa

SEQ ID NO: 2147787 - RNA, 14 nt, Staphylococcus aureus subsp. aureus N315
cagcaguaagauau

SEQ ID NO: 2147788 - RNA, 16 nt, Staphylococcus aureus subsp. aureus N315
cagcaguugcacaaau

SEQ ID NO: 2147789 - RNA, 22 nt, Staphylococcus aureus subsp. aureus N315
cagcaguugacuguaaaacaau

SEQ ID NO: 2147790 - RNA, 19 nt, Staphylococcus aureus subsp. aureus N315
cagcagugaaguuaacuau

SEQ ID NO: 2147791 - RNA, 22 nt, Staphylococcus aureus subsp. aureus N315
cagcaccgacaauuauaauaaa

SEQ ID NO: 2147792 - RNA, 15 nt, Staphylococcus aureus subsp. aureus N315
cagcgaaauuuguaa

SEQ ID NO: 2147793 - RNA, 12 nt, Staphylococcus aureus subsp. aureus N315
cagcgaaauuug

SEQ ID NO: 2147794 - RNA, 17 nt, Staphylococcus aureus subsp. aureus N315
cagcggaauacagauga

SEQ ID NO: 2147795 - RNA, 19 nt, Staphylococcus aureus subsp. aureus N315
cagcggaauacagaugaug

SEQ ID NO: 2147796 - RNA, 18 nt, Staphylococcus aureus subsp. aureus N315
caaccagucagaaagaau

SEQ ID NO: 2147797 - RNA, 16 nt, Staphylococcus aureus subsp. aureus N315
caacagggguaaaacu

SEQ ID NO: 2147798 - RNA, 12 nt, Staphylococcus aureus subsp. aureus N315
caacauguuugg

SEQ ID NO: 2147799 - RNA, 22 nt, Staphylococcus aureus subsp. aureus N315
caacaugauacguacguugaug

SEQ ID NO: 2147800 - RNA, 18 nt, Staphylococcus aureus subsp. aureus N315
caaccaaaaccaaaugaa

SEQ ID NO: 2147801 - RNA, 15 nt, Staphylococcus aureus subsp. aureus N315
caacauuauuuuugu

SEQ ID NO: 2147802 - RNA, 12 nt, Staphylococcus aureus subsp. aureus N315
caacauuacgua

SEQ ID NO: 2147803 - RNA, 17 nt, Staphylococcus aureus subsp. aureus N315
caacauuaauaaauaau

SEQ ID NO: 2147804 - RNA, 15 nt, Staphylococcus aureus subsp. aureus N315
caaccgauauaauua

SEQ ID NO: 2147805 - RNA, 17 nt, Staphylococcus aureus subsp. aureus N315
caacgccauauuuauuu

SEQ ID NO: 2147806 - RNA, 20 nt, Staphylococcus aureus subsp. aureus N315
caacuguaguggaagacaau

SEQ ID NO: 2147807 - RNA, 13 nt, Staphylococcus aureus subsp. aureus N315
caacuuagaauuu

SEQ ID NO: 2147808 - RNA, 13 nt, Staphylococcus aureus subsp. aureus N315
caacuuaauagaa

SEQ ID NO: 2147809 - RNA, 18 nt, Staphylococcus aureus subsp. aureus N315
caacuuaauacgauaaua

SEQ ID NO: 2147810 - RNA, 13 nt, Staphylococcus aureus subsp. aureus N315
caacuuaauaacc

SEQ ID NO: 2147811 - RNA, 11 nt, Staphylococcus aureus subsp. aureus N315
caacuuaauac

SEQ ID NO: 2147812 - RNA, 22 nt, Staphylococcus aureus subsp. aureus N315
caacuuaauaaccauguaaaau

SEQ ID NO: 2147813 - RNA, 16 nt, Staphylococcus aureus subsp. aureus N315
caacugcgacaugucc

SEQ ID NO: 2147814 - RNA, 18 nt, Staphylococcus aureus subsp. aureus N315
caacugcugcuaaaauaa

SEQ ID NO: 2147815 - RNA, 12 nt, Staphylococcus aureus subsp. aureus N315
caacuaagauau

SEQ ID NO: 2147816 - RNA, 16 nt, Staphylococcus aureus subsp. aureus N315
caacuaauaacaaaua

SEQ ID NO: 2147817 - RNA, 18 nt, Staphylococcus aureus subsp. aureus N315
caacuaauguuaaaauaa

SEQ ID NO: 2147818 - RNA, 17 nt, Staphylococcus aureus subsp. aureus N315
caacuaauaacaaauag

SEQ ID NO: 2147819 - RNA, 20 nt, Staphylococcus aureus subsp. aureus N315
caacuaauuuaaagcaucau

SEQ ID NO: 2147820 - RNA, 21 nt, Staphylococcus aureus subsp. aureus N315
caacuacugucaauauaacau

SEQ ID NO: 2147821 - RNA, 19 nt, Staphylococcus aureus subsp. aureus N315
caacuacuuaaauuaagaa

SEQ ID NO: 2147822 - RNA, 22 nt, Staphylococcus aureus subsp. aureus N315
caacuaauuuaaagcaucauau

SEQ ID NO: 2147823 - RNA, 13 nt, Staphylococcus aureus subsp. aureus N315
caacugaaauuuu

SEQ ID NO: 2147824 - RNA, 12 nt, Staphylococcus aureus subsp. aureus N315
caacugagaaau

SEQ ID NO: 2147825 - RNA, 12 nt, Staphylococcus aureus subsp. aureus N315
caacacagagaa

SEQ ID NO: 2147826 - RNA, 16 nt, Staphylococcus aureus subsp. aureus N315
caacacagagaaauuc

SEQ ID NO: 2147827 - RNA, 20 nt, Staphylococcus aureus subsp. aureus N315
caacaauugcuaauccauac

SEQ ID NO: 2147828 - RNA, 15 nt, Staphylococcus aureus subsp. aureus N315
caaauuugaaacaau

SEQ ID NO: 2147829 - RNA, 19 nt, Staphylococcus aureus subsp. aureus N315
caaauuggaaaaauaaaua

SEQ ID NO: 2147830 - RNA, 16 nt, Staphylococcus aureus subsp. aureus N315
caaauugccuuucauu

SEQ ID NO: 2147831 - RNA, 16 nt, Staphylococcus aureus subsp. aureus N315
caacacaaagaauuuc

SEQ ID NO: 2147832 - RNA, 16 nt, Staphylococcus aureus subsp. aureus N315
caacacagagaauuuc

SEQ ID NO: 2147833 - RNA, 22 nt, Staphylococcus aureus subsp. aureus N315
caacacugagaauuucuaauua

SEQ ID NO: 2147834 - RNA, 17 nt, Staphylococcus aureus subsp. aureus N315
caaaugagcguuccauu

SEQ ID NO: 2147835 - RNA, 22 nt, Staphylococcus aureus subsp. aureus N315
caaaucucgucacauauaaaua

SEQ ID NO: 2147836 - RNA, 15 nt, Staphylococcus aureus subsp. aureus N315
caaaugcaauaggau

SEQ ID NO: 2147837 - RNA, 23 nt, Staphylococcus aureus subsp. aureus N315
caaaugccgcuucuaauuuuuca

SEQ ID NO: 2147838 - RNA, 15 nt, Staphylococcus aureus subsp. aureus N315
caaauuacaaauuau

SEQ ID NO: 2147839 - RNA, 15 nt, Staphylococcus aureus subsp. aureus N315
caaauuaucauuaaa

SEQ ID NO: 2147840 - RNA, 14 nt, Staphylococcus aureus subsp. aureus N315
caaauuaguaugac

SEQ ID NO: 2147841 - RNA, 21 nt, Staphylococcus aureus subsp. aureus N315
caaauuagucauccaaagaaa

SEQ ID NO: 2147842 - RNA, 19 nt, Staphylococcus aureus subsp. aureus N315
caaauucuuuuacagcaag

SEQ ID NO: 2147843 - RNA, 19 nt, Staphylococcus aureus subsp. aureus N315
caaauugcaaaguaacaau

SEQ ID NO: 2147844 - RNA, 21 nt, Staphylococcus aureus subsp. aureus N315
caaauauacuugccuucaaau

SEQ ID NO: 2147845 - RNA, 13 nt, Staphylococcus aureus subsp. aureus N315
caaauauacuuuu

SEQ ID NO: 2147846 - RNA, 21 nt, Staphylococcus aureus subsp. aureus N315
caaauauaauguauaaaacag

SEQ ID NO: 2147847 - RNA, 14 nt, Staphylococcus aureus subsp. aureus N315
caaauauaauuuca

SEQ ID NO: 2147848 - RNA, 15 nt, Staphylococcus aureus subsp. aureus N315
caaauauaauuucaa

SEQ ID NO: 2147849 - RNA, 17 nt, Staphylococcus aureus subsp. aureus N315
caaauauaauguauaaa

SEQ ID NO: 2147850 - RNA, 19 nt, Staphylococcus aureus subsp. aureus N315
caaaucggaauaaaauaaa

SEQ ID NO: 2147851 - RNA, 17 nt, Staphylococcus aureus subsp. aureus N315
caaaugacauuuuaaau

SEQ ID NO: 2147852 - RNA, 15 nt, Staphylococcus aureus subsp. aureus N315
caaaugaauggagca

SEQ ID NO: 2147853 - RNA, 21 nt, Staphylococcus aureus subsp. aureus N315
caaaucguuucaugcacuuua

SEQ ID NO: 2147854 - RNA, 23 nt, Staphylococcus aureus subsp. aureus N315
caaaucgauuaauuauaaguagu

SEQ ID NO: 2147855 - RNA, 15 nt, Staphylococcus aureus subsp. aureus N315
caaagacauacaguc

SEQ ID NO: 2147856 - RNA, 15 nt, Staphylococcus aureus subsp. aureus N315
caaagaauuucgaaa

SEQ ID NO: 2147857 - RNA, 20 nt, Staphylococcus aureus subsp. aureus N315
caaagacacggccugcaagu

SEQ ID NO: 2147858 - RNA, 22 nt, Staphylococcus aureus subsp. aureus N315
caaagacauacagucaauacaa

SEQ ID NO: 2147859 - RNA, 19 nt, Staphylococcus aureus subsp. aureus N315
caaagaaacggaaaugacu

SEQ ID NO: 2147860 - RNA, 15 nt, Staphylococcus aureus subsp. aureus N315
caaagaaaucaccag

SEQ ID NO: 2147861 - RNA, 21 nt, Staphylococcus aureus subsp. aureus N315
caaauaguuaagauuuuaacu

SEQ ID NO: 2147862 - RNA, 16 nt, Staphylococcus aureus subsp. aureus N315
caaauacauaaucauu

SEQ ID NO: 2147863 - RNA, 17 nt, Staphylococcus aureus subsp. aureus N315
caaauacaucaauuucu

SEQ ID NO: 2147864 - RNA, 15 nt, Staphylococcus aureus subsp. aureus N315
caaauacaucaauuu

SEQ ID NO: 2147865 - RNA, 18 nt, Staphylococcus aureus subsp. aureus N315
caaauacauaaucauugu

SEQ ID NO: 2147866 - RNA, 21 nt, Staphylococcus aureus subsp. aureus N315
caaauacauaaucauugugua

SEQ ID NO: 2147867 - RNA, 13 nt, Staphylococcus aureus subsp. aureus N315
caaauaauauaaa

SEQ ID NO: 2147868 - RNA, 19 nt, Staphylococcus aureus subsp. aureus N315
caaauaaacacaucuaugu

SEQ ID NO: 2147869 - RNA, 17 nt, Staphylococcus aureus subsp. aureus N315
caaaguagacauugaau

SEQ ID NO: 2147870 - RNA, 16 nt, Staphylococcus aureus subsp. aureus N315
caaaguauauacuaau

SEQ ID NO: 2147871 - RNA, 22 nt, Staphylococcus aureus subsp. aureus N315
caaaguaacaugugcaaguaua

SEQ ID NO: 2147872 - RNA, 16 nt, Staphylococcus aureus subsp. aureus N315
caaagugcaauuauuu

SEQ ID NO: 2147873 - RNA, 19 nt, Staphylococcus aureus subsp. aureus N315
caaaguuuauacuuaauau

SEQ ID NO: 2147874 - RNA, 20 nt, Staphylococcus aureus subsp. aureus N315
caaggaagucaccauauuua

SEQ ID NO: 2147875 - RNA, 14 nt, Staphylococcus aureus subsp. aureus N315
caagcuuuuuucaa

SEQ ID NO: 2147876 - RNA, 21 nt, Staphylococcus aureus subsp. aureus N315
caagguguucgggaauuuuuu

SEQ ID NO: 2147877 - RNA, 19 nt, Staphylococcus aureus subsp. aureus N315
caagguaguuggcugauag

SEQ ID NO: 2147878 - RNA, 14 nt, Staphylococcus aureus subsp. aureus N315
caagcaucaugaaa

SEQ ID NO: 2147879 - RNA, 14 nt, Staphylococcus aureus subsp. aureus N315
caacuucauuaguu

SEQ ID NO: 2147880 - RNA, 19 nt, Staphylococcus aureus subsp. aureus N315
caacuucacgcaaaacaau

SEQ ID NO: 2147881 - RNA, 13 nt, Staphylococcus aureus subsp. aureus N315
caacuuauuauuu

SEQ ID NO: 2147882 - RNA, 15 nt, Staphylococcus aureus subsp. aureus N315
caacuuauucuucac

SEQ ID NO: 2147883 - RNA, 14 nt, Staphylococcus aureus subsp. aureus N315
caauacuacuuaau

SEQ ID NO: 2147884 - RNA, 14 nt, Staphylococcus aureus subsp. aureus N315
caauaauuuuaucu

SEQ ID NO: 2147885 - RNA, 20 nt, Staphylococcus aureus subsp. aureus N315
caauacaaagaauuauguau

SEQ ID NO: 2147886 - RNA, 19 nt, Staphylococcus aureus subsp. aureus N315
caauacagaacuuuaauaa

SEQ ID NO: 2147887 - RNA, 23 nt, Staphylococcus aureus subsp. aureus N315
caauacgaugaugauuuauaaaa

SEQ ID NO: 2147888 - RNA, 12 nt, Staphylococcus aureus subsp. aureus N315
caauaauuuuau

SEQ ID NO: 2147889 - RNA, 15 nt, Staphylococcus aureus subsp. aureus N315
caauaauugaugaaa

SEQ ID NO: 2147890 - RNA, 16 nt, Staphylococcus aureus subsp. aureus N315
caauaguauaaauauc

SEQ ID NO: 2147891 - RNA, 22 nt, Staphylococcus aureus subsp. aureus N315
caauaucuucuuuuaauauuug

SEQ ID NO: 2147892 - RNA, 13 nt, Staphylococcus aureus subsp. aureus N315
caauaucuuuaau

SEQ ID NO: 2147893 - RNA, 19 nt, Staphylococcus aureus subsp. aureus N315
caauauuaaucauaaugaa

SEQ ID NO: 2147894 - RNA, 23 nt, Staphylococcus aureus subsp. aureus N315
caauauuaaucauaaugaauaau

SEQ ID NO: 2147895 - RNA, 16 nt, Staphylococcus aureus subsp. aureus N315
caauauuaaugaauau

SEQ ID NO: 2147896 - RNA, 14 nt, Staphylococcus aureus subsp. aureus N315
caauaucauauuug

SEQ ID NO: 2147897 - RNA, 17 nt, Staphylococcus aureus subsp. aureus N315
caauaacaaugcagcug

SEQ ID NO: 2147898 - RNA, 23 nt, Staphylococcus aureus subsp. aureus N315
caauaaauuucaagguauacaca

SEQ ID NO: 2147899 - RNA, 15 nt, Staphylococcus aureus subsp. aureus N315
caauaaauuuuauau

SEQ ID NO: 2147900 - RNA, 16 nt, Staphylococcus aureus subsp. aureus N315
caauaaauaaacaacu

SEQ ID NO: 2147901 - RNA, 19 nt, Staphylococcus aureus subsp. aureus N315
caauaaaucaguaguuuua

SEQ ID NO: 2147902 - RNA, 23 nt, Staphylococcus aureus subsp. aureus N315
caauaacaggugcuuacuuuuaa

SEQ ID NO: 2147903 - RNA, 13 nt, Staphylococcus aureus subsp. aureus N315
caaguccaaauaa

SEQ ID NO: 2147904 - RNA, 19 nt, Staphylococcus aureus subsp. aureus N315
caauaaaaaaccaagugca

SEQ ID NO: 2147905 - RNA, 19 nt, Staphylococcus aureus subsp. aureus N315
caaguuuucggcuagauuu

SEQ ID NO: 2147906 - RNA, 15 nt, Staphylococcus aureus subsp. aureus N315
caaguuuaaaauacg

SEQ ID NO: 2147907 - RNA, 20 nt, Staphylococcus aureus subsp. aureus N315
caauaaaaugcaauuuuuca

SEQ ID NO: 2147908 - RNA, 21 nt, Staphylococcus aureus subsp. aureus N315
caauaaaauuggaacacgaaa

SEQ ID NO: 2147909 - RNA, 13 nt, Staphylococcus aureus subsp. aureus N315
caauaaaaugcaa

SEQ ID NO: 2147910 - RNA, 14 nt, Staphylococcus aureus subsp. aureus N315
caauggccauuuga

SEQ ID NO: 2147911 - RNA, 18 nt, Staphylococcus aureus subsp. aureus N315
caauggcagaugauuaug

SEQ ID NO: 2147912 - RNA, 20 nt, Staphylococcus aureus subsp. aureus N315
caauggcagaugauuauguu

SEQ ID NO: 2147913 - RNA, 16 nt, Staphylococcus aureus subsp. aureus N315
caaugcgcaaugaaaa

SEQ ID NO: 2147914 - RNA, 18 nt, Staphylococcus aureus subsp. aureus N315
caaugcgguaaaaacucu

SEQ ID NO: 2147915 - RNA, 19 nt, Staphylococcus aureus subsp. aureus N315
caaugcgguaaaaacucuu

SEQ ID NO: 2147916 - RNA, 20 nt, Staphylococcus aureus subsp. aureus N315
caaugaaaacagguggaagu

SEQ ID NO: 2147917 - RNA, 14 nt, Staphylococcus aureus subsp. aureus N315
caaugaauuuacuc

SEQ ID NO: 2147918 - RNA, 17 nt, Staphylococcus aureus subsp. aureus N315
caaugacagcagacuuc

SEQ ID NO: 2147919 - RNA, 17 nt, Staphylococcus aureus subsp. aureus N315
caaugacauccauacaa

SEQ ID NO: 2147920 - RNA, 16 nt, Staphylococcus aureus subsp. aureus N315
caaugaauaaauugau

SEQ ID NO: 2147921 - RNA, 19 nt, Staphylococcus aureus subsp. aureus N315
caaugaauaacaagaaaaa

SEQ ID NO: 2147922 - RNA, 19 nt, Staphylococcus aureus subsp. aureus N315
caaugacugagaaaaauau

SEQ ID NO: 2147923 - RNA, 15 nt, Staphylococcus aureus subsp. aureus N315
caaugacugagaaaa

SEQ ID NO: 2147924 - RNA, 14 nt, Staphylococcus aureus subsp. aureus N315
caaugauuuuauaa

SEQ ID NO: 2147925 - RNA, 20 nt, Staphylococcus aureus subsp. aureus N315
caaugagcaagucuucuaaa

SEQ ID NO: 2147926 - RNA, 13 nt, Staphylococcus aureus subsp. aureus N315
caaugagcaucuu

SEQ ID NO: 2147927 - RNA, 18 nt, Staphylococcus aureus subsp. aureus N315
caaugauuaaaucuucua

SEQ ID NO: 2147928 - RNA, 15 nt, Staphylococcus aureus subsp. aureus N315
caaucauucacuuca

SEQ ID NO: 2147929 - RNA, 12 nt, Staphylococcus aureus subsp. aureus N315
caauauuacuuu

SEQ ID NO: 2147930 - RNA, 16 nt, Staphylococcus aureus subsp. aureus N315
caauauucaauaauuc

SEQ ID NO: 2147931 - RNA, 18 nt, Staphylococcus aureus subsp. aureus N315
caauauucuuaucauuca

SEQ ID NO: 2147932 - RNA, 18 nt, Staphylococcus aureus subsp. aureus N315
caauauucguaaauccuu

SEQ ID NO: 2147933 - RNA, 20 nt, Staphylococcus aureus subsp. aureus N315
caauauuuauauuaaauacu

SEQ ID NO: 2147934 - RNA, 19 nt, Staphylococcus aureus subsp. aureus N315
caauauuuaccacaaauau

SEQ ID NO: 2147935 - RNA, 17 nt, Staphylococcus aureus subsp. aureus N315
caauauuuaucaauaaa

SEQ ID NO: 2147936 - RNA, 14 nt, Staphylococcus aureus subsp. aureus N315
caauauugaacaau

SEQ ID NO: 2147937 - RNA, 15 nt, Staphylococcus aureus subsp. aureus N315
caauauuuuuacaua

SEQ ID NO: 2147938 - RNA, 18 nt, Staphylococcus aureus subsp. aureus N315
caaucaucacacauaaau

SEQ ID NO: 2147939 - RNA, 12 nt, Staphylococcus aureus subsp. aureus N315
caaucauaauac

SEQ ID NO: 2147940 - RNA, 19 nt, Staphylococcus aureus subsp. aureus N315
caaucgcuuuagcaauuga

SEQ ID NO: 2147941 - RNA, 23 nt, Staphylococcus aureus subsp. aureus N315
caaucguuucuuccgcacugccu

SEQ ID NO: 2147942 - RNA, 13 nt, Staphylococcus aureus subsp. aureus N315
caaucguuaauuu

SEQ ID NO: 2147943 - RNA, 21 nt, Staphylococcus aureus subsp. aureus N315
caaucguugaaaaauauccug

SEQ ID NO: 2147944 - RNA, 18 nt, Staphylococcus aureus subsp. aureus N315
caaucguugaaaaauauc

SEQ ID NO: 2147945 - RNA, 23 nt, Staphylococcus aureus subsp. aureus N315
auuuuuuaaaugcguaguauaaa

SEQ ID NO: 2147946 - RNA, 15 nt, Staphylococcus aureus subsp. aureus N315
auuuuuuaauaauca

SEQ ID NO: 2147947 - RNA, 18 nt, Staphylococcus aureus subsp. aureus N315
auuuuuuagacaaauguu

SEQ ID NO: 2147948 - RNA, 17 nt, Staphylococcus aureus subsp. aureus N315
auuuuuuaaugucuaaa

SEQ ID NO: 2147949 - RNA, 21 nt, Staphylococcus aureus subsp. aureus N315
auuuuucuucaguuaaaucuu

SEQ ID NO: 2147950 - RNA, 14 nt, Staphylococcus aureus subsp. aureus N315
auuuuucuuauaaa

SEQ ID NO: 2147951 - RNA, 16 nt, Staphylococcus aureus subsp. aureus N315
auuuuucuuauaaaaa

SEQ ID NO: 2147952 - RNA, 19 nt, Staphylococcus aureus subsp. aureus N315
auuuuugaguaauuuaauc

SEQ ID NO: 2147953 - RNA, 17 nt, Staphylococcus aureus subsp. aureus N315
auuuuugauaacuguaa

SEQ ID NO: 2147954 - RNA, 14 nt, Staphylococcus aureus subsp. aureus N315
auuuuugauuuaau

SEQ ID NO: 2147955 - RNA, 17 nt, Staphylococcus aureus subsp. aureus N315
auuuuugauuuaauaau

SEQ ID NO: 2147956 - RNA, 15 nt, Staphylococcus aureus subsp. aureus N315
auuuuuaaauuacua

SEQ ID NO: 2147957 - RNA, 21 nt, Staphylococcus aureus subsp. aureus N315
auuuuuaaaaaccuagggaua

SEQ ID NO: 2147958 - RNA, 19 nt, Staphylococcus aureus subsp. aureus N315
auuuuucuaaaugauuuau

SEQ ID NO: 2147959 - RNA, 22 nt, Staphylococcus aureus subsp. aureus N315
auuuuuccauaguggaauacuu

SEQ ID NO: 2147960 - RNA, 12 nt, Staphylococcus aureus subsp. aureus N315
auuuuuuuaugc

SEQ ID NO: 2147961 - RNA, 18 nt, Staphylococcus aureus subsp. aureus N315
auuuuuuucacuaauuuc

SEQ ID NO: 2147962 - RNA, 21 nt, Staphylococcus aureus subsp. aureus N315
auuuuuuuaaaucuauauaaa

SEQ ID NO: 2147963 - RNA, 12 nt, Staphylococcus aureus subsp. aureus N315
auuuuuugauau

SEQ ID NO: 2147964 - RNA, 14 nt, Staphylococcus aureus subsp. aureus N315
auuuuuugauaugg

SEQ ID NO: 2147965 - RNA, 12 nt, Staphylococcus aureus subsp. aureus N315
auuuuuuuaaag

SEQ ID NO: 2147966 - RNA, 17 nt, Staphylococcus aureus subsp. aureus N315
auuuuuuggucaccaaa

SEQ ID NO: 2147967 - RNA, 20 nt, Staphylococcus aureus subsp. aureus N315
auuuuuuauuccgaacaugu

SEQ ID NO: 2147968 - RNA, 17 nt, Staphylococcus aureus subsp. aureus N315
auuuuuucguuuuaaua

SEQ ID NO: 2147969 - RNA, 21 nt, Staphylococcus aureus subsp. aureus N315
caaaaaaaccgaacaucugaa

SEQ ID NO: 2147970 - RNA, 18 nt, Staphylococcus aureus subsp. aureus N315
auuuuuuuccaagcauca

SEQ ID NO: 2147971 - RNA, 14 nt, Staphylococcus aureus subsp. aureus N315
auuuuuuuccuuuc

SEQ ID NO: 2147972 - RNA, 19 nt, Staphylococcus aureus subsp. aureus N315
auuuuuuugacaguuuuaa

SEQ ID NO: 2147973 - RNA, 20 nt, Staphylococcus aureus subsp. aureus N315
caaaaaaagacacaucacua

SEQ ID NO: 2147974 - RNA, 21 nt, Staphylococcus aureus subsp. aureus N315
caaaaauaauuaugaaaagua

SEQ ID NO: 2147975 - RNA, 17 nt, Staphylococcus aureus subsp. aureus N315
caaaaauagauugaaaa

SEQ ID NO: 2147976 - RNA, 15 nt, Staphylococcus aureus subsp. aureus N315
caaaaauaguaaaac

SEQ ID NO: 2147977 - RNA, 22 nt, Staphylococcus aureus subsp. aureus N315
caaaaauaguaaaaccuguauc

SEQ ID NO: 2147978 - RNA, 17 nt, Staphylococcus aureus subsp. aureus N315
caaaaaucauccauaaa

SEQ ID NO: 2147979 - RNA, 17 nt, Staphylococcus aureus subsp. aureus N315
caaaaauuguaaaaccu

SEQ ID NO: 2147980 - RNA, 20 nt, Staphylococcus aureus subsp. aureus N315
caaaaauugcuauauuagua

SEQ ID NO: 2147981 - RNA, 14 nt, Staphylococcus aureus subsp. aureus N315
caaaaaugaagaau

SEQ ID NO: 2147982 - RNA, 17 nt, Staphylococcus aureus subsp. aureus N315
caaaaacaguuacaacu

SEQ ID NO: 2147983 - RNA, 22 nt, Staphylococcus aureus subsp. aureus N315
caaaaagcccuauuguuuuuua

SEQ ID NO: 2147984 - RNA, 16 nt, Staphylococcus aureus subsp. aureus N315
caaaaacgguaauuuc

SEQ ID NO: 2147985 - RNA, 11 nt, Staphylococcus aureus subsp. aureus N315
caaaaagaauu

SEQ ID NO: 2147986 - RNA, 15 nt, Staphylococcus aureus subsp. aureus N315
caaaaaauaaaucuc

SEQ ID NO: 2147987 - RNA, 15 nt, Staphylococcus aureus subsp. aureus N315
caaaaaauaaaaacu

SEQ ID NO: 2147988 - RNA, 20 nt, Staphylococcus aureus subsp. aureus N315
caaaagauguuucaaaauaa

SEQ ID NO: 2147989 - RNA, 15 nt, Staphylococcus aureus subsp. aureus N315
caaaagaugaaaauc

SEQ ID NO: 2147990 - RNA, 21 nt, Staphylococcus aureus subsp. aureus N315
caaaagauguuucaaaauaau

SEQ ID NO: 2147991 - RNA, 20 nt, Staphylococcus aureus subsp. aureus N315
caaaagaaaguuaauuaugu

SEQ ID NO: 2147992 - RNA, 19 nt, Staphylococcus aureus subsp. aureus N315
caaaacuuuuacuuucuca

SEQ ID NO: 2147993 - RNA, 17 nt, Staphylococcus aureus subsp. aureus N315
caaaaccgcuauaaaau

SEQ ID NO: 2147994 - RNA, 20 nt, Staphylococcus aureus subsp. aureus N315
caaaaccgcuauaaaauuuu

SEQ ID NO: 2147995 - RNA, 19 nt, Staphylococcus aureus subsp. aureus N315
caaaacaaaaaauaucuuu

SEQ ID NO: 2147996 - RNA, 21 nt, Staphylococcus aureus subsp. aureus N315
caaaacaauuuaaaaagcagu

SEQ ID NO: 2147997 - RNA, 11 nt, Staphylococcus aureus subsp. aureus N315
caaaacaaauc

SEQ ID NO: 2147998 - RNA, 13 nt, Staphylococcus aureus subsp. aureus N315
caaaacaaaaaau

SEQ ID NO: 2147999 - RNA, 14 nt, Staphylococcus aureus subsp. aureus N315
caaaacaaaaaaua

SEQ ID NO: 2148000 - RNA, 23 nt, Staphylococcus aureus subsp. aureus N315
caaaacaaaaaauaucuuuuugu

SEQ ID NO: 2148001 - RNA, 13 nt, Staphylococcus aureus subsp. aureus N315
caaaacauuuugu

SEQ ID NO: 2148002 - RNA, 19 nt, Staphylococcus aureus subsp. aureus N315
caaaacauauucaguauau

SEQ ID NO: 2148003 - RNA, 16 nt, Staphylococcus aureus subsp. aureus N315
auuugcgauuucuucu

SEQ ID NO: 2148004 - RNA, 21 nt, Staphylococcus aureus subsp. aureus N315
auuugccccgccauucauaaa

SEQ ID NO: 2148005 - RNA, 16 nt, Staphylococcus aureus subsp. aureus N315
auuugauuauucuuca

SEQ ID NO: 2148006 - RNA, 19 nt, Staphylococcus aureus subsp. aureus N315
auuugauucauuacauguu

SEQ ID NO: 2148007 - RNA, 17 nt, Staphylococcus aureus subsp. aureus N315
auuugaugaucccaaaa

SEQ ID NO: 2148008 - RNA, 15 nt, Staphylococcus aureus subsp. aureus N315
auuugauucuauuuc

SEQ ID NO: 2148009 - RNA, 12 nt, Staphylococcus aureus subsp. aureus N315
auuugaucaacc

SEQ ID NO: 2148010 - RNA, 21 nt, Staphylococcus aureus subsp. aureus N315
auuugaucaaccuguucuuua

SEQ ID NO: 2148011 - RNA, 22 nt, Staphylococcus aureus subsp. aureus N315
auuugauacaacuauauguguc

SEQ ID NO: 2148012 - RNA, 19 nt, Staphylococcus aureus subsp. aureus N315
auuugauauaguuauaugu

SEQ ID NO: 2148013 - RNA, 13 nt, Staphylococcus aureus subsp. aureus N315
auuugauacaacu

SEQ ID NO: 2148014 - RNA, 16 nt, Staphylococcus aureus subsp. aureus N315
auuugauaaauaaaau

SEQ ID NO: 2148015 - RNA, 15 nt, Staphylococcus aureus subsp. aureus N315
auuuggcguaaugau

SEQ ID NO: 2148016 - RNA, 20 nt, Staphylococcus aureus subsp. aureus N315
auuugggucguuagaugaau

SEQ ID NO: 2148017 - RNA, 16 nt, Staphylococcus aureus subsp. aureus N315
auuuggguaauguuuu

SEQ ID NO: 2148018 - RNA, 21 nt, Staphylococcus aureus subsp. aureus N315
auuuggaugguaaguauaauu

SEQ ID NO: 2148019 - RNA, 20 nt, Staphylococcus aureus subsp. aureus N315
auuugcucgugaaaagcagu

SEQ ID NO: 2148020 - RNA, 21 nt, Staphylococcus aureus subsp. aureus N315
auuuguucaaugauuuuauaa

SEQ ID NO: 2148021 - RNA, 23 nt, Staphylococcus aureus subsp. aureus N315
auuuguguuuuuaauguuugcuu

SEQ ID NO: 2148022 - RNA, 14 nt, Staphylococcus aureus subsp. aureus N315
auuuguuaaauuca

SEQ ID NO: 2148023 - RNA, 14 nt, Staphylococcus aureus subsp. aureus N315
auuuguuauaccug

SEQ ID NO: 2148024 - RNA, 20 nt, Staphylococcus aureus subsp. aureus N315
auuuuaaaccguuauauauu

SEQ ID NO: 2148025 - RNA, 13 nt, Staphylococcus aureus subsp. aureus N315
auuuguugauagu

SEQ ID NO: 2148026 - RNA, 19 nt, Staphylococcus aureus subsp. aureus N315
auuuguguauaaaugucau

SEQ ID NO: 2148027 - RNA, 14 nt, Staphylococcus aureus subsp. aureus N315
auuuguauuuaaaa

SEQ ID NO: 2148028 - RNA, 16 nt, Staphylococcus aureus subsp. aureus N315
auuuguccauccauuu

SEQ ID NO: 2148029 - RNA, 17 nt, Staphylococcus aureus subsp. aureus N315
auuuguccauccauuuu

SEQ ID NO: 2148030 - RNA, 19 nt, Staphylococcus aureus subsp. aureus N315
auuugucaucguauuucua

SEQ ID NO: 2148031 - RNA, 17 nt, Staphylococcus aureus subsp. aureus N315
auuuguaguaaguagaa

SEQ ID NO: 2148032 - RNA, 19 nt, Staphylococcus aureus subsp. aureus N315
auuuggucauagaaauuuu

SEQ ID NO: 2148033 - RNA, 17 nt, Staphylococcus aureus subsp. aureus N315
auuuguauagauuguau

SEQ ID NO: 2148034 - RNA, 16 nt, Staphylococcus aureus subsp. aureus N315
auuugaacaucauuua

SEQ ID NO: 2148035 - RNA, 16 nt, Staphylococcus aureus subsp. aureus N315
auuugaaagacauuua

SEQ ID NO: 2148036 - RNA, 18 nt, Staphylococcus aureus subsp. aureus N315
auuucuucauuaucaaua

SEQ ID NO: 2148037 - RNA, 20 nt, Staphylococcus aureus subsp. aureus N315
auuucucguuucgucagauu

SEQ ID NO: 2148038 - RNA, 13 nt, Staphylococcus aureus subsp. aureus N315
auuucuaaauuau

SEQ ID NO: 2148039 - RNA, 21 nt, Staphylococcus aureus subsp. aureus N315
auuucaugugcaagcuuuuua

SEQ ID NO: 2148040 - RNA, 20 nt, Staphylococcus aureus subsp. aureus N315
auuucguggaccuauuguau

SEQ ID NO: 2148041 - RNA, 15 nt, Staphylococcus aureus subsp. aureus N315
auuucaugauguuaa

SEQ ID NO: 2148042 - RNA, 15 nt, Staphylococcus aureus subsp. aureus N315
auuuuccguguuuau

SEQ ID NO: 2148043 - RNA, 17 nt, Staphylococcus aureus subsp. aureus N315
auuuucuggccacuaau

SEQ ID NO: 2148044 - RNA, 20 nt, Staphylococcus aureus subsp. aureus N315
auuuucuucaccaguuucug

SEQ ID NO: 2148045 - RNA, 17 nt, Staphylococcus aureus subsp. aureus N315
auuuucuguccaaaaag

SEQ ID NO: 2148046 - RNA, 14 nt, Staphylococcus aureus subsp. aureus N315
auuuucuguccaaa

SEQ ID NO: 2148047 - RNA, 14 nt, Staphylococcus aureus subsp. aureus N315
auuuuguacauuuc

SEQ ID NO: 2148048 - RNA, 15 nt, Staphylococcus aureus subsp. aureus N315
auuuuguacauuucu

SEQ ID NO: 2148049 - RNA, 15 nt, Staphylococcus aureus subsp. aureus N315
auuuugugaauuuau

SEQ ID NO: 2148050 - RNA, 19 nt, Staphylococcus aureus subsp. aureus N315
auuuugucuuuuauauuuu

SEQ ID NO: 2148051 - RNA, 17 nt, Staphylococcus aureus subsp. aureus N315
auuuugucuuuuauauu

SEQ ID NO: 2148052 - RNA, 16 nt, Staphylococcus aureus subsp. aureus N315
auuuuguauuagcauc

SEQ ID NO: 2148053 - RNA, 14 nt, Staphylococcus aureus subsp. aureus N315
auuuuguauuuuuc

SEQ ID NO: 2148054 - RNA, 23 nt, Staphylococcus aureus subsp. aureus N315
auuuuguauuuuucaaauaaaga

SEQ ID NO: 2148055 - RNA, 18 nt, Staphylococcus aureus subsp. aureus N315
auuuuguuucaacauuuc

SEQ ID NO: 2148056 - RNA, 23 nt, Staphylococcus aureus subsp. aureus N315
auuuuguucaguuaaaucuguau

SEQ ID NO: 2148057 - RNA, 15 nt, Staphylococcus aureus subsp. aureus N315
auuuuguuuuaaaaa

SEQ ID NO: 2148058 - RNA, 23 nt, Staphylococcus aureus subsp. aureus N315
auuuuguuaauaagcgcaucccu

SEQ ID NO: 2148059 - RNA, 14 nt, Staphylococcus aureus subsp. aureus N315
auuuuguucaguua

SEQ ID NO: 2148060 - RNA, 15 nt, Staphylococcus aureus subsp. aureus N315
auuuuaacuuauaua

SEQ ID NO: 2148061 - RNA, 13 nt, Staphylococcus aureus subsp. aureus N315
auuuuaacuuaua

SEQ ID NO: 2148062 - RNA, 20 nt, Staphylococcus aureus subsp. aureus N315
auuuuaaaucuaauuauuca

SEQ ID NO: 2148063 - RNA, 13 nt, Staphylococcus aureus subsp. aureus N315
auuuuaaauuaca

SEQ ID NO: 2148064 - RNA, 17 nt, Staphylococcus aureus subsp. aureus N315
auuuuaaauaaaaugca

SEQ ID NO: 2148065 - RNA, 18 nt, Staphylococcus aureus subsp. aureus N315
auuuuaaauaaaaugcau

SEQ ID NO: 2148066 - RNA, 15 nt, Staphylococcus aureus subsp. aureus N315
auuuuaauauuaugu

SEQ ID NO: 2148067 - RNA, 21 nt, Staphylococcus aureus subsp. aureus N315
auuuuaauauugaaaugagcu

SEQ ID NO: 2148068 - RNA, 20 nt, Staphylococcus aureus subsp. aureus N315
auuuuaauauugacauuuac

SEQ ID NO: 2148069 - RNA, 16 nt, Staphylococcus aureus subsp. aureus N315
auuuuaaucuauccuu

SEQ ID NO: 2148070 - RNA, 14 nt, Staphylococcus aureus subsp. aureus N315
auuuucaauuagaa

SEQ ID NO: 2148071 - RNA, 17 nt, Staphylococcus aureus subsp. aureus N315
auuuucacuaauauuuc

SEQ ID NO: 2148072 - RNA, 13 nt, Staphylococcus aureus subsp. aureus N315
auuuuauuauuaa

SEQ ID NO: 2148073 - RNA, 15 nt, Staphylococcus aureus subsp. aureus N315
auuuuauuuaaaaau

SEQ ID NO: 2148074 - RNA, 13 nt, Staphylococcus aureus subsp. aureus N315
auuuucaauacuu

SEQ ID NO: 2148075 - RNA, 18 nt, Staphylococcus aureus subsp. aureus N315
auuuuaugauuugauuug

SEQ ID NO: 2148076 - RNA, 12 nt, Staphylococcus aureus subsp. aureus N315
auuuuaugauuu

SEQ ID NO: 2148077 - RNA, 15 nt, Staphylococcus aureus subsp. aureus N315
auuuuaugauuugau

SEQ ID NO: 2148078 - RNA, 19 nt, Staphylococcus aureus subsp. aureus N315
auuuaacauguauuuagua

SEQ ID NO: 2148079 - RNA, 14 nt, Staphylococcus aureus subsp. aureus N315
auuuaacaaaauua

SEQ ID NO: 2148080 - RNA, 21 nt, Staphylococcus aureus subsp. aureus N315
auuuaacgucuaccucuagga

SEQ ID NO: 2148081 - RNA, 16 nt, Staphylococcus aureus subsp. aureus N315
auuuaacggaaauaca

SEQ ID NO: 2148082 - RNA, 23 nt, Staphylococcus aureus subsp. aureus N315
auuuaacggaaauacaaugaauu

SEQ ID NO: 2148083 - RNA, 13 nt, Staphylococcus aureus subsp. aureus N315
auuuaaaugucuu

SEQ ID NO: 2148084 - RNA, 21 nt, Staphylococcus aureus subsp. aureus N315
auuuaaaugucuuucaaauac

SEQ ID NO: 2148085 - RNA, 13 nt, Staphylococcus aureus subsp. aureus N315
auuuaaauuuuca

SEQ ID NO: 2148086 - RNA, 17 nt, Staphylococcus aureus subsp. aureus N315
auuuaaagucuucaucu

SEQ ID NO: 2148087 - RNA, 15 nt, Staphylococcus aureus subsp. aureus N315
auuuaaauaacaagu

SEQ ID NO: 2148088 - RNA, 14 nt, Staphylococcus aureus subsp. aureus N315
auuuaaagcaucau

SEQ ID NO: 2148089 - RNA, 17 nt, Staphylococcus aureus subsp. aureus N315
auuuaaagaacuauuuu

SEQ ID NO: 2148090 - RNA, 15 nt, Staphylococcus aureus subsp. aureus N315
auuguuuguuuuuau

SEQ ID NO: 2148091 - RNA, 16 nt, Staphylococcus aureus subsp. aureus N315
auuguuuguagaaauu

SEQ ID NO: 2148092 - RNA, 21 nt, Staphylococcus aureus subsp. aureus N315
auuguuuguagaaauuaggaa

SEQ ID NO: 2148093 - RNA, 19 nt, Staphylococcus aureus subsp. aureus N315
auuguuagauaaucucauu

SEQ ID NO: 2148094 - RNA, 18 nt, Staphylococcus aureus subsp. aureus N315
auuguuauccaaaacauu

SEQ ID NO: 2148095 - RNA, 19 nt, Staphylococcus aureus subsp. aureus N315
auuguuaaacccucauuuu

SEQ ID NO: 2148096 - RNA, 16 nt, Staphylococcus aureus subsp. aureus N315
auuguuacuuuaacuu

SEQ ID NO: 2148097 - RNA, 22 nt, Staphylococcus aureus subsp. aureus N315
auuguuaaacuagaaaacauaa

SEQ ID NO: 2148098 - RNA, 16 nt, Staphylococcus aureus subsp. aureus N315
auuguuaaaucaccaa

SEQ ID NO: 2148099 - RNA, 18 nt, Staphylococcus aureus subsp. aureus N315
auuguugcaaugauuaau

SEQ ID NO: 2148100 - RNA, 21 nt, Staphylococcus aureus subsp. aureus N315
auuguugcuaaucucagauuu

SEQ ID NO: 2148101 - RNA, 18 nt, Staphylococcus aureus subsp. aureus N315
auuguuuaauaacaaaau

SEQ ID NO: 2148102 - RNA, 20 nt, Staphylococcus aureus subsp. aureus N315
auuguuuaauaacaaaauua

SEQ ID NO: 2148103 - RNA, 17 nt, Staphylococcus aureus subsp. aureus N315
auuguuuagucuucuuu

SEQ ID NO: 2148104 - RNA, 18 nt, Staphylococcus aureus subsp. aureus N315
auuguauagaauguguau

SEQ ID NO: 2148105 - RNA, 21 nt, Staphylococcus aureus subsp. aureus N315
auuguacgcuucaauuauuuc

SEQ ID NO: 2148106 - RNA, 16 nt, Staphylococcus aureus subsp. aureus N315
auuguaaucuauuuuc

SEQ ID NO: 2148107 - RNA, 23 nt, Staphylococcus aureus subsp. aureus N315
auuguaauaauaaucuuuaacau

SEQ ID NO: 2148108 - RNA, 15 nt, Staphylococcus aureus subsp. aureus N315
auuguaccaguaaca

SEQ ID NO: 2148109 - RNA, 19 nt, Staphylococcus aureus subsp. aureus N315
auuguaccaguaacaauaa

SEQ ID NO: 2148110 - RNA, 17 nt, Staphylococcus aureus subsp. aureus N315
auuguauuauccucaaa

SEQ ID NO: 2148111 - RNA, 16 nt, Staphylococcus aureus subsp. aureus N315
auuguaucuugucauu

SEQ ID NO: 2148112 - RNA, 20 nt, Staphylococcus aureus subsp. aureus N315
auuguauuguuuucaucaug

SEQ ID NO: 2148113 - RNA, 22 nt, Staphylococcus aureus subsp. aureus N315
auuguauuguuuucaucaugca

SEQ ID NO: 2148114 - RNA, 18 nt, Staphylococcus aureus subsp. aureus N315
auuguauguugaaaguga

SEQ ID NO: 2148115 - RNA, 15 nt, Staphylococcus aureus subsp. aureus N315
auuguaugaauaaua

SEQ ID NO: 2148116 - RNA, 13 nt, Staphylococcus aureus subsp. aureus N315
auuguauuuuaau

SEQ ID NO: 2148117 - RNA, 22 nt, Staphylococcus aureus subsp. aureus N315
auuggguggucguaauuugguc

SEQ ID NO: 2148118 - RNA, 16 nt, Staphylococcus aureus subsp. aureus N315
auugguugauuaguuu

SEQ ID NO: 2148119 - RNA, 16 nt, Staphylococcus aureus subsp. aureus N315
auugguuuuuagugaa

SEQ ID NO: 2148120 - RNA, 17 nt, Staphylococcus aureus subsp. aureus N315
auugguuuggauaaaau

SEQ ID NO: 2148121 - RNA, 18 nt, Staphylococcus aureus subsp. aureus N315
auugguuuucauguguca

SEQ ID NO: 2148122 - RNA, 21 nt, Staphylococcus aureus subsp. aureus N315
auuguaaaaacguucaaucgu

SEQ ID NO: 2148123 - RNA, 13 nt, Staphylococcus aureus subsp. aureus N315
auuguaaaaugua

SEQ ID NO: 2148124 - RNA, 18 nt, Staphylococcus aureus subsp. aureus N315
auuguaaaaauacauaau

SEQ ID NO: 2148125 - RNA, 13 nt, Staphylococcus aureus subsp. aureus N315
auuguaaauaaaa

SEQ ID NO: 2148126 - RNA, 14 nt, Staphylococcus aureus subsp. aureus N315
auuguaaauauagu

SEQ ID NO: 2148127 - RNA, 13 nt, Staphylococcus aureus subsp. aureus N315
auuguaaucuauu

SEQ ID NO: 2148128 - RNA, 22 nt, Staphylococcus aureus subsp. aureus N315
auuguaagucgaaaguacccag

SEQ ID NO: 2148129 - RNA, 18 nt, Staphylococcus aureus subsp. aureus N315
auugucgacuuuuagauu

SEQ ID NO: 2148130 - RNA, 20 nt, Staphylococcus aureus subsp. aureus N315
auugucuagguuagaauuau

SEQ ID NO: 2148131 - RNA, 11 nt, Staphylococcus aureus subsp. aureus N315
auugucuuaau

SEQ ID NO: 2148132 - RNA, 19 nt, Staphylococcus aureus subsp. aureus N315
auugucucaucauuuaaaa

SEQ ID NO: 2148133 - RNA, 23 nt, Staphylococcus aureus subsp. aureus N315
auugucucaucauuuaaaauuug

SEQ ID NO: 2148134 - RNA, 22 nt, Staphylococcus aureus subsp. aureus N315
auuguccguuuauagauaggua

SEQ ID NO: 2148135 - RNA, 12 nt, Staphylococcus aureus subsp. aureus N315
auugucaucaug

SEQ ID NO: 2148136 - RNA, 14 nt, Staphylococcus aureus subsp. aureus N315
auugucuuauaaga

SEQ ID NO: 2148137 - RNA, 18 nt, Staphylococcus aureus subsp. aureus N315
auuguguccauaaauauu

SEQ ID NO: 2148138 - RNA, 20 nt, Staphylococcus aureus subsp. aureus N315
auuguguaaugagauuauuc

SEQ ID NO: 2148139 - RNA, 13 nt, Staphylococcus aureus subsp. aureus N315
auuuaauaaugcu

SEQ ID NO: 2148140 - RNA, 21 nt, Staphylococcus aureus subsp. aureus N315
auuuaauacaauucaagacca

SEQ ID NO: 2148141 - RNA, 20 nt, Staphylococcus aureus subsp. aureus N315
auuuaauaaguuaauguaau

SEQ ID NO: 2148142 - RNA, 15 nt, Staphylococcus aureus subsp. aureus N315
auuuaauaaguuaau

SEQ ID NO: 2148143 - RNA, 21 nt, Staphylococcus aureus subsp. aureus N315
auuuaauacuauaguaagaaa

SEQ ID NO: 2148144 - RNA, 23 nt, Staphylococcus aureus subsp. aureus N315
auuuaauaucacgaucuuuaaag

SEQ ID NO: 2148145 - RNA, 12 nt, Staphylococcus aureus subsp. aureus N315
auuuagaauaag

SEQ ID NO: 2148146 - RNA, 14 nt, Staphylococcus aureus subsp. aureus N315
auuuaauccuucuc

SEQ ID NO: 2148147 - RNA, 23 nt, Staphylococcus aureus subsp. aureus N315
auuuaaucuauuaacugaccuaa

SEQ ID NO: 2148148 - RNA, 15 nt, Staphylococcus aureus subsp. aureus N315
auuuagauaaaaauu

SEQ ID NO: 2148149 - RNA, 17 nt, Staphylococcus aureus subsp. aureus N315
auuuagaugauucuuau

SEQ ID NO: 2148150 - RNA, 22 nt, Staphylococcus aureus subsp. aureus N315
auuuagaugcauaaaaaaagaa

SEQ ID NO: 2148151 - RNA, 20 nt, Staphylococcus aureus subsp. aureus N315
auuuagaauucuaaaagaau

SEQ ID NO: 2148152 - RNA, 19 nt, Staphylococcus aureus subsp. aureus N315
auuuagaauucuaaaagaa

SEQ ID NO: 2148153 - RNA, 23 nt, Staphylococcus aureus subsp. aureus N315
auuuagacucuccuuuuuuaaag

SEQ ID NO: 2148154 - RNA, 14 nt, Staphylococcus aureus subsp. aureus N315
auuuaguauaaaua

SEQ ID NO: 2148155 - RNA, 17 nt, Staphylococcus aureus subsp. aureus N315
auuuaguacauagaccu

SEQ ID NO: 2148156 - RNA, 15 nt, Staphylococcus aureus subsp. aureus N315
auuuagucauuacaa

SEQ ID NO: 2148157 - RNA, 15 nt, Staphylococcus aureus subsp. aureus N315
auuuaguuaaauaca

SEQ ID NO: 2148158 - RNA, 16 nt, Staphylococcus aureus subsp. aureus N315
auuuaguuaaguauuu

SEQ ID NO: 2148159 - RNA, 22 nt, Staphylococcus aureus subsp. aureus N315
auuuagugaaacaauuuguaac

SEQ ID NO: 2148160 - RNA, 18 nt, Staphylococcus aureus subsp. aureus N315
auuuagucauuacaaauc

SEQ ID NO: 2148161 - RNA, 13 nt, Staphylococcus aureus subsp. aureus N315
auuuaguuuuuuu

SEQ ID NO: 2148162 - RNA, 16 nt, Staphylococcus aureus subsp. aureus N315
auuuaguuuuuuuaaa

SEQ ID NO: 2148163 - RNA, 17 nt, Staphylococcus aureus subsp. aureus N315
auuuaguuagcccuauu

SEQ ID NO: 2148164 - RNA, 13 nt, Staphylococcus aureus subsp. aureus N315
auuuaguuaaaua

SEQ ID NO: 2148165 - RNA, 20 nt, Staphylococcus aureus subsp. aureus N315
auuuaguuuuuuuaaaguuu

SEQ ID NO: 2148166 - RNA, 16 nt, Staphylococcus aureus subsp. aureus N315
auuuauacuaaagcac

SEQ ID NO: 2148167 - RNA, 16 nt, Staphylococcus aureus subsp. aureus N315
auuuauacuauaaaua

SEQ ID NO: 2148168 - RNA, 14 nt, Staphylococcus aureus subsp. aureus N315
auuuauacuauaaa

SEQ ID NO: 2148169 - RNA, 15 nt, Staphylococcus aureus subsp. aureus N315
auuuauacuauaaau

SEQ ID NO: 2148170 - RNA, 21 nt, Staphylococcus aureus subsp. aureus N315
auuuauacuugaugaaacuga

SEQ ID NO: 2148171 - RNA, 17 nt, Staphylococcus aureus subsp. aureus N315
auuuaucgccaauuaau

SEQ ID NO: 2148172 - RNA, 15 nt, Staphylococcus aureus subsp. aureus N315
auuuaucgugaagaa

SEQ ID NO: 2148173 - RNA, 19 nt, Staphylococcus aureus subsp. aureus N315
auuuaucgugaagaaaaaa

SEQ ID NO: 2148174 - RNA, 19 nt, Staphylococcus aureus subsp. aureus N315
auuuauacuauaaauacaa

SEQ ID NO: 2148175 - RNA, 23 nt, Staphylococcus aureus subsp. aureus N315
auuuauuucuuuuugucauuaau

SEQ ID NO: 2148176 - RNA, 21 nt, Staphylococcus aureus subsp. aureus N315
auuuauuuauaaaauaaaaug

SEQ ID NO: 2148177 - RNA, 19 nt, Staphylococcus aureus subsp. aureus N315
auuuauuuucaauaaauaa

SEQ ID NO: 2148178 - RNA, 17 nt, Staphylococcus aureus subsp. aureus N315
auuuauuuucuuuggug

SEQ ID NO: 2148179 - RNA, 14 nt, Staphylococcus aureus subsp. aureus N315
auuuauuuugauua

SEQ ID NO: 2148180 - RNA, 15 nt, Staphylococcus aureus subsp. aureus N315
auuucaaaaauagcg

SEQ ID NO: 2148181 - RNA, 15 nt, Staphylococcus aureus subsp. aureus N315
auuucaaaaauagua

SEQ ID NO: 2148182 - RNA, 14 nt, Staphylococcus aureus subsp. aureus N315
auuuauuauuacca

SEQ ID NO: 2148183 - RNA, 23 nt, Staphylococcus aureus subsp. aureus N315
auuuauuaguugugguuguuaau

SEQ ID NO: 2148184 - RNA, 15 nt, Staphylococcus aureus subsp. aureus N315
auuuauuauaaaaua

SEQ ID NO: 2148185 - RNA, 12 nt, Staphylococcus aureus subsp. aureus N315
auuuauuaaaua

SEQ ID NO: 2148186 - RNA, 14 nt, Staphylococcus aureus subsp. aureus N315
auuuauuaaauaua

SEQ ID NO: 2148187 - RNA, 15 nt, Staphylococcus aureus subsp. aureus N315
auuuauuaacucaug

SEQ ID NO: 2148188 - RNA, 21 nt, Staphylococcus aureus subsp. aureus N315
auuuaucuagacucaaggaaa

SEQ ID NO: 2148189 - RNA, 22 nt, Staphylococcus aureus subsp. aureus N315
auuuauuaguugugguuguuaa

SEQ ID NO: 2148190 - RNA, 17 nt, Staphylococcus aureus subsp. aureus N315
auuuauuguuuuuaaaa

SEQ ID NO: 2148191 - RNA, 20 nt, Staphylococcus aureus subsp. aureus N315
auuuauucuaaauauauuuu

SEQ ID NO: 2148192 - RNA, 13 nt, Staphylococcus aureus subsp. aureus N315
auuucaacuuaua

SEQ ID NO: 2148193 - RNA, 16 nt, Staphylococcus aureus subsp. aureus N315
auuucaacaaacauaa

SEQ ID NO: 2148194 - RNA, 22 nt, Staphylococcus aureus subsp. aureus N315
auuucagaacuaugaauagaug

SEQ ID NO: 2148195 - RNA, 20 nt, Staphylococcus aureus subsp. aureus N315
auuucaaugagaagcugucu

SEQ ID NO: 2148196 - RNA, 21 nt, Staphylococcus aureus subsp. aureus N315
auuucagcaccgacaauuaua

SEQ ID NO: 2148197 - RNA, 23 nt, Staphylococcus aureus subsp. aureus N315
auuucagcaccgacaauuauaau

SEQ ID NO: 2148198 - RNA, 13 nt, Staphylococcus aureus subsp. aureus N315
auuucagcaaggu

SEQ ID NO: 2148199 - RNA, 18 nt, Staphylococcus aureus subsp. aureus N315
auugcuguaaccccuugu

SEQ ID NO: 2148200 - RNA, 17 nt, Staphylococcus aureus subsp. aureus N315
auugcucuaagcauuca

SEQ ID NO: 2148201 - RNA, 16 nt, Staphylococcus aureus subsp. aureus N315
auugcgaaaaauaauu

SEQ ID NO: 2148202 - RNA, 21 nt, Staphylococcus aureus subsp. aureus N315
auugcgaaagaaagaaacaua

SEQ ID NO: 2148203 - RNA, 13 nt, Staphylococcus aureus subsp. aureus N315
auugcuaaaaaaa

SEQ ID NO: 2148204 - RNA, 21 nt, Staphylococcus aureus subsp. aureus N315
auugcuugaaauuauuauuua

SEQ ID NO: 2148205 - RNA, 18 nt, Staphylococcus aureus subsp. aureus N315
auugcuuguccucuaaaa

SEQ ID NO: 2148206 - RNA, 21 nt, Staphylococcus aureus subsp. aureus N315
auugcuuguccucuaaaacau

SEQ ID NO: 2148207 - RNA, 13 nt, Staphylococcus aureus subsp. aureus N315
auugggacuuauu

SEQ ID NO: 2148208 - RNA, 20 nt, Staphylococcus aureus subsp. aureus N315
auugggagcaaucaauacaa

SEQ ID NO: 2148209 - RNA, 14 nt, Staphylococcus aureus subsp. aureus N315
auuggcuugcuuca

SEQ ID NO: 2148210 - RNA, 23 nt, Staphylococcus aureus subsp. aureus N315
auuggauuacuuccauugcuucu

SEQ ID NO: 2148211 - RNA, 21 nt, Staphylococcus aureus subsp. aureus N315
auugcaacgcaucacaaaauu

SEQ ID NO: 2148212 - RNA, 19 nt, Staphylococcus aureus subsp. aureus N315
auugcaaugaauaacaaga

SEQ ID NO: 2148213 - RNA, 22 nt, Staphylococcus aureus subsp. aureus N315
auugcaaaacuugcgcaugcuu

SEQ ID NO: 2148214 - RNA, 21 nt, Staphylococcus aureus subsp. aureus N315
auugcaaaaauaauaugaauu

SEQ ID NO: 2148215 - RNA, 15 nt, Staphylococcus aureus subsp. aureus N315
auugcaaaaauaaua

SEQ ID NO: 2148216 - RNA, 22 nt, Staphylococcus aureus subsp. aureus N315
auugauuugggcgcuuuuuaau

SEQ ID NO: 2148217 - RNA, 16 nt, Staphylococcus aureus subsp. aureus N315
auugcaaaaaaacaaa

SEQ ID NO: 2148218 - RNA, 21 nt, Staphylococcus aureus subsp. aureus N315
auugcaaaaaaacaaauauua

SEQ ID NO: 2148219 - RNA, 22 nt, Staphylococcus aureus subsp. aureus N315
auugcaaaaaaacaaauauuag

SEQ ID NO: 2148220 - RNA, 16 nt, Staphylococcus aureus subsp. aureus N315
auugaguugaaaauaa

SEQ ID NO: 2148221 - RNA, 23 nt, Staphylococcus aureus subsp. aureus N315
auugaggauaauuauuaggggag

SEQ ID NO: 2148222 - RNA, 16 nt, Staphylococcus aureus subsp. aureus N315
auugccuaaccuguuu

SEQ ID NO: 2148223 - RNA, 18 nt, Staphylococcus aureus subsp. aureus N315
auugccgguuaaauuauu

SEQ ID NO: 2148224 - RNA, 21 nt, Staphylococcus aureus subsp. aureus N315
auugcacguuugaaugaaccu

SEQ ID NO: 2148225 - RNA, 21 nt, Staphylococcus aureus subsp. aureus N315
auugcacuaugcauaauacca

SEQ ID NO: 2148226 - RNA, 22 nt, Staphylococcus aureus subsp. aureus N315
auugcacuaugcauaauaccaa

SEQ ID NO: 2148227 - RNA, 22 nt, Staphylococcus aureus subsp. aureus N315
auucuucaauuucauuuuugau

SEQ ID NO: 2148228 - RNA, 18 nt, Staphylococcus aureus subsp. aureus N315
auucuucaccaguuugug

SEQ ID NO: 2148229 - RNA, 20 nt, Staphylococcus aureus subsp. aureus N315
auucuucaaccauuuguucu

SEQ ID NO: 2148230 - RNA, 14 nt, Staphylococcus aureus subsp. aureus N315
auucuuuuuaacua

SEQ ID NO: 2148231 - RNA, 16 nt, Staphylococcus aureus subsp. aureus N315
auucuucacuaaaaau

SEQ ID NO: 2148232 - RNA, 22 nt, Staphylococcus aureus subsp. aureus N315
auucuucacuaaaaauauauuu

SEQ ID NO: 2148233 - RNA, 14 nt, Staphylococcus aureus subsp. aureus N315
auucuuauaaaaua

SEQ ID NO: 2148234 - RNA, 17 nt, Staphylococcus aureus subsp. aureus N315
auucuuauauguuuuau

SEQ ID NO: 2148235 - RNA, 19 nt, Staphylococcus aureus subsp. aureus N315
auucuuaucauucauuacu

SEQ ID NO: 2148236 - RNA, 15 nt, Staphylococcus aureus subsp. aureus N315
auucuuaucuuuaau

SEQ ID NO: 2148237 - RNA, 22 nt, Staphylococcus aureus subsp. aureus N315
auucuuaugcggucuaaaugcu

SEQ ID NO: 2148238 - RNA, 14 nt, Staphylococcus aureus subsp. aureus N315
auucuucaaaaaau

SEQ ID NO: 2148239 - RNA, 16 nt, Staphylococcus aureus subsp. aureus N315
auugaaauaauauaaa

SEQ ID NO: 2148240 - RNA, 18 nt, Staphylococcus aureus subsp. aureus N315
auugaaauaauauaaaaa

SEQ ID NO: 2148241 - RNA, 23 nt, Staphylococcus aureus subsp. aureus N315
auugacuuacauuuuaauaaaau

SEQ ID NO: 2148242 - RNA, 17 nt, Staphylococcus aureus subsp. aureus N315
auugagaaauagcaaca

SEQ ID NO: 2148243 - RNA, 22 nt, Staphylococcus aureus subsp. aureus N315
auugacucgaccuuuauaugaa

SEQ ID NO: 2148244 - RNA, 21 nt, Staphylococcus aureus subsp. aureus N315
auugaaucuuuguuauauuuu

SEQ ID NO: 2148245 - RNA, 13 nt, Staphylococcus aureus subsp. aureus N315
auugaaucaaaua

SEQ ID NO: 2148246 - RNA, 14 nt, Staphylococcus aureus subsp. aureus N315
auugaauaaaugaa

SEQ ID NO: 2148247 - RNA, 15 nt, Staphylococcus aureus subsp. aureus N315
auucuuaauuuaagu

SEQ ID NO: 2148248 - RNA, 21 nt, Staphylococcus aureus subsp. aureus N315
auucuuaaaaagcagcaguaa

SEQ ID NO: 2148249 - RNA, 16 nt, Staphylococcus aureus subsp. aureus N315
auucuguguaaauaua

SEQ ID NO: 2148250 - RNA, 17 nt, Staphylococcus aureus subsp. aureus N315
auucuguguaaauauaa

SEQ ID NO: 2148251 - RNA, 14 nt, Staphylococcus aureus subsp. aureus N315
auucucgauuuuuu

SEQ ID NO: 2148252 - RNA, 22 nt, Staphylococcus aureus subsp. aureus N315
auucucuauucacgaaauuacu

SEQ ID NO: 2148253 - RNA, 13 nt, Staphylococcus aureus subsp. aureus N315
auucuauuuuuga

SEQ ID NO: 2148254 - RNA, 13 nt, Staphylococcus aureus subsp. aureus N315
auucuauacuuuu

SEQ ID NO: 2148255 - RNA, 17 nt, Staphylococcus aureus subsp. aureus N315
auucuauaauuuuaauu

SEQ ID NO: 2148256 - RNA, 15 nt, Staphylococcus aureus subsp. aureus N315
auucuauaaauagaa

SEQ ID NO: 2148257 - RNA, 22 nt, Staphylococcus aureus subsp. aureus N315
auucuauaaauagaauuuuuga

SEQ ID NO: 2148258 - RNA, 17 nt, Staphylococcus aureus subsp. aureus N315
augccgccuaauaauaa

SEQ ID NO: 2148259 - RNA, 20 nt, Staphylococcus aureus subsp. aureus N315
augccgcuucuaauuuuuca

SEQ ID NO: 2148260 - RNA, 16 nt, Staphylococcus aureus subsp. aureus N315
augccguaguuuucuc

SEQ ID NO: 2148261 - RNA, 15 nt, Staphylococcus aureus subsp. aureus N315
augccggucauaaca

SEQ ID NO: 2148262 - RNA, 19 nt, Staphylococcus aureus subsp. aureus N315
augccuugucuauuguaaa

SEQ ID NO: 2148263 - RNA, 20 nt, Staphylococcus aureus subsp. aureus N315
augccuuaugucauauacua

SEQ ID NO: 2148264 - RNA, 16 nt, Staphylococcus aureus subsp. aureus N315
augccauuguuaucca

SEQ ID NO: 2148265 - RNA, 23 nt, Staphylococcus aureus subsp. aureus N315
augcccgauaaaaccaccuacca

SEQ ID NO: 2148266 - RNA, 15 nt, Staphylococcus aureus subsp. aureus N315
augcccuuaaagcac

SEQ ID NO: 2148267 - RNA, 20 nt, Staphylococcus aureus subsp. aureus N315
augcccuagguuuauauauc

SEQ ID NO: 2148268 - RNA, 13 nt, Staphylococcus aureus subsp. aureus N315
augcauaaaaaaa

SEQ ID NO: 2148269 - RNA, 22 nt, Staphylococcus aureus subsp. aureus N315
augccaacacguuuuaagccag

SEQ ID NO: 2148270 - RNA, 13 nt, Staphylococcus aureus subsp. aureus N315
augcagcuguauu

SEQ ID NO: 2148271 - RNA, 15 nt, Staphylococcus aureus subsp. aureus N315
augcaguaaaaccaa

SEQ ID NO: 2148272 - RNA, 14 nt, Staphylococcus aureus subsp. aureus N315
augcaauacauuaa

SEQ ID NO: 2148273 - RNA, 12 nt, Staphylococcus aureus subsp. aureus N315
augcaauacauu

SEQ ID NO: 2148274 - RNA, 22 nt, Staphylococcus aureus subsp. aureus N315
augcacaccagccucuauaagu

SEQ ID NO: 2148275 - RNA, 14 nt, Staphylococcus aureus subsp. aureus N315
augauaagaaucau

SEQ ID NO: 2148276 - RNA, 22 nt, Staphylococcus aureus subsp. aureus N315
augauaaagagccacuaaugau

SEQ ID NO: 2148277 - RNA, 19 nt, Staphylococcus aureus subsp. aureus N315
augauaaaaauaaaaccga

SEQ ID NO: 2148278 - RNA, 17 nt, Staphylococcus aureus subsp. aureus N315
augaguugaagcuaauu

SEQ ID NO: 2148279 - RNA, 23 nt, Staphylococcus aureus subsp. aureus N315
augaugaauuguuguacauguau

SEQ ID NO: 2148280 - RNA, 15 nt, Staphylococcus aureus subsp. aureus N315
augaugacaucaaua

SEQ ID NO: 2148281 - RNA, 21 nt, Staphylococcus aureus subsp. aureus N315
augaugaauuguuguacaugu

SEQ ID NO: 2148282 - RNA, 14 nt, Staphylococcus aureus subsp. aureus N315
augaugaauuguug

SEQ ID NO: 2148283 - RNA, 20 nt, Staphylococcus aureus subsp. aureus N315
augaugggaaaucaguaaua

SEQ ID NO: 2148284 - RNA, 16 nt, Staphylococcus aureus subsp. aureus N315
augaugagauaaaauc

SEQ ID NO: 2148285 - RNA, 20 nt, Staphylococcus aureus subsp. aureus N315
augaugauaaaaauaaaacc

SEQ ID NO: 2148286 - RNA, 21 nt, Staphylococcus aureus subsp. aureus N315
augaugcuucuaacugaauua

SEQ ID NO: 2148287 - RNA, 17 nt, Staphylococcus aureus subsp. aureus N315
augcaacuaaaacuauc

SEQ ID NO: 2148288 - RNA, 19 nt, Staphylococcus aureus subsp. aureus N315
augcaacuuauaauauuaa

SEQ ID NO: 2148289 - RNA, 13 nt, Staphylococcus aureus subsp. aureus N315
augcaaacucauu

SEQ ID NO: 2148290 - RNA, 21 nt, Staphylococcus aureus subsp. aureus N315
augauugguauacaguuuuac

SEQ ID NO: 2148291 - RNA, 15 nt, Staphylococcus aureus subsp. aureus N315
augauguuaaaaaau

SEQ ID NO: 2148292 - RNA, 21 nt, Staphylococcus aureus subsp. aureus N315
augauguuaaaaaauauguau

SEQ ID NO: 2148293 - RNA, 21 nt, Staphylococcus aureus subsp. aureus N315
augaugugcaaacgauauguu

SEQ ID NO: 2148294 - RNA, 14 nt, Staphylococcus aureus subsp. aureus N315
augauuuauaaaaa

SEQ ID NO: 2148295 - RNA, 15 nt, Staphylococcus aureus subsp. aureus N315
augauuuauaaaaac

SEQ ID NO: 2148296 - RNA, 16 nt, Staphylococcus aureus subsp. aureus N315
augauuuauaaaaacu

SEQ ID NO: 2148297 - RNA, 15 nt, Staphylococcus aureus subsp. aureus N315
augaaucgauauaau

SEQ ID NO: 2148298 - RNA, 16 nt, Staphylococcus aureus subsp. aureus N315
augaauguuaagacau

SEQ ID NO: 2148299 - RNA, 19 nt, Staphylococcus aureus subsp. aureus N315
augaaugccuaauuuugug

SEQ ID NO: 2148300 - RNA, 17 nt, Staphylococcus aureus subsp. aureus N315
augaaucuagaauauaa

SEQ ID NO: 2148301 - RNA, 19 nt, Staphylococcus aureus subsp. aureus N315
augaauuauuuaaaaugcu

SEQ ID NO: 2148302 - RNA, 16 nt, Staphylococcus aureus subsp. aureus N315
augaauugaguauuaa

SEQ ID NO: 2148303 - RNA, 20 nt, Staphylococcus aureus subsp. aureus N315
augaauugaguauuaaauuu

SEQ ID NO: 2148304 - RNA, 19 nt, Staphylococcus aureus subsp. aureus N315
augaauucauuuuaucuau

SEQ ID NO: 2148305 - RNA, 20 nt, Staphylococcus aureus subsp. aureus N315
augaauuuacuccuuacaau

SEQ ID NO: 2148306 - RNA, 19 nt, Staphylococcus aureus subsp. aureus N315
augaauugucuuaauaugc

SEQ ID NO: 2148307 - RNA, 16 nt, Staphylococcus aureus subsp. aureus N315
augacaucaauaucuu

SEQ ID NO: 2148308 - RNA, 15 nt, Staphylococcus aureus subsp. aureus N315
augacauccauacaa

SEQ ID NO: 2148309 - RNA, 21 nt, Staphylococcus aureus subsp. aureus N315
augacauuuaauacuuuucuc

SEQ ID NO: 2148310 - RNA, 14 nt, Staphylococcus aureus subsp. aureus N315
augaaucagaugau

SEQ ID NO: 2148311 - RNA, 16 nt, Staphylococcus aureus subsp. aureus N315
augaaucaacaauuua

SEQ ID NO: 2148312 - RNA, 13 nt, Staphylococcus aureus subsp. aureus N315
augaaucaauugc

SEQ ID NO: 2148313 - RNA, 22 nt, Staphylococcus aureus subsp. aureus N315
augaaucagaugauuuaauucu

SEQ ID NO: 2148314 - RNA, 20 nt, Staphylococcus aureus subsp. aureus N315
augaaucgauauaaugaagu

SEQ ID NO: 2148315 - RNA, 13 nt, Staphylococcus aureus subsp. aureus N315
augaauagaugau

SEQ ID NO: 2148316 - RNA, 12 nt, Staphylococcus aureus subsp. aureus N315
augaauauauug

SEQ ID NO: 2148317 - RNA, 21 nt, Staphylococcus aureus subsp. aureus N315
augaaggcuuuuuguuuugaa

SEQ ID NO: 2148318 - RNA, 22 nt, Staphylococcus aureus subsp. aureus N315
augaaguaauauauaaaagucg

SEQ ID NO: 2148319 - RNA, 19 nt, Staphylococcus aureus subsp. aureus N315
augaaguaguuucauugcu

SEQ ID NO: 2148320 - RNA, 16 nt, Staphylococcus aureus subsp. aureus N315
augaaguugguuuaga

SEQ ID NO: 2148321 - RNA, 15 nt, Staphylococcus aureus subsp. aureus N315
augaauaauuaaaaa

SEQ ID NO: 2148322 - RNA, 17 nt, Staphylococcus aureus subsp. aureus N315
augaauaauuaaaaaac

SEQ ID NO: 2148323 - RNA, 21 nt, Staphylococcus aureus subsp. aureus N315
augagaguaauguuccauaua

SEQ ID NO: 2148324 - RNA, 21 nt, Staphylococcus aureus subsp. aureus N315
augagacgcauugcaagacuu

SEQ ID NO: 2148325 - RNA, 20 nt, Staphylococcus aureus subsp. aureus N315
augagauuauuuuuuuaaau

SEQ ID NO: 2148326 - RNA, 19 nt, Staphylococcus aureus subsp. aureus N315
augagguucaguagaauug

SEQ ID NO: 2148327 - RNA, 22 nt, Staphylococcus aureus subsp. aureus N315
augacugagaaaaauauuucua

SEQ ID NO: 2148328 - RNA, 16 nt, Staphylococcus aureus subsp. aureus N315
augaccuggaauauug

SEQ ID NO: 2148329 - RNA, 16 nt, Staphylococcus aureus subsp. aureus N315
augacgaacgauagau

SEQ ID NO: 2148330 - RNA, 20 nt, Staphylococcus aureus subsp. aureus N315
augacuguugguuugaucau

SEQ ID NO: 2148331 - RNA, 22 nt, Staphylococcus aureus subsp. aureus N315
augagaagcugucuuacugcug

SEQ ID NO: 2148332 - RNA, 16 nt, Staphylococcus aureus subsp. aureus N315
augacuuuuuauuagu

SEQ ID NO: 2148333 - RNA, 12 nt, Staphylococcus aureus subsp. aureus N315
augagaaauguu

SEQ ID NO: 2148334 - RNA, 17 nt, Staphylococcus aureus subsp. aureus N315
augaaaguaccuaaaau

SEQ ID NO: 2148335 - RNA, 22 nt, Staphylococcus aureus subsp. aureus N315
augaacuucuacaguuggaggu

SEQ ID NO: 2148336 - RNA, 16 nt, Staphylococcus aureus subsp. aureus N315
augaacuuaaugcuuc

SEQ ID NO: 2148337 - RNA, 20 nt, Staphylococcus aureus subsp. aureus N315
augaacuuaaugcuucaaau

SEQ ID NO: 2148338 - RNA, 13 nt, Staphylococcus aureus subsp. aureus N315
augaagauuuugu

SEQ ID NO: 2148339 - RNA, 19 nt, Staphylococcus aureus subsp. aureus N315
augaagaggucuccaauac

SEQ ID NO: 2148340 - RNA, 21 nt, Staphylococcus aureus subsp. aureus N315
augaagaggucuccaauacuu

SEQ ID NO: 2148341 - RNA, 19 nt, Staphylococcus aureus subsp. aureus N315
augaaggcuuuuuguuuug

SEQ ID NO: 2148342 - RNA, 12 nt, Staphylococcus aureus subsp. aureus N315
aucuuuuagcuu

SEQ ID NO: 2148343 - RNA, 19 nt, Staphylococcus aureus subsp. aureus N315
aucuuuugguuuaucuguu

SEQ ID NO: 2148344 - RNA, 21 nt, Staphylococcus aureus subsp. aureus N315
aucuuuugguuuaucuguugu

SEQ ID NO: 2148345 - RNA, 13 nt, Staphylococcus aureus subsp. aureus N315
aucuuuugcuucg

SEQ ID NO: 2148346 - RNA, 13 nt, Staphylococcus aureus subsp. aureus N315
aucuuuuauccaa

SEQ ID NO: 2148347 - RNA, 20 nt, Staphylococcus aureus subsp. aureus N315
aucuuuuccaaaacaaaaau

SEQ ID NO: 2148348 - RNA, 19 nt, Staphylococcus aureus subsp. aureus N315
aucuuuuccauucauaaaa

SEQ ID NO: 2148349 - RNA, 15 nt, Staphylococcus aureus subsp. aureus N315
augaaaccguauuau

SEQ ID NO: 2148350 - RNA, 19 nt, Staphylococcus aureus subsp. aureus N315
augaaaauauagugguggu

SEQ ID NO: 2148351 - RNA, 15 nt, Staphylococcus aureus subsp. aureus N315
aucuucuuuuucuac

SEQ ID NO: 2148352 - RNA, 21 nt, Staphylococcus aureus subsp. aureus N315
aucuucuggauagguaucacu

SEQ ID NO: 2148353 - RNA, 16 nt, Staphylococcus aureus subsp. aureus N315
aucuggcaaauugccu

SEQ ID NO: 2148354 - RNA, 22 nt, Staphylococcus aureus subsp. aureus N315
aucuuucacaauuguauaaugu

SEQ ID NO: 2148355 - RNA, 15 nt, Staphylococcus aureus subsp. aureus N315
aucuuucaaaugcuu

SEQ ID NO: 2148356 - RNA, 20 nt, Staphylococcus aureus subsp. aureus N315
aucuuucaacgcauauucua

SEQ ID NO: 2148357 - RNA, 22 nt, Staphylococcus aureus subsp. aureus N315
aucuuuacgauaaacuaaaaag

SEQ ID NO: 2148358 - RNA, 21 nt, Staphylococcus aureus subsp. aureus N315
aucuuuaauuuucuugccauc

SEQ ID NO: 2148359 - RNA, 20 nt, Staphylococcus aureus subsp. aureus N315
aucuuuaacauuuauucuuu

SEQ ID NO: 2148360 - RNA, 12 nt, Staphylococcus aureus subsp. aureus N315
aucuuuaacucu

SEQ ID NO: 2148361 - RNA, 15 nt, Staphylococcus aureus subsp. aureus N315
aucuugagauuuuca

SEQ ID NO: 2148362 - RNA, 19 nt, Staphylococcus aureus subsp. aureus N315
aucuuguuuucauuuaaaa

SEQ ID NO: 2148363 - RNA, 16 nt, Staphylococcus aureus subsp. aureus N315
aucuuuaaagucaaca

SEQ ID NO: 2148364 - RNA, 17 nt, Staphylococcus aureus subsp. aureus N315
aucuuuaaagaaaauuu

SEQ ID NO: 2148365 - RNA, 17 nt, Staphylococcus aureus subsp. aureus N315
aucgcauguuuguaaau

SEQ ID NO: 2148366 - RNA, 15 nt, Staphylococcus aureus subsp. aureus N315
aucgcauuuaaauau

SEQ ID NO: 2148367 - RNA, 18 nt, Staphylococcus aureus subsp. aureus N315
aucgccuaaaaauaaaau

SEQ ID NO: 2148368 - RNA, 13 nt, Staphylococcus aureus subsp. aureus N315
aucgauaaaaugu

SEQ ID NO: 2148369 - RNA, 21 nt, Staphylococcus aureus subsp. aureus N315
aucgauaaauguauuaaacau

SEQ ID NO: 2148370 - RNA, 16 nt, Staphylococcus aureus subsp. aureus N315
aucgcaaauacauaau

SEQ ID NO: 2148371 - RNA, 14 nt, Staphylococcus aureus subsp. aureus N315
aucagcucuuaaau

SEQ ID NO: 2148372 - RNA, 17 nt, Staphylococcus aureus subsp. aureus N315
aucagcuauaaaaguac

SEQ ID NO: 2148373 - RNA, 18 nt, Staphylococcus aureus subsp. aureus N315
aucagcuaaguuaaauau

SEQ ID NO: 2148374 - RNA, 17 nt, Staphylococcus aureus subsp. aureus N315
aucgaacauaaauaaac

SEQ ID NO: 2148375 - RNA, 14 nt, Staphylococcus aureus subsp. aureus N315
auccuuuuugacuc

SEQ ID NO: 2148376 - RNA, 15 nt, Staphylococcus aureus subsp. aureus N315
aucgguaauuacuug

SEQ ID NO: 2148377 - RNA, 17 nt, Staphylococcus aureus subsp. aureus N315
aucguuaaggaaagcuu

SEQ ID NO: 2148378 - RNA, 14 nt, Staphylococcus aureus subsp. aureus N315
aucguuaaggaaag

SEQ ID NO: 2148379 - RNA, 20 nt, Staphylococcus aureus subsp. aureus N315
aucguguauuauugaaacua

SEQ ID NO: 2148380 - RNA, 23 nt, Staphylococcus aureus subsp. aureus N315
aucguggggugccuuuuacauuu

SEQ ID NO: 2148381 - RNA, 19 nt, Staphylococcus aureus subsp. aureus N315
aucuacagagaaucaauua

SEQ ID NO: 2148382 - RNA, 20 nt, Staphylococcus aureus subsp. aureus N315
aucuacauaauuugaauuag

SEQ ID NO: 2148383 - RNA, 16 nt, Staphylococcus aureus subsp. aureus N315
aucuaaaauaucauca

SEQ ID NO: 2148384 - RNA, 13 nt, Staphylococcus aureus subsp. aureus N315
aucuaaaugauca

SEQ ID NO: 2148385 - RNA, 19 nt, Staphylococcus aureus subsp. aureus N315
aucuacaauauuaaaauua

SEQ ID NO: 2148386 - RNA, 21 nt, Staphylococcus aureus subsp. aureus N315
aucuaaaugcacgagcaacau

SEQ ID NO: 2148387 - RNA, 21 nt, Staphylococcus aureus subsp. aureus N315
aucuaaaugaucuuuguagcc

SEQ ID NO: 2148388 - RNA, 17 nt, Staphylococcus aureus subsp. aureus N315
aucuaaacuauaauaau

SEQ ID NO: 2148389 - RNA, 22 nt, Staphylococcus aureus subsp. aureus N315
aucuaaaaugaguuguucagau

SEQ ID NO: 2148390 - RNA, 14 nt, Staphylococcus aureus subsp. aureus N315
aucguucccauucu

SEQ ID NO: 2148391 - RNA, 22 nt, Staphylococcus aureus subsp. aureus N315
aucguuaauaaaccuacaauau

SEQ ID NO: 2148392 - RNA, 17 nt, Staphylococcus aureus subsp. aureus N315
aucugcaugguuugcug

SEQ ID NO: 2148393 - RNA, 19 nt, Staphylococcus aureus subsp. aureus N315
aucugcaaaugccucuuuc

SEQ ID NO: 2148394 - RNA, 13 nt, Staphylococcus aureus subsp. aureus N315
aucucuuauaagu

SEQ ID NO: 2148395 - RNA, 21 nt, Staphylococcus aureus subsp. aureus N315
aucucuuacguccuaauccca

SEQ ID NO: 2148396 - RNA, 17 nt, Staphylococcus aureus subsp. aureus N315
aucucugcuuuaauaua

SEQ ID NO: 2148397 - RNA, 20 nt, Staphylococcus aureus subsp. aureus N315
aucucuucugucuaaaaaca

SEQ ID NO: 2148398 - RNA, 16 nt, Staphylococcus aureus subsp. aureus N315
aucucggcauuuuuau

SEQ ID NO: 2148399 - RNA, 14 nt, Staphylococcus aureus subsp. aureus N315
aucucuauuuuuua

SEQ ID NO: 2148400 - RNA, 14 nt, Staphylococcus aureus subsp. aureus N315
aucuacuaagugcc

SEQ ID NO: 2148401 - RNA, 21 nt, Staphylococcus aureus subsp. aureus N315
aucuacuuuguucugcuuuuu

SEQ ID NO: 2148402 - RNA, 23 nt, Staphylococcus aureus subsp. aureus N315
aucuacuuccuuacagacaaaca

SEQ ID NO: 2148403 - RNA, 15 nt, Staphylococcus aureus subsp. aureus N315
aucuacucaaauaua

SEQ ID NO: 2148404 - RNA, 18 nt, Staphylococcus aureus subsp. aureus N315
aucuacuauuuguuuuag

SEQ ID NO: 2148405 - RNA, 13 nt, Staphylococcus aureus subsp. aureus N315
aucuauaaauacu

SEQ ID NO: 2148406 - RNA, 14 nt, Staphylococcus aureus subsp. aureus N315
aucuauaaaaagaa

SEQ ID NO: 2148407 - RNA, 15 nt, Staphylococcus aureus subsp. aureus N315
aucuaguuguuuuau

SEQ ID NO: 2148408 - RNA, 14 nt, Staphylococcus aureus subsp. aureus N315
aucuaguacaccuc

SEQ ID NO: 2148409 - RNA, 16 nt, Staphylococcus aureus subsp. aureus N315
aucuagcugcuucugc

SEQ ID NO: 2148410 - RNA, 19 nt, Staphylococcus aureus subsp. aureus N315
aucuagccugaaauagaaa

SEQ ID NO: 2148411 - RNA, 21 nt, Staphylococcus aureus subsp. aureus N315
aucuagccugaaauagaaaug

SEQ ID NO: 2148412 - RNA, 15 nt, Staphylococcus aureus subsp. aureus N315
aucuagaugaaauug

SEQ ID NO: 2148413 - RNA, 14 nt, Staphylococcus aureus subsp. aureus N315
aucuauauaaaaac

SEQ ID NO: 2148414 - RNA, 16 nt, Staphylococcus aureus subsp. aureus N315
aucuauauaaauguuu

SEQ ID NO: 2148415 - RNA, 21 nt, Staphylococcus aureus subsp. aureus N315
aucuauggaaaauguuaucaa

SEQ ID NO: 2148416 - RNA, 18 nt, Staphylococcus aureus subsp. aureus N315
aucuauuauuauguuaua

SEQ ID NO: 2148417 - RNA, 15 nt, Staphylococcus aureus subsp. aureus N315
aucuaugaaauuuuu

SEQ ID NO: 2148418 - RNA, 13 nt, Staphylococcus aureus subsp. aureus N315
aucuaucuugugc

SEQ ID NO: 2148419 - RNA, 18 nt, Staphylococcus aureus subsp. aureus N315
aucuauugugauauauga

SEQ ID NO: 2148420 - RNA, 14 nt, Staphylococcus aureus subsp. aureus N315
aucuauuuaucaua

SEQ ID NO: 2148421 - RNA, 19 nt, Staphylococcus aureus subsp. aureus N315
aucuauuuuaaacucaucc

SEQ ID NO: 2148422 - RNA, 20 nt, Staphylococcus aureus subsp. aureus N315
aucuauuuaucauacuucaa

SEQ ID NO: 2148423 - RNA, 15 nt, Staphylococcus aureus subsp. aureus N315
aucuauuuuuaacua

SEQ ID NO: 2148424 - RNA, 14 nt, Staphylococcus aureus subsp. aureus N315
aucucaaaauuucg

SEQ ID NO: 2148425 - RNA, 19 nt, Staphylococcus aureus subsp. aureus N315
aucucaacagcaaaaaaua

SEQ ID NO: 2148426 - RNA, 20 nt, Staphylococcus aureus subsp. aureus N315
aucucaacagcaaaaaauaa

SEQ ID NO: 2148427 - RNA, 22 nt, Staphylococcus aureus subsp. aureus N315
aucucaacagcaaaaaauaaau

SEQ ID NO: 2148428 - RNA, 20 nt, Staphylococcus aureus subsp. aureus N315
aucucauucuuuaauauaaa

SEQ ID NO: 2148429 - RNA, 21 nt, Staphylococcus aureus subsp. aureus N315
aucucaauccaauuaaauauu

SEQ ID NO: 2148430 - RNA, 14 nt, Staphylococcus aureus subsp. aureus N315
aucucaauccaauu

SEQ ID NO: 2148431 - RNA, 16 nt, Staphylococcus aureus subsp. aureus N315
aucuccauuaaucauu

SEQ ID NO: 2148432 - RNA, 18 nt, Staphylococcus aureus subsp. aureus N315
aucuccauuaaucauuua

SEQ ID NO: 2148433 - RNA, 17 nt, Staphylococcus aureus subsp. aureus N315
auguggguguaccaauu

SEQ ID NO: 2148434 - RNA, 14 nt, Staphylococcus aureus subsp. aureus N315
augugcuuuaucaa

SEQ ID NO: 2148435 - RNA, 17 nt, Staphylococcus aureus subsp. aureus N315
auguggaacaugauuca

SEQ ID NO: 2148436 - RNA, 15 nt, Staphylococcus aureus subsp. aureus N315
augugcuuuaucaac

SEQ ID NO: 2148437 - RNA, 17 nt, Staphylococcus aureus subsp. aureus N315
auguuaacugcaaacuu

SEQ ID NO: 2148438 - RNA, 17 nt, Staphylococcus aureus subsp. aureus N315
auguuaaugucuuaaaa

SEQ ID NO: 2148439 - RNA, 14 nt, Staphylococcus aureus subsp. aureus N315
auguguugugauau

SEQ ID NO: 2148440 - RNA, 17 nt, Staphylococcus aureus subsp. aureus N315
auguguugugauuauaa

SEQ ID NO: 2148441 - RNA, 18 nt, Staphylococcus aureus subsp. aureus N315
auguguuucuagcuuguu

SEQ ID NO: 2148442 - RNA, 20 nt, Staphylococcus aureus subsp. aureus N315
augugcaagugguaaaaaug

SEQ ID NO: 2148443 - RNA, 21 nt, Staphylococcus aureus subsp. aureus N315
augugcaagugguaaaaauga

SEQ ID NO: 2148444 - RNA, 20 nt, Staphylococcus aureus subsp. aureus N315
augugaugcuugaauguuug

SEQ ID NO: 2148445 - RNA, 19 nt, Staphylococcus aureus subsp. aureus N315
augugaacaucuaguuauu

SEQ ID NO: 2148446 - RNA, 23 nt, Staphylococcus aureus subsp. aureus N315
augugaagugcgggggauuauuu

SEQ ID NO: 2148447 - RNA, 21 nt, Staphylococcus aureus subsp. aureus N315
augucuuuuuuuaccuaauug

SEQ ID NO: 2148448 - RNA, 17 nt, Staphylococcus aureus subsp. aureus N315
augugaaaaagcuaauu

SEQ ID NO: 2148449 - RNA, 20 nt, Staphylococcus aureus subsp. aureus N315
augugaaaaagcuaauucuu

SEQ ID NO: 2148450 - RNA, 16 nt, Staphylococcus aureus subsp. aureus N315
augucgauauuucuag

SEQ ID NO: 2148451 - RNA, 16 nt, Staphylococcus aureus subsp. aureus N315
augucgaaaauagcua

SEQ ID NO: 2148452 - RNA, 15 nt, Staphylococcus aureus subsp. aureus N315
augucuuuaauuguc

SEQ ID NO: 2148453 - RNA, 13 nt, Staphylococcus aureus subsp. aureus N315
augucuuucaaau

SEQ ID NO: 2148454 - RNA, 12 nt, Staphylococcus aureus subsp. aureus N315
auguaauuauuu

SEQ ID NO: 2148455 - RNA, 15 nt, Staphylococcus aureus subsp. aureus N315
auguaauagagaagg

SEQ ID NO: 2148456 - RNA, 18 nt, Staphylococcus aureus subsp. aureus N315
auguaauagagaagggag

SEQ ID NO: 2148457 - RNA, 20 nt, Staphylococcus aureus subsp. aureus N315
augucaugucuagauuuuaa

SEQ ID NO: 2148458 - RNA, 23 nt, Staphylococcus aureus subsp. aureus N315
auguauuaauugaauugauuaua

SEQ ID NO: 2148459 - RNA, 23 nt, Staphylococcus aureus subsp. aureus N315
auguccaucuuuuauuaaagaaa

SEQ ID NO: 2148460 - RNA, 17 nt, Staphylococcus aureus subsp. aureus N315
auguaucaagaucaaca

SEQ ID NO: 2148461 - RNA, 22 nt, Staphylococcus aureus subsp. aureus N315
auguauaugaauuuuauaaauu

SEQ ID NO: 2148462 - RNA, 21 nt, Staphylococcus aureus subsp. aureus N315
auguauaugaauuuuauaaau

SEQ ID NO: 2148463 - RNA, 20 nt, Staphylococcus aureus subsp. aureus N315
auguauaaaaccuucaauca

SEQ ID NO: 2148464 - RNA, 22 nt, Staphylococcus aureus subsp. aureus N315
augcgauucucauuuacuugau

SEQ ID NO: 2148465 - RNA, 15 nt, Staphylococcus aureus subsp. aureus N315
augcgauugaugcgu

SEQ ID NO: 2148466 - RNA, 16 nt, Staphylococcus aureus subsp. aureus N315
augcgcaaaagcgcag

SEQ ID NO: 2148467 - RNA, 15 nt, Staphylococcus aureus subsp. aureus N315
augcgcaaugaaaac

SEQ ID NO: 2148468 - RNA, 14 nt, Staphylococcus aureus subsp. aureus N315
auggcauuauugcc

SEQ ID NO: 2148469 - RNA, 19 nt, Staphylococcus aureus subsp. aureus N315
auggcaucuggcaaauugc

SEQ ID NO: 2148470 - RNA, 23 nt, Staphylococcus aureus subsp. aureus N315
auggcaguaguugacugaacgaa

SEQ ID NO: 2148471 - RNA, 13 nt, Staphylococcus aureus subsp. aureus N315
auggcuaauacaa

SEQ ID NO: 2148472 - RNA, 18 nt, Staphylococcus aureus subsp. aureus N315
augguaaguauaauuaaa

SEQ ID NO: 2148473 - RNA, 20 nt, Staphylococcus aureus subsp. aureus N315
augggccccaacaaagagaa

SEQ ID NO: 2148474 - RNA, 22 nt, Staphylococcus aureus subsp. aureus N315
auggugaacuguuaaacucaua

SEQ ID NO: 2148475 - RNA, 15 nt, Staphylococcus aureus subsp. aureus N315
auggucuggaauaaa

SEQ ID NO: 2148476 - RNA, 21 nt, Staphylococcus aureus subsp. aureus N315
auuaacuuacuuuuguaaaaa

SEQ ID NO: 2148477 - RNA, 18 nt, Staphylococcus aureus subsp. aureus N315
auuaacuuaaaauuuaaa

SEQ ID NO: 2148478 - RNA, 19 nt, Staphylococcus aureus subsp. aureus N315
auuaaccuugauuuaauuu

SEQ ID NO: 2148479 - RNA, 16 nt, Staphylococcus aureus subsp. aureus N315
auuaacuugauaucau

SEQ ID NO: 2148480 - RNA, 19 nt, Staphylococcus aureus subsp. aureus N315
auuaagaagaaauacuuga

SEQ ID NO: 2148481 - RNA, 14 nt, Staphylococcus aureus subsp. aureus N315
auuaacauuaucca

SEQ ID NO: 2148482 - RNA, 17 nt, Staphylococcus aureus subsp. aureus N315
auuaacaacaaauauaa

SEQ ID NO: 2148483 - RNA, 16 nt, Staphylococcus aureus subsp. aureus N315
auuaacaacaaauaua

SEQ ID NO: 2148484 - RNA, 21 nt, Staphylococcus aureus subsp. aureus N315
auuaacaccagauaucauaau

SEQ ID NO: 2148485 - RNA, 22 nt, Staphylococcus aureus subsp. aureus N315
auuaacacauucuuauuugaaa

SEQ ID NO: 2148486 - RNA, 17 nt, Staphylococcus aureus subsp. aureus N315
auuaacaauauuaaauu

SEQ ID NO: 2148487 - RNA, 21 nt, Staphylococcus aureus subsp. aureus N315
auuaaauucaucuugcaagua

SEQ ID NO: 2148488 - RNA, 22 nt, Staphylococcus aureus subsp. aureus N315
auuaaauuauauguuuuuauua

SEQ ID NO: 2148489 - RNA, 20 nt, Staphylococcus aureus subsp. aureus N315
auuaaauuauggagcggaag

SEQ ID NO: 2148490 - RNA, 19 nt, Staphylococcus aureus subsp. aureus N315
auuaaauuauauguuuuua

SEQ ID NO: 2148491 - RNA, 22 nt, Staphylococcus aureus subsp. aureus N315
auuaaaugaugcaguaaaacca

SEQ ID NO: 2148492 - RNA, 20 nt, Staphylococcus aureus subsp. aureus N315
auuaaaucuucuaguaauuc

SEQ ID NO: 2148493 - RNA, 18 nt, Staphylococcus aureus subsp. aureus N315
auuaaauuuguuauaccu

SEQ ID NO: 2148494 - RNA, 19 nt, Staphylococcus aureus subsp. aureus N315
auuaaauuuuguauaaccu

SEQ ID NO: 2148495 - RNA, 20 nt, Staphylococcus aureus subsp. aureus N315
auuaaauuuuguauaaccuu

SEQ ID NO: 2148496 - RNA, 17 nt, Staphylococcus aureus subsp. aureus N315
auuaauggcaacuaaga

SEQ ID NO: 2148497 - RNA, 18 nt, Staphylococcus aureus subsp. aureus N315
auuaauggcaacuaagau

SEQ ID NO: 2148498 - RNA, 20 nt, Staphylococcus aureus subsp. aureus N315
auuaaugcucuauauaucca

SEQ ID NO: 2148499 - RNA, 17 nt, Staphylococcus aureus subsp. aureus N315
auuaaucguauuuuuaa

SEQ ID NO: 2148500 - RNA, 14 nt, Staphylococcus aureus subsp. aureus N315
auuaaucguauuuu

SEQ ID NO: 2148501 - RNA, 15 nt, Staphylococcus aureus subsp. aureus N315
auuaaucccuucaaa

SEQ ID NO: 2148502 - RNA, 15 nt, Staphylococcus aureus subsp. aureus N315
auuaauauuagugac

SEQ ID NO: 2148503 - RNA, 20 nt, Staphylococcus aureus subsp. aureus N315
auuaauauaaauaucaauug

SEQ ID NO: 2148504 - RNA, 18 nt, Staphylococcus aureus subsp. aureus N315
auuaauaacauccccaaa

SEQ ID NO: 2148505 - RNA, 12 nt, Staphylococcus aureus subsp. aureus N315
auuaauagagac

SEQ ID NO: 2148506 - RNA, 14 nt, Staphylococcus aureus subsp. aureus N315
auuaauagaaagug

SEQ ID NO: 2148507 - RNA, 15 nt, Staphylococcus aureus subsp. aureus N315
auuaauacaucaaua

SEQ ID NO: 2148508 - RNA, 14 nt, Staphylococcus aureus subsp. aureus N315
auuaaaaauuucaa

SEQ ID NO: 2148509 - RNA, 17 nt, Staphylococcus aureus subsp. aureus N315
auuaaaaauuucaauaa

SEQ ID NO: 2148510 - RNA, 23 nt, Staphylococcus aureus subsp. aureus N315
auuaaaacgaaguuauuuauuca

SEQ ID NO: 2148511 - RNA, 18 nt, Staphylococcus aureus subsp. aureus N315
auuaaaacagcaaauaaa

SEQ ID NO: 2148512 - RNA, 14 nt, Staphylococcus aureus subsp. aureus N315
auuaaaaucugcuu

SEQ ID NO: 2148513 - RNA, 15 nt, Staphylococcus aureus subsp. aureus N315
auuaaaaucugcuuu

SEQ ID NO: 2148514 - RNA, 21 nt, Staphylococcus aureus subsp. aureus N315
auuaaaauuacgguuugcuuu

SEQ ID NO: 2148515 - RNA, 18 nt, Staphylococcus aureus subsp. aureus N315
auuaaaauuaaauaauga

SEQ ID NO: 2148516 - RNA, 12 nt, Staphylococcus aureus subsp. aureus N315
auuaaaauguua

SEQ ID NO: 2148517 - RNA, 18 nt, Staphylococcus aureus subsp. aureus N315
auuaaaauguuaauaaug

SEQ ID NO: 2148518 - RNA, 16 nt, Staphylococcus aureus subsp. aureus N315
auguuuuuauuauaca

SEQ ID NO: 2148519 - RNA, 21 nt, Staphylococcus aureus subsp. aureus N315
auguuuuuaacagcuuuuucu

SEQ ID NO: 2148520 - RNA, 23 nt, Staphylococcus aureus subsp. aureus N315
auuaaauccgcuuguucaacuaa

SEQ ID NO: 2148521 - RNA, 15 nt, Staphylococcus aureus subsp. aureus N315
auuaaaucaacaaga

SEQ ID NO: 2148522 - RNA, 16 nt, Staphylococcus aureus subsp. aureus N315
auuaaaggaaaucaau

SEQ ID NO: 2148523 - RNA, 17 nt, Staphylococcus aureus subsp. aureus N315
auuaaauaacacaugca

SEQ ID NO: 2148524 - RNA, 16 nt, Staphylococcus aureus subsp. aureus N315
auuaaaguuaaagacu

SEQ ID NO: 2148525 - RNA, 21 nt, Staphylococcus aureus subsp. aureus N315
auuaaaguguuucaacauauu

SEQ ID NO: 2148526 - RNA, 15 nt, Staphylococcus aureus subsp. aureus N315
auuaaacuuauaacu

SEQ ID NO: 2148527 - RNA, 19 nt, Staphylococcus aureus subsp. aureus N315
auuaaacuuauaacuuuau

SEQ ID NO: 2148528 - RNA, 18 nt, Staphylococcus aureus subsp. aureus N315
auuaaagcaucgaacaau

SEQ ID NO: 2148529 - RNA, 21 nt, Staphylococcus aureus subsp. aureus N315
auuaaacauuuagauuucaug

SEQ ID NO: 2148530 - RNA, 17 nt, Staphylococcus aureus subsp. aureus N315
auuaaacgcaauuaacc

SEQ ID NO: 2148531 - RNA, 23 nt, Staphylococcus aureus subsp. aureus N315
auuaaaccuacaacgaagaaucc

SEQ ID NO: 2148532 - RNA, 14 nt, Staphylococcus aureus subsp. aureus N315
auguuuaauuuucu

SEQ ID NO: 2148533 - RNA, 20 nt, Staphylococcus aureus subsp. aureus N315
auguuuaauuugauuaaauu

SEQ ID NO: 2148534 - RNA, 18 nt, Staphylococcus aureus subsp. aureus N315
auguuucuucaauugucu

SEQ ID NO: 2148535 - RNA, 22 nt, Staphylococcus aureus subsp. aureus N315
auguuucuucaauuuaauguau

SEQ ID NO: 2148536 - RNA, 12 nt, Staphylococcus aureus subsp. aureus N315
auguuuccauuu

SEQ ID NO: 2148537 - RNA, 13 nt, Staphylococcus aureus subsp. aureus N315
auguuuccauuua

SEQ ID NO: 2148538 - RNA, 14 nt, Staphylococcus aureus subsp. aureus N315
auguuuuauacauu

SEQ ID NO: 2148539 - RNA, 20 nt, Staphylococcus aureus subsp. aureus N315
auguuugcaacauauuuuca

SEQ ID NO: 2148540 - RNA, 17 nt, Staphylococcus aureus subsp. aureus N315
auguuuggcauaauaau

SEQ ID NO: 2148541 - RNA, 15 nt, Staphylococcus aureus subsp. aureus N315
auguuugauucuaaa

SEQ ID NO: 2148542 - RNA, 19 nt, Staphylococcus aureus subsp. aureus N315
auguuugauucuaaauaau

SEQ ID NO: 2148543 - RNA, 18 nt, Staphylococcus aureus subsp. aureus N315
auguuugcaacauauuuu

SEQ ID NO: 2148544 - RNA, 22 nt, Staphylococcus aureus subsp. aureus N315
auguuugaugauucguauucaa

SEQ ID NO: 2148545 - RNA, 20 nt, Staphylococcus aureus subsp. aureus N315
auguugguucaucaaacaac

SEQ ID NO: 2148546 - RNA, 14 nt, Staphylococcus aureus subsp. aureus N315
auguuuaaaaaacu

SEQ ID NO: 2148547 - RNA, 13 nt, Staphylococcus aureus subsp. aureus N315
auguuuaaacauu

SEQ ID NO: 2148548 - RNA, 21 nt, Staphylococcus aureus subsp. aureus N315
auguuguuugcggcuuccucu

SEQ ID NO: 2148549 - RNA, 16 nt, Staphylococcus aureus subsp. aureus N315
auguuguuauaaagga

SEQ ID NO: 2148550 - RNA, 16 nt, Staphylococcus aureus subsp. aureus N315
auguuccauauaaccu

SEQ ID NO: 2148551 - RNA, 15 nt, Staphylococcus aureus subsp. aureus N315
auguugcguuaaaua

SEQ ID NO: 2148552 - RNA, 17 nt, Staphylococcus aureus subsp. aureus N315
auguucagguucaaaau

SEQ ID NO: 2148553 - RNA, 18 nt, Staphylococcus aureus subsp. aureus N315
auguucagguucaaaauu

SEQ ID NO: 2148554 - RNA, 19 nt, Staphylococcus aureus subsp. aureus N315
auuaguaugacuuaccuaa

SEQ ID NO: 2148555 - RNA, 14 nt, Staphylococcus aureus subsp. aureus N315
auuagguaauacuu

SEQ ID NO: 2148556 - RNA, 23 nt, Staphylococcus aureus subsp. aureus N315
auuagucauccaaagaaacggaa

SEQ ID NO: 2148557 - RNA, 17 nt, Staphylococcus aureus subsp. aureus N315
auuagugucacaaagaa

SEQ ID NO: 2148558 - RNA, 20 nt, Staphylococcus aureus subsp. aureus N315
auuagugucacaaagaaauu

SEQ ID NO: 2148559 - RNA, 12 nt, Staphylococcus aureus subsp. aureus N315
auuauaaaauaa

SEQ ID NO: 2148560 - RNA, 14 nt, Staphylococcus aureus subsp. aureus N315
auuauaaauauuuu

SEQ ID NO: 2148561 - RNA, 18 nt, Staphylococcus aureus subsp. aureus N315
auuauaaauauuuuuugg

SEQ ID NO: 2148562 - RNA, 15 nt, Staphylococcus aureus subsp. aureus N315
auuaguuuuuaaaau

SEQ ID NO: 2148563 - RNA, 14 nt, Staphylococcus aureus subsp. aureus N315
auuaggauguucag

SEQ ID NO: 2148564 - RNA, 23 nt, Staphylococcus aureus subsp. aureus N315
auuaggcuuaaauauaaugaucc

SEQ ID NO: 2148565 - RNA, 23 nt, Staphylococcus aureus subsp. aureus N315
auuaggauuaacauaacuagcaa

SEQ ID NO: 2148566 - RNA, 19 nt, Staphylococcus aureus subsp. aureus N315
auuaggauuagcguuagau

SEQ ID NO: 2148567 - RNA, 23 nt, Staphylococcus aureus subsp. aureus N315
auuaggaauccaauuucucuaug

SEQ ID NO: 2148568 - RNA, 12 nt, Staphylococcus aureus subsp. aureus N315
auuaguaaauau

SEQ ID NO: 2148569 - RNA, 15 nt, Staphylococcus aureus subsp. aureus N315
auuaguaaauauagu

SEQ ID NO: 2148570 - RNA, 19 nt, Staphylococcus aureus subsp. aureus N315
auuaguaauuuuuaaaucu

SEQ ID NO: 2148571 - RNA, 17 nt, Staphylococcus aureus subsp. aureus N315
auuauaauuuuguuuca

SEQ ID NO: 2148572 - RNA, 16 nt, Staphylococcus aureus subsp. aureus N315
auuauaaugauuuuua

SEQ ID NO: 2148573 - RNA, 14 nt, Staphylococcus aureus subsp. aureus N315
auuauaauuguuca

SEQ ID NO: 2148574 - RNA, 18 nt, Staphylococcus aureus subsp. aureus N315
auuauaauaaauagacug

SEQ ID NO: 2148575 - RNA, 22 nt, Staphylococcus aureus subsp. aureus N315
auuauaauagcuuucguuucuu

SEQ ID NO: 2148576 - RNA, 18 nt, Staphylococcus aureus subsp. aureus N315
auuauaacgugcuuuuuu

SEQ ID NO: 2148577 - RNA, 21 nt, Staphylococcus aureus subsp. aureus N315
auuauacuuuacauuucucgu

SEQ ID NO: 2148578 - RNA, 18 nt, Staphylococcus aureus subsp. aureus N315
auuauacgugcuuuaaag

SEQ ID NO: 2148579 - RNA, 21 nt, Staphylococcus aureus subsp. aureus N315
auuauacgugcuuuaaaguug

SEQ ID NO: 2148580 - RNA, 21 nt, Staphylococcus aureus subsp. aureus N315
auuauauggagcuacccuauu

SEQ ID NO: 2148581 - RNA, 21 nt, Staphylococcus aureus subsp. aureus N315
auuauauuuuucuucaguuaa

SEQ ID NO: 2148582 - RNA, 19 nt, Staphylococcus aureus subsp. aureus N315
auuauagucuuaaacauaa

SEQ ID NO: 2148583 - RNA, 18 nt, Staphylococcus aureus subsp. aureus N315
auuauagucuuaaacaua

SEQ ID NO: 2148584 - RNA, 16 nt, Staphylococcus aureus subsp. aureus N315
auuauagguauaagaa

SEQ ID NO: 2148585 - RNA, 16 nt, Staphylococcus aureus subsp. aureus N315
auuauauaauucuuca

SEQ ID NO: 2148586 - RNA, 19 nt, Staphylococcus aureus subsp. aureus N315
auuauauacccaccacauu

SEQ ID NO: 2148587 - RNA, 15 nt, Staphylococcus aureus subsp. aureus N315
auuacugauuguuaa

SEQ ID NO: 2148588 - RNA, 15 nt, Staphylococcus aureus subsp. aureus N315
auuacucuuuuucuu

SEQ ID NO: 2148589 - RNA, 22 nt, Staphylococcus aureus subsp. aureus N315
auuacuuauuucuuuucauuau

SEQ ID NO: 2148590 - RNA, 21 nt, Staphylococcus aureus subsp. aureus N315
auuacuguuugcuuuaucaau

SEQ ID NO: 2148591 - RNA, 15 nt, Staphylococcus aureus subsp. aureus N315
auuacuuaauaguaa

SEQ ID NO: 2148592 - RNA, 13 nt, Staphylococcus aureus subsp. aureus N315
auuacuuaucugu

SEQ ID NO: 2148593 - RNA, 17 nt, Staphylococcus aureus subsp. aureus N315
auuacuugcacaccagu

SEQ ID NO: 2148594 - RNA, 17 nt, Staphylococcus aureus subsp. aureus N315
auuacuuucauuguaaa

SEQ ID NO: 2148595 - RNA, 17 nt, Staphylococcus aureus subsp. aureus N315
auuacuuuggaaauuua

SEQ ID NO: 2148596 - RNA, 21 nt, Staphylococcus aureus subsp. aureus N315
auuagaaaaggcucauuuguu

SEQ ID NO: 2148597 - RNA, 20 nt, Staphylococcus aureus subsp. aureus N315
auuagaaaauaucuuacugc

SEQ ID NO: 2148598 - RNA, 17 nt, Staphylococcus aureus subsp. aureus N315
auuagaacauuuaucgu

SEQ ID NO: 2148599 - RNA, 14 nt, Staphylococcus aureus subsp. aureus N315
auuagaaccaucau

SEQ ID NO: 2148600 - RNA, 14 nt, Staphylococcus aureus subsp. aureus N315
auuagaauauaugu

SEQ ID NO: 2148601 - RNA, 19 nt, Staphylococcus aureus subsp. aureus N315
auuagacguguaaauguua

SEQ ID NO: 2148602 - RNA, 17 nt, Staphylococcus aureus subsp. aureus N315
auuagauauauuugaaa

SEQ ID NO: 2148603 - RNA, 19 nt, Staphylococcus aureus subsp. aureus N315
auuagauauauuugaaagg

SEQ ID NO: 2148604 - RNA, 15 nt, Staphylococcus aureus subsp. aureus N315
auuagauaucuuaau

SEQ ID NO: 2148605 - RNA, 16 nt, Staphylococcus aureus subsp. aureus N315
auuagaugauauuuaa

SEQ ID NO: 2148606 - RNA, 14 nt, Staphylococcus aureus subsp. aureus N315
auuagauuuuaugc

SEQ ID NO: 2148607 - RNA, 17 nt, Staphylococcus aureus subsp. aureus N315
auuagcgcaagagauaa

SEQ ID NO: 2148608 - RNA, 21 nt, Staphylococcus aureus subsp. aureus N315
auuagcgcaccaauuaucaac

SEQ ID NO: 2148609 - RNA, 22 nt, Staphylococcus aureus subsp. aureus N315
auuacccacaucuuuuuaaaag

SEQ ID NO: 2148610 - RNA, 13 nt, Staphylococcus aureus subsp. aureus N315
auuaccagcaauu

SEQ ID NO: 2148611 - RNA, 16 nt, Staphylococcus aureus subsp. aureus N315
auuaccauaacuuuau

SEQ ID NO: 2148612 - RNA, 13 nt, Staphylococcus aureus subsp. aureus N315
auuaccauauaaa

SEQ ID NO: 2148613 - RNA, 15 nt, Staphylococcus aureus subsp. aureus N315
auuaccauauaaagc

SEQ ID NO: 2148614 - RNA, 14 nt, Staphylococcus aureus subsp. aureus N315
auuacauuuuaugu

SEQ ID NO: 2148615 - RNA, 17 nt, Staphylococcus aureus subsp. aureus N315
auuacauuuuaugucca

SEQ ID NO: 2148616 - RNA, 16 nt, Staphylococcus aureus subsp. aureus N315
auuacguuuacuagaa

SEQ ID NO: 2148617 - RNA, 18 nt, Staphylococcus aureus subsp. aureus N315
auuacuaaaacaaauuca

SEQ ID NO: 2148618 - RNA, 22 nt, Staphylococcus aureus subsp. aureus N315
auuacuaaccuauuaaaauaaa

SEQ ID NO: 2148619 - RNA, 16 nt, Staphylococcus aureus subsp. aureus N315
auuacuaauugaucag

SEQ ID NO: 2148620 - RNA, 21 nt, Staphylococcus aureus subsp. aureus N315
auuacuaaccuauuaaaauaa

SEQ ID NO: 2148621 - RNA, 17 nt, Staphylococcus aureus subsp. aureus N315
auuacuauauuuaaauu

SEQ ID NO: 2148622 - RNA, 17 nt, Staphylococcus aureus subsp. aureus N315
auuacuauaaaaaacag

SEQ ID NO: 2148623 - RNA, 23 nt, Staphylococcus aureus subsp. aureus N315
auuacuacuuuauaaauaucuuu

SEQ ID NO: 2148624 - RNA, 22 nt, Staphylococcus aureus subsp. aureus N315
auuacucaaaauuaaagcuuaa

SEQ ID NO: 2148625 - RNA, 15 nt, Staphylococcus aureus subsp. aureus N315
auuacucaaaauuaa

SEQ ID NO: 2148626 - RNA, 21 nt, Staphylococcus aureus subsp. aureus N315
auuacucaauuugaagauuuu

SEQ ID NO: 2148627 - RNA, 17 nt, Staphylococcus aureus subsp. aureus N315
auuacgucauaaaauac

SEQ ID NO: 2148628 - RNA, 21 nt, Staphylococcus aureus subsp. aureus N315
auuacgcugucucauuaaugu

SEQ ID NO: 2148629 - RNA, 13 nt, Staphylococcus aureus subsp. aureus N315
auuaauguuugau

SEQ ID NO: 2148630 - RNA, 19 nt, Staphylococcus aureus subsp. aureus N315
auuaauuaaaauucucuuu

SEQ ID NO: 2148631 - RNA, 17 nt, Staphylococcus aureus subsp. aureus N315
auuaauuaucuuaaguc

SEQ ID NO: 2148632 - RNA, 22 nt, Staphylococcus aureus subsp. aureus N315
auuaauuacuuucauuguaaau

SEQ ID NO: 2148633 - RNA, 12 nt, Staphylococcus aureus subsp. aureus N315
auuaauuaacaa

SEQ ID NO: 2148634 - RNA, 13 nt, Staphylococcus aureus subsp. aureus N315
auuaauugaaaaa

SEQ ID NO: 2148635 - RNA, 17 nt, Staphylococcus aureus subsp. aureus N315
auuaauuggauuaaaua

SEQ ID NO: 2148636 - RNA, 11 nt, Staphylococcus aureus subsp. aureus N315
auuaauuauua

SEQ ID NO: 2148637 - RNA, 19 nt, Staphylococcus aureus subsp. aureus N315
auuaauuuucuuuuuuaau

SEQ ID NO: 2148638 - RNA, 22 nt, Staphylococcus aureus subsp. aureus N315
auuaauuuucuuuuuuaauucu

SEQ ID NO: 2148639 - RNA, 19 nt, Staphylococcus aureus subsp. aureus N315
auuaauuuuguaauuagga

SEQ ID NO: 2148640 - RNA, 23 nt, Staphylococcus aureus subsp. aureus N315
auuaauuuguccauccauuuuag

SEQ ID NO: 2148641 - RNA, 17 nt, Staphylococcus aureus subsp. aureus N315
auuaauuuuucaaaugu

SEQ ID NO: 2148642 - RNA, 13 nt, Staphylococcus aureus subsp. aureus N315
auuaauuuucuuu

SEQ ID NO: 2148643 - RNA, 21 nt, Staphylococcus aureus subsp. aureus N315
auuacaaaagaaucauuuaaa

SEQ ID NO: 2148644 - RNA, 15 nt, Staphylococcus aureus subsp. aureus N315
auuaauuugaaugcc

SEQ ID NO: 2148645 - RNA, 15 nt, Staphylococcus aureus subsp. aureus N315
auuaauuggauuuuu

SEQ ID NO: 2148646 - RNA, 20 nt, Staphylococcus aureus subsp. aureus N315
auuaauuuacucaaaccauc

SEQ ID NO: 2148647 - RNA, 24 nt, Staphylococcus aureus subsp. aureus N315
auuacaggaaauccgcauaaauua

SEQ ID NO: 2148648 - RNA, 22 nt, Staphylococcus aureus subsp. aureus N315
auuacaggaauugcuuuaaacu

SEQ ID NO: 2148649 - RNA, 20 nt, Staphylococcus aureus subsp. aureus N315
auuacagcguacuaaagaau

SEQ ID NO: 2148650 - RNA, 14 nt, Staphylococcus aureus subsp. aureus N315
auuacauaauuuau

SEQ ID NO: 2148651 - RNA, 19 nt, Staphylococcus aureus subsp. aureus N315
auuacauauaagauagaua

SEQ ID NO: 2148652 - RNA, 23 nt, Staphylococcus aureus subsp. aureus N315
auuacaugcaccuuuacaacaua

SEQ ID NO: 2148653 - RNA, 13 nt, Staphylococcus aureus subsp. aureus N315
auuacaaaucaug

SEQ ID NO: 2148654 - RNA, 15 nt, Staphylococcus aureus subsp. aureus N315
auuacaaaaguauga

SEQ ID NO: 2148655 - RNA, 21 nt, Staphylococcus aureus subsp. aureus N315
auuacaauaagcgcaauuaaa

SEQ ID NO: 2148656 - RNA, 12 nt, Staphylococcus aureus subsp. aureus N315
auuacaauaagg

SEQ ID NO: 2148657 - RNA, 18 nt, Staphylococcus aureus subsp. aureus N315
auuacaaugaaaaaacga

SEQ ID NO: 2148658 - RNA, 22 nt, Staphylococcus aureus subsp. aureus N315
auuacacuacgcugaugaauga

SEQ ID NO: 2148659 - RNA, 19 nt, Staphylococcus aureus subsp. aureus N315
auuacacgcauuacuuuag

SEQ ID NO: 2148660 - RNA, 22 nt, Staphylococcus aureus subsp. aureus N315
auucacucuguaauaaagaaua

SEQ ID NO: 2148661 - RNA, 19 nt, Staphylococcus aureus subsp. aureus N315
auucacuacuuuuucaacu

SEQ ID NO: 2148662 - RNA, 20 nt, Staphylococcus aureus subsp. aureus N315
auucacgcguucaaauguug

SEQ ID NO: 2148663 - RNA, 19 nt, Staphylococcus aureus subsp. aureus N315
auucacgauauaacauuaa

SEQ ID NO: 2148664 - RNA, 17 nt, Staphylococcus aureus subsp. aureus N315
auucagauuuucgagug

SEQ ID NO: 2148665 - RNA, 13 nt, Staphylococcus aureus subsp. aureus N315
auucacuguauaa

SEQ ID NO: 2148666 - RNA, 18 nt, Staphylococcus aureus subsp. aureus N315
auucaauugauuacacca

SEQ ID NO: 2148667 - RNA, 13 nt, Staphylococcus aureus subsp. aureus N315
auucaauuuaguu

SEQ ID NO: 2148668 - RNA, 23 nt, Staphylococcus aureus subsp. aureus N315
auucaaugauuaguaaugauuaa

SEQ ID NO: 2148669 - RNA, 17 nt, Staphylococcus aureus subsp. aureus N315
auucaaugauuuuuaaa

SEQ ID NO: 2148670 - RNA, 18 nt, Staphylococcus aureus subsp. aureus N315
auucaaugauuuuuaaaa

SEQ ID NO: 2148671 - RNA, 17 nt, Staphylococcus aureus subsp. aureus N315
auucaauguaauuuuca

SEQ ID NO: 2148672 - RNA, 16 nt, Staphylococcus aureus subsp. aureus N315
auucaauguuuuaaau

SEQ ID NO: 2148673 - RNA, 14 nt, Staphylococcus aureus subsp. aureus N315
auucaauucuguga

SEQ ID NO: 2148674 - RNA, 15 nt, Staphylococcus aureus subsp. aureus N315
auucacauacauuuu

SEQ ID NO: 2148675 - RNA, 14 nt, Staphylococcus aureus subsp. aureus N315
auucaccuaaaaag

SEQ ID NO: 2148676 - RNA, 12 nt, Staphylococcus aureus subsp. aureus N315
auucaaccaauu

SEQ ID NO: 2148677 - RNA, 13 nt, Staphylococcus aureus subsp. aureus N315
auucaaaucauaa

SEQ ID NO: 2148678 - RNA, 22 nt, Staphylococcus aureus subsp. aureus N315
auucaaauaaaugacauuuaau

SEQ ID NO: 2148679 - RNA, 23 nt, Staphylococcus aureus subsp. aureus N315
auucaaauaaaucaaacuuuuca

SEQ ID NO: 2148680 - RNA, 21 nt, Staphylococcus aureus subsp. aureus N315
auucaaauaaaucaaacuuuu

SEQ ID NO: 2148681 - RNA, 12 nt, Staphylococcus aureus subsp. aureus N315
auucaacuuaaa

SEQ ID NO: 2148682 - RNA, 17 nt, Staphylococcus aureus subsp. aureus N315
auucaacuuauuauuua

SEQ ID NO: 2148683 - RNA, 15 nt, Staphylococcus aureus subsp. aureus N315
auucaacuugauuaa

SEQ ID NO: 2148684 - RNA, 15 nt, Staphylococcus aureus subsp. aureus N315
auucaacuaauuuaa

SEQ ID NO: 2148685 - RNA, 16 nt, Staphylococcus aureus subsp. aureus N315
auucaagcaucauuuu

SEQ ID NO: 2148686 - RNA, 18 nt, Staphylococcus aureus subsp. aureus N315
auucaagcaucauuuuuc

SEQ ID NO: 2148687 - RNA, 22 nt, Staphylococcus aureus subsp. aureus N315
auucaagaccaugcaaacucau

SEQ ID NO: 2148688 - RNA, 21 nt, Staphylococcus aureus subsp. aureus N315
auucaaguguaguaaaaauca

SEQ ID NO: 2148689 - RNA, 15 nt, Staphylococcus aureus subsp. aureus N315
auucaauaauuauua

SEQ ID NO: 2148690 - RNA, 18 nt, Staphylococcus aureus subsp. aureus N315
auuauuuuguauuuuuca

SEQ ID NO: 2148691 - RNA, 22 nt, Staphylococcus aureus subsp. aureus N315
auuauuucccuggaaaaugauu

SEQ ID NO: 2148692 - RNA, 22 nt, Staphylococcus aureus subsp. aureus N315
auuauuucucuuuccacugcaa

SEQ ID NO: 2148693 - RNA, 16 nt, Staphylococcus aureus subsp. aureus N315
auuauuugauaaauaa

SEQ ID NO: 2148694 - RNA, 14 nt, Staphylococcus aureus subsp. aureus N315
auucaaaauaacuu

SEQ ID NO: 2148695 - RNA, 18 nt, Staphylococcus aureus subsp. aureus N315
auucaaaauucaauauua

SEQ ID NO: 2148696 - RNA, 21 nt, Staphylococcus aureus subsp. aureus N315
auuaugucgagguguuuuuuu

SEQ ID NO: 2148697 - RNA, 23 nt, Staphylococcus aureus subsp. aureus N315
auuauguaucuauacaacaguaa

SEQ ID NO: 2148698 - RNA, 14 nt, Staphylococcus aureus subsp. aureus N315
auuauguaaaaaau

SEQ ID NO: 2148699 - RNA, 18 nt, Staphylococcus aureus subsp. aureus N315
auuauguaaaaaauaucu

SEQ ID NO: 2148700 - RNA, 22 nt, Staphylococcus aureus subsp. aureus N315
auuauguaaaaaauaucuuguc

SEQ ID NO: 2148701 - RNA, 17 nt, Staphylococcus aureus subsp. aureus N315
auuauggagcggaagau

SEQ ID NO: 2148702 - RNA, 19 nt, Staphylococcus aureus subsp. aureus N315
auuauggagcggaagauag

SEQ ID NO: 2148703 - RNA, 11 nt, Staphylococcus aureus subsp. aureus N315
auuauggagcg

SEQ ID NO: 2148704 - RNA, 15 nt, Staphylococcus aureus subsp. aureus N315
auuaugcuucaaagu

SEQ ID NO: 2148705 - RNA, 14 nt, Staphylococcus aureus subsp. aureus N315
auuaugcccaacca

SEQ ID NO: 2148706 - RNA, 16 nt, Staphylococcus aureus subsp. aureus N315
auuauuacaaugaaaa

SEQ ID NO: 2148707 - RNA, 16 nt, Staphylococcus aureus subsp. aureus N315
auuauuauaauaaaua

SEQ ID NO: 2148708 - RNA, 19 nt, Staphylococcus aureus subsp. aureus N315
auuauuaugccuuugauuu

SEQ ID NO: 2148709 - RNA, 15 nt, Staphylococcus aureus subsp. aureus N315
auuauuauaauaaau

SEQ ID NO: 2148710 - RNA, 22 nt, Staphylococcus aureus subsp. aureus N315
auuauuaacuguaccugcuaca

SEQ ID NO: 2148711 - RNA, 15 nt, Staphylococcus aureus subsp. aureus N315
auuauuaacuuuaau

SEQ ID NO: 2148712 - RNA, 14 nt, Staphylococcus aureus subsp. aureus N315
auuauuaacuguac

SEQ ID NO: 2148713 - RNA, 18 nt, Staphylococcus aureus subsp. aureus N315
auuauuaacuguaccugc

SEQ ID NO: 2148714 - RNA, 20 nt, Staphylococcus aureus subsp. aureus N315
auuauuaaggggguaauacu

SEQ ID NO: 2148715 - RNA, 19 nt, Staphylococcus aureus subsp. aureus N315
auuauuaaauuauggagcg

SEQ ID NO: 2148716 - RNA, 13 nt, Staphylococcus aureus subsp. aureus N315
auuauuaaaucaa

SEQ ID NO: 2148717 - RNA, 17 nt, Staphylococcus aureus subsp. aureus N315
auuauugguugaaauua

SEQ ID NO: 2148718 - RNA, 18 nt, Staphylococcus aureus subsp. aureus N315
auuauugguugaaauuaa

SEQ ID NO: 2148719 - RNA, 17 nt, Staphylococcus aureus subsp. aureus N315
auuauuguaaguuggcu

SEQ ID NO: 2148720 - RNA, 18 nt, Staphylococcus aureus subsp. aureus N315
auuauugucaucauguuc

SEQ ID NO: 2148721 - RNA, 14 nt, Staphylococcus aureus subsp. aureus N315
auuauuuaaaacuu

SEQ ID NO: 2148722 - RNA, 13 nt, Staphylococcus aureus subsp. aureus N315
auuauuuauauuu

SEQ ID NO: 2148723 - RNA, 16 nt, Staphylococcus aureus subsp. aureus N315
auuauuuauucauuau

SEQ ID NO: 2148724 - RNA, 16 nt, Staphylococcus aureus subsp. aureus N315
auuauuuaaaaugcuu

SEQ ID NO: 2148725 - RNA, 16 nt, Staphylococcus aureus subsp. aureus N315
auuauuuaaauuuuca

SEQ ID NO: 2148726 - RNA, 19 nt, Staphylococcus aureus subsp. aureus N315
auuauuuaauuuuucuaaa

SEQ ID NO: 2148727 - RNA, 22 nt, Staphylococcus aureus subsp. aureus N315
auuauuuagaauucuaaaagaa

SEQ ID NO: 2148728 - RNA, 14 nt, Staphylococcus aureus subsp. aureus N315
auuauucucuuuau

SEQ ID NO: 2148729 - RNA, 21 nt, Staphylococcus aureus subsp. aureus N315
auuauucucucauuuguauag

SEQ ID NO: 2148730 - RNA, 12 nt, Staphylococcus aureus subsp. aureus N315
auuauugaaacu

SEQ ID NO: 2148731 - RNA, 22 nt, Staphylococcus aureus subsp. aureus N315
auuauucugagauugagaauuc

SEQ ID NO: 2148732 - RNA, 17 nt, Staphylococcus aureus subsp. aureus N315
auuauucuucauuuaua

SEQ ID NO: 2148733 - RNA, 16 nt, Staphylococcus aureus subsp. aureus N315
auuauugaaaacaaaa

SEQ ID NO: 2148734 - RNA, 19 nt, Staphylococcus aureus subsp. aureus N315
auuaugauugcuuauuuau

SEQ ID NO: 2148735 - RNA, 17 nt, Staphylococcus aureus subsp. aureus N315
auuaugauuauauuuuc

SEQ ID NO: 2148736 - RNA, 22 nt, Staphylococcus aureus subsp. aureus N315
auuaugauacgcuuuuuaaaaa

SEQ ID NO: 2148737 - RNA, 12 nt, Staphylococcus aureus subsp. aureus N315
auuaugauauac

SEQ ID NO: 2148738 - RNA, 15 nt, Staphylococcus aureus subsp. aureus N315
auuaugauuaauccu

SEQ ID NO: 2148739 - RNA, 17 nt, Staphylococcus aureus subsp. aureus N315
auuaucuuuaguauuuc

SEQ ID NO: 2148740 - RNA, 22 nt, Staphylococcus aureus subsp. aureus N315
auuaucuuuaauuuacaauuaa

SEQ ID NO: 2148741 - RNA, 14 nt, Staphylococcus aureus subsp. aureus N315
auuaugaaaaguaa

SEQ ID NO: 2148742 - RNA, 15 nt, Staphylococcus aureus subsp. aureus N315
auuaugaaaaguaaa

SEQ ID NO: 2148743 - RNA, 18 nt, Staphylococcus aureus subsp. aureus N315
auuaucuuuguaaauuuu

SEQ ID NO: 2148744 - RNA, 13 nt, Staphylococcus aureus subsp. aureus N315
auuaucuauauau

SEQ ID NO: 2148745 - RNA, 14 nt, Staphylococcus aureus subsp. aureus N315
auuaucuguaauua

SEQ ID NO: 2148746 - RNA, 18 nt, Staphylococcus aureus subsp. aureus N315
auuaucuuaagucaucaa

SEQ ID NO: 2148747 - RNA, 14 nt, Staphylococcus aureus subsp. aureus N315
auuaucuaaagaaa

SEQ ID NO: 2148748 - RNA, 15 nt, Staphylococcus aureus subsp. aureus N315
auuaucuaaagaaau

SEQ ID NO: 2148749 - RNA, 15 nt, Staphylococcus aureus subsp. aureus N315
auuaucuaacucaua

SEQ ID NO: 2148750 - RNA, 13 nt, Staphylococcus aureus subsp. aureus N315
auuaucuaacuca

SEQ ID NO: 2148751 - RNA, 20 nt, Staphylococcus aureus subsp. aureus N315
auuaucuauccauuugguuu

SEQ ID NO: 2148752 - RNA, 22 nt, Staphylococcus aureus subsp. aureus N315
auuaucuauccauuugguuuaa

SEQ ID NO: 2148753 - RNA, 19 nt, Staphylococcus aureus subsp. aureus N315
auuaucauauaaaucaaau

SEQ ID NO: 2148754 - RNA, 14 nt, Staphylococcus aureus subsp. aureus N315
auuaucauuaaauu

SEQ ID NO: 2148755 - RNA, 17 nt, Staphylococcus aureus subsp. aureus N315
auuaucauuaaauugcu

SEQ ID NO: 2148756 - RNA, 20 nt, Staphylococcus aureus subsp. aureus N315
auuaucauauaaaucaaaua

SEQ ID NO: 2148757 - RNA, 18 nt, Staphylococcus aureus subsp. aureus N315
auuaucauaugaacaaua

SEQ ID NO: 2148758 - RNA, 19 nt, Staphylococcus aureus subsp. aureus N315
auuaucauaugugauuuaa

SEQ ID NO: 2148759 - RNA, 18 nt, Staphylococcus aureus subsp. aureus N315
auuaucaccuucaaacuu

SEQ ID NO: 2148760 - RNA, 21 nt, Staphylococcus aureus subsp. aureus N315
auuaucaccuucaaacuuuca

SEQ ID NO: 2148761 - RNA, 15 nt, Staphylococcus aureus subsp. aureus N315
auuaucaauagauga

SEQ ID NO: 2148762 - RNA, 23 nt, Staphylococcus aureus subsp. aureus N315
auuauccaaggauguuauaaaau

SEQ ID NO: 2148763 - RNA, 21 nt, Staphylococcus aureus subsp. aureus N315
auuaucgaagaaacauuauau

SEQ ID NO: 2148764 - RNA, 16 nt, Staphylococcus aureus subsp. aureus N315
auauaaccuauuucau

SEQ ID NO: 2148765 - RNA, 20 nt, Staphylococcus aureus subsp. aureus N315
auauaacuauggucaucaau

SEQ ID NO: 2148766 - RNA, 22 nt, Staphylococcus aureus subsp. aureus N315
auauaacuucuauuaagaaaua

SEQ ID NO: 2148767 - RNA, 18 nt, Staphylococcus aureus subsp. aureus N315
auauaaaaacaaaagaaa

SEQ ID NO: 2148768 - RNA, 16 nt, Staphylococcus aureus subsp. aureus N315
auauaaaaaauuauua

SEQ ID NO: 2148769 - RNA, 20 nt, Staphylococcus aureus subsp. aureus N315
auauaaaaaauuauuaaaaa

SEQ ID NO: 2148770 - RNA, 23 nt, Staphylococcus aureus subsp. aureus N315
auauaaaaagugaagauauuuau

SEQ ID NO: 2148771 - RNA, 13 nt, Staphylococcus aureus subsp. aureus N315
auauaaaaacugu

SEQ ID NO: 2148772 - RNA, 22 nt, Staphylococcus aureus subsp. aureus N315
auauaauguauaaaacagaauu

SEQ ID NO: 2148773 - RNA, 15 nt, Staphylococcus aureus subsp. aureus N315
auauaauuauuaaac

SEQ ID NO: 2148774 - RNA, 14 nt, Staphylococcus aureus subsp. aureus N315
auauaauuuauuua

SEQ ID NO: 2148775 - RNA, 17 nt, Staphylococcus aureus subsp. aureus N315
auauaauguauaaaaca

SEQ ID NO: 2148776 - RNA, 16 nt, Staphylococcus aureus subsp. aureus N315
auauaauguauaaaac

SEQ ID NO: 2148777 - RNA, 19 nt, Staphylococcus aureus subsp. aureus N315
auauaauggcacugcaauc

SEQ ID NO: 2148778 - RNA, 21 nt, Staphylococcus aureus subsp. aureus N315
auauaaugguugaauaacacu

SEQ ID NO: 2148779 - RNA, 23 nt, Staphylococcus aureus subsp. aureus N315
auauaacuucuauuaagaaauac

SEQ ID NO: 2148780 - RNA, 20 nt, Staphylococcus aureus subsp. aureus N315
auaguugucuuuacauucuu

SEQ ID NO: 2148781 - RNA, 15 nt, Staphylococcus aureus subsp. aureus N315
auaguuucaaugccu

SEQ ID NO: 2148782 - RNA, 19 nt, Staphylococcus aureus subsp. aureus N315
auaguuucgucuacuauuu

SEQ ID NO: 2148783 - RNA, 17 nt, Staphylococcus aureus subsp. aureus N315
auaguuuuucauauuca

SEQ ID NO: 2148784 - RNA, 18 nt, Staphylococcus aureus subsp. aureus N315
auaguuuuucauauucac

SEQ ID NO: 2148785 - RNA, 16 nt, Staphylococcus aureus subsp. aureus N315
auagugguaaaaaguu

SEQ ID NO: 2148786 - RNA, 18 nt, Staphylococcus aureus subsp. aureus N315
auaggaauacaugaguaa

SEQ ID NO: 2148787 - RNA, 19 nt, Staphylococcus aureus subsp. aureus N315
auaggauauugcaucauuc

SEQ ID NO: 2148788 - RNA, 24 nt, Staphylococcus aureus subsp. aureus N315
auaggauuugcaccuauaccucgu

SEQ ID NO: 2148789 - RNA, 16 nt, Staphylococcus aureus subsp. aureus N315
auaggauuuacaccua

SEQ ID NO: 2148790 - RNA, 17 nt, Staphylococcus aureus subsp. aureus N315
auaggugauuauauaua

SEQ ID NO: 2148791 - RNA, 22 nt, Staphylococcus aureus subsp. aureus N315
auaggugauuauauauauuaaa

SEQ ID NO: 2148792 - RNA, 14 nt, Staphylococcus aureus subsp. aureus N315
auagguauaagaau

SEQ ID NO: 2148793 - RNA, 13 nt, Staphylococcus aureus subsp. aureus N315
auagguaucuuaa

SEQ ID NO: 2148794 - RNA, 19 nt, Staphylococcus aureus subsp. aureus N315
auaguaaaauaaauacaau

SEQ ID NO: 2148795 - RNA, 14 nt, Staphylococcus aureus subsp. aureus N315
auaguaaaaccugu

SEQ ID NO: 2148796 - RNA, 13 nt, Staphylococcus aureus subsp. aureus N315
auaguaagaaaag

SEQ ID NO: 2148797 - RNA, 17 nt, Staphylococcus aureus subsp. aureus N315
auaguaaagugaaauaa

SEQ ID NO: 2148798 - RNA, 19 nt, Staphylococcus aureus subsp. aureus N315
auaguacauuuauuuucaa

SEQ ID NO: 2148799 - RNA, 16 nt, Staphylococcus aureus subsp. aureus N315
auaguaauaaaagucg

SEQ ID NO: 2148800 - RNA, 18 nt, Staphylococcus aureus subsp. aureus N315
auaguaagguuugaacuc

SEQ ID NO: 2148801 - RNA, 13 nt, Staphylococcus aureus subsp. aureus N315
auaguacagucau

SEQ ID NO: 2148802 - RNA, 16 nt, Staphylococcus aureus subsp. aureus N315
auauacuuaauuuaaa

SEQ ID NO: 2148803 - RNA, 17 nt, Staphylococcus aureus subsp. aureus N315
auauacuuguucaacaa

SEQ ID NO: 2148804 - RNA, 12 nt, Staphylococcus aureus subsp. aureus N315
auauacuugaag

SEQ ID NO: 2148805 - RNA, 14 nt, Staphylococcus aureus subsp. aureus N315
auauacuugaagaa

SEQ ID NO: 2148806 - RNA, 11 nt, Staphylococcus aureus subsp. aureus N315
auauacuuuuu

SEQ ID NO: 2148807 - RNA, 23 nt, Staphylococcus aureus subsp. aureus N315
auauagaaaaugaguacaacaua

SEQ ID NO: 2148808 - RNA, 20 nt, Staphylococcus aureus subsp. aureus N315
auauauguauaacauuauua

SEQ ID NO: 2148809 - RNA, 22 nt, Staphylococcus aureus subsp. aureus N315
auauagaagauauaacauguau

SEQ ID NO: 2148810 - RNA, 14 nt, Staphylococcus aureus subsp. aureus N315
auauagaaggggac

SEQ ID NO: 2148811 - RNA, 22 nt, Staphylococcus aureus subsp. aureus N315
auauauuaucguaauuguuaaa

SEQ ID NO: 2148812 - RNA, 22 nt, Staphylococcus aureus subsp. aureus N315
auauauuacuaaccuauuaaaa

SEQ ID NO: 2148813 - RNA, 13 nt, Staphylococcus aureus subsp. aureus N315
auauauucguuac

SEQ ID NO: 2148814 - RNA, 14 nt, Staphylococcus aureus subsp. aureus N315
auauauuauaaccc

SEQ ID NO: 2148815 - RNA, 12 nt, Staphylococcus aureus subsp. aureus N315
auauauuucuau

SEQ ID NO: 2148816 - RNA, 12 nt, Staphylococcus aureus subsp. aureus N315
auauauuuuguu

SEQ ID NO: 2148817 - RNA, 22 nt, Staphylococcus aureus subsp. aureus N315
auaucagcuaaguuaaauauca

SEQ ID NO: 2148818 - RNA, 15 nt, Staphylococcus aureus subsp. aureus N315
auaucagcuuuuuca

SEQ ID NO: 2148819 - RNA, 18 nt, Staphylococcus aureus subsp. aureus N315
auaucaguaauaauacgc

SEQ ID NO: 2148820 - RNA, 16 nt, Staphylococcus aureus subsp. aureus N315
auaucacuuuagauaa

SEQ ID NO: 2148821 - RNA, 17 nt, Staphylococcus aureus subsp. aureus N315
auaucacgagcuuuuaa

SEQ ID NO: 2148822 - RNA, 14 nt, Staphylococcus aureus subsp. aureus N315
auaucaaauacauu

SEQ ID NO: 2148823 - RNA, 13 nt, Staphylococcus aureus subsp. aureus N315
auaucaaauacau

SEQ ID NO: 2148824 - RNA, 17 nt, Staphylococcus aureus subsp. aureus N315
auaucaaauacauuuca

SEQ ID NO: 2148825 - RNA, 21 nt, Staphylococcus aureus subsp. aureus N315
auaucaaauacauuucaaaaa

SEQ ID NO: 2148826 - RNA, 13 nt, Staphylococcus aureus subsp. aureus N315
auaucaaaaaaua

SEQ ID NO: 2148827 - RNA, 21 nt, Staphylococcus aureus subsp. aureus N315
auaucaaaaaauacguuuaau

SEQ ID NO: 2148828 - RNA, 21 nt, Staphylococcus aureus subsp. aureus N315
auaucaauuuauuauuaacug

SEQ ID NO: 2148829 - RNA, 21 nt, Staphylococcus aureus subsp. aureus N315
auaucaauuucaacuuauaaa

SEQ ID NO: 2148830 - RNA, 18 nt, Staphylococcus aureus subsp. aureus N315
auaucaauuuuuacuaaa

SEQ ID NO: 2148831 - RNA, 14 nt, Staphylococcus aureus subsp. aureus N315
auaucaaguuuuaa

SEQ ID NO: 2148832 - RNA, 17 nt, Staphylococcus aureus subsp. aureus N315
auaucaacguuaauaua

SEQ ID NO: 2148833 - RNA, 11 nt, Staphylococcus aureus subsp. aureus N315
auaucuaaguc

SEQ ID NO: 2148834 - RNA, 14 nt, Staphylococcus aureus subsp. aureus N315
auaucgauaaaugu

SEQ ID NO: 2148835 - RNA, 21 nt, Staphylococcus aureus subsp. aureus N315
auauccacgguuuaccacuua

SEQ ID NO: 2148836 - RNA, 13 nt, Staphylococcus aureus subsp. aureus N315
auaucauucugug

SEQ ID NO: 2148837 - RNA, 23 nt, Staphylococcus aureus subsp. aureus N315
auaucauucuguguaaauauaaa

SEQ ID NO: 2148838 - RNA, 17 nt, Staphylococcus aureus subsp. aureus N315
auaucuuuuccaaaaca

SEQ ID NO: 2148839 - RNA, 22 nt, Staphylococcus aureus subsp. aureus N315
auaucuuuuuuuuuauaguggu

SEQ ID NO: 2148840 - RNA, 12 nt, Staphylococcus aureus subsp. aureus N315
auaugaaaagag

SEQ ID NO: 2148841 - RNA, 17 nt, Staphylococcus aureus subsp. aureus N315
auaugacuuuauuucua

SEQ ID NO: 2148842 - RNA, 20 nt, Staphylococcus aureus subsp. aureus N315
auaugacuuuuuauuaguau

SEQ ID NO: 2148843 - RNA, 21 nt, Staphylococcus aureus subsp. aureus N315
auaucuuucaauuaauuuaaa

SEQ ID NO: 2148844 - RNA, 15 nt, Staphylococcus aureus subsp. aureus N315
auaucuuuauuugau

SEQ ID NO: 2148845 - RNA, 22 nt, Staphylococcus aureus subsp. aureus N315
auaucuagcugcuucugcugua

SEQ ID NO: 2148846 - RNA, 19 nt, Staphylococcus aureus subsp. aureus N315
auaucuuaaguacauaaau

SEQ ID NO: 2148847 - RNA, 17 nt, Staphylococcus aureus subsp. aureus N315
auaucuuaaagaauuaa

SEQ ID NO: 2148848 - RNA, 21 nt, Staphylococcus aureus subsp. aureus N315
auaucuuaugauacuuugaaa

SEQ ID NO: 2148849 - RNA, 17 nt, Staphylococcus aureus subsp. aureus N315
auaucuucauuuaaaag

SEQ ID NO: 2148850 - RNA, 21 nt, Staphylococcus aureus subsp. aureus N315
auagcucuucuuuuucuugca

SEQ ID NO: 2148851 - RNA, 14 nt, Staphylococcus aureus subsp. aureus N315
auagcuacaauuaa

SEQ ID NO: 2148852 - RNA, 21 nt, Staphylococcus aureus subsp. aureus N315
auagcucaauugaaucuuugu

SEQ ID NO: 2148853 - RNA, 18 nt, Staphylococcus aureus subsp. aureus N315
auagcuauuacuauaaaa

SEQ ID NO: 2148854 - RNA, 13 nt, Staphylococcus aureus subsp. aureus N315
auagcuauauuua

SEQ ID NO: 2148855 - RNA, 16 nt, Staphylococcus aureus subsp. aureus N315
auaggaaacuuaaaua

SEQ ID NO: 2148856 - RNA, 15 nt, Staphylococcus aureus subsp. aureus N315
auaggaauacaugag

SEQ ID NO: 2148857 - RNA, 17 nt, Staphylococcus aureus subsp. aureus N315
auagcgguguuuugaga

SEQ ID NO: 2148858 - RNA, 13 nt, Staphylococcus aureus subsp. aureus N315
auagcuaaauaaa

SEQ ID NO: 2148859 - RNA, 20 nt, Staphylococcus aureus subsp. aureus N315
auagcagguggcauccauau

SEQ ID NO: 2148860 - RNA, 24 nt, Staphylococcus aureus subsp. aureus N315
auagcagggugcuaaauuuacgaa

SEQ ID NO: 2148861 - RNA, 21 nt, Staphylococcus aureus subsp. aureus N315
auagcaccguaacauauguac

SEQ ID NO: 2148862 - RNA, 16 nt, Staphylococcus aureus subsp. aureus N315
auacuuucaaacaaau

SEQ ID NO: 2148863 - RNA, 23 nt, Staphylococcus aureus subsp. aureus N315
auacuuucacuuugaauacaugu

SEQ ID NO: 2148864 - RNA, 14 nt, Staphylococcus aureus subsp. aureus N315
auacuuugaaagaa

SEQ ID NO: 2148865 - RNA, 22 nt, Staphylococcus aureus subsp. aureus N315
auacuuuuaccauugugaauaa

SEQ ID NO: 2148866 - RNA, 16 nt, Staphylococcus aureus subsp. aureus N315
auacuugaauuuaaua

SEQ ID NO: 2148867 - RNA, 17 nt, Staphylococcus aureus subsp. aureus N315
auacuugaagcaucgau

SEQ ID NO: 2148868 - RNA, 21 nt, Staphylococcus aureus subsp. aureus N315
auacuucuuuugcaaaacgca

SEQ ID NO: 2148869 - RNA, 12 nt, Staphylococcus aureus subsp. aureus N315
auacuugaagaa

SEQ ID NO: 2148870 - RNA, 13 nt, Staphylococcus aureus subsp. aureus N315
auacuugaagaaa

SEQ ID NO: 2148871 - RNA, 18 nt, Staphylococcus aureus subsp. aureus N315
auacuugaugaaacugau

SEQ ID NO: 2148872 - RNA, 19 nt, Staphylococcus aureus subsp. aureus N315
auacuugccuucaaauucu

SEQ ID NO: 2148873 - RNA, 14 nt, Staphylococcus aureus subsp. aureus N315
auagagaacagcag

SEQ ID NO: 2148874 - RNA, 20 nt, Staphylococcus aureus subsp. aureus N315
auacuuuuauagaaaauuaa

SEQ ID NO: 2148875 - RNA, 13 nt, Staphylococcus aureus subsp. aureus N315
auagagaaagaau

SEQ ID NO: 2148876 - RNA, 14 nt, Staphylococcus aureus subsp. aureus N315
auagagacauuuua

SEQ ID NO: 2148877 - RNA, 16 nt, Staphylococcus aureus subsp. aureus N315
auagauuaaaaaauca

SEQ ID NO: 2148878 - RNA, 16 nt, Staphylococcus aureus subsp. aureus N315
auagaugaaaauuuaa

SEQ ID NO: 2148879 - RNA, 24 nt, Staphylococcus aureus subsp. aureus N315
auagaugaugugacgauauuuguu

SEQ ID NO: 2148880 - RNA, 17 nt, Staphylococcus aureus subsp. aureus N315
auagcaauuuucgauau

SEQ ID NO: 2148881 - RNA, 17 nt, Staphylococcus aureus subsp. aureus N315
auagcaaugaauuaaua

SEQ ID NO: 2148882 - RNA, 21 nt, Staphylococcus aureus subsp. aureus N315
auaauuacuaaccuaaagaua

SEQ ID NO: 2148883 - RNA, 21 nt, Staphylococcus aureus subsp. aureus N315
auaauuaccuuuccauucgua

SEQ ID NO: 2148884 - RNA, 13 nt, Staphylococcus aureus subsp. aureus N315
auaauuaauguuu

SEQ ID NO: 2148885 - RNA, 21 nt, Staphylococcus aureus subsp. aureus N315
auaauuagauuuaaaauguca

SEQ ID NO: 2148886 - RNA, 22 nt, Staphylococcus aureus subsp. aureus N315
auaccguacaaagguaauagaa

SEQ ID NO: 2148887 - RNA, 17 nt, Staphylococcus aureus subsp. aureus N315
auacguaucaaaauuuu

SEQ ID NO: 2148888 - RNA, 20 nt, Staphylococcus aureus subsp. aureus N315
auacguaucaagaaaaaguu

SEQ ID NO: 2148889 - RNA, 19 nt, Staphylococcus aureus subsp. aureus N315
auacgauaauaacuagaac

SEQ ID NO: 2148890 - RNA, 17 nt, Staphylococcus aureus subsp. aureus N315
auacgagcuuugcucau

SEQ ID NO: 2148891 - RNA, 12 nt, Staphylococcus aureus subsp. aureus N315
auaccuuuaaau

SEQ ID NO: 2148892 - RNA, 22 nt, Staphylococcus aureus subsp. aureus N315
auacgcaaucauuguaaaugau

SEQ ID NO: 2148893 - RNA, 14 nt, Staphylococcus aureus subsp. aureus N315
auacgcaaaccaau

SEQ ID NO: 2148894 - RNA, 16 nt, Staphylococcus aureus subsp. aureus N315
auacgauugcaauugc

SEQ ID NO: 2148895 - RNA, 19 nt, Staphylococcus aureus subsp. aureus N315
auacucaucuguccgauau

SEQ ID NO: 2148896 - RNA, 14 nt, Staphylococcus aureus subsp. aureus N315
auacucuaaaaaag

SEQ ID NO: 2148897 - RNA, 17 nt, Staphylococcus aureus subsp. aureus N315
auacucugggcauuuug

SEQ ID NO: 2148898 - RNA, 16 nt, Staphylococcus aureus subsp. aureus N315
auacguguguuuucuu

SEQ ID NO: 2148899 - RNA, 15 nt, Staphylococcus aureus subsp. aureus N315
auacgugcuuuaaag

SEQ ID NO: 2148900 - RNA, 20 nt, Staphylococcus aureus subsp. aureus N315
auacguuauuucaauaauaa

SEQ ID NO: 2148901 - RNA, 14 nt, Staphylococcus aureus subsp. aureus N315
auacguuauuuuuu

SEQ ID NO: 2148902 - RNA, 13 nt, Staphylococcus aureus subsp. aureus N315
auacuauacugau

SEQ ID NO: 2148903 - RNA, 16 nt, Staphylococcus aureus subsp. aureus N315
auacuauaugaaaaga

SEQ ID NO: 2148904 - RNA, 14 nt, Staphylococcus aureus subsp. aureus N315
auacuauacugaug

SEQ ID NO: 2148905 - RNA, 16 nt, Staphylococcus aureus subsp. aureus N315
auacuauaugucuuau

SEQ ID NO: 2148906 - RNA, 17 nt, Staphylococcus aureus subsp. aureus N315
auacuauaugaaaagag

SEQ ID NO: 2148907 - RNA, 19 nt, Staphylococcus aureus subsp. aureus N315
auacuaucugacauuuaaa

SEQ ID NO: 2148908 - RNA, 21 nt, Staphylococcus aureus subsp. aureus N315
auacuauaugucuuaucaauu

SEQ ID NO: 2148909 - RNA, 13 nt, Staphylococcus aureus subsp. aureus N315
auacucaauaaaa

SEQ ID NO: 2148910 - RNA, 14 nt, Staphylococcus aureus subsp. aureus N315
auacuguuuaaaua

SEQ ID NO: 2148911 - RNA, 13 nt, Staphylococcus aureus subsp. aureus N315
auacuucuauuuu

SEQ ID NO: 2148912 - RNA, 19 nt, Staphylococcus aureus subsp. aureus N315
auacuucuauuuuauaaua

SEQ ID NO: 2148913 - RNA, 13 nt, Staphylococcus aureus subsp. aureus N315
auacuucuuguuc

SEQ ID NO: 2148914 - RNA, 15 nt, Staphylococcus aureus subsp. aureus N315
auacugucaucuuuc

SEQ ID NO: 2148915 - RNA, 16 nt, Staphylococcus aureus subsp. aureus N315
auacugccauauguuu

SEQ ID NO: 2148916 - RNA, 14 nt, Staphylococcus aureus subsp. aureus N315
auacugauauuuag

SEQ ID NO: 2148917 - RNA, 20 nt, Staphylococcus aureus subsp. aureus N315
auauuugcuagucauaauuu

SEQ ID NO: 2148918 - RNA, 17 nt, Staphylococcus aureus subsp. aureus N315
auauuuggaaguuuuca

SEQ ID NO: 2148919 - RNA, 16 nt, Staphylococcus aureus subsp. aureus N315
auauuuguauaugcaa

SEQ ID NO: 2148920 - RNA, 17 nt, Staphylococcus aureus subsp. aureus N315
auauuuuaaaaaguaau

SEQ ID NO: 2148921 - RNA, 18 nt, Staphylococcus aureus subsp. aureus N315
auauuuuauuuaaaaaua

SEQ ID NO: 2148922 - RNA, 14 nt, Staphylococcus aureus subsp. aureus N315
auauuuuauuuaaa

SEQ ID NO: 2148923 - RNA, 22 nt, Staphylococcus aureus subsp. aureus N315
auauuuuauuuaaaaauagccu

SEQ ID NO: 2148924 - RNA, 13 nt, Staphylococcus aureus subsp. aureus N315
auauuguauuuua

SEQ ID NO: 2148925 - RNA, 17 nt, Staphylococcus aureus subsp. aureus N315
auauugucgacuuuuag

SEQ ID NO: 2148926 - RNA, 13 nt, Staphylococcus aureus subsp. aureus N315
auauuguuaauuc

SEQ ID NO: 2148927 - RNA, 22 nt, Staphylococcus aureus subsp. aureus N315
auauuguuuaggaucuucuugu

SEQ ID NO: 2148928 - RNA, 19 nt, Staphylococcus aureus subsp. aureus N315
auauuuucuuagaaaauca

SEQ ID NO: 2148929 - RNA, 14 nt, Staphylococcus aureus subsp. aureus N315
auauuuucugcgau

SEQ ID NO: 2148930 - RNA, 12 nt, Staphylococcus aureus subsp. aureus N315
auauuuugauuu

SEQ ID NO: 2148931 - RNA, 11 nt, Staphylococcus aureus subsp. aureus N315
auauuuucuua

SEQ ID NO: 2148932 - RNA, 13 nt, Staphylococcus aureus subsp. aureus N315
auauuuuuaggaa

SEQ ID NO: 2148933 - RNA, 18 nt, Staphylococcus aureus subsp. aureus N315
auauuuuuacauauuuau

SEQ ID NO: 2148934 - RNA, 20 nt, Staphylococcus aureus subsp. aureus N315
auauuuuuaauuauuuuaaa

SEQ ID NO: 2148935 - RNA, 14 nt, Staphylococcus aureus subsp. aureus N315
aucaaaaauaaaaa

SEQ ID NO: 2148936 - RNA, 13 nt, Staphylococcus aureus subsp. aureus N315
aucaaaaauaaaa

SEQ ID NO: 2148937 - RNA, 14 nt, Staphylococcus aureus subsp. aureus N315
auauuuuuucugug

SEQ ID NO: 2148938 - RNA, 14 nt, Staphylococcus aureus subsp. aureus N315
auauucuaaaaaau

SEQ ID NO: 2148939 - RNA, 21 nt, Staphylococcus aureus subsp. aureus N315
auauucuaaaaaauuaaaaau

SEQ ID NO: 2148940 - RNA, 18 nt, Staphylococcus aureus subsp. aureus N315
auauucuacaugaaucaa

SEQ ID NO: 2148941 - RNA, 21 nt, Staphylococcus aureus subsp. aureus N315
auauucuagauucauauuuau

SEQ ID NO: 2148942 - RNA, 20 nt, Staphylococcus aureus subsp. aureus N315
auauucgauacauaaaacau

SEQ ID NO: 2148943 - RNA, 23 nt, Staphylococcus aureus subsp. aureus N315
auauucgcgaacguuauuuucaa

SEQ ID NO: 2148944 - RNA, 22 nt, Staphylococcus aureus subsp. aureus N315
auauucuagauucauauuuaua

SEQ ID NO: 2148945 - RNA, 16 nt, Staphylococcus aureus subsp. aureus N315
auauugaugaauaaau

SEQ ID NO: 2148946 - RNA, 16 nt, Staphylococcus aureus subsp. aureus N315
auauugcaaaaauaau

SEQ ID NO: 2148947 - RNA, 20 nt, Staphylococcus aureus subsp. aureus N315
auauugauucuagugaaaua

SEQ ID NO: 2148948 - RNA, 20 nt, Staphylococcus aureus subsp. aureus N315
auaugauuacaacuuauucu

SEQ ID NO: 2148949 - RNA, 17 nt, Staphylococcus aureus subsp. aureus N315
auaugauguuaaaaaau

SEQ ID NO: 2148950 - RNA, 22 nt, Staphylococcus aureus subsp. aureus N315
auauuaugauacgcuuuuuaaa

SEQ ID NO: 2148951 - RNA, 15 nt, Staphylococcus aureus subsp. aureus N315
auaugauaaccaaac

SEQ ID NO: 2148952 - RNA, 20 nt, Staphylococcus aureus subsp. aureus N315
auaugauaaccaaaccauaa

SEQ ID NO: 2148953 - RNA, 16 nt, Staphylococcus aureus subsp. aureus N315
auaugagguucaguag

SEQ ID NO: 2148954 - RNA, 16 nt, Staphylococcus aureus subsp. aureus N315
auaugacuuuauuucu

SEQ ID NO: 2148955 - RNA, 21 nt, Staphylococcus aureus subsp. aureus N315
auauucaccuacaacaccaau

SEQ ID NO: 2148956 - RNA, 14 nt, Staphylococcus aureus subsp. aureus N315
auauucaaaauaac

SEQ ID NO: 2148957 - RNA, 15 nt, Staphylococcus aureus subsp. aureus N315
auauucaaaauaacu

SEQ ID NO: 2148958 - RNA, 14 nt, Staphylococcus aureus subsp. aureus N315
auauucaacuuauu

SEQ ID NO: 2148959 - RNA, 13 nt, Staphylococcus aureus subsp. aureus N315
auauuauuucaau

SEQ ID NO: 2148960 - RNA, 12 nt, Staphylococcus aureus subsp. aureus N315
auauuauuuuua

SEQ ID NO: 2148961 - RNA, 19 nt, Staphylococcus aureus subsp. aureus N315
aucaauuucuguaauaaua

SEQ ID NO: 2148962 - RNA, 18 nt, Staphylococcus aureus subsp. aureus N315
aucaauuucuauuucacu

SEQ ID NO: 2148963 - RNA, 22 nt, Staphylococcus aureus subsp. aureus N315
aucaauuuauuauuaacuguac

SEQ ID NO: 2148964 - RNA, 16 nt, Staphylococcus aureus subsp. aureus N315
aucaauuuauuauuaa

SEQ ID NO: 2148965 - RNA, 15 nt, Staphylococcus aureus subsp. aureus N315
aucaauuuaauuaag

SEQ ID NO: 2148966 - RNA, 22 nt, Staphylococcus aureus subsp. aureus N315
aucaauucgcgucauuuguuca

SEQ ID NO: 2148967 - RNA, 22 nt, Staphylococcus aureus subsp. aureus N315
aucacaauacgaaaucaaaaau

SEQ ID NO: 2148968 - RNA, 23 nt, Staphylococcus aureus subsp. aureus N315
aucacaauacgaaaucaaaaaua

SEQ ID NO: 2148969 - RNA, 15 nt, Staphylococcus aureus subsp. aureus N315
aucaaguugauaaug

SEQ ID NO: 2148970 - RNA, 19 nt, Staphylococcus aureus subsp. aureus N315
aucaauaugaccuuuaugu

SEQ ID NO: 2148971 - RNA, 13 nt, Staphylococcus aureus subsp. aureus N315
aucaauauaaccg

SEQ ID NO: 2148972 - RNA, 15 nt, Staphylococcus aureus subsp. aureus N315
aucaauauaauuugg

SEQ ID NO: 2148973 - RNA, 21 nt, Staphylococcus aureus subsp. aureus N315
aucaauaguuuauaaauuaau

SEQ ID NO: 2148974 - RNA, 20 nt, Staphylococcus aureus subsp. aureus N315
aucaauaguuuauaaauuaa

SEQ ID NO: 2148975 - RNA, 16 nt, Staphylococcus aureus subsp. aureus N315
aucaauaguuuauaaa

SEQ ID NO: 2148976 - RNA, 14 nt, Staphylococcus aureus subsp. aureus N315
aucaauaguuuaua

SEQ ID NO: 2148977 - RNA, 19 nt, Staphylococcus aureus subsp. aureus N315
aucaauuauugaaaacaaa

SEQ ID NO: 2148978 - RNA, 19 nt, Staphylococcus aureus subsp. aureus N315
aucaauuacucuuuuucuu

SEQ ID NO: 2148979 - RNA, 13 nt, Staphylococcus aureus subsp. aureus N315
aucaauuagccaa

SEQ ID NO: 2148980 - RNA, 14 nt, Staphylococcus aureus subsp. aureus N315
aucaaccuguucuu

SEQ ID NO: 2148981 - RNA, 18 nt, Staphylococcus aureus subsp. aureus N315
aucaaccuguucuuuauu

SEQ ID NO: 2148982 - RNA, 17 nt, Staphylococcus aureus subsp. aureus N315
aucaacauuaauaaaua

SEQ ID NO: 2148983 - RNA, 15 nt, Staphylococcus aureus subsp. aureus N315
aucaaacaacaucac

SEQ ID NO: 2148984 - RNA, 18 nt, Staphylococcus aureus subsp. aureus N315
aucaacgccauauuuauu

SEQ ID NO: 2148985 - RNA, 19 nt, Staphylococcus aureus subsp. aureus N315
aucaacgagucauaaauau

SEQ ID NO: 2148986 - RNA, 20 nt, Staphylococcus aureus subsp. aureus N315
aucaacgagucauaaauaua

SEQ ID NO: 2148987 - RNA, 22 nt, Staphylococcus aureus subsp. aureus N315
aucaaccuguucuuuauuuaaa

SEQ ID NO: 2148988 - RNA, 19 nt, Staphylococcus aureus subsp. aureus N315
aucaacgauugaauuguag

SEQ ID NO: 2148989 - RNA, 18 nt, Staphylococcus aureus subsp. aureus N315
aucaagucugcauuaauu

SEQ ID NO: 2148990 - RNA, 16 nt, Staphylococcus aureus subsp. aureus N315
aucaaguauaaauguu

SEQ ID NO: 2148991 - RNA, 17 nt, Staphylococcus aureus subsp. aureus N315
aucaaguaguuaucuaa

SEQ ID NO: 2148992 - RNA, 16 nt, Staphylococcus aureus subsp. aureus N315
aucaagcuagcaucau

SEQ ID NO: 2148993 - RNA, 15 nt, Staphylococcus aureus subsp. aureus N315
aucaagcugagcuuu

SEQ ID NO: 2148994 - RNA, 12 nt, Staphylococcus aureus subsp. aureus N315
aucagacuaaaa

SEQ ID NO: 2148995 - RNA, 23 nt, Staphylococcus aureus subsp. aureus N315
aucagcauuuaagcuaucuaaac

SEQ ID NO: 2148996 - RNA, 18 nt, Staphylococcus aureus subsp. aureus N315
aucacaguacacuaaguu

SEQ ID NO: 2148997 - RNA, 17 nt, Staphylococcus aureus subsp. aureus N315
aucacagcaauaauaau

SEQ ID NO: 2148998 - RNA, 16 nt, Staphylococcus aureus subsp. aureus N315
aucacagcaauaauaa

SEQ ID NO: 2148999 - RNA, 15 nt, Staphylococcus aureus subsp. aureus N315
aucacagcaauaaua

SEQ ID NO: 2149000 - RNA, 16 nt, Staphylococcus aureus subsp. aureus N315
aucacaguuauauauu

SEQ ID NO: 2149001 - RNA, 13 nt, Staphylococcus aureus subsp. aureus N315
aucacaucauacc

SEQ ID NO: 2149002 - RNA, 23 nt, Staphylococcus aureus subsp. aureus N315
aucaccaacaacuuuguuuucag

SEQ ID NO: 2149003 - RNA, 15 nt, Staphylococcus aureus subsp. aureus N315
aucaccagauuuuaa

SEQ ID NO: 2149004 - RNA, 23 nt, Staphylococcus aureus subsp. aureus N315
aucaccaauggcagaugauuaug

SEQ ID NO: 2149005 - RNA, 19 nt, Staphylococcus aureus subsp. aureus N315
aucacuauauuucacacag

SEQ ID NO: 2149006 - RNA, 14 nt, Staphylococcus aureus subsp. aureus N315
aucacuccucuauu

SEQ ID NO: 2149007 - RNA, 16 nt, Staphylococcus aureus subsp. aureus N315
aucacucaacauauua

SEQ ID NO: 2149008 - RNA, 21 nt, Staphylococcus aureus subsp. aureus N315
aucacugaaugcuaauacuaa

SEQ ID NO: 2149009 - RNA, 23 nt, Staphylococcus aureus subsp. aureus N315
aucacgauuuucaaguaaugaua

SEQ ID NO: 2149010 - RNA, 15 nt, Staphylococcus aureus subsp. aureus N315
aucacgaucuuuaaa

SEQ ID NO: 2149011 - RNA, 14 nt, Staphylococcus aureus subsp. aureus N315
aucacgauauguug

SEQ ID NO: 2149012 - RNA, 23 nt, Staphylococcus aureus subsp. aureus N315
aucacgauauguugugcugccaa

SEQ ID NO: 2149013 - RNA, 15 nt, Staphylococcus aureus subsp. aureus N315
aucacgccauaaucu

SEQ ID NO: 2149014 - RNA, 22 nt, Staphylococcus aureus subsp. aureus N315
aguuugauaugcucucuucaaa

SEQ ID NO: 2149015 - RNA, 17 nt, Staphylococcus aureus subsp. aureus N315
aguuuguccuuuaagaa

SEQ ID NO: 2149016 - RNA, 19 nt, Staphylococcus aureus subsp. aureus N315
aguuucuacuguauaagug

SEQ ID NO: 2149017 - RNA, 20 nt, Staphylococcus aureus subsp. aureus N315
aguuucuauagaauuuuuca

SEQ ID NO: 2149018 - RNA, 14 nt, Staphylococcus aureus subsp. aureus N315
aguuucggaaaaag

SEQ ID NO: 2149019 - RNA, 18 nt, Staphylococcus aureus subsp. aureus N315
aguuucugagaagaaaua

SEQ ID NO: 2149020 - RNA, 14 nt, Staphylococcus aureus subsp. aureus N315
aguuucugagaaga

SEQ ID NO: 2149021 - RNA, 18 nt, Staphylococcus aureus subsp. aureus N315
aguuucucuacuaauauu

SEQ ID NO: 2149022 - RNA, 19 nt, Staphylococcus aureus subsp. aureus N315
aguuuacagguugaauaaa

SEQ ID NO: 2149023 - RNA, 19 nt, Staphylococcus aureus subsp. aureus N315
aguuuugaagaauaaaaaa

SEQ ID NO: 2149024 - RNA, 16 nt, Staphylococcus aureus subsp. aureus N315
aguuuucuucacugcu

SEQ ID NO: 2149025 - RNA, 21 nt, Staphylococcus aureus subsp. aureus N315
aguuuucggcuagauuuuaaa

SEQ ID NO: 2149026 - RNA, 16 nt, Staphylococcus aureus subsp. aureus N315
aguuuuacugagggau

SEQ ID NO: 2149027 - RNA, 16 nt, Staphylococcus aureus subsp. aureus N315
aguuuguuucuaaauu

SEQ ID NO: 2149028 - RNA, 20 nt, Staphylococcus aureus subsp. aureus N315
aguuuguuucuaaauucuuu

SEQ ID NO: 2149029 - RNA, 14 nt, Staphylococcus aureus subsp. aureus N315
auaaaaaaagagac

SEQ ID NO: 2149030 - RNA, 15 nt, Staphylococcus aureus subsp. aureus N315
aguuuuuuuauaagc

SEQ ID NO: 2149031 - RNA, 19 nt, Staphylococcus aureus subsp. aureus N315
aguuuuuuuaaaguuuaaa

SEQ ID NO: 2149032 - RNA, 16 nt, Staphylococcus aureus subsp. aureus N315
aguuuuuuuaaaguuu

SEQ ID NO: 2149033 - RNA, 14 nt, Staphylococcus aureus subsp. aureus N315
aguuuuuaaaucaa

SEQ ID NO: 2149034 - RNA, 15 nt, Staphylococcus aureus subsp. aureus N315
aguugaauauaaaaa

SEQ ID NO: 2149035 - RNA, 13 nt, Staphylococcus aureus subsp. aureus N315
aguucuuuuugau

SEQ ID NO: 2149036 - RNA, 14 nt, Staphylococcus aureus subsp. aureus N315
aguugaaaauaauc

SEQ ID NO: 2149037 - RNA, 21 nt, Staphylococcus aureus subsp. aureus N315
aguugaaaaccucuuuuuguu

SEQ ID NO: 2149038 - RNA, 21 nt, Staphylococcus aureus subsp. aureus N315
aguugauugcaugacagcaaa

SEQ ID NO: 2149039 - RNA, 16 nt, Staphylococcus aureus subsp. aureus N315
aguugcugaauaaaau

SEQ ID NO: 2149040 - RNA, 22 nt, Staphylococcus aureus subsp. aureus N315
aguugcauaaucaauuucaccu

SEQ ID NO: 2149041 - RNA, 24 nt, Staphylococcus aureus subsp. aureus N315
aguugcacuugguucauaaugauc

SEQ ID NO: 2149042 - RNA, 17 nt, Staphylococcus aureus subsp. aureus N315
aguuguuauuuuugcua

SEQ ID NO: 2149043 - RNA, 14 nt, Staphylococcus aureus subsp. aureus N315
aguuguugaaauuu

SEQ ID NO: 2149044 - RNA, 15 nt, Staphylococcus aureus subsp. aureus N315
aguuguuaggggcuc

SEQ ID NO: 2149045 - RNA, 15 nt, Staphylococcus aureus subsp. aureus N315
aguuuaacaauacua

SEQ ID NO: 2149046 - RNA, 13 nt, Staphylococcus aureus subsp. aureus N315
aguuuaacaauac

SEQ ID NO: 2149047 - RNA, 15 nt, Staphylococcus aureus subsp. aureus N315
aguuguugcaacuug

SEQ ID NO: 2149048 - RNA, 11 nt, Staphylococcus aureus subsp. aureus N315
aguuuaaaaau

SEQ ID NO: 2149049 - RNA, 19 nt, Staphylococcus aureus subsp. aureus N315
aguuacuauauuuauuagu

SEQ ID NO: 2149050 - RNA, 17 nt, Staphylococcus aureus subsp. aureus N315
aguuaccuacuacauuc

SEQ ID NO: 2149051 - RNA, 19 nt, Staphylococcus aureus subsp. aureus N315
aguuaaaauugguuuggau

SEQ ID NO: 2149052 - RNA, 13 nt, Staphylococcus aureus subsp. aureus N315
aguguuuguaaug

SEQ ID NO: 2149053 - RNA, 17 nt, Staphylococcus aureus subsp. aureus N315
aguuaaaagugguuuua

SEQ ID NO: 2149054 - RNA, 17 nt, Staphylococcus aureus subsp. aureus N315
aguuaaaauaaccauuu

SEQ ID NO: 2149055 - RNA, 22 nt, Staphylococcus aureus subsp. aureus N315
aguuaaacgaaaaaugccaacu

SEQ ID NO: 2149056 - RNA, 23 nt, Staphylococcus aureus subsp. aureus N315
aguuaaaaccuuuucaaauuaua

SEQ ID NO: 2149057 - RNA, 20 nt, Staphylococcus aureus subsp. aureus N315
aguuaggcgacuuaacuuaa

SEQ ID NO: 2149058 - RNA, 21 nt, Staphylococcus aureus subsp. aureus N315
aguuaggcgacuuaacuuaag

SEQ ID NO: 2149059 - RNA, 17 nt, Staphylococcus aureus subsp. aureus N315
aguuacucaauauaaaa

SEQ ID NO: 2149060 - RNA, 17 nt, Staphylococcus aureus subsp. aureus N315
aguuacuucaguuuggu

SEQ ID NO: 2149061 - RNA, 15 nt, Staphylococcus aureus subsp. aureus N315
aguuagacuaaaaaa

SEQ ID NO: 2149062 - RNA, 21 nt, Staphylococcus aureus subsp. aureus N315
aguuacuuacgccaaucacaa

SEQ ID NO: 2149063 - RNA, 19 nt, Staphylococcus aureus subsp. aureus N315
aguguuucauaaucucuuu

SEQ ID NO: 2149064 - RNA, 13 nt, Staphylococcus aureus subsp. aureus N315
aguguuauauugu

SEQ ID NO: 2149065 - RNA, 22 nt, Staphylococcus aureus subsp. aureus N315
aguguuauaauggcgggccccc

SEQ ID NO: 2149066 - RNA, 17 nt, Staphylococcus aureus subsp. aureus N315
aguguuauaaauagaga

SEQ ID NO: 2149067 - RNA, 23 nt, Staphylococcus aureus subsp. aureus N315
agugugcaggauaacguucacuu

SEQ ID NO: 2149068 - RNA, 16 nt, Staphylococcus aureus subsp. aureus N315
aguucaaauugaacuu

SEQ ID NO: 2149069 - RNA, 19 nt, Staphylococcus aureus subsp. aureus N315
aguucaaauugaacuucuu

SEQ ID NO: 2149070 - RNA, 19 nt, Staphylococcus aureus subsp. aureus N315
aguucaacagggguuuuua

SEQ ID NO: 2149071 - RNA, 14 nt, Staphylococcus aureus subsp. aureus N315
aguucaaacagaaa

SEQ ID NO: 2149072 - RNA, 15 nt, Staphylococcus aureus subsp. aureus N315
aguucaaaauacuca

SEQ ID NO: 2149073 - RNA, 19 nt, Staphylococcus aureus subsp. aureus N315
aguuauaccauauuuaugg

SEQ ID NO: 2149074 - RNA, 20 nt, Staphylococcus aureus subsp. aureus N315
aguucaaagcgauaaaguau

SEQ ID NO: 2149075 - RNA, 21 nt, Staphylococcus aureus subsp. aureus N315
agugguuuucuuuauuuuaaa

SEQ ID NO: 2149076 - RNA, 22 nt, Staphylococcus aureus subsp. aureus N315
agugguuguucccauuuuuaaa

SEQ ID NO: 2149077 - RNA, 14 nt, Staphylococcus aureus subsp. aureus N315
agugguaaaaauga

SEQ ID NO: 2149078 - RNA, 17 nt, Staphylococcus aureus subsp. aureus N315
agugguaaaaaguuuaa

SEQ ID NO: 2149079 - RNA, 21 nt, Staphylococcus aureus subsp. aureus N315
agugucaugcuuaauuuaugu

SEQ ID NO: 2149080 - RNA, 15 nt, Staphylococcus aureus subsp. aureus N315
agugucgagauuuua

SEQ ID NO: 2149081 - RNA, 16 nt, Staphylococcus aureus subsp. aureus N315
agugucgagauuuuau

SEQ ID NO: 2149082 - RNA, 20 nt, Staphylococcus aureus subsp. aureus N315
agugucgagauuuuauaagu

SEQ ID NO: 2149083 - RNA, 13 nt, Staphylococcus aureus subsp. aureus N315
aguguaccuuguu

SEQ ID NO: 2149084 - RNA, 14 nt, Staphylococcus aureus subsp. aureus N315
aguguaguaaaaau

SEQ ID NO: 2149085 - RNA, 19 nt, Staphylococcus aureus subsp. aureus N315
aguguauucauuuuaaauu

SEQ ID NO: 2149086 - RNA, 20 nt, Staphylococcus aureus subsp. aureus N315
agugcauuuuuuauuuuacu

SEQ ID NO: 2149087 - RNA, 19 nt, Staphylococcus aureus subsp. aureus N315
agugcgguuauuuauacag

SEQ ID NO: 2149088 - RNA, 16 nt, Staphylococcus aureus subsp. aureus N315
agugcucuugcaauag

SEQ ID NO: 2149089 - RNA, 13 nt, Staphylococcus aureus subsp. aureus N315
aguggauuacaga

SEQ ID NO: 2149090 - RNA, 19 nt, Staphylococcus aureus subsp. aureus N315
aguggauuacagaugaugc

SEQ ID NO: 2149091 - RNA, 13 nt, Staphylococcus aureus subsp. aureus N315
aguggcaaacauu

SEQ ID NO: 2149092 - RNA, 19 nt, Staphylococcus aureus subsp. aureus N315
agucguuguugaaauuaaa

SEQ ID NO: 2149093 - RNA, 22 nt, Staphylococcus aureus subsp. aureus N315
agucuaacaguuaauaugaauu

SEQ ID NO: 2149094 - RNA, 18 nt, Staphylococcus aureus subsp. aureus N315
agucguuuguacuucacu

SEQ ID NO: 2149095 - RNA, 16 nt, Staphylococcus aureus subsp. aureus N315
agucucuuuugauaaa

SEQ ID NO: 2149096 - RNA, 20 nt, Staphylococcus aureus subsp. aureus N315
agucuaggacauugauuucu

SEQ ID NO: 2149097 - RNA, 21 nt, Staphylococcus aureus subsp. aureus N315
aguaccuaaaauagaaaaauu

SEQ ID NO: 2149098 - RNA, 14 nt, Staphylococcus aureus subsp. aureus N315
aguccggggcccca

SEQ ID NO: 2149099 - RNA, 13 nt, Staphylococcus aureus subsp. aureus N315
agucuuuaacuuu

SEQ ID NO: 2149100 - RNA, 20 nt, Staphylococcus aureus subsp. aureus N315
agucuugugauaauucuuca

SEQ ID NO: 2149101 - RNA, 22 nt, Staphylococcus aureus subsp. aureus N315
agucuucuuacugcaauuauuu

SEQ ID NO: 2149102 - RNA, 17 nt, Staphylococcus aureus subsp. aureus N315
agucuucuuuuuuuaac

SEQ ID NO: 2149103 - RNA, 19 nt, Staphylococcus aureus subsp. aureus N315
agucuucuuuuuuuaacuu

SEQ ID NO: 2149104 - RNA, 16 nt, Staphylococcus aureus subsp. aureus N315
agugaauuaucuauau

SEQ ID NO: 2149105 - RNA, 15 nt, Staphylococcus aureus subsp. aureus N315
agugacacuguaacg

SEQ ID NO: 2149106 - RNA, 13 nt, Staphylococcus aureus subsp. aureus N315
agugaccucaggu

SEQ ID NO: 2149107 - RNA, 14 nt, Staphylococcus aureus subsp. aureus N315
agugaccucagguu

SEQ ID NO: 2149108 - RNA, 17 nt, Staphylococcus aureus subsp. aureus N315
agugaccucagguuguu

SEQ ID NO: 2149109 - RNA, 13 nt, Staphylococcus aureus subsp. aureus N315
agucuguugguuu

SEQ ID NO: 2149110 - RNA, 14 nt, Staphylococcus aureus subsp. aureus N315
agucuuauuuuuau

SEQ ID NO: 2149111 - RNA, 15 nt, Staphylococcus aureus subsp. aureus N315
auaacgugcuuuuuu

SEQ ID NO: 2149112 - RNA, 15 nt, Staphylococcus aureus subsp. aureus N315
auaaccuagguuaaa

SEQ ID NO: 2149113 - RNA, 20 nt, Staphylococcus aureus subsp. aureus N315
auaaccuaauucgccaucuu

SEQ ID NO: 2149114 - RNA, 14 nt, Staphylococcus aureus subsp. aureus N315
auaacuagaaugau

SEQ ID NO: 2149115 - RNA, 16 nt, Staphylococcus aureus subsp. aureus N315
auaacguucuguuuug

SEQ ID NO: 2149116 - RNA, 20 nt, Staphylococcus aureus subsp. aureus N315
auaacuagaacaagaauuau

SEQ ID NO: 2149117 - RNA, 13 nt, Staphylococcus aureus subsp. aureus N315
auaacuacacuua

SEQ ID NO: 2149118 - RNA, 12 nt, Staphylococcus aureus subsp. aureus N315
auaacuuuaaaa

SEQ ID NO: 2149119 - RNA, 13 nt, Staphylococcus aureus subsp. aureus N315
auaacuuguaaua

SEQ ID NO: 2149120 - RNA, 15 nt, Staphylococcus aureus subsp. aureus N315
auaacuucguuuuaa

SEQ ID NO: 2149121 - RNA, 16 nt, Staphylococcus aureus subsp. aureus N315
auaacuuuaaaaauua

SEQ ID NO: 2149122 - RNA, 13 nt, Staphylococcus aureus subsp. aureus N315
auaacuuuaaaaa

SEQ ID NO: 2149123 - RNA, 15 nt, Staphylococcus aureus subsp. aureus N315
auaacuuuaaaaauu

SEQ ID NO: 2149124 - RNA, 15 nt, Staphylococcus aureus subsp. aureus N315
auaacuuuauauaua

SEQ ID NO: 2149125 - RNA, 15 nt, Staphylococcus aureus subsp. aureus N315
auaagaaaauaccua

SEQ ID NO: 2149126 - RNA, 14 nt, Staphylococcus aureus subsp. aureus N315
auaagaaaauacua

SEQ ID NO: 2149127 - RNA, 15 nt, Staphylococcus aureus subsp. aureus N315
auaacugauaauacu

SEQ ID NO: 2149128 - RNA, 15 nt, Staphylococcus aureus subsp. aureus N315
auaacucuaaauaua

SEQ ID NO: 2149129 - RNA, 21 nt, Staphylococcus aureus subsp. aureus N315
auaacucgcuucguucuaaaa

SEQ ID NO: 2149130 - RNA, 14 nt, Staphylococcus aureus subsp. aureus N315
auaacuccuccaaa

SEQ ID NO: 2149131 - RNA, 23 nt, Staphylococcus aureus subsp. aureus N315
auaacuguucuuucgucuuguaa

SEQ ID NO: 2149132 - RNA, 20 nt, Staphylococcus aureus subsp. aureus N315
auaacugcauguacaucuuu

SEQ ID NO: 2149133 - RNA, 16 nt, Staphylococcus aureus subsp. aureus N315
auaacccauuuucaaa

SEQ ID NO: 2149134 - RNA, 22 nt, Staphylococcus aureus subsp. aureus N315
auaacauucuucaaaaaauaau

SEQ ID NO: 2149135 - RNA, 23 nt, Staphylococcus aureus subsp. aureus N315
auaacauucuucaaaaaauaaua

SEQ ID NO: 2149136 - RNA, 20 nt, Staphylococcus aureus subsp. aureus N315
auaacauuggcaaacgaaua

SEQ ID NO: 2149137 - RNA, 23 nt, Staphylococcus aureus subsp. aureus N315
auaacauuggcaaacgaauauuc

SEQ ID NO: 2149138 - RNA, 18 nt, Staphylococcus aureus subsp. aureus N315
auaacauucuucaaaaaa

SEQ ID NO: 2149139 - RNA, 18 nt, Staphylococcus aureus subsp. aureus N315
auaacaccuuucauuugg

SEQ ID NO: 2149140 - RNA, 18 nt, Staphylococcus aureus subsp. aureus N315
auaacaauuuuaaaucuu

SEQ ID NO: 2149141 - RNA, 18 nt, Staphylococcus aureus subsp. aureus N315
auaaauuuuuaguuaaag

SEQ ID NO: 2149142 - RNA, 21 nt, Staphylococcus aureus subsp. aureus N315
auaaauuuugaauuacagauu

SEQ ID NO: 2149143 - RNA, 17 nt, Staphylococcus aureus subsp. aureus N315
auaaauuuugaauuaca

SEQ ID NO: 2149144 - RNA, 21 nt, Staphylococcus aureus subsp. aureus N315
auaaauuuucuguuuaauuaa

SEQ ID NO: 2149145 - RNA, 19 nt, Staphylococcus aureus subsp. aureus N315
auaaauuuuacgaaaauau

SEQ ID NO: 2149146 - RNA, 21 nt, Staphylococcus aureus subsp. aureus N315
auaaauuuguaccaaauaaau

SEQ ID NO: 2149147 - RNA, 16 nt, Staphylococcus aureus subsp. aureus N315
auaaauuagaugaaau

SEQ ID NO: 2149148 - RNA, 13 nt, Staphylococcus aureus subsp. aureus N315
auaaauuaaauuu

SEQ ID NO: 2149149 - RNA, 17 nt, Staphylococcus aureus subsp. aureus N315
auaaauuagaugaaaug

SEQ ID NO: 2149150 - RNA, 14 nt, Staphylococcus aureus subsp. aureus N315
auaaauuaguuuuu

SEQ ID NO: 2149151 - RNA, 15 nt, Staphylococcus aureus subsp. aureus N315
auaaauuaauugcuu

SEQ ID NO: 2149152 - RNA, 19 nt, Staphylococcus aureus subsp. aureus N315
auaaauguuaaagauuauu

SEQ ID NO: 2149153 - RNA, 16 nt, Staphylococcus aureus subsp. aureus N315
auaaauguuuauaucu

SEQ ID NO: 2149154 - RNA, 12 nt, Staphylococcus aureus subsp. aureus N315
auaaauguuaaa

SEQ ID NO: 2149155 - RNA, 16 nt, Staphylococcus aureus subsp. aureus N315
auaaaugucauaguau

SEQ ID NO: 2149156 - RNA, 22 nt, Staphylococcus aureus subsp. aureus N315
auaaauguccgacuugauaaaa

SEQ ID NO: 2149157 - RNA, 13 nt, Staphylococcus aureus subsp. aureus N315
auaaaugacauuu

SEQ ID NO: 2149158 - RNA, 13 nt, Staphylococcus aureus subsp. aureus N315
auaaaugucacug

SEQ ID NO: 2149159 - RNA, 15 nt, Staphylococcus aureus subsp. aureus N315
auaaaugaauugucu

SEQ ID NO: 2149160 - RNA, 12 nt, Staphylococcus aureus subsp. aureus N315
auaaacaauaaa

SEQ ID NO: 2149161 - RNA, 20 nt, Staphylococcus aureus subsp. aureus N315
auaaacaacugcaauagcua

SEQ ID NO: 2149162 - RNA, 13 nt, Staphylococcus aureus subsp. aureus N315
auaaaauuuugaa

SEQ ID NO: 2149163 - RNA, 14 nt, Staphylococcus aureus subsp. aureus N315
auaaaccagcugau

SEQ ID NO: 2149164 - RNA, 23 nt, Staphylococcus aureus subsp. aureus N315
auaaaccaaaucggaauaaaaua

SEQ ID NO: 2149165 - RNA, 14 nt, Staphylococcus aureus subsp. aureus N315
auaaacaauaacug

SEQ ID NO: 2149166 - RNA, 13 nt, Staphylococcus aureus subsp. aureus N315
auaaacaauaacu

SEQ ID NO: 2149167 - RNA, 19 nt, Staphylococcus aureus subsp. aureus N315
auaaaaagaauaugauauu

SEQ ID NO: 2149168 - RNA, 21 nt, Staphylococcus aureus subsp. aureus N315
auaaaaaggagcgacaaugga

SEQ ID NO: 2149169 - RNA, 13 nt, Staphylococcus aureus subsp. aureus N315
auaaaaaacaaua

SEQ ID NO: 2149170 - RNA, 17 nt, Staphylococcus aureus subsp. aureus N315
auaaaaaaccaagugca

SEQ ID NO: 2149171 - RNA, 15 nt, Staphylococcus aureus subsp. aureus N315
auaaaaaaauuaacu

SEQ ID NO: 2149172 - RNA, 12 nt, Staphylococcus aureus subsp. aureus N315
auaaaaauaaaa

SEQ ID NO: 2149173 - RNA, 16 nt, Staphylococcus aureus subsp. aureus N315
auaaaaagugaaagua

SEQ ID NO: 2149174 - RNA, 18 nt, Staphylococcus aureus subsp. aureus N315
auaaaaagugaaaguauu

SEQ ID NO: 2149175 - RNA, 18 nt, Staphylococcus aureus subsp. aureus N315
auaaagauagaaugaaua

SEQ ID NO: 2149176 - RNA, 14 nt, Staphylococcus aureus subsp. aureus N315
auaaacuacacacg

SEQ ID NO: 2149177 - RNA, 12 nt, Staphylococcus aureus subsp. aureus N315
auaaacuaaaaa

SEQ ID NO: 2149178 - RNA, 19 nt, Staphylococcus aureus subsp. aureus N315
auaaaccuacaauauagaa

SEQ ID NO: 2149179 - RNA, 19 nt, Staphylococcus aureus subsp. aureus N315
auaaaccuaaugcuuuaau

SEQ ID NO: 2149180 - RNA, 21 nt, Staphylococcus aureus subsp. aureus N315
auaaaccgauuguuucaccag

SEQ ID NO: 2149181 - RNA, 23 nt, Staphylococcus aureus subsp. aureus N315
auaaaccgauuguuucaccagcu

SEQ ID NO: 2149182 - RNA, 16 nt, Staphylococcus aureus subsp. aureus N315
auaaaucgauaaaaug

SEQ ID NO: 2149183 - RNA, 14 nt, Staphylococcus aureus subsp. aureus N315
auaaauauuuuuaa

SEQ ID NO: 2149184 - RNA, 21 nt, Staphylococcus aureus subsp. aureus N315
auaaauccuaagucuuuuaaa

SEQ ID NO: 2149185 - RNA, 19 nt, Staphylococcus aureus subsp. aureus N315
auaaauauuuaaaauauua

SEQ ID NO: 2149186 - RNA, 13 nt, Staphylococcus aureus subsp. aureus N315
auaaauauuuuua

SEQ ID NO: 2149187 - RNA, 14 nt, Staphylococcus aureus subsp. aureus N315
auaaauauuuaaaa

SEQ ID NO: 2149188 - RNA, 14 nt, Staphylococcus aureus subsp. aureus N315
auaaauauuguguu

SEQ ID NO: 2149189 - RNA, 22 nt, Staphylococcus aureus subsp. aureus N315
auaaaugaauuauuuaaaaugc

SEQ ID NO: 2149190 - RNA, 18 nt, Staphylococcus aureus subsp. aureus N315
auaaaucguguuaauucu

SEQ ID NO: 2149191 - RNA, 20 nt, Staphylococcus aureus subsp. aureus N315
auaaaucguaauaauuuugu

SEQ ID NO: 2149192 - RNA, 19 nt, Staphylococcus aureus subsp. aureus N315
auaaaucuaauacuuucaa

SEQ ID NO: 2149193 - RNA, 15 nt, Staphylococcus aureus subsp. aureus N315
auaaaucuaucuacu

SEQ ID NO: 2149194 - RNA, 17 nt, Staphylococcus aureus subsp. aureus N315
auaaaucuccauuaauc

SEQ ID NO: 2149195 - RNA, 21 nt, Staphylococcus aureus subsp. aureus N315
auaaaucuccauuaaucauuu

SEQ ID NO: 2149196 - RNA, 18 nt, Staphylococcus aureus subsp. aureus N315
auaaauacaaauauaucu

SEQ ID NO: 2149197 - RNA, 21 nt, Staphylococcus aureus subsp. aureus N315
auaaauaauuucggauuaucu

SEQ ID NO: 2149198 - RNA, 22 nt, Staphylococcus aureus subsp. aureus N315
auaaauaacuucguuuuaauaa

SEQ ID NO: 2149199 - RNA, 22 nt, Staphylococcus aureus subsp. aureus N315
auaaauaauaaguugaauauaa

SEQ ID NO: 2149200 - RNA, 22 nt, Staphylococcus aureus subsp. aureus N315
auaaauaagcaaucauaauacu

SEQ ID NO: 2149201 - RNA, 20 nt, Staphylococcus aureus subsp. aureus N315
auaaauaacacgauuugguu

SEQ ID NO: 2149202 - RNA, 15 nt, Staphylococcus aureus subsp. aureus N315
auaaauauuaagcgu

SEQ ID NO: 2149203 - RNA, 19 nt, Staphylococcus aureus subsp. aureus N315
auaaauacaauagaaauga

SEQ ID NO: 2149204 - RNA, 22 nt, Staphylococcus aureus subsp. aureus N315
auaaauaucaauuguugcaaaa

SEQ ID NO: 2149205 - RNA, 21 nt, Staphylococcus aureus subsp. aureus N315
auaaauaugauguuaaaaaau

SEQ ID NO: 2149206 - RNA, 17 nt, Staphylococcus aureus subsp. aureus N315
auaaauaugauguuaaa

SEQ ID NO: 2149207 - RNA, 20 nt, Staphylococcus aureus subsp. aureus N315
auaaagcugcgauauaacua

SEQ ID NO: 2149208 - RNA, 15 nt, Staphylococcus aureus subsp. aureus N315
auaaaggaauagcua

SEQ ID NO: 2149209 - RNA, 21 nt, Staphylococcus aureus subsp. aureus N315
auaaagcugauuuuucauuga

SEQ ID NO: 2149210 - RNA, 14 nt, Staphylococcus aureus subsp. aureus N315
auaaaggcaacaaa

SEQ ID NO: 2149211 - RNA, 12 nt, Staphylococcus aureus subsp. aureus N315
auaaauaaaauu

SEQ ID NO: 2149212 - RNA, 13 nt, Staphylococcus aureus subsp. aureus N315
auaaauaaacuca

SEQ ID NO: 2149213 - RNA, 14 nt, Staphylococcus aureus subsp. aureus N315
auaaauaaaaugcu

SEQ ID NO: 2149214 - RNA, 13 nt, Staphylococcus aureus subsp. aureus N315
auaaauaaaaugc

SEQ ID NO: 2149215 - RNA, 17 nt, Staphylococcus aureus subsp. aureus N315
auaauauugaugaauaa

SEQ ID NO: 2149216 - RNA, 15 nt, Staphylococcus aureus subsp. aureus N315
auaaucaagaauaua

SEQ ID NO: 2149217 - RNA, 14 nt, Staphylococcus aureus subsp. aureus N315
auaaucaacaugug

SEQ ID NO: 2149218 - RNA, 14 nt, Staphylococcus aureus subsp. aureus N315
auaaucaagaauau

SEQ ID NO: 2149219 - RNA, 22 nt, Staphylococcus aureus subsp. aureus N315
auaaucaaaccaccaaaaauca

SEQ ID NO: 2149220 - RNA, 17 nt, Staphylococcus aureus subsp. aureus N315
auaaucaaaccaccaaa

SEQ ID NO: 2149221 - RNA, 23 nt, Staphylococcus aureus subsp. aureus N315
auaaucaacaaagugcaauuauu

SEQ ID NO: 2149222 - RNA, 13 nt, Staphylococcus aureus subsp. aureus N315
auaauauauccug

SEQ ID NO: 2149223 - RNA, 13 nt, Staphylococcus aureus subsp. aureus N315
auaauauaaaaac

SEQ ID NO: 2149224 - RNA, 15 nt, Staphylococcus aureus subsp. aureus N315
auaauauaaaacgau

SEQ ID NO: 2149225 - RNA, 21 nt, Staphylococcus aureus subsp. aureus N315
auaauauaaaacgauaagaau

SEQ ID NO: 2149226 - RNA, 13 nt, Staphylococcus aureus subsp. aureus N315
auaauauaaauaa

SEQ ID NO: 2149227 - RNA, 16 nt, Staphylococcus aureus subsp. aureus N315
auaauauaaauaaaag

SEQ ID NO: 2149228 - RNA, 19 nt, Staphylococcus aureus subsp. aureus N315
auaauacgcuugauaaaag

SEQ ID NO: 2149229 - RNA, 18 nt, Staphylococcus aureus subsp. aureus N315
auaauacgucguaaugaa

SEQ ID NO: 2149230 - RNA, 15 nt, Staphylococcus aureus subsp. aureus N315
auaauacuguuuaaa

SEQ ID NO: 2149231 - RNA, 15 nt, Staphylococcus aureus subsp. aureus N315
auaauagauaauagu

SEQ ID NO: 2149232 - RNA, 16 nt, Staphylococcus aureus subsp. aureus N315
auaauagcaaaauuau

SEQ ID NO: 2149233 - RNA, 18 nt, Staphylococcus aureus subsp. aureus N315
auaauagcuugagcaucu

SEQ ID NO: 2149234 - RNA, 19 nt, Staphylococcus aureus subsp. aureus N315
auaauaaucggacugaugg

SEQ ID NO: 2149235 - RNA, 21 nt, Staphylococcus aureus subsp. aureus N315
auaauaagagaacuuuucaaa

SEQ ID NO: 2149236 - RNA, 22 nt, Staphylococcus aureus subsp. aureus N315
auaauaaguugaauauaaaaaa

SEQ ID NO: 2149237 - RNA, 18 nt, Staphylococcus aureus subsp. aureus N315
auaauaaguugaauauaa

SEQ ID NO: 2149238 - RNA, 21 nt, Staphylococcus aureus subsp. aureus N315
auaauuaaaauaagauauaua

SEQ ID NO: 2149239 - RNA, 21 nt, Staphylococcus aureus subsp. aureus N315
auaauguuuccugauauuuca

SEQ ID NO: 2149240 - RNA, 14 nt, Staphylococcus aureus subsp. aureus N315
auaauuaacacauu

SEQ ID NO: 2149241 - RNA, 14 nt, Staphylococcus aureus subsp. aureus N315
auaauuaaauauaa

SEQ ID NO: 2149242 - RNA, 24 nt, Staphylococcus aureus subsp. aureus N315
auaauuaaacuaauagcauuugua

SEQ ID NO: 2149243 - RNA, 16 nt, Staphylococcus aureus subsp. aureus N315
auaauuaaauaaaaau

SEQ ID NO: 2149244 - RNA, 18 nt, Staphylococcus aureus subsp. aureus N315
auaauuaaauaaaaauau

SEQ ID NO: 2149245 - RNA, 15 nt, Staphylococcus aureus subsp. aureus N315
auaauuaaauaacuu

SEQ ID NO: 2149246 - RNA, 14 nt, Staphylococcus aureus subsp. aureus N315
auaaugcuacuauu

SEQ ID NO: 2149247 - RNA, 14 nt, Staphylococcus aureus subsp. aureus N315
auaaugcuauauuu

SEQ ID NO: 2149248 - RNA, 14 nt, Staphylococcus aureus subsp. aureus N315
auaaugaauaguaa

SEQ ID NO: 2149249 - RNA, 18 nt, Staphylococcus aureus subsp. aureus N315
auaaugaauaauuaaaaa

SEQ ID NO: 2149250 - RNA, 15 nt, Staphylococcus aureus subsp. aureus N315
auaaugaauaguaau

SEQ ID NO: 2149251 - RNA, 21 nt, Staphylococcus aureus subsp. aureus N315
auaaucacuuggcgacauuug

SEQ ID NO: 2149252 - RNA, 14 nt, Staphylococcus aureus subsp. aureus N315
auaaucaguauuua

SEQ ID NO: 2149253 - RNA, 16 nt, Staphylococcus aureus subsp. aureus N315
auaaucaguauuuacu

SEQ ID NO: 2149254 - RNA, 16 nt, Staphylococcus aureus subsp. aureus N315
auaaucuuuuuuacua

SEQ ID NO: 2149255 - RNA, 21 nt, Staphylococcus aureus subsp. aureus N315
auaaugaaaugaaguuuuuag

SEQ ID NO: 2149256 - RNA, 19 nt, Staphylococcus aureus subsp. aureus N315
auaaucgguaauuacuugu

SEQ ID NO: 2149257 - RNA, 23 nt, Staphylococcus aureus subsp. aureus N315
auaauaaauagacugccaauaaa

SEQ ID NO: 2149258 - RNA, 13 nt, Staphylococcus aureus subsp. aureus N315
auaauaaaucacg

SEQ ID NO: 2149259 - RNA, 14 nt, Staphylococcus aureus subsp. aureus N315
auaauaaaccuaaa

SEQ ID NO: 2149260 - RNA, 17 nt, Staphylococcus aureus subsp. aureus N315
auaauaaaacuugugau

SEQ ID NO: 2149261 - RNA, 23 nt, Staphylococcus aureus subsp. aureus N315
auaagugauuucuucauuaucaa

SEQ ID NO: 2149262 - RNA, 13 nt, Staphylococcus aureus subsp. aureus N315
auaagugauaaau

SEQ ID NO: 2149263 - RNA, 17 nt, Staphylococcus aureus subsp. aureus N315
auaaguuaaaaauguaa

SEQ ID NO: 2149264 - RNA, 16 nt, Staphylococcus aureus subsp. aureus N315
auaaguugaauauaaa

SEQ ID NO: 2149265 - RNA, 17 nt, Staphylococcus aureus subsp. aureus N315
auaaguugaauauaaaa

SEQ ID NO: 2149266 - RNA, 15 nt, Staphylococcus aureus subsp. aureus N315
auaaguucuagauua

SEQ ID NO: 2149267 - RNA, 14 nt, Staphylococcus aureus subsp. aureus N315
auaaguacaaauaa

SEQ ID NO: 2149268 - RNA, 16 nt, Staphylococcus aureus subsp. aureus N315
auaaguaaauaauagu

SEQ ID NO: 2149269 - RNA, 22 nt, Staphylococcus aureus subsp. aureus N315
auaaguagcucaaaacaauuua

SEQ ID NO: 2149270 - RNA, 19 nt, Staphylococcus aureus subsp. aureus N315
auaaguaguucagcaaguu

SEQ ID NO: 2149271 - RNA, 16 nt, Staphylococcus aureus subsp. aureus N315
auaagguacauaaaua

SEQ ID NO: 2149272 - RNA, 20 nt, Staphylococcus aureus subsp. aureus N315
auaagcuuuuucuuucucua

SEQ ID NO: 2149273 - RNA, 15 nt, Staphylococcus aureus subsp. aureus N315
auaaggauaucugaa

SEQ ID NO: 2149274 - RNA, 22 nt, Staphylococcus aureus subsp. aureus N315
auaaggaugauuuauuaacuca

SEQ ID NO: 2149275 - RNA, 13 nt, Staphylococcus aureus subsp. aureus N315
auaagauuuugaa

SEQ ID NO: 2149276 - RNA, 17 nt, Staphylococcus aureus subsp. aureus N315
auaagaggagaaagcua

SEQ ID NO: 2149277 - RNA, 15 nt, Staphylococcus aureus subsp. aureus N315
auaagacaauaguau

SEQ ID NO: 2149278 - RNA, 13 nt, Staphylococcus aureus subsp. aureus N315
auaagacaauagu

SEQ ID NO: 2149279 - RNA, 17 nt, Staphylococcus aureus subsp. aureus N315
auaagaauuuaaaagag

SEQ ID NO: 2149280 - RNA, 10 nt, Staphylococcus aureus subsp. aureus N315
auaagaauuu

SEQ ID NO: 2149281 - RNA, 11 nt, Staphylococcus aureus subsp. aureus N315
auaagaaucag

SEQ ID NO: 2149282 - RNA, 18 nt, Staphylococcus aureus subsp. aureus N315
auaagagaacuuuucaaa

SEQ ID NO: 2149283 - RNA, 21 nt, Staphylococcus aureus subsp. aureus N315
auaagacuucccuauauguag

SEQ ID NO: 2149284 - RNA, 18 nt, Staphylococcus aureus subsp. aureus N315
auaagccuuuucaaacau

SEQ ID NO: 2149285 - RNA, 21 nt, Staphylococcus aureus subsp. aureus N315
auaagcgcaauuaaaaguacu

SEQ ID NO: 2149286 - RNA, 16 nt, Staphylococcus aureus subsp. aureus N315
auaagcgcaauuaaaa

SEQ ID NO: 2149287 - RNA, 17 nt, Staphylococcus aureus subsp. aureus N315
auaagccuuuucaaaca

SEQ ID NO: 2149288 - RNA, 12 nt, Staphylococcus aureus subsp. aureus N315
auaagcugaaaa

SEQ ID NO: 2149289 - RNA, 17 nt, Staphylococcus aureus subsp. aureus N315
auaagcuuguaacaagc

SEQ ID NO: 2149290 - RNA, 12 nt, Staphylococcus aureus subsp. aureus N315
aggcaaugcaag

SEQ ID NO: 2149291 - RNA, 13 nt, Staphylococcus aureus subsp. aureus N315
aggcaaugcaagu

SEQ ID NO: 2149292 - RNA, 17 nt, Staphylococcus aureus subsp. aureus N315
aggcaaugcaaguuggc

SEQ ID NO: 2149293 - RNA, 23 nt, Staphylococcus aureus subsp. aureus N315
aggcaaugcaaguuggcggggcc

SEQ ID NO: 2149294 - RNA, 15 nt, Staphylococcus aureus subsp. aureus N315
aggcaauauuaaaau

SEQ ID NO: 2149295 - RNA, 14 nt, Staphylococcus aureus subsp. aureus N315
aggcaauauuaaaa

SEQ ID NO: 2149296 - RNA, 17 nt, Staphylococcus aureus subsp. aureus N315
aggcaacuuuuauuacu

SEQ ID NO: 2149297 - RNA, 22 nt, Staphylococcus aureus subsp. aureus N315
aggcaacaacuuuucauauaaa

SEQ ID NO: 2149298 - RNA, 21 nt, Staphylococcus aureus subsp. aureus N315
aggcacaguggauuacagaug

SEQ ID NO: 2149299 - RNA, 22 nt, Staphylococcus aureus subsp. aureus N315
aggcacaguggauuacagauga

SEQ ID NO: 2149300 - RNA, 23 nt, Staphylococcus aureus subsp. aureus N315
aggcacaguggauuacagaugau

SEQ ID NO: 2149301 - RNA, 18 nt, Staphylococcus aureus subsp. aureus N315
aggcacuaguuaauucua

SEQ ID NO: 2149302 - RNA, 20 nt, Staphylococcus aureus subsp. aureus N315
aggauuauagguauaagaau

SEQ ID NO: 2149303 - RNA, 12 nt, Staphylococcus aureus subsp. aureus N315
aggauuuuagau

SEQ ID NO: 2149304 - RNA, 17 nt, Staphylococcus aureus subsp. aureus N315
aggauuuuagauuuagu

SEQ ID NO: 2149305 - RNA, 19 nt, Staphylococcus aureus subsp. aureus N315
aggauuuacaccuauaccu

SEQ ID NO: 2149306 - RNA, 15 nt, Staphylococcus aureus subsp. aureus N315
aggaugaguuuaaaa

SEQ ID NO: 2149307 - RNA, 18 nt, Staphylococcus aureus subsp. aureus N315
aggaugaguuuaaaaaua

SEQ ID NO: 2149308 - RNA, 19 nt, Staphylococcus aureus subsp. aureus N315
aggaucuucuuguuuuaaa

SEQ ID NO: 2149309 - RNA, 16 nt, Staphylococcus aureus subsp. aureus N315
aggcauucuuccaaca

SEQ ID NO: 2149310 - RNA, 19 nt, Staphylococcus aureus subsp. aureus N315
aggccauuuuuauuuaaca

SEQ ID NO: 2149311 - RNA, 23 nt, Staphylococcus aureus subsp. aureus N315
aggcccgaccaacuugcacauua

SEQ ID NO: 2149312 - RNA, 21 nt, Staphylococcus aureus subsp. aureus N315
aggaauaauuuuaaaaauaaa

SEQ ID NO: 2149313 - RNA, 18 nt, Staphylococcus aureus subsp. aureus N315
aggaauaauuuuaaaaau

SEQ ID NO: 2149314 - RNA, 15 nt, Staphylococcus aureus subsp. aureus N315
aggaauguuuaaaaa

SEQ ID NO: 2149315 - RNA, 21 nt, Staphylococcus aureus subsp. aureus N315
aggaauauuucccuaugaaau

SEQ ID NO: 2149316 - RNA, 13 nt, Staphylococcus aureus subsp. aureus N315
aggaauaugaauu

SEQ ID NO: 2149317 - RNA, 15 nt, Staphylococcus aureus subsp. aureus N315
aggaauauaaaacug

SEQ ID NO: 2149318 - RNA, 21 nt, Staphylococcus aureus subsp. aureus N315
aggaaacgguucaaaaguaaa

SEQ ID NO: 2149319 - RNA, 16 nt, Staphylococcus aureus subsp. aureus N315
aggaaagccauuaaac

SEQ ID NO: 2149320 - RNA, 14 nt, Staphylococcus aureus subsp. aureus N315
aggaaaauaaaaac

SEQ ID NO: 2149321 - RNA, 23 nt, Staphylococcus aureus subsp. aureus N315
agcuuuuuucaauucuagucagg

SEQ ID NO: 2149322 - RNA, 11 nt, Staphylococcus aureus subsp. aureus N315
agcuuuuucuu

SEQ ID NO: 2149323 - RNA, 18 nt, Staphylococcus aureus subsp. aureus N315
aggaaauccgcauaaauu

SEQ ID NO: 2149324 - RNA, 18 nt, Staphylococcus aureus subsp. aureus N315
aggaaaucauauauuucu

SEQ ID NO: 2149325 - RNA, 22 nt, Staphylococcus aureus subsp. aureus N315
aggaacagcggaauacagauga

SEQ ID NO: 2149326 - RNA, 23 nt, Staphylococcus aureus subsp. aureus N315
aggaacagcggaauacagaugau

SEQ ID NO: 2149327 - RNA, 22 nt, Staphylococcus aureus subsp. aureus N315
aggagcgagccauuauuauuuu

SEQ ID NO: 2149328 - RNA, 15 nt, Staphylococcus aureus subsp. aureus N315
aggauaucuacgccu

SEQ ID NO: 2149329 - RNA, 19 nt, Staphylococcus aureus subsp. aureus N315
aggauacauaaaucuaaua

SEQ ID NO: 2149330 - RNA, 16 nt, Staphylococcus aureus subsp. aureus N315
aggauaagaacgagaa

SEQ ID NO: 2149331 - RNA, 12 nt, Staphylococcus aureus subsp. aureus N315
aggauaagaacg

SEQ ID NO: 2149332 - RNA, 14 nt, Staphylococcus aureus subsp. aureus N315
aggauaauuauuag

SEQ ID NO: 2149333 - RNA, 18 nt, Staphylococcus aureus subsp. aureus N315
aggauacauaaaucuaau

SEQ ID NO: 2149334 - RNA, 21 nt, Staphylococcus aureus subsp. aureus N315
aggagacauuucccauuuauc

SEQ ID NO: 2149335 - RNA, 17 nt, Staphylococcus aureus subsp. aureus N315
agcuuguaaaucacgau

SEQ ID NO: 2149336 - RNA, 20 nt, Staphylococcus aureus subsp. aureus N315
agcuugggacagaaaacaaa

SEQ ID NO: 2149337 - RNA, 15 nt, Staphylococcus aureus subsp. aureus N315
agcuuuucauuuuua

SEQ ID NO: 2149338 - RNA, 13 nt, Staphylococcus aureus subsp. aureus N315
agcuuuuguaaag

SEQ ID NO: 2149339 - RNA, 17 nt, Staphylococcus aureus subsp. aureus N315
agcuuuuacgccuucuu

SEQ ID NO: 2149340 - RNA, 18 nt, Staphylococcus aureus subsp. aureus N315
agcuuugcucauagauga

SEQ ID NO: 2149341 - RNA, 11 nt, Staphylococcus aureus subsp. aureus N315
agcuuucaguu

SEQ ID NO: 2149342 - RNA, 14 nt, Staphylococcus aureus subsp. aureus N315
agcuuuaauuuuuu

SEQ ID NO: 2149343 - RNA, 15 nt, Staphylococcus aureus subsp. aureus N315
agcuuguuucagguu

SEQ ID NO: 2149344 - RNA, 18 nt, Staphylococcus aureus subsp. aureus N315
agcuugaauaauauauuu

SEQ ID NO: 2149345 - RNA, 19 nt, Staphylococcus aureus subsp. aureus N315
agcuugaauaauauauuua

SEQ ID NO: 2149346 - RNA, 15 nt, Staphylococcus aureus subsp. aureus N315
agcuucuaaguaaua

SEQ ID NO: 2149347 - RNA, 13 nt, Staphylococcus aureus subsp. aureus N315
agcuucauauuua

SEQ ID NO: 2149348 - RNA, 21 nt, Staphylococcus aureus subsp. aureus N315
agcuuaaauagugcuuuuuca

SEQ ID NO: 2149349 - RNA, 22 nt, Staphylococcus aureus subsp. aureus N315
agcugugcugucauuuucugcu

SEQ ID NO: 2149350 - RNA, 16 nt, Staphylococcus aureus subsp. aureus N315
agcucuuuuuugauuu

SEQ ID NO: 2149351 - RNA, 20 nt, Staphylococcus aureus subsp. aureus N315
agcucuuuuuugauuuggaa

SEQ ID NO: 2149352 - RNA, 15 nt, Staphylococcus aureus subsp. aureus N315
agcucguuuuuucau

SEQ ID NO: 2149353 - RNA, 13 nt, Staphylococcus aureus subsp. aureus N315
agcggaauacaga

SEQ ID NO: 2149354 - RNA, 22 nt, Staphylococcus aureus subsp. aureus N315
agcggaaauaugauugaaugaa

SEQ ID NO: 2149355 - RNA, 20 nt, Staphylococcus aureus subsp. aureus N315
agcggaaauaugauugaaug

SEQ ID NO: 2149356 - RNA, 19 nt, Staphylococcus aureus subsp. aureus N315
agcggccgugguaugauuu

SEQ ID NO: 2149357 - RNA, 22 nt, Staphylococcus aureus subsp. aureus N315
agcguauauugaaauuaaauuu

SEQ ID NO: 2149358 - RNA, 13 nt, Staphylococcus aureus subsp. aureus N315
agcuaaccaaaua

SEQ ID NO: 2149359 - RNA, 17 nt, Staphylococcus aureus subsp. aureus N315
agcuaauaacgcugcac

SEQ ID NO: 2149360 - RNA, 16 nt, Staphylococcus aureus subsp. aureus N315
agcuaauaucaauaau

SEQ ID NO: 2149361 - RNA, 13 nt, Staphylococcus aureus subsp. aureus N315
agcuaaguuaaau

SEQ ID NO: 2149362 - RNA, 22 nt, Staphylococcus aureus subsp. aureus N315
agcuaauuucuaauacauacug

SEQ ID NO: 2149363 - RNA, 17 nt, Staphylococcus aureus subsp. aureus N315
agcuaaugucaugaaaa

SEQ ID NO: 2149364 - RNA, 17 nt, Staphylococcus aureus subsp. aureus N315
agcuaucuucagauucc

SEQ ID NO: 2149365 - RNA, 21 nt, Staphylococcus aureus subsp. aureus N315
agggacagaaaagggcaaaaa

SEQ ID NO: 2149366 - RNA, 13 nt, Staphylococcus aureus subsp. aureus N315
agggcaaaaaagg

SEQ ID NO: 2149367 - RNA, 14 nt, Staphylococcus aureus subsp. aureus N315
agggcaaaaaagga

SEQ ID NO: 2149368 - RNA, 15 nt, Staphylococcus aureus subsp. aureus N315
agggcaaaaaaggau

SEQ ID NO: 2149369 - RNA, 22 nt, Staphylococcus aureus subsp. aureus N315
aggcuguucuggaauugggaaa

SEQ ID NO: 2149370 - RNA, 16 nt, Staphylococcus aureus subsp. aureus N315
agggggcuucuuuguu

SEQ ID NO: 2149371 - RNA, 21 nt, Staphylococcus aureus subsp. aureus N315
aggggccccaacacagagaau

SEQ ID NO: 2149372 - RNA, 13 nt, Staphylococcus aureus subsp. aureus N315
agggguaaaacuu

SEQ ID NO: 2149373 - RNA, 11 nt, Staphylococcus aureus subsp. aureus N315
agggccccaac

SEQ ID NO: 2149374 - RNA, 14 nt, Staphylococcus aureus subsp. aureus N315
agggcauugauuca

SEQ ID NO: 2149375 - RNA, 22 nt, Staphylococcus aureus subsp. aureus N315
agggcauugagauuggaagggc

SEQ ID NO: 2149376 - RNA, 18 nt, Staphylococcus aureus subsp. aureus N315
aggcgcuuguaaaauuuu

SEQ ID NO: 2149377 - RNA, 19 nt, Staphylococcus aureus subsp. aureus N315
aggcgcuguuccaaauuca

SEQ ID NO: 2149378 - RNA, 23 nt, Staphylococcus aureus subsp. aureus N315
aggcgcuccuacuuuucaacuuu

SEQ ID NO: 2149379 - RNA, 13 nt, Staphylococcus aureus subsp. aureus N315
aggcgccauaauc

SEQ ID NO: 2149380 - RNA, 18 nt, Staphylococcus aureus subsp. aureus N315
aguaacauacuauaaaaa

SEQ ID NO: 2149381 - RNA, 17 nt, Staphylococcus aureus subsp. aureus N315
aguaacauacuauaaaa

SEQ ID NO: 2149382 - RNA, 22 nt, Staphylococcus aureus subsp. aureus N315
aguaacucaacauuuuuucuau

SEQ ID NO: 2149383 - RNA, 19 nt, Staphylococcus aureus subsp. aureus N315
aguaagauuauuuucaauu

SEQ ID NO: 2149384 - RNA, 17 nt, Staphylococcus aureus subsp. aureus N315
aguaagauauuuccaaa

SEQ ID NO: 2149385 - RNA, 21 nt, Staphylococcus aureus subsp. aureus N315
aguaauaaaagucgauaaaua

SEQ ID NO: 2149386 - RNA, 20 nt, Staphylococcus aureus subsp. aureus N315
aguaaguagaagcaaaagau

SEQ ID NO: 2149387 - RNA, 15 nt, Staphylococcus aureus subsp. aureus N315
aguaaguaaaauaaa

SEQ ID NO: 2149388 - RNA, 17 nt, Staphylococcus aureus subsp. aureus N315
aguaaguaauaaaauaa

SEQ ID NO: 2149389 - RNA, 21 nt, Staphylococcus aureus subsp. aureus N315
aguaauaauggcaauuaaaac

SEQ ID NO: 2149390 - RNA, 13 nt, Staphylococcus aureus subsp. aureus N315
aguaauaauauaa

SEQ ID NO: 2149391 - RNA, 16 nt, Staphylococcus aureus subsp. aureus N315
aguaauauauaaaagu

SEQ ID NO: 2149392 - RNA, 19 nt, Staphylococcus aureus subsp. aureus N315
aguaccauguuuuuuaagu

SEQ ID NO: 2149393 - RNA, 18 nt, Staphylococcus aureus subsp. aureus N315
aguaccaaagaaaucacc

SEQ ID NO: 2149394 - RNA, 16 nt, Staphylococcus aureus subsp. aureus N315
aguaccaagaaauacu

SEQ ID NO: 2149395 - RNA, 23 nt, Staphylococcus aureus subsp. aureus N315
aguacauuuauuuucaauaaaua

SEQ ID NO: 2149396 - RNA, 22 nt, Staphylococcus aureus subsp. aureus N315
aguacagcgguuuguaugauaa

SEQ ID NO: 2149397 - RNA, 23 nt, Staphylococcus aureus subsp. aureus N315
aguacaguuaguggcauuauauu

SEQ ID NO: 2149398 - RNA, 21 nt, Staphylococcus aureus subsp. aureus N315
aguacaauaauaccuucaauu

SEQ ID NO: 2149399 - RNA, 12 nt, Staphylococcus aureus subsp. aureus N315
aguacaauaaua

SEQ ID NO: 2149400 - RNA, 15 nt, Staphylococcus aureus subsp. aureus N315
aguacaaauaacaaa

SEQ ID NO: 2149401 - RNA, 22 nt, Staphylococcus aureus subsp. aureus N315
aguacaacaguugcaccuaaac

SEQ ID NO: 2149402 - RNA, 20 nt, Staphylococcus aureus subsp. aureus N315
aguaaucuuguuuucauuua

SEQ ID NO: 2149403 - RNA, 18 nt, Staphylococcus aureus subsp. aureus N315
aguaaugaccaauagcaa

SEQ ID NO: 2149404 - RNA, 16 nt, Staphylococcus aureus subsp. aureus N315
aguaaucaagcaaugc

SEQ ID NO: 2149405 - RNA, 19 nt, Staphylococcus aureus subsp. aureus N315
aguaaucagcuuuuucaca

SEQ ID NO: 2149406 - RNA, 19 nt, Staphylococcus aureus subsp. aureus N315
aguaauccccgaagcacag

SEQ ID NO: 2149407 - RNA, 22 nt, Staphylococcus aureus subsp. aureus N315
aguaauccccgaagcacagaaa

SEQ ID NO: 2149408 - RNA, 16 nt, Staphylococcus aureus subsp. aureus N315
agguucaguagaauug

SEQ ID NO: 2149409 - RNA, 19 nt, Staphylococcus aureus subsp. aureus N315
agguuauuauaaaauaaau

SEQ ID NO: 2149410 - RNA, 16 nt, Staphylococcus aureus subsp. aureus N315
agguucaaaauugcug

SEQ ID NO: 2149411 - RNA, 17 nt, Staphylococcus aureus subsp. aureus N315
agguucaaaauugcuga

SEQ ID NO: 2149412 - RNA, 16 nt, Staphylococcus aureus subsp. aureus N315
agguuauuuuuuaugg

SEQ ID NO: 2149413 - RNA, 17 nt, Staphylococcus aureus subsp. aureus N315
agguuaaauauuuaauu

SEQ ID NO: 2149414 - RNA, 19 nt, Staphylococcus aureus subsp. aureus N315
agguguggaguaaagauca

SEQ ID NO: 2149415 - RNA, 17 nt, Staphylococcus aureus subsp. aureus N315
aguaaacgagacaucau

SEQ ID NO: 2149416 - RNA, 16 nt, Staphylococcus aureus subsp. aureus N315
aguaaacuaauccuca

SEQ ID NO: 2149417 - RNA, 15 nt, Staphylococcus aureus subsp. aureus N315
aguaaaauaaaaaau

SEQ ID NO: 2149418 - RNA, 20 nt, Staphylococcus aureus subsp. aureus N315
aguaaaaccuguaucuuaaa

SEQ ID NO: 2149419 - RNA, 14 nt, Staphylococcus aureus subsp. aureus N315
aguaaaaaucacag

SEQ ID NO: 2149420 - RNA, 16 nt, Staphylococcus aureus subsp. aureus N315
agguuuguaagacaac

SEQ ID NO: 2149421 - RNA, 14 nt, Staphylococcus aureus subsp. aureus N315
agguuuuaugaauu

SEQ ID NO: 2149422 - RNA, 16 nt, Staphylococcus aureus subsp. aureus N315
agguuuucgccaauaa

SEQ ID NO: 2149423 - RNA, 21 nt, Staphylococcus aureus subsp. aureus N315
agguuguuuuucaucauuaaa

SEQ ID NO: 2149424 - RNA, 21 nt, Staphylococcus aureus subsp. aureus N315
agguuuaaacaucuauaacaa

SEQ ID NO: 2149425 - RNA, 23 nt, Staphylococcus aureus subsp. aureus N315
agguuuaaacaucuauaacaaaa

SEQ ID NO: 2149426 - RNA, 19 nt, Staphylococcus aureus subsp. aureus N315
agguuguucuauacauucc

SEQ ID NO: 2149427 - RNA, 14 nt, Staphylococcus aureus subsp. aureus N315
agguuuauaaaaaa

SEQ ID NO: 2149428 - RNA, 13 nt, Staphylococcus aureus subsp. aureus N315
agguuuauauauc

SEQ ID NO: 2149429 - RNA, 21 nt, Staphylococcus aureus subsp. aureus N315
aggguauugaaauaauauaaa

SEQ ID NO: 2149430 - RNA, 13 nt, Staphylococcus aureus subsp. aureus N315
agguaaauuuaaa

SEQ ID NO: 2149431 - RNA, 12 nt, Staphylococcus aureus subsp. aureus N315
agguaaauuuaa

SEQ ID NO: 2149432 - RNA, 18 nt, Staphylococcus aureus subsp. aureus N315
agguaaauuuaaaauaau

SEQ ID NO: 2149433 - RNA, 23 nt, Staphylococcus aureus subsp. aureus N315
aggguuugccagucauuguauaa

SEQ ID NO: 2149434 - RNA, 21 nt, Staphylococcus aureus subsp. aureus N315
agguauaggugcaguuaaauu

SEQ ID NO: 2149435 - RNA, 22 nt, Staphylococcus aureus subsp. aureus N315
agguauagcaaguuuauaaauu

SEQ ID NO: 2149436 - RNA, 17 nt, Staphylococcus aureus subsp. aureus N315
agguauucaaauaaaca

SEQ ID NO: 2149437 - RNA, 11 nt, Staphylococcus aureus subsp. aureus N315
agguauucaaa

SEQ ID NO: 2149438 - RNA, 19 nt, Staphylococcus aureus subsp. aureus N315
agguauuucauugauaagu

SEQ ID NO: 2149439 - RNA, 17 nt, Staphylococcus aureus subsp. aureus N315
agguaugaaauaacaau

SEQ ID NO: 2149440 - RNA, 19 nt, Staphylococcus aureus subsp. aureus N315
aggucaccuuuaaauuuac

SEQ ID NO: 2149441 - RNA, 13 nt, Staphylococcus aureus subsp. aureus N315
aggucaaaaaauu

SEQ ID NO: 2149442 - RNA, 17 nt, Staphylococcus aureus subsp. aureus N315
agguaauuuaacauuuu

SEQ ID NO: 2149443 - RNA, 13 nt, Staphylococcus aureus subsp. aureus N315
agguaauacuuuu

SEQ ID NO: 2149444 - RNA, 13 nt, Staphylococcus aureus subsp. aureus N315
agguaaugcaagu

SEQ ID NO: 2149445 - RNA, 17 nt, Staphylococcus aureus subsp. aureus N315
agguaaugcaaguuggc

SEQ ID NO: 2149446 - RNA, 12 nt, Staphylococcus aureus subsp. aureus N315
agguaaugcaag

SEQ ID NO: 2149447 - RNA, 17 nt, Staphylococcus aureus subsp. aureus N315
agguacuuaucugaagc

SEQ ID NO: 2149448 - RNA, 19 nt, Staphylococcus aureus subsp. aureus N315
aggugauuauauauauuaa

SEQ ID NO: 2149449 - RNA, 22 nt, Staphylococcus aureus subsp. aureus N315
aggucaucugaugaggcaauau

SEQ ID NO: 2149450 - RNA, 15 nt, Staphylococcus aureus subsp. aureus N315
acgguuauggugugu

SEQ ID NO: 2149451 - RNA, 19 nt, Staphylococcus aureus subsp. aureus N315
acguaaguguaaaugaaag

SEQ ID NO: 2149452 - RNA, 22 nt, Staphylococcus aureus subsp. aureus N315
acguaacaucacauaaaauaca

SEQ ID NO: 2149453 - RNA, 14 nt, Staphylococcus aureus subsp. aureus N315
acguaaaauaugau

SEQ ID NO: 2149454 - RNA, 22 nt, Staphylococcus aureus subsp. aureus N315
acgguauuuucaaaacugccaa

SEQ ID NO: 2149455 - RNA, 12 nt, Staphylococcus aureus subsp. aureus N315
acgguacagaua

SEQ ID NO: 2149456 - RNA, 21 nt, Staphylococcus aureus subsp. aureus N315
acgguauuuucaaaacugcca

SEQ ID NO: 2149457 - RNA, 18 nt, Staphylococcus aureus subsp. aureus N315
acgguaggaccucuuauu

SEQ ID NO: 2149458 - RNA, 16 nt, Staphylococcus aureus subsp. aureus N315
acgggugguuuuuaau

SEQ ID NO: 2149459 - RNA, 17 nt, Staphylococcus aureus subsp. aureus N315
acgcaauuuaauauuau

SEQ ID NO: 2149460 - RNA, 19 nt, Staphylococcus aureus subsp. aureus N315
acgcugguaauauuuuugu

SEQ ID NO: 2149461 - RNA, 16 nt, Staphylococcus aureus subsp. aureus N315
acgcugguaauauuuu

SEQ ID NO: 2149462 - RNA, 16 nt, Staphylococcus aureus subsp. aureus N315
acggaacuacuacauu

SEQ ID NO: 2149463 - RNA, 15 nt, Staphylococcus aureus subsp. aureus N315
acgcuguuuuaaauu

SEQ ID NO: 2149464 - RNA, 15 nt, Staphylococcus aureus subsp. aureus N315
acuauuuuuucuaau

SEQ ID NO: 2149465 - RNA, 14 nt, Staphylococcus aureus subsp. aureus N315
acucaaauaucuaa

SEQ ID NO: 2149466 - RNA, 14 nt, Staphylococcus aureus subsp. aureus N315
acuauuuguuuuag

SEQ ID NO: 2149467 - RNA, 18 nt, Staphylococcus aureus subsp. aureus N315
acuauuuuaaaaaugcug

SEQ ID NO: 2149468 - RNA, 19 nt, Staphylococcus aureus subsp. aureus N315
acuauugaaaauagaaaga

SEQ ID NO: 2149469 - RNA, 15 nt, Staphylococcus aureus subsp. aureus N315
acuauugaaaauaga

SEQ ID NO: 2149470 - RNA, 15 nt, Staphylococcus aureus subsp. aureus N315
acuauucuuucuugc

SEQ ID NO: 2149471 - RNA, 21 nt, Staphylococcus aureus subsp. aureus N315
acuauuaaaaccaaaagaaau

SEQ ID NO: 2149472 - RNA, 17 nt, Staphylococcus aureus subsp. aureus N315
acuauguuacuuauaua

SEQ ID NO: 2149473 - RNA, 19 nt, Staphylococcus aureus subsp. aureus N315
acuauguuacuuauauauu

SEQ ID NO: 2149474 - RNA, 13 nt, Staphylococcus aureus subsp. aureus N315
acuauggcauuau

SEQ ID NO: 2149475 - RNA, 13 nt, Staphylococcus aureus subsp. aureus N315
acuauuaaaggaa

SEQ ID NO: 2149476 - RNA, 16 nt, Staphylococcus aureus subsp. aureus N315
acuauuaguaugcaua

SEQ ID NO: 2149477 - RNA, 18 nt, Staphylococcus aureus subsp. aureus N315
acuaguuuguaauaauua

SEQ ID NO: 2149478 - RNA, 19 nt, Staphylococcus aureus subsp. aureus N315
acuaguuuguaauaauuaa

SEQ ID NO: 2149479 - RNA, 15 nt, Staphylococcus aureus subsp. aureus N315
acuauaaaaaacagc

SEQ ID NO: 2149480 - RNA, 15 nt, Staphylococcus aureus subsp. aureus N315
acuauaaaaauuuau

SEQ ID NO: 2149481 - RNA, 19 nt, Staphylococcus aureus subsp. aureus N315
acuauaaaauucaccaacu

SEQ ID NO: 2149482 - RNA, 18 nt, Staphylococcus aureus subsp. aureus N315
acuauaaauacaaauaua

SEQ ID NO: 2149483 - RNA, 14 nt, Staphylococcus aureus subsp. aureus N315
acuauaauaauuaa

SEQ ID NO: 2149484 - RNA, 21 nt, Staphylococcus aureus subsp. aureus N315
acuaaacgauaaauuaacuua

SEQ ID NO: 2149485 - RNA, 20 nt, Staphylococcus aureus subsp. aureus N315
acuaaugauaguacauuuau

SEQ ID NO: 2149486 - RNA, 20 nt, Staphylococcus aureus subsp. aureus N315
acuaauggcacuuaauauaa

SEQ ID NO: 2149487 - RNA, 22 nt, Staphylococcus aureus subsp. aureus N315
acuaauggauaugauaaccaaa

SEQ ID NO: 2149488 - RNA, 21 nt, Staphylococcus aureus subsp. aureus N315
acuaauguuaaucaaaauuau

SEQ ID NO: 2149489 - RNA, 11 nt, Staphylococcus aureus subsp. aureus N315
acuaauuaaag

SEQ ID NO: 2149490 - RNA, 18 nt, Staphylococcus aureus subsp. aureus N315
acuaauuuaaagcaucau

SEQ ID NO: 2149491 - RNA, 19 nt, Staphylococcus aureus subsp. aureus N315
acuaccuauuaauaucaua

SEQ ID NO: 2149492 - RNA, 15 nt, Staphylococcus aureus subsp. aureus N315
acuacgcauuauuaa

SEQ ID NO: 2149493 - RNA, 22 nt, Staphylococcus aureus subsp. aureus N315
acuaguucuaaguguugaccau

SEQ ID NO: 2149494 - RNA, 16 nt, Staphylococcus aureus subsp. aureus N315
acuacugucaauauaa

SEQ ID NO: 2149495 - RNA, 19 nt, Staphylococcus aureus subsp. aureus N315
acuacuuuuucaacuguac

SEQ ID NO: 2149496 - RNA, 14 nt, Staphylococcus aureus subsp. aureus N315
acuacuuuuucaac

SEQ ID NO: 2149497 - RNA, 13 nt, Staphylococcus aureus subsp. aureus N315
acguuauuuucaa

SEQ ID NO: 2149498 - RNA, 17 nt, Staphylococcus aureus subsp. aureus N315
acguucaaucguuucuu

SEQ ID NO: 2149499 - RNA, 18 nt, Staphylococcus aureus subsp. aureus N315
acguuauucguuaacaau

SEQ ID NO: 2149500 - RNA, 21 nt, Staphylococcus aureus subsp. aureus N315
acguuuauccuuuaaaucauu

SEQ ID NO: 2149501 - RNA, 21 nt, Staphylococcus aureus subsp. aureus N315
acuaaaccgauuaauauaaua

SEQ ID NO: 2149502 - RNA, 16 nt, Staphylococcus aureus subsp. aureus N315
acuaaacgauaaauua

SEQ ID NO: 2149503 - RNA, 15 nt, Staphylococcus aureus subsp. aureus N315
acuaaaccauugaau

SEQ ID NO: 2149504 - RNA, 15 nt, Staphylococcus aureus subsp. aureus N315
acuaaaccaaugauu

SEQ ID NO: 2149505 - RNA, 15 nt, Staphylococcus aureus subsp. aureus N315
acuaaaaauauauuu

SEQ ID NO: 2149506 - RNA, 16 nt, Staphylococcus aureus subsp. aureus N315
acuaaaaauauauuuc

SEQ ID NO: 2149507 - RNA, 16 nt, Staphylococcus aureus subsp. aureus N315
acguuuucuagguaau

SEQ ID NO: 2149508 - RNA, 15 nt, Staphylococcus aureus subsp. aureus N315
acguuuuuuuauaaa

SEQ ID NO: 2149509 - RNA, 15 nt, Staphylococcus aureus subsp. aureus N315
acguuuuugaaucag

SEQ ID NO: 2149510 - RNA, 11 nt, Staphylococcus aureus subsp. aureus N315
acguuuucuag

SEQ ID NO: 2149511 - RNA, 17 nt, Staphylococcus aureus subsp. aureus N315
acguuuuccaugaguuu

SEQ ID NO: 2149512 - RNA, 21 nt, Staphylococcus aureus subsp. aureus N315
acguuuuaaagguuaaauauu

SEQ ID NO: 2149513 - RNA, 20 nt, Staphylococcus aureus subsp. aureus N315
acguuuuaaauaaaugacuu

SEQ ID NO: 2149514 - RNA, 16 nt, Staphylococcus aureus subsp. aureus N315
acguuugcauauccuu

SEQ ID NO: 2149515 - RNA, 18 nt, Staphylococcus aureus subsp. aureus N315
acgugcauuguaauacca

SEQ ID NO: 2149516 - RNA, 13 nt, Staphylococcus aureus subsp. aureus N315
acgugcuuuaaag

SEQ ID NO: 2149517 - RNA, 19 nt, Staphylococcus aureus subsp. aureus N315
acgugcugccuuuuugcuu

SEQ ID NO: 2149518 - RNA, 14 nt, Staphylococcus aureus subsp. aureus N315
acguaaugaaucaa

SEQ ID NO: 2149519 - RNA, 16 nt, Staphylococcus aureus subsp. aureus N315
acguaaugaaucaauu

SEQ ID NO: 2149520 - RNA, 22 nt, Staphylococcus aureus subsp. aureus N315
acgucgcaacaggaccacucaa

SEQ ID NO: 2149521 - RNA, 20 nt, Staphylococcus aureus subsp. aureus N315
acgucgaauguuucuucguu

SEQ ID NO: 2149522 - RNA, 12 nt, Staphylococcus aureus subsp. aureus N315
acuucacauuua

SEQ ID NO: 2149523 - RNA, 15 nt, Staphylococcus aureus subsp. aureus N315
acuuaugagcaaagc

SEQ ID NO: 2149524 - RNA, 18 nt, Staphylococcus aureus subsp. aureus N315
acuucaauaacaaugcag

SEQ ID NO: 2149525 - RNA, 19 nt, Staphylococcus aureus subsp. aureus N315
acuuauaaaaugaaauauu

SEQ ID NO: 2149526 - RNA, 18 nt, Staphylococcus aureus subsp. aureus N315
acuuauaaaucaaagucu

SEQ ID NO: 2149527 - RNA, 12 nt, Staphylococcus aureus subsp. aureus N315
acuuauauauuc

SEQ ID NO: 2149528 - RNA, 13 nt, Staphylococcus aureus subsp. aureus N315
acuuauauauuca

SEQ ID NO: 2149529 - RNA, 20 nt, Staphylococcus aureus subsp. aureus N315
acuuauauauucaauaauua

SEQ ID NO: 2149530 - RNA, 23 nt, Staphylococcus aureus subsp. aureus N315
acuuauauacguugauuaacaca

SEQ ID NO: 2149531 - RNA, 13 nt, Staphylococcus aureus subsp. aureus N315
acuuaucaucaca

SEQ ID NO: 2149532 - RNA, 16 nt, Staphylococcus aureus subsp. aureus N315
acuuccuaaaauuuac

SEQ ID NO: 2149533 - RNA, 17 nt, Staphylococcus aureus subsp. aureus N315
acuuccgacugcaccuc

SEQ ID NO: 2149534 - RNA, 23 nt, Staphylococcus aureus subsp. aureus N315
acugucucaucuucuaaaucaau

SEQ ID NO: 2149535 - RNA, 16 nt, Staphylococcus aureus subsp. aureus N315
acugucgguucaucua

SEQ ID NO: 2149536 - RNA, 16 nt, Staphylococcus aureus subsp. aureus N315
acugucgcucauccuc

SEQ ID NO: 2149537 - RNA, 14 nt, Staphylococcus aureus subsp. aureus N315
acugguugauaaau

SEQ ID NO: 2149538 - RNA, 19 nt, Staphylococcus aureus subsp. aureus N315
acugguugauaaauaaacu

SEQ ID NO: 2149539 - RNA, 15 nt, Staphylococcus aureus subsp. aureus N315
acuguaaaauucuau

SEQ ID NO: 2149540 - RNA, 20 nt, Staphylococcus aureus subsp. aureus N315
acuguaaaauucuauaaaua

SEQ ID NO: 2149541 - RNA, 15 nt, Staphylococcus aureus subsp. aureus N315
acuuaaaaaugaaau

SEQ ID NO: 2149542 - RNA, 15 nt, Staphylococcus aureus subsp. aureus N315
acuuaaagauuuacc

SEQ ID NO: 2149543 - RNA, 12 nt, Staphylococcus aureus subsp. aureus N315
acuuaaaauuua

SEQ ID NO: 2149544 - RNA, 17 nt, Staphylococcus aureus subsp. aureus N315
acuuaaaacuauaaccu

SEQ ID NO: 2149545 - RNA, 16 nt, Staphylococcus aureus subsp. aureus N315
acuuaacuuguguuau

SEQ ID NO: 2149546 - RNA, 16 nt, Staphylococcus aureus subsp. aureus N315
acuuaaccauuuaaaa

SEQ ID NO: 2149547 - RNA, 21 nt, Staphylococcus aureus subsp. aureus N315
acuuaacgagugcuuucaccu

SEQ ID NO: 2149548 - RNA, 19 nt, Staphylococcus aureus subsp. aureus N315
acuuagcaaucucuuuaga

SEQ ID NO: 2149549 - RNA, 16 nt, Staphylococcus aureus subsp. aureus N315
acuuaaucguucccau

SEQ ID NO: 2149550 - RNA, 23 nt, Staphylococcus aureus subsp. aureus N315
acugcuuuuuuauucuaauacaa

SEQ ID NO: 2149551 - RNA, 19 nt, Staphylococcus aureus subsp. aureus N315
acugcuuuuuuaaauuuaa

SEQ ID NO: 2149552 - RNA, 16 nt, Staphylococcus aureus subsp. aureus N315
acugcuuucaaguaau

SEQ ID NO: 2149553 - RNA, 15 nt, Staphylococcus aureus subsp. aureus N315
acugcuguucuuuuu

SEQ ID NO: 2149554 - RNA, 20 nt, Staphylococcus aureus subsp. aureus N315
acugcuguucucuauuuaua

SEQ ID NO: 2149555 - RNA, 16 nt, Staphylococcus aureus subsp. aureus N315
acugcuaauuuuuuca

SEQ ID NO: 2149556 - RNA, 20 nt, Staphylococcus aureus subsp. aureus N315
acugcuaauauuagauaucu

SEQ ID NO: 2149557 - RNA, 18 nt, Staphylococcus aureus subsp. aureus N315
acugcuaauauuagauau

SEQ ID NO: 2149558 - RNA, 19 nt, Staphylococcus aureus subsp. aureus N315
acugcacaucauaauaaau

SEQ ID NO: 2149559 - RNA, 13 nt, Staphylococcus aureus subsp. aureus N315
acugcaauuauuu

SEQ ID NO: 2149560 - RNA, 20 nt, Staphylococcus aureus subsp. aureus N315
acugcaccgauaucauauaa

SEQ ID NO: 2149561 - RNA, 21 nt, Staphylococcus aureus subsp. aureus N315
acugcauagguaaccuuaaau

SEQ ID NO: 2149562 - RNA, 16 nt, Staphylococcus aureus subsp. aureus N315
acugccauauguuuua

SEQ ID NO: 2149563 - RNA, 17 nt, Staphylococcus aureus subsp. aureus N315
acugccauauguuuuag

SEQ ID NO: 2149564 - RNA, 22 nt, Staphylococcus aureus subsp. aureus N315
acugauaaaaggggaaaucauu

SEQ ID NO: 2149565 - RNA, 13 nt, Staphylococcus aureus subsp. aureus N315
acugauaauacug

SEQ ID NO: 2149566 - RNA, 16 nt, Staphylococcus aureus subsp. aureus N315
acugauauuuagaaua

SEQ ID NO: 2149567 - RNA, 19 nt, Staphylococcus aureus subsp. aureus N315
acugagcaacaaaagaugu

SEQ ID NO: 2149568 - RNA, 17 nt, Staphylococcus aureus subsp. aureus N315
acugagaaaucuuaaag

SEQ ID NO: 2149569 - RNA, 22 nt, Staphylococcus aureus subsp. aureus N315
acugauucaccagguuuuuuau

SEQ ID NO: 2149570 - RNA, 21 nt, Staphylococcus aureus subsp. aureus N315
acugaugaaaacuuaaaaaug

SEQ ID NO: 2149571 - RNA, 18 nt, Staphylococcus aureus subsp. aureus N315
acugcaacaccacacagc

SEQ ID NO: 2149572 - RNA, 21 nt, Staphylococcus aureus subsp. aureus N315
acugcaacaccacacagcauu

SEQ ID NO: 2149573 - RNA, 18 nt, Staphylococcus aureus subsp. aureus N315
acugauuuuguuucaaac

SEQ ID NO: 2149574 - RNA, 23 nt, Staphylococcus aureus subsp. aureus N315
acugauuuauugauaaauauuga

SEQ ID NO: 2149575 - RNA, 18 nt, Staphylococcus aureus subsp. aureus N315
acucuagagguaaaucua

SEQ ID NO: 2149576 - RNA, 17 nt, Staphylococcus aureus subsp. aureus N315
acucuagagguaaaucu

SEQ ID NO: 2149577 - RNA, 19 nt, Staphylococcus aureus subsp. aureus N315
acucugaucuaaaaccaua

SEQ ID NO: 2149578 - RNA, 17 nt, Staphylococcus aureus subsp. aureus N315
acucugauuacauauac

SEQ ID NO: 2149579 - RNA, 22 nt, Staphylococcus aureus subsp. aureus N315
acucugauauugaucugauuuc

SEQ ID NO: 2149580 - RNA, 13 nt, Staphylococcus aureus subsp. aureus N315
acucuuuuucuuu

SEQ ID NO: 2149581 - RNA, 15 nt, Staphylococcus aureus subsp. aureus N315
acucaauucucuaac

SEQ ID NO: 2149582 - RNA, 12 nt, Staphylococcus aureus subsp. aureus N315
acucaauucucu

SEQ ID NO: 2149583 - RNA, 15 nt, Staphylococcus aureus subsp. aureus N315
acuccguugaauuca

SEQ ID NO: 2149584 - RNA, 19 nt, Staphylococcus aureus subsp. aureus N315
acucaaggaaaucauauau

SEQ ID NO: 2149585 - RNA, 22 nt, Staphylococcus aureus subsp. aureus N315
acucaauaugaaaccuuugguu

SEQ ID NO: 2149586 - RNA, 15 nt, Staphylococcus aureus subsp. aureus N315
acuccuccaaagcua

SEQ ID NO: 2149587 - RNA, 18 nt, Staphylococcus aureus subsp. aureus N315
agauucacuguauaaaua

SEQ ID NO: 2149588 - RNA, 15 nt, Staphylococcus aureus subsp. aureus N315
agauucaaauugguu

SEQ ID NO: 2149589 - RNA, 22 nt, Staphylococcus aureus subsp. aureus N315
agauuccaucacgauauguugu

SEQ ID NO: 2149590 - RNA, 15 nt, Staphylococcus aureus subsp. aureus N315
agauuccuguaacaa

SEQ ID NO: 2149591 - RNA, 24 nt, Staphylococcus aureus subsp. aureus N315
agauuaguguagggggcauuauua

SEQ ID NO: 2149592 - RNA, 12 nt, Staphylococcus aureus subsp. aureus N315
agauuagagaag

SEQ ID NO: 2149593 - RNA, 22 nt, Staphylococcus aureus subsp. aureus N315
agauuauuauuacaaugaaaaa

SEQ ID NO: 2149594 - RNA, 18 nt, Staphylococcus aureus subsp. aureus N315
agauuauugguugaaauu

SEQ ID NO: 2149595 - RNA, 22 nt, Staphylococcus aureus subsp. aureus N315
agauuauugguugaaauuaauu

SEQ ID NO: 2149596 - RNA, 15 nt, Staphylococcus aureus subsp. aureus N315
agauuggaagggcau

SEQ ID NO: 2149597 - RNA, 20 nt, Staphylococcus aureus subsp. aureus N315
agauucggaaaauaugauaa

SEQ ID NO: 2149598 - RNA, 16 nt, Staphylococcus aureus subsp. aureus N315
agauguucacauucuu

SEQ ID NO: 2149599 - RNA, 17 nt, Staphylococcus aureus subsp. aureus N315
agauguauaaaacuaau

SEQ ID NO: 2149600 - RNA, 19 nt, Staphylococcus aureus subsp. aureus N315
agaugucgaaaaguauaug

SEQ ID NO: 2149601 - RNA, 17 nt, Staphylococcus aureus subsp. aureus N315
agaugcuuuaauuaaag

SEQ ID NO: 2149602 - RNA, 14 nt, Staphylococcus aureus subsp. aureus N315
agaugcuucaaaaa

SEQ ID NO: 2149603 - RNA, 18 nt, Staphylococcus aureus subsp. aureus N315
agaugcucauugcauuuc

SEQ ID NO: 2149604 - RNA, 15 nt, Staphylococcus aureus subsp. aureus N315
agaugcuaauguaau

SEQ ID NO: 2149605 - RNA, 13 nt, Staphylococcus aureus subsp. aureus N315
agaucuaacaaua

SEQ ID NO: 2149606 - RNA, 14 nt, Staphylococcus aureus subsp. aureus N315
agaucuaacaauau

SEQ ID NO: 2149607 - RNA, 13 nt, Staphylococcus aureus subsp. aureus N315
agaugaauaaugu

SEQ ID NO: 2149608 - RNA, 21 nt, Staphylococcus aureus subsp. aureus N315
agaucuuuguaugcaucaguu

SEQ ID NO: 2149609 - RNA, 16 nt, Staphylococcus aureus subsp. aureus N315
agaugaggcgauaaaa

SEQ ID NO: 2149610 - RNA, 22 nt, Staphylococcus aureus subsp. aureus N315
agaugacugaaccaauccaaua

SEQ ID NO: 2149611 - RNA, 19 nt, Staphylococcus aureus subsp. aureus N315
agaugaggcgauaaaagaa

SEQ ID NO: 2149612 - RNA, 19 nt, Staphylococcus aureus subsp. aureus N315
agaugauauuuaacaaaau

SEQ ID NO: 2149613 - RNA, 15 nt, Staphylococcus aureus subsp. aureus N315
agaugaugcuucuca

SEQ ID NO: 2149614 - RNA, 16 nt, Staphylococcus aureus subsp. aureus N315
agaugcauaaaaaccu

SEQ ID NO: 2149615 - RNA, 17 nt, Staphylococcus aureus subsp. aureus N315
agaugcauaaaaaccua

SEQ ID NO: 2149616 - RNA, 15 nt, Staphylococcus aureus subsp. aureus N315
agaugcauaaaaaaa

SEQ ID NO: 2149617 - RNA, 13 nt, Staphylococcus aureus subsp. aureus N315
agaugcauaaaaa

SEQ ID NO: 2149618 - RNA, 17 nt, Staphylococcus aureus subsp. aureus N315
agauauaaacauuuaua

SEQ ID NO: 2149619 - RNA, 13 nt, Staphylococcus aureus subsp. aureus N315
agauauagaauuc

SEQ ID NO: 2149620 - RNA, 21 nt, Staphylococcus aureus subsp. aureus N315
agauauuauugugaaaucuau

SEQ ID NO: 2149621 - RNA, 22 nt, Staphylococcus aureus subsp. aureus N315
agauauuauaaaaacagcagug

SEQ ID NO: 2149622 - RNA, 21 nt, Staphylococcus aureus subsp. aureus N315
agauaucuuauaacaaaaauu

SEQ ID NO: 2149623 - RNA, 22 nt, Staphylococcus aureus subsp. aureus N315
agauaucuuaaucuaaaaauag

SEQ ID NO: 2149624 - RNA, 18 nt, Staphylococcus aureus subsp. aureus N315
agauaucuuaaucuaaaa

SEQ ID NO: 2149625 - RNA, 14 nt, Staphylococcus aureus subsp. aureus N315
agaucaauaucacu

SEQ ID NO: 2149626 - RNA, 21 nt, Staphylococcus aureus subsp. aureus N315
agaucaauaucacuaucagcu

SEQ ID NO: 2149627 - RNA, 18 nt, Staphylococcus aureus subsp. aureus N315
agauauuuauaagaggag

SEQ ID NO: 2149628 - RNA, 15 nt, Staphylococcus aureus subsp. aureus N315
agauaauuuucaauu

SEQ ID NO: 2149629 - RNA, 16 nt, Staphylococcus aureus subsp. aureus N315
agauaauuuucaauua

SEQ ID NO: 2149630 - RNA, 19 nt, Staphylococcus aureus subsp. aureus N315
agauaauuuucaauuagaa

SEQ ID NO: 2149631 - RNA, 19 nt, Staphylococcus aureus subsp. aureus N315
agauacauuaucaagaaua

SEQ ID NO: 2149632 - RNA, 23 nt, Staphylococcus aureus subsp. aureus N315
agauacauuaucaagaauaacua

SEQ ID NO: 2149633 - RNA, 16 nt, Staphylococcus aureus subsp. aureus N315
agauacacguaacgca

SEQ ID NO: 2149634 - RNA, 16 nt, Staphylococcus aureus subsp. aureus N315
agauaccaaacugccu

SEQ ID NO: 2149635 - RNA, 16 nt, Staphylococcus aureus subsp. aureus N315
agaguuuuuauuauua

SEQ ID NO: 2149636 - RNA, 19 nt, Staphylococcus aureus subsp. aureus N315
agauaggaaacuuaaauau

SEQ ID NO: 2149637 - RNA, 13 nt, Staphylococcus aureus subsp. aureus N315
agauaggauuuac

SEQ ID NO: 2149638 - RNA, 15 nt, Staphylococcus aureus subsp. aureus N315
agauaggauuuacac

SEQ ID NO: 2149639 - RNA, 15 nt, Staphylococcus aureus subsp. aureus N315
agauaggauuugcac

SEQ ID NO: 2149640 - RNA, 22 nt, Staphylococcus aureus subsp. aureus N315
agauagacuuucuugaugaauu

SEQ ID NO: 2149641 - RNA, 20 nt, Staphylococcus aureus subsp. aureus N315
agauacugguuaguaaaauu

SEQ ID NO: 2149642 - RNA, 16 nt, Staphylococcus aureus subsp. aureus N315
agauacuucuuuugca

SEQ ID NO: 2149643 - RNA, 14 nt, Staphylococcus aureus subsp. aureus N315
agauagaaauuacc

SEQ ID NO: 2149644 - RNA, 13 nt, Staphylococcus aureus subsp. aureus N315
agauagaaauuac

SEQ ID NO: 2149645 - RNA, 14 nt, Staphylococcus aureus subsp. aureus N315
agauacguuauuuc

SEQ ID NO: 2149646 - RNA, 18 nt, Staphylococcus aureus subsp. aureus N315
agauacguugauguaauu

SEQ ID NO: 2149647 - RNA, 19 nt, Staphylococcus aureus subsp. aureus N315
agaggucuccaauacuuuu

SEQ ID NO: 2149648 - RNA, 17 nt, Staphylococcus aureus subsp. aureus N315
agaguaguucggaugag

SEQ ID NO: 2149649 - RNA, 13 nt, Staphylococcus aureus subsp. aureus N315
agagaugaaagau

SEQ ID NO: 2149650 - RNA, 23 nt, Staphylococcus aureus subsp. aureus N315
agagaugggcuaagguuguucua

SEQ ID NO: 2149651 - RNA, 15 nt, Staphylococcus aureus subsp. aureus N315
agacuauauucaauu

SEQ ID NO: 2149652 - RNA, 15 nt, Staphylococcus aureus subsp. aureus N315
agacucaauuucauu

SEQ ID NO: 2149653 - RNA, 18 nt, Staphylococcus aureus subsp. aureus N315
agacucaaggaaaucaua

SEQ ID NO: 2149654 - RNA, 18 nt, Staphylococcus aureus subsp. aureus N315
agacuaaaaugaaugaag

SEQ ID NO: 2149655 - RNA, 17 nt, Staphylococcus aureus subsp. aureus N315
agacuaaaaugaaugaa

SEQ ID NO: 2149656 - RNA, 18 nt, Staphylococcus aureus subsp. aureus N315
agaaaaugaguacaacau

SEQ ID NO: 2149657 - RNA, 18 nt, Staphylococcus aureus subsp. aureus N315
agaaagcuaauaucaaua

SEQ ID NO: 2149658 - RNA, 22 nt, Staphylococcus aureus subsp. aureus N315
agaaagcuaauggcuaauacaa

SEQ ID NO: 2149659 - RNA, 23 nt, Staphylococcus aureus subsp. aureus N315
agaaagcuaauggcuaauacaaa

SEQ ID NO: 2149660 - RNA, 23 nt, Staphylococcus aureus subsp. aureus N315
agaaacuauuaucgaagaaacau

SEQ ID NO: 2149661 - RNA, 19 nt, Staphylococcus aureus subsp. aureus N315
acuuuuuuguucaaucacu

SEQ ID NO: 2149662 - RNA, 14 nt, Staphylococcus aureus subsp. aureus N315
acuuuuuuguucaa

SEQ ID NO: 2149663 - RNA, 23 nt, Staphylococcus aureus subsp. aureus N315
acuuuuuuuaaaucuucuauuuu

SEQ ID NO: 2149664 - RNA, 20 nt, Staphylococcus aureus subsp. aureus N315
acuuuuuugagcauuuuuau

SEQ ID NO: 2149665 - RNA, 19 nt, Staphylococcus aureus subsp. aureus N315
agaaaaagugauaauuaaa

SEQ ID NO: 2149666 - RNA, 14 nt, Staphylococcus aureus subsp. aureus N315
agaaaaauaugauu

SEQ ID NO: 2149667 - RNA, 12 nt, Staphylococcus aureus subsp. aureus N315
agaaaaaguauu

SEQ ID NO: 2149668 - RNA, 17 nt, Staphylococcus aureus subsp. aureus N315
acuuuuucaucuuucac

SEQ ID NO: 2149669 - RNA, 14 nt, Staphylococcus aureus subsp. aureus N315
acuuuuucaucuuu

SEQ ID NO: 2149670 - RNA, 13 nt, Staphylococcus aureus subsp. aureus N315
acuuuuuguuaau

SEQ ID NO: 2149671 - RNA, 16 nt, Staphylococcus aureus subsp. aureus N315
acuuuuugaguaucca

SEQ ID NO: 2149672 - RNA, 23 nt, Staphylococcus aureus subsp. aureus N315
acuuuuuaaacguacauuuuuau

SEQ ID NO: 2149673 - RNA, 16 nt, Staphylococcus aureus subsp. aureus N315
acuuuuguuaaaaaau

SEQ ID NO: 2149674 - RNA, 19 nt, Staphylococcus aureus subsp. aureus N315
acuuuuguuaaaaaaugga

SEQ ID NO: 2149675 - RNA, 18 nt, Staphylococcus aureus subsp. aureus N315
acuuuuucagaaugaacu

SEQ ID NO: 2149676 - RNA, 18 nt, Staphylococcus aureus subsp. aureus N315
acuuuuuauaucaaaauc

SEQ ID NO: 2149677 - RNA, 12 nt, Staphylococcus aureus subsp. aureus N315
acuuuucuuauc

SEQ ID NO: 2149678 - RNA, 23 nt, Staphylococcus aureus subsp. aureus N315
acuuuucucgauuaauuuucuuu

SEQ ID NO: 2149679 - RNA, 14 nt, Staphylococcus aureus subsp. aureus N315
acuuuucuaaacaa

SEQ ID NO: 2149680 - RNA, 20 nt, Staphylococcus aureus subsp. aureus N315
acuuuuggucuguugaaguc

SEQ ID NO: 2149681 - RNA, 24 nt, Staphylococcus aureus subsp. aureus N315
acuuuugcaucacagauaaugcau

SEQ ID NO: 2149682 - RNA, 14 nt, Staphylococcus aureus subsp. aureus N315
acuuuugcaucaca

SEQ ID NO: 2149683 - RNA, 11 nt, Staphylococcus aureus subsp. aureus N315
acuuuugauuu

SEQ ID NO: 2149684 - RNA, 13 nt, Staphylococcus aureus subsp. aureus N315
acuuccuuuuuau

SEQ ID NO: 2149685 - RNA, 18 nt, Staphylococcus aureus subsp. aureus N315
acuuccugcuuuuuuuau

SEQ ID NO: 2149686 - RNA, 14 nt, Staphylococcus aureus subsp. aureus N315
agaacuaauguaaa

SEQ ID NO: 2149687 - RNA, 23 nt, Staphylococcus aureus subsp. aureus N315
agaacuaagaugugcaucccgaa

SEQ ID NO: 2149688 - RNA, 15 nt, Staphylococcus aureus subsp. aureus N315
agaacguucauauau

SEQ ID NO: 2149689 - RNA, 13 nt, Staphylococcus aureus subsp. aureus N315
agaacuaugaaua

SEQ ID NO: 2149690 - RNA, 17 nt, Staphylococcus aureus subsp. aureus N315
agaacgcuuuauuacuu

SEQ ID NO: 2149691 - RNA, 23 nt, Staphylococcus aureus subsp. aureus N315
agaaccuauauuaagcauuuguc

SEQ ID NO: 2149692 - RNA, 16 nt, Staphylococcus aureus subsp. aureus N315
agaaauugaauucucg

SEQ ID NO: 2149693 - RNA, 14 nt, Staphylococcus aureus subsp. aureus N315
agaaauuuuaaaau

SEQ ID NO: 2149694 - RNA, 13 nt, Staphylococcus aureus subsp. aureus N315
agaaauuuuaaaa

SEQ ID NO: 2149695 - RNA, 20 nt, Staphylococcus aureus subsp. aureus N315
agaaauuguguuucuuuuau

SEQ ID NO: 2149696 - RNA, 21 nt, Staphylococcus aureus subsp. aureus N315
agaaauuuaauauuguuaauu

SEQ ID NO: 2149697 - RNA, 15 nt, Staphylococcus aureus subsp. aureus N315
agaacaauaauugau

SEQ ID NO: 2149698 - RNA, 14 nt, Staphylococcus aureus subsp. aureus N315
agaacaagaauuau

SEQ ID NO: 2149699 - RNA, 12 nt, Staphylococcus aureus subsp. aureus N315
agaacaaaaugu

SEQ ID NO: 2149700 - RNA, 23 nt, Staphylococcus aureus subsp. aureus N315
agaacaugauacugaaauuucau

SEQ ID NO: 2149701 - RNA, 15 nt, Staphylococcus aureus subsp. aureus N315
agaaccaacaauaaa

SEQ ID NO: 2149702 - RNA, 16 nt, Staphylococcus aureus subsp. aureus N315
agaaccaaaauuauau

SEQ ID NO: 2149703 - RNA, 21 nt, Staphylococcus aureus subsp. aureus N315
agaaccaucauucauauggaa

SEQ ID NO: 2149704 - RNA, 22 nt, Staphylococcus aureus subsp. aureus N315
agaaccacgcaucauguauaug

SEQ ID NO: 2149705 - RNA, 17 nt, Staphylococcus aureus subsp. aureus N315
agaacagcacauuuuua

SEQ ID NO: 2149706 - RNA, 13 nt, Staphylococcus aureus subsp. aureus N315
agacauaaaaaaa

SEQ ID NO: 2149707 - RNA, 14 nt, Staphylococcus aureus subsp. aureus N315
agacauaaaaaaag

SEQ ID NO: 2149708 - RNA, 16 nt, Staphylococcus aureus subsp. aureus N315
agacauaaaaaaagag

SEQ ID NO: 2149709 - RNA, 17 nt, Staphylococcus aureus subsp. aureus N315
agacauaaccuugcuuu

SEQ ID NO: 2149710 - RNA, 12 nt, Staphylococcus aureus subsp. aureus N315
agacauaaauau

SEQ ID NO: 2149711 - RNA, 22 nt, Staphylococcus aureus subsp. aureus N315
agacauacagucaauacaaaga

SEQ ID NO: 2149712 - RNA, 15 nt, Staphylococcus aureus subsp. aureus N315
agacauccacagaau

SEQ ID NO: 2149713 - RNA, 14 nt, Staphylococcus aureus subsp. aureus N315
agaauuucaucaaa

SEQ ID NO: 2149714 - RNA, 17 nt, Staphylococcus aureus subsp. aureus N315
agaauuucaucaaaucc

SEQ ID NO: 2149715 - RNA, 16 nt, Staphylococcus aureus subsp. aureus N315
agaauuucgaaaagaa

SEQ ID NO: 2149716 - RNA, 19 nt, Staphylococcus aureus subsp. aureus N315
agaauuucgaaaagaaauu

SEQ ID NO: 2149717 - RNA, 21 nt, Staphylococcus aureus subsp. aureus N315
agaauuucuuuucgaaaaucu

SEQ ID NO: 2149718 - RNA, 20 nt, Staphylococcus aureus subsp. aureus N315
agacaaccgauauaauuaau

SEQ ID NO: 2149719 - RNA, 21 nt, Staphylococcus aureus subsp. aureus N315
agaauugcaacgcaucacaaa

SEQ ID NO: 2149720 - RNA, 12 nt, Staphylococcus aureus subsp. aureus N315
agacaauauuuu

SEQ ID NO: 2149721 - RNA, 20 nt, Staphylococcus aureus subsp. aureus N315
agacaauaaugcacgcgugc

SEQ ID NO: 2149722 - RNA, 17 nt, Staphylococcus aureus subsp. aureus N315
agacguuuuugaaucag

SEQ ID NO: 2149723 - RNA, 14 nt, Staphylococcus aureus subsp. aureus N315
agacguuuuccaug

SEQ ID NO: 2149724 - RNA, 19 nt, Staphylococcus aureus subsp. aureus N315
agaauccuaugccaaauaa

SEQ ID NO: 2149725 - RNA, 20 nt, Staphylococcus aureus subsp. aureus N315
agaauccuaugccaaauaac

SEQ ID NO: 2149726 - RNA, 17 nt, Staphylococcus aureus subsp. aureus N315
agaaucaaguaauucau

SEQ ID NO: 2149727 - RNA, 22 nt, Staphylococcus aureus subsp. aureus N315
agaauauuaagauguauaugaa

SEQ ID NO: 2149728 - RNA, 19 nt, Staphylococcus aureus subsp. aureus N315
agaauauucagauuuucga

SEQ ID NO: 2149729 - RNA, 16 nt, Staphylococcus aureus subsp. aureus N315
agaauauucagauuuu

SEQ ID NO: 2149730 - RNA, 11 nt, Staphylococcus aureus subsp. aureus N315
agaauauuaac

SEQ ID NO: 2149731 - RNA, 16 nt, Staphylococcus aureus subsp. aureus N315
agaauacuaaaagugu

SEQ ID NO: 2149732 - RNA, 17 nt, Staphylococcus aureus subsp. aureus N315
agaauacuaaaaguguu

SEQ ID NO: 2149733 - RNA, 16 nt, Staphylococcus aureus subsp. aureus N315
agaauucaauuucuca

SEQ ID NO: 2149734 - RNA, 17 nt, Staphylococcus aureus subsp. aureus N315
agaauuauuuuggacug

SEQ ID NO: 2149735 - RNA, 14 nt, Staphylococcus aureus subsp. aureus N315
agaauuauuuagaa

SEQ ID NO: 2149736 - RNA, 14 nt, Staphylococcus aureus subsp. aureus N315
agaauuauuuugga

SEQ ID NO: 2149737 - RNA, 16 nt, Staphylococcus aureus subsp. aureus N315
agaauucuaaaagaau

SEQ ID NO: 2149738 - RNA, 13 nt, Staphylococcus aureus subsp. aureus N315
agaauucauuaau

SEQ ID NO: 2149739 - RNA, 14 nt, Staphylococcus aureus subsp. aureus N315
agaaucuccauuua

SEQ ID NO: 2149740 - RNA, 15 nt, Staphylococcus aureus subsp. aureus N315
agaagcugacgaaaa

SEQ ID NO: 2149741 - RNA, 16 nt, Staphylococcus aureus subsp. aureus N315
agaauacaaauauuaa

SEQ ID NO: 2149742 - RNA, 13 nt, Staphylococcus aureus subsp. aureus N315
agaaguauuauga

SEQ ID NO: 2149743 - RNA, 19 nt, Staphylococcus aureus subsp. aureus N315
agaagcaaaagaugaaaau

SEQ ID NO: 2149744 - RNA, 18 nt, Staphylococcus aureus subsp. aureus N315
agaagaauucucuauuca

SEQ ID NO: 2149745 - RNA, 13 nt, Staphylococcus aureus subsp. aureus N315
agaagaaauauau

SEQ ID NO: 2149746 - RNA, 15 nt, Staphylococcus aureus subsp. aureus N315
acagggguaaaacuu

SEQ ID NO: 2149747 - RNA, 20 nt, Staphylococcus aureus subsp. aureus N315
acagguaaauuuaaaauaau

SEQ ID NO: 2149748 - RNA, 17 nt, Staphylococcus aureus subsp. aureus N315
acaggugcuuacuuuua

SEQ ID NO: 2149749 - RNA, 18 nt, Staphylococcus aureus subsp. aureus N315
acaguaugauuaggauua

SEQ ID NO: 2149750 - RNA, 20 nt, Staphylococcus aureus subsp. aureus N315
acaguaguuaauugaaugaa

SEQ ID NO: 2149751 - RNA, 21 nt, Staphylococcus aureus subsp. aureus N315
acaguacgauuauuuggauaa

SEQ ID NO: 2149752 - RNA, 18 nt, Staphylococcus aureus subsp. aureus N315
acagucauaaauugauuu

SEQ ID NO: 2149753 - RNA, 23 nt, Staphylococcus aureus subsp. aureus N315
acagucaacugcugcuaaaauaa

SEQ ID NO: 2149754 - RNA, 15 nt, Staphylococcus aureus subsp. aureus N315
acagucaacugcugc

SEQ ID NO: 2149755 - RNA, 22 nt, Staphylococcus aureus subsp. aureus N315
acagucaacugcugcuaaaaua

SEQ ID NO: 2149756 - RNA, 15 nt, Staphylococcus aureus subsp. aureus N315
acagugaaucuaaac

SEQ ID NO: 2149757 - RNA, 17 nt, Staphylococcus aureus subsp. aureus N315
acagugacugauucacc

SEQ ID NO: 2149758 - RNA, 19 nt, Staphylococcus aureus subsp. aureus N315
acaguguaugaugaacuua

SEQ ID NO: 2149759 - RNA, 23 nt, Staphylococcus aureus subsp. aureus N315
acaguuacuuucgcuugcaaaga

SEQ ID NO: 2149760 - RNA, 20 nt, Staphylococcus aureus subsp. aureus N315
acaguuaugccugaagcgcu

SEQ ID NO: 2149761 - RNA, 22 nt, Staphylococcus aureus subsp. aureus N315
acaguucuauagguuuauaaaa

SEQ ID NO: 2149762 - RNA, 14 nt, Staphylococcus aureus subsp. aureus N315
acauaaauaaacuu

SEQ ID NO: 2149763 - RNA, 22 nt, Staphylococcus aureus subsp. aureus N315
acauaaauaagcaguaagauga

SEQ ID NO: 2149764 - RNA, 15 nt, Staphylococcus aureus subsp. aureus N315
acauaaaauuaacuu

SEQ ID NO: 2149765 - RNA, 16 nt, Staphylococcus aureus subsp. aureus N315
acauaaaacuuacauu

SEQ ID NO: 2149766 - RNA, 12 nt, Staphylococcus aureus subsp. aureus N315
acauaaaauuua

SEQ ID NO: 2149767 - RNA, 22 nt, Staphylococcus aureus subsp. aureus N315
acauaaucauuguguauuguuu

SEQ ID NO: 2149768 - RNA, 16 nt, Staphylococcus aureus subsp. aureus N315
acauaaucauugugua

SEQ ID NO: 2149769 - RNA, 15 nt, Staphylococcus aureus subsp. aureus N315
acauaacacaaguua

SEQ ID NO: 2149770 - RNA, 23 nt, Staphylococcus aureus subsp. aureus N315
acauaaaucuaauacuuucaaac

SEQ ID NO: 2149771 - RNA, 16 nt, Staphylococcus aureus subsp. aureus N315
acaucuaaauuugcca

SEQ ID NO: 2149772 - RNA, 22 nt, Staphylococcus aureus subsp. aureus N315
acaucuagaugaaauuguguug

SEQ ID NO: 2149773 - RNA, 20 nt, Staphylococcus aureus subsp. aureus N315
acaucuauaacaaaaucuca

SEQ ID NO: 2149774 - RNA, 14 nt, Staphylococcus aureus subsp. aureus N315
acaucuauuucuug

SEQ ID NO: 2149775 - RNA, 22 nt, Staphylococcus aureus subsp. aureus N315
acaucgccaauuugauuaguaa

SEQ ID NO: 2149776 - RNA, 13 nt, Staphylococcus aureus subsp. aureus N315
acaucugaaaaaa

SEQ ID NO: 2149777 - RNA, 22 nt, Staphylococcus aureus subsp. aureus N315
acaugacauucauuuaguuaaa

SEQ ID NO: 2149778 - RNA, 16 nt, Staphylococcus aureus subsp. aureus N315
acaugacauucauuua

SEQ ID NO: 2149779 - RNA, 19 nt, Staphylococcus aureus subsp. aureus N315
acaugaauuuuaauauauu

SEQ ID NO: 2149780 - RNA, 16 nt, Staphylococcus aureus subsp. aureus N315
acaugaauuuuaauau

SEQ ID NO: 2149781 - RNA, 22 nt, Staphylococcus aureus subsp. aureus N315
acaugagauuauuuuuuuaaau

SEQ ID NO: 2149782 - RNA, 23 nt, Staphylococcus aureus subsp. aureus N315
acaugaggaucaacugaaauuuu

SEQ ID NO: 2149783 - RNA, 15 nt, Staphylococcus aureus subsp. aureus N315
acaugauaauuuuua

SEQ ID NO: 2149784 - RNA, 15 nt, Staphylococcus aureus subsp. aureus N315
acaugaguaaaacuc

SEQ ID NO: 2149785 - RNA, 19 nt, Staphylococcus aureus subsp. aureus N315
acaugcuuggacauauacu

SEQ ID NO: 2149786 - RNA, 19 nt, Staphylococcus aureus subsp. aureus N315
acaugcaccuuuacaacau

SEQ ID NO: 2149787 - RNA, 19 nt, Staphylococcus aureus subsp. aureus N315
acaugauucaugauauguu

SEQ ID NO: 2149788 - RNA, 19 nt, Staphylococcus aureus subsp. aureus N315
acaugcacuuuauuaaaaa

SEQ ID NO: 2149789 - RNA, 23 nt, Staphylococcus aureus subsp. aureus N315
acaugcacuuuauuaaaaauccu

SEQ ID NO: 2149790 - RNA, 16 nt, Staphylococcus aureus subsp. aureus N315
acaugauaauuuuuag

SEQ ID NO: 2149791 - RNA, 22 nt, Staphylococcus aureus subsp. aureus N315
acauccaauuauguuuaucuac

SEQ ID NO: 2149792 - RNA, 23 nt, Staphylococcus aureus subsp. aureus N315
acauccaauuauguuuaucuacu

SEQ ID NO: 2149793 - RNA, 14 nt, Staphylococcus aureus subsp. aureus N315
acaucacuugcugu

SEQ ID NO: 2149794 - RNA, 15 nt, Staphylococcus aureus subsp. aureus N315
acaucagauauaagu

SEQ ID NO: 2149795 - RNA, 13 nt, Staphylococcus aureus subsp. aureus N315
acaucauuaaaua

SEQ ID NO: 2149796 - RNA, 17 nt, Staphylococcus aureus subsp. aureus N315
acaucauuaaauauuua

SEQ ID NO: 2149797 - RNA, 15 nt, Staphylococcus aureus subsp. aureus N315
acauauuuuuuaaau

SEQ ID NO: 2149798 - RNA, 18 nt, Staphylococcus aureus subsp. aureus N315
acaucaaauagacaccaa

SEQ ID NO: 2149799 - RNA, 22 nt, Staphylococcus aureus subsp. aureus N315
acaucaaauagacaccaaaaaa

SEQ ID NO: 2149800 - RNA, 15 nt, Staphylococcus aureus subsp. aureus N315
acauauuuucacaau

SEQ ID NO: 2149801 - RNA, 17 nt, Staphylococcus aureus subsp. aureus N315
acauauuuuaacuauga

SEQ ID NO: 2149802 - RNA, 15 nt, Staphylococcus aureus subsp. aureus N315
acauauuuauacuga

SEQ ID NO: 2149803 - RNA, 13 nt, Staphylococcus aureus subsp. aureus N315
acauauuggcuug

SEQ ID NO: 2149804 - RNA, 18 nt, Staphylococcus aureus subsp. aureus N315
acauauucaguauaugua

SEQ ID NO: 2149805 - RNA, 14 nt, Staphylococcus aureus subsp. aureus N315
acauauucauaaua

SEQ ID NO: 2149806 - RNA, 21 nt, Staphylococcus aureus subsp. aureus N315
acauaccacacuuuaaacaag

SEQ ID NO: 2149807 - RNA, 14 nt, Staphylococcus aureus subsp. aureus N315
acauauuauauaua

SEQ ID NO: 2149808 - RNA, 18 nt, Staphylococcus aureus subsp. aureus N315
acauauuaugauacgcuu

SEQ ID NO: 2149809 - RNA, 14 nt, Staphylococcus aureus subsp. aureus N315
acauacauuuugaa

SEQ ID NO: 2149810 - RNA, 15 nt, Staphylococcus aureus subsp. aureus N315
acauacauuuugaaa

SEQ ID NO: 2149811 - RNA, 16 nt, Staphylococcus aureus subsp. aureus N315
acauacagucaauaca

SEQ ID NO: 2149812 - RNA, 16 nt, Staphylococcus aureus subsp. aureus N315
acauacaccuucagau

SEQ ID NO: 2149813 - RNA, 18 nt, Staphylococcus aureus subsp. aureus N315
acauaauuuaucaauuuc

SEQ ID NO: 2149814 - RNA, 21 nt, Staphylococcus aureus subsp. aureus N315
acauaauccagccacaccaaa

SEQ ID NO: 2149815 - RNA, 16 nt, Staphylococcus aureus subsp. aureus N315
acauaauuuaucaauu

SEQ ID NO: 2149816 - RNA, 16 nt, Staphylococcus aureus subsp. aureus N315
acacuuuaguauuaua

SEQ ID NO: 2149817 - RNA, 16 nt, Staphylococcus aureus subsp. aureus N315
acacuugauaaaacua

SEQ ID NO: 2149818 - RNA, 13 nt, Staphylococcus aureus subsp. aureus N315
acacuugauaaaa

SEQ ID NO: 2149819 - RNA, 15 nt, Staphylococcus aureus subsp. aureus N315
acacuuaauauauuc

SEQ ID NO: 2149820 - RNA, 21 nt, Staphylococcus aureus subsp. aureus N315
acacuucguauugaaugaauu

SEQ ID NO: 2149821 - RNA, 18 nt, Staphylococcus aureus subsp. aureus N315
acagaauuucaucaaauc

SEQ ID NO: 2149822 - RNA, 21 nt, Staphylococcus aureus subsp. aureus N315
aauuucacuuuaacuucuuuu

SEQ ID NO: 2149823 - RNA, 21 nt, Staphylococcus aureus subsp. aureus N315
aauuucaguaggacauauaaa

SEQ ID NO: 2149824 - RNA, 20 nt, Staphylococcus aureus subsp. aureus N315
aauuucauaaaguuuauuua

SEQ ID NO: 2149825 - RNA, 23 nt, Staphylococcus aureus subsp. aureus N315
aauuucaguaucauguucuuaua

SEQ ID NO: 2149826 - RNA, 17 nt, Staphylococcus aureus subsp. aureus N315
acagcacgagacaauaa

SEQ ID NO: 2149827 - RNA, 22 nt, Staphylococcus aureus subsp. aureus N315
acagcacauuuuuaguuagaaa

SEQ ID NO: 2149828 - RNA, 22 nt, Staphylococcus aureus subsp. aureus N315
acagagaauuucgaaaagaaau

SEQ ID NO: 2149829 - RNA, 16 nt, Staphylococcus aureus subsp. aureus N315
acagccgaggcaauau

SEQ ID NO: 2149830 - RNA, 22 nt, Staphylococcus aureus subsp. aureus N315
acagccgaggcaauauugaaca

SEQ ID NO: 2149831 - RNA, 16 nt, Staphylococcus aureus subsp. aureus N315
acaggccacacuugag

SEQ ID NO: 2149832 - RNA, 13 nt, Staphylococcus aureus subsp. aureus N315
acagcuucauuaa

SEQ ID NO: 2149833 - RNA, 20 nt, Staphylococcus aureus subsp. aureus N315
accccaacuugcacauuauc

SEQ ID NO: 2149834 - RNA, 21 nt, Staphylococcus aureus subsp. aureus N315
acccagaugaauuuuuauuuu

SEQ ID NO: 2149835 - RNA, 16 nt, Staphylococcus aureus subsp. aureus N315
accccgaaaagaggga

SEQ ID NO: 2149836 - RNA, 16 nt, Staphylococcus aureus subsp. aureus N315
accaucauucauaugg

SEQ ID NO: 2149837 - RNA, 22 nt, Staphylococcus aureus subsp. aureus N315
accauucaucgucucacuuaau

SEQ ID NO: 2149838 - RNA, 14 nt, Staphylococcus aureus subsp. aureus N315
accauuccaaaaau

SEQ ID NO: 2149839 - RNA, 22 nt, Staphylococcus aureus subsp. aureus N315
accauucgaaagccaauuaaua

SEQ ID NO: 2149840 - RNA, 16 nt, Staphylococcus aureus subsp. aureus N315
accauuguauuauccu

SEQ ID NO: 2149841 - RNA, 19 nt, Staphylococcus aureus subsp. aureus N315
accauugcacaguuucauc

SEQ ID NO: 2149842 - RNA, 19 nt, Staphylococcus aureus subsp. aureus N315
accauugugaugauaauua

SEQ ID NO: 2149843 - RNA, 21 nt, Staphylococcus aureus subsp. aureus N315
accauugugaauaauuucagu

SEQ ID NO: 2149844 - RNA, 17 nt, Staphylococcus aureus subsp. aureus N315
accauugugaauaauuu

SEQ ID NO: 2149845 - RNA, 13 nt, Staphylococcus aureus subsp. aureus N315
acccaaucuuguu

SEQ ID NO: 2149846 - RNA, 20 nt, Staphylococcus aureus subsp. aureus N315
acccaaguccggcugaaggg

SEQ ID NO: 2149847 - RNA, 16 nt, Staphylococcus aureus subsp. aureus N315
accauaauuaaauaac

SEQ ID NO: 2149848 - RNA, 14 nt, Staphylococcus aureus subsp. aureus N315
accauacucuaacu

SEQ ID NO: 2149849 - RNA, 18 nt, Staphylococcus aureus subsp. aureus N315
accaguggaaauuaugua

SEQ ID NO: 2149850 - RNA, 14 nt, Staphylococcus aureus subsp. aureus N315
accaguuucuggua

SEQ ID NO: 2149851 - RNA, 23 nt, Staphylococcus aureus subsp. aureus N315
accaguuugaucauaauucagug

SEQ ID NO: 2149852 - RNA, 15 nt, Staphylococcus aureus subsp. aureus N315
accacuauuuuuaaa

SEQ ID NO: 2149853 - RNA, 16 nt, Staphylococcus aureus subsp. aureus N315
accacuauuuuuaaau

SEQ ID NO: 2149854 - RNA, 19 nt, Staphylococcus aureus subsp. aureus N315
accacgauaucuagcugcu

SEQ ID NO: 2149855 - RNA, 14 nt, Staphylococcus aureus subsp. aureus N315
accaccacuuucag

SEQ ID NO: 2149856 - RNA, 11 nt, Staphylococcus aureus subsp. aureus N315
accaccccaac

SEQ ID NO: 2149857 - RNA, 21 nt, Staphylococcus aureus subsp. aureus N315
accacuuuuguuaaaaaaugg

SEQ ID NO: 2149858 - RNA, 18 nt, Staphylococcus aureus subsp. aureus N315
accacuuuuucuguaaua

SEQ ID NO: 2149859 - RNA, 22 nt, Staphylococcus aureus subsp. aureus N315
accacuuuuucuguaauaauua

SEQ ID NO: 2149860 - RNA, 20 nt, Staphylococcus aureus subsp. aureus N315
accaaccaaaaccaaaugaa

SEQ ID NO: 2149861 - RNA, 19 nt, Staphylococcus aureus subsp. aureus N315
accaaccaaaaccaaauga

SEQ ID NO: 2149862 - RNA, 13 nt, Staphylococcus aureus subsp. aureus N315
accaaguaaugau

SEQ ID NO: 2149863 - RNA, 12 nt, Staphylococcus aureus subsp. aureus N315
accaacuuuuuu

SEQ ID NO: 2149864 - RNA, 18 nt, Staphylococcus aureus subsp. aureus N315
accaacuugcacauuauu

SEQ ID NO: 2149865 - RNA, 12 nt, Staphylococcus aureus subsp. aureus N315
accaauuuuuag

SEQ ID NO: 2149866 - RNA, 18 nt, Staphylococcus aureus subsp. aureus N315
accaauuuuaacuuauau

SEQ ID NO: 2149867 - RNA, 19 nt, Staphylococcus aureus subsp. aureus N315
accaauugcugauauaaua

SEQ ID NO: 2149868 - RNA, 15 nt, Staphylococcus aureus subsp. aureus N315
accaauuagcaugac

SEQ ID NO: 2149869 - RNA, 16 nt, Staphylococcus aureus subsp. aureus N315
acaugguuuucaccag

SEQ ID NO: 2149870 - RNA, 22 nt, Staphylococcus aureus subsp. aureus N315
acaugguugauucgauaugaau

SEQ ID NO: 2149871 - RNA, 13 nt, Staphylococcus aureus subsp. aureus N315
acauguacauuau

SEQ ID NO: 2149872 - RNA, 18 nt, Staphylococcus aureus subsp. aureus N315
acauguacaauuuuuaaa

SEQ ID NO: 2149873 - RNA, 18 nt, Staphylococcus aureus subsp. aureus N315
acaugggcaaucacuccu

SEQ ID NO: 2149874 - RNA, 23 nt, Staphylococcus aureus subsp. aureus N315
acauggcuuagguuuaauuuuaa

SEQ ID NO: 2149875 - RNA, 18 nt, Staphylococcus aureus subsp. aureus N315
acauuuaaaaaaugcgcu

SEQ ID NO: 2149876 - RNA, 20 nt, Staphylococcus aureus subsp. aureus N315
acauguauuggccaaacaac

SEQ ID NO: 2149877 - RNA, 14 nt, Staphylococcus aureus subsp. aureus N315
acauuuacauccaa

SEQ ID NO: 2149878 - RNA, 18 nt, Staphylococcus aureus subsp. aureus N315
acauuuacuuaagaacua

SEQ ID NO: 2149879 - RNA, 14 nt, Staphylococcus aureus subsp. aureus N315
acauuuaauacuuu

SEQ ID NO: 2149880 - RNA, 20 nt, Staphylococcus aureus subsp. aureus N315
acauuuaucgugaagaaaaa

SEQ ID NO: 2149881 - RNA, 22 nt, Staphylococcus aureus subsp. aureus N315
acauuuaucgugaagaaaaaau

SEQ ID NO: 2149882 - RNA, 16 nt, Staphylococcus aureus subsp. aureus N315
acauuuuugugcaaaa

SEQ ID NO: 2149883 - RNA, 18 nt, Staphylococcus aureus subsp. aureus N315
acauuuuugugcaaaagu

SEQ ID NO: 2149884 - RNA, 15 nt, Staphylococcus aureus subsp. aureus N315
accaaaaaauccaag

SEQ ID NO: 2149885 - RNA, 15 nt, Staphylococcus aureus subsp. aureus N315
accaaaaaucaucca

SEQ ID NO: 2149886 - RNA, 17 nt, Staphylococcus aureus subsp. aureus N315
accaaagaaaucaccag

SEQ ID NO: 2149887 - RNA, 16 nt, Staphylococcus aureus subsp. aureus N315
accaaauaaauuaaau

SEQ ID NO: 2149888 - RNA, 14 nt, Staphylococcus aureus subsp. aureus N315
acgauagauuuauc

SEQ ID NO: 2149889 - RNA, 18 nt, Staphylococcus aureus subsp. aureus N315
acgauaccuuuaauaaua

SEQ ID NO: 2149890 - RNA, 16 nt, Staphylococcus aureus subsp. aureus N315
acgauaagaauuaaca

SEQ ID NO: 2149891 - RNA, 20 nt, Staphylococcus aureus subsp. aureus N315
acgauaagcacgauaaaaau

SEQ ID NO: 2149892 - RNA, 15 nt, Staphylococcus aureus subsp. aureus N315
acgauauucuacaug

SEQ ID NO: 2149893 - RNA, 14 nt, Staphylococcus aureus subsp. aureus N315
acgaucaaauuuaa

SEQ ID NO: 2149894 - RNA, 20 nt, Staphylococcus aureus subsp. aureus N315
acgaucaguugagucaauuu

SEQ ID NO: 2149895 - RNA, 17 nt, Staphylococcus aureus subsp. aureus N315
acgaucauaaauauuuu

SEQ ID NO: 2149896 - RNA, 16 nt, Staphylococcus aureus subsp. aureus N315
acgagcaguauauauc

SEQ ID NO: 2149897 - RNA, 12 nt, Staphylococcus aureus subsp. aureus N315
acgcaaaacaau

SEQ ID NO: 2149898 - RNA, 17 nt, Staphylococcus aureus subsp. aureus N315
acgcaaaacaauaugaa

SEQ ID NO: 2149899 - RNA, 23 nt, Staphylococcus aureus subsp. aureus N315
acgauuuguucaaugauuuuaua

SEQ ID NO: 2149900 - RNA, 17 nt, Staphylococcus aureus subsp. aureus N315
acgauuuguucaaugau

SEQ ID NO: 2149901 - RNA, 18 nt, Staphylococcus aureus subsp. aureus N315
acgauuuaauuaaaacau

SEQ ID NO: 2149902 - RNA, 14 nt, Staphylococcus aureus subsp. aureus N315
acgauuaauaaaau

SEQ ID NO: 2149903 - RNA, 18 nt, Staphylococcus aureus subsp. aureus N315
acgauugaguugaaaaua

SEQ ID NO: 2149904 - RNA, 16 nt, Staphylococcus aureus subsp. aureus N315
acgauugauuaucaua

SEQ ID NO: 2149905 - RNA, 15 nt, Staphylococcus aureus subsp. aureus N315
acgauucacagacaa

SEQ ID NO: 2149906 - RNA, 13 nt, Staphylococcus aureus subsp. aureus N315
acgaugguugcuu

SEQ ID NO: 2149907 - RNA, 22 nt, Staphylococcus aureus subsp. aureus N315
acgacaaucacagcaauaauaa

SEQ ID NO: 2149908 - RNA, 22 nt, Staphylococcus aureus subsp. aureus N315
acgacaacuugaacuaaaacga

SEQ ID NO: 2149909 - RNA, 17 nt, Staphylococcus aureus subsp. aureus N315
acgaauuaaaauaacuc

SEQ ID NO: 2149910 - RNA, 19 nt, Staphylococcus aureus subsp. aureus N315
acgaagcgggccucaucga

SEQ ID NO: 2149911 - RNA, 23 nt, Staphylococcus aureus subsp. aureus N315
acgaacaucuaauacauuauguu

SEQ ID NO: 2149912 - RNA, 22 nt, Staphylococcus aureus subsp. aureus N315
acgacauuuuuagacauuaaaa

SEQ ID NO: 2149913 - RNA, 13 nt, Staphylococcus aureus subsp. aureus N315
acgacauuuuuag

SEQ ID NO: 2149914 - RNA, 14 nt, Staphylococcus aureus subsp. aureus N315
acgacauuguuuag

SEQ ID NO: 2149915 - RNA, 22 nt, Staphylococcus aureus subsp. aureus N315
acgaccagucgcauauuuugau

SEQ ID NO: 2149916 - RNA, 15 nt, Staphylococcus aureus subsp. aureus N315
acgaaauaguucaaa

SEQ ID NO: 2149917 - RNA, 18 nt, Staphylococcus aureus subsp. aureus N315
acgaaaguagaauuauuu

SEQ ID NO: 2149918 - RNA, 19 nt, Staphylococcus aureus subsp. aureus N315
acgaaauuacuuuaacagu

SEQ ID NO: 2149919 - RNA, 23 nt, Staphylococcus aureus subsp. aureus N315
acgaacaagucuugcaauaccuc

SEQ ID NO: 2149920 - RNA, 13 nt, Staphylococcus aureus subsp. aureus N315
acgaaaugcaaug

SEQ ID NO: 2149921 - RNA, 20 nt, Staphylococcus aureus subsp. aureus N315
acgaaauggugaacuaaauu

SEQ ID NO: 2149922 - RNA, 12 nt, Staphylococcus aureus subsp. aureus N315
accuuuuuuaac

SEQ ID NO: 2149923 - RNA, 21 nt, Staphylococcus aureus subsp. aureus N315
accuuuuuuaguuaaagugau

SEQ ID NO: 2149924 - RNA, 20 nt, Staphylococcus aureus subsp. aureus N315
acgaaaaagaugguuuuguu

SEQ ID NO: 2149925 - RNA, 16 nt, Staphylococcus aureus subsp. aureus N315
accuuuaaaacaucau

SEQ ID NO: 2149926 - RNA, 14 nt, Staphylococcus aureus subsp. aureus N315
accuuuaaaacauc

SEQ ID NO: 2149927 - RNA, 23 nt, Staphylococcus aureus subsp. aureus N315
accuuuagacaauauuuuuacau

SEQ ID NO: 2149928 - RNA, 17 nt, Staphylococcus aureus subsp. aureus N315
accuuuaccaguaucau

SEQ ID NO: 2149929 - RNA, 14 nt, Staphylococcus aureus subsp. aureus N315
accuuuaaauuuac

SEQ ID NO: 2149930 - RNA, 20 nt, Staphylococcus aureus subsp. aureus N315
accuuuaugugcaucauuua

SEQ ID NO: 2149931 - RNA, 23 nt, Staphylococcus aureus subsp. aureus N315
accuuuaugugcaucauuuauau

SEQ ID NO: 2149932 - RNA, 18 nt, Staphylococcus aureus subsp. aureus N315
accuuuaucuguaacaaa

SEQ ID NO: 2149933 - RNA, 12 nt, Staphylococcus aureus subsp. aureus N315
accuuucaaaua

SEQ ID NO: 2149934 - RNA, 22 nt, Staphylococcus aureus subsp. aureus N315
accuuucgcagcuucuuuaaca

SEQ ID NO: 2149935 - RNA, 17 nt, Staphylococcus aureus subsp. aureus N315
accuuugucuuuuuuau

SEQ ID NO: 2149936 - RNA, 21 nt, Staphylococcus aureus subsp. aureus N315
accuuuuaaggcagcuaaaaa

SEQ ID NO: 2149937 - RNA, 19 nt, Staphylococcus aureus subsp. aureus N315
accuuuuauccccucaauu

SEQ ID NO: 2149938 - RNA, 15 nt, Staphylococcus aureus subsp. aureus N315
accuucaguuucuac

SEQ ID NO: 2149939 - RNA, 16 nt, Staphylococcus aureus subsp. aureus N315
accuucagaugcuaca

SEQ ID NO: 2149940 - RNA, 21 nt, Staphylococcus aureus subsp. aureus N315
accugcaauauagcaauuuuc

SEQ ID NO: 2149941 - RNA, 15 nt, Staphylococcus aureus subsp. aureus N315
accugggacauuaau

SEQ ID NO: 2149942 - RNA, 18 nt, Staphylococcus aureus subsp. aureus N315
accugcugaaguuugaac

SEQ ID NO: 2149943 - RNA, 17 nt, Staphylococcus aureus subsp. aureus N315
accugcuuuuuauuauu

SEQ ID NO: 2149944 - RNA, 12 nt, Staphylococcus aureus subsp. aureus N315
accugugauaac

SEQ ID NO: 2149945 - RNA, 14 nt, Staphylococcus aureus subsp. aureus N315
accugugauaaaaa

SEQ ID NO: 2149946 - RNA, 12 nt, Staphylococcus aureus subsp. aureus N315
accuguuaaugu

SEQ ID NO: 2149947 - RNA, 17 nt, Staphylococcus aureus subsp. aureus N315
accuguuacuugagaac

SEQ ID NO: 2149948 - RNA, 23 nt, Staphylococcus aureus subsp. aureus N315
accuguuucuuuacuucuuucaa

SEQ ID NO: 2149949 - RNA, 18 nt, Staphylococcus aureus subsp. aureus N315
accuggucguacuuucaa

SEQ ID NO: 2149950 - RNA, 13 nt, Staphylococcus aureus subsp. aureus N315
accuuaauaauga

SEQ ID NO: 2149951 - RNA, 15 nt, Staphylococcus aureus subsp. aureus N315
accuuacccaaaaaa

SEQ ID NO: 2149952 - RNA, 21 nt, Staphylococcus aureus subsp. aureus N315
accuuacuacgcauuauuaag

SEQ ID NO: 2149953 - RNA, 20 nt, Staphylococcus aureus subsp. aureus N315
accuuacccaaaaaauugua

SEQ ID NO: 2149954 - RNA, 13 nt, Staphylococcus aureus subsp. aureus N315
accuucaauaucu

SEQ ID NO: 2149955 - RNA, 15 nt, Staphylococcus aureus subsp. aureus N315
accuuauauuuuauu

SEQ ID NO: 2149956 - RNA, 16 nt, Staphylococcus aureus subsp. aureus N315
accuuaucaugacaca

SEQ ID NO: 2149957 - RNA, 23 nt, Staphylococcus aureus subsp. aureus N315
accucuaaguucaccuaaaugau

SEQ ID NO: 2149958 - RNA, 19 nt, Staphylococcus aureus subsp. aureus N315
accucuaccaguucaacau

SEQ ID NO: 2149959 - RNA, 16 nt, Staphylococcus aureus subsp. aureus N315
accucuugauaaaaua

SEQ ID NO: 2149960 - RNA, 21 nt, Staphylococcus aureus subsp. aureus N315
accucugauguguuauguuag

SEQ ID NO: 2149961 - RNA, 12 nt, Staphylococcus aureus subsp. aureus N315
accucuuuuguu

SEQ ID NO: 2149962 - RNA, 17 nt, Staphylococcus aureus subsp. aureus N315
accucuuuauuuuaucu

SEQ ID NO: 2149963 - RNA, 21 nt, Staphylococcus aureus subsp. aureus N315
accucuuuauuuuaucucuua

SEQ ID NO: 2149964 - RNA, 17 nt, Staphylococcus aureus subsp. aureus N315
accuauuuuuugagcac

SEQ ID NO: 2149965 - RNA, 21 nt, Staphylococcus aureus subsp. aureus N315
accuaucccuguaaaaccaua

SEQ ID NO: 2149966 - RNA, 17 nt, Staphylococcus aureus subsp. aureus N315
accuauuccuaauaaau

SEQ ID NO: 2149967 - RNA, 19 nt, Staphylococcus aureus subsp. aureus N315
accuaagcugauuaaaaug

SEQ ID NO: 2149968 - RNA, 16 nt, Staphylococcus aureus subsp. aureus N315
accuaaggcuaaugau

SEQ ID NO: 2149969 - RNA, 16 nt, Staphylococcus aureus subsp. aureus N315
accuaaguuaauuuau

SEQ ID NO: 2149970 - RNA, 13 nt, Staphylococcus aureus subsp. aureus N315
accuaaaaacaaa

SEQ ID NO: 2149971 - RNA, 18 nt, Staphylococcus aureus subsp. aureus N315
accuaaaauacccauuuu

SEQ ID NO: 2149972 - RNA, 20 nt, Staphylococcus aureus subsp. aureus N315
accguuuuuuauaaaucauu

SEQ ID NO: 2149973 - RNA, 14 nt, Staphylococcus aureus subsp. aureus N315
accuacaaauauuu

SEQ ID NO: 2149974 - RNA, 12 nt, Staphylococcus aureus subsp. aureus N315
accuacaaauau

SEQ ID NO: 2149975 - RNA, 18 nt, Staphylococcus aureus subsp. aureus N315
accuaauucauauauacu

SEQ ID NO: 2149976 - RNA, 18 nt, Staphylococcus aureus subsp. aureus N315
accuaauauuuuaaacgu

SEQ ID NO: 2149977 - RNA, 22 nt, Staphylococcus aureus subsp. aureus N315
accuaaguuaauuuaucguuua

SEQ ID NO: 2149978 - RNA, 19 nt, Staphylococcus aureus subsp. aureus N315
accuacaacaccaauugaa

SEQ ID NO: 2149979 - RNA, 17 nt, Staphylococcus aureus subsp. aureus N315
accuacacggucccaag

SEQ ID NO: 2149980 - RNA, 19 nt, Staphylococcus aureus subsp. aureus N315
accuacuuugauauguuuc

SEQ ID NO: 2149981 - RNA, 22 nt, Staphylococcus aureus subsp. aureus N315
accuacuuugauauguuuccuc

SEQ ID NO: 2149982 - RNA, 19 nt, Staphylococcus aureus subsp. aureus N315
accuagggauaauuuuauu

SEQ ID NO: 2149983 - RNA, 16 nt, Staphylococcus aureus subsp. aureus N315
accuauaagucucuuu

SEQ ID NO: 2149984 - RNA, 15 nt, Staphylococcus aureus subsp. aureus N315
accgucaaacuuaaa

SEQ ID NO: 2149985 - RNA, 19 nt, Staphylococcus aureus subsp. aureus N315
accgucaaacuuaaaacua

SEQ ID NO: 2149986 - RNA, 20 nt, Staphylococcus aureus subsp. aureus N315
accgucuucucuaucaguau

SEQ ID NO: 2149987 - RNA, 16 nt, Staphylococcus aureus subsp. aureus N315
accgucuuaucuaaau

SEQ ID NO: 2149988 - RNA, 18 nt, Staphylococcus aureus subsp. aureus N315
accgucuuaucuaaaucu

SEQ ID NO: 2149989 - RNA, 15 nt, Staphylococcus aureus subsp. aureus N315
accguaaucuuuuaa

SEQ ID NO: 2149990 - RNA, 13 nt, Staphylococcus aureus subsp. aureus N315
accguaauuuuaa

SEQ ID NO: 2149991 - RNA, 14 nt, Staphylococcus aureus subsp. aureus N315
accguaaucuuuua

SEQ ID NO: 2149992 - RNA, 21 nt, Staphylococcus aureus subsp. aureus N315
accccuccuggugcugcacca

SEQ ID NO: 2149993 - RNA, 19 nt, Staphylococcus aureus subsp. aureus N315
accgcacuucuauauuaau

SEQ ID NO: 2149994 - RNA, 20 nt, Staphylococcus aureus subsp. aureus N315
accgauuaauauaauaccua

SEQ ID NO: 2149995 - RNA, 19 nt, Staphylococcus aureus subsp. aureus N315
accgccaacuaauguuaaa

SEQ ID NO: 2149996 - RNA, 22 nt, Staphylococcus aureus subsp. aureus N315
aaccauuuuuuuaucuguagaa

SEQ ID NO: 2149997 - RNA, 14 nt, Staphylococcus aureus subsp. aureus N315
aaccauuuuuucaa

SEQ ID NO: 2149998 - RNA, 13 nt, Staphylococcus aureus subsp. aureus N315
aaccauucguaau

SEQ ID NO: 2149999 - RNA, 18 nt, Staphylococcus aureus subsp. aureus N315
aaccauucguaauaaaca

SEQ ID NO: 2150000 - RNA, 19 nt, Staphylococcus aureus subsp. aureus N315
aaccauugaaugaauccca

SEQ ID NO: 2150001 - RNA, 14 nt, Staphylococcus aureus subsp. aureus N315
aacccacauuaaau

SEQ ID NO: 2150002 - RNA, 23 nt, Staphylococcus aureus subsp. aureus N315
aaccaucugugucagcauucaua

SEQ ID NO: 2150003 - RNA, 17 nt, Staphylococcus aureus subsp. aureus N315
aaccaugauuagcgcac

SEQ ID NO: 2150004 - RNA, 12 nt, Staphylococcus aureus subsp. aureus N315
aaccaucugugu

SEQ ID NO: 2150005 - RNA, 16 nt, Staphylococcus aureus subsp. aureus N315
aaccauaguaauaaaa

SEQ ID NO: 2150006 - RNA, 17 nt, Staphylococcus aureus subsp. aureus N315
aaccauaaguaaaacug

SEQ ID NO: 2150007 - RNA, 16 nt, Staphylococcus aureus subsp. aureus N315
aaccauaacaauuuug

SEQ ID NO: 2150008 - RNA, 13 nt, Staphylococcus aureus subsp. aureus N315
aaccauaacaauu

SEQ ID NO: 2150009 - RNA, 15 nt, Staphylococcus aureus subsp. aureus N315
aaccaccugauaaua

SEQ ID NO: 2150010 - RNA, 16 nt, Staphylococcus aureus subsp. aureus N315
aaccaccaaaaaucau

SEQ ID NO: 2150011 - RNA, 16 nt, Staphylococcus aureus subsp. aureus N315
aaccagcuaaccaaau

SEQ ID NO: 2150012 - RNA, 18 nt, Staphylococcus aureus subsp. aureus N315
aaccagcuaaccaaauaa

SEQ ID NO: 2150013 - RNA, 20 nt, Staphylococcus aureus subsp. aureus N315
aaccagcuaaccaaauaauu

SEQ ID NO: 2150014 - RNA, 16 nt, Staphylococcus aureus subsp. aureus N315
aaccagcuaaaccauc

SEQ ID NO: 2150015 - RNA, 22 nt, Staphylococcus aureus subsp. aureus N315
aaccagcuuacugcuuuuuuau

SEQ ID NO: 2150016 - RNA, 18 nt, Staphylococcus aureus subsp. aureus N315
aaccguaacuauaugaaa

SEQ ID NO: 2150017 - RNA, 17 nt, Staphylococcus aureus subsp. aureus N315
aaccgcuuaauucuuca

SEQ ID NO: 2150018 - RNA, 18 nt, Staphylococcus aureus subsp. aureus N315
aaccgauuaauauaauac

SEQ ID NO: 2150019 - RNA, 22 nt, Staphylococcus aureus subsp. aureus N315
aaccgcuacaauuauaaaugau

SEQ ID NO: 2150020 - RNA, 14 nt, Staphylococcus aureus subsp. aureus N315
aaccgcuguuuuuc

SEQ ID NO: 2150021 - RNA, 18 nt, Staphylococcus aureus subsp. aureus N315
aacccauuuucaaaacua

SEQ ID NO: 2150022 - RNA, 21 nt, Staphylococcus aureus subsp. aureus N315
aaccgaagcgcagugaccuca

SEQ ID NO: 2150023 - RNA, 13 nt, Staphylococcus aureus subsp. aureus N315
aacaucuucaaca

SEQ ID NO: 2150024 - RNA, 15 nt, Staphylococcus aureus subsp. aureus N315
aacaucugaaaaaau

SEQ ID NO: 2150025 - RNA, 17 nt, Staphylococcus aureus subsp. aureus N315
aacaucugaaaaaauua

SEQ ID NO: 2150026 - RNA, 23 nt, Staphylococcus aureus subsp. aureus N315
aacaugaccuaauauauuacuaa

SEQ ID NO: 2150027 - RNA, 23 nt, Staphylococcus aureus subsp. aureus N315
aacaugaacaaucagauaaguua

SEQ ID NO: 2150028 - RNA, 17 nt, Staphylococcus aureus subsp. aureus N315
aacaugaacaaucagau

SEQ ID NO: 2150029 - RNA, 19 nt, Staphylococcus aureus subsp. aureus N315
aacaucuaaauaguuuuuc

SEQ ID NO: 2150030 - RNA, 16 nt, Staphylococcus aureus subsp. aureus N315
aacaucuauaacaaaa

SEQ ID NO: 2150031 - RNA, 17 nt, Staphylococcus aureus subsp. aureus N315
aacaucuauaacaaaau

SEQ ID NO: 2150032 - RNA, 21 nt, Staphylococcus aureus subsp. aureus N315
aacaucuauaacaaaaucuca

SEQ ID NO: 2150033 - RNA, 20 nt, Staphylococcus aureus subsp. aureus N315
aacaucgauuuaucauuauu

SEQ ID NO: 2150034 - RNA, 17 nt, Staphylococcus aureus subsp. aureus N315
aacauuagcaugauaaa

SEQ ID NO: 2150035 - RNA, 20 nt, Staphylococcus aureus subsp. aureus N315
aacauuacuaauugaucagc

SEQ ID NO: 2150036 - RNA, 19 nt, Staphylococcus aureus subsp. aureus N315
aacauuagcaugauaaagu

SEQ ID NO: 2150037 - RNA, 22 nt, Staphylococcus aureus subsp. aureus N315
aacauuacaugcaccuuuacaa

SEQ ID NO: 2150038 - RNA, 17 nt, Staphylococcus aureus subsp. aureus N315
aacauuacccuuuaaac

SEQ ID NO: 2150039 - RNA, 14 nt, Staphylococcus aureus subsp. aureus N315
aacauuaauaaaua

SEQ ID NO: 2150040 - RNA, 21 nt, Staphylococcus aureus subsp. aureus N315
aacauguugauaaaaaggauc

SEQ ID NO: 2150041 - RNA, 13 nt, Staphylococcus aureus subsp. aureus N315
aacauguacaauu

SEQ ID NO: 2150042 - RNA, 23 nt, Staphylococcus aureus subsp. aureus N315
aacaugguuuucuuuuuaucaug

SEQ ID NO: 2150043 - RNA, 12 nt, Staphylococcus aureus subsp. aureus N315
aacauuaaaaau

SEQ ID NO: 2150044 - RNA, 21 nt, Staphylococcus aureus subsp. aureus N315
aacaugauucaugauauguuc

SEQ ID NO: 2150045 - RNA, 22 nt, Staphylococcus aureus subsp. aureus N315
aacaugauacugaaauuucaua

SEQ ID NO: 2150046 - RNA, 13 nt, Staphylococcus aureus subsp. aureus N315
aacaugauacgua

SEQ ID NO: 2150047 - RNA, 17 nt, Staphylococcus aureus subsp. aureus N315
aaccaauuaauuguaaa

SEQ ID NO: 2150048 - RNA, 18 nt, Staphylococcus aureus subsp. aureus N315
aaccaaaucggaauaaaa

SEQ ID NO: 2150049 - RNA, 23 nt, Staphylococcus aureus subsp. aureus N315
aaccaaaucggaauaaaauaaau

SEQ ID NO: 2150050 - RNA, 18 nt, Staphylococcus aureus subsp. aureus N315
aaccaaaccauaaguaaa

SEQ ID NO: 2150051 - RNA, 13 nt, Staphylococcus aureus subsp. aureus N315
aaccaaauaauug

SEQ ID NO: 2150052 - RNA, 22 nt, Staphylococcus aureus subsp. aureus N315
aacauuuguuggaagccuucaa

SEQ ID NO: 2150053 - RNA, 13 nt, Staphylococcus aureus subsp. aureus N315
aacauuugucaua

SEQ ID NO: 2150054 - RNA, 19 nt, Staphylococcus aureus subsp. aureus N315
aacauuuaucgugaagaaa

SEQ ID NO: 2150055 - RNA, 20 nt, Staphylococcus aureus subsp. aureus N315
aacauuuaucgugaagaaaa

SEQ ID NO: 2150056 - RNA, 14 nt, Staphylococcus aureus subsp. aureus N315
aacauuuuuucuau

SEQ ID NO: 2150057 - RNA, 15 nt, Staphylococcus aureus subsp. aureus N315
aaccaaaaccaaaug

SEQ ID NO: 2150058 - RNA, 22 nt, Staphylococcus aureus subsp. aureus N315
aacauuuugauacguaaacacu

SEQ ID NO: 2150059 - RNA, 11 nt, Staphylococcus aureus subsp. aureus N315
aacauuuuuag

SEQ ID NO: 2150060 - RNA, 22 nt, Staphylococcus aureus subsp. aureus N315
aacauuuugccccucauucaca

SEQ ID NO: 2150061 - RNA, 15 nt, Staphylococcus aureus subsp. aureus N315
aacauugagauuauc

SEQ ID NO: 2150062 - RNA, 20 nt, Staphylococcus aureus subsp. aureus N315
aacauugagauuaucuuuag

SEQ ID NO: 2150063 - RNA, 19 nt, Staphylococcus aureus subsp. aureus N315
aacauugauuauuguucca

SEQ ID NO: 2150064 - RNA, 13 nt, Staphylococcus aureus subsp. aureus N315
aacauuauuuuug

SEQ ID NO: 2150065 - RNA, 19 nt, Staphylococcus aureus subsp. aureus N315
aacauucccuuaauaauaa

SEQ ID NO: 2150066 - RNA, 15 nt, Staphylococcus aureus subsp. aureus N315
aacauaauauuuuga

SEQ ID NO: 2150067 - RNA, 14 nt, Staphylococcus aureus subsp. aureus N315
aacauaauuuuuau

SEQ ID NO: 2150068 - RNA, 23 nt, Staphylococcus aureus subsp. aureus N315
aacauagauacaaaguacaguua

SEQ ID NO: 2150069 - RNA, 15 nt, Staphylococcus aureus subsp. aureus N315
aacauacuauaaaaa

SEQ ID NO: 2150070 - RNA, 19 nt, Staphylococcus aureus subsp. aureus N315
aacauaauuuuuauuuaca

SEQ ID NO: 2150071 - RNA, 20 nt, Staphylococcus aureus subsp. aureus N315
aacauaccuaauaacgcaua

SEQ ID NO: 2150072 - RNA, 18 nt, Staphylococcus aureus subsp. aureus N315
aacauagcuuaauaauua

SEQ ID NO: 2150073 - RNA, 21 nt, Staphylococcus aureus subsp. aureus N315
aacauagcuuaauaauuaaua

SEQ ID NO: 2150074 - RNA, 16 nt, Staphylococcus aureus subsp. aureus N315
aacauauguacuauua

SEQ ID NO: 2150075 - RNA, 21 nt, Staphylococcus aureus subsp. aureus N315
aacaucacuuuaggguucauu

SEQ ID NO: 2150076 - RNA, 14 nt, Staphylococcus aureus subsp. aureus N315
aacaucacuugcug

SEQ ID NO: 2150077 - RNA, 18 nt, Staphylococcus aureus subsp. aureus N315
aacaucacauaaaauaca

SEQ ID NO: 2150078 - RNA, 19 nt, Staphylococcus aureus subsp. aureus N315
aacaucaauuacucuuuuu

SEQ ID NO: 2150079 - RNA, 21 nt, Staphylococcus aureus subsp. aureus N315
aacauauuuuaacuaugaaug

SEQ ID NO: 2150080 - RNA, 12 nt, Staphylococcus aureus subsp. aureus N315
aacauauuuuaa

SEQ ID NO: 2150081 - RNA, 14 nt, Staphylococcus aureus subsp. aureus N315
aacaucaucuaugc

SEQ ID NO: 2150082 - RNA, 16 nt, Staphylococcus aureus subsp. aureus N315
aacaucauaaucgcca

SEQ ID NO: 2150083 - RNA, 13 nt, Staphylococcus aureus subsp. aureus N315
aacaucauucaca

SEQ ID NO: 2150084 - RNA, 16 nt, Staphylococcus aureus subsp. aureus N315
aacauccccaaaaaua

SEQ ID NO: 2150085 - RNA, 20 nt, Staphylococcus aureus subsp. aureus N315
aacagcuuuuucuacaccua

SEQ ID NO: 2150086 - RNA, 13 nt, Staphylococcus aureus subsp. aureus N315
aacaguuagugcu

SEQ ID NO: 2150087 - RNA, 15 nt, Staphylococcus aureus subsp. aureus N315
aacaguuaauaugaa

SEQ ID NO: 2150088 - RNA, 15 nt, Staphylococcus aureus subsp. aureus N315
aacauaacucaaaua

SEQ ID NO: 2150089 - RNA, 15 nt, Staphylococcus aureus subsp. aureus N315
aacagcuuuuucuac

SEQ ID NO: 2150090 - RNA, 20 nt, Staphylococcus aureus subsp. aureus N315
aacagcggaauacagaugau

SEQ ID NO: 2150091 - RNA, 18 nt, Staphylococcus aureus subsp. aureus N315
aacagcaguaagauuauu

SEQ ID NO: 2150092 - RNA, 18 nt, Staphylococcus aureus subsp. aureus N315
aacagcaguaagauauuu

SEQ ID NO: 2150093 - RNA, 17 nt, Staphylococcus aureus subsp. aureus N315
aacagcaaaaaauaaau

SEQ ID NO: 2150094 - RNA, 18 nt, Staphylococcus aureus subsp. aureus N315
aacagcaaaaaauaaauc

SEQ ID NO: 2150095 - RNA, 21 nt, Staphylococcus aureus subsp. aureus N315
aacacggucgccaacaguaau

SEQ ID NO: 2150096 - RNA, 21 nt, Staphylococcus aureus subsp. aureus N315
aacacgaugagcgcauaaauu

SEQ ID NO: 2150097 - RNA, 19 nt, Staphylococcus aureus subsp. aureus N315
aacacgaugagcgcauaaa

SEQ ID NO: 2150098 - RNA, 20 nt, Staphylococcus aureus subsp. aureus N315
aacacgauuugguugaacug

SEQ ID NO: 2150099 - RNA, 18 nt, Staphylococcus aureus subsp. aureus N315
aacacugagaauuucuaa

SEQ ID NO: 2150100 - RNA, 19 nt, Staphylococcus aureus subsp. aureus N315
aacacugagaauuucuaau

SEQ ID NO: 2150101 - RNA, 16 nt, Staphylococcus aureus subsp. aureus N315
aacacucggaaacaug

SEQ ID NO: 2150102 - RNA, 19 nt, Staphylococcus aureus subsp. aureus N315
aacacguuuuaagccagca

SEQ ID NO: 2150103 - RNA, 18 nt, Staphylococcus aureus subsp. aureus N315
aacacauucuuauuugaa

SEQ ID NO: 2150104 - RNA, 19 nt, Staphylococcus aureus subsp. aureus N315
aacacauucuuauuugaaa

SEQ ID NO: 2150105 - RNA, 14 nt, Staphylococcus aureus subsp. aureus N315
aacacauucaaaua

SEQ ID NO: 2150106 - RNA, 16 nt, Staphylococcus aureus subsp. aureus N315
aacaccacacagcauu

SEQ ID NO: 2150107 - RNA, 21 nt, Staphylococcus aureus subsp. aureus N315
aacacaucuauguggcuacuu

SEQ ID NO: 2150108 - RNA, 16 nt, Staphylococcus aureus subsp. aureus N315
aacacaguacaaauaa

SEQ ID NO: 2150109 - RNA, 17 nt, Staphylococcus aureus subsp. aureus N315
aacacagacguuuuuga

SEQ ID NO: 2150110 - RNA, 18 nt, Staphylococcus aureus subsp. aureus N315
aacacagagaauuucgaa

SEQ ID NO: 2150111 - RNA, 23 nt, Staphylococcus aureus subsp. aureus N315
aacacagagaaauucgaaaagaa

SEQ ID NO: 2150112 - RNA, 20 nt, Staphylococcus aureus subsp. aureus N315
aacacgaacugcauagguaa

SEQ ID NO: 2150113 - RNA, 14 nt, Staphylococcus aureus subsp. aureus N315
aacacgaacugcau

SEQ ID NO: 2150114 - RNA, 14 nt, Staphylococcus aureus subsp. aureus N315
aacaccuaauauuu

SEQ ID NO: 2150115 - RNA, 22 nt, Staphylococcus aureus subsp. aureus N315
aacaccugguacauaaauaccu

SEQ ID NO: 2150116 - RNA, 20 nt, Staphylococcus aureus subsp. aureus N315
aacaauauucguaaauccuu

SEQ ID NO: 2150117 - RNA, 15 nt, Staphylococcus aureus subsp. aureus N315
aacaaucguuuuaau

SEQ ID NO: 2150118 - RNA, 17 nt, Staphylococcus aureus subsp. aureus N315
aacaaugauuaaaauua

SEQ ID NO: 2150119 - RNA, 13 nt, Staphylococcus aureus subsp. aureus N315
aacaauaauugau

SEQ ID NO: 2150120 - RNA, 13 nt, Staphylococcus aureus subsp. aureus N315
aacaauaauaugc

SEQ ID NO: 2150121 - RNA, 19 nt, Staphylococcus aureus subsp. aureus N315
aacaauagguacaacuaaa

SEQ ID NO: 2150122 - RNA, 12 nt, Staphylococcus aureus subsp. aureus N315
aacaauacuacu

SEQ ID NO: 2150123 - RNA, 16 nt, Staphylococcus aureus subsp. aureus N315
aacaaucacaaauuca

SEQ ID NO: 2150124 - RNA, 19 nt, Staphylococcus aureus subsp. aureus N315
aacaaucagauaaguuacu

SEQ ID NO: 2150125 - RNA, 22 nt, Staphylococcus aureus subsp. aureus N315
aacaauagguacaacuaaauau

SEQ ID NO: 2150126 - RNA, 20 nt, Staphylococcus aureus subsp. aureus N315
aacaauauuaaauuucugaa

SEQ ID NO: 2150127 - RNA, 19 nt, Staphylococcus aureus subsp. aureus N315
aacacaaaaaugaagaaua

SEQ ID NO: 2150128 - RNA, 18 nt, Staphylococcus aureus subsp. aureus N315
aacacaaaaaugaagaau

SEQ ID NO: 2150129 - RNA, 21 nt, Staphylococcus aureus subsp. aureus N315
aacaauuuuugggaagaauaa

SEQ ID NO: 2150130 - RNA, 23 nt, Staphylococcus aureus subsp. aureus N315
aacaauuuuauauagacaguagu

SEQ ID NO: 2150131 - RNA, 15 nt, Staphylococcus aureus subsp. aureus N315
aacaauuuuguacau

SEQ ID NO: 2150132 - RNA, 18 nt, Staphylococcus aureus subsp. aureus N315
aacaauuugcauaacauu

SEQ ID NO: 2150133 - RNA, 12 nt, Staphylococcus aureus subsp. aureus N315
aacaauuuuaaa

SEQ ID NO: 2150134 - RNA, 17 nt, Staphylococcus aureus subsp. aureus N315
aacaauucuucaucaug

SEQ ID NO: 2150135 - RNA, 19 nt, Staphylococcus aureus subsp. aureus N315
aacaauugcuaauccauac

SEQ ID NO: 2150136 - RNA, 17 nt, Staphylococcus aureus subsp. aureus N315
aacaauugauugcucua

SEQ ID NO: 2150137 - RNA, 19 nt, Staphylococcus aureus subsp. aureus N315
aacaaauucauauuaacug

SEQ ID NO: 2150138 - RNA, 12 nt, Staphylococcus aureus subsp. aureus N315
aacaaauuaaaa

SEQ ID NO: 2150139 - RNA, 17 nt, Staphylococcus aureus subsp. aureus N315
aacaaauucauauuaac

SEQ ID NO: 2150140 - RNA, 22 nt, Staphylococcus aureus subsp. aureus N315
aacaaauauuagaacauuuauc

SEQ ID NO: 2150141 - RNA, 21 nt, Staphylococcus aureus subsp. aureus N315
aacaaauauaauguauaaaac

SEQ ID NO: 2150142 - RNA, 16 nt, Staphylococcus aureus subsp. aureus N315
aacaaauccauuaaau

SEQ ID NO: 2150143 - RNA, 17 nt, Staphylococcus aureus subsp. aureus N315
aacaaaucuuuuaaauu

SEQ ID NO: 2150144 - RNA, 18 nt, Staphylococcus aureus subsp. aureus N315
aacaaaucuauaaauauc

SEQ ID NO: 2150145 - RNA, 11 nt, Staphylococcus aureus subsp. aureus N315
aacaaagaagc

SEQ ID NO: 2150146 - RNA, 12 nt, Staphylococcus aureus subsp. aureus N315
aacaaagaagcu

SEQ ID NO: 2150147 - RNA, 21 nt, Staphylococcus aureus subsp. aureus N315
aacaaagugcaauuauuucaa

SEQ ID NO: 2150148 - RNA, 13 nt, Staphylococcus aureus subsp. aureus N315
aacaaagcuucca

SEQ ID NO: 2150149 - RNA, 19 nt, Staphylococcus aureus subsp. aureus N315
aacaaagucucuaguaucu

SEQ ID NO: 2150150 - RNA, 17 nt, Staphylococcus aureus subsp. aureus N315
aacaaagugcaauuauu

SEQ ID NO: 2150151 - RNA, 14 nt, Staphylococcus aureus subsp. aureus N315
aacaaauauaauac

SEQ ID NO: 2150152 - RNA, 13 nt, Staphylococcus aureus subsp. aureus N315
aacaaaauuaaau

SEQ ID NO: 2150153 - RNA, 22 nt, Staphylococcus aureus subsp. aureus N315
aacaaaauuaagaagaaauacu

SEQ ID NO: 2150154 - RNA, 14 nt, Staphylococcus aureus subsp. aureus N315
aacaaacauaaaua

SEQ ID NO: 2150155 - RNA, 12 nt, Staphylococcus aureus subsp. aureus N315
aacaaaagaaag

SEQ ID NO: 2150156 - RNA, 14 nt, Staphylococcus aureus subsp. aureus N315
aacaaaaagaauuu

SEQ ID NO: 2150157 - RNA, 20 nt, Staphylococcus aureus subsp. aureus N315
aaauuuuuuagugaaaaagu

SEQ ID NO: 2150158 - RNA, 19 nt, Staphylococcus aureus subsp. aureus N315
aacaaaaagguucuccacc

SEQ ID NO: 2150159 - RNA, 15 nt, Staphylococcus aureus subsp. aureus N315
aacaauaaaaaacca

SEQ ID NO: 2150160 - RNA, 16 nt, Staphylococcus aureus subsp. aureus N315
aacaauaaaaaaccaa

SEQ ID NO: 2150161 - RNA, 20 nt, Staphylococcus aureus subsp. aureus N315
aacaaguauaaaugcagcug

SEQ ID NO: 2150162 - RNA, 17 nt, Staphylococcus aureus subsp. aureus N315
aacaagcuuuuuucaau

SEQ ID NO: 2150163 - RNA, 18 nt, Staphylococcus aureus subsp. aureus N315
aacaagcuuuuuucaauu

SEQ ID NO: 2150164 - RNA, 18 nt, Staphylococcus aureus subsp. aureus N315
aacaagguucuaaaucuu

SEQ ID NO: 2150165 - RNA, 23 nt, Staphylococcus aureus subsp. aureus N315
aacaagguguucgggaauuuuuu

SEQ ID NO: 2150166 - RNA, 15 nt, Staphylococcus aureus subsp. aureus N315
aacaagcaucaugaa

SEQ ID NO: 2150167 - RNA, 14 nt, Staphylococcus aureus subsp. aureus N315
aacaagauucauac

SEQ ID NO: 2150168 - RNA, 12 nt, Staphylococcus aureus subsp. aureus N315
aacaacuaagau

SEQ ID NO: 2150169 - RNA, 23 nt, Staphylococcus aureus subsp. aureus N315
aacaacugcaauagcuauaacuc

SEQ ID NO: 2150170 - RNA, 23 nt, Staphylococcus aureus subsp. aureus N315
aacaacuuuaauuuuucauuaau

SEQ ID NO: 2150171 - RNA, 15 nt, Staphylococcus aureus subsp. aureus N315
aacaacuuuguuuuc

SEQ ID NO: 2150172 - RNA, 15 nt, Staphylococcus aureus subsp. aureus N315
aacaacaucacuuua

SEQ ID NO: 2150173 - RNA, 23 nt, Staphylococcus aureus subsp. aureus N315
aacaaccguuuuaaguacagcau

SEQ ID NO: 2150174 - RNA, 23 nt, Staphylococcus aureus subsp. aureus N315
aacaaccucugauacuucaccau

SEQ ID NO: 2150175 - RNA, 18 nt, Staphylococcus aureus subsp. aureus N315
aacaaccugugauaaaaa

SEQ ID NO: 2150176 - RNA, 17 nt, Staphylococcus aureus subsp. aureus N315
aaauuugaaauauacca

SEQ ID NO: 2150177 - RNA, 19 nt, Staphylococcus aureus subsp. aureus N315
aaauuuguguucaaaucac

SEQ ID NO: 2150178 - RNA, 20 nt, Staphylococcus aureus subsp. aureus N315
aaauuugugcauucaucaau

SEQ ID NO: 2150179 - RNA, 18 nt, Staphylococcus aureus subsp. aureus N315
aaauuucuguaaccaaaa

SEQ ID NO: 2150180 - RNA, 19 nt, Staphylococcus aureus subsp. aureus N315
aaauuuuaucuaaacauuu

SEQ ID NO: 2150181 - RNA, 20 nt, Staphylococcus aureus subsp. aureus N315
aaauuuuggaccucuugaaa

SEQ ID NO: 2150182 - RNA, 15 nt, Staphylococcus aureus subsp. aureus N315
aaauuuugaagaagu

SEQ ID NO: 2150183 - RNA, 22 nt, Staphylococcus aureus subsp. aureus N315
aaauuuucuguuuaauuaaaau

SEQ ID NO: 2150184 - RNA, 19 nt, Staphylococcus aureus subsp. aureus N315
aaauuucaccgcuuucaau

SEQ ID NO: 2150185 - RNA, 21 nt, Staphylococcus aureus subsp. aureus N315
aaauuucaagguauacacaaa

SEQ ID NO: 2150186 - RNA, 17 nt, Staphylococcus aureus subsp. aureus N315
aaauuuauuuuuaauuu

SEQ ID NO: 2150187 - RNA, 12 nt, Staphylococcus aureus subsp. aureus N315
aaauuucaaaaa

SEQ ID NO: 2150188 - RNA, 15 nt, Staphylococcus aureus subsp. aureus N315
aaauuucaaaaauag

SEQ ID NO: 2150189 - RNA, 18 nt, Staphylococcus aureus subsp. aureus N315
aaauuuauuauaaaauag

SEQ ID NO: 2150190 - RNA, 21 nt, Staphylococcus aureus subsp. aureus N315
aaauuuccucaccuucauuuu

SEQ ID NO: 2150191 - RNA, 15 nt, Staphylococcus aureus subsp. aureus N315
aaauuucgacaucua

SEQ ID NO: 2150192 - RNA, 20 nt, Staphylococcus aureus subsp. aureus N315
aaauuguggcguaguuugaa

SEQ ID NO: 2150193 - RNA, 14 nt, Staphylococcus aureus subsp. aureus N315
aaauuguauagaau

SEQ ID NO: 2150194 - RNA, 14 nt, Staphylococcus aureus subsp. aureus N315
aaauuguaugaaua

SEQ ID NO: 2150195 - RNA, 22 nt, Staphylococcus aureus subsp. aureus N315
aaauuguguuucuuuuauuuuc

SEQ ID NO: 2150196 - RNA, 20 nt, Staphylococcus aureus subsp. aureus N315
aaauuguuuacuauacuuug

SEQ ID NO: 2150197 - RNA, 15 nt, Staphylococcus aureus subsp. aureus N315
aaauuguguuucuuu

SEQ ID NO: 2150198 - RNA, 22 nt, Staphylococcus aureus subsp. aureus N315
aaauuuauauagucuaugaaua

SEQ ID NO: 2150199 - RNA, 13 nt, Staphylococcus aureus subsp. aureus N315
aaauuuauaauac

SEQ ID NO: 2150200 - RNA, 21 nt, Staphylococcus aureus subsp. aureus N315
aaauuuaguuaaguauuuaaa

SEQ ID NO: 2150201 - RNA, 21 nt, Staphylococcus aureus subsp. aureus N315
aaauuuacgaaaguagaauua

SEQ ID NO: 2150202 - RNA, 16 nt, Staphylococcus aureus subsp. aureus N315
aaauuuaaauauugaa

SEQ ID NO: 2150203 - RNA, 18 nt, Staphylococcus aureus subsp. aureus N315
aaauuuaauacaauucaa

SEQ ID NO: 2150204 - RNA, 14 nt, Staphylococcus aureus subsp. aureus N315
aaauuuaacuauga

SEQ ID NO: 2150205 - RNA, 14 nt, Staphylococcus aureus subsp. aureus N315
aaauuuaaaauaau

SEQ ID NO: 2150206 - RNA, 17 nt, Staphylococcus aureus subsp. aureus N315
aaauuuaaaacaaugau

SEQ ID NO: 2150207 - RNA, 15 nt, Staphylococcus aureus subsp. aureus N315
aaauuuaaaagaaaa

SEQ ID NO: 2150208 - RNA, 16 nt, Staphylococcus aureus subsp. aureus N315
aaauuuaaaacaauga

SEQ ID NO: 2150209 - RNA, 12 nt, Staphylococcus aureus subsp. aureus N315
aaauuuaaaaua

SEQ ID NO: 2150210 - RNA, 19 nt, Staphylococcus aureus subsp. aureus N315
aaauugcuauauuaguaua

SEQ ID NO: 2150211 - RNA, 20 nt, Staphylococcus aureus subsp. aureus N315
aaauugccuuucauuuuagc

SEQ ID NO: 2150212 - RNA, 19 nt, Staphylococcus aureus subsp. aureus N315
aaauuggauaauuucuucu

SEQ ID NO: 2150213 - RNA, 12 nt, Staphylococcus aureus subsp. aureus N315
aaauuguaaaac

SEQ ID NO: 2150214 - RNA, 23 nt, Staphylococcus aureus subsp. aureus N315
uuucaaaaaaagcugauuucuau

SEQ ID NO: 2150215 - RNA, 11 nt, Staphylococcus aureus subsp. aureus N315
uuuauuuuuuu

SEQ ID NO: 2150216 - RNA, 11 nt, Staphylococcus aureus subsp. aureus N315
uuucaaaaaua

SEQ ID NO: 2150217 - RNA, 14 nt, Staphylococcus aureus subsp. aureus N315
uuucaaaacuagca

SEQ ID NO: 2150218 - RNA, 14 nt, Staphylococcus aureus subsp. aureus N315
uuucaaaacugcca

SEQ ID NO: 2150219 - RNA, 21 nt, Staphylococcus aureus subsp. aureus N315
aaauugauauugcaaaacuug

SEQ ID NO: 2150220 - RNA, 17 nt, Staphylococcus aureus subsp. aureus N315
aaauugauauugcaaaa

SEQ ID NO: 2150221 - RNA, 19 nt, Staphylococcus aureus subsp. aureus N315
aaauugcaaaguaacaaua

SEQ ID NO: 2150222 - RNA, 17 nt, Staphylococcus aureus subsp. aureus N315
aagaaauucgcaagccu

SEQ ID NO: 2150223 - RNA, 13 nt, Staphylococcus aureus subsp. aureus N315
aagaaauuaaagu

SEQ ID NO: 2150224 - RNA, 14 nt, Staphylococcus aureus subsp. aureus N315
aagaaaucaccaga

SEQ ID NO: 2150225 - RNA, 20 nt, Staphylococcus aureus subsp. aureus N315
aagaaauacuugaauuuaau

SEQ ID NO: 2150226 - RNA, 17 nt, Staphylococcus aureus subsp. aureus N315
aagaaauaauuuaaagg

SEQ ID NO: 2150227 - RNA, 19 nt, Staphylococcus aureus subsp. aureus N315
aagaaaccuuuuuucucuu

SEQ ID NO: 2150228 - RNA, 15 nt, Staphylococcus aureus subsp. aureus N315
aacuuuuuuaacuuu

SEQ ID NO: 2150229 - RNA, 13 nt, Staphylococcus aureus subsp. aureus N315
aacuuuuuuaaca

SEQ ID NO: 2150230 - RNA, 17 nt, Staphylococcus aureus subsp. aureus N315
aacuuuucaaagccaca

SEQ ID NO: 2150231 - RNA, 15 nt, Staphylococcus aureus subsp. aureus N315
aacuuuuuuaacagc

SEQ ID NO: 2150232 - RNA, 24 nt, Staphylococcus aureus subsp. aureus N315
aagaaaaauguguuaaaauauauu

SEQ ID NO: 2150233 - RNA, 21 nt, Staphylococcus aureus subsp. aureus N315
aagaaaaauguguuaaaauau

SEQ ID NO: 2150234 - RNA, 20 nt, Staphylococcus aureus subsp. aureus N315
aagaaaaagugauaauuaaa

SEQ ID NO: 2150235 - RNA, 21 nt, Staphylococcus aureus subsp. aureus N315
aagaaaaagugauaauuaaaa

SEQ ID NO: 2150236 - RNA, 14 nt, Staphylococcus aureus subsp. aureus N315
aagaaaaaaugaua

SEQ ID NO: 2150237 - RNA, 21 nt, Staphylococcus aureus subsp. aureus N315
aagaaaaaccugggacauuaa

SEQ ID NO: 2150238 - RNA, 18 nt, Staphylococcus aureus subsp. aureus N315
aagaaaauacuaacaauu

SEQ ID NO: 2150239 - RNA, 21 nt, Staphylococcus aureus subsp. aureus N315
aagaaaaauuuucuugguuug

SEQ ID NO: 2150240 - RNA, 18 nt, Staphylococcus aureus subsp. aureus N315
aagaaaaguauaaauaua

SEQ ID NO: 2150241 - RNA, 22 nt, Staphylococcus aureus subsp. aureus N315
aagaagacauuggauuacuucc

SEQ ID NO: 2150242 - RNA, 13 nt, Staphylococcus aureus subsp. aureus N315
aagaagaaauacu

SEQ ID NO: 2150243 - RNA, 22 nt, Staphylococcus aureus subsp. aureus N315
aagaagauuaugaaaacauuau

SEQ ID NO: 2150244 - RNA, 21 nt, Staphylococcus aureus subsp. aureus N315
aagaaggaugaguuuaaaaau

SEQ ID NO: 2150245 - RNA, 17 nt, Staphylococcus aureus subsp. aureus N315
aagaacguguuugaaug

SEQ ID NO: 2150246 - RNA, 13 nt, Staphylococcus aureus subsp. aureus N315
aagaaauuguguu

SEQ ID NO: 2150247 - RNA, 15 nt, Staphylococcus aureus subsp. aureus N315
aagaaauuuaauaca

SEQ ID NO: 2150248 - RNA, 22 nt, Staphylococcus aureus subsp. aureus N315
aagaaauucuacaggcaaugca

SEQ ID NO: 2150249 - RNA, 19 nt, Staphylococcus aureus subsp. aureus N315
aagaaauucuacagguaau

SEQ ID NO: 2150250 - RNA, 22 nt, Staphylococcus aureus subsp. aureus N315
aagaaauucuacagguaaugca

SEQ ID NO: 2150251 - RNA, 12 nt, Staphylococcus aureus subsp. aureus N315
aagaaauuuuuu

SEQ ID NO: 2150252 - RNA, 14 nt, Staphylococcus aureus subsp. aureus N315
aagaaauuuuuucu

SEQ ID NO: 2150253 - RNA, 14 nt, Staphylococcus aureus subsp. aureus N315
aagaacauaaccua

SEQ ID NO: 2150254 - RNA, 22 nt, Staphylococcus aureus subsp. aureus N315
aagaacaguauguggauacaaa

SEQ ID NO: 2150255 - RNA, 13 nt, Staphylococcus aureus subsp. aureus N315
aacuuuaauacua

SEQ ID NO: 2150256 - RNA, 22 nt, Staphylococcus aureus subsp. aureus N315
aacuuuaauuaaagcaucuuca

SEQ ID NO: 2150257 - RNA, 19 nt, Staphylococcus aureus subsp. aureus N315
aacuuuaauuuuucauuaa

SEQ ID NO: 2150258 - RNA, 14 nt, Staphylococcus aureus subsp. aureus N315
aacuuguaaucaua

SEQ ID NO: 2150259 - RNA, 24 nt, Staphylococcus aureus subsp. aureus N315
aacuuguauuguuuguagaaauua

SEQ ID NO: 2150260 - RNA, 13 nt, Staphylococcus aureus subsp. aureus N315
aacuucuuuucuu

SEQ ID NO: 2150261 - RNA, 22 nt, Staphylococcus aureus subsp. aureus N315
aacuucuuuuguuuuaccauca

SEQ ID NO: 2150262 - RNA, 11 nt, Staphylococcus aureus subsp. aureus N315
aacuucuuuuu

SEQ ID NO: 2150263 - RNA, 18 nt, Staphylococcus aureus subsp. aureus N315
aacuugaacuaaaacgau

SEQ ID NO: 2150264 - RNA, 20 nt, Staphylococcus aureus subsp. aureus N315
aacuugaucauuauaaaaug

SEQ ID NO: 2150265 - RNA, 20 nt, Staphylococcus aureus subsp. aureus N315
aacuugauuauguaauucua

SEQ ID NO: 2150266 - RNA, 20 nt, Staphylococcus aureus subsp. aureus N315
aacuuuaguuguuaggggcu

SEQ ID NO: 2150267 - RNA, 17 nt, Staphylococcus aureus subsp. aureus N315
aacuuuaguauauucaa

SEQ ID NO: 2150268 - RNA, 15 nt, Staphylococcus aureus subsp. aureus N315
aacuuuaguuguuag

SEQ ID NO: 2150269 - RNA, 16 nt, Staphylococcus aureus subsp. aureus N315
aacuuuacgauaaaua

SEQ ID NO: 2150270 - RNA, 20 nt, Staphylococcus aureus subsp. aureus N315
aacuuuaccaauaucaugca

SEQ ID NO: 2150271 - RNA, 17 nt, Staphylococcus aureus subsp. aureus N315
aacuuucguauuuuucu

SEQ ID NO: 2150272 - RNA, 23 nt, Staphylococcus aureus subsp. aureus N315
aacuuucagcaccagaacaauuc

SEQ ID NO: 2150273 - RNA, 19 nt, Staphylococcus aureus subsp. aureus N315
aacuuugucuguauuauua

SEQ ID NO: 2150274 - RNA, 19 nt, Staphylococcus aureus subsp. aureus N315
aacuuuuuaacugccauau

SEQ ID NO: 2150275 - RNA, 22 nt, Staphylococcus aureus subsp. aureus N315
aacuuuucagcaguugcacaaa

SEQ ID NO: 2150276 - RNA, 15 nt, Staphylococcus aureus subsp. aureus N315
aacuuauuauuuauc

SEQ ID NO: 2150277 - RNA, 13 nt, Staphylococcus aureus subsp. aureus N315
aacuuauucuuca

SEQ ID NO: 2150278 - RNA, 13 nt, Staphylococcus aureus subsp. aureus N315
aacuuauuauuua

SEQ ID NO: 2150279 - RNA, 12 nt, Staphylococcus aureus subsp. aureus N315
aacuuauaauau

SEQ ID NO: 2150280 - RNA, 22 nt, Staphylococcus aureus subsp. aureus N315
aacuuaccaugaugagauaaaa

SEQ ID NO: 2150281 - RNA, 15 nt, Staphylococcus aureus subsp. aureus N315
aacuuaccaugauga

SEQ ID NO: 2150282 - RNA, 13 nt, Staphylococcus aureus subsp. aureus N315
aacuuacauuaca

SEQ ID NO: 2150283 - RNA, 17 nt, Staphylococcus aureus subsp. aureus N315
aacuuaaucaagcuagc

SEQ ID NO: 2150284 - RNA, 17 nt, Staphylococcus aureus subsp. aureus N315
aacuuccaacauauaaa

SEQ ID NO: 2150285 - RNA, 20 nt, Staphylococcus aureus subsp. aureus N315
aacuuccuuuuuauuuuuug

SEQ ID NO: 2150286 - RNA, 22 nt, Staphylococcus aureus subsp. aureus N315
aacuucuucuccguauuuaccu

SEQ ID NO: 2150287 - RNA, 22 nt, Staphylococcus aureus subsp. aureus N315
aacuucugaaacgccucaacac

SEQ ID NO: 2150288 - RNA, 16 nt, Staphylococcus aureus subsp. aureus N315
aacuucugauucuuca

SEQ ID NO: 2150289 - RNA, 18 nt, Staphylococcus aureus subsp. aureus N315
aacuucugauucuucacu

SEQ ID NO: 2150290 - RNA, 12 nt, Staphylococcus aureus subsp. aureus N315
aacuucuacagu

SEQ ID NO: 2150291 - RNA, 14 nt, Staphylococcus aureus subsp. aureus N315
aacuggaacuuaca

SEQ ID NO: 2150292 - RNA, 18 nt, Staphylococcus aureus subsp. aureus N315
aacuggaacuuacaaguc

SEQ ID NO: 2150293 - RNA, 14 nt, Staphylococcus aureus subsp. aureus N315
aacugggauauaga

SEQ ID NO: 2150294 - RNA, 23 nt, Staphylococcus aureus subsp. aureus N315
aacugugcaugacgauaaugaaa

SEQ ID NO: 2150295 - RNA, 20 nt, Staphylococcus aureus subsp. aureus N315
aacugugauauuaauugaaa

SEQ ID NO: 2150296 - RNA, 13 nt, Staphylococcus aureus subsp. aureus N315
aacugugauucau

SEQ ID NO: 2150297 - RNA, 15 nt, Staphylococcus aureus subsp. aureus N315
aacuuaaaauuuaaa

SEQ ID NO: 2150298 - RNA, 23 nt, Staphylococcus aureus subsp. aureus N315
aacuuaaaaaugaaaugaaguau

SEQ ID NO: 2150299 - RNA, 13 nt, Staphylococcus aureus subsp. aureus N315
aacuuaaaacuau

SEQ ID NO: 2150300 - RNA, 17 nt, Staphylococcus aureus subsp. aureus N315
aacuguuaaacucauac

SEQ ID NO: 2150301 - RNA, 22 nt, Staphylococcus aureus subsp. aureus N315
aacuguucuuucgucuuguaaa

SEQ ID NO: 2150302 - RNA, 17 nt, Staphylococcus aureus subsp. aureus N315
aacugauaaaaggggaa

SEQ ID NO: 2150303 - RNA, 21 nt, Staphylococcus aureus subsp. aureus N315
aacugaucauuuucauuuaau

SEQ ID NO: 2150304 - RNA, 14 nt, Staphylococcus aureus subsp. aureus N315
aacugaaauuuuuc

SEQ ID NO: 2150305 - RNA, 19 nt, Staphylococcus aureus subsp. aureus N315
aacugacccuugucaguuu

SEQ ID NO: 2150306 - RNA, 13 nt, Staphylococcus aureus subsp. aureus N315
aacugaauuucgu

SEQ ID NO: 2150307 - RNA, 22 nt, Staphylococcus aureus subsp. aureus N315
aacugccaaaaugguuaaaauc

SEQ ID NO: 2150308 - RNA, 15 nt, Staphylococcus aureus subsp. aureus N315
aacugcauauaaagu

SEQ ID NO: 2150309 - RNA, 18 nt, Staphylococcus aureus subsp. aureus N315
aacugcaaacuugauuca

SEQ ID NO: 2150310 - RNA, 13 nt, Staphylococcus aureus subsp. aureus N315
aacugauuuuguu

SEQ ID NO: 2150311 - RNA, 14 nt, Staphylococcus aureus subsp. aureus N315
aacugcauaaaagc

SEQ ID NO: 2150312 - RNA, 19 nt, Staphylococcus aureus subsp. aureus N315
aacugcugcuaaaauaaaa

SEQ ID NO: 2150313 - RNA, 19 nt, Staphylococcus aureus subsp. aureus N315
aacucguuauagauaagua

SEQ ID NO: 2150314 - RNA, 23 nt, Staphylococcus aureus subsp. aureus N315
aacucgcgagaccuauaagucuc

SEQ ID NO: 2150315 - RNA, 20 nt, Staphylococcus aureus subsp. aureus N315
aacucuuggauugccccuaa

SEQ ID NO: 2150316 - RNA, 21 nt, Staphylococcus aureus subsp. aureus N315
aacucuuuuaacccacauuaa

SEQ ID NO: 2150317 - RNA, 22 nt, Staphylococcus aureus subsp. aureus N315
aacucuaaauauaauagaaaua

SEQ ID NO: 2150318 - RNA, 24 nt, Staphylococcus aureus subsp. aureus N315
aacucuaaauauaauagaaauaau

SEQ ID NO: 2150319 - RNA, 12 nt, Staphylococcus aureus subsp. aureus N315
aacucaauauga

SEQ ID NO: 2150320 - RNA, 15 nt, Staphylococcus aureus subsp. aureus N315
aacucaauaugauaa

SEQ ID NO: 2150321 - RNA, 13 nt, Staphylococcus aureus subsp. aureus N315
aacucaacauuuu

SEQ ID NO: 2150322 - RNA, 22 nt, Staphylococcus aureus subsp. aureus N315
aacuauguuacuuauauauuca

SEQ ID NO: 2150323 - RNA, 17 nt, Staphylococcus aureus subsp. aureus N315
aacuauuaaaaccaaaa

SEQ ID NO: 2150324 - RNA, 23 nt, Staphylococcus aureus subsp. aureus N315
aacuauuaaaaccaaaagaaauu

SEQ ID NO: 2150325 - RNA, 22 nt, Staphylococcus aureus subsp. aureus N315
aacuaucgauacuaaacgauaa

SEQ ID NO: 2150326 - RNA, 14 nt, Staphylococcus aureus subsp. aureus N315
aacuaucugauuaa

SEQ ID NO: 2150327 - RNA, 14 nt, Staphylococcus aureus subsp. aureus N315
aacuauaacaauag

SEQ ID NO: 2150328 - RNA, 20 nt, Staphylococcus aureus subsp. aureus N315
aacuauauauaguugaucaa

SEQ ID NO: 2150329 - RNA, 17 nt, Staphylococcus aureus subsp. aureus N315
aacucauccauugaucu

SEQ ID NO: 2150330 - RNA, 15 nt, Staphylococcus aureus subsp. aureus N315
aacucauuuauaaac

SEQ ID NO: 2150331 - RNA, 16 nt, Staphylococcus aureus subsp. aureus N315
aacucauacaaauuuu

SEQ ID NO: 2150332 - RNA, 14 nt, Staphylococcus aureus subsp. aureus N315
aacucauaccaaaa

SEQ ID NO: 2150333 - RNA, 23 nt, Staphylococcus aureus subsp. aureus N315
aacuaaaaagcgugguucccaau

SEQ ID NO: 2150334 - RNA, 17 nt, Staphylococcus aureus subsp. aureus N315
aacuaaaaugucuuuga

SEQ ID NO: 2150335 - RNA, 19 nt, Staphylococcus aureus subsp. aureus N315
aacuaaaacgauaauaaua

SEQ ID NO: 2150336 - RNA, 20 nt, Staphylococcus aureus subsp. aureus N315
aacuaaaacgauaauaauaa

SEQ ID NO: 2150337 - RNA, 15 nt, Staphylococcus aureus subsp. aureus N315
aacuaaaccauugaa

SEQ ID NO: 2150338 - RNA, 14 nt, Staphylococcus aureus subsp. aureus N315
aacuaaauuaaaag

SEQ ID NO: 2150339 - RNA, 16 nt, Staphylococcus aureus subsp. aureus N315
aacuaacuaauaacuc

SEQ ID NO: 2150340 - RNA, 20 nt, Staphylococcus aureus subsp. aureus N315
aacuaaucguguauuauuga

SEQ ID NO: 2150341 - RNA, 16 nt, Staphylococcus aureus subsp. aureus N315
aacuaauguuaaaaua

SEQ ID NO: 2150342 - RNA, 16 nt, Staphylococcus aureus subsp. aureus N315
aacuaauuuaaagcau

SEQ ID NO: 2150343 - RNA, 20 nt, Staphylococcus aureus subsp. aureus N315
aacuaauaauuuguaauucc

SEQ ID NO: 2150344 - RNA, 18 nt, Staphylococcus aureus subsp. aureus N315
aacuaagugaauuaucua

SEQ ID NO: 2150345 - RNA, 14 nt, Staphylococcus aureus subsp. aureus N315
aacuaauaauuugu

SEQ ID NO: 2150346 - RNA, 15 nt, Staphylococcus aureus subsp. aureus N315
aacuaauaauuugua

SEQ ID NO: 2150347 - RNA, 22 nt, Staphylococcus aureus subsp. aureus N315
aacuacacacguagaaagaugu

SEQ ID NO: 2150348 - RNA, 23 nt, Staphylococcus aureus subsp. aureus N315
aacuacaauucauaagaaaaaug

SEQ ID NO: 2150349 - RNA, 20 nt, Staphylococcus aureus subsp. aureus N315
aacuacgauaccggcaacug

SEQ ID NO: 2150350 - RNA, 23 nt, Staphylococcus aureus subsp. aureus N315
aacuacgcauuuuaaauaaaaug

SEQ ID NO: 2150351 - RNA, 16 nt, Staphylococcus aureus subsp. aureus N315
aacuacugcaacacca

SEQ ID NO: 2150352 - RNA, 19 nt, Staphylococcus aureus subsp. aureus N315
aacuauaaccuauuaaauc

SEQ ID NO: 2150353 - RNA, 19 nt, Staphylococcus aureus subsp. aureus N315
aacuauaauaaagauuaua

SEQ ID NO: 2150354 - RNA, 17 nt, Staphylococcus aureus subsp. aureus N315
aacuauaauaauuggaa

SEQ ID NO: 2150355 - RNA, 18 nt, Staphylococcus aureus subsp. aureus N315
aacuacuuaaauuaagaa

SEQ ID NO: 2150356 - RNA, 13 nt, Staphylococcus aureus subsp. aureus N315
aacuacuucauca

SEQ ID NO: 2150357 - RNA, 18 nt, Staphylococcus aureus subsp. aureus N315
aacuagaaaacauaaaua

SEQ ID NO: 2150358 - RNA, 13 nt, Staphylococcus aureus subsp. aureus N315
aacguccaaacac

SEQ ID NO: 2150359 - RNA, 14 nt, Staphylococcus aureus subsp. aureus N315
aacgucauuuuuaa

SEQ ID NO: 2150360 - RNA, 15 nt, Staphylococcus aureus subsp. aureus N315
aacgucaacagcaua

SEQ ID NO: 2150361 - RNA, 18 nt, Staphylococcus aureus subsp. aureus N315
aacguauauaaguuaaaa

SEQ ID NO: 2150362 - RNA, 12 nt, Staphylococcus aureus subsp. aureus N315
aacgucacuuua

SEQ ID NO: 2150363 - RNA, 20 nt, Staphylococcus aureus subsp. aureus N315
aacguucaaucguuucuucc

SEQ ID NO: 2150364 - RNA, 19 nt, Staphylococcus aureus subsp. aureus N315
aacguucaaucguuucuuc

SEQ ID NO: 2150365 - RNA, 12 nt, Staphylococcus aureus subsp. aureus N315
aacguuuucacu

SEQ ID NO: 2150366 - RNA, 13 nt, Staphylococcus aureus subsp. aureus N315
aacguuuucacuu

SEQ ID NO: 2150367 - RNA, 18 nt, Staphylococcus aureus subsp. aureus N315
aacguucauauaugauaa

SEQ ID NO: 2150368 - RNA, 17 nt, Staphylococcus aureus subsp. aureus N315
aacguugaguauuacuu

SEQ ID NO: 2150369 - RNA, 23 nt, Staphylococcus aureus subsp. aureus N315
aacguugccauacccauauuaaa

SEQ ID NO: 2150370 - RNA, 14 nt, Staphylococcus aureus subsp. aureus N315
aacgguagaauaaa

SEQ ID NO: 2150371 - RNA, 16 nt, Staphylococcus aureus subsp. aureus N315
aacgguagaauaaaag

SEQ ID NO: 2150372 - RNA, 19 nt, Staphylococcus aureus subsp. aureus N315
aacgguaucaacauauuua

SEQ ID NO: 2150373 - RNA, 20 nt, Staphylococcus aureus subsp. aureus N315
aacgguacagauaagaauau

SEQ ID NO: 2150374 - RNA, 21 nt, Staphylococcus aureus subsp. aureus N315
aacguacuguguaauaccaau

SEQ ID NO: 2150375 - RNA, 19 nt, Staphylococcus aureus subsp. aureus N315
aacguacaauguauuaccu

SEQ ID NO: 2150376 - RNA, 15 nt, Staphylococcus aureus subsp. aureus N315
aacguacauuuauga

SEQ ID NO: 2150377 - RNA, 15 nt, Staphylococcus aureus subsp. aureus N315
aacguacauuuuuau

SEQ ID NO: 2150378 - RNA, 17 nt, Staphylococcus aureus subsp. aureus N315
aacguacauuuuuauga

SEQ ID NO: 2150379 - RNA, 22 nt, Staphylococcus aureus subsp. aureus N315
aacgcuuugcagauugauauaa

SEQ ID NO: 2150380 - RNA, 16 nt, Staphylococcus aureus subsp. aureus N315
aacgccucaacacuuu

SEQ ID NO: 2150381 - RNA, 18 nt, Staphylococcus aureus subsp. aureus N315
aacgccucaacacuuucu

SEQ ID NO: 2150382 - RNA, 18 nt, Staphylococcus aureus subsp. aureus N315
aacgcauugcgaaagaaa

SEQ ID NO: 2150383 - RNA, 21 nt, Staphylococcus aureus subsp. aureus N315
aacgauaacaauuuauuaaaa

SEQ ID NO: 2150384 - RNA, 18 nt, Staphylococcus aureus subsp. aureus N315
aacgauaagaauuaacaa

SEQ ID NO: 2150385 - RNA, 23 nt, Staphylococcus aureus subsp. aureus N315
aacgauaagauagcuauauuuag

SEQ ID NO: 2150386 - RNA, 18 nt, Staphylococcus aureus subsp. aureus N315
aacgagucauaaauauaa

SEQ ID NO: 2150387 - RNA, 18 nt, Staphylococcus aureus subsp. aureus N315
aacgauaccaaauauauu

SEQ ID NO: 2150388 - RNA, 17 nt, Staphylococcus aureus subsp. aureus N315
aacgagcuggugagaaa

SEQ ID NO: 2150389 - RNA, 17 nt, Staphylococcus aureus subsp. aureus N315
aacgaugcuacuuaaag

SEQ ID NO: 2150390 - RNA, 18 nt, Staphylococcus aureus subsp. aureus N315
aacgcacuaucaaugaca

SEQ ID NO: 2150391 - RNA, 14 nt, Staphylococcus aureus subsp. aureus N315
aaccuaaaaacaaa

SEQ ID NO: 2150392 - RNA, 13 nt, Staphylococcus aureus subsp. aureus N315
aaccuaaaaacaa

SEQ ID NO: 2150393 - RNA, 15 nt, Staphylococcus aureus subsp. aureus N315
aaccguuauauauua

SEQ ID NO: 2150394 - RNA, 15 nt, Staphylococcus aureus subsp. aureus N315
aaccuauuaaaauaa

SEQ ID NO: 2150395 - RNA, 13 nt, Staphylococcus aureus subsp. aureus N315
aaccuauuaauua

SEQ ID NO: 2150396 - RNA, 12 nt, Staphylococcus aureus subsp. aureus N315
aaccuacaauau

SEQ ID NO: 2150397 - RNA, 17 nt, Staphylococcus aureus subsp. aureus N315
aaccuaaagauaauauu

SEQ ID NO: 2150398 - RNA, 16 nt, Staphylococcus aureus subsp. aureus N315
aaccuaaguuaauuua

SEQ ID NO: 2150399 - RNA, 23 nt, Staphylococcus aureus subsp. aureus N315
aaccuaaucuaccauguuuugua

SEQ ID NO: 2150400 - RNA, 22 nt, Staphylococcus aureus subsp. aureus N315
aaccucuguuuuguugguguuu

SEQ ID NO: 2150401 - RNA, 18 nt, Staphylococcus aureus subsp. aureus N315
aaccucuaaauaaaauua

SEQ ID NO: 2150402 - RNA, 21 nt, Staphylococcus aureus subsp. aureus N315
aaccucuaagguuaaauuacu

SEQ ID NO: 2150403 - RNA, 22 nt, Staphylococcus aureus subsp. aureus N315
aaccugagccauaacugaauaa

SEQ ID NO: 2150404 - RNA, 15 nt, Staphylococcus aureus subsp. aureus N315
aacgacauuguuuag

SEQ ID NO: 2150405 - RNA, 22 nt, Staphylococcus aureus subsp. aureus N315
aacgaaucgccuacuauaaaua

SEQ ID NO: 2150406 - RNA, 20 nt, Staphylococcus aureus subsp. aureus N315
aaccuuuuuguuuucaauaa

SEQ ID NO: 2150407 - RNA, 17 nt, Staphylococcus aureus subsp. aureus N315
aacgaaauuguuaucua

SEQ ID NO: 2150408 - RNA, 13 nt, Staphylococcus aureus subsp. aureus N315
aaccuugauuuaa

SEQ ID NO: 2150409 - RNA, 13 nt, Staphylococcus aureus subsp. aureus N315
aaccuuuaaaagu

SEQ ID NO: 2150410 - RNA, 11 nt, Staphylococcus aureus subsp. aureus N315
aaccuuuaaaa

SEQ ID NO: 2150411 - RNA, 21 nt, Staphylococcus aureus subsp. aureus N315
aaccuuugguuguuaggggcu

SEQ ID NO: 2150412 - RNA, 16 nt, Staphylococcus aureus subsp. aureus N315
aaccuuuucaaauuau

SEQ ID NO: 2150413 - RNA, 14 nt, Staphylococcus aureus subsp. aureus N315
aaccuuuauuuuca

SEQ ID NO: 2150414 - RNA, 17 nt, Staphylococcus aureus subsp. aureus N315
aaccuuacccaaaaaau

SEQ ID NO: 2150415 - RNA, 14 nt, Staphylococcus aureus subsp. aureus N315
aaucauucacuuca

SEQ ID NO: 2150416 - RNA, 15 nt, Staphylococcus aureus subsp. aureus N315
aaucauucaccuaaa

SEQ ID NO: 2150417 - RNA, 19 nt, Staphylococcus aureus subsp. aureus N315
aaucauucacuucaaguua

SEQ ID NO: 2150418 - RNA, 21 nt, Staphylococcus aureus subsp. aureus N315
aaucauucuuuauagaaacca

SEQ ID NO: 2150419 - RNA, 13 nt, Staphylococcus aureus subsp. aureus N315
aaucauuauagca

SEQ ID NO: 2150420 - RNA, 18 nt, Staphylococcus aureus subsp. aureus N315
aaucauuaguuaugugcu

SEQ ID NO: 2150421 - RNA, 23 nt, Staphylococcus aureus subsp. aureus N315
aaucauuaguuaugugcuaaucu

SEQ ID NO: 2150422 - RNA, 18 nt, Staphylococcus aureus subsp. aureus N315
aaucauuagcgaaaaccu

SEQ ID NO: 2150423 - RNA, 15 nt, Staphylococcus aureus subsp. aureus N315
aaucauguaaugcuu

SEQ ID NO: 2150424 - RNA, 18 nt, Staphylococcus aureus subsp. aureus N315
aaucauguaaugcuuaaa

SEQ ID NO: 2150425 - RNA, 16 nt, Staphylococcus aureus subsp. aureus N315
aaucauauauuucuau

SEQ ID NO: 2150426 - RNA, 18 nt, Staphylococcus aureus subsp. aureus N315
aaucaucguauuucauau

SEQ ID NO: 2150427 - RNA, 16 nt, Staphylococcus aureus subsp. aureus N315
aaucaucgcaaauaca

SEQ ID NO: 2150428 - RNA, 21 nt, Staphylococcus aureus subsp. aureus N315
aaucaucuuaacaacuuuaau

SEQ ID NO: 2150429 - RNA, 13 nt, Staphylococcus aureus subsp. aureus N315
aaucaugacauag

SEQ ID NO: 2150430 - RNA, 17 nt, Staphylococcus aureus subsp. aureus N315
aaucaucuuuuugaaau

SEQ ID NO: 2150431 - RNA, 21 nt, Staphylococcus aureus subsp. aureus N315
aaucaugaaauaaaaaaacac

SEQ ID NO: 2150432 - RNA, 21 nt, Staphylococcus aureus subsp. aureus N315
aaucaugcucguuuuuauuca

SEQ ID NO: 2150433 - RNA, 20 nt, Staphylococcus aureus subsp. aureus N315
aaucauacgagaaauuagaa

SEQ ID NO: 2150434 - RNA, 18 nt, Staphylococcus aureus subsp. aureus N315
aaucauaccggcaaauaa

SEQ ID NO: 2150435 - RNA, 20 nt, Staphylococcus aureus subsp. aureus N315
aaucauagcaacaucggcac

SEQ ID NO: 2150436 - RNA, 22 nt, Staphylococcus aureus subsp. aureus N315
aaucauagauauaagaaaucca

SEQ ID NO: 2150437 - RNA, 12 nt, Staphylococcus aureus subsp. aureus N315
aaucauagauau

SEQ ID NO: 2150438 - RNA, 17 nt, Staphylococcus aureus subsp. aureus N315
aaucagcuuuuucacau

SEQ ID NO: 2150439 - RNA, 24 nt, Staphylococcus aureus subsp. aureus N315
aaucagcuuuuucacauugccuaa

SEQ ID NO: 2150440 - RNA, 11 nt, Staphylococcus aureus subsp. aureus N315
aauauuaaaau

SEQ ID NO: 2150441 - RNA, 16 nt, Staphylococcus aureus subsp. aureus N315
aauauuaaauucaucu

SEQ ID NO: 2150442 - RNA, 23 nt, Staphylococcus aureus subsp. aureus N315
aauauguggcgcucuuauaaaga

SEQ ID NO: 2150443 - RNA, 17 nt, Staphylococcus aureus subsp. aureus N315
aauaugugcaugagacu

SEQ ID NO: 2150444 - RNA, 17 nt, Staphylococcus aureus subsp. aureus N315
aauauguaaucagguuu

SEQ ID NO: 2150445 - RNA, 18 nt, Staphylococcus aureus subsp. aureus N315
aauccaauuaaauauuua

SEQ ID NO: 2150446 - RNA, 17 nt, Staphylococcus aureus subsp. aureus N315
aauccaagcaaucuuag

SEQ ID NO: 2150447 - RNA, 17 nt, Staphylococcus aureus subsp. aureus N315
aauccaauauacaaugc

SEQ ID NO: 2150448 - RNA, 18 nt, Staphylococcus aureus subsp. aureus N315
aauccaagauauauaacu

SEQ ID NO: 2150449 - RNA, 14 nt, Staphylococcus aureus subsp. aureus N315
aaucauuuguguau

SEQ ID NO: 2150450 - RNA, 21 nt, Staphylococcus aureus subsp. aureus N315
aaucauuguggcuuuuuuuau

SEQ ID NO: 2150451 - RNA, 21 nt, Staphylococcus aureus subsp. aureus N315
aaucauuuauguagauuuuaa

SEQ ID NO: 2150452 - RNA, 18 nt, Staphylococcus aureus subsp. aureus N315
aaucauugguuucaucau

SEQ ID NO: 2150453 - RNA, 15 nt, Staphylococcus aureus subsp. aureus N315
aaucauuguggcuuu

SEQ ID NO: 2150454 - RNA, 19 nt, Staphylococcus aureus subsp. aureus N315
aaucauuguaaaugaucau

SEQ ID NO: 2150455 - RNA, 18 nt, Staphylococcus aureus subsp. aureus N315
aauccauucuucuuguuu

SEQ ID NO: 2150456 - RNA, 15 nt, Staphylococcus aureus subsp. aureus N315
aaucuagaccuucaa

SEQ ID NO: 2150457 - RNA, 12 nt, Staphylococcus aureus subsp. aureus N315
aaucuacaauau

SEQ ID NO: 2150458 - RNA, 14 nt, Staphylococcus aureus subsp. aureus N315
aaucuacaauauua

SEQ ID NO: 2150459 - RNA, 16 nt, Staphylococcus aureus subsp. aureus N315
aaucguaggaugcuuc

SEQ ID NO: 2150460 - RNA, 20 nt, Staphylococcus aureus subsp. aureus N315
aaucguaacauaucagcuuu

SEQ ID NO: 2150461 - RNA, 14 nt, Staphylococcus aureus subsp. aureus N315
aaucgccauugucc

SEQ ID NO: 2150462 - RNA, 14 nt, Staphylococcus aureus subsp. aureus N315
aauccuucaucaau

SEQ ID NO: 2150463 - RNA, 17 nt, Staphylococcus aureus subsp. aureus N315
aaucgcauuuaaauaua

SEQ ID NO: 2150464 - RNA, 15 nt, Staphylococcus aureus subsp. aureus N315
aaucgcauuuaaaua

SEQ ID NO: 2150465 - RNA, 13 nt, Staphylococcus aureus subsp. aureus N315
aauccugauucca

SEQ ID NO: 2150466 - RNA, 21 nt, Staphylococcus aureus subsp. aureus N315
aauccucuaacgguauaucau

SEQ ID NO: 2150467 - RNA, 23 nt, Staphylococcus aureus subsp. aureus N315
aauccucaguuauaccauauuua

SEQ ID NO: 2150468 - RNA, 21 nt, Staphylococcus aureus subsp. aureus N315
aauccuauggcgcaauuuuua

SEQ ID NO: 2150469 - RNA, 22 nt, Staphylococcus aureus subsp. aureus N315
aauccucacaaauuugaauaua

SEQ ID NO: 2150470 - RNA, 20 nt, Staphylococcus aureus subsp. aureus N315
aauccgauuuugauauaaaa

SEQ ID NO: 2150471 - RNA, 21 nt, Staphylococcus aureus subsp. aureus N315
aauccgauucacucuguaaua

SEQ ID NO: 2150472 - RNA, 19 nt, Staphylococcus aureus subsp. aureus N315
aaucccauaaugacuauaa

SEQ ID NO: 2150473 - RNA, 21 nt, Staphylococcus aureus subsp. aureus N315
aaucccaaguuacaauaucau

SEQ ID NO: 2150474 - RNA, 18 nt, Staphylococcus aureus subsp. aureus N315
aaucccaucgcuuuuucc

SEQ ID NO: 2150475 - RNA, 21 nt, Staphylococcus aureus subsp. aureus N315
aaucuguuuaaauuuaaaaga

SEQ ID NO: 2150476 - RNA, 20 nt, Staphylococcus aureus subsp. aureus N315
aaucuguacuucuaauuugc

SEQ ID NO: 2150477 - RNA, 19 nt, Staphylococcus aureus subsp. aureus N315
aaucuauuuucugccauaa

SEQ ID NO: 2150478 - RNA, 16 nt, Staphylococcus aureus subsp. aureus N315
aaucuauugugauaua

SEQ ID NO: 2150479 - RNA, 13 nt, Staphylococcus aureus subsp. aureus N315
aaucuauuuuaaa

SEQ ID NO: 2150480 - RNA, 16 nt, Staphylococcus aureus subsp. aureus N315
aaucuauuuuaaacuc

SEQ ID NO: 2150481 - RNA, 13 nt, Staphylococcus aureus subsp. aureus N315
aaucuauauaaag

SEQ ID NO: 2150482 - RNA, 21 nt, Staphylococcus aureus subsp. aureus N315
aaucuauauaaaguugacaau

SEQ ID NO: 2150483 - RNA, 14 nt, Staphylococcus aureus subsp. aureus N315
aaucuauaaauauc

SEQ ID NO: 2150484 - RNA, 21 nt, Staphylococcus aureus subsp. aureus N315
aaucuauuaaugcucuauaua

SEQ ID NO: 2150485 - RNA, 13 nt, Staphylococcus aureus subsp. aureus N315
aaucuuacugcuu

SEQ ID NO: 2150486 - RNA, 14 nt, Staphylococcus aureus subsp. aureus N315
aaugaaaaaacgag

SEQ ID NO: 2150487 - RNA, 13 nt, Staphylococcus aureus subsp. aureus N315
aaucuuuuaacuu

SEQ ID NO: 2150488 - RNA, 12 nt, Staphylococcus aureus subsp. aureus N315
aaucuuuuaacu

SEQ ID NO: 2150489 - RNA, 20 nt, Staphylococcus aureus subsp. aureus N315
aaucuuuguuauauuuuuag

SEQ ID NO: 2150490 - RNA, 13 nt, Staphylococcus aureus subsp. aureus N315
aaucuuuguuaua

SEQ ID NO: 2150491 - RNA, 19 nt, Staphylococcus aureus subsp. aureus N315
aaucuuuuagcuuuuguaa

SEQ ID NO: 2150492 - RNA, 19 nt, Staphylococcus aureus subsp. aureus N315
aaugaaaguaccuaaaaua

SEQ ID NO: 2150493 - RNA, 18 nt, Staphylococcus aureus subsp. aureus N315
aaugaaaccguauuauug

SEQ ID NO: 2150494 - RNA, 18 nt, Staphylococcus aureus subsp. aureus N315
aaugaaaauaagcuugua

SEQ ID NO: 2150495 - RNA, 20 nt, Staphylococcus aureus subsp. aureus N315
aaugaaaugaaguauggaag

SEQ ID NO: 2150496 - RNA, 17 nt, Staphylococcus aureus subsp. aureus N315
aaugaaccagcuaacca

SEQ ID NO: 2150497 - RNA, 18 nt, Staphylococcus aureus subsp. aureus N315
aaugaucaucuauauuua

SEQ ID NO: 2150498 - RNA, 18 nt, Staphylococcus aureus subsp. aureus N315
aaugagcuuuucuaaugc

SEQ ID NO: 2150499 - RNA, 16 nt, Staphylococcus aureus subsp. aureus N315
aaugauuuauucuaaa

SEQ ID NO: 2150500 - RNA, 17 nt, Staphylococcus aureus subsp. aureus N315
aaugauggguaguuaau

SEQ ID NO: 2150501 - RNA, 22 nt, Staphylococcus aureus subsp. aureus N315
aaugauugucuuauaagauaua

SEQ ID NO: 2150502 - RNA, 22 nt, Staphylococcus aureus subsp. aureus N315
aaugauuuuuauuauugucauc

SEQ ID NO: 2150503 - RNA, 14 nt, Staphylococcus aureus subsp. aureus N315
aaugauuuugcuuu

SEQ ID NO: 2150504 - RNA, 20 nt, Staphylococcus aureus subsp. aureus N315
aaugcaaaucucgucacaua

SEQ ID NO: 2150505 - RNA, 21 nt, Staphylococcus aureus subsp. aureus N315
aaugacgugcuuuuaaaugua

SEQ ID NO: 2150506 - RNA, 14 nt, Staphylococcus aureus subsp. aureus N315
aaugacgagaauua

SEQ ID NO: 2150507 - RNA, 20 nt, Staphylococcus aureus subsp. aureus N315
aaugagcccguuaaaaagac

SEQ ID NO: 2150508 - RNA, 16 nt, Staphylococcus aureus subsp. aureus N315
aaugaaucaauugcau

SEQ ID NO: 2150509 - RNA, 21 nt, Staphylococcus aureus subsp. aureus N315
aaugaauaauugcuaaaauau

SEQ ID NO: 2150510 - RNA, 22 nt, Staphylococcus aureus subsp. aureus N315
aaugaauaaucaaaguucguaa

SEQ ID NO: 2150511 - RNA, 15 nt, Staphylococcus aureus subsp. aureus N315
aaugaauaauuaaaa

SEQ ID NO: 2150512 - RNA, 16 nt, Staphylococcus aureus subsp. aureus N315
aaugaauaauuaaaaa

SEQ ID NO: 2150513 - RNA, 15 nt, Staphylococcus aureus subsp. aureus N315
aaugaccuggaauau

SEQ ID NO: 2150514 - RNA, 19 nt, Staphylococcus aureus subsp. aureus N315
aaugaauuauuuaaaaugc

SEQ ID NO: 2150515 - RNA, 15 nt, Staphylococcus aureus subsp. aureus N315
aaugccuaauuuugu

SEQ ID NO: 2150516 - RNA, 16 nt, Staphylococcus aureus subsp. aureus N315
aaugccggucauaaca

SEQ ID NO: 2150517 - RNA, 21 nt, Staphylococcus aureus subsp. aureus N315
aaugcauguggacguugaucu

SEQ ID NO: 2150518 - RNA, 19 nt, Staphylococcus aureus subsp. aureus N315
aaugcauagcucuucuuuu

SEQ ID NO: 2150519 - RNA, 19 nt, Staphylococcus aureus subsp. aureus N315
aaugcauccaaauauuaaa

SEQ ID NO: 2150520 - RNA, 20 nt, Staphylococcus aureus subsp. aureus N315
aaugcagcuguauaaccaua

SEQ ID NO: 2150521 - RNA, 16 nt, Staphylococcus aureus subsp. aureus N315
aauggaugaauauauu

SEQ ID NO: 2150522 - RNA, 14 nt, Staphylococcus aureus subsp. aureus N315
aauggaguauauca

SEQ ID NO: 2150523 - RNA, 21 nt, Staphylococcus aureus subsp. aureus N315
aaugguucuauaauaaaucga

SEQ ID NO: 2150524 - RNA, 19 nt, Staphylococcus aureus subsp. aureus N315
aaugguuucauaaacugaa

SEQ ID NO: 2150525 - RNA, 15 nt, Staphylococcus aureus subsp. aureus N315
aaugcuguuuuaugg

SEQ ID NO: 2150526 - RNA, 13 nt, Staphylococcus aureus subsp. aureus N315
aaugcuuauauaa

SEQ ID NO: 2150527 - RNA, 23 nt, Staphylococcus aureus subsp. aureus N315
aauucaucuaaccuuuucaucag

SEQ ID NO: 2150528 - RNA, 20 nt, Staphylococcus aureus subsp. aureus N315
aauucaucuuaucaagaaua

SEQ ID NO: 2150529 - RNA, 15 nt, Staphylococcus aureus subsp. aureus N315
aauucacgagcugcu

SEQ ID NO: 2150530 - RNA, 18 nt, Staphylococcus aureus subsp. aureus N315
aauucccauguauucuua

SEQ ID NO: 2150531 - RNA, 21 nt, Staphylococcus aureus subsp. aureus N315
aauuccccaaagccuucuauc

SEQ ID NO: 2150532 - RNA, 17 nt, Staphylococcus aureus subsp. aureus N315
aauuccaaagaaagcua

SEQ ID NO: 2150533 - RNA, 13 nt, Staphylococcus aureus subsp. aureus N315
aauucuauuuuug

SEQ ID NO: 2150534 - RNA, 14 nt, Staphylococcus aureus subsp. aureus N315
aauucuauuuuuga

SEQ ID NO: 2150535 - RNA, 17 nt, Staphylococcus aureus subsp. aureus N315
aauucuauuuuugauuu

SEQ ID NO: 2150536 - RNA, 19 nt, Staphylococcus aureus subsp. aureus N315
aauucuauuuuugauuuaa

SEQ ID NO: 2150537 - RNA, 20 nt, Staphylococcus aureus subsp. aureus N315
aauucuauuuuugauuuaau

SEQ ID NO: 2150538 - RNA, 20 nt, Staphylococcus aureus subsp. aureus N315
aauucucuuuguuggggccc

SEQ ID NO: 2150539 - RNA, 20 nt, Staphylococcus aureus subsp. aureus N315
aauucucuuuuaaauucuua

SEQ ID NO: 2150540 - RNA, 13 nt, Staphylococcus aureus subsp. aureus N315
aauucucuuaucu

SEQ ID NO: 2150541 - RNA, 19 nt, Staphylococcus aureus subsp. aureus N315
aauucucuuaucuugauuu

SEQ ID NO: 2150542 - RNA, 23 nt, Staphylococcus aureus subsp. aureus N315
aauucucuuaucuugauuuaaac

SEQ ID NO: 2150543 - RNA, 16 nt, Staphylococcus aureus subsp. aureus N315
aauucugauuauguuc

SEQ ID NO: 2150544 - RNA, 20 nt, Staphylococcus aureus subsp. aureus N315
aauucguuuugcuaaccauc

SEQ ID NO: 2150545 - RNA, 22 nt, Staphylococcus aureus subsp. aureus N315
aauucguuuuacuacugucuca

SEQ ID NO: 2150546 - RNA, 16 nt, Staphylococcus aureus subsp. aureus N315
aauucuaaaagaauua

SEQ ID NO: 2150547 - RNA, 22 nt, Staphylococcus aureus subsp. aureus N315
aauucguuuugcuaaccaucau

SEQ ID NO: 2150548 - RNA, 15 nt, Staphylococcus aureus subsp. aureus N315
aauucuacuaaaaau

SEQ ID NO: 2150549 - RNA, 14 nt, Staphylococcus aureus subsp. aureus N315
aauucuaacugcaa

SEQ ID NO: 2150550 - RNA, 17 nt, Staphylococcus aureus subsp. aureus N315
aauucuauaauuuuaau

SEQ ID NO: 2150551 - RNA, 15 nt, Staphylococcus aureus subsp. aureus N315
aauucgccaucuuuu

SEQ ID NO: 2150552 - RNA, 21 nt, Staphylococcus aureus subsp. aureus N315
aauucgccuaaaugguuuuga

SEQ ID NO: 2150553 - RNA, 17 nt, Staphylococcus aureus subsp. aureus N315
aauucgucuguuucaua

SEQ ID NO: 2150554 - RNA, 19 nt, Staphylococcus aureus subsp. aureus N315
aauucgucuguuucauaua

SEQ ID NO: 2150555 - RNA, 21 nt, Staphylococcus aureus subsp. aureus N315
aauuccuggugcaauaauaaa

SEQ ID NO: 2150556 - RNA, 18 nt, Staphylococcus aureus subsp. aureus N315
aauucgacucaaacaaua

SEQ ID NO: 2150557 - RNA, 15 nt, Staphylococcus aureus subsp. aureus N315
aauuauagccuucau

SEQ ID NO: 2150558 - RNA, 17 nt, Staphylococcus aureus subsp. aureus N315
aauuaggucauuuuuau

SEQ ID NO: 2150559 - RNA, 16 nt, Staphylococcus aureus subsp. aureus N315
aauuaggauuaacaua

SEQ ID NO: 2150560 - RNA, 21 nt, Staphylococcus aureus subsp. aureus N315
aauuaggaauccaauuucucu

SEQ ID NO: 2150561 - RNA, 17 nt, Staphylococcus aureus subsp. aureus N315
aauuagaugaaauggaa

SEQ ID NO: 2150562 - RNA, 21 nt, Staphylococcus aureus subsp. aureus N315
aauuagauuuuaugcuuuacu

SEQ ID NO: 2150563 - RNA, 14 nt, Staphylococcus aureus subsp. aureus N315
aauuagauuuaaaa

SEQ ID NO: 2150564 - RNA, 20 nt, Staphylococcus aureus subsp. aureus N315
aauuacaauauaauuuccua

SEQ ID NO: 2150565 - RNA, 21 nt, Staphylococcus aureus subsp. aureus N315
aauuacucuuuuucuuucaua

SEQ ID NO: 2150566 - RNA, 20 nt, Staphylococcus aureus subsp. aureus N315
aauuacuguaaauaugaacu

SEQ ID NO: 2150567 - RNA, 17 nt, Staphylococcus aureus subsp. aureus N315
aauuaacaacaaauaua

SEQ ID NO: 2150568 - RNA, 18 nt, Staphylococcus aureus subsp. aureus N315
aauuaaauuauauguuuu

SEQ ID NO: 2150569 - RNA, 21 nt, Staphylococcus aureus subsp. aureus N315
aauguaagcaacauaugauuu

SEQ ID NO: 2150570 - RNA, 21 nt, Staphylococcus aureus subsp. aureus N315
aauguaacauuaaaaauaaaa

SEQ ID NO: 2150571 - RNA, 21 nt, Staphylococcus aureus subsp. aureus N315
aauguaccgaauccuucauca

SEQ ID NO: 2150572 - RNA, 18 nt, Staphylococcus aureus subsp. aureus N315
aauguacauuguaaauau

SEQ ID NO: 2150573 - RNA, 23 nt, Staphylococcus aureus subsp. aureus N315
aauuaaccuugauuuaauuuuua

SEQ ID NO: 2150574 - RNA, 19 nt, Staphylococcus aureus subsp. aureus N315
aauuaaccuugauuuaauu

SEQ ID NO: 2150575 - RNA, 13 nt, Staphylococcus aureus subsp. aureus N315
aauuaauuaaaau

SEQ ID NO: 2150576 - RNA, 14 nt, Staphylococcus aureus subsp. aureus N315
aauuaauuaaaauu

SEQ ID NO: 2150577 - RNA, 12 nt, Staphylococcus aureus subsp. aureus N315
aauuaauguaau

SEQ ID NO: 2150578 - RNA, 16 nt, Staphylococcus aureus subsp. aureus N315
aauuacaaaaguauga

SEQ ID NO: 2150579 - RNA, 19 nt, Staphylococcus aureus subsp. aureus N315
aauuaauuauuauauaaua

SEQ ID NO: 2150580 - RNA, 19 nt, Staphylococcus aureus subsp. aureus N315
aauuaauuaucauaaagau

SEQ ID NO: 2150581 - RNA, 22 nt, Staphylococcus aureus subsp. aureus N315
aauuaauuacuuucauuguaaa

SEQ ID NO: 2150582 - RNA, 22 nt, Staphylococcus aureus subsp. aureus N315
aauuauuaaagcuaucuucaga

SEQ ID NO: 2150583 - RNA, 18 nt, Staphylococcus aureus subsp. aureus N315
aauuauuaauuuaaucca

SEQ ID NO: 2150584 - RNA, 13 nt, Staphylococcus aureus subsp. aureus N315
aauuauuaauaaa

SEQ ID NO: 2150585 - RNA, 15 nt, Staphylococcus aureus subsp. aureus N315
aauuauuauaauaaa

SEQ ID NO: 2150586 - RNA, 21 nt, Staphylococcus aureus subsp. aureus N315
aauuaucuuuacgauaaacua

SEQ ID NO: 2150587 - RNA, 19 nt, Staphylococcus aureus subsp. aureus N315
aauuauggcagauccauaa

SEQ ID NO: 2150588 - RNA, 19 nt, Staphylococcus aureus subsp. aureus N315
aauuauggagcggaagaua

SEQ ID NO: 2150589 - RNA, 22 nt, Staphylococcus aureus subsp. aureus N315
aauuauggagcggaagauagga

SEQ ID NO: 2150590 - RNA, 20 nt, Staphylococcus aureus subsp. aureus N315
aauuauguauuuuuauuuau

SEQ ID NO: 2150591 - RNA, 19 nt, Staphylococcus aureus subsp. aureus N315
aauuaucauuaaauugcuu

SEQ ID NO: 2150592 - RNA, 20 nt, Staphylococcus aureus subsp. aureus N315
aauuaucagaaucaaguaau

SEQ ID NO: 2150593 - RNA, 15 nt, Staphylococcus aureus subsp. aureus N315
aauuaucauaaagau

SEQ ID NO: 2150594 - RNA, 12 nt, Staphylococcus aureus subsp. aureus N315
aauuauauaccc

SEQ ID NO: 2150595 - RNA, 22 nt, Staphylococcus aureus subsp. aureus N315
aauuauauagaaaacuagaacu

SEQ ID NO: 2150596 - RNA, 13 nt, Staphylococcus aureus subsp. aureus N315
aauuauauuaaug

SEQ ID NO: 2150597 - RNA, 12 nt, Staphylococcus aureus subsp. aureus N315
aauuaucauuac

SEQ ID NO: 2150598 - RNA, 15 nt, Staphylococcus aureus subsp. aureus N315
aauuaucuuaaguca

SEQ ID NO: 2150599 - RNA, 13 nt, Staphylococcus aureus subsp. aureus N315
aauuaucuauaua

SEQ ID NO: 2150600 - RNA, 17 nt, Staphylococcus aureus subsp. aureus N315
aauuaucuauauaugaa

SEQ ID NO: 2150601 - RNA, 20 nt, Staphylococcus aureus subsp. aureus N315
aauuauuucucuuuccacug

SEQ ID NO: 2150602 - RNA, 24 nt, Staphylococcus aureus subsp. aureus N315
aauuauuuauucauuauagucuua

SEQ ID NO: 2150603 - RNA, 23 nt, Staphylococcus aureus subsp. aureus N315
aauuauuucccuggaaaaugauu

SEQ ID NO: 2150604 - RNA, 21 nt, Staphylococcus aureus subsp. aureus N315
aauuauuuuucucaacaguuu

SEQ ID NO: 2150605 - RNA, 17 nt, Staphylococcus aureus subsp. aureus N315
aauuauuuuaaaaaaug

SEQ ID NO: 2150606 - RNA, 20 nt, Staphylococcus aureus subsp. aureus N315
aauuauuuuaaaaaaugaug

SEQ ID NO: 2150607 - RNA, 19 nt, Staphylococcus aureus subsp. aureus N315
aauuauuuauucauuauag

SEQ ID NO: 2150608 - RNA, 19 nt, Staphylococcus aureus subsp. aureus N315
aauuauuuaauuuuucuaa

SEQ ID NO: 2150609 - RNA, 15 nt, Staphylococcus aureus subsp. aureus N315
aauucaauaaucuua

SEQ ID NO: 2150610 - RNA, 14 nt, Staphylococcus aureus subsp. aureus N315
aauucaauauuaau

SEQ ID NO: 2150611 - RNA, 15 nt, Staphylococcus aureus subsp. aureus N315
aauucaaugauuuuu

SEQ ID NO: 2150612 - RNA, 20 nt, Staphylococcus aureus subsp. aureus N315
aauucaaugauuuuuaaaaa

SEQ ID NO: 2150613 - RNA, 19 nt, Staphylococcus aureus subsp. aureus N315
aauucaaccaauuauuaaa

SEQ ID NO: 2150614 - RNA, 12 nt, Staphylococcus aureus subsp. aureus N315
aauuguaaaucu

SEQ ID NO: 2150615 - RNA, 20 nt, Staphylococcus aureus subsp. aureus N315
aauuguaaucuauuuucugc

SEQ ID NO: 2150616 - RNA, 18 nt, Staphylococcus aureus subsp. aureus N315
aauugguuuuuagugaaa

SEQ ID NO: 2150617 - RNA, 15 nt, Staphylococcus aureus subsp. aureus N315
aauuguaaagcauga

SEQ ID NO: 2150618 - RNA, 18 nt, Staphylococcus aureus subsp. aureus N315
aauuguagauccaauucc

SEQ ID NO: 2150619 - RNA, 16 nt, Staphylococcus aureus subsp. aureus N315
aauuguaguaaugaag

SEQ ID NO: 2150620 - RNA, 13 nt, Staphylococcus aureus subsp. aureus N315
aauuguauagaau

SEQ ID NO: 2150621 - RNA, 16 nt, Staphylococcus aureus subsp. aureus N315
aauuguauuuucugcu

SEQ ID NO: 2150622 - RNA, 12 nt, Staphylococcus aureus subsp. aureus N315
aauuguauuuuc

SEQ ID NO: 2150623 - RNA, 22 nt, Staphylococcus aureus subsp. aureus N315
aauugugccauuugcaacaaua

SEQ ID NO: 2150624 - RNA, 20 nt, Staphylococcus aureus subsp. aureus N315
aauugucuagguuagaauua

SEQ ID NO: 2150625 - RNA, 14 nt, Staphylococcus aureus subsp. aureus N315
aauugucucaucau

SEQ ID NO: 2150626 - RNA, 13 nt, Staphylococcus aureus subsp. aureus N315
aauuguucuaaua

SEQ ID NO: 2150627 - RNA, 22 nt, Staphylococcus aureus subsp. aureus N315
aauuguuaguuuucuuaaaaga

SEQ ID NO: 2150628 - RNA, 16 nt, Staphylococcus aureus subsp. aureus N315
aauuguuacuaguucu

SEQ ID NO: 2150629 - RNA, 16 nt, Staphylococcus aureus subsp. aureus N315
aauuguguuucuuuua

SEQ ID NO: 2150630 - RNA, 21 nt, Staphylococcus aureus subsp. aureus N315
aauuguguugaaucaacaguu

SEQ ID NO: 2150631 - RNA, 12 nt, Staphylococcus aureus subsp. aureus N315
aauuguguuucu

SEQ ID NO: 2150632 - RNA, 14 nt, Staphylococcus aureus subsp. aureus N315
aauuguuuacuaua

SEQ ID NO: 2150633 - RNA, 19 nt, Staphylococcus aureus subsp. aureus N315
aauuguuuaauaacaaaau

SEQ ID NO: 2150634 - RNA, 17 nt, Staphylococcus aureus subsp. aureus N315
aauuguuguacauguau

SEQ ID NO: 2150635 - RNA, 18 nt, Staphylococcus aureus subsp. aureus N315
aauuguuguacauguauu

SEQ ID NO: 2150636 - RNA, 16 nt, Staphylococcus aureus subsp. aureus N315
aauuuaaaaagcagua

SEQ ID NO: 2150637 - RNA, 17 nt, Staphylococcus aureus subsp. aureus N315
aauuguuuuuucuuauu

SEQ ID NO: 2150638 - RNA, 16 nt, Staphylococcus aureus subsp. aureus N315
aauuuaaaacaaugau

SEQ ID NO: 2150639 - RNA, 19 nt, Staphylococcus aureus subsp. aureus N315
aauuuaaaacaaugauuaa

SEQ ID NO: 2150640 - RNA, 20 nt, Staphylococcus aureus subsp. aureus N315
aauuuaaaacaaugauuaaa

SEQ ID NO: 2150641 - RNA, 13 nt, Staphylococcus aureus subsp. aureus N315
aauuuaaaauaau

SEQ ID NO: 2150642 - RNA, 21 nt, Staphylococcus aureus subsp. aureus N315
aauuuaaaacaaugauuaaaa

SEQ ID NO: 2150643 - RNA, 14 nt, Staphylococcus aureus subsp. aureus N315
aauuuaaaagaaaa

SEQ ID NO: 2150644 - RNA, 19 nt, Staphylococcus aureus subsp. aureus N315
aauuuaaaugcuuaauuug

SEQ ID NO: 2150645 - RNA, 12 nt, Staphylococcus aureus subsp. aureus N315
aauuuaaaugcu

SEQ ID NO: 2150646 - RNA, 17 nt, Staphylococcus aureus subsp. aureus N315
aauuuaacguguaauga

SEQ ID NO: 2150647 - RNA, 19 nt, Staphylococcus aureus subsp. aureus N315
aauuuaacggaaauacaau

SEQ ID NO: 2150648 - RNA, 17 nt, Staphylococcus aureus subsp. aureus N315
aauuuaacguuuugaug

SEQ ID NO: 2150649 - RNA, 16 nt, Staphylococcus aureus subsp. aureus N315
aauuuaacuaugaaau

SEQ ID NO: 2150650 - RNA, 17 nt, Staphylococcus aureus subsp. aureus N315
aauuuaacuaugaaauu

SEQ ID NO: 2150651 - RNA, 20 nt, Staphylococcus aureus subsp. aureus N315
aauuuaacguuauucauuug

SEQ ID NO: 2150652 - RNA, 12 nt, Staphylococcus aureus subsp. aureus N315
aauuuaaauauu

SEQ ID NO: 2150653 - RNA, 13 nt, Staphylococcus aureus subsp. aureus N315
aauuuaaaugaua

SEQ ID NO: 2150654 - RNA, 13 nt, Staphylococcus aureus subsp. aureus N315
aauuuaaagcauc

SEQ ID NO: 2150655 - RNA, 16 nt, Staphylococcus aureus subsp. aureus N315
aauuuaaaggcauaau

SEQ ID NO: 2150656 - RNA, 23 nt, Staphylococcus aureus subsp. aureus N315
aauuuaaacgcacuauuuuuaua

SEQ ID NO: 2150657 - RNA, 21 nt, Staphylococcus aureus subsp. aureus N315
aauuucacgcugaaauuuuuu

SEQ ID NO: 2150658 - RNA, 19 nt, Staphylococcus aureus subsp. aureus N315
aauuucacgcugaaauuuu

SEQ ID NO: 2150659 - RNA, 21 nt, Staphylococcus aureus subsp. aureus N315
aauuucaacuuauaaaaugaa

SEQ ID NO: 2150660 - RNA, 15 nt, Staphylococcus aureus subsp. aureus N315
aauuucaaugucugc

SEQ ID NO: 2150661 - RNA, 13 nt, Staphylococcus aureus subsp. aureus N315
aauuuauuuugua

SEQ ID NO: 2150662 - RNA, 12 nt, Staphylococcus aureus subsp. aureus N315
aauuucaaaaua

SEQ ID NO: 2150663 - RNA, 19 nt, Staphylococcus aureus subsp. aureus N315
aauuucaaaauaguaaagu

SEQ ID NO: 2150664 - RNA, 15 nt, Staphylococcus aureus subsp. aureus N315
aauuuaucugcaaaa

SEQ ID NO: 2150665 - RNA, 16 nt, Staphylococcus aureus subsp. aureus N315
aauuuauauagucuau

SEQ ID NO: 2150666 - RNA, 22 nt, Staphylococcus aureus subsp. aureus N315
aauuuauuaaaacgaaguuauu

SEQ ID NO: 2150667 - RNA, 22 nt, Staphylococcus aureus subsp. aureus N315
aauuuauuauaaaauagaagua

SEQ ID NO: 2150668 - RNA, 12 nt, Staphylococcus aureus subsp. aureus N315
aauuuauuauua

SEQ ID NO: 2150669 - RNA, 14 nt, Staphylococcus aureus subsp. aureus N315
aauuuaucuuaauc

SEQ ID NO: 2150670 - RNA, 15 nt, Staphylococcus aureus subsp. aureus N315
aauuuacgaaaguag

SEQ ID NO: 2150671 - RNA, 16 nt, Staphylococcus aureus subsp. aureus N315
aauuuaauuaagaaaa

SEQ ID NO: 2150672 - RNA, 19 nt, Staphylococcus aureus subsp. aureus N315
aauuuagcaucaaaaauaa

SEQ ID NO: 2150673 - RNA, 18 nt, Staphylococcus aureus subsp. aureus N315
aauuuaguacucaauguu

SEQ ID NO: 2150674 - RNA, 21 nt, Staphylococcus aureus subsp. aureus N315
aauuuaguauaaauaaaaaua

SEQ ID NO: 2150675 - RNA, 15 nt, Staphylococcus aureus subsp. aureus N315
aauuuagucauuaca

SEQ ID NO: 2150676 - RNA, 18 nt, Staphylococcus aureus subsp. aureus N315
aauuuagugaaacaauuu

SEQ ID NO: 2150677 - RNA, 13 nt, Staphylococcus aureus subsp. aureus N315
aauuuagugaaac

SEQ ID NO: 2150678 - RNA, 16 nt, Staphylococcus aureus subsp. aureus N315
aauugagaaguauuau

SEQ ID NO: 2150679 - RNA, 19 nt, Staphylococcus aureus subsp. aureus N315
aauugacuuuaauugcucu

SEQ ID NO: 2150680 - RNA, 19 nt, Staphylococcus aureus subsp. aureus N315
aauugagaaguauuaugau

SEQ ID NO: 2150681 - RNA, 17 nt, Staphylococcus aureus subsp. aureus N315
aauugacucaaagauau

SEQ ID NO: 2150682 - RNA, 22 nt, Staphylococcus aureus subsp. aureus N315
aauugacucaaagauauacuua

SEQ ID NO: 2150683 - RNA, 19 nt, Staphylococcus aureus subsp. aureus N315
aauugaguauuaaauuugu

SEQ ID NO: 2150684 - RNA, 11 nt, Staphylococcus aureus subsp. aureus N315
aauugaguauu

SEQ ID NO: 2150685 - RNA, 16 nt, Staphylococcus aureus subsp. aureus N315
aauugaguauuaaauu

SEQ ID NO: 2150686 - RNA, 15 nt, Staphylococcus aureus subsp. aureus N315
aauugaaauuaacug

SEQ ID NO: 2150687 - RNA, 22 nt, Staphylococcus aureus subsp. aureus N315
aauugaaggccauuuuuauuua

SEQ ID NO: 2150688 - RNA, 16 nt, Staphylococcus aureus subsp. aureus N315
aauugaagugaaauug

SEQ ID NO: 2150689 - RNA, 14 nt, Staphylococcus aureus subsp. aureus N315
aauugaaugaaaau

SEQ ID NO: 2150690 - RNA, 15 nt, Staphylococcus aureus subsp. aureus N315
aauugaaugaaaaua

SEQ ID NO: 2150691 - RNA, 16 nt, Staphylococcus aureus subsp. aureus N315
aauucuuguuugauuu

SEQ ID NO: 2150692 - RNA, 22 nt, Staphylococcus aureus subsp. aureus N315
aauucuucuuuagauugaucag

SEQ ID NO: 2150693 - RNA, 23 nt, Staphylococcus aureus subsp. aureus N315
aauucuuuuucagcuaauugucg

SEQ ID NO: 2150694 - RNA, 18 nt, Staphylococcus aureus subsp. aureus N315
aauucuuuucaagaaauu

SEQ ID NO: 2150695 - RNA, 23 nt, Staphylococcus aureus subsp. aureus N315
aauucuuaaucgagugauucagg

SEQ ID NO: 2150696 - RNA, 15 nt, Staphylococcus aureus subsp. aureus N315
aauucuuauaaaaua

SEQ ID NO: 2150697 - RNA, 23 nt, Staphylococcus aureus subsp. aureus N315
aauucuucaaauuuaacguguaa

SEQ ID NO: 2150698 - RNA, 16 nt, Staphylococcus aureus subsp. aureus N315
aauucuucaaccauuu

SEQ ID NO: 2150699 - RNA, 21 nt, Staphylococcus aureus subsp. aureus N315
aauucuucaauuucauuuuug

SEQ ID NO: 2150700 - RNA, 21 nt, Staphylococcus aureus subsp. aureus N315
aauucuucaucuucuucaaaa

SEQ ID NO: 2150701 - RNA, 17 nt, Staphylococcus aureus subsp. aureus N315
aauucugugagguaaaa

SEQ ID NO: 2150702 - RNA, 17 nt, Staphylococcus aureus subsp. aureus N315
aauucuggauuaaaccc

SEQ ID NO: 2150703 - RNA, 20 nt, Staphylococcus aureus subsp. aureus N315
aauugcauguaaaauuaaau

SEQ ID NO: 2150704 - RNA, 23 nt, Staphylococcus aureus subsp. aureus N315
aauugcauuacuacaaacuugau

SEQ ID NO: 2150705 - RNA, 18 nt, Staphylococcus aureus subsp. aureus N315
aauugcauuacuacaaac

SEQ ID NO: 2150706 - RNA, 20 nt, Staphylococcus aureus subsp. aureus N315
aauugauucucuguagauau

SEQ ID NO: 2150707 - RNA, 18 nt, Staphylococcus aureus subsp. aureus N315
aauugcaaugaauaacaa

SEQ ID NO: 2150708 - RNA, 19 nt, Staphylococcus aureus subsp. aureus N315
aauugauuucuaauugaaa

SEQ ID NO: 2150709 - RNA, 21 nt, Staphylococcus aureus subsp. aureus N315
aauugauugcucuaagcauuc

SEQ ID NO: 2150710 - RNA, 14 nt, Staphylococcus aureus subsp. aureus N315
aauugauugucaua

SEQ ID NO: 2150711 - RNA, 18 nt, Staphylococcus aureus subsp. aureus N315
aauugauuacaccacuua

SEQ ID NO: 2150712 - RNA, 22 nt, Staphylococcus aureus subsp. aureus N315
aauugauuacaccacuuaggau

SEQ ID NO: 2150713 - RNA, 17 nt, Staphylococcus aureus subsp. aureus N315
aauugcucuuuaacaau

SEQ ID NO: 2150714 - RNA, 20 nt, Staphylococcus aureus subsp. aureus N315
aauugcugacaccuauauuu

SEQ ID NO: 2150715 - RNA, 21 nt, Staphylococcus aureus subsp. aureus N315
aauugcugacaccuauauuuu

SEQ ID NO: 2150716 - RNA, 20 nt, Staphylococcus aureus subsp. aureus N315
aauugcuauauuaguauaau

SEQ ID NO: 2150717 - RNA, 22 nt, Staphylococcus aureus subsp. aureus N315
aauugcuauauuaguauaauuu

SEQ ID NO: 2150718 - RNA, 18 nt, Staphylococcus aureus subsp. aureus N315
aauuggauaauuucuucu

SEQ ID NO: 2150719 - RNA, 20 nt, Staphylococcus aureus subsp. aureus N315
aauuggauguaauagagaag

SEQ ID NO: 2150720 - RNA, 22 nt, Staphylococcus aureus subsp. aureus N315
aauuggauuaucgaauuagauu

SEQ ID NO: 2150721 - RNA, 16 nt, Staphylococcus aureus subsp. aureus N315
aauuggcagauagaau

SEQ ID NO: 2150722 - RNA, 22 nt, Staphylococcus aureus subsp. aureus N315
aauuggaaucaucuuuuugaaa

SEQ ID NO: 2150723 - RNA, 21 nt, Staphylococcus aureus subsp. aureus N315
aauugcuugaaauuauuauuu

SEQ ID NO: 2150724 - RNA, 17 nt, Staphylococcus aureus subsp. aureus N315
aauugcuuguucuuucu

SEQ ID NO: 2150725 - RNA, 17 nt, Staphylococcus aureus subsp. aureus N315
aauugcuuuaaacuuau

SEQ ID NO: 2150726 - RNA, 17 nt, Staphylococcus aureus subsp. aureus N315
aauugcuuuagaaaguc

SEQ ID NO: 2150727 - RNA, 20 nt, Staphylococcus aureus subsp. aureus N315
aagggaucguucuuugauua

SEQ ID NO: 2150728 - RNA, 20 nt, Staphylococcus aureus subsp. aureus N315
aagggaucggucuugaaaac

SEQ ID NO: 2150729 - RNA, 16 nt, Staphylococcus aureus subsp. aureus N315
aagggagcauuucacu

SEQ ID NO: 2150730 - RNA, 21 nt, Staphylococcus aureus subsp. aureus N315
aaggcuagcuaaaauuugcuc

SEQ ID NO: 2150731 - RNA, 20 nt, Staphylococcus aureus subsp. aureus N315
aaggaugaugugaauguuuu

SEQ ID NO: 2150732 - RNA, 15 nt, Staphylococcus aureus subsp. aureus N315
aaguaauauauaaaa

SEQ ID NO: 2150733 - RNA, 17 nt, Staphylococcus aureus subsp. aureus N315
aaguaauggauugauaa

SEQ ID NO: 2150734 - RNA, 22 nt, Staphylococcus aureus subsp. aureus N315
aaguaauccccgaagcacagaa

SEQ ID NO: 2150735 - RNA, 14 nt, Staphylococcus aureus subsp. aureus N315
aaguaaaaguuuug

SEQ ID NO: 2150736 - RNA, 14 nt, Staphylococcus aureus subsp. aureus N315
aaguaaaagcuuuc

SEQ ID NO: 2150737 - RNA, 22 nt, Staphylococcus aureus subsp. aureus N315
aaggguguuuagauagcucuau

SEQ ID NO: 2150738 - RNA, 17 nt, Staphylococcus aureus subsp. aureus N315
aaggucaccuuuaaauu

SEQ ID NO: 2150739 - RNA, 20 nt, Staphylococcus aureus subsp. aureus N315
aaggucaccuuuaaauuuac

SEQ ID NO: 2150740 - RNA, 21 nt, Staphylococcus aureus subsp. aureus N315
aaguacauaaaugcuaaaagu

SEQ ID NO: 2150741 - RNA, 18 nt, Staphylococcus aureus subsp. aureus N315
aaguaccuaaaauagaaa

SEQ ID NO: 2150742 - RNA, 21 nt, Staphylococcus aureus subsp. aureus N315
aaguaccuaaaauagaaaaau

SEQ ID NO: 2150743 - RNA, 13 nt, Staphylococcus aureus subsp. aureus N315
aaguaauuaaaua

SEQ ID NO: 2150744 - RNA, 19 nt, Staphylococcus aureus subsp. aureus N315
aaguaauguuaaacacuca

SEQ ID NO: 2150745 - RNA, 13 nt, Staphylococcus aureus subsp. aureus N315
aaguaauguuaaa

SEQ ID NO: 2150746 - RNA, 13 nt, Staphylococcus aureus subsp. aureus N315
aaguacaaauaau

SEQ ID NO: 2150747 - RNA, 14 nt, Staphylococcus aureus subsp. aureus N315
aaguacaaauaaua

SEQ ID NO: 2150748 - RNA, 17 nt, Staphylococcus aureus subsp. aureus N315
aaguaauuuaauugguu

SEQ ID NO: 2150749 - RNA, 13 nt, Staphylococcus aureus subsp. aureus N315
aaguaauuuaauu

SEQ ID NO: 2150750 - RNA, 16 nt, Staphylococcus aureus subsp. aureus N315
aaguagacauugaaag

SEQ ID NO: 2150751 - RNA, 17 nt, Staphylococcus aureus subsp. aureus N315
aaguacuuacaaauaua

SEQ ID NO: 2150752 - RNA, 17 nt, Staphylococcus aureus subsp. aureus N315
aaguacuucggugcuug

SEQ ID NO: 2150753 - RNA, 14 nt, Staphylococcus aureus subsp. aureus N315
aaguacuuacaaau

SEQ ID NO: 2150754 - RNA, 22 nt, Staphylococcus aureus subsp. aureus N315
aaguacgcaauuuaauauuaua

SEQ ID NO: 2150755 - RNA, 14 nt, Staphylococcus aureus subsp. aureus N315
aaguacgcaauuua

SEQ ID NO: 2150756 - RNA, 21 nt, Staphylococcus aureus subsp. aureus N315
aaguacgacgguauaaaaaaa

SEQ ID NO: 2150757 - RNA, 16 nt, Staphylococcus aureus subsp. aureus N315
aaguauauaauugauu

SEQ ID NO: 2150758 - RNA, 14 nt, Staphylococcus aureus subsp. aureus N315
aaguauaucuuuga

SEQ ID NO: 2150759 - RNA, 15 nt, Staphylococcus aureus subsp. aureus N315
aaguauaauuaaacu

SEQ ID NO: 2150760 - RNA, 18 nt, Staphylococcus aureus subsp. aureus N315
aaguauagcuuuuaucca

SEQ ID NO: 2150761 - RNA, 13 nt, Staphylococcus aureus subsp. aureus N315
aaguaguuucauu

SEQ ID NO: 2150762 - RNA, 13 nt, Staphylococcus aureus subsp. aureus N315
aaguauaaauaua

SEQ ID NO: 2150763 - RNA, 18 nt, Staphylococcus aureus subsp. aureus N315
aaguauaagguugaagaa

SEQ ID NO: 2150764 - RNA, 17 nt, Staphylococcus aureus subsp. aureus N315
aaguauuaugauugcuu

SEQ ID NO: 2150765 - RNA, 23 nt, Staphylococcus aureus subsp. aureus N315
aaguauuaugauugcuuauuuau

SEQ ID NO: 2150766 - RNA, 17 nt, Staphylococcus aureus subsp. aureus N315
aaguauuagauauauuu

SEQ ID NO: 2150767 - RNA, 14 nt, Staphylococcus aureus subsp. aureus N315
aaguauuagauaua

SEQ ID NO: 2150768 - RNA, 16 nt, Staphylococcus aureus subsp. aureus N315
aaguauuaugauugcu

SEQ ID NO: 2150769 - RNA, 16 nt, Staphylococcus aureus subsp. aureus N315
aagucauuaaauguac

SEQ ID NO: 2150770 - RNA, 22 nt, Staphylococcus aureus subsp. aureus N315
aagucauuaaauguacauugua

SEQ ID NO: 2150771 - RNA, 15 nt, Staphylococcus aureus subsp. aureus N315
aagucauuaaaugua

SEQ ID NO: 2150772 - RNA, 20 nt, Staphylococcus aureus subsp. aureus N315
aagucgcucuagacauuaca

SEQ ID NO: 2150773 - RNA, 18 nt, Staphylococcus aureus subsp. aureus N315
aaguuaggcgacuuaacu

SEQ ID NO: 2150774 - RNA, 18 nt, Staphylococcus aureus subsp. aureus N315
aaguuauauaaauuugua

SEQ ID NO: 2150775 - RNA, 18 nt, Staphylococcus aureus subsp. aureus N315
aaguuaucaaauugaccg

SEQ ID NO: 2150776 - RNA, 19 nt, Staphylococcus aureus subsp. aureus N315
aaguucaaccauaugacuu

SEQ ID NO: 2150777 - RNA, 20 nt, Staphylococcus aureus subsp. aureus N315
aagugguuuuacugcuucaa

SEQ ID NO: 2150778 - RNA, 19 nt, Staphylococcus aureus subsp. aureus N315
aaguguagccaaauaaauu

SEQ ID NO: 2150779 - RNA, 17 nt, Staphylococcus aureus subsp. aureus N315
aaguguaguaaaaauca

SEQ ID NO: 2150780 - RNA, 16 nt, Staphylococcus aureus subsp. aureus N315
aagugcgguuuaaucu

SEQ ID NO: 2150781 - RNA, 23 nt, Staphylococcus aureus subsp. aureus N315
aagugacuuaauaucauauucaa

SEQ ID NO: 2150782 - RNA, 13 nt, Staphylococcus aureus subsp. aureus N315
aagugacacugua

SEQ ID NO: 2150783 - RNA, 20 nt, Staphylococcus aureus subsp. aureus N315
aagucugaugucgaaaauag

SEQ ID NO: 2150784 - RNA, 17 nt, Staphylococcus aureus subsp. aureus N315
aagucugaugucgaaaa

SEQ ID NO: 2150785 - RNA, 17 nt, Staphylococcus aureus subsp. aureus N315
aagucucuugucauuuc

SEQ ID NO: 2150786 - RNA, 15 nt, Staphylococcus aureus subsp. aureus N315
aagucucuuuccuca

SEQ ID NO: 2150787 - RNA, 16 nt, Staphylococcus aureus subsp. aureus N315
aagucucuugucauuu

SEQ ID NO: 2150788 - RNA, 16 nt, Staphylococcus aureus subsp. aureus N315
aagucuguugguuuau

SEQ ID NO: 2150789 - RNA, 14 nt, Staphylococcus aureus subsp. aureus N315
aagugauaauuaaa

SEQ ID NO: 2150790 - RNA, 21 nt, Staphylococcus aureus subsp. aureus N315
aagugccuugccaugauuuaa

SEQ ID NO: 2150791 - RNA, 13 nt, Staphylococcus aureus subsp. aureus N315
aagcuuauuaaau

SEQ ID NO: 2150792 - RNA, 17 nt, Staphylococcus aureus subsp. aureus N315
aagcugaugugacaaag

SEQ ID NO: 2150793 - RNA, 19 nt, Staphylococcus aureus subsp. aureus N315
aagcugacgaaaagucagc

SEQ ID NO: 2150794 - RNA, 17 nt, Staphylococcus aureus subsp. aureus N315
aagcugacuuuccacca

SEQ ID NO: 2150795 - RNA, 13 nt, Staphylococcus aureus subsp. aureus N315
aaggaaagcuuca

SEQ ID NO: 2150796 - RNA, 21 nt, Staphylococcus aureus subsp. aureus N315
aagcuuuuuugcuuuuauaau

SEQ ID NO: 2150797 - RNA, 20 nt, Staphylococcus aureus subsp. aureus N315
aagcuucuguguuggggccc

SEQ ID NO: 2150798 - RNA, 11 nt, Staphylococcus aureus subsp. aureus N315
aaggaagaaca

SEQ ID NO: 2150799 - RNA, 17 nt, Staphylococcus aureus subsp. aureus N315
aaggacaggaauaaauu

SEQ ID NO: 2150800 - RNA, 20 nt, Staphylococcus aureus subsp. aureus N315
aagcucauuucaauauuaaa

SEQ ID NO: 2150801 - RNA, 20 nt, Staphylococcus aureus subsp. aureus N315
aagcucaugaaucagaugau

SEQ ID NO: 2150802 - RNA, 22 nt, Staphylococcus aureus subsp. aureus N315
aagcucaugaaucagaugauuu

SEQ ID NO: 2150803 - RNA, 15 nt, Staphylococcus aureus subsp. aureus N315
aagcucaugaaucag

SEQ ID NO: 2150804 - RNA, 20 nt, Staphylococcus aureus subsp. aureus N315
aagcuaaauguuaaugcuuc

SEQ ID NO: 2150805 - RNA, 15 nt, Staphylococcus aureus subsp. aureus N315
aagcuaaauguuaau

SEQ ID NO: 2150806 - RNA, 21 nt, Staphylococcus aureus subsp. aureus N315
aagcguucgugauagaaguuu

SEQ ID NO: 2150807 - RNA, 20 nt, Staphylococcus aureus subsp. aureus N315
aagcguucucuaauuucaca

SEQ ID NO: 2150808 - RNA, 15 nt, Staphylococcus aureus subsp. aureus N315
aagcgcagugaccuc

SEQ ID NO: 2150809 - RNA, 23 nt, Staphylococcus aureus subsp. aureus N315
aagcgcaugcuugaacuuuuauu

SEQ ID NO: 2150810 - RNA, 18 nt, Staphylococcus aureus subsp. aureus N315
aagaaguauguuuuauac

SEQ ID NO: 2150811 - RNA, 13 nt, Staphylococcus aureus subsp. aureus N315
aagccaucaauau

SEQ ID NO: 2150812 - RNA, 20 nt, Staphylococcus aureus subsp. aureus N315
aagcgacgauuggaaaguuu

SEQ ID NO: 2150813 - RNA, 19 nt, Staphylococcus aureus subsp. aureus N315
aagcgauaaaguaugagug

SEQ ID NO: 2150814 - RNA, 20 nt, Staphylococcus aureus subsp. aureus N315
aagccuucaauaguuucaau

SEQ ID NO: 2150815 - RNA, 16 nt, Staphylococcus aureus subsp. aureus N315
aagccuucaauaguuu

SEQ ID NO: 2150816 - RNA, 11 nt, Staphylococcus aureus subsp. aureus N315
aauauacuuuu

SEQ ID NO: 2150817 - RNA, 18 nt, Staphylococcus aureus subsp. aureus N315
aauauagcuauuacuaua

SEQ ID NO: 2150818 - RNA, 16 nt, Staphylococcus aureus subsp. aureus N315
aauauaggcacauucc

SEQ ID NO: 2150819 - RNA, 15 nt, Staphylococcus aureus subsp. aureus N315
aauauacuaaaguuc

SEQ ID NO: 2150820 - RNA, 17 nt, Staphylococcus aureus subsp. aureus N315
aauauacuuaauuuaaa

SEQ ID NO: 2150821 - RNA, 14 nt, Staphylococcus aureus subsp. aureus N315
aauaguucaaaaua

SEQ ID NO: 2150822 - RNA, 13 nt, Staphylococcus aureus subsp. aureus N315
aauauaauagaaa

SEQ ID NO: 2150823 - RNA, 15 nt, Staphylococcus aureus subsp. aureus N315
aauaguuaagauuuu

SEQ ID NO: 2150824 - RNA, 12 nt, Staphylococcus aureus subsp. aureus N315
aauagugugcaa

SEQ ID NO: 2150825 - RNA, 20 nt, Staphylococcus aureus subsp. aureus N315
aauauaauguauaaaacaga

SEQ ID NO: 2150826 - RNA, 23 nt, Staphylococcus aureus subsp. aureus N315
aauauaauuaaacauuuagauuu

SEQ ID NO: 2150827 - RNA, 14 nt, Staphylococcus aureus subsp. aureus N315
aauauaauguauaa

SEQ ID NO: 2150828 - RNA, 13 nt, Staphylococcus aureus subsp. aureus N315
aauauaauauaca

SEQ ID NO: 2150829 - RNA, 18 nt, Staphylococcus aureus subsp. aureus N315
aauauaauagaaauaauc

SEQ ID NO: 2150830 - RNA, 17 nt, Staphylococcus aureus subsp. aureus N315
aauauaauuauuaaacu

SEQ ID NO: 2150831 - RNA, 23 nt, Staphylococcus aureus subsp. aureus N315
aauauacacaaaaagacuuccaa

SEQ ID NO: 2150832 - RNA, 15 nt, Staphylococcus aureus subsp. aureus N315
aauagcgauuuuaaa

SEQ ID NO: 2150833 - RNA, 14 nt, Staphylococcus aureus subsp. aureus N315
aauaggucgcugug

SEQ ID NO: 2150834 - RNA, 21 nt, Staphylococcus aureus subsp. aureus N315
aauaggcgcuuguaaaauuuu

SEQ ID NO: 2150835 - RNA, 17 nt, Staphylococcus aureus subsp. aureus N315
aauaucuuaaagaauua

SEQ ID NO: 2150836 - RNA, 16 nt, Staphylococcus aureus subsp. aureus N315
aauaucugaaaaacca

SEQ ID NO: 2150837 - RNA, 22 nt, Staphylococcus aureus subsp. aureus N315
aauaucuguugcauuaagugca

SEQ ID NO: 2150838 - RNA, 15 nt, Staphylococcus aureus subsp. aureus N315
aauaucugucaaagg

SEQ ID NO: 2150839 - RNA, 12 nt, Staphylococcus aureus subsp. aureus N315
aauauccaaaau

SEQ ID NO: 2150840 - RNA, 20 nt, Staphylococcus aureus subsp. aureus N315
aauaucaucauuuaaauauu

SEQ ID NO: 2150841 - RNA, 22 nt, Staphylococcus aureus subsp. aureus N315
aauaucaucauuuaaauauuuc

SEQ ID NO: 2150842 - RNA, 23 nt, Staphylococcus aureus subsp. aureus N315
aauaucauauucaaaauaacuua

SEQ ID NO: 2150843 - RNA, 15 nt, Staphylococcus aureus subsp. aureus N315
aauaucauauuugaa

SEQ ID NO: 2150844 - RNA, 16 nt, Staphylococcus aureus subsp. aureus N315
aauauaucaucucuau

SEQ ID NO: 2150845 - RNA, 21 nt, Staphylococcus aureus subsp. aureus N315
aauauauccugccaauauauu

SEQ ID NO: 2150846 - RNA, 22 nt, Staphylococcus aureus subsp. aureus N315
aauaucagguacaaauggaaua

SEQ ID NO: 2150847 - RNA, 15 nt, Staphylococcus aureus subsp. aureus N315
aauauaguaauaaaa

SEQ ID NO: 2150848 - RNA, 18 nt, Staphylococcus aureus subsp. aureus N315
aauauaguaauuguuaua

SEQ ID NO: 2150849 - RNA, 13 nt, Staphylococcus aureus subsp. aureus N315
aauaccaauugcu

SEQ ID NO: 2150850 - RNA, 14 nt, Staphylococcus aureus subsp. aureus N315
aauaccaauugcuu

SEQ ID NO: 2150851 - RNA, 16 nt, Staphylococcus aureus subsp. aureus N315
aauaccacuuaaucgu

SEQ ID NO: 2150852 - RNA, 18 nt, Staphylococcus aureus subsp. aureus N315
aauacccuacuauauauc

SEQ ID NO: 2150853 - RNA, 22 nt, Staphylococcus aureus subsp. aureus N315
aauaauuucaguucuuagauuu

SEQ ID NO: 2150854 - RNA, 18 nt, Staphylococcus aureus subsp. aureus N315
aauaauuuuuuuccuuuc

SEQ ID NO: 2150855 - RNA, 21 nt, Staphylococcus aureus subsp. aureus N315
aauacgccaaauaucaguaau

SEQ ID NO: 2150856 - RNA, 17 nt, Staphylococcus aureus subsp. aureus N315
aauaccuccccaacuua

SEQ ID NO: 2150857 - RNA, 18 nt, Staphylococcus aureus subsp. aureus N315
aauaccucuacauuauau

SEQ ID NO: 2150858 - RNA, 16 nt, Staphylococcus aureus subsp. aureus N315
aauacgcuugauaaaa

SEQ ID NO: 2150859 - RNA, 22 nt, Staphylococcus aureus subsp. aureus N315
aauaccuaugauauaugcugca

SEQ ID NO: 2150860 - RNA, 18 nt, Staphylococcus aureus subsp. aureus N315
aauacuuucacuuuuuau

SEQ ID NO: 2150861 - RNA, 15 nt, Staphylococcus aureus subsp. aureus N315
aauacuuuuuaacug

SEQ ID NO: 2150862 - RNA, 14 nt, Staphylococcus aureus subsp. aureus N315
aauacuuuucucga

SEQ ID NO: 2150863 - RNA, 19 nt, Staphylococcus aureus subsp. aureus N315
aauacuuuuuauauaauuc

SEQ ID NO: 2150864 - RNA, 12 nt, Staphylococcus aureus subsp. aureus N315
aauacuuuuuga

SEQ ID NO: 2150865 - RNA, 21 nt, Staphylococcus aureus subsp. aureus N315
aauagaaaaauuucaaaaaua

SEQ ID NO: 2150866 - RNA, 22 nt, Staphylococcus aureus subsp. aureus N315
aauagaaagcgcauuugucauc

SEQ ID NO: 2150867 - RNA, 17 nt, Staphylococcus aureus subsp. aureus N315
aauacuguauuuuaacg

SEQ ID NO: 2150868 - RNA, 16 nt, Staphylococcus aureus subsp. aureus N315
aauacuguauuuuaac

SEQ ID NO: 2150869 - RNA, 20 nt, Staphylococcus aureus subsp. aureus N315
aauacuuucaaacaaaucuu

SEQ ID NO: 2150870 - RNA, 22 nt, Staphylococcus aureus subsp. aureus N315
aauacuuucaaacaaaucuuuu

SEQ ID NO: 2150871 - RNA, 13 nt, Staphylococcus aureus subsp. aureus N315
aauacucuucaau

SEQ ID NO: 2150872 - RNA, 16 nt, Staphylococcus aureus subsp. aureus N315
aauagauugaaaaaau

SEQ ID NO: 2150873 - RNA, 16 nt, Staphylococcus aureus subsp. aureus N315
aauagauaaugcaccu

SEQ ID NO: 2150874 - RNA, 19 nt, Staphylococcus aureus subsp. aureus N315
aauagaugagaaaguaaaa

SEQ ID NO: 2150875 - RNA, 20 nt, Staphylococcus aureus subsp. aureus N315
aauagcauuuguaaacagua

SEQ ID NO: 2150876 - RNA, 19 nt, Staphylococcus aureus subsp. aureus N315
aauagccauucgaugcuaa

SEQ ID NO: 2150877 - RNA, 14 nt, Staphylococcus aureus subsp. aureus N315
aauagccauauuca

SEQ ID NO: 2150878 - RNA, 22 nt, Staphylococcus aureus subsp. aureus N315
aauagcaguuucugagaagaaa

SEQ ID NO: 2150879 - RNA, 22 nt, Staphylococcus aureus subsp. aureus N315
aauagcagggugcuaaauuuac

SEQ ID NO: 2150880 - RNA, 14 nt, Staphylococcus aureus subsp. aureus N315
aauaaccauguaaa

SEQ ID NO: 2150881 - RNA, 16 nt, Staphylococcus aureus subsp. aureus N315
aauaacccauuuucaa

SEQ ID NO: 2150882 - RNA, 20 nt, Staphylococcus aureus subsp. aureus N315
aauaaccauuuuuucaaauu

SEQ ID NO: 2150883 - RNA, 21 nt, Staphylococcus aureus subsp. aureus N315
aauaaccaccaucccauuaaa

SEQ ID NO: 2150884 - RNA, 17 nt, Staphylococcus aureus subsp. aureus N315
aauaacacgauuugguu

SEQ ID NO: 2150885 - RNA, 18 nt, Staphylococcus aureus subsp. aureus N315
aauaacaguuaauuauac

SEQ ID NO: 2150886 - RNA, 15 nt, Staphylococcus aureus subsp. aureus N315
aauaacaucuaaauu

SEQ ID NO: 2150887 - RNA, 17 nt, Staphylococcus aureus subsp. aureus N315
aauaacauguuuguggc

SEQ ID NO: 2150888 - RNA, 18 nt, Staphylococcus aureus subsp. aureus N315
aauaaccgcuuaauucuu

SEQ ID NO: 2150889 - RNA, 23 nt, Staphylococcus aureus subsp. aureus N315
aauaaccuuuaaaacaucauuca

SEQ ID NO: 2150890 - RNA, 17 nt, Staphylococcus aureus subsp. aureus N315
aauaaccuuuaaaacau

SEQ ID NO: 2150891 - RNA, 15 nt, Staphylococcus aureus subsp. aureus N315
aauaacuguucuuuc

SEQ ID NO: 2150892 - RNA, 20 nt, Staphylococcus aureus subsp. aureus N315
aauaacuggcaaaucaaaca

SEQ ID NO: 2150893 - RNA, 22 nt, Staphylococcus aureus subsp. aureus N315
aauaacuucguuuuaauaaauu

SEQ ID NO: 2150894 - RNA, 15 nt, Staphylococcus aureus subsp. aureus N315
aauaacugaguuaaa

SEQ ID NO: 2150895 - RNA, 16 nt, Staphylococcus aureus subsp. aureus N315
aauaacuggcaaauca

SEQ ID NO: 2150896 - RNA, 15 nt, Staphylococcus aureus subsp. aureus N315
aauaacguuaauaua

SEQ ID NO: 2150897 - RNA, 22 nt, Staphylococcus aureus subsp. aureus N315
aauaacaccaauugaauauuuu

SEQ ID NO: 2150898 - RNA, 18 nt, Staphylococcus aureus subsp. aureus N315
aauaacaccuuucauuug

SEQ ID NO: 2150899 - RNA, 16 nt, Staphylococcus aureus subsp. aureus N315
aauaacaccaauugaa

SEQ ID NO: 2150900 - RNA, 19 nt, Staphylococcus aureus subsp. aureus N315
aauaaauuguaugaauaau

SEQ ID NO: 2150901 - RNA, 15 nt, Staphylococcus aureus subsp. aureus N315
aauaaauuuuauaua

SEQ ID NO: 2150902 - RNA, 13 nt, Staphylococcus aureus subsp. aureus N315
aauaaauuuuaua

SEQ ID NO: 2150903 - RNA, 13 nt, Staphylococcus aureus subsp. aureus N315
aauaaauguuaaa

SEQ ID NO: 2150904 - RNA, 14 nt, Staphylococcus aureus subsp. aureus N315
aauaaauguuaaag

SEQ ID NO: 2150905 - RNA, 13 nt, Staphylococcus aureus subsp. aureus N315
aauaaauuaaauu

SEQ ID NO: 2150906 - RNA, 14 nt, Staphylococcus aureus subsp. aureus N315
aauaaauuaaauuu

SEQ ID NO: 2150907 - RNA, 18 nt, Staphylococcus aureus subsp. aureus N315
aauaaauugacucaaaga

SEQ ID NO: 2150908 - RNA, 13 nt, Staphylococcus aureus subsp. aureus N315
aauaaaucuuucc

SEQ ID NO: 2150909 - RNA, 17 nt, Staphylococcus aureus subsp. aureus N315
aauaaaugacauuuaau

SEQ ID NO: 2150910 - RNA, 12 nt, Staphylococcus aureus subsp. aureus N315
aauaaaucucca

SEQ ID NO: 2150911 - RNA, 20 nt, Staphylococcus aureus subsp. aureus N315
aauaaaucaguaguuuuaaa

SEQ ID NO: 2150912 - RNA, 21 nt, Staphylococcus aureus subsp. aureus N315
aauaaaugacuucacauuuau

SEQ ID NO: 2150913 - RNA, 19 nt, Staphylococcus aureus subsp. aureus N315
aauaaaugacauuuaauac

SEQ ID NO: 2150914 - RNA, 20 nt, Staphylococcus aureus subsp. aureus N315
aauaaaugcuauauuuagaa

SEQ ID NO: 2150915 - RNA, 21 nt, Staphylococcus aureus subsp. aureus N315
aauaaaucauuaguuguauca

SEQ ID NO: 2150916 - RNA, 16 nt, Staphylococcus aureus subsp. aureus N315
aaguugcugaauaaaa

SEQ ID NO: 2150917 - RNA, 19 nt, Staphylococcus aureus subsp. aureus N315
aauaaauaagcaaucauaa

SEQ ID NO: 2150918 - RNA, 16 nt, Staphylococcus aureus subsp. aureus N315
aauaaauacaauguua

SEQ ID NO: 2150919 - RNA, 23 nt, Staphylococcus aureus subsp. aureus N315
aaguucaucguuaucuuuaagua

SEQ ID NO: 2150920 - RNA, 15 nt, Staphylococcus aureus subsp. aureus N315
aaguugcauauaaaa

SEQ ID NO: 2150921 - RNA, 16 nt, Staphylococcus aureus subsp. aureus N315
aaguugcauauaaaaa

SEQ ID NO: 2150922 - RNA, 15 nt, Staphylococcus aureus subsp. aureus N315
aaguugacaauacaa

SEQ ID NO: 2150923 - RNA, 16 nt, Staphylococcus aureus subsp. aureus N315
aauaauaucaccuuuu

SEQ ID NO: 2150924 - RNA, 12 nt, Staphylococcus aureus subsp. aureus N315
aauaauauauuu

SEQ ID NO: 2150925 - RNA, 13 nt, Staphylococcus aureus subsp. aureus N315
aauaauaugaauu

SEQ ID NO: 2150926 - RNA, 16 nt, Staphylococcus aureus subsp. aureus N315
aauaaucauccauaua

SEQ ID NO: 2150927 - RNA, 20 nt, Staphylococcus aureus subsp. aureus N315
aauaauaaaccuaaagauau

SEQ ID NO: 2150928 - RNA, 14 nt, Staphylococcus aureus subsp. aureus N315
aauaauaaucuuua

SEQ ID NO: 2150929 - RNA, 18 nt, Staphylococcus aureus subsp. aureus N315
aauaauagcaguuucuga

SEQ ID NO: 2150930 - RNA, 19 nt, Staphylococcus aureus subsp. aureus N315
aauaauauaaaaacaaaag

SEQ ID NO: 2150931 - RNA, 16 nt, Staphylococcus aureus subsp. aureus N315
aauaauauaaaacgau

SEQ ID NO: 2150932 - RNA, 20 nt, Staphylococcus aureus subsp. aureus N315
aauaauauaaauaaaagcca

SEQ ID NO: 2150933 - RNA, 17 nt, Staphylococcus aureus subsp. aureus N315
aauaagcguaaaaucau

SEQ ID NO: 2150934 - RNA, 15 nt, Staphylococcus aureus subsp. aureus N315
aauaagcgcaauuaa

SEQ ID NO: 2150935 - RNA, 13 nt, Staphylococcus aureus subsp. aureus N315
aauaagcauuaau

SEQ ID NO: 2150936 - RNA, 11 nt, Staphylococcus aureus subsp. aureus N315
aauaaguaugg

SEQ ID NO: 2150937 - RNA, 13 nt, Staphylococcus aureus subsp. aureus N315
aauaaguugucau

SEQ ID NO: 2150938 - RNA, 19 nt, Staphylococcus aureus subsp. aureus N315
aauaaguugucaucuaauu

SEQ ID NO: 2150939 - RNA, 15 nt, Staphylococcus aureus subsp. aureus N315
aauaagugguuguuc

SEQ ID NO: 2150940 - RNA, 19 nt, Staphylococcus aureus subsp. aureus N315
aauaagugguuguucccau

SEQ ID NO: 2150941 - RNA, 20 nt, Staphylococcus aureus subsp. aureus N315
aauaagugguuguucccauu

SEQ ID NO: 2150942 - RNA, 13 nt, Staphylococcus aureus subsp. aureus N315
aauaaguuaccuu

SEQ ID NO: 2150943 - RNA, 20 nt, Staphylococcus aureus subsp. aureus N315
aauaaugaugcauaagauuu

SEQ ID NO: 2150944 - RNA, 19 nt, Staphylococcus aureus subsp. aureus N315
aauaaugacgagaauuaaa

SEQ ID NO: 2150945 - RNA, 18 nt, Staphylococcus aureus subsp. aureus N315
aauaauccgagucauacu

SEQ ID NO: 2150946 - RNA, 15 nt, Staphylococcus aureus subsp. aureus N315
aauaaucgaacagaa

SEQ ID NO: 2150947 - RNA, 16 nt, Staphylococcus aureus subsp. aureus N315
aauaaucggacugaug

SEQ ID NO: 2150948 - RNA, 19 nt, Staphylococcus aureus subsp. aureus N315
aauaaucggacugauggaa

SEQ ID NO: 2150949 - RNA, 21 nt, Staphylococcus aureus subsp. aureus N315
aauaaucguaaacacuauaaa

SEQ ID NO: 2150950 - RNA, 21 nt, Staphylococcus aureus subsp. aureus N315
aauaaucgguaauuacuugua

SEQ ID NO: 2150951 - RNA, 17 nt, Staphylococcus aureus subsp. aureus N315
aauaauuagauuuaaaa

SEQ ID NO: 2150952 - RNA, 18 nt, Staphylococcus aureus subsp. aureus N315
aauaauucccuaggaaau

SEQ ID NO: 2150953 - RNA, 17 nt, Staphylococcus aureus subsp. aureus N315
aauaauuggcugaugaa

SEQ ID NO: 2150954 - RNA, 19 nt, Staphylococcus aureus subsp. aureus N315
aauaauugcuuuagaaagu

SEQ ID NO: 2150955 - RNA, 17 nt, Staphylococcus aureus subsp. aureus N315
aauaauuggaaucaucu

SEQ ID NO: 2150956 - RNA, 14 nt, Staphylococcus aureus subsp. aureus N315
aauaauugaugaaa

SEQ ID NO: 2150957 - RNA, 16 nt, Staphylococcus aureus subsp. aureus N315
aauaauugcauguaaa

SEQ ID NO: 2150958 - RNA, 17 nt, Staphylococcus aureus subsp. aureus N315
aauaauugcauguaaaa

SEQ ID NO: 2150959 - RNA, 22 nt, Staphylococcus aureus subsp. aureus N315
aauaauugcauguaaaauuaaa

SEQ ID NO: 2150960 - RNA, 23 nt, Staphylococcus aureus subsp. aureus N315
aauaauugcauguaaaauuaaau

SEQ ID NO: 2150961 - RNA, 16 nt, Staphylococcus aureus subsp. aureus N315
aauaauugcuaaaaua

SEQ ID NO: 2150962 - RNA, 13 nt, Staphylococcus aureus subsp. aureus N315
aauaauugcuaaa

SEQ ID NO: 2150963 - RNA, 17 nt, Staphylococcus aureus subsp. aureus N315
aauaauguuuccauuua

SEQ ID NO: 2150964 - RNA, 18 nt, Staphylococcus aureus subsp. aureus N315
aauaaugugaaaaaucuu

SEQ ID NO: 2150965 - RNA, 23 nt, Staphylococcus aureus subsp. aureus N315
aauaaugggaauuguauuagcaa

SEQ ID NO: 2150966 - RNA, 23 nt, Staphylococcus aureus subsp. aureus N315
aauaauguuuccugauauuucaa

SEQ ID NO: 2150967 - RNA, 12 nt, Staphylococcus aureus subsp. aureus N315
aauaauuaaaua

SEQ ID NO: 2150968 - RNA, 16 nt, Staphylococcus aureus subsp. aureus N315
aauaauuaaauaaaaa

SEQ ID NO: 2150969 - RNA, 17 nt, Staphylococcus aureus subsp. aureus N315
aauaauuaaauaaaaau

SEQ ID NO: 2150970 - RNA, 12 nt, Staphylococcus aureus subsp. aureus N315
aauaauuaaaaa

SEQ ID NO: 2150971 - RNA, 15 nt, Staphylococcus aureus subsp. aureus N315
aauaauuacuaaccu

SEQ ID NO: 2150972 - RNA, 19 nt, Staphylococcus aureus subsp. aureus N315
uuggugaguguuucauaau

SEQ ID NO: 2150973 - RNA, 16 nt, Staphylococcus aureus subsp. aureus N315
uuggucaaguuuuggu

SEQ ID NO: 2150974 - RNA, 19 nt, Staphylococcus aureus subsp. aureus N315
uuggucaccuacagauaaa

SEQ ID NO: 2150975 - RNA, 18 nt, Staphylococcus aureus subsp. aureus N315
uuggucauagaaauuuua

SEQ ID NO: 2150976 - RNA, 15 nt, Staphylococcus aureus subsp. aureus N315
uugguugaacuguuu

SEQ ID NO: 2150977 - RNA, 21 nt, Staphylococcus aureus subsp. aureus N315
uugguuaauacguuuaauaau

SEQ ID NO: 2150978 - RNA, 12 nt, Staphylococcus aureus subsp. aureus N315
uugguuaaaguu

SEQ ID NO: 2150979 - RNA, 20 nt, Staphylococcus aureus subsp. aureus N315
uugguauacaguuuuacuau

SEQ ID NO: 2150980 - RNA, 13 nt, Staphylococcus aureus subsp. aureus N315
uugguauugguaa

SEQ ID NO: 2150981 - RNA, 18 nt, Staphylococcus aureus subsp. aureus N315
uugguagcauuuuagauu

SEQ ID NO: 2150982 - RNA, 20 nt, Staphylococcus aureus subsp. aureus N315
uugguaaaaaucucaaaauu

SEQ ID NO: 2150983 - RNA, 20 nt, Staphylococcus aureus subsp. aureus N315
uugguaagcuaauuucuaau

SEQ ID NO: 2150984 - RNA, 20 nt, Staphylococcus aureus subsp. aureus N315
uuggggccccgacuauuuuu

SEQ ID NO: 2150985 - RNA, 23 nt, Staphylococcus aureus subsp. aureus N315
uuggggaugggccccaacaaaga

SEQ ID NO: 2150986 - RNA, 17 nt, Staphylococcus aureus subsp. aureus N315
uuggggaugggccccaa

SEQ ID NO: 2150987 - RNA, 20 nt, Staphylococcus aureus subsp. aureus N315
uugggcugauaauaaaaguu

SEQ ID NO: 2150988 - RNA, 17 nt, Staphylococcus aureus subsp. aureus N315
uugggcgcuuuuuaauu

SEQ ID NO: 2150989 - RNA, 18 nt, Staphylococcus aureus subsp. aureus N315
uuggggugagggccccaa

SEQ ID NO: 2150990 - RNA, 13 nt, Staphylococcus aureus subsp. aureus N315
uuggccauuggau

SEQ ID NO: 2150991 - RNA, 15 nt, Staphylococcus aureus subsp. aureus N315
uugggaauugaccac

SEQ ID NO: 2150992 - RNA, 20 nt, Staphylococcus aureus subsp. aureus N315
uugcuagucauaauuuaaaa

SEQ ID NO: 2150993 - RNA, 16 nt, Staphylococcus aureus subsp. aureus N315
uugcuauauuaguaua

SEQ ID NO: 2150994 - RNA, 19 nt, Staphylococcus aureus subsp. aureus N315
uugcuaucaaacuuggcaa

SEQ ID NO: 2150995 - RNA, 21 nt, Staphylococcus aureus subsp. aureus N315
uugcuaaccaucauaaauguu

SEQ ID NO: 2150996 - RNA, 16 nt, Staphylococcus aureus subsp. aureus N315
uugcgguuggcucuuu

SEQ ID NO: 2150997 - RNA, 19 nt, Staphylococcus aureus subsp. aureus N315
uugcuuauuuuuguauucu

SEQ ID NO: 2150998 - RNA, 14 nt, Staphylococcus aureus subsp. aureus N315
uugcuuauguuuuu

SEQ ID NO: 2150999 - RNA, 17 nt, Staphylococcus aureus subsp. aureus N315
uugcuuaacuuccuuuu

SEQ ID NO: 2151000 - RNA, 13 nt, Staphylococcus aureus subsp. aureus N315
uugcuuaacuucc

SEQ ID NO: 2151001 - RNA, 13 nt, Staphylococcus aureus subsp. aureus N315
uugcuuuaauuug

SEQ ID NO: 2151002 - RNA, 14 nt, Staphylococcus aureus subsp. aureus N315
uugcuuuaauuuga

SEQ ID NO: 2151003 - RNA, 15 nt, Staphylococcus aureus subsp. aureus N315
uugcuuuagcucuuu

SEQ ID NO: 2151004 - RNA, 17 nt, Staphylococcus aureus subsp. aureus N315
uugcuuggauaauugca

SEQ ID NO: 2151005 - RNA, 17 nt, Staphylococcus aureus subsp. aureus N315
uuggauagguaacuaaa

SEQ ID NO: 2151006 - RNA, 23 nt, Staphylococcus aureus subsp. aureus N315
uuggaugaacaaaauaacauguu

SEQ ID NO: 2151007 - RNA, 19 nt, Staphylococcus aureus subsp. aureus N315
uuggauguaauagagaagg

SEQ ID NO: 2151008 - RNA, 15 nt, Staphylococcus aureus subsp. aureus N315
uuggauuuuaacaag

SEQ ID NO: 2151009 - RNA, 17 nt, Staphylococcus aureus subsp. aureus N315
uuggauuuuaacaagau

SEQ ID NO: 2151010 - RNA, 17 nt, Staphylococcus aureus subsp. aureus N315
uuggcacauaaaucaau

SEQ ID NO: 2151011 - RNA, 15 nt, Staphylococcus aureus subsp. aureus N315
uuggcacauaaauca

SEQ ID NO: 2151012 - RNA, 23 nt, Staphylococcus aureus subsp. aureus N315
uuggcaauuguuuaucuccuaaa

SEQ ID NO: 2151013 - RNA, 18 nt, Staphylococcus aureus subsp. aureus N315
uuggcagugaucuuuuuu

SEQ ID NO: 2151014 - RNA, 13 nt, Staphylococcus aureus subsp. aureus N315
uuggaauacucuu

SEQ ID NO: 2151015 - RNA, 16 nt, Staphylococcus aureus subsp. aureus N315
uuggaaucccaaugcu

SEQ ID NO: 2151016 - RNA, 14 nt, Staphylococcus aureus subsp. aureus N315
uuggauaaaaugau

SEQ ID NO: 2151017 - RNA, 14 nt, Staphylococcus aureus subsp. aureus N315
uuggaaaaauaaau

SEQ ID NO: 2151018 - RNA, 14 nt, Staphylococcus aureus subsp. aureus N315
uugcuuuuuacuau

SEQ ID NO: 2151019 - RNA, 21 nt, Staphylococcus aureus subsp. aureus N315
uugcuuuuucaaauaauauaa

SEQ ID NO: 2151020 - RNA, 18 nt, Staphylococcus aureus subsp. aureus N315
uuggaaauuuauuauaaa

SEQ ID NO: 2151021 - RNA, 12 nt, Staphylococcus aureus subsp. aureus N315
uuggaagucugc

SEQ ID NO: 2151022 - RNA, 12 nt, Staphylococcus aureus subsp. aureus N315
uuggaaguuuuc

SEQ ID NO: 2151023 - RNA, 16 nt, Staphylococcus aureus subsp. aureus N315
uuggaagcaauuaugg

SEQ ID NO: 2151024 - RNA, 20 nt, Staphylococcus aureus subsp. aureus N315
uugccaucaauuucuguaau

SEQ ID NO: 2151025 - RNA, 22 nt, Staphylococcus aureus subsp. aureus N315
uugccauacccauauuaaauuu

SEQ ID NO: 2151026 - RNA, 14 nt, Staphylococcus aureus subsp. aureus N315
uugccuuucauuuu

SEQ ID NO: 2151027 - RNA, 16 nt, Staphylococcus aureus subsp. aureus N315
uugccuuuugaauaau

SEQ ID NO: 2151028 - RNA, 21 nt, Staphylococcus aureus subsp. aureus N315
uugcgauauacgaauccucau

SEQ ID NO: 2151029 - RNA, 22 nt, Staphylococcus aureus subsp. aureus N315
uugcgauuucuucugcuaacuc

SEQ ID NO: 2151030 - RNA, 19 nt, Staphylococcus aureus subsp. aureus N315
uugcauacguaaaugguaa

SEQ ID NO: 2151031 - RNA, 13 nt, Staphylococcus aureus subsp. aureus N315
uugcauauaaaaa

SEQ ID NO: 2151032 - RNA, 19 nt, Staphylococcus aureus subsp. aureus N315
uugcaugacagcaaauuuu

SEQ ID NO: 2151033 - RNA, 13 nt, Staphylococcus aureus subsp. aureus N315
uugcauguaaaau

SEQ ID NO: 2151034 - RNA, 16 nt, Staphylococcus aureus subsp. aureus N315
uugaucuuugacaugu

SEQ ID NO: 2151035 - RNA, 15 nt, Staphylococcus aureus subsp. aureus N315
uugauagcuaaugca

SEQ ID NO: 2151036 - RNA, 20 nt, Staphylococcus aureus subsp. aureus N315
uugauagcaccguaacauau

SEQ ID NO: 2151037 - RNA, 13 nt, Staphylococcus aureus subsp. aureus N315
uugauauaaaaag

SEQ ID NO: 2151038 - RNA, 22 nt, Staphylococcus aureus subsp. aureus N315
uugauagugguagccaauauca

SEQ ID NO: 2151039 - RNA, 20 nt, Staphylococcus aureus subsp. aureus N315
uugauaguuguaucauuaau

SEQ ID NO: 2151040 - RNA, 18 nt, Staphylococcus aureus subsp. aureus N315
uugauuuagcauacauua

SEQ ID NO: 2151041 - RNA, 22 nt, Staphylococcus aureus subsp. aureus N315
uugauuaucauuguucauacgc

SEQ ID NO: 2151042 - RNA, 16 nt, Staphylococcus aureus subsp. aureus N315
uugauuuaacaaccuc

SEQ ID NO: 2151043 - RNA, 12 nt, Staphylococcus aureus subsp. aureus N315
uugauuauguaa

SEQ ID NO: 2151044 - RNA, 17 nt, Staphylococcus aureus subsp. aureus N315
uugauuagcauaccuuu

SEQ ID NO: 2151045 - RNA, 19 nt, Staphylococcus aureus subsp. aureus N315
uugauuaacacaauccuuu

SEQ ID NO: 2151046 - RNA, 18 nt, Staphylococcus aureus subsp. aureus N315
uugauguucuugaaaaca

SEQ ID NO: 2151047 - RNA, 14 nt, Staphylococcus aureus subsp. aureus N315
uugauuaaaagugu

SEQ ID NO: 2151048 - RNA, 15 nt, Staphylococcus aureus subsp. aureus N315
uugauguaauucugu

SEQ ID NO: 2151049 - RNA, 23 nt, Staphylococcus aureus subsp. aureus N315
uugaugguuaaugacuaugcaaa

SEQ ID NO: 2151050 - RNA, 20 nt, Staphylococcus aureus subsp. aureus N315
uugauguguugcauuacuau

SEQ ID NO: 2151051 - RNA, 16 nt, Staphylococcus aureus subsp. aureus N315
uugaugucaauuucac

SEQ ID NO: 2151052 - RNA, 23 nt, Staphylococcus aureus subsp. aureus N315
uugauaaugcuacuauuaaauaa

SEQ ID NO: 2151053 - RNA, 22 nt, Staphylococcus aureus subsp. aureus N315
uugauaaguucuagauuauuua

SEQ ID NO: 2151054 - RNA, 13 nt, Staphylococcus aureus subsp. aureus N315
uugaguuauauuu

SEQ ID NO: 2151055 - RNA, 15 nt, Staphylococcus aureus subsp. aureus N315
uugaguauuaaauuu

SEQ ID NO: 2151056 - RNA, 22 nt, Staphylococcus aureus subsp. aureus N315
uugaguaucaugcuuuuaauau

SEQ ID NO: 2151057 - RNA, 21 nt, Staphylococcus aureus subsp. aureus N315
uugaguacuaaucaauacuaa

SEQ ID NO: 2151058 - RNA, 16 nt, Staphylococcus aureus subsp. aureus N315
uugagguguggaguaa

SEQ ID NO: 2151059 - RNA, 23 nt, Staphylococcus aureus subsp. aureus N315
uugaggaccacggucuugauauu

SEQ ID NO: 2151060 - RNA, 16 nt, Staphylococcus aureus subsp. aureus N315
uucuuguucuaaaaua

SEQ ID NO: 2151061 - RNA, 21 nt, Staphylococcus aureus subsp. aureus N315
uucuuguuuagggaaucccau

SEQ ID NO: 2151062 - RNA, 22 nt, Staphylococcus aureus subsp. aureus N315
uuuauaacauacguuauuuuuu

SEQ ID NO: 2151063 - RNA, 22 nt, Staphylococcus aureus subsp. aureus N315
uuuauaagaacaugauacugaa

SEQ ID NO: 2151064 - RNA, 20 nt, Staphylococcus aureus subsp. aureus N315
uuuauaugauuaauuagccu

SEQ ID NO: 2151065 - RNA, 16 nt, Staphylococcus aureus subsp. aureus N315
uuuauauuaaauacua

SEQ ID NO: 2151066 - RNA, 22 nt, Staphylococcus aureus subsp. aureus N315
uuuauaucuuaaguacauaaau

SEQ ID NO: 2151067 - RNA, 18 nt, Staphylococcus aureus subsp. aureus N315
uuuauacauguacauuau

SEQ ID NO: 2151068 - RNA, 14 nt, Staphylococcus aureus subsp. aureus N315
uuuauaauuuuuga

SEQ ID NO: 2151069 - RNA, 13 nt, Staphylococcus aureus subsp. aureus N315
uuuauacaauacu

SEQ ID NO: 2151070 - RNA, 13 nt, Staphylococcus aureus subsp. aureus N315
uuuagccaaugcu

SEQ ID NO: 2151071 - RNA, 17 nt, Staphylococcus aureus subsp. aureus N315
uuuagauucuuuucuga

SEQ ID NO: 2151072 - RNA, 14 nt, Staphylococcus aureus subsp. aureus N315
uuuagauuuaguuu

SEQ ID NO: 2151073 - RNA, 19 nt, Staphylococcus aureus subsp. aureus N315
uuuagauuucaugauguua

SEQ ID NO: 2151074 - RNA, 17 nt, Staphylococcus aureus subsp. aureus N315
uuuagacauuaaaaaau

SEQ ID NO: 2151075 - RNA, 15 nt, Staphylococcus aureus subsp. aureus N315
uuuagauaaaaauua

SEQ ID NO: 2151076 - RNA, 13 nt, Staphylococcus aureus subsp. aureus N315
uuuaucacuguau

SEQ ID NO: 2151077 - RNA, 17 nt, Staphylococcus aureus subsp. aureus N315
uuuaucaacaaauuuaa

SEQ ID NO: 2151078 - RNA, 12 nt, Staphylococcus aureus subsp. aureus N315
uuuaucaauaaa

SEQ ID NO: 2151079 - RNA, 15 nt, Staphylococcus aureus subsp. aureus N315
uuuaucaacauaaaa

SEQ ID NO: 2151080 - RNA, 19 nt, Staphylococcus aureus subsp. aureus N315
uuuaucaacauaaaauuua

SEQ ID NO: 2151081 - RNA, 16 nt, Staphylococcus aureus subsp. aureus N315
uuuauauuauuucaau

SEQ ID NO: 2151082 - RNA, 13 nt, Staphylococcus aureus subsp. aureus N315
uuuauauucuaau

SEQ ID NO: 2151083 - RNA, 18 nt, Staphylococcus aureus subsp. aureus N315
uuuauauuuaaacucucu

SEQ ID NO: 2151084 - RNA, 16 nt, Staphylococcus aureus subsp. aureus N315
uuuauauuuauuuuau

SEQ ID NO: 2151085 - RNA, 17 nt, Staphylococcus aureus subsp. aureus N315
uuuauauuuuuaucauc

SEQ ID NO: 2151086 - RNA, 12 nt, Staphylococcus aureus subsp. aureus N315
uuuauauuuuau

SEQ ID NO: 2151087 - RNA, 15 nt, Staphylococcus aureus subsp. aureus N315
uuuauauuuuuauca

SEQ ID NO: 2151088 - RNA, 13 nt, Staphylococcus aureus subsp. aureus N315
uuuauauuuuuau

SEQ ID NO: 2151089 - RNA, 19 nt, Staphylococcus aureus subsp. aureus N315
uuuaucaugaugauaaauu

SEQ ID NO: 2151090 - RNA, 22 nt, Staphylococcus aureus subsp. aureus N315
uuuaucaucaugacuauuucgc

SEQ ID NO: 2151091 - RNA, 12 nt, Staphylococcus aureus subsp. aureus N315
uuuauccaaacc

SEQ ID NO: 2151092 - RNA, 19 nt, Staphylococcus aureus subsp. aureus N315
uuuauccaaaccaauuuua

SEQ ID NO: 2151093 - RNA, 20 nt, Staphylococcus aureus subsp. aureus N315
uuuauccaaaccaauuuuaa

SEQ ID NO: 2151094 - RNA, 20 nt, Staphylococcus aureus subsp. aureus N315
uuuaugaauugaguauuaaa

SEQ ID NO: 2151095 - RNA, 17 nt, Staphylococcus aureus subsp. aureus N315
uuuaugaagugaaauca

SEQ ID NO: 2151096 - RNA, 12 nt, Staphylococcus aureus subsp. aureus N315
uuuaugauuguu

SEQ ID NO: 2151097 - RNA, 18 nt, Staphylococcus aureus subsp. aureus N315
uuuaucgaucgguauuuu

SEQ ID NO: 2151098 - RNA, 15 nt, Staphylococcus aureus subsp. aureus N315
uuuaucuaguuguuu

SEQ ID NO: 2151099 - RNA, 16 nt, Staphylococcus aureus subsp. aureus N315
uuuaucuauaugcaua

SEQ ID NO: 2151100 - RNA, 17 nt, Staphylococcus aureus subsp. aureus N315
uuuaucugaaaauauca

SEQ ID NO: 2151101 - RNA, 19 nt, Staphylococcus aureus subsp. aureus N315
uuuaucuguaacaaagucu

SEQ ID NO: 2151102 - RNA, 21 nt, Staphylococcus aureus subsp. aureus N315
uuuauuaauggcaacuaagau

SEQ ID NO: 2151103 - RNA, 17 nt, Staphylococcus aureus subsp. aureus N315
uuuauuaauauuaguga

SEQ ID NO: 2151104 - RNA, 13 nt, Staphylococcus aureus subsp. aureus N315
uuuauuaaauaua

SEQ ID NO: 2151105 - RNA, 15 nt, Staphylococcus aureus subsp. aureus N315
uuuauguaacuacua

SEQ ID NO: 2151106 - RNA, 14 nt, Staphylococcus aureus subsp. aureus N315
uuuauguauuuauu

SEQ ID NO: 2151107 - RNA, 17 nt, Staphylococcus aureus subsp. aureus N315
uuuauguuuuaauuucu

SEQ ID NO: 2151108 - RNA, 21 nt, Staphylococcus aureus subsp. aureus N315
uuuauggucuugaguacuaau

SEQ ID NO: 2151109 - RNA, 23 nt, Staphylococcus aureus subsp. aureus N315
uuuaugguguagcugaggauuuu

SEQ ID NO: 2151110 - RNA, 13 nt, Staphylococcus aureus subsp. aureus N315
uuuaugguguggu

SEQ ID NO: 2151111 - RNA, 21 nt, Staphylococcus aureus subsp. aureus N315
uuuaugguguggugugaugua

SEQ ID NO: 2151112 - RNA, 13 nt, Staphylococcus aureus subsp. aureus N315
uuuauuuaacacu

SEQ ID NO: 2151113 - RNA, 20 nt, Staphylococcus aureus subsp. aureus N315
uuuauuuaacacuucaguua

SEQ ID NO: 2151114 - RNA, 22 nt, Staphylococcus aureus subsp. aureus N315
uuuauuuuuggauucaccaauu

SEQ ID NO: 2151115 - RNA, 14 nt, Staphylococcus aureus subsp. aureus N315
uuuauuuaauuauu

SEQ ID NO: 2151116 - RNA, 19 nt, Staphylococcus aureus subsp. aureus N315
uuuauugaggauaauuauu

SEQ ID NO: 2151117 - RNA, 15 nt, Staphylococcus aureus subsp. aureus N315
uuuauugcaauaaca

SEQ ID NO: 2151118 - RNA, 18 nt, Staphylococcus aureus subsp. aureus N315
uuuacaccuauaccucau

SEQ ID NO: 2151119 - RNA, 18 nt, Staphylococcus aureus subsp. aureus N315
uuuacaccuauaccucgu

SEQ ID NO: 2151120 - RNA, 22 nt, Staphylococcus aureus subsp. aureus N315
uuuaaugggcgugccauuaaaa

SEQ ID NO: 2151121 - RNA, 12 nt, Staphylococcus aureus subsp. aureus N315
uuuaauguguaa

SEQ ID NO: 2151122 - RNA, 16 nt, Staphylococcus aureus subsp. aureus N315
uuuaaugucuaaaaau

SEQ ID NO: 2151123 - RNA, 20 nt, Staphylococcus aureus subsp. aureus N315
uuuaauguauaaauuaguuu

SEQ ID NO: 2151124 - RNA, 21 nt, Staphylococcus aureus subsp. aureus N315
uuuacauccaacuaaauguag

SEQ ID NO: 2151125 - RNA, 23 nt, Staphylococcus aureus subsp. aureus N315
uuuacauggcuuagguuuaauuu

SEQ ID NO: 2151126 - RNA, 20 nt, Staphylococcus aureus subsp. aureus N315
uuuaccuguuucuuuacuuc

SEQ ID NO: 2151127 - RNA, 14 nt, Staphylococcus aureus subsp. aureus N315
uuuacauucguuua

SEQ ID NO: 2151128 - RNA, 15 nt, Staphylococcus aureus subsp. aureus N315
uuuacauuucucguu

SEQ ID NO: 2151129 - RNA, 16 nt, Staphylococcus aureus subsp. aureus N315
uuuacguucugauuca

SEQ ID NO: 2151130 - RNA, 14 nt, Staphylococcus aureus subsp. aureus N315
uuuacguucugauu

SEQ ID NO: 2151131 - RNA, 13 nt, Staphylococcus aureus subsp. aureus N315
uuuacuucauaag

SEQ ID NO: 2151132 - RNA, 12 nt, Staphylococcus aureus subsp. aureus N315
uuuacuuaaucu

SEQ ID NO: 2151133 - RNA, 22 nt, Staphylococcus aureus subsp. aureus N315
uuuacuaggaauauaaaacugu

SEQ ID NO: 2151134 - RNA, 21 nt, Staphylococcus aureus subsp. aureus N315
uuuacuugcuuuuucaaauaa

SEQ ID NO: 2151135 - RNA, 18 nt, Staphylococcus aureus subsp. aureus N315
uuuagaaaaggauuauag

SEQ ID NO: 2151136 - RNA, 22 nt, Staphylococcus aureus subsp. aureus N315
uuuagaaucaaccguuuuauug

SEQ ID NO: 2151137 - RNA, 18 nt, Staphylococcus aureus subsp. aureus N315
uuuaaucuuauucgcacc

SEQ ID NO: 2151138 - RNA, 19 nt, Staphylococcus aureus subsp. aureus N315
uuuaaucguaacauaucag

SEQ ID NO: 2151139 - RNA, 13 nt, Staphylococcus aureus subsp. aureus N315
uuuaaucuauccu

SEQ ID NO: 2151140 - RNA, 23 nt, Staphylococcus aureus subsp. aureus N315
uuuaaucacaucuuuuugauaau

SEQ ID NO: 2151141 - RNA, 13 nt, Staphylococcus aureus subsp. aureus N315
uuuaaucaaaaaa

SEQ ID NO: 2151142 - RNA, 19 nt, Staphylococcus aureus subsp. aureus N315
uuuaauauuugauaacaaa

SEQ ID NO: 2151143 - RNA, 16 nt, Staphylococcus aureus subsp. aureus N315
uuuaauccuucuccaa

SEQ ID NO: 2151144 - RNA, 21 nt, Staphylococcus aureus subsp. aureus N315
uuuaauacuauaguaagaaaa

SEQ ID NO: 2151145 - RNA, 21 nt, Staphylococcus aureus subsp. aureus N315
uuuaauauugaaaugagcuua

SEQ ID NO: 2151146 - RNA, 21 nt, Staphylococcus aureus subsp. aureus N315
uuuaauaaccuuuaaaacauc

SEQ ID NO: 2151147 - RNA, 18 nt, Staphylococcus aureus subsp. aureus N315
uuuaauaauuaaauauaa

SEQ ID NO: 2151148 - RNA, 17 nt, Staphylococcus aureus subsp. aureus N315
uuuaauaccuaugauau

SEQ ID NO: 2151149 - RNA, 22 nt, Staphylococcus aureus subsp. aureus N315
uuuaaaacaaugauuaaaauua

SEQ ID NO: 2151150 - RNA, 22 nt, Staphylococcus aureus subsp. aureus N315
uuuaaaacaucauucacaaguu

SEQ ID NO: 2151151 - RNA, 21 nt, Staphylococcus aureus subsp. aureus N315
uuuaaaaaugcuguuuuaugg

SEQ ID NO: 2151152 - RNA, 12 nt, Staphylococcus aureus subsp. aureus N315
uuuaaaaaugcu

SEQ ID NO: 2151153 - RNA, 13 nt, Staphylococcus aureus subsp. aureus N315
uuuaaaagagaau

SEQ ID NO: 2151154 - RNA, 18 nt, Staphylococcus aureus subsp. aureus N315
uuuaagauagguuuauuu

SEQ ID NO: 2151155 - RNA, 14 nt, Staphylococcus aureus subsp. aureus N315
uuuaagaucaauau

SEQ ID NO: 2151156 - RNA, 15 nt, Staphylococcus aureus subsp. aureus N315
uuuaagaucaauauc

SEQ ID NO: 2151157 - RNA, 14 nt, Staphylococcus aureus subsp. aureus N315
uuuaagaauguaca

SEQ ID NO: 2151158 - RNA, 17 nt, Staphylococcus aureus subsp. aureus N315
uuuaauaaaccagugcg

SEQ ID NO: 2151159 - RNA, 18 nt, Staphylococcus aureus subsp. aureus N315
uuuaauaaaaaccaauau

SEQ ID NO: 2151160 - RNA, 19 nt, Staphylococcus aureus subsp. aureus N315
uuuaaguuaucaaauugac

SEQ ID NO: 2151161 - RNA, 12 nt, Staphylococcus aureus subsp. aureus N315
uuuaagcugcuc

SEQ ID NO: 2151162 - RNA, 13 nt, Staphylococcus aureus subsp. aureus N315
uuuaagcugcucg

SEQ ID NO: 2151163 - RNA, 23 nt, Staphylococcus aureus subsp. aureus N315
uuuaagcugcucgauauaugucu

SEQ ID NO: 2151164 - RNA, 18 nt, Staphylococcus aureus subsp. aureus N315
uugucaucauguucuaau

SEQ ID NO: 2151165 - RNA, 11 nt, Staphylococcus aureus subsp. aureus N315
uugucaugccu

SEQ ID NO: 2151166 - RNA, 14 nt, Staphylococcus aureus subsp. aureus N315
uuguccguuuauag

SEQ ID NO: 2151167 - RNA, 20 nt, Staphylococcus aureus subsp. aureus N315
uuguccuaacgcuaauuuua

SEQ ID NO: 2151168 - RNA, 16 nt, Staphylococcus aureus subsp. aureus N315
uuguaucaacauuaau

SEQ ID NO: 2151169 - RNA, 18 nt, Staphylococcus aureus subsp. aureus N315
uuguauagaauguguaug

SEQ ID NO: 2151170 - RNA, 20 nt, Staphylococcus aureus subsp. aureus N315
uuguauagauuguauuuaau

SEQ ID NO: 2151171 - RNA, 22 nt, Staphylococcus aureus subsp. aureus N315
uuguauagauuguauuuaauaa

SEQ ID NO: 2151172 - RNA, 15 nt, Staphylococcus aureus subsp. aureus N315
uuguauuuaaaauca

SEQ ID NO: 2151173 - RNA, 17 nt, Staphylococcus aureus subsp. aureus N315
uuguauuuuauuuauuu

SEQ ID NO: 2151174 - RNA, 15 nt, Staphylococcus aureus subsp. aureus N315
uuguauuuuucaaau

SEQ ID NO: 2151175 - RNA, 16 nt, Staphylococcus aureus subsp. aureus N315
uugucacgaucaaauu

SEQ ID NO: 2151176 - RNA, 19 nt, Staphylococcus aureus subsp. aureus N315
uugucacgaucaaauuuaa

SEQ ID NO: 2151177 - RNA, 19 nt, Staphylococcus aureus subsp. aureus N315
uugucacuuggauucaaau

SEQ ID NO: 2151178 - RNA, 20 nt, Staphylococcus aureus subsp. aureus N315
uugucaguuuuuuuauaagc

SEQ ID NO: 2151179 - RNA, 19 nt, Staphylococcus aureus subsp. aureus N315
uuguacacauccucauaau

SEQ ID NO: 2151180 - RNA, 19 nt, Staphylococcus aureus subsp. aureus N315
uuguacaucauuaaauauu

SEQ ID NO: 2151181 - RNA, 16 nt, Staphylococcus aureus subsp. aureus N315
uuguacuucuuugguc

SEQ ID NO: 2151182 - RNA, 11 nt, Staphylococcus aureus subsp. aureus N315
uuguacuucuu

SEQ ID NO: 2151183 - RNA, 21 nt, Staphylococcus aureus subsp. aureus N315
uuguacgcuucaauuauuuca

SEQ ID NO: 2151184 - RNA, 19 nt, Staphylococcus aureus subsp. aureus N315
uuguauaaagauuuaaguc

SEQ ID NO: 2151185 - RNA, 23 nt, Staphylococcus aureus subsp. aureus N315
uuguagggaguauuguuuuauau

SEQ ID NO: 2151186 - RNA, 21 nt, Staphylococcus aureus subsp. aureus N315
uuguacaaaaaauuguaaguc

SEQ ID NO: 2151187 - RNA, 15 nt, Staphylococcus aureus subsp. aureus N315
uuguaauuuaaaaua

SEQ ID NO: 2151188 - RNA, 21 nt, Staphylococcus aureus subsp. aureus N315
uuguaauuagugcaaguaauu

SEQ ID NO: 2151189 - RNA, 15 nt, Staphylococcus aureus subsp. aureus N315
uuguaacuauugaaa

SEQ ID NO: 2151190 - RNA, 17 nt, Staphylococcus aureus subsp. aureus N315
uugguuuagacaaccag

SEQ ID NO: 2151191 - RNA, 17 nt, Staphylococcus aureus subsp. aureus N315
uugguuucuuaacauaa

SEQ ID NO: 2151192 - RNA, 18 nt, Staphylococcus aureus subsp. aureus N315
uugguuuggauaaaauga

SEQ ID NO: 2151193 - RNA, 12 nt, Staphylococcus aureus subsp. aureus N315
uuguaaauuuaa

SEQ ID NO: 2151194 - RNA, 20 nt, Staphylococcus aureus subsp. aureus N315
uuguaacaagcauuuuucaa

SEQ ID NO: 2151195 - RNA, 12 nt, Staphylococcus aureus subsp. aureus N315
uuguucggcuuu

SEQ ID NO: 2151196 - RNA, 14 nt, Staphylococcus aureus subsp. aureus N315
uuguugcaaugauu

SEQ ID NO: 2151197 - RNA, 16 nt, Staphylococcus aureus subsp. aureus N315
uuguuugauuuauuau

SEQ ID NO: 2151198 - RNA, 16 nt, Staphylococcus aureus subsp. aureus N315
uuguugauaguaaucu

SEQ ID NO: 2151199 - RNA, 22 nt, Staphylococcus aureus subsp. aureus N315
uuguugaauaauuaauguuucu

SEQ ID NO: 2151200 - RNA, 23 nt, Staphylococcus aureus subsp. aureus N315
uuguuuuccaauaauaaaccuaa

SEQ ID NO: 2151201 - RNA, 22 nt, Staphylococcus aureus subsp. aureus N315
uuguuuucaucaugcauaauca

SEQ ID NO: 2151202 - RNA, 12 nt, Staphylococcus aureus subsp. aureus N315
uuguuugcuucu

SEQ ID NO: 2151203 - RNA, 20 nt, Staphylococcus aureus subsp. aureus N315
uuguuuugaauguuucuccu

SEQ ID NO: 2151204 - RNA, 19 nt, Staphylococcus aureus subsp. aureus N315
uuguuuugacaaauccuaa

SEQ ID NO: 2151205 - RNA, 21 nt, Staphylococcus aureus subsp. aureus N315
uuuaaaaaguaauuaauuccu

SEQ ID NO: 2151206 - RNA, 13 nt, Staphylococcus aureus subsp. aureus N315
uuuaaaaaguuaa

SEQ ID NO: 2151207 - RNA, 15 nt, Staphylococcus aureus subsp. aureus N315
uuuaaaaaucaaaga

SEQ ID NO: 2151208 - RNA, 21 nt, Staphylococcus aureus subsp. aureus N315
uuuaaaaauagccuucaaaau

SEQ ID NO: 2151209 - RNA, 22 nt, Staphylococcus aureus subsp. aureus N315
uuuaaaaauaaaaaaccaauaa

SEQ ID NO: 2151210 - RNA, 20 nt, Staphylococcus aureus subsp. aureus N315
uuguguuuuuaauguuugcu

SEQ ID NO: 2151211 - RNA, 13 nt, Staphylococcus aureus subsp. aureus N315
uuguguugaauca

SEQ ID NO: 2151212 - RNA, 20 nt, Staphylococcus aureus subsp. aureus N315
uuguucaauucagcaaugag

SEQ ID NO: 2151213 - RNA, 19 nt, Staphylococcus aureus subsp. aureus N315
uugugguaaucauguaaug

SEQ ID NO: 2151214 - RNA, 24 nt, Staphylococcus aureus subsp. aureus N315
uuguguauuuuuauuguuuuggcu

SEQ ID NO: 2151215 - RNA, 13 nt, Staphylococcus aureus subsp. aureus N315
uuguguuauguau

SEQ ID NO: 2151216 - RNA, 21 nt, Staphylococcus aureus subsp. aureus N315
uugucggacgauauauacaaa

SEQ ID NO: 2151217 - RNA, 13 nt, Staphylococcus aureus subsp. aureus N315
uugucuguauuau

SEQ ID NO: 2151218 - RNA, 16 nt, Staphylococcus aureus subsp. aureus N315
uugucuuaauaugcaa

SEQ ID NO: 2151219 - RNA, 15 nt, Staphylococcus aureus subsp. aureus N315
uugugaauaauuuca

SEQ ID NO: 2151220 - RNA, 21 nt, Staphylococcus aureus subsp. aureus N315
uugugacgcugguaauauuuu

SEQ ID NO: 2151221 - RNA, 14 nt, Staphylococcus aureus subsp. aureus N315
uugugcuuuuccau

SEQ ID NO: 2151222 - RNA, 13 nt, Staphylococcus aureus subsp. aureus N315
uugugauuuuuug

SEQ ID NO: 2151223 - RNA, 23 nt, Staphylococcus aureus subsp. aureus N315
uugugaugauaauuaaugccauu

SEQ ID NO: 2151224 - RNA, 18 nt, Staphylococcus aureus subsp. aureus N315
uugugauaauucuucaac

SEQ ID NO: 2151225 - RNA, 15 nt, Staphylococcus aureus subsp. aureus N315
uugugaguucauaau

SEQ ID NO: 2151226 - RNA, 14 nt, Staphylococcus aureus subsp. aureus N315
uugugccaacaaag

SEQ ID NO: 2151227 - RNA, 18 nt, Staphylococcus aureus subsp. aureus N315
uucuacuuaguaauaaga

SEQ ID NO: 2151228 - RNA, 21 nt, Staphylococcus aureus subsp. aureus N315
uucuagcaucgauguuaucga

SEQ ID NO: 2151229 - RNA, 22 nt, Staphylococcus aureus subsp. aureus N315
uucuagcaacugaucauuuuca

SEQ ID NO: 2151230 - RNA, 18 nt, Staphylococcus aureus subsp. aureus N315
uucuaaaaaauuaaaaau

SEQ ID NO: 2151231 - RNA, 18 nt, Staphylococcus aureus subsp. aureus N315
uucuaaacaacuucugaa

SEQ ID NO: 2151232 - RNA, 14 nt, Staphylococcus aureus subsp. aureus N315
uucuaaaauaaaac

SEQ ID NO: 2151233 - RNA, 12 nt, Staphylococcus aureus subsp. aureus N315
uucuaaaaguug

SEQ ID NO: 2151234 - RNA, 22 nt, Staphylococcus aureus subsp. aureus N315
uucuaaaagaauuauucaagua

SEQ ID NO: 2151235 - RNA, 23 nt, Staphylococcus aureus subsp. aureus N315
uucucaacaaaucuauaaauauc

SEQ ID NO: 2151236 - RNA, 13 nt, Staphylococcus aureus subsp. aureus N315
uucucauuauaau

SEQ ID NO: 2151237 - RNA, 18 nt, Staphylococcus aureus subsp. aureus N315
uucuauuuuauaauaaau

SEQ ID NO: 2151238 - RNA, 14 nt, Staphylococcus aureus subsp. aureus N315
uucuauuuuauaau

SEQ ID NO: 2151239 - RNA, 17 nt, Staphylococcus aureus subsp. aureus N315
uucuauuuucauagaug

SEQ ID NO: 2151240 - RNA, 15 nt, Staphylococcus aureus subsp. aureus N315
uucuauuuuucaauu

SEQ ID NO: 2151241 - RNA, 20 nt, Staphylococcus aureus subsp. aureus N315
uucuauuuuugauuuaauaa

SEQ ID NO: 2151242 - RNA, 21 nt, Staphylococcus aureus subsp. aureus N315
uucuauuuuugauuuaauaau

SEQ ID NO: 2151243 - RNA, 17 nt, Staphylococcus aureus subsp. aureus N315
uucuauauaguaaaaua

SEQ ID NO: 2151244 - RNA, 13 nt, Staphylococcus aureus subsp. aureus N315
uucuaucaaauaa

SEQ ID NO: 2151245 - RNA, 16 nt, Staphylococcus aureus subsp. aureus N315
uucuaucaaauaauga

SEQ ID NO: 2151246 - RNA, 20 nt, Staphylococcus aureus subsp. aureus N315
uucugcgugcuuaauuacaa

SEQ ID NO: 2151247 - RNA, 23 nt, Staphylococcus aureus subsp. aureus N315
uucugaaaugauacauuauuaaa

SEQ ID NO: 2151248 - RNA, 15 nt, Staphylococcus aureus subsp. aureus N315
uucucccuuaaauac

SEQ ID NO: 2151249 - RNA, 16 nt, Staphylococcus aureus subsp. aureus N315
uucuucuaauucugaa

SEQ ID NO: 2151250 - RNA, 22 nt, Staphylococcus aureus subsp. aureus N315
uucuuccaacacccauauaauu

SEQ ID NO: 2151251 - RNA, 15 nt, Staphylococcus aureus subsp. aureus N315
uucuucaucuuuuau

SEQ ID NO: 2151252 - RNA, 17 nt, Staphylococcus aureus subsp. aureus N315
uucuucaguuaaaucuu

SEQ ID NO: 2151253 - RNA, 15 nt, Staphylococcus aureus subsp. aureus N315
uucuucauaguucaa

SEQ ID NO: 2151254 - RNA, 17 nt, Staphylococcus aureus subsp. aureus N315
uucuucagguguuuuac

SEQ ID NO: 2151255 - RNA, 12 nt, Staphylococcus aureus subsp. aureus N315
uucuucaucaug

SEQ ID NO: 2151256 - RNA, 13 nt, Staphylococcus aureus subsp. aureus N315
uucuucaauuguc

SEQ ID NO: 2151257 - RNA, 17 nt, Staphylococcus aureus subsp. aureus N315
uucuucacuaaaaauau

SEQ ID NO: 2151258 - RNA, 18 nt, Staphylococcus aureus subsp. aureus N315
uucuucacugcuguuuuu

SEQ ID NO: 2151259 - RNA, 21 nt, Staphylococcus aureus subsp. aureus N315
uucuucaacaauuucaauguc

SEQ ID NO: 2151260 - RNA, 23 nt, Staphylococcus aureus subsp. aureus N315
uucuucaacaauuucaaugucug

SEQ ID NO: 2151261 - RNA, 22 nt, Staphylococcus aureus subsp. aureus N315
uucuucaaaaaauaauagcaaa

SEQ ID NO: 2151262 - RNA, 12 nt, Staphylococcus aureus subsp. aureus N315
uucuuauuugaa

SEQ ID NO: 2151263 - RNA, 19 nt, Staphylococcus aureus subsp. aureus N315
uucuuauuugauucuauuu

SEQ ID NO: 2151264 - RNA, 18 nt, Staphylococcus aureus subsp. aureus N315
uucuuauuuauucauaac

SEQ ID NO: 2151265 - RNA, 22 nt, Staphylococcus aureus subsp. aureus N315
uucuuagauuuuauauaaaaag

SEQ ID NO: 2151266 - RNA, 22 nt, Staphylococcus aureus subsp. aureus N315
uucuuagauuuucacuaauauu

SEQ ID NO: 2151267 - RNA, 14 nt, Staphylococcus aureus subsp. aureus N315
uucuuauaaaauaa

SEQ ID NO: 2151268 - RNA, 12 nt, Staphylococcus aureus subsp. aureus N315
uucuuauaaaaa

SEQ ID NO: 2151269 - RNA, 13 nt, Staphylococcus aureus subsp. aureus N315
uucuuaucaguuu

SEQ ID NO: 2151270 - RNA, 13 nt, Staphylococcus aureus subsp. aureus N315
uucuuaauuauca

SEQ ID NO: 2151271 - RNA, 18 nt, Staphylococcus aureus subsp. aureus N315
uucuuaacauaaaaugag

SEQ ID NO: 2151272 - RNA, 16 nt, Staphylococcus aureus subsp. aureus N315
uucuuaacauaaaaug

SEQ ID NO: 2151273 - RNA, 14 nt, Staphylococcus aureus subsp. aureus N315
uucuguaauaauua

SEQ ID NO: 2151274 - RNA, 19 nt, Staphylococcus aureus subsp. aureus N315
uucuguacguuuuaaauaa

SEQ ID NO: 2151275 - RNA, 11 nt, Staphylococcus aureus subsp. aureus N315
uucuuaaaaag

SEQ ID NO: 2151276 - RNA, 17 nt, Staphylococcus aureus subsp. aureus N315
uucuuaaaaagcagcag

SEQ ID NO: 2151277 - RNA, 16 nt, Staphylococcus aureus subsp. aureus N315
uucggaugagaaaugu

SEQ ID NO: 2151278 - RNA, 15 nt, Staphylococcus aureus subsp. aureus N315
uucggcuuuccuaau

SEQ ID NO: 2151279 - RNA, 17 nt, Staphylococcus aureus subsp. aureus N315
uucguuguucauaauca

SEQ ID NO: 2151280 - RNA, 23 nt, Staphylococcus aureus subsp. aureus N315
uucguccaacauguaacaaaaua

SEQ ID NO: 2151281 - RNA, 19 nt, Staphylococcus aureus subsp. aureus N315
uucgauaccuaaaauaccc

SEQ ID NO: 2151282 - RNA, 12 nt, Staphylococcus aureus subsp. aureus N315
uucgauggcugc

SEQ ID NO: 2151283 - RNA, 15 nt, Staphylococcus aureus subsp. aureus N315
uucgauuauucuuaa

SEQ ID NO: 2151284 - RNA, 13 nt, Staphylococcus aureus subsp. aureus N315
uucgauucauaaa

SEQ ID NO: 2151285 - RNA, 19 nt, Staphylococcus aureus subsp. aureus N315
uucgauuauuuagauaaaa

SEQ ID NO: 2151286 - RNA, 18 nt, Staphylococcus aureus subsp. aureus N315
uucgacuguauacgacgu

SEQ ID NO: 2151287 - RNA, 16 nt, Staphylococcus aureus subsp. aureus N315
uucgauuuagaagaac

SEQ ID NO: 2151288 - RNA, 23 nt, Staphylococcus aureus subsp. aureus N315
uucgauucauuuaaaaaucaaag

SEQ ID NO: 2151289 - RNA, 17 nt, Staphylococcus aureus subsp. aureus N315
uuccaaucaacuucaua

SEQ ID NO: 2151290 - RNA, 16 nt, Staphylococcus aureus subsp. aureus N315
uuccaaguuaaugcac

SEQ ID NO: 2151291 - RNA, 17 nt, Staphylococcus aureus subsp. aureus N315
uuccaaguauuuucucu

SEQ ID NO: 2151292 - RNA, 16 nt, Staphylococcus aureus subsp. aureus N315
uuccaauaauaaauca

SEQ ID NO: 2151293 - RNA, 18 nt, Staphylococcus aureus subsp. aureus N315
uuccaaucaacuucauau

SEQ ID NO: 2151294 - RNA, 15 nt, Staphylococcus aureus subsp. aureus N315
uucccuaugaaauaa

SEQ ID NO: 2151295 - RNA, 12 nt, Staphylococcus aureus subsp. aureus N315
uucccuacugcu

SEQ ID NO: 2151296 - RNA, 17 nt, Staphylococcus aureus subsp. aureus N315
uucgaacuaucaauaua

SEQ ID NO: 2151297 - RNA, 17 nt, Staphylococcus aureus subsp. aureus N315
uucgaacgcuugaaaaa

SEQ ID NO: 2151298 - RNA, 16 nt, Staphylococcus aureus subsp. aureus N315
uucgaacgcuugaaaa

SEQ ID NO: 2151299 - RNA, 23 nt, Staphylococcus aureus subsp. aureus N315
uucgaacgauauuuuaaaaagua

SEQ ID NO: 2151300 - RNA, 18 nt, Staphylococcus aureus subsp. aureus N315
uuccguugaauuaacaau

SEQ ID NO: 2151301 - RNA, 18 nt, Staphylococcus aureus subsp. aureus N315
uuccuaaaccucuaaaua

SEQ ID NO: 2151302 - RNA, 15 nt, Staphylococcus aureus subsp. aureus N315
uuccugauacaauga

SEQ ID NO: 2151303 - RNA, 17 nt, Staphylococcus aureus subsp. aureus N315
uucauuuaguuaaauac

SEQ ID NO: 2151304 - RNA, 23 nt, Staphylococcus aureus subsp. aureus N315
uucauucguacuuccaauacugu

SEQ ID NO: 2151305 - RNA, 17 nt, Staphylococcus aureus subsp. aureus N315
uucauucguacuuccaa

SEQ ID NO: 2151306 - RNA, 14 nt, Staphylococcus aureus subsp. aureus N315
uucauugaaaauaa

SEQ ID NO: 2151307 - RNA, 21 nt, Staphylococcus aureus subsp. aureus N315
uucauuauauaauucuucaaa

SEQ ID NO: 2151308 - RNA, 14 nt, Staphylococcus aureus subsp. aureus N315
uucauuaucauuaa

SEQ ID NO: 2151309 - RNA, 16 nt, Staphylococcus aureus subsp. aureus N315
uucauuauauaauucu

SEQ ID NO: 2151310 - RNA, 18 nt, Staphylococcus aureus subsp. aureus N315
uuccaaagaaagcuaaua

SEQ ID NO: 2151311 - RNA, 18 nt, Staphylococcus aureus subsp. aureus N315
uuccaaauugaaauuauc

SEQ ID NO: 2151312 - RNA, 14 nt, Staphylococcus aureus subsp. aureus N315
uuccaaauguucag

SEQ ID NO: 2151313 - RNA, 23 nt, Staphylococcus aureus subsp. aureus N315
uuccaaauguucagguucaaaau

SEQ ID NO: 2151314 - RNA, 18 nt, Staphylococcus aureus subsp. aureus N315
uuccaaauugcaaaguaa

SEQ ID NO: 2151315 - RNA, 13 nt, Staphylococcus aureus subsp. aureus N315
uuccaaaacaaaa

SEQ ID NO: 2151316 - RNA, 20 nt, Staphylococcus aureus subsp. aureus N315
uucauuuuuucaaugucuac

SEQ ID NO: 2151317 - RNA, 11 nt, Staphylococcus aureus subsp. aureus N315
uuccaaaaauu

SEQ ID NO: 2151318 - RNA, 17 nt, Staphylococcus aureus subsp. aureus N315
uucauuuucaaauaacu

SEQ ID NO: 2151319 - RNA, 14 nt, Staphylococcus aureus subsp. aureus N315
uucauuuuauaaau

SEQ ID NO: 2151320 - RNA, 19 nt, Staphylococcus aureus subsp. aureus N315
uucauuuuagcaaaagcuu

SEQ ID NO: 2151321 - RNA, 16 nt, Staphylococcus aureus subsp. aureus N315
uucauuuuaaauuuaa

SEQ ID NO: 2151322 - RNA, 14 nt, Staphylococcus aureus subsp. aureus N315
uucauuaauacaag

SEQ ID NO: 2151323 - RNA, 17 nt, Staphylococcus aureus subsp. aureus N315
uucauguuugauucuaa

SEQ ID NO: 2151324 - RNA, 16 nt, Staphylococcus aureus subsp. aureus N315
uucauguacgaaaauu

SEQ ID NO: 2151325 - RNA, 22 nt, Staphylococcus aureus subsp. aureus N315
uucaugugcaagugguaaaaau

SEQ ID NO: 2151326 - RNA, 17 nt, Staphylococcus aureus subsp. aureus N315
uucaugugucacaauga

SEQ ID NO: 2151327 - RNA, 12 nt, Staphylococcus aureus subsp. aureus N315
uucaugaacagc

SEQ ID NO: 2151328 - RNA, 14 nt, Staphylococcus aureus subsp. aureus N315
uucaugaacagcau

SEQ ID NO: 2151329 - RNA, 13 nt, Staphylococcus aureus subsp. aureus N315
uucaugaauaauu

SEQ ID NO: 2151330 - RNA, 21 nt, Staphylococcus aureus subsp. aureus N315
uucaugaauaaauacaauguu

SEQ ID NO: 2151331 - RNA, 21 nt, Staphylococcus aureus subsp. aureus N315
uucaucuugcaaguauuuucu

SEQ ID NO: 2151332 - RNA, 17 nt, Staphylococcus aureus subsp. aureus N315
uucaucugacugauuuu

SEQ ID NO: 2151333 - RNA, 12 nt, Staphylococcus aureus subsp. aureus N315
uucaucuucaac

SEQ ID NO: 2151334 - RNA, 12 nt, Staphylococcus aureus subsp. aureus N315
uucaucuucaaa

SEQ ID NO: 2151335 - RNA, 13 nt, Staphylococcus aureus subsp. aureus N315
uucaucuuaucaa

SEQ ID NO: 2151336 - RNA, 12 nt, Staphylococcus aureus subsp. aureus N315
uucaucuaaaug

SEQ ID NO: 2151337 - RNA, 16 nt, Staphylococcus aureus subsp. aureus N315
uucaucuaauuuuccu

SEQ ID NO: 2151338 - RNA, 18 nt, Staphylococcus aureus subsp. aureus N315
uucaucguucauauauuu

SEQ ID NO: 2151339 - RNA, 13 nt, Staphylococcus aureus subsp. aureus N315
uucaguuguuuuu

SEQ ID NO: 2151340 - RNA, 17 nt, Staphylococcus aureus subsp. aureus N315
uucaguuuguuggucuu

SEQ ID NO: 2151341 - RNA, 15 nt, Staphylococcus aureus subsp. aureus N315
uucauaaucauaaua

SEQ ID NO: 2151342 - RNA, 16 nt, Staphylococcus aureus subsp. aureus N315
uucauaaugaucaagu

SEQ ID NO: 2151343 - RNA, 21 nt, Staphylococcus aureus subsp. aureus N315
uucauacacuaucauuaucaa

SEQ ID NO: 2151344 - RNA, 14 nt, Staphylococcus aureus subsp. aureus N315
uucauaauuaauaa

SEQ ID NO: 2151345 - RNA, 20 nt, Staphylococcus aureus subsp. aureus N315
uucauaauuaacacauucaa

SEQ ID NO: 2151346 - RNA, 19 nt, Staphylococcus aureus subsp. aureus N315
uucauaagaaaaauguguu

SEQ ID NO: 2151347 - RNA, 22 nt, Staphylococcus aureus subsp. aureus N315
uucauaagucuuaacaaauuaa

SEQ ID NO: 2151348 - RNA, 20 nt, Staphylococcus aureus subsp. aureus N315
uucauaaaguuuauuuaugu

SEQ ID NO: 2151349 - RNA, 16 nt, Staphylococcus aureus subsp. aureus N315
uucauaaacucuuaca

SEQ ID NO: 2151350 - RNA, 23 nt, Staphylococcus aureus subsp. aureus N315
uucauaaauuguuuuacaugauu

SEQ ID NO: 2151351 - RNA, 20 nt, Staphylococcus aureus subsp. aureus N315
uucauaaaugacugaauuaa

SEQ ID NO: 2151352 - RNA, 18 nt, Staphylococcus aureus subsp. aureus N315
uucauaaaugacugaauu

SEQ ID NO: 2151353 - RNA, 22 nt, Staphylococcus aureus subsp. aureus N315
uucaguacgguuauuuaauaau

SEQ ID NO: 2151354 - RNA, 17 nt, Staphylococcus aureus subsp. aureus N315
uucaguacgaacaacua

SEQ ID NO: 2151355 - RNA, 16 nt, Staphylococcus aureus subsp. aureus N315
uucaguaacugauuuu

SEQ ID NO: 2151356 - RNA, 22 nt, Staphylococcus aureus subsp. aureus N315
uucagguucaaaauugcugaca

SEQ ID NO: 2151357 - RNA, 22 nt, Staphylococcus aureus subsp. aureus N315
uucagcgauaacguacaaugua

SEQ ID NO: 2151358 - RNA, 14 nt, Staphylococcus aureus subsp. aureus N315
uucauaguuuaugu

SEQ ID NO: 2151359 - RNA, 23 nt, Staphylococcus aureus subsp. aureus N315
uucauagugguguuuauaucuuu

SEQ ID NO: 2151360 - RNA, 22 nt, Staphylococcus aureus subsp. aureus N315
uucauacacugcacaucauaau

SEQ ID NO: 2151361 - RNA, 13 nt, Staphylococcus aureus subsp. aureus N315
uucaucaauaauu

SEQ ID NO: 2151362 - RNA, 20 nt, Staphylococcus aureus subsp. aureus N315
uucaucaaauccaaaaucuu

SEQ ID NO: 2151363 - RNA, 17 nt, Staphylococcus aureus subsp. aureus N315
uucaucaaacaacauca

SEQ ID NO: 2151364 - RNA, 22 nt, Staphylococcus aureus subsp. aureus N315
uucauauuuagguaauacauca

SEQ ID NO: 2151365 - RNA, 12 nt, Staphylococcus aureus subsp. aureus N315
uucauauuguuu

SEQ ID NO: 2151366 - RNA, 16 nt, Staphylococcus aureus subsp. aureus N315
uucauauggugaacug

SEQ ID NO: 2151367 - RNA, 13 nt, Staphylococcus aureus subsp. aureus N315
uucauauuaacug

SEQ ID NO: 2151368 - RNA, 17 nt, Staphylococcus aureus subsp. aureus N315
uucaucaaguugauaau

SEQ ID NO: 2151369 - RNA, 16 nt, Staphylococcus aureus subsp. aureus N315
uucaucauuaaaauca

SEQ ID NO: 2151370 - RNA, 14 nt, Staphylococcus aureus subsp. aureus N315
uucaucauuaaaau

SEQ ID NO: 2151371 - RNA, 14 nt, Staphylococcus aureus subsp. aureus N315
uucaccaauauuaa

SEQ ID NO: 2151372 - RNA, 14 nt, Staphylococcus aureus subsp. aureus N315
uucacucuguaaua

SEQ ID NO: 2151373 - RNA, 16 nt, Staphylococcus aureus subsp. aureus N315
uucacgcugaaauuuu

SEQ ID NO: 2151374 - RNA, 16 nt, Staphylococcus aureus subsp. aureus N315
uucacuguauaaauaa

SEQ ID NO: 2151375 - RNA, 23 nt, Staphylococcus aureus subsp. aureus N315
uucacuucgccaagccaucuuuc

SEQ ID NO: 2151376 - RNA, 12 nt, Staphylococcus aureus subsp. aureus N315
uucacuguuuua

SEQ ID NO: 2151377 - RNA, 14 nt, Staphylococcus aureus subsp. aureus N315
uucagaugaauaau

SEQ ID NO: 2151378 - RNA, 21 nt, Staphylococcus aureus subsp. aureus N315
uucagaacuacaauucauaag

SEQ ID NO: 2151379 - RNA, 13 nt, Staphylococcus aureus subsp. aureus N315
uucaauuaucaaa

SEQ ID NO: 2151380 - RNA, 13 nt, Staphylococcus aureus subsp. aureus N315
uucaauuagaaaa

SEQ ID NO: 2151381 - RNA, 15 nt, Staphylococcus aureus subsp. aureus N315
uucaauuagaaaaua

SEQ ID NO: 2151382 - RNA, 17 nt, Staphylococcus aureus subsp. aureus N315
uucaauguuuuaaauuu

SEQ ID NO: 2151383 - RNA, 18 nt, Staphylococcus aureus subsp. aureus N315
uucaauguuuaauuuucu

SEQ ID NO: 2151384 - RNA, 16 nt, Staphylococcus aureus subsp. aureus N315
uucaauuaaauguuua

SEQ ID NO: 2151385 - RNA, 15 nt, Staphylococcus aureus subsp. aureus N315
uucaauugucucaau

SEQ ID NO: 2151386 - RNA, 21 nt, Staphylococcus aureus subsp. aureus N315
uucaauuuaauguauugagaa

SEQ ID NO: 2151387 - RNA, 21 nt, Staphylococcus aureus subsp. aureus N315
uucaauucgcucacaugugaa

SEQ ID NO: 2151388 - RNA, 16 nt, Staphylococcus aureus subsp. aureus N315
uucaauugacauuaau

SEQ ID NO: 2151389 - RNA, 22 nt, Staphylococcus aureus subsp. aureus N315
uucaaucgcauuuuguuucaac

SEQ ID NO: 2151390 - RNA, 13 nt, Staphylococcus aureus subsp. aureus N315
uucaaguuuaaaa

SEQ ID NO: 2151391 - RNA, 15 nt, Staphylococcus aureus subsp. aureus N315
uucaaucguuucuuc

SEQ ID NO: 2151392 - RNA, 14 nt, Staphylococcus aureus subsp. aureus N315
uucaauccuuuguu

SEQ ID NO: 2151393 - RNA, 21 nt, Staphylococcus aureus subsp. aureus N315
uucaaguaauggauugauaau

SEQ ID NO: 2151394 - RNA, 19 nt, Staphylococcus aureus subsp. aureus N315
uucaauguaauuuucacuu

SEQ ID NO: 2151395 - RNA, 14 nt, Staphylococcus aureus subsp. aureus N315
uucaaugucugcau

SEQ ID NO: 2151396 - RNA, 16 nt, Staphylococcus aureus subsp. aureus N315
uucaauguucaauuca

SEQ ID NO: 2151397 - RNA, 18 nt, Staphylococcus aureus subsp. aureus N315
uucaaugucuacuuugaa

SEQ ID NO: 2151398 - RNA, 19 nt, Staphylococcus aureus subsp. aureus N315
uucaaugagaagcugucuu

SEQ ID NO: 2151399 - RNA, 16 nt, Staphylococcus aureus subsp. aureus N315
uucaaugaauucauuu

SEQ ID NO: 2151400 - RNA, 18 nt, Staphylococcus aureus subsp. aureus N315
uucaaugauuuuuaaaaa

SEQ ID NO: 2151401 - RNA, 19 nt, Staphylococcus aureus subsp. aureus N315
uucaaugauuuuuaaaaau

SEQ ID NO: 2151402 - RNA, 14 nt, Staphylococcus aureus subsp. aureus N315
uuauucuaauacaa

SEQ ID NO: 2151403 - RNA, 17 nt, Staphylococcus aureus subsp. aureus N315
uuauucuaaguuaaaac

SEQ ID NO: 2151404 - RNA, 13 nt, Staphylococcus aureus subsp. aureus N315
uuauucuaaauau

SEQ ID NO: 2151405 - RNA, 20 nt, Staphylococcus aureus subsp. aureus N315
uuauugccgguuaaauuauu

SEQ ID NO: 2151406 - RNA, 18 nt, Staphylococcus aureus subsp. aureus N315
uuauugccgguuaaauua

SEQ ID NO: 2151407 - RNA, 23 nt, Staphylococcus aureus subsp. aureus N315
uuauuuccuguuacuuucacauu

SEQ ID NO: 2151408 - RNA, 12 nt, Staphylococcus aureus subsp. aureus N315
uuauuucagcuu

SEQ ID NO: 2151409 - RNA, 16 nt, Staphylococcus aureus subsp. aureus N315
uuauuuauucagcauu

SEQ ID NO: 2151410 - RNA, 15 nt, Staphylococcus aureus subsp. aureus N315
uuauuucaauuauca

SEQ ID NO: 2151411 - RNA, 12 nt, Staphylococcus aureus subsp. aureus N315
uuauuuauauuu

SEQ ID NO: 2151412 - RNA, 17 nt, Staphylococcus aureus subsp. aureus N315
uuauugguugaaauuaa

SEQ ID NO: 2151413 - RNA, 20 nt, Staphylococcus aureus subsp. aureus N315
uuauugguuacuguaguacu

SEQ ID NO: 2151414 - RNA, 18 nt, Staphylococcus aureus subsp. aureus N315
uuauuuauacuaaauuga

SEQ ID NO: 2151415 - RNA, 17 nt, Staphylococcus aureus subsp. aureus N315
uuauuuauaaacaauaa

SEQ ID NO: 2151416 - RNA, 20 nt, Staphylococcus aureus subsp. aureus N315
uuauuuagaauucuaaaaga

SEQ ID NO: 2151417 - RNA, 17 nt, Staphylococcus aureus subsp. aureus N315
uuauucaauugauuaca

SEQ ID NO: 2151418 - RNA, 22 nt, Staphylococcus aureus subsp. aureus N315
uuauuauugucaucauguucua

SEQ ID NO: 2151419 - RNA, 20 nt, Staphylococcus aureus subsp. aureus N315
uuauuauuuuguauuuuuca

SEQ ID NO: 2151420 - RNA, 16 nt, Staphylococcus aureus subsp. aureus N315
uuauuauuuuguauuu

SEQ ID NO: 2151421 - RNA, 19 nt, Staphylococcus aureus subsp. aureus N315
uuauucaaaauucaauauu

SEQ ID NO: 2151422 - RNA, 14 nt, Staphylococcus aureus subsp. aureus N315
uuauucaaaucaua

SEQ ID NO: 2151423 - RNA, 13 nt, Staphylococcus aureus subsp. aureus N315
uuauucaauauuu

SEQ ID NO: 2151424 - RNA, 18 nt, Staphylococcus aureus subsp. aureus N315
uuaggauccaauuuaucu

SEQ ID NO: 2151425 - RNA, 17 nt, Staphylococcus aureus subsp. aureus N315
uuaggcgcuacaauguu

SEQ ID NO: 2151426 - RNA, 15 nt, Staphylococcus aureus subsp. aureus N315
uuaggcgacuuaacu

SEQ ID NO: 2151427 - RNA, 15 nt, Staphylococcus aureus subsp. aureus N315
uuauuaucuuuguaa

SEQ ID NO: 2151428 - RNA, 22 nt, Staphylococcus aureus subsp. aureus N315
uuauuaucagcccaaucaguuu

SEQ ID NO: 2151429 - RNA, 16 nt, Staphylococcus aureus subsp. aureus N315
uuaggcuuauuaacuu

SEQ ID NO: 2151430 - RNA, 21 nt, Staphylococcus aureus subsp. aureus N315
uuaggcuuauuaacuuuuccu

SEQ ID NO: 2151431 - RNA, 17 nt, Staphylococcus aureus subsp. aureus N315
uuaggcuuaaauauaau

SEQ ID NO: 2151432 - RNA, 15 nt, Staphylococcus aureus subsp. aureus N315
uucaaauugguuuuc

SEQ ID NO: 2151433 - RNA, 14 nt, Staphylococcus aureus subsp. aureus N315
uucaaauuaauuaa

SEQ ID NO: 2151434 - RNA, 21 nt, Staphylococcus aureus subsp. aureus N315
uucaaauguugacuacucaau

SEQ ID NO: 2151435 - RNA, 21 nt, Staphylococcus aureus subsp. aureus N315
uucaaaugcuuaauaaaauca

SEQ ID NO: 2151436 - RNA, 13 nt, Staphylococcus aureus subsp. aureus N315
uucaaauguugaa

SEQ ID NO: 2151437 - RNA, 17 nt, Staphylococcus aureus subsp. aureus N315
uucaacagggguaaaac

SEQ ID NO: 2151438 - RNA, 19 nt, Staphylococcus aureus subsp. aureus N315
uucaacaaacauaaauaag

SEQ ID NO: 2151439 - RNA, 16 nt, Staphylococcus aureus subsp. aureus N315
uucaacauauaaauca

SEQ ID NO: 2151440 - RNA, 21 nt, Staphylococcus aureus subsp. aureus N315
uucaacgucgaauguuucuuc

SEQ ID NO: 2151441 - RNA, 15 nt, Staphylococcus aureus subsp. aureus N315
uucaacuaauuuaaa

SEQ ID NO: 2151442 - RNA, 15 nt, Staphylococcus aureus subsp. aureus N315
uucaacuacuucauc

SEQ ID NO: 2151443 - RNA, 19 nt, Staphylococcus aureus subsp. aureus N315
uucaacuuuaaucaaaaaa

SEQ ID NO: 2151444 - RNA, 18 nt, Staphylococcus aureus subsp. aureus N315
uucaacuuauaaaaugaa

SEQ ID NO: 2151445 - RNA, 19 nt, Staphylococcus aureus subsp. aureus N315
uucaacuuauaaaaugaaa

SEQ ID NO: 2151446 - RNA, 23 nt, Staphylococcus aureus subsp. aureus N315
uucaacuaguaaaucaaagauga

SEQ ID NO: 2151447 - RNA, 18 nt, Staphylococcus aureus subsp. aureus N315
uuauuuucaguuaaaaua

SEQ ID NO: 2151448 - RNA, 19 nt, Staphylococcus aureus subsp. aureus N315
uuauuuugcaauugcaaug

SEQ ID NO: 2151449 - RNA, 20 nt, Staphylococcus aureus subsp. aureus N315
uuauuuucaauaaauaaaca

SEQ ID NO: 2151450 - RNA, 12 nt, Staphylococcus aureus subsp. aureus N315
uuauuuucaaua

SEQ ID NO: 2151451 - RNA, 17 nt, Staphylococcus aureus subsp. aureus N315
uucaaagcugucaacuu

SEQ ID NO: 2151452 - RNA, 19 nt, Staphylococcus aureus subsp. aureus N315
uucaaagcugucaacuugu

SEQ ID NO: 2151453 - RNA, 21 nt, Staphylococcus aureus subsp. aureus N315
uucaaaguagacauugaauaa

SEQ ID NO: 2151454 - RNA, 18 nt, Staphylococcus aureus subsp. aureus N315
uucaaagcgauaaaguau

SEQ ID NO: 2151455 - RNA, 13 nt, Staphylococcus aureus subsp. aureus N315
uucaaauaaagau

SEQ ID NO: 2151456 - RNA, 21 nt, Staphylococcus aureus subsp. aureus N315
uucaaauaaaugacauuuaau

SEQ ID NO: 2151457 - RNA, 15 nt, Staphylococcus aureus subsp. aureus N315
uucaaauaauauaaa

SEQ ID NO: 2151458 - RNA, 19 nt, Staphylococcus aureus subsp. aureus N315
uucaaauauaucuaauacu

SEQ ID NO: 2151459 - RNA, 16 nt, Staphylococcus aureus subsp. aureus N315
uggcacauaaaucaau

SEQ ID NO: 2151460 - RNA, 14 nt, Staphylococcus aureus subsp. aureus N315
uggcaaaucaaaca

SEQ ID NO: 2151461 - RNA, 14 nt, Staphylococcus aureus subsp. aureus N315
uggcaaauaugagu

SEQ ID NO: 2151462 - RNA, 19 nt, Staphylococcus aureus subsp. aureus N315
uggcaaagaauccuuaauu

SEQ ID NO: 2151463 - RNA, 19 nt, Staphylococcus aureus subsp. aureus N315
uggcauuuacgaaguuuaa

SEQ ID NO: 2151464 - RNA, 15 nt, Staphylococcus aureus subsp. aureus N315
uggcauuuuaucaug

SEQ ID NO: 2151465 - RNA, 21 nt, Staphylococcus aureus subsp. aureus N315
uggccuuuaaugauucuacag

SEQ ID NO: 2151466 - RNA, 21 nt, Staphylococcus aureus subsp. aureus N315
uggcgaauagcgauuuuaaag

SEQ ID NO: 2151467 - RNA, 17 nt, Staphylococcus aureus subsp. aureus N315
ugguacuauuuuugacu

SEQ ID NO: 2151468 - RNA, 20 nt, Staphylococcus aureus subsp. aureus N315
ugguaugacugcaaauacga

SEQ ID NO: 2151469 - RNA, 18 nt, Staphylococcus aureus subsp. aureus N315
ugguaugacugcaaauac

SEQ ID NO: 2151470 - RNA, 15 nt, Staphylococcus aureus subsp. aureus N315
ugguaaaaaguuuaa

SEQ ID NO: 2151471 - RNA, 18 nt, Staphylococcus aureus subsp. aureus N315
ugguaaaaaaauaacguu

SEQ ID NO: 2151472 - RNA, 18 nt, Staphylococcus aureus subsp. aureus N315
ugguacauaaauaccugg

SEQ ID NO: 2151473 - RNA, 19 nt, Staphylococcus aureus subsp. aureus N315
ugguaauucaccaucauau

SEQ ID NO: 2151474 - RNA, 11 nt, Staphylococcus aureus subsp. aureus N315
ugguaauauuu

SEQ ID NO: 2151475 - RNA, 23 nt, Staphylococcus aureus subsp. aureus N315
ugguaaauuuaucauuuuaagua

SEQ ID NO: 2151476 - RNA, 20 nt, Staphylococcus aureus subsp. aureus N315
ugguaacucuucaguacgaa

SEQ ID NO: 2151477 - RNA, 16 nt, Staphylococcus aureus subsp. aureus N315
ugguauuuuuuuaugc

SEQ ID NO: 2151478 - RNA, 15 nt, Staphylococcus aureus subsp. aureus N315
ugguauuuuuuaaau

SEQ ID NO: 2151479 - RNA, 14 nt, Staphylococcus aureus subsp. aureus N315
uggcuuuuuuaauu

SEQ ID NO: 2151480 - RNA, 14 nt, Staphylococcus aureus subsp. aureus N315
uggcuuuuuuauuu

SEQ ID NO: 2151481 - RNA, 15 nt, Staphylococcus aureus subsp. aureus N315
uggcguugcaccaag

SEQ ID NO: 2151482 - RNA, 14 nt, Staphylococcus aureus subsp. aureus N315
ugggcguucugcua

SEQ ID NO: 2151483 - RNA, 22 nt, Staphylococcus aureus subsp. aureus N315
uggggaugggccccaacaaaga

SEQ ID NO: 2151484 - RNA, 17 nt, Staphylococcus aureus subsp. aureus N315
ugugggcguucugcuaa

SEQ ID NO: 2151485 - RNA, 16 nt, Staphylococcus aureus subsp. aureus N315
ugugggcguucugcua

SEQ ID NO: 2151486 - RNA, 11 nt, Staphylococcus aureus subsp. aureus N315
ugugguaaaag

SEQ ID NO: 2151487 - RNA, 15 nt, Staphylococcus aureus subsp. aureus N315
uguguauuuuuauug

SEQ ID NO: 2151488 - RNA, 21 nt, Staphylococcus aureus subsp. aureus N315
uguguaucaguuauuuuaaua

SEQ ID NO: 2151489 - RNA, 16 nt, Staphylococcus aureus subsp. aureus N315
uguguaugaucaagcu

SEQ ID NO: 2151490 - RNA, 17 nt, Staphylococcus aureus subsp. aureus N315
uguggcggugguauggu

SEQ ID NO: 2151491 - RNA, 14 nt, Staphylococcus aureus subsp. aureus N315
ugugcuguucuauu

SEQ ID NO: 2151492 - RNA, 18 nt, Staphylococcus aureus subsp. aureus N315
ugugcuguucuauuccac

SEQ ID NO: 2151493 - RNA, 19 nt, Staphylococcus aureus subsp. aureus N315
ugugcugccaaauauaauu

SEQ ID NO: 2151494 - RNA, 17 nt, Staphylococcus aureus subsp. aureus N315
uguggauucucuuuaua

SEQ ID NO: 2151495 - RNA, 17 nt, Staphylococcus aureus subsp. aureus N315
uguggauuuaauuuuua

SEQ ID NO: 2151496 - RNA, 23 nt, Staphylococcus aureus subsp. aureus N315
uguggauguaggcuuuuuuauua

SEQ ID NO: 2151497 - RNA, 19 nt, Staphylococcus aureus subsp. aureus N315
ugugcucauuuuuuuaauu

SEQ ID NO: 2151498 - RNA, 14 nt, Staphylococcus aureus subsp. aureus N315
uguguguuuuaaaa

SEQ ID NO: 2151499 - RNA, 19 nt, Staphylococcus aureus subsp. aureus N315
uguguucggaauuugcaca

SEQ ID NO: 2151500 - RNA, 17 nt, Staphylococcus aureus subsp. aureus N315
uguguuggugcuauuaa

SEQ ID NO: 2151501 - RNA, 17 nt, Staphylococcus aureus subsp. aureus N315
uguguugugauuauaaa

SEQ ID NO: 2151502 - RNA, 21 nt, Staphylococcus aureus subsp. aureus N315
uguguuuaggaggaauaccca

SEQ ID NO: 2151503 - RNA, 13 nt, Staphylococcus aureus subsp. aureus N315
uguguuucagcuu

SEQ ID NO: 2151504 - RNA, 14 nt, Staphylococcus aureus subsp. aureus N315
uguguuuucuuuuc

SEQ ID NO: 2151505 - RNA, 18 nt, Staphylococcus aureus subsp. aureus N315
uguguuugcuuuuuacua

SEQ ID NO: 2151506 - RNA, 18 nt, Staphylococcus aureus subsp. aureus N315
uguguuuuaaaauuauuu

SEQ ID NO: 2151507 - RNA, 15 nt, Staphylococcus aureus subsp. aureus N315
uguuaaaauuugaau

SEQ ID NO: 2151508 - RNA, 15 nt, Staphylococcus aureus subsp. aureus N315
uguuaaauucuaaaa

SEQ ID NO: 2151509 - RNA, 12 nt, Staphylococcus aureus subsp. aureus N315
uguuaaaucacc

SEQ ID NO: 2151510 - RNA, 18 nt, Staphylococcus aureus subsp. aureus N315
uguuaaagauuauuauua

SEQ ID NO: 2151511 - RNA, 16 nt, Staphylococcus aureus subsp. aureus N315
uguuaauuuaauaauu

SEQ ID NO: 2151512 - RNA, 13 nt, Staphylococcus aureus subsp. aureus N315
uguuaauuucaac

SEQ ID NO: 2151513 - RNA, 18 nt, Staphylococcus aureus subsp. aureus N315
uguuaauuucaacauuac

SEQ ID NO: 2151514 - RNA, 17 nt, Staphylococcus aureus subsp. aureus N315
uguuaauuuuuuauuaa

SEQ ID NO: 2151515 - RNA, 16 nt, Staphylococcus aureus subsp. aureus N315
uguuaaugucuucaua

SEQ ID NO: 2151516 - RNA, 20 nt, Staphylococcus aureus subsp. aureus N315
uguuaaugcuucguaaucuu

SEQ ID NO: 2151517 - RNA, 20 nt, Staphylococcus aureus subsp. aureus N315
uguuaaucaaaauuaugacu

SEQ ID NO: 2151518 - RNA, 14 nt, Staphylococcus aureus subsp. aureus N315
uguuaacugaauuu

SEQ ID NO: 2151519 - RNA, 14 nt, Staphylococcus aureus subsp. aureus N315
uguuaaucaaaauu

SEQ ID NO: 2151520 - RNA, 22 nt, Staphylococcus aureus subsp. aureus N315
uguuacauauugcauuuagacu

SEQ ID NO: 2151521 - RNA, 15 nt, Staphylococcus aureus subsp. aureus N315
uguuacacuuuucuu

SEQ ID NO: 2151522 - RNA, 13 nt, Staphylococcus aureus subsp. aureus N315
uguuacuuauaua

SEQ ID NO: 2151523 - RNA, 18 nt, Staphylococcus aureus subsp. aureus N315
uguuacuaguuuguaaua

SEQ ID NO: 2151524 - RNA, 22 nt, Staphylococcus aureus subsp. aureus N315
uguuacuuucacauuuucaaau

SEQ ID NO: 2151525 - RNA, 15 nt, Staphylococcus aureus subsp. aureus N315
uguuacuugagaacc

SEQ ID NO: 2151526 - RNA, 18 nt, Staphylococcus aureus subsp. aureus N315
uguuacuucuaauaguaa

SEQ ID NO: 2151527 - RNA, 20 nt, Staphylococcus aureus subsp. aureus N315
uguuacuuauauauucaaua

SEQ ID NO: 2151528 - RNA, 24 nt, Staphylococcus aureus subsp. aureus N315
uguuacuuauauauucaauaauua

SEQ ID NO: 2151529 - RNA, 23 nt, Staphylococcus aureus subsp. aureus N315
ugugacucggggaauuuuuaugc

SEQ ID NO: 2151530 - RNA, 14 nt, Staphylococcus aureus subsp. aureus N315
ugugacgauauuug

SEQ ID NO: 2151531 - RNA, 19 nt, Staphylococcus aureus subsp. aureus N315
ugugaauaugcuuuuaaua

SEQ ID NO: 2151532 - RNA, 16 nt, Staphylococcus aureus subsp. aureus N315
ugucuuacuuuuaaau

SEQ ID NO: 2151533 - RNA, 15 nt, Staphylococcus aureus subsp. aureus N315
ugucuuacuuuuaaa

SEQ ID NO: 2151534 - RNA, 15 nt, Staphylococcus aureus subsp. aureus N315
ugugccuuucuaaua

SEQ ID NO: 2151535 - RNA, 14 nt, Staphylococcus aureus subsp. aureus N315
ugugccuuucucua

SEQ ID NO: 2151536 - RNA, 20 nt, Staphylococcus aureus subsp. aureus N315
ugugauaacuuguaauauaa

SEQ ID NO: 2151537 - RNA, 17 nt, Staphylococcus aureus subsp. aureus N315
ugugauaauucuucaac

SEQ ID NO: 2151538 - RNA, 15 nt, Staphylococcus aureus subsp. aureus N315
ugucauuuucugcuu

SEQ ID NO: 2151539 - RNA, 15 nt, Staphylococcus aureus subsp. aureus N315
ugucauuuugauuaa

SEQ ID NO: 2151540 - RNA, 13 nt, Staphylococcus aureus subsp. aureus N315
uguccaaauaaau

SEQ ID NO: 2151541 - RNA, 12 nt, Staphylococcus aureus subsp. aureus N315
uguccagacaac

SEQ ID NO: 2151542 - RNA, 20 nt, Staphylococcus aureus subsp. aureus N315
ugucugccaaaccuuuauau

SEQ ID NO: 2151543 - RNA, 20 nt, Staphylococcus aureus subsp. aureus N315
ugucuaaucgacuuuuacaa

SEQ ID NO: 2151544 - RNA, 15 nt, Staphylococcus aureus subsp. aureus N315
ugucguauucuucaa

SEQ ID NO: 2151545 - RNA, 15 nt, Staphylococcus aureus subsp. aureus N315
ugucaugccuucauu

SEQ ID NO: 2151546 - RNA, 20 nt, Staphylococcus aureus subsp. aureus N315
ugucaugaauuuucaucauu

SEQ ID NO: 2151547 - RNA, 12 nt, Staphylococcus aureus subsp. aureus N315
ugucaucgcuuu

SEQ ID NO: 2151548 - RNA, 16 nt, Staphylococcus aureus subsp. aureus N315
ugucaucgcuuuaauu

SEQ ID NO: 2151549 - RNA, 15 nt, Staphylococcus aureus subsp. aureus N315
ugucaucauguucua

SEQ ID NO: 2151550 - RNA, 18 nt, Staphylococcus aureus subsp. aureus N315
ugucaucauguucuaaug

SEQ ID NO: 2151551 - RNA, 22 nt, Staphylococcus aureus subsp. aureus N315
ugucaucaccuuguuaaaauaa

SEQ ID NO: 2151552 - RNA, 22 nt, Staphylococcus aureus subsp. aureus N315
ugucacuuggauucaaaugaca

SEQ ID NO: 2151553 - RNA, 20 nt, Staphylococcus aureus subsp. aureus N315
ugucauaauagauaaugcac

SEQ ID NO: 2151554 - RNA, 20 nt, Staphylococcus aureus subsp. aureus N315
ugucauaguauacauaauuc

SEQ ID NO: 2151555 - RNA, 19 nt, Staphylococcus aureus subsp. aureus N315
ugucauaguauacauaauu

SEQ ID NO: 2151556 - RNA, 17 nt, Staphylococcus aureus subsp. aureus N315
ugucauaccuuuuaauu

SEQ ID NO: 2151557 - RNA, 19 nt, Staphylococcus aureus subsp. aureus N315
uguaugaguucguaaucuu

SEQ ID NO: 2151558 - RNA, 15 nt, Staphylococcus aureus subsp. aureus N315
uguauguugaaagug

SEQ ID NO: 2151559 - RNA, 18 nt, Staphylococcus aureus subsp. aureus N315
uguauuuuuacuuuuaua

SEQ ID NO: 2151560 - RNA, 13 nt, Staphylococcus aureus subsp. aureus N315
uguauuuuuauuu

SEQ ID NO: 2151561 - RNA, 21 nt, Staphylococcus aureus subsp. aureus N315
uguauuuuucuuaauuaucau

SEQ ID NO: 2151562 - RNA, 22 nt, Staphylococcus aureus subsp. aureus N315
ugucaauaaauuguuuacuaua

SEQ ID NO: 2151563 - RNA, 20 nt, Staphylococcus aureus subsp. aureus N315
uguauagauuguauuuaaua

SEQ ID NO: 2151564 - RNA, 20 nt, Staphylococcus aureus subsp. aureus N315
uguauagcuggcuuuuuaau

SEQ ID NO: 2151565 - RNA, 17 nt, Staphylococcus aureus subsp. aureus N315
uguauaccuauuccuau

SEQ ID NO: 2151566 - RNA, 22 nt, Staphylococcus aureus subsp. aureus N315
uguauaguaaccuuuauuuuca

SEQ ID NO: 2151567 - RNA, 17 nt, Staphylococcus aureus subsp. aureus N315
uguauagagagaaauaa

SEQ ID NO: 2151568 - RNA, 15 nt, Staphylococcus aureus subsp. aureus N315
uguauauauauguaa

SEQ ID NO: 2151569 - RNA, 20 nt, Staphylococcus aureus subsp. aureus N315
uguauauggcgauaacaaga

SEQ ID NO: 2151570 - RNA, 22 nt, Staphylococcus aureus subsp. aureus N315
uguaucaaaaucgguuugauua

SEQ ID NO: 2151571 - RNA, 24 nt, Staphylococcus aureus subsp. aureus N315
uguauauuuaacaucaauuacucu

SEQ ID NO: 2151572 - RNA, 14 nt, Staphylococcus aureus subsp. aureus N315
uguauauucuuuuu

SEQ ID NO: 2151573 - RNA, 13 nt, Staphylococcus aureus subsp. aureus N315
uguauaacauuau

SEQ ID NO: 2151574 - RNA, 19 nt, Staphylococcus aureus subsp. aureus N315
uguauaaggauguacuaua

SEQ ID NO: 2151575 - RNA, 21 nt, Staphylococcus aureus subsp. aureus N315
uguauaaauaauaaaugcuau

SEQ ID NO: 2151576 - RNA, 20 nt, Staphylococcus aureus subsp. aureus N315
uguauaaagggcuauuugau

SEQ ID NO: 2151577 - RNA, 18 nt, Staphylococcus aureus subsp. aureus N315
uguaguuaagauaccuuu

SEQ ID NO: 2151578 - RNA, 16 nt, Staphylococcus aureus subsp. aureus N315
uguagugguucuuaua

SEQ ID NO: 2151579 - RNA, 16 nt, Staphylococcus aureus subsp. aureus N315
uguaguaaaaaucaca

SEQ ID NO: 2151580 - RNA, 17 nt, Staphylococcus aureus subsp. aureus N315
uguagggggcauuauua

SEQ ID NO: 2151581 - RNA, 21 nt, Staphylococcus aureus subsp. aureus N315
uguaaaaccuuacccaaaaaa

SEQ ID NO: 2151582 - RNA, 23 nt, Staphylococcus aureus subsp. aureus N315
uguaaaacaaugcccguguaaca

SEQ ID NO: 2151583 - RNA, 16 nt, Staphylococcus aureus subsp. aureus N315
uguaaaaaauaucuug

SEQ ID NO: 2151584 - RNA, 16 nt, Staphylococcus aureus subsp. aureus N315
uguaaaaacguucaau

SEQ ID NO: 2151585 - RNA, 13 nt, Staphylococcus aureus subsp. aureus N315
uguaaaaaauauc

SEQ ID NO: 2151586 - RNA, 12 nt, Staphylococcus aureus subsp. aureus N315
uguaaaaaauau

SEQ ID NO: 2151587 - RNA, 14 nt, Staphylococcus aureus subsp. aureus N315
uguaaccaccugau

SEQ ID NO: 2151588 - RNA, 17 nt, Staphylococcus aureus subsp. aureus N315
uguaaauuuuuaagaag

SEQ ID NO: 2151589 - RNA, 13 nt, Staphylococcus aureus subsp. aureus N315
uguaacaaagucu

SEQ ID NO: 2151590 - RNA, 18 nt, Staphylococcus aureus subsp. aureus N315
uguaacacacuuauaauc

SEQ ID NO: 2151591 - RNA, 20 nt, Staphylococcus aureus subsp. aureus N315
uguaacacgcucuuuucaaa

SEQ ID NO: 2151592 - RNA, 18 nt, Staphylococcus aureus subsp. aureus N315
uguaaacaguauguagcu

SEQ ID NO: 2151593 - RNA, 20 nt, Staphylococcus aureus subsp. aureus N315
uguaaaaugcucccuucaaa

SEQ ID NO: 2151594 - RNA, 20 nt, Staphylococcus aureus subsp. aureus N315
uguaaauuuauuuuuaauuu

SEQ ID NO: 2151595 - RNA, 21 nt, Staphylococcus aureus subsp. aureus N315
uguaaaccagcuaaaccaucu

SEQ ID NO: 2151596 - RNA, 18 nt, Staphylococcus aureus subsp. aureus N315
ugguuucauaaacugaau

SEQ ID NO: 2151597 - RNA, 14 nt, Staphylococcus aureus subsp. aureus N315
ugguuucaucauau

SEQ ID NO: 2151598 - RNA, 16 nt, Staphylococcus aureus subsp. aureus N315
ugguuuuuagugaaaa

SEQ ID NO: 2151599 - RNA, 19 nt, Staphylococcus aureus subsp. aureus N315
uguaauauaacaaguauaa

SEQ ID NO: 2151600 - RNA, 21 nt, Staphylococcus aureus subsp. aureus N315
uguaacuuuagacauaaaaaa

SEQ ID NO: 2151601 - RNA, 16 nt, Staphylococcus aureus subsp. aureus N315
uguaaccuaaaaacaa

SEQ ID NO: 2151602 - RNA, 22 nt, Staphylococcus aureus subsp. aureus N315
uguaaucauugguuucaucaua

SEQ ID NO: 2151603 - RNA, 16 nt, Staphylococcus aureus subsp. aureus N315
uguaauccuugagcuc

SEQ ID NO: 2151604 - RNA, 21 nt, Staphylococcus aureus subsp. aureus N315
uguaaugcuuaaaaacaauau

SEQ ID NO: 2151605 - RNA, 15 nt, Staphylococcus aureus subsp. aureus N315
uguaaugcuuaaaaa

SEQ ID NO: 2151606 - RNA, 22 nt, Staphylococcus aureus subsp. aureus N315
uguaaugaguaggcucuuaaug

SEQ ID NO: 2151607 - RNA, 20 nt, Staphylococcus aureus subsp. aureus N315
uguaccaucacuaaaguaaa

SEQ ID NO: 2151608 - RNA, 13 nt, Staphylococcus aureus subsp. aureus N315
uguaccaccccaa

SEQ ID NO: 2151609 - RNA, 17 nt, Staphylococcus aureus subsp. aureus N315
uguacauuguaaauaua

SEQ ID NO: 2151610 - RNA, 20 nt, Staphylococcus aureus subsp. aureus N315
uguacacauccucauaauua

SEQ ID NO: 2151611 - RNA, 18 nt, Staphylococcus aureus subsp. aureus N315
uguacaauuuuuaaaaac

SEQ ID NO: 2151612 - RNA, 23 nt, Staphylococcus aureus subsp. aureus N315
uguacgaccagucgcauauuuug

SEQ ID NO: 2151613 - RNA, 15 nt, Staphylococcus aureus subsp. aureus N315
uguacuucuuugguc

SEQ ID NO: 2151614 - RNA, 23 nt, Staphylococcus aureus subsp. aureus N315
uguagaaacacaaggaauauaca

SEQ ID NO: 2151615 - RNA, 23 nt, Staphylococcus aureus subsp. aureus N315
uguacuuuuauguuguuauaaag

SEQ ID NO: 2151616 - RNA, 13 nt, Staphylococcus aureus subsp. aureus N315
uguagaaaacaug

SEQ ID NO: 2151617 - RNA, 22 nt, Staphylococcus aureus subsp. aureus N315
uguuuacgccauaagaaaauac

SEQ ID NO: 2151618 - RNA, 21 nt, Staphylococcus aureus subsp. aureus N315
uguuuaccuaaaucuuuaaau

SEQ ID NO: 2151619 - RNA, 12 nt, Staphylococcus aureus subsp. aureus N315
uguuuaauuauc

SEQ ID NO: 2151620 - RNA, 17 nt, Staphylococcus aureus subsp. aureus N315
uguuuaauuaaaauaca

SEQ ID NO: 2151621 - RNA, 14 nt, Staphylococcus aureus subsp. aureus N315
uguuuaauuuucua

SEQ ID NO: 2151622 - RNA, 21 nt, Staphylococcus aureus subsp. aureus N315
uguuuaauuugauuaaauuca

SEQ ID NO: 2151623 - RNA, 13 nt, Staphylococcus aureus subsp. aureus N315
uguuuacagaugc

SEQ ID NO: 2151624 - RNA, 20 nt, Staphylococcus aureus subsp. aureus N315
uguuuaguauggaauaaaug

SEQ ID NO: 2151625 - RNA, 16 nt, Staphylococcus aureus subsp. aureus N315
uguuuaaacauguaca

SEQ ID NO: 2151626 - RNA, 15 nt, Staphylococcus aureus subsp. aureus N315
uguuuaaacauguac

SEQ ID NO: 2151627 - RNA, 16 nt, Staphylococcus aureus subsp. aureus N315
uguuuaaaaaacuacu

SEQ ID NO: 2151628 - RNA, 13 nt, Staphylococcus aureus subsp. aureus N315
uguuguuuuugau

SEQ ID NO: 2151629 - RNA, 16 nt, Staphylococcus aureus subsp. aureus N315
uguuguuauuauaaau

SEQ ID NO: 2151630 - RNA, 14 nt, Staphylococcus aureus subsp. aureus N315
uguuguuauauaaa

SEQ ID NO: 2151631 - RNA, 16 nt, Staphylococcus aureus subsp. aureus N315
uguuggcaaacuauua

SEQ ID NO: 2151632 - RNA, 22 nt, Staphylococcus aureus subsp. aureus N315
uguuggaagccuucaauaguuu

SEQ ID NO: 2151633 - RNA, 15 nt, Staphylococcus aureus subsp. aureus N315
uguugggucuuguaa

SEQ ID NO: 2151634 - RNA, 20 nt, Staphylococcus aureus subsp. aureus N315
uguugguucaucaaacaaca

SEQ ID NO: 2151635 - RNA, 17 nt, Staphylococcus aureus subsp. aureus N315
uguuggggcccacaccc

SEQ ID NO: 2151636 - RNA, 14 nt, Staphylococcus aureus subsp. aureus N315
uguugugaauaaaa

SEQ ID NO: 2151637 - RNA, 15 nt, Staphylococcus aureus subsp. aureus N315
uguugugcugccaaa

SEQ ID NO: 2151638 - RNA, 17 nt, Staphylococcus aureus subsp. aureus N315
uguugcuaaucucagau

SEQ ID NO: 2151639 - RNA, 19 nt, Staphylococcus aureus subsp. aureus N315
uguugacauuugaccaagu

SEQ ID NO: 2151640 - RNA, 18 nt, Staphylococcus aureus subsp. aureus N315
uguugaccaccugauaau

SEQ ID NO: 2151641 - RNA, 14 nt, Staphylococcus aureus subsp. aureus N315
uguugauaaaaagg

SEQ ID NO: 2151642 - RNA, 22 nt, Staphylococcus aureus subsp. aureus N315
uguugaggcguuucagaaguug

SEQ ID NO: 2151643 - RNA, 21 nt, Staphylococcus aureus subsp. aureus N315
uguugaggcguuucagaaguu

SEQ ID NO: 2151644 - RNA, 21 nt, Staphylococcus aureus subsp. aureus N315
uguucuggaauugggaaauau

SEQ ID NO: 2151645 - RNA, 16 nt, Staphylococcus aureus subsp. aureus N315
uguucugcuuuuucuu

SEQ ID NO: 2151646 - RNA, 19 nt, Staphylococcus aureus subsp. aureus N315
uguucuugaaaacaauaaa

SEQ ID NO: 2151647 - RNA, 22 nt, Staphylococcus aureus subsp. aureus N315
uguucuugaaaacaauaaauuu

SEQ ID NO: 2151648 - RNA, 21 nt, Staphylococcus aureus subsp. aureus N315
uguucuucugcauagcgcucu

SEQ ID NO: 2151649 - RNA, 18 nt, Staphylococcus aureus subsp. aureus N315
uguucuucgucaaauuca

SEQ ID NO: 2151650 - RNA, 15 nt, Staphylococcus aureus subsp. aureus N315
uguucucuauuuaua

SEQ ID NO: 2151651 - RNA, 16 nt, Staphylococcus aureus subsp. aureus N315
uguucuaauuguugua

SEQ ID NO: 2151652 - RNA, 22 nt, Staphylococcus aureus subsp. aureus N315
uguucuaaccauucguaauaaa

SEQ ID NO: 2151653 - RNA, 20 nt, Staphylococcus aureus subsp. aureus N315
uguuccuccaccaccugcaa

SEQ ID NO: 2151654 - RNA, 22 nt, Staphylococcus aureus subsp. aureus N315
uguuccugcuacaacuucuucu

SEQ ID NO: 2151655 - RNA, 21 nt, Staphylococcus aureus subsp. aureus N315
uguucaucugauaauucgaaa

SEQ ID NO: 2151656 - RNA, 22 nt, Staphylococcus aureus subsp. aureus N315
uguucaucugauaauucgaaau

SEQ ID NO: 2151657 - RNA, 18 nt, Staphylococcus aureus subsp. aureus N315
uguuccaaucuuuuuaau

SEQ ID NO: 2151658 - RNA, 17 nt, Staphylococcus aureus subsp. aureus N315
uguucaacuaaauuuuc

SEQ ID NO: 2151659 - RNA, 23 nt, Staphylococcus aureus subsp. aureus N315
uguucaaugauuuuauaauauua

SEQ ID NO: 2151660 - RNA, 16 nt, Staphylococcus aureus subsp. aureus N315
uguucacauucuugaa

SEQ ID NO: 2151661 - RNA, 17 nt, Staphylococcus aureus subsp. aureus N315
uguucaaugauuuuaua

SEQ ID NO: 2151662 - RNA, 22 nt, Staphylococcus aureus subsp. aureus N315
uguucagaacuacaauucauaa

SEQ ID NO: 2151663 - RNA, 15 nt, Staphylococcus aureus subsp. aureus N315
uguucagguucaaaa

SEQ ID NO: 2151664 - RNA, 21 nt, Staphylococcus aureus subsp. aureus N315
uguucaguuguuuuuuuguca

SEQ ID NO: 2151665 - RNA, 16 nt, Staphylococcus aureus subsp. aureus N315
uguucaguuaaaucug

SEQ ID NO: 2151666 - RNA, 19 nt, Staphylococcus aureus subsp. aureus N315
uguucaguuguuuuuuugu

SEQ ID NO: 2151667 - RNA, 18 nt, Staphylococcus aureus subsp. aureus N315
uguuagucuuuuuaagua

SEQ ID NO: 2151668 - RNA, 13 nt, Staphylococcus aureus subsp. aureus N315
uguuaggggcuuu

SEQ ID NO: 2151669 - RNA, 16 nt, Staphylococcus aureus subsp. aureus N315
uguuaggggcucuuau

SEQ ID NO: 2151670 - RNA, 17 nt, Staphylococcus aureus subsp. aureus N315
uguuauagcguuuaaga

SEQ ID NO: 2151671 - RNA, 11 nt, Staphylococcus aureus subsp. aureus N315
uguuauaaaau

SEQ ID NO: 2151672 - RNA, 23 nt, Staphylococcus aureus subsp. aureus N315
uguuauauuggcaguguuugacu

SEQ ID NO: 2151673 - RNA, 15 nt, Staphylococcus aureus subsp. aureus N315
uguuauaucuaauuc

SEQ ID NO: 2151674 - RNA, 14 nt, Staphylococcus aureus subsp. aureus N315
uguuaugaaguauc

SEQ ID NO: 2151675 - RNA, 16 nt, Staphylococcus aureus subsp. aureus N315
uguuauuauaaauauu

SEQ ID NO: 2151676 - RNA, 22 nt, Staphylococcus aureus subsp. aureus N315
uguuauuaucguaaaaaaacgu

SEQ ID NO: 2151677 - RNA, 15 nt, Staphylococcus aureus subsp. aureus N315
uguuauugcaauaaa

SEQ ID NO: 2151678 - RNA, 13 nt, Staphylococcus aureus subsp. aureus N315
uuaaaacuauaau

SEQ ID NO: 2151679 - RNA, 14 nt, Staphylococcus aureus subsp. aureus N315
uuaaaacuauaaua

SEQ ID NO: 2151680 - RNA, 14 nt, Staphylococcus aureus subsp. aureus N315
uuaaaacuuguaaa

SEQ ID NO: 2151681 - RNA, 20 nt, Staphylococcus aureus subsp. aureus N315
uuaaaagacauccacagaau

SEQ ID NO: 2151682 - RNA, 15 nt, Staphylococcus aureus subsp. aureus N315
uuaaaagauaaauaa

SEQ ID NO: 2151683 - RNA, 12 nt, Staphylococcus aureus subsp. aureus N315
uuaaaacaucau

SEQ ID NO: 2151684 - RNA, 15 nt, Staphylococcus aureus subsp. aureus N315
uuaaaaccaaaagaa

SEQ ID NO: 2151685 - RNA, 13 nt, Staphylococcus aureus subsp. aureus N315
uuaaaaaucaaag

SEQ ID NO: 2151686 - RNA, 21 nt, Staphylococcus aureus subsp. aureus N315
uuaaaauaugauuuaaaauau

SEQ ID NO: 2151687 - RNA, 15 nt, Staphylococcus aureus subsp. aureus N315
uuaaaauauauuugu

SEQ ID NO: 2151688 - RNA, 22 nt, Staphylococcus aureus subsp. aureus N315
uuaaaauauaaauuucuucaua

SEQ ID NO: 2151689 - RNA, 12 nt, Staphylococcus aureus subsp. aureus N315
uuaaaauacguu

SEQ ID NO: 2151690 - RNA, 18 nt, Staphylococcus aureus subsp. aureus N315
uuaaaauaguucuuuaaa

SEQ ID NO: 2151691 - RNA, 21 nt, Staphylococcus aureus subsp. aureus N315
uuaaaagugcaaguccaaaua

SEQ ID NO: 2151692 - RNA, 15 nt, Staphylococcus aureus subsp. aureus N315
uuaaaauaaaucuuu

SEQ ID NO: 2151693 - RNA, 20 nt, Staphylococcus aureus subsp. aureus N315
uuaaaauaaccauuuuuuca

SEQ ID NO: 2151694 - RNA, 14 nt, Staphylococcus aureus subsp. aureus N315
uuaaaauaaaccac

SEQ ID NO: 2151695 - RNA, 18 nt, Staphylococcus aureus subsp. aureus N315
uuaaaaggcgaaacauua

SEQ ID NO: 2151696 - RNA, 14 nt, Staphylococcus aureus subsp. aureus N315
uuaaaaaacaaaac

SEQ ID NO: 2151697 - RNA, 11 nt, Staphylococcus aureus subsp. aureus N315
uuaaaaaaccu

SEQ ID NO: 2151698 - RNA, 15 nt, Staphylococcus aureus subsp. aureus N315
uuaaaaaaccugaaa

SEQ ID NO: 2151699 - RNA, 12 nt, Staphylococcus aureus subsp. aureus N315
uuaaaaauaaaa

SEQ ID NO: 2151700 - RNA, 16 nt, Staphylococcus aureus subsp. aureus N315
uuaaaaauauguguua

SEQ ID NO: 2151701 - RNA, 12 nt, Staphylococcus aureus subsp. aureus N315
uuaaaaaauaug

SEQ ID NO: 2151702 - RNA, 19 nt, Staphylococcus aureus subsp. aureus N315
uuaaaaacaauauugacuu

SEQ ID NO: 2151703 - RNA, 16 nt, Staphylococcus aureus subsp. aureus N315
uuaaaaaauuuaaaua

SEQ ID NO: 2151704 - RNA, 16 nt, Staphylococcus aureus subsp. aureus N315
uuaaaauuuuaauuaa

SEQ ID NO: 2151705 - RNA, 14 nt, Staphylococcus aureus subsp. aureus N315
uuaaaauuuaaaua

SEQ ID NO: 2151706 - RNA, 22 nt, Staphylococcus aureus subsp. aureus N315
uuaaaauugguuuggauaaaau

SEQ ID NO: 2151707 - RNA, 19 nt, Staphylococcus aureus subsp. aureus N315
uuaaacaagcaucaugaaa

SEQ ID NO: 2151708 - RNA, 17 nt, Staphylococcus aureus subsp. aureus N315
uuaaacaaauaaauguc

SEQ ID NO: 2151709 - RNA, 21 nt, Staphylococcus aureus subsp. aureus N315
uuaaaaugauuguuuuaagug

SEQ ID NO: 2151710 - RNA, 11 nt, Staphylococcus aureus subsp. aureus N315
uuaaaaugcuu

SEQ ID NO: 2151711 - RNA, 22 nt, Staphylococcus aureus subsp. aureus N315
uuaaaaugauagcuaaacauuu

SEQ ID NO: 2151712 - RNA, 18 nt, Staphylococcus aureus subsp. aureus N315
uuaaaaugcuuuuuugaa

SEQ ID NO: 2151713 - RNA, 20 nt, Staphylococcus aureus subsp. aureus N315
uuaaacauccaauuauguuu

SEQ ID NO: 2151714 - RNA, 21 nt, Staphylococcus aureus subsp. aureus N315
uuaaacauccaauuauguuua

SEQ ID NO: 2151715 - RNA, 16 nt, Staphylococcus aureus subsp. aureus N315
uuaaacaguuuaauuc

SEQ ID NO: 2151716 - RNA, 21 nt, Staphylococcus aureus subsp. aureus N315
uuaaacacgcgguaaaacgaa

SEQ ID NO: 2151717 - RNA, 23 nt, Staphylococcus aureus subsp. aureus N315
uuaaaccgcacuucuauauuaau

SEQ ID NO: 2151718 - RNA, 20 nt, Staphylococcus aureus subsp. aureus N315
uuaaaccgccaccaccuaau

SEQ ID NO: 2151719 - RNA, 15 nt, Staphylococcus aureus subsp. aureus N315
uuaaacauuuuugaa

SEQ ID NO: 2151720 - RNA, 14 nt, Staphylococcus aureus subsp. aureus N315
uuaaaccuuaauaa

SEQ ID NO: 2151721 - RNA, 14 nt, Staphylococcus aureus subsp. aureus N315
uuaaacgcaauuaa

SEQ ID NO: 2151722 - RNA, 18 nt, Staphylococcus aureus subsp. aureus N315
uuaaaccguauagucauu

SEQ ID NO: 2151723 - RNA, 12 nt, Staphylococcus aureus subsp. aureus N315
uuaaacuuauua

SEQ ID NO: 2151724 - RNA, 14 nt, Staphylococcus aureus subsp. aureus N315
uuaaacuuauuaau

SEQ ID NO: 2151725 - RNA, 16 nt, Staphylococcus aureus subsp. aureus N315
uuaaacucucuaaaaa

SEQ ID NO: 2151726 - RNA, 23 nt, Staphylococcus aureus subsp. aureus N315
uuaaacucauaccaaaaacauua

SEQ ID NO: 2151727 - RNA, 15 nt, Staphylococcus aureus subsp. aureus N315
uuaaagcaucuucaa

SEQ ID NO: 2151728 - RNA, 13 nt, Staphylococcus aureus subsp. aureus N315
uuaaagauuauua

SEQ ID NO: 2151729 - RNA, 18 nt, Staphylococcus aureus subsp. aureus N315
uuaaagauuuacccauua

SEQ ID NO: 2151730 - RNA, 16 nt, Staphylococcus aureus subsp. aureus N315
uuaaagacuagccaua

SEQ ID NO: 2151731 - RNA, 18 nt, Staphylococcus aureus subsp. aureus N315
uuaaagauggcugcauca

SEQ ID NO: 2151732 - RNA, 20 nt, Staphylococcus aureus subsp. aureus N315
uuaaagaugucgaaaaguau

SEQ ID NO: 2151733 - RNA, 21 nt, Staphylococcus aureus subsp. aureus N315
uuaaagagcaauuaaagucaa

SEQ ID NO: 2151734 - RNA, 18 nt, Staphylococcus aureus subsp. aureus N315
uuaaagaaaauuucagua

SEQ ID NO: 2151735 - RNA, 19 nt, Staphylococcus aureus subsp. aureus N315
uuaaagaaaaguuuaaguc

SEQ ID NO: 2151736 - RNA, 20 nt, Staphylococcus aureus subsp. aureus N315
uuaaagaaaauaucugaaaa

SEQ ID NO: 2151737 - RNA, 14 nt, Staphylococcus aureus subsp. aureus N315
uguuuuaucaauau

SEQ ID NO: 2151738 - RNA, 20 nt, Staphylococcus aureus subsp. aureus N315
uguuuucaacaguuuuaaag

SEQ ID NO: 2151739 - RNA, 13 nt, Staphylococcus aureus subsp. aureus N315
uguuuuauucaau

SEQ ID NO: 2151740 - RNA, 14 nt, Staphylococcus aureus subsp. aureus N315
uguuuucaauaauu

SEQ ID NO: 2151741 - RNA, 16 nt, Staphylococcus aureus subsp. aureus N315
uguuuuaaaucauaaa

SEQ ID NO: 2151742 - RNA, 12 nt, Staphylococcus aureus subsp. aureus N315
uguuuuaauaau

SEQ ID NO: 2151743 - RNA, 15 nt, Staphylococcus aureus subsp. aureus N315
uguuuuaauaauauc

SEQ ID NO: 2151744 - RNA, 14 nt, Staphylococcus aureus subsp. aureus N315
uguuuguuuuuaua

SEQ ID NO: 2151745 - RNA, 16 nt, Staphylococcus aureus subsp. aureus N315
uguuuuaaaauuauuu

SEQ ID NO: 2151746 - RNA, 12 nt, Staphylococcus aureus subsp. aureus N315
uguuuuaaaaaa

SEQ ID NO: 2151747 - RNA, 16 nt, Staphylococcus aureus subsp. aureus N315
uguuuguaagucgcuc

SEQ ID NO: 2151748 - RNA, 24 nt, Staphylococcus aureus subsp. aureus N315
uguuuguaaugucgaucuaacaau

SEQ ID NO: 2151749 - RNA, 18 nt, Staphylococcus aureus subsp. aureus N315
uguuugggauauagaaaa

SEQ ID NO: 2151750 - RNA, 17 nt, Staphylococcus aureus subsp. aureus N315
uguuuuucaucauuaaa

SEQ ID NO: 2151751 - RNA, 21 nt, Staphylococcus aureus subsp. aureus N315
uguuuuucacuguuaaagucu

SEQ ID NO: 2151752 - RNA, 21 nt, Staphylococcus aureus subsp. aureus N315
uguuuuuaacagcuuuuucua

SEQ ID NO: 2151753 - RNA, 19 nt, Staphylococcus aureus subsp. aureus N315
uguuuuuaacagcuuuuuc

SEQ ID NO: 2151754 - RNA, 21 nt, Staphylococcus aureus subsp. aureus N315
uguuuugagagauuauuuaaa

SEQ ID NO: 2151755 - RNA, 20 nt, Staphylococcus aureus subsp. aureus N315
uguuuugagagauuauuuaa

SEQ ID NO: 2151756 - RNA, 15 nt, Staphylococcus aureus subsp. aureus N315
uguuuucuuuucaaa

SEQ ID NO: 2151757 - RNA, 17 nt, Staphylococcus aureus subsp. aureus N315
uguuuucuuuucaaaau

SEQ ID NO: 2151758 - RNA, 20 nt, Staphylococcus aureus subsp. aureus N315
uguuuugcgguuuuuuugau

SEQ ID NO: 2151759 - RNA, 20 nt, Staphylococcus aureus subsp. aureus N315
uguuuuggaaaaauuguggc

SEQ ID NO: 2151760 - RNA, 12 nt, Staphylococcus aureus subsp. aureus N315
uguuuauaucuu

SEQ ID NO: 2151761 - RNA, 21 nt, Staphylococcus aureus subsp. aureus N315
uguuuaucaugaugauaaauu

SEQ ID NO: 2151762 - RNA, 18 nt, Staphylococcus aureus subsp. aureus N315
uguuuaugacaaaguucu

SEQ ID NO: 2151763 - RNA, 19 nt, Staphylococcus aureus subsp. aureus N315
uguuucaaaauaauuuuau

SEQ ID NO: 2151764 - RNA, 13 nt, Staphylococcus aureus subsp. aureus N315
uguuucaaacaaa

SEQ ID NO: 2151765 - RNA, 13 nt, Staphylococcus aureus subsp. aureus N315
uguuuauucagau

SEQ ID NO: 2151766 - RNA, 12 nt, Staphylococcus aureus subsp. aureus N315
uguuucaacaua

SEQ ID NO: 2151767 - RNA, 19 nt, Staphylococcus aureus subsp. aureus N315
uguuucauaugcaucaaca

SEQ ID NO: 2151768 - RNA, 14 nt, Staphylococcus aureus subsp. aureus N315
uguuucaacauauu

SEQ ID NO: 2151769 - RNA, 15 nt, Staphylococcus aureus subsp. aureus N315
uguuucaggauaaug

SEQ ID NO: 2151770 - RNA, 17 nt, Staphylococcus aureus subsp. aureus N315
uguuucaggauaaugaa

SEQ ID NO: 2151771 - RNA, 14 nt, Staphylococcus aureus subsp. aureus N315
uguuugagauauau

SEQ ID NO: 2151772 - RNA, 18 nt, Staphylococcus aureus subsp. aureus N315
uguuugaauggcaaauau

SEQ ID NO: 2151773 - RNA, 21 nt, Staphylococcus aureus subsp. aureus N315
uguuugaugauucguauucaa

SEQ ID NO: 2151774 - RNA, 14 nt, Staphylococcus aureus subsp. aureus N315
uguuugcuuuuugu

SEQ ID NO: 2151775 - RNA, 16 nt, Staphylococcus aureus subsp. aureus N315
uguuuggaugaacaaa

SEQ ID NO: 2151776 - RNA, 17 nt, Staphylococcus aureus subsp. aureus N315
uguuucuucaauuuaau

SEQ ID NO: 2151777 - RNA, 18 nt, Staphylococcus aureus subsp. aureus N315
uguuucuuuuauuuucau

SEQ ID NO: 2151778 - RNA, 13 nt, Staphylococcus aureus subsp. aureus N315
uguuucuuguucu

SEQ ID NO: 2151779 - RNA, 23 nt, Staphylococcus aureus subsp. aureus N315
uguuucuauauuaauaaucuucu

SEQ ID NO: 2151780 - RNA, 15 nt, Staphylococcus aureus subsp. aureus N315
uguuucuauauuaau

SEQ ID NO: 2151781 - RNA, 22 nt, Staphylococcus aureus subsp. aureus N315
uuacaaaugaagguguugaaaa

SEQ ID NO: 2151782 - RNA, 22 nt, Staphylococcus aureus subsp. aureus N315
uuacaaaguuaaccauacauau

SEQ ID NO: 2151783 - RNA, 21 nt, Staphylococcus aureus subsp. aureus N315
uuacaaaucaugacauaaaac

SEQ ID NO: 2151784 - RNA, 17 nt, Staphylococcus aureus subsp. aureus N315
uuacaaaucaugacaua

SEQ ID NO: 2151785 - RNA, 17 nt, Staphylococcus aureus subsp. aureus N315
uuacaaaguuaaccaua

SEQ ID NO: 2151786 - RNA, 21 nt, Staphylococcus aureus subsp. aureus N315
uuacaaaguuaaccauacaua

SEQ ID NO: 2151787 - RNA, 13 nt, Staphylococcus aureus subsp. aureus N315
uuacaaacuucac

SEQ ID NO: 2151788 - RNA, 16 nt, Staphylococcus aureus subsp. aureus N315
uuacaaacuucacauc

SEQ ID NO: 2151789 - RNA, 21 nt, Staphylococcus aureus subsp. aureus N315
uuacaaaagaaucauuuaaau

SEQ ID NO: 2151790 - RNA, 20 nt, Staphylococcus aureus subsp. aureus N315
uuaauuuuucauuaauacaa

SEQ ID NO: 2151791 - RNA, 15 nt, Staphylococcus aureus subsp. aureus N315
uuaauuuuucuaaau

SEQ ID NO: 2151792 - RNA, 12 nt, Staphylococcus aureus subsp. aureus N315
uuaauuuuucaa

SEQ ID NO: 2151793 - RNA, 14 nt, Staphylococcus aureus subsp. aureus N315
uuaauuuuucauua

SEQ ID NO: 2151794 - RNA, 20 nt, Staphylococcus aureus subsp. aureus N315
uuacaacuuuaguuguuagg

SEQ ID NO: 2151795 - RNA, 19 nt, Staphylococcus aureus subsp. aureus N315
uuacaaccuuugguuguua

SEQ ID NO: 2151796 - RNA, 15 nt, Staphylococcus aureus subsp. aureus N315
uuacaccuuuggcac

SEQ ID NO: 2151797 - RNA, 15 nt, Staphylococcus aureus subsp. aureus N315
uuacaccuauaccuc

SEQ ID NO: 2151798 - RNA, 20 nt, Staphylococcus aureus subsp. aureus N315
uuaaugacuucuuuauauuu

SEQ ID NO: 2151799 - RNA, 17 nt, Staphylococcus aureus subsp. aureus N315
uuaauuuagugaaacaa

SEQ ID NO: 2151800 - RNA, 16 nt, Staphylococcus aureus subsp. aureus N315
uuaauuucaacauuac

SEQ ID NO: 2151801 - RNA, 15 nt, Staphylococcus aureus subsp. aureus N315
uuaauuucaacauua

SEQ ID NO: 2151802 - RNA, 14 nt, Staphylococcus aureus subsp. aureus N315
uuaauuuuauuuua

SEQ ID NO: 2151803 - RNA, 16 nt, Staphylococcus aureus subsp. aureus N315
uuaauuuucuuuuuua

SEQ ID NO: 2151804 - RNA, 16 nt, Staphylococcus aureus subsp. aureus N315
uuaauuuacaauuaau

SEQ ID NO: 2151805 - RNA, 21 nt, Staphylococcus aureus subsp. aureus N315
uuaauuuaaguaguuguuaua

SEQ ID NO: 2151806 - RNA, 18 nt, Staphylococcus aureus subsp. aureus N315
uuaauuuaaaucuguacu

SEQ ID NO: 2151807 - RNA, 18 nt, Staphylococcus aureus subsp. aureus N315
uuaauugcuguaaauauu

SEQ ID NO: 2151808 - RNA, 19 nt, Staphylococcus aureus subsp. aureus N315
uuaauugcuguaaauauuc

SEQ ID NO: 2151809 - RNA, 21 nt, Staphylococcus aureus subsp. aureus N315
uuaauugcuuucacauuguuu

SEQ ID NO: 2151810 - RNA, 18 nt, Staphylococcus aureus subsp. aureus N315
uuaauuguuuaauaacaa

SEQ ID NO: 2151811 - RNA, 12 nt, Staphylococcus aureus subsp. aureus N315
uuacccaaaaaa

SEQ ID NO: 2151812 - RNA, 17 nt, Staphylococcus aureus subsp. aureus N315
uuaccauugugaauaau

SEQ ID NO: 2151813 - RNA, 14 nt, Staphylococcus aureus subsp. aureus N315
uuaccaguaucauu

SEQ ID NO: 2151814 - RNA, 15 nt, Staphylococcus aureus subsp. aureus N315
uuacauauugcauuu

SEQ ID NO: 2151815 - RNA, 20 nt, Staphylococcus aureus subsp. aureus N315
uuacauaauuuaucugcaaa

SEQ ID NO: 2151816 - RNA, 15 nt, Staphylococcus aureus subsp. aureus N315
uuacgaucauaaaua

SEQ ID NO: 2151817 - RNA, 14 nt, Staphylococcus aureus subsp. aureus N315
uuacgauaaacuaa

SEQ ID NO: 2151818 - RNA, 21 nt, Staphylococcus aureus subsp. aureus N315
uuacgaucauaaauauuuucu

SEQ ID NO: 2151819 - RNA, 13 nt, Staphylococcus aureus subsp. aureus N315
uuaccuuuaauua

SEQ ID NO: 2151820 - RNA, 16 nt, Staphylococcus aureus subsp. aureus N315
uuagaugcauaaaaaa

SEQ ID NO: 2151821 - RNA, 20 nt, Staphylococcus aureus subsp. aureus N315
uuagaugcauaaaaaaagaa

SEQ ID NO: 2151822 - RNA, 15 nt, Staphylococcus aureus subsp. aureus N315
uuagauaucuuaauc

SEQ ID NO: 2151823 - RNA, 21 nt, Staphylococcus aureus subsp. aureus N315
uuagauauauuugaaagguaa

SEQ ID NO: 2151824 - RNA, 15 nt, Staphylococcus aureus subsp. aureus N315
uuagaugacuuuguc

SEQ ID NO: 2151825 - RNA, 23 nt, Staphylococcus aureus subsp. aureus N315
uuagaugauauuuaacaaaauua

SEQ ID NO: 2151826 - RNA, 17 nt, Staphylococcus aureus subsp. aureus N315
uuagauucacuguauaa

SEQ ID NO: 2151827 - RNA, 14 nt, Staphylococcus aureus subsp. aureus N315
uuagauugacuaag

SEQ ID NO: 2151828 - RNA, 12 nt, Staphylococcus aureus subsp. aureus N315
uuagauuuaaaa

SEQ ID NO: 2151829 - RNA, 15 nt, Staphylococcus aureus subsp. aureus N315
uuagcaaauauuucu

SEQ ID NO: 2151830 - RNA, 17 nt, Staphylococcus aureus subsp. aureus N315
uuagauuuuauauaaaa

SEQ ID NO: 2151831 - RNA, 15 nt, Staphylococcus aureus subsp. aureus N315
uuacuucauaaguca

SEQ ID NO: 2151832 - RNA, 14 nt, Staphylococcus aureus subsp. aureus N315
uuagaaaaauauga

SEQ ID NO: 2151833 - RNA, 18 nt, Staphylococcus aureus subsp. aureus N315
uuagaauaguuaccaaaa

SEQ ID NO: 2151834 - RNA, 14 nt, Staphylococcus aureus subsp. aureus N315
uuagaguuuuuauu

SEQ ID NO: 2151835 - RNA, 18 nt, Staphylococcus aureus subsp. aureus N315
uuagacgcuguuuuaaau

SEQ ID NO: 2151836 - RNA, 17 nt, Staphylococcus aureus subsp. aureus N315
uuagauaaaaauuacua

SEQ ID NO: 2151837 - RNA, 13 nt, Staphylococcus aureus subsp. aureus N315
uuagauaaaaauu

SEQ ID NO: 2151838 - RNA, 15 nt, Staphylococcus aureus subsp. aureus N315
uuagauaauaaggaa

SEQ ID NO: 2151839 - RNA, 16 nt, Staphylococcus aureus subsp. aureus N315
uuacuccuuacaauaa

SEQ ID NO: 2151840 - RNA, 16 nt, Staphylococcus aureus subsp. aureus N315
uuacuacuuaauuaau

SEQ ID NO: 2151841 - RNA, 18 nt, Staphylococcus aureus subsp. aureus N315
uuacuaggaauauaaaac

SEQ ID NO: 2151842 - RNA, 16 nt, Staphylococcus aureus subsp. aureus N315
uuacuaguuuguaaua

SEQ ID NO: 2151843 - RNA, 13 nt, Staphylococcus aureus subsp. aureus N315
uuacuauaaaaaa

SEQ ID NO: 2151844 - RNA, 11 nt, Staphylococcus aureus subsp. aureus N315
uuacuucaguu

SEQ ID NO: 2151845 - RNA, 17 nt, Staphylococcus aureus subsp. aureus N315
uuacuuccauugcuucu

SEQ ID NO: 2151846 - RNA, 13 nt, Staphylococcus aureus subsp. aureus N315
uuacuucaguuug

SEQ ID NO: 2151847 - RNA, 17 nt, Staphylococcus aureus subsp. aureus N315
uuacuuauauauucaau

SEQ ID NO: 2151848 - RNA, 14 nt, Staphylococcus aureus subsp. aureus N315
uuacuguaguacua

SEQ ID NO: 2151849 - RNA, 15 nt, Staphylococcus aureus subsp. aureus N315
uuacuacuuaauuaa

SEQ ID NO: 2151850 - RNA, 16 nt, Staphylococcus aureus subsp. aureus N315
uuacuacgcauuauua

SEQ ID NO: 2151851 - RNA, 15 nt, Staphylococcus aureus subsp. aureus N315
uuacuaccuauuaau

SEQ ID NO: 2151852 - RNA, 21 nt, Staphylococcus aureus subsp. aureus N315
uuacgccaccaguuucaagug

SEQ ID NO: 2151853 - RNA, 19 nt, Staphylococcus aureus subsp. aureus N315
uuaacuuaaaauuuaaaua

SEQ ID NO: 2151854 - RNA, 20 nt, Staphylococcus aureus subsp. aureus N315
uuaacuguacgauucaauuu

SEQ ID NO: 2151855 - RNA, 22 nt, Staphylococcus aureus subsp. aureus N315
uuaacuguacgauucaauuuaa

SEQ ID NO: 2151856 - RNA, 15 nt, Staphylococcus aureus subsp. aureus N315
uuaacuuaaaauuua

SEQ ID NO: 2151857 - RNA, 17 nt, Staphylococcus aureus subsp. aureus N315
uuaacuucauaauauau

SEQ ID NO: 2151858 - RNA, 14 nt, Staphylococcus aureus subsp. aureus N315
uuaacuuuaacauc

SEQ ID NO: 2151859 - RNA, 13 nt, Staphylococcus aureus subsp. aureus N315
uuaacuuuaauua

SEQ ID NO: 2151860 - RNA, 20 nt, Staphylococcus aureus subsp. aureus N315
uuaacuuuccgccuucaauc

SEQ ID NO: 2151861 - RNA, 17 nt, Staphylococcus aureus subsp. aureus N315
uuaagaaacgucuuaau

SEQ ID NO: 2151862 - RNA, 12 nt, Staphylococcus aureus subsp. aureus N315
uuaagcauuugu

SEQ ID NO: 2151863 - RNA, 17 nt, Staphylococcus aureus subsp. aureus N315
uuaacucuugaaacaca

SEQ ID NO: 2151864 - RNA, 14 nt, Staphylococcus aureus subsp. aureus N315
uuaacgcaaaaaua

SEQ ID NO: 2151865 - RNA, 15 nt, Staphylococcus aureus subsp. aureus N315
uuaacaucugaaucu

SEQ ID NO: 2151866 - RNA, 19 nt, Staphylococcus aureus subsp. aureus N315
uuaaccacuccuuaaacaa

SEQ ID NO: 2151867 - RNA, 20 nt, Staphylococcus aureus subsp. aureus N315
uuaacauccugcuuauuaau

SEQ ID NO: 2151868 - RNA, 15 nt, Staphylococcus aureus subsp. aureus N315
uuaacaucaauuacu

SEQ ID NO: 2151869 - RNA, 19 nt, Staphylococcus aureus subsp. aureus N315
uuaacaguuguaaucauug

SEQ ID NO: 2151870 - RNA, 16 nt, Staphylococcus aureus subsp. aureus N315
uuaauaugaacaaaaa

SEQ ID NO: 2151871 - RNA, 20 nt, Staphylococcus aureus subsp. aureus N315
uuaauaugaacaaaaaauaa

SEQ ID NO: 2151872 - RNA, 15 nt, Staphylococcus aureus subsp. aureus N315
uuaauauauuuauuu

SEQ ID NO: 2151873 - RNA, 13 nt, Staphylococcus aureus subsp. aureus N315
uuaauauauuuau

SEQ ID NO: 2151874 - RNA, 14 nt, Staphylococcus aureus subsp. aureus N315
uuaauauauuuauu

SEQ ID NO: 2151875 - RNA, 17 nt, Staphylococcus aureus subsp. aureus N315
uuaauaucacgaucuuu

SEQ ID NO: 2151876 - RNA, 21 nt, Staphylococcus aureus subsp. aureus N315
uuaauaucauauucaaaauaa

SEQ ID NO: 2151877 - RNA, 12 nt, Staphylococcus aureus subsp. aureus N315
uuaauauccaaa

SEQ ID NO: 2151878 - RNA, 14 nt, Staphylococcus aureus subsp. aureus N315
uuaaucauuuaucu

SEQ ID NO: 2151879 - RNA, 16 nt, Staphylococcus aureus subsp. aureus N315
uuaaucauagcauuaa

SEQ ID NO: 2151880 - RNA, 23 nt, Staphylococcus aureus subsp. aureus N315
uuaauacaauucaagaccaugca

SEQ ID NO: 2151881 - RNA, 19 nt, Staphylococcus aureus subsp. aureus N315
uuaauaauuuguuuuauuu

SEQ ID NO: 2151882 - RNA, 20 nt, Staphylococcus aureus subsp. aureus N315
uuaauaauuuuuuuccuuuc

SEQ ID NO: 2151883 - RNA, 16 nt, Staphylococcus aureus subsp. aureus N315
uuaauauaauuaauuu

SEQ ID NO: 2151884 - RNA, 14 nt, Staphylococcus aureus subsp. aureus N315
uuaauauaauaccu

SEQ ID NO: 2151885 - RNA, 22 nt, Staphylococcus aureus subsp. aureus N315
uuaauauaaauuuugaauuaca

SEQ ID NO: 2151886 - RNA, 13 nt, Staphylococcus aureus subsp. aureus N315
uuaauaccuauga

SEQ ID NO: 2151887 - RNA, 15 nt, Staphylococcus aureus subsp. aureus N315
uuaauauaaauauca

SEQ ID NO: 2151888 - RNA, 17 nt, Staphylococcus aureus subsp. aureus N315
uuaauauaaauaucaau

SEQ ID NO: 2151889 - RNA, 23 nt, Staphylococcus aureus subsp. aureus N315
uuaaguaaucugcaaaugccucu

SEQ ID NO: 2151890 - RNA, 14 nt, Staphylococcus aureus subsp. aureus N315
uuaaguacagcaua

SEQ ID NO: 2151891 - RNA, 13 nt, Staphylococcus aureus subsp. aureus N315
uuaauaauguaca

SEQ ID NO: 2151892 - RNA, 22 nt, Staphylococcus aureus subsp. aureus N315
uuaauaaauuuaacguuauuca

SEQ ID NO: 2151893 - RNA, 12 nt, Staphylococcus aureus subsp. aureus N315
uuaauaauuaau

SEQ ID NO: 2151894 - RNA, 13 nt, Staphylococcus aureus subsp. aureus N315
uuaauaaauuuaa

SEQ ID NO: 2151895 - RNA, 20 nt, Staphylococcus aureus subsp. aureus N315
uuaauaaauuguaugaauaa

SEQ ID NO: 2151896 - RNA, 13 nt, Staphylococcus aureus subsp. aureus N315
uuaaguuuuucag

SEQ ID NO: 2151897 - RNA, 12 nt, Staphylococcus aureus subsp. aureus N315
uuaauaaaccua

SEQ ID NO: 2151898 - RNA, 15 nt, Staphylococcus aureus subsp. aureus N315
uuaaauaaugauaaa

SEQ ID NO: 2151899 - RNA, 21 nt, Staphylococcus aureus subsp. aureus N315
uuaaauacaauuucuucauuu

SEQ ID NO: 2151900 - RNA, 15 nt, Staphylococcus aureus subsp. aureus N315
uuaaauaagcuacua

SEQ ID NO: 2151901 - RNA, 22 nt, Staphylococcus aureus subsp. aureus N315
uuaaauaaucgaaaauuucagg

SEQ ID NO: 2151902 - RNA, 21 nt, Staphylococcus aureus subsp. aureus N315
uuaaauaggugauuauauaua

SEQ ID NO: 2151903 - RNA, 19 nt, Staphylococcus aureus subsp. aureus N315
uuaaauacgccaaauauca

SEQ ID NO: 2151904 - RNA, 14 nt, Staphylococcus aureus subsp. aureus N315
uuaaauacuauaua

SEQ ID NO: 2151905 - RNA, 22 nt, Staphylococcus aureus subsp. aureus N315
uuaaaucauugcgugcuucacu

SEQ ID NO: 2151906 - RNA, 15 nt, Staphylococcus aureus subsp. aureus N315
uuaaaucuaauuauu

SEQ ID NO: 2151907 - RNA, 14 nt, Staphylococcus aureus subsp. aureus N315
uuaaauaucaugca

SEQ ID NO: 2151908 - RNA, 18 nt, Staphylococcus aureus subsp. aureus N315
uuaaauaugaauaaugca

SEQ ID NO: 2151909 - RNA, 15 nt, Staphylococcus aureus subsp. aureus N315
uuaaauauucuuauc

SEQ ID NO: 2151910 - RNA, 19 nt, Staphylococcus aureus subsp. aureus N315
uuaaauauugauauaaaaa

SEQ ID NO: 2151911 - RNA, 14 nt, Staphylococcus aureus subsp. aureus N315
uuaaauauuuaauu

SEQ ID NO: 2151912 - RNA, 14 nt, Staphylococcus aureus subsp. aureus N315
uuaaagguuaaaua

SEQ ID NO: 2151913 - RNA, 22 nt, Staphylococcus aureus subsp. aureus N315
uuaaaguaaccacaacaaugca

SEQ ID NO: 2151914 - RNA, 15 nt, Staphylococcus aureus subsp. aureus N315
uuaaagguuaaauau

SEQ ID NO: 2151915 - RNA, 14 nt, Staphylococcus aureus subsp. aureus N315
uuaaagucaguaua

SEQ ID NO: 2151916 - RNA, 17 nt, Staphylococcus aureus subsp. aureus N315
uuaaaguagaaccuaua

SEQ ID NO: 2151917 - RNA, 24 nt, Staphylococcus aureus subsp. aureus N315
uuaaaggaaaucaauccaucaaua

SEQ ID NO: 2151918 - RNA, 22 nt, Staphylococcus aureus subsp. aureus N315
uuaaagucuguugguuuaucag

SEQ ID NO: 2151919 - RNA, 23 nt, Staphylococcus aureus subsp. aureus N315
uuaaagucuguugguuuaucagc

SEQ ID NO: 2151920 - RNA, 11 nt, Staphylococcus aureus subsp. aureus N315
uuaaagucuuc

SEQ ID NO: 2151921 - RNA, 22 nt, Staphylococcus aureus subsp. aureus N315
uuaaaguguuucaacauauuau

SEQ ID NO: 2151922 - RNA, 14 nt, Staphylococcus aureus subsp. aureus N315
uuaaaguuuaaaua

SEQ ID NO: 2151923 - RNA, 13 nt, Staphylococcus aureus subsp. aureus N315
uuaaauaaaaaua

SEQ ID NO: 2151924 - RNA, 18 nt, Staphylococcus aureus subsp. aureus N315
uuaaaguuuaaauauuca

SEQ ID NO: 2151925 - RNA, 17 nt, Staphylococcus aureus subsp. aureus N315
uuaaaguuuaaauauuc

SEQ ID NO: 2151926 - RNA, 22 nt, Staphylococcus aureus subsp. aureus N315
uuaaaguuuuguucaauaugau

SEQ ID NO: 2151927 - RNA, 13 nt, Staphylococcus aureus subsp. aureus N315
uuaaaucuucuag

SEQ ID NO: 2151928 - RNA, 21 nt, Staphylococcus aureus subsp. aureus N315
uuaaaucuucuaguaauucuu

SEQ ID NO: 2151929 - RNA, 22 nt, Staphylococcus aureus subsp. aureus N315
uuaaaucugcuugugugucauu

SEQ ID NO: 2151930 - RNA, 20 nt, Staphylococcus aureus subsp. aureus N315
uuaaaucuucaagugccauu

SEQ ID NO: 2151931 - RNA, 15 nt, Staphylococcus aureus subsp. aureus N315
uuaaaucuauauaaa

SEQ ID NO: 2151932 - RNA, 16 nt, Staphylococcus aureus subsp. aureus N315
uuaaaugauuuaauaa

SEQ ID NO: 2151933 - RNA, 20 nt, Staphylococcus aureus subsp. aureus N315
uuaaaugcccaccauguaca

SEQ ID NO: 2151934 - RNA, 21 nt, Staphylococcus aureus subsp. aureus N315
uuaaauguacauuguaaauau

SEQ ID NO: 2151935 - RNA, 14 nt, Staphylococcus aureus subsp. aureus N315
uuaaauuaaagcaa

SEQ ID NO: 2151936 - RNA, 14 nt, Staphylococcus aureus subsp. aureus N315
uuaaauuaagaaua

SEQ ID NO: 2151937 - RNA, 18 nt, Staphylococcus aureus subsp. aureus N315
uuaaaugucuuucaaaua

SEQ ID NO: 2151938 - RNA, 21 nt, Staphylococcus aureus subsp. aureus N315
uuaaauuagggugaacaguua

SEQ ID NO: 2151939 - RNA, 14 nt, Staphylococcus aureus subsp. aureus N315
uuaaauuauauacc

SEQ ID NO: 2151940 - RNA, 16 nt, Staphylococcus aureus subsp. aureus N315
uuaaauuauauaccca

SEQ ID NO: 2151941 - RNA, 18 nt, Staphylococcus aureus subsp. aureus N315
uuaaauucauuuuaagug

SEQ ID NO: 2151942 - RNA, 15 nt, Staphylococcus aureus subsp. aureus N315
uuaaauuauuuaauu

SEQ ID NO: 2151943 - RNA, 15 nt, Staphylococcus aureus subsp. aureus N315
uuaaauuuaaaagaa

SEQ ID NO: 2151944 - RNA, 13 nt, Staphylococcus aureus subsp. aureus N315
uuaaauuuaaaag

SEQ ID NO: 2151945 - RNA, 21 nt, Staphylococcus aureus subsp. aureus N315
uuaaauugcuugaaauuauua

SEQ ID NO: 2151946 - RNA, 18 nt, Staphylococcus aureus subsp. aureus N315
uuaaauucuuauaaaaua

SEQ ID NO: 2151947 - RNA, 19 nt, Staphylococcus aureus subsp. aureus N315
uuaaauucuuauaaaauaa

SEQ ID NO: 2151948 - RNA, 21 nt, Staphylococcus aureus subsp. aureus N315
uuaaauucuuauaaaauaaaa

SEQ ID NO: 2151949 - RNA, 21 nt, Staphylococcus aureus subsp. aureus N315
uuaacaauauucguaaauccu

SEQ ID NO: 2151950 - RNA, 14 nt, Staphylococcus aureus subsp. aureus N315
uuaacaauauuaaa

SEQ ID NO: 2151951 - RNA, 15 nt, Staphylococcus aureus subsp. aureus N315
uuaacaacuuuaauu

SEQ ID NO: 2151952 - RNA, 14 nt, Staphylococcus aureus subsp. aureus N315
uuaaauuuauaaua

SEQ ID NO: 2151953 - RNA, 22 nt, Staphylococcus aureus subsp. aureus N315
uuaaauuuauacagcugucacu

SEQ ID NO: 2151954 - RNA, 14 nt, Staphylococcus aureus subsp. aureus N315
uuaaauuucugaac

SEQ ID NO: 2151955 - RNA, 16 nt, Staphylococcus aureus subsp. aureus N315
uuaaauuuaauuucga

SEQ ID NO: 2151956 - RNA, 17 nt, Staphylococcus aureus subsp. aureus N315
uuaaauuuguguucaaa

SEQ ID NO: 2151957 - RNA, 19 nt, Staphylococcus aureus subsp. aureus N315
uuaaauuuucaucauaauc

SEQ ID NO: 2151958 - RNA, 13 nt, Staphylococcus aureus subsp. aureus N315
uuaaauuuucauc

SEQ ID NO: 2151959 - RNA, 14 nt, Staphylococcus aureus subsp. aureus N315
uuaaauuuuaaguu

SEQ ID NO: 2151960 - RNA, 18 nt, Staphylococcus aureus subsp. aureus N315
uuaaauuucugaacauaa

SEQ ID NO: 2151961 - RNA, 15 nt, Staphylococcus aureus subsp. aureus N315
uuaaauuugaaagua

SEQ ID NO: 2151962 - RNA, 16 nt, Staphylococcus aureus subsp. aureus N315
uuaacaacaaauauaa

SEQ ID NO: 2151963 - RNA, 14 nt, Staphylococcus aureus subsp. aureus N315
uuaacaacaaauau

SEQ ID NO: 2151964 - RNA, 15 nt, Staphylococcus aureus subsp. aureus N315
uuaacaacaaauaua

SEQ ID NO: 2151965 - RNA, 14 nt, Staphylococcus aureus subsp. aureus N315
ucuauaaagaauga

SEQ ID NO: 2151966 - RNA, 13 nt, Staphylococcus aureus subsp. aureus N315
ucuauaaaaagaa

SEQ ID NO: 2151967 - RNA, 23 nt, Staphylococcus aureus subsp. aureus N315
ucuauacauuccaaaguaccauc

SEQ ID NO: 2151968 - RNA, 14 nt, Staphylococcus aureus subsp. aureus N315
ucuauaauuuuaau

SEQ ID NO: 2151969 - RNA, 15 nt, Staphylococcus aureus subsp. aureus N315
ucuauaauuuuaauu

SEQ ID NO: 2151970 - RNA, 16 nt, Staphylococcus aureus subsp. aureus N315
ucuauaauuuuaauua

SEQ ID NO: 2151971 - RNA, 15 nt, Staphylococcus aureus subsp. aureus N315
ucuauacaacaguaa

SEQ ID NO: 2151972 - RNA, 15 nt, Staphylococcus aureus subsp. aureus N315
ucuauaucuauuuau

SEQ ID NO: 2151973 - RNA, 16 nt, Staphylococcus aureus subsp. aureus N315
ucuauauuaauagaaa

SEQ ID NO: 2151974 - RNA, 12 nt, Staphylococcus aureus subsp. aureus N315
ucuauaugcaua

SEQ ID NO: 2151975 - RNA, 19 nt, Staphylococcus aureus subsp. aureus N315
ucuauauaguaaaauaaau

SEQ ID NO: 2151976 - RNA, 19 nt, Staphylococcus aureus subsp. aureus N315
ucuauacuuuuaauuguau

SEQ ID NO: 2151977 - RNA, 17 nt, Staphylococcus aureus subsp. aureus N315
ucuauagguuuauaaaa

SEQ ID NO: 2151978 - RNA, 16 nt, Staphylococcus aureus subsp. aureus N315
ucuauauaaaaacugu

SEQ ID NO: 2151979 - RNA, 16 nt, Staphylococcus aureus subsp. aureus N315
ucuaugucaaauugaa

SEQ ID NO: 2151980 - RNA, 14 nt, Staphylococcus aureus subsp. aureus N315
ucuaugucaaauug

SEQ ID NO: 2151981 - RNA, 16 nt, Staphylococcus aureus subsp. aureus N315
ucuaugaauaauguuu

SEQ ID NO: 2151982 - RNA, 21 nt, Staphylococcus aureus subsp. aureus N315
ucuaucuccgcuacaauuaua

SEQ ID NO: 2151983 - RNA, 19 nt, Staphylococcus aureus subsp. aureus N315
ucuaucaguaugaaguugc

SEQ ID NO: 2151984 - RNA, 12 nt, Staphylococcus aureus subsp. aureus N315
ucuaucaaauua

SEQ ID NO: 2151985 - RNA, 13 nt, Staphylococcus aureus subsp. aureus N315
ucuauccuucaaa

SEQ ID NO: 2151986 - RNA, 18 nt, Staphylococcus aureus subsp. aureus N315
ucuaucgguauaucuaaa

SEQ ID NO: 2151987 - RNA, 17 nt, Staphylococcus aureus subsp. aureus N315
ucuaucgguaauuuuug

SEQ ID NO: 2151988 - RNA, 16 nt, Staphylococcus aureus subsp. aureus N315
ucuaucgccuaaaaau

SEQ ID NO: 2151989 - RNA, 13 nt, Staphylococcus aureus subsp. aureus N315
aaaugauaucuau

SEQ ID NO: 2151990 - RNA, 16 nt, Staphylococcus aureus subsp. aureus N315
aaaugauaauuuaaua

SEQ ID NO: 2151991 - RNA, 20 nt, Staphylococcus aureus subsp. aureus N315
aaaugauagggcauugagau

SEQ ID NO: 2151992 - RNA, 18 nt, Staphylococcus aureus subsp. aureus N315
aaaugauauacuugaaga

SEQ ID NO: 2151993 - RNA, 19 nt, Staphylococcus aureus subsp. aureus N315
aaaugauauacuugaagaa

SEQ ID NO: 2151994 - RNA, 15 nt, Staphylococcus aureus subsp. aureus N315
aaaugauacauuauu

SEQ ID NO: 2151995 - RNA, 20 nt, Staphylococcus aureus subsp. aureus N315
aaaugauacauuauuaaaua

SEQ ID NO: 2151996 - RNA, 12 nt, Staphylococcus aureus subsp. aureus N315
ucuagaauauaa

SEQ ID NO: 2151997 - RNA, 15 nt, Staphylococcus aureus subsp. aureus N315
ucuagagauaacuag

SEQ ID NO: 2151998 - RNA, 17 nt, Staphylococcus aureus subsp. aureus N315
ucuagagauaacuagaa

SEQ ID NO: 2151999 - RNA, 13 nt, Staphylococcus aureus subsp. aureus N315
ucuagaugaaauu

SEQ ID NO: 2152000 - RNA, 21 nt, Staphylococcus aureus subsp. aureus N315
ucuagcguagcgaaaguaucu

SEQ ID NO: 2152001 - RNA, 18 nt, Staphylococcus aureus subsp. aureus N315
ucuaguaccucuuuauuu

SEQ ID NO: 2152002 - RNA, 19 nt, Staphylococcus aureus subsp. aureus N315
ucuagcuuuagucguuugu

SEQ ID NO: 2152003 - RNA, 19 nt, Staphylococcus aureus subsp. aureus N315
aaaugcacugagcaacaaa

SEQ ID NO: 2152004 - RNA, 21 nt, Staphylococcus aureus subsp. aureus N315
aaaugcaauuuuucacuuaua

SEQ ID NO: 2152005 - RNA, 13 nt, Staphylococcus aureus subsp. aureus N315
aaaugcaauacau

SEQ ID NO: 2152006 - RNA, 19 nt, Staphylococcus aureus subsp. aureus N315
aaaugcacgagcaacaucu

SEQ ID NO: 2152007 - RNA, 21 nt, Staphylococcus aureus subsp. aureus N315
aaaugcacgagcaacaucuuu

SEQ ID NO: 2152008 - RNA, 18 nt, Staphylococcus aureus subsp. aureus N315
aaaugauuguuuuaagug

SEQ ID NO: 2152009 - RNA, 20 nt, Staphylococcus aureus subsp. aureus N315
aaaugauuuauucuaaauau

SEQ ID NO: 2152010 - RNA, 22 nt, Staphylococcus aureus subsp. aureus N315
aaaugauuuauucuaaauauau

SEQ ID NO: 2152011 - RNA, 14 nt, Staphylococcus aureus subsp. aureus N315
aaaugauuucacuu

SEQ ID NO: 2152012 - RNA, 13 nt, Staphylococcus aureus subsp. aureus N315
aaaugauucuuua

SEQ ID NO: 2152013 - RNA, 20 nt, Staphylococcus aureus subsp. aureus N315
ucucaucuauuuaauaaugu

SEQ ID NO: 2152014 - RNA, 13 nt, Staphylococcus aureus subsp. aureus N315
ucucaucuucuaa

SEQ ID NO: 2152015 - RNA, 17 nt, Staphylococcus aureus subsp. aureus N315
ucucaucgaauucauuu

SEQ ID NO: 2152016 - RNA, 14 nt, Staphylococcus aureus subsp. aureus N315
ucucaucauuuaaa

SEQ ID NO: 2152017 - RNA, 17 nt, Staphylococcus aureus subsp. aureus N315
ucucauagucaucuuag

SEQ ID NO: 2152018 - RNA, 13 nt, Staphylococcus aureus subsp. aureus N315
ucucauaauaauu

SEQ ID NO: 2152019 - RNA, 14 nt, Staphylococcus aureus subsp. aureus N315
ucucagcaauacua

SEQ ID NO: 2152020 - RNA, 20 nt, Staphylococcus aureus subsp. aureus N315
ucucagccucuuuuuacauu

SEQ ID NO: 2152021 - RNA, 21 nt, Staphylococcus aureus subsp. aureus N315
aaaugccaacuauaccuaggg

SEQ ID NO: 2152022 - RNA, 21 nt, Staphylococcus aureus subsp. aureus N315
aaaugcgcuuccaauuuaaaa

SEQ ID NO: 2152023 - RNA, 14 nt, Staphylococcus aureus subsp. aureus N315
ucuauuaaugcucu

SEQ ID NO: 2152024 - RNA, 16 nt, Staphylococcus aureus subsp. aureus N315
ucuauuccuucuaaca

SEQ ID NO: 2152025 - RNA, 17 nt, Staphylococcus aureus subsp. aureus N315
ucuauuccuucuaacau

SEQ ID NO: 2152026 - RNA, 17 nt, Staphylococcus aureus subsp. aureus N315
ucuauugcaauauaguu

SEQ ID NO: 2152027 - RNA, 18 nt, Staphylococcus aureus subsp. aureus N315
ucuauuuacggcauaauu

SEQ ID NO: 2152028 - RNA, 22 nt, Staphylococcus aureus subsp. aureus N315
ucuauuuagcuugcuuacaaua

SEQ ID NO: 2152029 - RNA, 21 nt, Staphylococcus aureus subsp. aureus N315
ucuauugugauauaugaaaua

SEQ ID NO: 2152030 - RNA, 16 nt, Staphylococcus aureus subsp. aureus N315
ucuauuuaauaaugua

SEQ ID NO: 2152031 - RNA, 17 nt, Staphylococcus aureus subsp. aureus N315
ucuauuuuauaauaaau

SEQ ID NO: 2152032 - RNA, 19 nt, Staphylococcus aureus subsp. aureus N315
ucuauuuuauaauaaauuu

SEQ ID NO: 2152033 - RNA, 13 nt, Staphylococcus aureus subsp. aureus N315
ucuauuuuauaaa

SEQ ID NO: 2152034 - RNA, 14 nt, Staphylococcus aureus subsp. aureus N315
ucuauuuuauaaaa

SEQ ID NO: 2152035 - RNA, 15 nt, Staphylococcus aureus subsp. aureus N315
ucuauuuuauaaaau

SEQ ID NO: 2152036 - RNA, 16 nt, Staphylococcus aureus subsp. aureus N315
ucuauuuuauaaaaua

SEQ ID NO: 2152037 - RNA, 13 nt, Staphylococcus aureus subsp. aureus N315
ucucaacagcaaa

SEQ ID NO: 2152038 - RNA, 22 nt, Staphylococcus aureus subsp. aureus N315
ucucaacagcaaaaaauaaauc

SEQ ID NO: 2152039 - RNA, 20 nt, Staphylococcus aureus subsp. aureus N315
ucuauuuuaugauuugauuu

SEQ ID NO: 2152040 - RNA, 19 nt, Staphylococcus aureus subsp. aureus N315
ucuauuuuaugauuugauu

SEQ ID NO: 2152041 - RNA, 20 nt, Staphylococcus aureus subsp. aureus N315
ucuauuuuugauuuaauaau

SEQ ID NO: 2152042 - RNA, 18 nt, Staphylococcus aureus subsp. aureus N315
ucucaaugugagauauaa

SEQ ID NO: 2152043 - RNA, 14 nt, Staphylococcus aureus subsp. aureus N315
ucucaacgauaaga

SEQ ID NO: 2152044 - RNA, 20 nt, Staphylococcus aureus subsp. aureus N315
ucuaaugggucaaugacuga

SEQ ID NO: 2152045 - RNA, 22 nt, Staphylococcus aureus subsp. aureus N315
ucuaaugauuaaaaaucaaaga

SEQ ID NO: 2152046 - RNA, 17 nt, Staphylococcus aureus subsp. aureus N315
ucuaaugcuaauuuaac

SEQ ID NO: 2152047 - RNA, 17 nt, Staphylococcus aureus subsp. aureus N315
ucuaaucuucacgcuua

SEQ ID NO: 2152048 - RNA, 18 nt, Staphylococcus aureus subsp. aureus N315
ucuaauacuuucacuuuu

SEQ ID NO: 2152049 - RNA, 22 nt, Staphylococcus aureus subsp. aureus N315
ucuaauacuuucacuuuuuaua

SEQ ID NO: 2152050 - RNA, 18 nt, Staphylococcus aureus subsp. aureus N315
ucuaauacuuucaaacaa

SEQ ID NO: 2152051 - RNA, 17 nt, Staphylococcus aureus subsp. aureus N315
ucuaauacauacugauu

SEQ ID NO: 2152052 - RNA, 21 nt, Staphylococcus aureus subsp. aureus N315
ucuaauacauacugauuaaac

SEQ ID NO: 2152053 - RNA, 18 nt, Staphylococcus aureus subsp. aureus N315
ucuaauccaaaauaaucg

SEQ ID NO: 2152054 - RNA, 14 nt, Staphylococcus aureus subsp. aureus N315
ucuaauccaaaaua

SEQ ID NO: 2152055 - RNA, 20 nt, Staphylococcus aureus subsp. aureus N315
ucuaaucgcauuuuuuauuc

SEQ ID NO: 2152056 - RNA, 21 nt, Staphylococcus aureus subsp. aureus N315
ucuaaucgacuuuuacaauca

SEQ ID NO: 2152057 - RNA, 17 nt, Staphylococcus aureus subsp. aureus N315
ucuaauuauucaugaau

SEQ ID NO: 2152058 - RNA, 22 nt, Staphylococcus aureus subsp. aureus N315
ucuaauucaaugauuuuuaaaa

SEQ ID NO: 2152059 - RNA, 14 nt, Staphylococcus aureus subsp. aureus N315
ucuaauucaaugau

SEQ ID NO: 2152060 - RNA, 18 nt, Staphylococcus aureus subsp. aureus N315
ucuaauuauucaugaauc

SEQ ID NO: 2152061 - RNA, 18 nt, Staphylococcus aureus subsp. aureus N315
ucuaauucaaguguauua

SEQ ID NO: 2152062 - RNA, 14 nt, Staphylococcus aureus subsp. aureus N315
ucuaauucugaaau

SEQ ID NO: 2152063 - RNA, 13 nt, Staphylococcus aureus subsp. aureus N315
ucuaauuucacaa

SEQ ID NO: 2152064 - RNA, 21 nt, Staphylococcus aureus subsp. aureus N315
ucuaauuguuguaauucuuuu

SEQ ID NO: 2152065 - RNA, 20 nt, Staphylococcus aureus subsp. aureus N315
ucuaauuugcaaaaucaacc

SEQ ID NO: 2152066 - RNA, 13 nt, Staphylococcus aureus subsp. aureus N315
ucuaauuuuccua

SEQ ID NO: 2152067 - RNA, 14 nt, Staphylococcus aureus subsp. aureus N315
ucuaauuuuccuag

SEQ ID NO: 2152068 - RNA, 16 nt, Staphylococcus aureus subsp. aureus N315
ucuacaauauuaaaau

SEQ ID NO: 2152069 - RNA, 19 nt, Staphylococcus aureus subsp. aureus N315
ucuacaauauucaauaauu

SEQ ID NO: 2152070 - RNA, 18 nt, Staphylococcus aureus subsp. aureus N315
ucuacaaacaaugcaagu

SEQ ID NO: 2152071 - RNA, 20 nt, Staphylococcus aureus subsp. aureus N315
ucuacaacuucauuaguugc

SEQ ID NO: 2152072 - RNA, 23 nt, Staphylococcus aureus subsp. aureus N315
ucuacauuauauugagacaacau

SEQ ID NO: 2152073 - RNA, 23 nt, Staphylococcus aureus subsp. aureus N315
ucuacaugaaucaacaauuuaaa

SEQ ID NO: 2152074 - RNA, 23 nt, Staphylococcus aureus subsp. aureus N315
ucuacauacaacucguuuuucca

SEQ ID NO: 2152075 - RNA, 15 nt, Staphylococcus aureus subsp. aureus N315
ucuacauaauuugaa

SEQ ID NO: 2152076 - RNA, 22 nt, Staphylococcus aureus subsp. aureus N315
ucuacagguaaugcaaguuggg

SEQ ID NO: 2152077 - RNA, 22 nt, Staphylococcus aureus subsp. aureus N315
ucuacaggcaaugcaaguuggc

SEQ ID NO: 2152078 - RNA, 18 nt, Staphylococcus aureus subsp. aureus N315
ucuacaggcaaugcaagu

SEQ ID NO: 2152079 - RNA, 21 nt, Staphylococcus aureus subsp. aureus N315
ucuacagcaucaccuaaagcu

SEQ ID NO: 2152080 - RNA, 13 nt, Staphylococcus aureus subsp. aureus N315
ucuaccuuuuaau

SEQ ID NO: 2152081 - RNA, 18 nt, Staphylococcus aureus subsp. aureus N315
ucuacuauuuuuucuaau

SEQ ID NO: 2152082 - RNA, 22 nt, Staphylococcus aureus subsp. aureus N315
ucuacuauuuuuucuaauucaa

SEQ ID NO: 2152083 - RNA, 21 nt, Staphylococcus aureus subsp. aureus N315
ucuacuaauauucuaggcaaa

SEQ ID NO: 2152084 - RNA, 22 nt, Staphylococcus aureus subsp. aureus N315
ucuacucgaaaccagcuuacug

SEQ ID NO: 2152085 - RNA, 13 nt, Staphylococcus aureus subsp. aureus N315
ucuacuuuguucu

SEQ ID NO: 2152086 - RNA, 16 nt, Staphylococcus aureus subsp. aureus N315
ucuaccaauacguuuc

SEQ ID NO: 2152087 - RNA, 18 nt, Staphylococcus aureus subsp. aureus N315
aaaugacuucacauuuau

SEQ ID NO: 2152088 - RNA, 17 nt, Staphylococcus aureus subsp. aureus N315
ucuaccaauaauucccu

SEQ ID NO: 2152089 - RNA, 22 nt, Staphylococcus aureus subsp. aureus N315
ucuacccauaauuuaaaugaua

SEQ ID NO: 2152090 - RNA, 14 nt, Staphylococcus aureus subsp. aureus N315
aaaugaaguuuuua

SEQ ID NO: 2152091 - RNA, 19 nt, Staphylococcus aureus subsp. aureus N315
aaaugaaugaagacgaaua

SEQ ID NO: 2152092 - RNA, 19 nt, Staphylococcus aureus subsp. aureus N315
aaaugaauugucuuaauau

SEQ ID NO: 2152093 - RNA, 16 nt, Staphylococcus aureus subsp. aureus N315
aaaugacuaccuguug

SEQ ID NO: 2152094 - RNA, 23 nt, Staphylococcus aureus subsp. aureus N315
aaaugacgugcuuuuaaauguau

SEQ ID NO: 2152095 - RNA, 15 nt, Staphylococcus aureus subsp. aureus N315
aaaugacauuuaaua

SEQ ID NO: 2152096 - RNA, 21 nt, Staphylococcus aureus subsp. aureus N315
aaaucuuaugaugucauguau

SEQ ID NO: 2152097 - RNA, 21 nt, Staphylococcus aureus subsp. aureus N315
aaaucuuguuggauuuuaaca

SEQ ID NO: 2152098 - RNA, 22 nt, Staphylococcus aureus subsp. aureus N315
aaaucuuguuggauuuuaacaa

SEQ ID NO: 2152099 - RNA, 16 nt, Staphylococcus aureus subsp. aureus N315
aaaucuucuauuuuca

SEQ ID NO: 2152100 - RNA, 16 nt, Staphylococcus aureus subsp. aureus N315
ucuaacuuaccaugau

SEQ ID NO: 2152101 - RNA, 17 nt, Staphylococcus aureus subsp. aureus N315
ucuaacuuuaccaauau

SEQ ID NO: 2152102 - RNA, 21 nt, Staphylococcus aureus subsp. aureus N315
ucuaacuuuaccaauaucaug

SEQ ID NO: 2152103 - RNA, 19 nt, Staphylococcus aureus subsp. aureus N315
ucuaacggcguuuguuucu

SEQ ID NO: 2152104 - RNA, 15 nt, Staphylococcus aureus subsp. aureus N315
ucuaacgguaaauaa

SEQ ID NO: 2152105 - RNA, 16 nt, Staphylococcus aureus subsp. aureus N315
ucuaacguuaacaaua

SEQ ID NO: 2152106 - RNA, 14 nt, Staphylococcus aureus subsp. aureus N315
ucuaacugaauuaa

SEQ ID NO: 2152107 - RNA, 14 nt, Staphylococcus aureus subsp. aureus N315
ucuaaguaauauaa

SEQ ID NO: 2152108 - RNA, 15 nt, Staphylococcus aureus subsp. aureus N315
ucuaauacauacuga

SEQ ID NO: 2152109 - RNA, 16 nt, Staphylococcus aureus subsp. aureus N315
ucuaauacauacugau

SEQ ID NO: 2152110 - RNA, 14 nt, Staphylococcus aureus subsp. aureus N315
aaaugaaaaaguaa

SEQ ID NO: 2152111 - RNA, 15 nt, Staphylococcus aureus subsp. aureus N315
aaaugaaacuuugug

SEQ ID NO: 2152112 - RNA, 22 nt, Staphylococcus aureus subsp. aureus N315
aaaucuuuugagacguuuucca

SEQ ID NO: 2152113 - RNA, 20 nt, Staphylococcus aureus subsp. aureus N315
aaaucuuuuagcuuuuguaa

SEQ ID NO: 2152114 - RNA, 14 nt, Staphylococcus aureus subsp. aureus N315
aaaucuuuuaaauu

SEQ ID NO: 2152115 - RNA, 13 nt, Staphylococcus aureus subsp. aureus N315
aaaucuuuaaaug

SEQ ID NO: 2152116 - RNA, 14 nt, Staphylococcus aureus subsp. aureus N315
aaaucuuuaaaugu

SEQ ID NO: 2152117 - RNA, 21 nt, Staphylococcus aureus subsp. aureus N315
aaaucuuuaaauguaucacuu

SEQ ID NO: 2152118 - RNA, 23 nt, Staphylococcus aureus subsp. aureus N315
aaaucuuuacuuguaauuaauac

SEQ ID NO: 2152119 - RNA, 18 nt, Staphylococcus aureus subsp. aureus N315
ucuaaagcuauaaaaaau

SEQ ID NO: 2152120 - RNA, 18 nt, Staphylococcus aureus subsp. aureus N315
ucuaaacuauaauaauug

SEQ ID NO: 2152121 - RNA, 16 nt, Staphylococcus aureus subsp. aureus N315
ucuaaacuauaauaau

SEQ ID NO: 2152122 - RNA, 11 nt, Staphylococcus aureus subsp. aureus N315
ucuaaaucuug

SEQ ID NO: 2152123 - RNA, 19 nt, Staphylococcus aureus subsp. aureus N315
ucuaaauauaauagaaaua

SEQ ID NO: 2152124 - RNA, 18 nt, Staphylococcus aureus subsp. aureus N315
ucuaaauaauuucucaaa

SEQ ID NO: 2152125 - RNA, 14 nt, Staphylococcus aureus subsp. aureus N315
ucuaaauaaaauua

SEQ ID NO: 2152126 - RNA, 14 nt, Staphylococcus aureus subsp. aureus N315
ucuaacaguuaaua

SEQ ID NO: 2152127 - RNA, 16 nt, Staphylococcus aureus subsp. aureus N315
ucuaacaauauauaau

SEQ ID NO: 2152128 - RNA, 11 nt, Staphylococcus aureus subsp. aureus N315
ucuaacauuuu

SEQ ID NO: 2152129 - RNA, 22 nt, Staphylococcus aureus subsp. aureus N315
ucuaaaugcacgagcaacaucu

SEQ ID NO: 2152130 - RNA, 13 nt, Staphylococcus aureus subsp. aureus N315
ucuaaauucuuuu

SEQ ID NO: 2152131 - RNA, 12 nt, Staphylococcus aureus subsp. aureus N315
ucguuuuuacug

SEQ ID NO: 2152132 - RNA, 17 nt, Staphylococcus aureus subsp. aureus N315
ucguuuuuacuguaauc

SEQ ID NO: 2152133 - RNA, 16 nt, Staphylococcus aureus subsp. aureus N315
ucguuuuaauaaauug

SEQ ID NO: 2152134 - RNA, 13 nt, Staphylococcus aureus subsp. aureus N315
ucuaaaaaauuaa

SEQ ID NO: 2152135 - RNA, 13 nt, Staphylococcus aureus subsp. aureus N315
ucguuuuuccaug

SEQ ID NO: 2152136 - RNA, 13 nt, Staphylococcus aureus subsp. aureus N315
ucuaaaaacauaa

SEQ ID NO: 2152137 - RNA, 16 nt, Staphylococcus aureus subsp. aureus N315
ucuaaaaacauaaaaa

SEQ ID NO: 2152138 - RNA, 21 nt, Staphylococcus aureus subsp. aureus N315
ucguuuuuucauuguaauaau

SEQ ID NO: 2152139 - RNA, 13 nt, Staphylococcus aureus subsp. aureus N315
ucuaaaacauguu

SEQ ID NO: 2152140 - RNA, 16 nt, Staphylococcus aureus subsp. aureus N315
ucuaaaacggaaauaa

SEQ ID NO: 2152141 - RNA, 17 nt, Staphylococcus aureus subsp. aureus N315
ucuaaaaguuguaauuu

SEQ ID NO: 2152142 - RNA, 23 nt, Staphylococcus aureus subsp. aureus N315
ucuaaaaguuguaauuuaaaaua

SEQ ID NO: 2152143 - RNA, 15 nt, Staphylococcus aureus subsp. aureus N315
ucuggcaaauugccu

SEQ ID NO: 2152144 - RNA, 20 nt, Staphylococcus aureus subsp. aureus N315
ucuggcacauuacuguaaaa

SEQ ID NO: 2152145 - RNA, 14 nt, Staphylococcus aureus subsp. aureus N315
ucugcuucuaaaac

SEQ ID NO: 2152146 - RNA, 13 nt, Staphylococcus aureus subsp. aureus N315
ucugcuuucgcuu

SEQ ID NO: 2152147 - RNA, 15 nt, Staphylococcus aureus subsp. aureus N315
ucugcuuuauuuuau

SEQ ID NO: 2152148 - RNA, 14 nt, Staphylococcus aureus subsp. aureus N315
ucugcuuuucuauu

SEQ ID NO: 2152149 - RNA, 23 nt, Staphylococcus aureus subsp. aureus N315
ucugcaugguuugcugguugcuu

SEQ ID NO: 2152150 - RNA, 23 nt, Staphylococcus aureus subsp. aureus N315
ucuguaucgauucgauuauuuag

SEQ ID NO: 2152151 - RNA, 14 nt, Staphylococcus aureus subsp. aureus N315
ucugucaaauugga

SEQ ID NO: 2152152 - RNA, 21 nt, Staphylococcus aureus subsp. aureus N315
ucuguccgauaucuuuuaauu

SEQ ID NO: 2152153 - RNA, 22 nt, Staphylococcus aureus subsp. aureus N315
ucuguccgacuuaauauugaau

SEQ ID NO: 2152154 - RNA, 13 nt, Staphylococcus aureus subsp. aureus N315
ucuguccaaaaag

SEQ ID NO: 2152155 - RNA, 21 nt, Staphylococcus aureus subsp. aureus N315
ucugucggacuccuuuuacuu

SEQ ID NO: 2152156 - RNA, 11 nt, Staphylococcus aureus subsp. aureus N315
ucuguguuggg

SEQ ID NO: 2152157 - RNA, 15 nt, Staphylococcus aureus subsp. aureus N315
ucuguguaaauauaa

SEQ ID NO: 2152158 - RNA, 20 nt, Staphylococcus aureus subsp. aureus N315
ucuguauauggcgauaacaa

SEQ ID NO: 2152159 - RNA, 19 nt, Staphylococcus aureus subsp. aureus N315
ucuguagcgauaccuuuaa

SEQ ID NO: 2152160 - RNA, 21 nt, Staphylococcus aureus subsp. aureus N315
ucuguaauaauuauuaauaaa

SEQ ID NO: 2152161 - RNA, 19 nt, Staphylococcus aureus subsp. aureus N315
ucuguacguuuuaaauaaa

SEQ ID NO: 2152162 - RNA, 16 nt, Staphylococcus aureus subsp. aureus N315
ucuguacguuuuaaau

SEQ ID NO: 2152163 - RNA, 18 nt, Staphylococcus aureus subsp. aureus N315
ucuguaccguauuuuaau

SEQ ID NO: 2152164 - RNA, 22 nt, Staphylococcus aureus subsp. aureus N315
ucuguaaauuaucuaaagaaau

SEQ ID NO: 2152165 - RNA, 15 nt, Staphylococcus aureus subsp. aureus N315
ucuguaaauaacuua

SEQ ID NO: 2152166 - RNA, 17 nt, Staphylococcus aureus subsp. aureus N315
ucugguucuuuacuaaa

SEQ ID NO: 2152167 - RNA, 22 nt, Staphylococcus aureus subsp. aureus N315
ucuuccaaucaacuucauauaa

SEQ ID NO: 2152168 - RNA, 17 nt, Staphylococcus aureus subsp. aureus N315
ucuucaauucuuacacc

SEQ ID NO: 2152169 - RNA, 13 nt, Staphylococcus aureus subsp. aureus N315
ucuucaauugucu

SEQ ID NO: 2152170 - RNA, 20 nt, Staphylococcus aureus subsp. aureus N315
ucuucccaaaaauuguucaa

SEQ ID NO: 2152171 - RNA, 23 nt, Staphylococcus aureus subsp. aureus N315
ucuuccuccgccaucaauauuua

SEQ ID NO: 2152172 - RNA, 15 nt, Staphylococcus aureus subsp. aureus N315
ucuguuucaaagcug

SEQ ID NO: 2152173 - RNA, 19 nt, Staphylococcus aureus subsp. aureus N315
ucuguuccucaauaggaau

SEQ ID NO: 2152174 - RNA, 18 nt, Staphylococcus aureus subsp. aureus N315
ucuuaguaagacugccau

SEQ ID NO: 2152175 - RNA, 15 nt, Staphylococcus aureus subsp. aureus N315
ucuuacuacuuaauu

SEQ ID NO: 2152176 - RNA, 17 nt, Staphylococcus aureus subsp. aureus N315
ucuuaccauuuauccuu

SEQ ID NO: 2152177 - RNA, 22 nt, Staphylococcus aureus subsp. aureus N315
ucuuaucgaaagaugauauauu

SEQ ID NO: 2152178 - RNA, 23 nt, Staphylococcus aureus subsp. aureus N315
ucuuaucgaaagaugauauauuc

SEQ ID NO: 2152179 - RNA, 13 nt, Staphylococcus aureus subsp. aureus N315
ucuucaauauuua

SEQ ID NO: 2152180 - RNA, 17 nt, Staphylococcus aureus subsp. aureus N315
ucuucaaucuaccaaua

SEQ ID NO: 2152181 - RNA, 21 nt, Staphylococcus aureus subsp. aureus N315
ucuucaauauuuaaauuuuaa

SEQ ID NO: 2152182 - RNA, 18 nt, Staphylococcus aureus subsp. aureus N315
ucuucaacuucgauauga

SEQ ID NO: 2152183 - RNA, 13 nt, Staphylococcus aureus subsp. aureus N315
ucuuaucaacaac

SEQ ID NO: 2152184 - RNA, 14 nt, Staphylococcus aureus subsp. aureus N315
ucuuauaaguucaa

SEQ ID NO: 2152185 - RNA, 17 nt, Staphylococcus aureus subsp. aureus N315
ucuuaucaagaauauaa

SEQ ID NO: 2152186 - RNA, 21 nt, Staphylococcus aureus subsp. aureus N315
ucuuaucaagaauauaacgaa

SEQ ID NO: 2152187 - RNA, 22 nt, Staphylococcus aureus subsp. aureus N315
ucugauacagaaccaacaauaa

SEQ ID NO: 2152188 - RNA, 21 nt, Staphylococcus aureus subsp. aureus N315
ucugauacaucaucgccagca

SEQ ID NO: 2152189 - RNA, 13 nt, Staphylococcus aureus subsp. aureus N315
ucugcaauuucau

SEQ ID NO: 2152190 - RNA, 22 nt, Staphylococcus aureus subsp. aureus N315
ucugaaaauaucacugaaugcu

SEQ ID NO: 2152191 - RNA, 18 nt, Staphylococcus aureus subsp. aureus N315
ucucuuuacaccauugca

SEQ ID NO: 2152192 - RNA, 22 nt, Staphylococcus aureus subsp. aureus N315
ucugacauuucaucaauaauuu

SEQ ID NO: 2152193 - RNA, 12 nt, Staphylococcus aureus subsp. aureus N315
ucucuucuggag

SEQ ID NO: 2152194 - RNA, 16 nt, Staphylococcus aureus subsp. aureus N315
ucucuucugucuaaaa

SEQ ID NO: 2152195 - RNA, 21 nt, Staphylococcus aureus subsp. aureus N315
aaaugcuucugguucuucaau

SEQ ID NO: 2152196 - RNA, 14 nt, Staphylococcus aureus subsp. aureus N315
aaaugcuuuaacua

SEQ ID NO: 2152197 - RNA, 20 nt, Staphylococcus aureus subsp. aureus N315
aaaugcuuaagaaauuuuuu

SEQ ID NO: 2152198 - RNA, 19 nt, Staphylococcus aureus subsp. aureus N315
ucucugcuuuaauauaauu

SEQ ID NO: 2152199 - RNA, 17 nt, Staphylococcus aureus subsp. aureus N315
ucucuaaaacuuuuuca

SEQ ID NO: 2152200 - RNA, 19 nt, Staphylococcus aureus subsp. aureus N315
ucucuaaaacuuuuucaau

SEQ ID NO: 2152201 - RNA, 17 nt, Staphylococcus aureus subsp. aureus N315
ucucguugcacaacagu

SEQ ID NO: 2152202 - RNA, 14 nt, Staphylococcus aureus subsp. aureus N315
ucucgucuuucguc

SEQ ID NO: 2152203 - RNA, 15 nt, Staphylococcus aureus subsp. aureus N315
ucucgugaaaauaau

SEQ ID NO: 2152204 - RNA, 20 nt, Staphylococcus aureus subsp. aureus N315
ucucgugaaaauaauacuac

SEQ ID NO: 2152205 - RNA, 17 nt, Staphylococcus aureus subsp. aureus N315
ucucucgcuaaauuuau

SEQ ID NO: 2152206 - RNA, 19 nt, Staphylococcus aureus subsp. aureus N315
ucucuaacauuuucuuauu

SEQ ID NO: 2152207 - RNA, 23 nt, Staphylococcus aureus subsp. aureus N315
ucucuaucaguccgcuuuuucau

SEQ ID NO: 2152208 - RNA, 14 nt, Staphylococcus aureus subsp. aureus N315
ucucuaaauaauuu

SEQ ID NO: 2152209 - RNA, 18 nt, Staphylococcus aureus subsp. aureus N315
ucucuaaauaauuucuca

SEQ ID NO: 2152210 - RNA, 20 nt, Staphylococcus aureus subsp. aureus N315
ucuccuugcucaugagcaca

SEQ ID NO: 2152211 - RNA, 22 nt, Staphylococcus aureus subsp. aureus N315
ucuccuaaagguaacuuuuuaa

SEQ ID NO: 2152212 - RNA, 20 nt, Staphylococcus aureus subsp. aureus N315
ucucgauuaauuuucuuuuu

SEQ ID NO: 2152213 - RNA, 19 nt, Staphylococcus aureus subsp. aureus N315
ucuccauuagaacuaagau

SEQ ID NO: 2152214 - RNA, 14 nt, Staphylococcus aureus subsp. aureus N315
ucuccaguuuucaa

SEQ ID NO: 2152215 - RNA, 14 nt, Staphylococcus aureus subsp. aureus N315
ucucaucuucuaaa

SEQ ID NO: 2152216 - RNA, 16 nt, Staphylococcus aureus subsp. aureus N315
ucucaucuucuaaauc

SEQ ID NO: 2152217 - RNA, 21 nt, Staphylococcus aureus subsp. aureus N315
ucucauucuuuaauauaaauu

SEQ ID NO: 2152218 - RNA, 21 nt, Staphylococcus aureus subsp. aureus N315
ucucauuauaaugauuuuuau

SEQ ID NO: 2152219 - RNA, 11 nt, Staphylococcus aureus subsp. aureus N315
ucuccaauacu

SEQ ID NO: 2152220 - RNA, 21 nt, Staphylococcus aureus subsp. aureus N315
ucuccaauacuuuuuauauaa

SEQ ID NO: 2152221 - RNA, 16 nt, Staphylococcus aureus subsp. aureus N315
ucuccaccauuaauag

SEQ ID NO: 2152222 - RNA, 15 nt, Staphylococcus aureus subsp. aureus N315
ucguuucuuuuauau

SEQ ID NO: 2152223 - RNA, 21 nt, Staphylococcus aureus subsp. aureus N315
ucguucucuuaaauaugaaua

SEQ ID NO: 2152224 - RNA, 15 nt, Staphylococcus aureus subsp. aureus N315
ucguucucuuaaaua

SEQ ID NO: 2152225 - RNA, 14 nt, Staphylococcus aureus subsp. aureus N315
ucguucucuuaaau

SEQ ID NO: 2152226 - RNA, 14 nt, Staphylococcus aureus subsp. aureus N315
ucguucuuugauua

SEQ ID NO: 2152227 - RNA, 20 nt, Staphylococcus aureus subsp. aureus N315
ucguucgaaguagcuuguuu

SEQ ID NO: 2152228 - RNA, 21 nt, Staphylococcus aureus subsp. aureus N315
ucguucaagaacaaucaauac

SEQ ID NO: 2152229 - RNA, 24 nt, Staphylococcus aureus subsp. aureus N315
ucguucaagaacaaucaauacaga

SEQ ID NO: 2152230 - RNA, 23 nt, Staphylococcus aureus subsp. aureus N315
ucguuaccuuuuaaggcagcuaa

SEQ ID NO: 2152231 - RNA, 22 nt, Staphylococcus aureus subsp. aureus N315
ucguuauaaguacaaauaauac

SEQ ID NO: 2152232 - RNA, 22 nt, Staphylococcus aureus subsp. aureus N315
ucguuauagacuaacuguacuu

SEQ ID NO: 2152233 - RNA, 21 nt, Staphylococcus aureus subsp. aureus N315
ucguuaaggaaagcuucauau

SEQ ID NO: 2152234 - RNA, 17 nt, Staphylococcus aureus subsp. aureus N315
ucguguuugaauguuuu

SEQ ID NO: 2152235 - RNA, 23 nt, Staphylococcus aureus subsp. aureus N315
ucguguuaauaaccgaaauauug

SEQ ID NO: 2152236 - RNA, 16 nt, Staphylococcus aureus subsp. aureus N315
ucgugauagaaguuuu

SEQ ID NO: 2152237 - RNA, 22 nt, Staphylococcus aureus subsp. aureus N315
ucgucuuuaucaacauaaaauu

SEQ ID NO: 2152238 - RNA, 19 nt, Staphylococcus aureus subsp. aureus N315
ucgugaaaagcaguuaaug

SEQ ID NO: 2152239 - RNA, 13 nt, Staphylococcus aureus subsp. aureus N315
ucgugaaaauaau

SEQ ID NO: 2152240 - RNA, 18 nt, Staphylococcus aureus subsp. aureus N315
ucgucucacuuaauaaau

SEQ ID NO: 2152241 - RNA, 14 nt, Staphylococcus aureus subsp. aureus N315
ucgucuacuauuuu

SEQ ID NO: 2152242 - RNA, 15 nt, Staphylococcus aureus subsp. aureus N315
ucguaguuguccauu

SEQ ID NO: 2152243 - RNA, 19 nt, Staphylococcus aureus subsp. aureus N315
ucguaggaugcuuccuuuu

SEQ ID NO: 2152244 - RNA, 19 nt, Staphylococcus aureus subsp. aureus N315
ucguauaguacuaaaagua

SEQ ID NO: 2152245 - RNA, 21 nt, Staphylococcus aureus subsp. aureus N315
ucguauauguaaucagaguag

SEQ ID NO: 2152246 - RNA, 18 nt, Staphylococcus aureus subsp. aureus N315
ucguauagauuaaaaaau

SEQ ID NO: 2152247 - RNA, 18 nt, Staphylococcus aureus subsp. aureus N315
ucguauaauuuuaauauu

SEQ ID NO: 2152248 - RNA, 16 nt, Staphylococcus aureus subsp. aureus N315
ucguauucuuuuaaua

SEQ ID NO: 2152249 - RNA, 13 nt, Staphylococcus aureus subsp. aureus N315
ucgucaaaaacag

SEQ ID NO: 2152250 - RNA, 22 nt, Staphylococcus aureus subsp. aureus N315
ucguaaugaugacaucaauauc

SEQ ID NO: 2152251 - RNA, 22 nt, Staphylococcus aureus subsp. aureus N315
ucguaauugucuuuauaaaaaa

SEQ ID NO: 2152252 - RNA, 17 nt, Staphylococcus aureus subsp. aureus N315
ucguaacauuuaaaaaa

SEQ ID NO: 2152253 - RNA, 18 nt, Staphylococcus aureus subsp. aureus N315
ucguacuuccaauacugu

SEQ ID NO: 2152254 - RNA, 16 nt, Staphylococcus aureus subsp. aureus N315
ucguacuuccaauacu

SEQ ID NO: 2152255 - RNA, 14 nt, Staphylococcus aureus subsp. aureus N315
ucgucgaaaugccu

SEQ ID NO: 2152256 - RNA, 15 nt, Staphylococcus aureus subsp. aureus N315
ucgucacguaaaaua

SEQ ID NO: 2152257 - RNA, 19 nt, Staphylococcus aureus subsp. aureus N315
ucgucaauuuuaaugagua

SEQ ID NO: 2152258 - RNA, 16 nt, Staphylococcus aureus subsp. aureus N315
ucggcuuuguaaaauu

SEQ ID NO: 2152259 - RNA, 13 nt, Staphylococcus aureus subsp. aureus N315
ucggcuuucuaag

SEQ ID NO: 2152260 - RNA, 20 nt, Staphylococcus aureus subsp. aureus N315
ucggcuuuggauuucuuuuu

SEQ ID NO: 2152261 - RNA, 13 nt, Staphylococcus aureus subsp. aureus N315
ucggcucucgcuu

SEQ ID NO: 2152262 - RNA, 21 nt, Staphylococcus aureus subsp. aureus N315
ucgguuugauuaaaaucugcu

SEQ ID NO: 2152263 - RNA, 15 nt, Staphylococcus aureus subsp. aureus N315
ucgguuuuauuuuua

SEQ ID NO: 2152264 - RNA, 23 nt, Staphylococcus aureus subsp. aureus N315
ucgguuuuauuuuuaucaucaug

SEQ ID NO: 2152265 - RNA, 22 nt, Staphylococcus aureus subsp. aureus N315
ucgguuuuauuuuuaucaucau

SEQ ID NO: 2152266 - RNA, 18 nt, Staphylococcus aureus subsp. aureus N315
ucgguucaucuaaaauga

SEQ ID NO: 2152267 - RNA, 15 nt, Staphylococcus aureus subsp. aureus N315
ucgguuugauuaaaa

SEQ ID NO: 2152268 - RNA, 17 nt, Staphylococcus aureus subsp. aureus N315
ucgguauuuaauguuuu

SEQ ID NO: 2152269 - RNA, 14 nt, Staphylococcus aureus subsp. aureus N315
ucgguaugauauuu

SEQ ID NO: 2152270 - RNA, 22 nt, Staphylococcus aureus subsp. aureus N315
ucgguacauuuaauggucuaau

SEQ ID NO: 2152271 - RNA, 18 nt, Staphylococcus aureus subsp. aureus N315
ucggggccccaacacaga

SEQ ID NO: 2152272 - RNA, 10 nt, Staphylococcus aureus subsp. aureus N315
ucggaaacau

SEQ ID NO: 2152273 - RNA, 14 nt, Staphylococcus aureus subsp. aureus N315
ucggaauaaaauaa

SEQ ID NO: 2152274 - RNA, 12 nt, Staphylococcus aureus subsp. aureus N315
ucggacagagga

SEQ ID NO: 2152275 - RNA, 23 nt, Staphylococcus aureus subsp. aureus N315
ucgcuugcuucuuuccucuccuu

SEQ ID NO: 2152276 - RNA, 19 nt, Staphylococcus aureus subsp. aureus N315
ucgcuuucauaccuugauu

SEQ ID NO: 2152277 - RNA, 18 nt, Staphylococcus aureus subsp. aureus N315
ucggaaaaagaugaaaaa

SEQ ID NO: 2152278 - RNA, 17 nt, Staphylococcus aureus subsp. aureus N315
ucggaaaaagaugaaaa

SEQ ID NO: 2152279 - RNA, 14 nt, Staphylococcus aureus subsp. aureus N315
ucgcuuugcccguc

SEQ ID NO: 2152280 - RNA, 21 nt, Staphylococcus aureus subsp. aureus N315
ucgcucacaugugaaauaauc

SEQ ID NO: 2152281 - RNA, 16 nt, Staphylococcus aureus subsp. aureus N315
ucgcucacaugugaaa

SEQ ID NO: 2152282 - RNA, 15 nt, Staphylococcus aureus subsp. aureus N315
ucgcugcuacaccac

SEQ ID NO: 2152283 - RNA, 14 nt, Staphylococcus aureus subsp. aureus N315
ucgcucuagacauu

SEQ ID NO: 2152284 - RNA, 20 nt, Staphylococcus aureus subsp. aureus N315
uccauacgaucuuuuucaau

SEQ ID NO: 2152285 - RNA, 17 nt, Staphylococcus aureus subsp. aureus N315
ucgccaagccaucuuuc

SEQ ID NO: 2152286 - RNA, 17 nt, Staphylococcus aureus subsp. aureus N315
uccauacguaucaaaau

SEQ ID NO: 2152287 - RNA, 21 nt, Staphylococcus aureus subsp. aureus N315
ucgcccuuuagccaaugcuuc

SEQ ID NO: 2152288 - RNA, 17 nt, Staphylococcus aureus subsp. aureus N315
ucgccuacuauaaauac

SEQ ID NO: 2152289 - RNA, 20 nt, Staphylococcus aureus subsp. aureus N315
ucgccuaaaaauaaaaucaa

SEQ ID NO: 2152290 - RNA, 18 nt, Staphylococcus aureus subsp. aureus N315
ugaacgauaacaauuuau

SEQ ID NO: 2152291 - RNA, 17 nt, Staphylococcus aureus subsp. aureus N315
ugaaccuuuacucauau

SEQ ID NO: 2152292 - RNA, 20 nt, Staphylococcus aureus subsp. aureus N315
ugaagaggucuccaauacuu

SEQ ID NO: 2152293 - RNA, 15 nt, Staphylococcus aureus subsp. aureus N315
ugaacuuuguaucuu

SEQ ID NO: 2152294 - RNA, 12 nt, Staphylococcus aureus subsp. aureus N315
ugaacuuuuauu

SEQ ID NO: 2152295 - RNA, 14 nt, Staphylococcus aureus subsp. aureus N315
ugaagaaaaaauga

SEQ ID NO: 2152296 - RNA, 18 nt, Staphylococcus aureus subsp. aureus N315
ugaagaaaaguauaaaua

SEQ ID NO: 2152297 - RNA, 20 nt, Staphylococcus aureus subsp. aureus N315
ugaagaaaaguauaaauaua

SEQ ID NO: 2152298 - RNA, 14 nt, Staphylococcus aureus subsp. aureus N315
ugaagcuaauucau

SEQ ID NO: 2152299 - RNA, 17 nt, Staphylococcus aureus subsp. aureus N315
ugaagggagcauuucau

SEQ ID NO: 2152300 - RNA, 22 nt, Staphylococcus aureus subsp. aureus N315
ugaauauacuuaauuuaaaucu

SEQ ID NO: 2152301 - RNA, 13 nt, Staphylococcus aureus subsp. aureus N315
ugaauauagcugu

SEQ ID NO: 2152302 - RNA, 20 nt, Staphylococcus aureus subsp. aureus N315
ugaauauagcugugauuuga

SEQ ID NO: 2152303 - RNA, 20 nt, Staphylococcus aureus subsp. aureus N315
ugaauauggaaaauguauua

SEQ ID NO: 2152304 - RNA, 17 nt, Staphylococcus aureus subsp. aureus N315
ugaauauggaaaaugua

SEQ ID NO: 2152305 - RNA, 21 nt, Staphylococcus aureus subsp. aureus N315
ugaauaguaaucagcuuuuuc

SEQ ID NO: 2152306 - RNA, 14 nt, Staphylococcus aureus subsp. aureus N315
ugaauacuucuuua

SEQ ID NO: 2152307 - RNA, 17 nt, Staphylococcus aureus subsp. aureus N315
ugaauacuuuauuugau

SEQ ID NO: 2152308 - RNA, 14 nt, Staphylococcus aureus subsp. aureus N315
ugaaguuacuauau

SEQ ID NO: 2152309 - RNA, 16 nt, Staphylococcus aureus subsp. aureus N315
ugaaguuacuauauuu

SEQ ID NO: 2152310 - RNA, 22 nt, Staphylococcus aureus subsp. aureus N315
ugaaguuuaaucguauuagcca

SEQ ID NO: 2152311 - RNA, 14 nt, Staphylococcus aureus subsp. aureus N315
ugaauaauauauuu

SEQ ID NO: 2152312 - RNA, 13 nt, Staphylococcus aureus subsp. aureus N315
ugaauaauuaaaa

SEQ ID NO: 2152313 - RNA, 14 nt, Staphylococcus aureus subsp. aureus N315
ugaauaauuaaaaa

SEQ ID NO: 2152314 - RNA, 22 nt, Staphylococcus aureus subsp. aureus N315
ugaauaauuucaguucuuagau

SEQ ID NO: 2152315 - RNA, 14 nt, Staphylococcus aureus subsp. aureus N315
ugaauaauuucagu

SEQ ID NO: 2152316 - RNA, 22 nt, Staphylococcus aureus subsp. aureus N315
ugaauaauugcuaaaauaucaa

SEQ ID NO: 2152317 - RNA, 11 nt, Staphylococcus aureus subsp. aureus N315
ugaauaauucc

SEQ ID NO: 2152318 - RNA, 19 nt, Staphylococcus aureus subsp. aureus N315
ugaacaauucuucaucaug

SEQ ID NO: 2152319 - RNA, 19 nt, Staphylococcus aureus subsp. aureus N315
ugaacaaucagauaaguua

SEQ ID NO: 2152320 - RNA, 21 nt, Staphylococcus aureus subsp. aureus N315
ugaaauuuuuuagugaaaaag

SEQ ID NO: 2152321 - RNA, 22 nt, Staphylococcus aureus subsp. aureus N315
ugaacaauaauaugccauagua

SEQ ID NO: 2152322 - RNA, 22 nt, Staphylococcus aureus subsp. aureus N315
ugaacaacauugagauuaucuu

SEQ ID NO: 2152323 - RNA, 18 nt, Staphylococcus aureus subsp. aureus N315
ugaaccaauccaauauac

SEQ ID NO: 2152324 - RNA, 22 nt, Staphylococcus aureus subsp. aureus N315
ugaacaucuaguuauuucauag

SEQ ID NO: 2152325 - RNA, 14 nt, Staphylococcus aureus subsp. aureus N315
ugaaauuuuuccga

SEQ ID NO: 2152326 - RNA, 13 nt, Staphylococcus aureus subsp. aureus N315
ugaaauuuuuccg

SEQ ID NO: 2152327 - RNA, 15 nt, Staphylococcus aureus subsp. aureus N315
ugaaauuuuuaauau

SEQ ID NO: 2152328 - RNA, 20 nt, Staphylococcus aureus subsp. aureus N315
ugaaauuuuuaauauacccc

SEQ ID NO: 2152329 - RNA, 22 nt, Staphylococcus aureus subsp. aureus N315
ugaaauucuuuuguaauugaaa

SEQ ID NO: 2152330 - RNA, 21 nt, Staphylococcus aureus subsp. aureus N315
ugaaauugcgugcguuuaaca

SEQ ID NO: 2152331 - RNA, 23 nt, Staphylococcus aureus subsp. aureus N315
ugaaauucgaacuaucaauauaa

SEQ ID NO: 2152332 - RNA, 19 nt, Staphylococcus aureus subsp. aureus N315
ugaaauuagauuuuaugcu

SEQ ID NO: 2152333 - RNA, 17 nt, Staphylococcus aureus subsp. aureus N315
ugaaauuauuauuuaaa

SEQ ID NO: 2152334 - RNA, 20 nt, Staphylococcus aureus subsp. aureus N315
ugaaauuauuauuuaaauuu

SEQ ID NO: 2152335 - RNA, 12 nt, Staphylococcus aureus subsp. aureus N315
ugaaauguuuaa

SEQ ID NO: 2152336 - RNA, 22 nt, Staphylococcus aureus subsp. aureus N315
ugaaauguagacaauaaaucuu

SEQ ID NO: 2152337 - RNA, 15 nt, Staphylococcus aureus subsp. aureus N315
ugaaaugguaucuaa

SEQ ID NO: 2152338 - RNA, 16 nt, Staphylococcus aureus subsp. aureus N315
ugaaauuaaauucaaa

SEQ ID NO: 2152339 - RNA, 15 nt, Staphylococcus aureus subsp. aureus N315
ugaaauuaaauuugu

SEQ ID NO: 2152340 - RNA, 19 nt, Staphylococcus aureus subsp. aureus N315
ugaaauuagaaaaauauga

SEQ ID NO: 2152341 - RNA, 20 nt, Staphylococcus aureus subsp. aureus N315
ugaaaugauacauuauuaaa

SEQ ID NO: 2152342 - RNA, 19 nt, Staphylococcus aureus subsp. aureus N315
ugaaauauuuaucuuuaga

SEQ ID NO: 2152343 - RNA, 19 nt, Staphylococcus aureus subsp. aureus N315
ugaaagaaaagugaaaacu

SEQ ID NO: 2152344 - RNA, 16 nt, Staphylococcus aureus subsp. aureus N315
ugaaacuuuaauacua

SEQ ID NO: 2152345 - RNA, 22 nt, Staphylococcus aureus subsp. aureus N315
ugaaauaggcgcuuguaaaauu

SEQ ID NO: 2152346 - RNA, 14 nt, Staphylococcus aureus subsp. aureus N315
ugaaauagaaacua

SEQ ID NO: 2152347 - RNA, 14 nt, Staphylococcus aureus subsp. aureus N315
ugaaauaucaagau

SEQ ID NO: 2152348 - RNA, 20 nt, Staphylococcus aureus subsp. aureus N315
ugaaauauaccaaccaaaac

SEQ ID NO: 2152349 - RNA, 13 nt, Staphylococcus aureus subsp. aureus N315
ugaaaguauuaga

SEQ ID NO: 2152350 - RNA, 18 nt, Staphylococcus aureus subsp. aureus N315
ugaaaguaccuaaaauag

SEQ ID NO: 2152351 - RNA, 23 nt, Staphylococcus aureus subsp. aureus N315
ugaaaguaccgguuuuucguaua

SEQ ID NO: 2152352 - RNA, 22 nt, Staphylococcus aureus subsp. aureus N315
ugaaaguaccuaaaauagaaaa

SEQ ID NO: 2152353 - RNA, 22 nt, Staphylococcus aureus subsp. aureus N315
ugaaaguacuuggaaaauacua

SEQ ID NO: 2152354 - RNA, 21 nt, Staphylococcus aureus subsp. aureus N315
ucuucggcuuuguaaaauugu

SEQ ID NO: 2152355 - RNA, 14 nt, Staphylococcus aureus subsp. aureus N315
ugaaaccauacuaa

SEQ ID NO: 2152356 - RNA, 13 nt, Staphylococcus aureus subsp. aureus N315
ugacauaaaacuu

SEQ ID NO: 2152357 - RNA, 23 nt, Staphylococcus aureus subsp. aureus N315
ugacauaggcgcuuuuuuuuaua

SEQ ID NO: 2152358 - RNA, 17 nt, Staphylococcus aureus subsp. aureus N315
ugacauauuuuuuaaau

SEQ ID NO: 2152359 - RNA, 21 nt, Staphylococcus aureus subsp. aureus N315
ugacauauuuuuuaaauuuaa

SEQ ID NO: 2152360 - RNA, 17 nt, Staphylococcus aureus subsp. aureus N315
ugacacuugugccaaca

SEQ ID NO: 2152361 - RNA, 15 nt, Staphylococcus aureus subsp. aureus N315
ugacacauuauugaa

SEQ ID NO: 2152362 - RNA, 22 nt, Staphylococcus aureus subsp. aureus N315
ugacaaguugcugaauaaaaua

SEQ ID NO: 2152363 - RNA, 19 nt, Staphylococcus aureus subsp. aureus N315
ugacaaguaugucaucuuc

SEQ ID NO: 2152364 - RNA, 17 nt, Staphylococcus aureus subsp. aureus N315
ugacacacccaaauuua

SEQ ID NO: 2152365 - RNA, 18 nt, Staphylococcus aureus subsp. aureus N315
ugacaaagcuaaagugaa

SEQ ID NO: 2152366 - RNA, 16 nt, Staphylococcus aureus subsp. aureus N315
ugaaucuagaauauaa

SEQ ID NO: 2152367 - RNA, 14 nt, Staphylococcus aureus subsp. aureus N315
ugaaucuaaacuau

SEQ ID NO: 2152368 - RNA, 19 nt, Staphylococcus aureus subsp. aureus N315
ugaaucuagaauauaacaa

SEQ ID NO: 2152369 - RNA, 20 nt, Staphylococcus aureus subsp. aureus N315
ugaaucuagaauauaacaac

SEQ ID NO: 2152370 - RNA, 20 nt, Staphylococcus aureus subsp. aureus N315
ugaaucgauauaaugaaguu

SEQ ID NO: 2152371 - RNA, 14 nt, Staphylococcus aureus subsp. aureus N315
ugaaucgcauuuaa

SEQ ID NO: 2152372 - RNA, 16 nt, Staphylococcus aureus subsp. aureus N315
ugaaucccauaaugac

SEQ ID NO: 2152373 - RNA, 23 nt, Staphylococcus aureus subsp. aureus N315
ugaaucaacaguuuuauuaucuu

SEQ ID NO: 2152374 - RNA, 21 nt, Staphylococcus aureus subsp. aureus N315
ugaaugaaguaauauauaaaa

SEQ ID NO: 2152375 - RNA, 14 nt, Staphylococcus aureus subsp. aureus N315
ugaaugagugucau

SEQ ID NO: 2152376 - RNA, 22 nt, Staphylococcus aureus subsp. aureus N315
ugaaugaaccuuuacucauauu

SEQ ID NO: 2152377 - RNA, 20 nt, Staphylococcus aureus subsp. aureus N315
ugaaugaaccuuuacucaua

SEQ ID NO: 2152378 - RNA, 23 nt, Staphylococcus aureus subsp. aureus N315
ugaaucuuauuuuguuuuaaaaa

SEQ ID NO: 2152379 - RNA, 16 nt, Staphylococcus aureus subsp. aureus N315
ugaauggcaaauauga

SEQ ID NO: 2152380 - RNA, 22 nt, Staphylococcus aureus subsp. aureus N315
ugaauggcaaucuauauaaaug

SEQ ID NO: 2152381 - RNA, 17 nt, Staphylococcus aureus subsp. aureus N315
ugaauggagcaugauua

SEQ ID NO: 2152382 - RNA, 23 nt, Staphylococcus aureus subsp. aureus N315
ugaauggcaaucuauauaaaugu

SEQ ID NO: 2152383 - RNA, 19 nt, Staphylococcus aureus subsp. aureus N315
ugaaugggucauuaaauga

SEQ ID NO: 2152384 - RNA, 12 nt, Staphylococcus aureus subsp. aureus N315
ugaauuaacaau

SEQ ID NO: 2152385 - RNA, 20 nt, Staphylococcus aureus subsp. aureus N315
ugaauguuuucuaaaucuaa

SEQ ID NO: 2152386 - RNA, 15 nt, Staphylococcus aureus subsp. aureus N315
ugaauuauuuaaaau

SEQ ID NO: 2152387 - RNA, 19 nt, Staphylococcus aureus subsp. aureus N315
ugaauuauuuaaaaugcuu

SEQ ID NO: 2152388 - RNA, 16 nt, Staphylococcus aureus subsp. aureus N315
ugaauucauucaauac

SEQ ID NO: 2152389 - RNA, 14 nt, Staphylococcus aureus subsp. aureus N315
ugaauugauuauaa

SEQ ID NO: 2152390 - RNA, 13 nt, Staphylococcus aureus subsp. aureus N315
ugaauugaaaaau

SEQ ID NO: 2152391 - RNA, 16 nt, Staphylococcus aureus subsp. aureus N315
ugaauugaguauuaaa

SEQ ID NO: 2152392 - RNA, 19 nt, Staphylococcus aureus subsp. aureus N315
ugaauugaguauuaaauuu

SEQ ID NO: 2152393 - RNA, 23 nt, Staphylococcus aureus subsp. aureus N315
ugaauuuuauuagguaauacuuu

SEQ ID NO: 2152394 - RNA, 21 nt, Staphylococcus aureus subsp. aureus N315
ugaauuuuauaaguauauaau

SEQ ID NO: 2152395 - RNA, 24 nt, Staphylococcus aureus subsp. aureus N315
ugaauuuuauaaguauauaauuga

SEQ ID NO: 2152396 - RNA, 21 nt, Staphylococcus aureus subsp. aureus N315
ugaauuuuauaaauuaaaugc

SEQ ID NO: 2152397 - RNA, 13 nt, Staphylococcus aureus subsp. aureus N315
ugaauuuuuauuu

SEQ ID NO: 2152398 - RNA, 21 nt, Staphylococcus aureus subsp. aureus N315
ugaauuuuaauauauuuggag

SEQ ID NO: 2152399 - RNA, 15 nt, Staphylococcus aureus subsp. aureus N315
ugaauuuuauaaauu

SEQ ID NO: 2152400 - RNA, 16 nt, Staphylococcus aureus subsp. aureus N315
ugaauuuuaauauauu

SEQ ID NO: 2152401 - RNA, 18 nt, Staphylococcus aureus subsp. aureus N315
ugaauugucuuaauaugc

SEQ ID NO: 2152402 - RNA, 19 nt, Staphylococcus aureus subsp. aureus N315
ugaauuguuaguuuucuua

SEQ ID NO: 2152403 - RNA, 15 nt, Staphylococcus aureus subsp. aureus N315
ugaauuuaauacuau

SEQ ID NO: 2152404 - RNA, 17 nt, Staphylococcus aureus subsp. aureus N315
ugaauugcuuguuuuaa

SEQ ID NO: 2152405 - RNA, 14 nt, Staphylococcus aureus subsp. aureus N315
ugaauuuauuuugu

SEQ ID NO: 2152406 - RNA, 21 nt, Staphylococcus aureus subsp. aureus N315
ugaauuuauuuuguaguuccu

SEQ ID NO: 2152407 - RNA, 14 nt, Staphylococcus aureus subsp. aureus N315
ugaauuucaaaaua

SEQ ID NO: 2152408 - RNA, 17 nt, Staphylococcus aureus subsp. aureus N315
ugaauuuagaugcauaa

SEQ ID NO: 2152409 - RNA, 23 nt, Staphylococcus aureus subsp. aureus N315
ugaauuuagcaucaaaaauaaaa

SEQ ID NO: 2152410 - RNA, 14 nt, Staphylococcus aureus subsp. aureus N315
ugaauuuagcauca

SEQ ID NO: 2152411 - RNA, 21 nt, Staphylococcus aureus subsp. aureus N315
ugaauuuagcaucaaaaauaa

SEQ ID NO: 2152412 - RNA, 16 nt, Staphylococcus aureus subsp. aureus N315
ugaugguacuaaaguu

SEQ ID NO: 2152413 - RNA, 17 nt, Staphylococcus aureus subsp. aureus N315
ugauguaacguuucuuu

SEQ ID NO: 2152414 - RNA, 12 nt, Staphylococcus aureus subsp. aureus N315
ugauguaauucu

SEQ ID NO: 2152415 - RNA, 15 nt, Staphylococcus aureus subsp. aureus N315
ugauguaauucuguu

SEQ ID NO: 2152416 - RNA, 13 nt, Staphylococcus aureus subsp. aureus N315
ugaugugaaaauu

SEQ ID NO: 2152417 - RNA, 14 nt, Staphylococcus aureus subsp. aureus N315
ugaugugaauguuu

SEQ ID NO: 2152418 - RNA, 16 nt, Staphylococcus aureus subsp. aureus N315
ugauguguugcauuac

SEQ ID NO: 2152419 - RNA, 13 nt, Staphylococcus aureus subsp. aureus N315
ugaugugcuaccu

SEQ ID NO: 2152420 - RNA, 22 nt, Staphylococcus aureus subsp. aureus N315
ugauuacauucuauacuuuuaa

SEQ ID NO: 2152421 - RNA, 18 nt, Staphylococcus aureus subsp. aureus N315
ugauuacauucuauacuu

SEQ ID NO: 2152422 - RNA, 21 nt, Staphylococcus aureus subsp. aureus N315
ugauuacaacuuauucuucac

SEQ ID NO: 2152423 - RNA, 13 nt, Staphylococcus aureus subsp. aureus N315
ugauuacaacuua

SEQ ID NO: 2152424 - RNA, 17 nt, Staphylococcus aureus subsp. aureus N315
ugauuaauuauugagaa

SEQ ID NO: 2152425 - RNA, 23 nt, Staphylococcus aureus subsp. aureus N315
ugauuaauuauugagaauauuua

SEQ ID NO: 2152426 - RNA, 16 nt, Staphylococcus aureus subsp. aureus N315
ugauuaccaacaaggu

SEQ ID NO: 2152427 - RNA, 22 nt, Staphylococcus aureus subsp. aureus N315
ugauuacguugguuuaaaaauu

SEQ ID NO: 2152428 - RNA, 20 nt, Staphylococcus aureus subsp. aureus N315
ugauuaaaucuucaagugcc

SEQ ID NO: 2152429 - RNA, 23 nt, Staphylococcus aureus subsp. aureus N315
ugauuaaaguguuucaacauauu

SEQ ID NO: 2152430 - RNA, 20 nt, Staphylococcus aureus subsp. aureus N315
ugauguucaauauuuucaug

SEQ ID NO: 2152431 - RNA, 22 nt, Staphylococcus aureus subsp. aureus N315
ugauucauuucgauuaauuuaa

SEQ ID NO: 2152432 - RNA, 19 nt, Staphylococcus aureus subsp. aureus N315
ugauucauucguacuucca

SEQ ID NO: 2152433 - RNA, 18 nt, Staphylococcus aureus subsp. aureus N315
ugauucuaaauaaucgaa

SEQ ID NO: 2152434 - RNA, 14 nt, Staphylococcus aureus subsp. aureus N315
ugauucuaaauaau

SEQ ID NO: 2152435 - RNA, 19 nt, Staphylococcus aureus subsp. aureus N315
ugauucuacagcacugaaa

SEQ ID NO: 2152436 - RNA, 22 nt, Staphylococcus aureus subsp. aureus N315
ugauucaaauaaaucaaacuuu

SEQ ID NO: 2152437 - RNA, 12 nt, Staphylococcus aureus subsp. aureus N315
ugauucaaauaa

SEQ ID NO: 2152438 - RNA, 23 nt, Staphylococcus aureus subsp. aureus N315
ugauuauucuuugauuaaaucuu

SEQ ID NO: 2152439 - RNA, 18 nt, Staphylococcus aureus subsp. aureus N315
ugauuauucuucauuuau

SEQ ID NO: 2152440 - RNA, 15 nt, Staphylococcus aureus subsp. aureus N315
ugauuauucuucauu

SEQ ID NO: 2152441 - RNA, 20 nt, Staphylococcus aureus subsp. aureus N315
ugauuauguucagaacuaca

SEQ ID NO: 2152442 - RNA, 22 nt, Staphylococcus aureus subsp. aureus N315
ugauuagcauaccuuuauuauu

SEQ ID NO: 2152443 - RNA, 13 nt, Staphylococcus aureus subsp. aureus N315
ugauuauaaauuc

SEQ ID NO: 2152444 - RNA, 19 nt, Staphylococcus aureus subsp. aureus N315
ugauuauauuuuucuucag

SEQ ID NO: 2152445 - RNA, 16 nt, Staphylococcus aureus subsp. aureus N315
ugauucucuguagaua

SEQ ID NO: 2152446 - RNA, 21 nt, Staphylococcus aureus subsp. aureus N315
ugauuggcagugaucuuuuuu

SEQ ID NO: 2152447 - RNA, 22 nt, Staphylococcus aureus subsp. aureus N315
ugauugcugcuguacaauuucg

SEQ ID NO: 2152448 - RNA, 11 nt, Staphylococcus aureus subsp. aureus N315
ugauucuucac

SEQ ID NO: 2152449 - RNA, 17 nt, Staphylococcus aureus subsp. aureus N315
ugaugaacuuaaugcuu

SEQ ID NO: 2152450 - RNA, 19 nt, Staphylococcus aureus subsp. aureus N315
ugaugaagcaguuguuggu

SEQ ID NO: 2152451 - RNA, 24 nt, Staphylococcus aureus subsp. aureus N315
ugaucuuuuuuauauucaacuuau

SEQ ID NO: 2152452 - RNA, 14 nt, Staphylococcus aureus subsp. aureus N315
ugaugaaagacuga

SEQ ID NO: 2152453 - RNA, 15 nt, Staphylococcus aureus subsp. aureus N315
ugaugaaaacaaaca

SEQ ID NO: 2152454 - RNA, 19 nt, Staphylococcus aureus subsp. aureus N315
ugaugcauaagauuuugaa

SEQ ID NO: 2152455 - RNA, 16 nt, Staphylococcus aureus subsp. aureus N315
ugaugcgaaaccuuuc

SEQ ID NO: 2152456 - RNA, 23 nt, Staphylococcus aureus subsp. aureus N315
ugaugcuagcuuucuuuuucauc

SEQ ID NO: 2152457 - RNA, 19 nt, Staphylococcus aureus subsp. aureus N315
ugaugcuugaauguuugaa

SEQ ID NO: 2152458 - RNA, 16 nt, Staphylococcus aureus subsp. aureus N315
ugaucauuauaaaaug

SEQ ID NO: 2152459 - RNA, 19 nt, Staphylococcus aureus subsp. aureus N315
ugaucauuugacauaaucc

SEQ ID NO: 2152460 - RNA, 23 nt, Staphylococcus aureus subsp. aureus N315
ugaucuaaaaccauagagcauuu

SEQ ID NO: 2152461 - RNA, 20 nt, Staphylococcus aureus subsp. aureus N315
ugauacauuauuaaauagau

SEQ ID NO: 2152462 - RNA, 16 nt, Staphylococcus aureus subsp. aureus N315
ugauacauucuauuaa

SEQ ID NO: 2152463 - RNA, 19 nt, Staphylococcus aureus subsp. aureus N315
ugauauucaacuugauuaa

SEQ ID NO: 2152464 - RNA, 14 nt, Staphylococcus aureus subsp. aureus N315
ugauauugaaagug

SEQ ID NO: 2152465 - RNA, 23 nt, Staphylococcus aureus subsp. aureus N315
ugauauuugcuagucauaauuua

SEQ ID NO: 2152466 - RNA, 22 nt, Staphylococcus aureus subsp. aureus N315
ugaucaaaaauguuaucuagua

SEQ ID NO: 2152467 - RNA, 17 nt, Staphylococcus aureus subsp. aureus N315
ugaguauuacuugaaaa

SEQ ID NO: 2152468 - RNA, 14 nt, Staphylococcus aureus subsp. aureus N315
ugaguauuaaauuu

SEQ ID NO: 2152469 - RNA, 14 nt, Staphylococcus aureus subsp. aureus N315
ugaguaguuucucu

SEQ ID NO: 2152470 - RNA, 13 nt, Staphylococcus aureus subsp. aureus N315
ugaguuuaaaaau

SEQ ID NO: 2152471 - RNA, 15 nt, Staphylococcus aureus subsp. aureus N315
ugaguugaaaauaau

SEQ ID NO: 2152472 - RNA, 13 nt, Staphylococcus aureus subsp. aureus N315
ugauaaugcaugu

SEQ ID NO: 2152473 - RNA, 14 nt, Staphylococcus aureus subsp. aureus N315
ugauaacgagcuaa

SEQ ID NO: 2152474 - RNA, 22 nt, Staphylococcus aureus subsp. aureus N315
ugauaaccauuaugauuaaucc

SEQ ID NO: 2152475 - RNA, 12 nt, Staphylococcus aureus subsp. aureus N315
ugauaaauugug

SEQ ID NO: 2152476 - RNA, 23 nt, Staphylococcus aureus subsp. aureus N315
ugauaacaaccgucccauaaaag

SEQ ID NO: 2152477 - RNA, 19 nt, Staphylococcus aureus subsp. aureus N315
ugauaacaauuuuaaaucu

SEQ ID NO: 2152478 - RNA, 20 nt, Staphylococcus aureus subsp. aureus N315
ugauaacaauuuuaaaucuu

SEQ ID NO: 2152479 - RNA, 23 nt, Staphylococcus aureus subsp. aureus N315
ugauaaccaaaccauaaguaaaa

SEQ ID NO: 2152480 - RNA, 15 nt, Staphylococcus aureus subsp. aureus N315
ugauaauuuaauaau

SEQ ID NO: 2152481 - RNA, 13 nt, Staphylococcus aureus subsp. aureus N315
ugauaauuuaaua

SEQ ID NO: 2152482 - RNA, 22 nt, Staphylococcus aureus subsp. aureus N315
ugauaauuuuucuucuuuuuua

SEQ ID NO: 2152483 - RNA, 14 nt, Staphylococcus aureus subsp. aureus N315
ugauaauucuucaa

SEQ ID NO: 2152484 - RNA, 22 nt, Staphylococcus aureus subsp. aureus N315
ugauaauuaauuaaaauucucu

SEQ ID NO: 2152485 - RNA, 19 nt, Staphylococcus aureus subsp. aureus N315
ugauaauuaaugccauugu

SEQ ID NO: 2152486 - RNA, 16 nt, Staphylococcus aureus subsp. aureus N315
ugauaauuaauuaaaa

SEQ ID NO: 2152487 - RNA, 17 nt, Staphylococcus aureus subsp. aureus N315
ugaguaggcucuuaaug

SEQ ID NO: 2152488 - RNA, 14 nt, Staphylococcus aureus subsp. aureus N315
ugaguaucaugcuu

SEQ ID NO: 2152489 - RNA, 16 nt, Staphylococcus aureus subsp. aureus N315
ugaguaucaugcuuuu

SEQ ID NO: 2152490 - RNA, 15 nt, Staphylococcus aureus subsp. aureus N315
ugaguauccaauacu

SEQ ID NO: 2152491 - RNA, 20 nt, Staphylococcus aureus subsp. aureus N315
ugaguaucaugcuuuuaaua

SEQ ID NO: 2152492 - RNA, 14 nt, Staphylococcus aureus subsp. aureus N315
ugaguacaacauag

SEQ ID NO: 2152493 - RNA, 11 nt, Staphylococcus aureus subsp. aureus N315
ugaguacaaca

SEQ ID NO: 2152494 - RNA, 13 nt, Staphylococcus aureus subsp. aureus N315
ugaguacaacaua

SEQ ID NO: 2152495 - RNA, 14 nt, Staphylococcus aureus subsp. aureus N315
ugaguaaauuaaua

SEQ ID NO: 2152496 - RNA, 20 nt, Staphylococcus aureus subsp. aureus N315
ugaggcccauaaauuacuug

SEQ ID NO: 2152497 - RNA, 19 nt, Staphylococcus aureus subsp. aureus N315
ugaggcccauaaauuacuu

SEQ ID NO: 2152498 - RNA, 18 nt, Staphylococcus aureus subsp. aureus N315
ugagcuuuucuaaugcua

SEQ ID NO: 2152499 - RNA, 23 nt, Staphylococcus aureus subsp. aureus N315
ugagcuguuacacuuuucuuauc

SEQ ID NO: 2152500 - RNA, 16 nt, Staphylococcus aureus subsp. aureus N315
ugacuguagaaaacau

SEQ ID NO: 2152501 - RNA, 17 nt, Staphylococcus aureus subsp. aureus N315
ugacugugaagcugugc

SEQ ID NO: 2152502 - RNA, 14 nt, Staphylococcus aureus subsp. aureus N315
ugacuuuaaaucuu

SEQ ID NO: 2152503 - RNA, 14 nt, Staphylococcus aureus subsp. aureus N315
ugacuguuaaacaa

SEQ ID NO: 2152504 - RNA, 21 nt, Staphylococcus aureus subsp. aureus N315
ugacgaacgauagauucugau

SEQ ID NO: 2152505 - RNA, 16 nt, Staphylococcus aureus subsp. aureus N315
ugacugcaaauacgag

SEQ ID NO: 2152506 - RNA, 20 nt, Staphylococcus aureus subsp. aureus N315
ugaccuuuacgccauucauc

SEQ ID NO: 2152507 - RNA, 17 nt, Staphylococcus aureus subsp. aureus N315
ugaccuuauauuuuauu

SEQ ID NO: 2152508 - RNA, 21 nt, Staphylococcus aureus subsp. aureus N315
ugaccuuauauuuuauuuaaa

SEQ ID NO: 2152509 - RNA, 14 nt, Staphylococcus aureus subsp. aureus N315
ugaccuucaguuuc

SEQ ID NO: 2152510 - RNA, 16 nt, Staphylococcus aureus subsp. aureus N315
ugagaauuucuaauua

SEQ ID NO: 2152511 - RNA, 17 nt, Staphylococcus aureus subsp. aureus N315
ugagaauugcaacgcau

SEQ ID NO: 2152512 - RNA, 18 nt, Staphylococcus aureus subsp. aureus N315
ugagaaaaauauuucuaa

SEQ ID NO: 2152513 - RNA, 23 nt, Staphylococcus aureus subsp. aureus N315
ugacuuuuaaaaaacauaccugc

SEQ ID NO: 2152514 - RNA, 14 nt, Staphylococcus aureus subsp. aureus N315
ugacuuuuaaaaaa

SEQ ID NO: 2152515 - RNA, 16 nt, Staphylococcus aureus subsp. aureus N315
ugacuuugucauacua

SEQ ID NO: 2152516 - RNA, 18 nt, Staphylococcus aureus subsp. aureus N315
ugacuuuccuaauucuug

SEQ ID NO: 2152517 - RNA, 13 nt, Staphylococcus aureus subsp. aureus N315
ugagauuaucuuu

SEQ ID NO: 2152518 - RNA, 14 nt, Staphylococcus aureus subsp. aureus N315
ugagcaucuugucu

SEQ ID NO: 2152519 - RNA, 19 nt, Staphylococcus aureus subsp. aureus N315
ugcggauuaucuaacucau

SEQ ID NO: 2152520 - RNA, 23 nt, Staphylococcus aureus subsp. aureus N315
ugcgauuucuucugcuaacucug

SEQ ID NO: 2152521 - RNA, 20 nt, Staphylococcus aureus subsp. aureus N315
ugccucaguuagaagaugau

SEQ ID NO: 2152522 - RNA, 22 nt, Staphylococcus aureus subsp. aureus N315
ugcgacaucgccaauuugauua

SEQ ID NO: 2152523 - RNA, 23 nt, Staphylococcus aureus subsp. aureus N315
aaauggcaucuggcaaauugccu

SEQ ID NO: 2152524 - RNA, 23 nt, Staphylococcus aureus subsp. aureus N315
aaauggcgaauagcgauuuuaaa

SEQ ID NO: 2152525 - RNA, 23 nt, Staphylococcus aureus subsp. aureus N315
aaaugguuuucuuuuucuauaca

SEQ ID NO: 2152526 - RNA, 20 nt, Staphylococcus aureus subsp. aureus N315
ugcccucauaaaucaugaaa

SEQ ID NO: 2152527 - RNA, 20 nt, Staphylococcus aureus subsp. aureus N315
ugccgccuaauaauaaaaua

SEQ ID NO: 2152528 - RNA, 17 nt, Staphylococcus aureus subsp. aureus N315
ugccguaucuauaaaaa

SEQ ID NO: 2152529 - RNA, 22 nt, Staphylococcus aureus subsp. aureus N315
ugccguaucuauaaaaagaaua

SEQ ID NO: 2152530 - RNA, 23 nt, Staphylococcus aureus subsp. aureus N315
ugccguaucuauaaaaagaauau

SEQ ID NO: 2152531 - RNA, 15 nt, Staphylococcus aureus subsp. aureus N315
ugccucaauaucuuu

SEQ ID NO: 2152532 - RNA, 17 nt, Staphylococcus aureus subsp. aureus N315
ugccucaauaucuuuaa

SEQ ID NO: 2152533 - RNA, 13 nt, Staphylococcus aureus subsp. aureus N315
ugccuaauuuugu

SEQ ID NO: 2152534 - RNA, 23 nt, Staphylococcus aureus subsp. aureus N315
ugccguuugaagucuguuuagaa

SEQ ID NO: 2152535 - RNA, 16 nt, Staphylococcus aureus subsp. aureus N315
ugccauauguuuuaga

SEQ ID NO: 2152536 - RNA, 13 nt, Staphylococcus aureus subsp. aureus N315
ugccauauguuuu

SEQ ID NO: 2152537 - RNA, 18 nt, Staphylococcus aureus subsp. aureus N315
ugccauacccauauuaaa

SEQ ID NO: 2152538 - RNA, 11 nt, Staphylococcus aureus subsp. aureus N315
ugccauaccug

SEQ ID NO: 2152539 - RNA, 18 nt, Staphylococcus aureus subsp. aureus N315
ugccauucauuaagcuuu

SEQ ID NO: 2152540 - RNA, 13 nt, Staphylococcus aureus subsp. aureus N315
ugccauucauuaa

SEQ ID NO: 2152541 - RNA, 20 nt, Staphylococcus aureus subsp. aureus N315
ugccauguuggcaauuguuu

SEQ ID NO: 2152542 - RNA, 21 nt, Staphylococcus aureus subsp. aureus N315
ugccauuuuuaaauuacuaua

SEQ ID NO: 2152543 - RNA, 19 nt, Staphylococcus aureus subsp. aureus N315
ugccauuguuauccaaaac

SEQ ID NO: 2152544 - RNA, 17 nt, Staphylococcus aureus subsp. aureus N315
ugcccaccauguacauu

SEQ ID NO: 2152545 - RNA, 16 nt, Staphylococcus aureus subsp. aureus N315
ugcccgucuggcacau

SEQ ID NO: 2152546 - RNA, 17 nt, Staphylococcus aureus subsp. aureus N315
ugccaauaaaaugcaau

SEQ ID NO: 2152547 - RNA, 20 nt, Staphylococcus aureus subsp. aureus N315
ugccaacaaagcuuccaaau

SEQ ID NO: 2152548 - RNA, 20 nt, Staphylococcus aureus subsp. aureus N315
ugcauuaauuucaugugcaa

SEQ ID NO: 2152549 - RNA, 18 nt, Staphylococcus aureus subsp. aureus N315
ugcauuacuacuuuauaa

SEQ ID NO: 2152550 - RNA, 14 nt, Staphylococcus aureus subsp. aureus N315
ugcauuacgcuguc

SEQ ID NO: 2152551 - RNA, 23 nt, Staphylococcus aureus subsp. aureus N315
ugcauagguaaccuuaaauauag

SEQ ID NO: 2152552 - RNA, 16 nt, Staphylococcus aureus subsp. aureus N315
ugcauauaaagucaua

SEQ ID NO: 2152553 - RNA, 14 nt, Staphylococcus aureus subsp. aureus N315
ugcauauauauaua

SEQ ID NO: 2152554 - RNA, 15 nt, Staphylococcus aureus subsp. aureus N315
ugcauauauauauag

SEQ ID NO: 2152555 - RNA, 24 nt, Staphylococcus aureus subsp. aureus N315
ugcauguccugaauguucgaagau

SEQ ID NO: 2152556 - RNA, 17 nt, Staphylococcus aureus subsp. aureus N315
ugcaugcuucucaauuu

SEQ ID NO: 2152557 - RNA, 20 nt, Staphylococcus aureus subsp. aureus N315
ugcaugacagcaaauuuucu

SEQ ID NO: 2152558 - RNA, 19 nt, Staphylococcus aureus subsp. aureus N315
ugcaugacucacuaaucuc

SEQ ID NO: 2152559 - RNA, 19 nt, Staphylococcus aureus subsp. aureus N315
ugcaugagacuuauucaac

SEQ ID NO: 2152560 - RNA, 22 nt, Staphylococcus aureus subsp. aureus N315
ugcaucccgaaaguuagacuaa

SEQ ID NO: 2152561 - RNA, 14 nt, Staphylococcus aureus subsp. aureus N315
ugcagagaauauag

SEQ ID NO: 2152562 - RNA, 18 nt, Staphylococcus aureus subsp. aureus N315
ugcagauaauugaaaauc

SEQ ID NO: 2152563 - RNA, 14 nt, Staphylococcus aureus subsp. aureus N315
ugcagauaauugaa

SEQ ID NO: 2152564 - RNA, 21 nt, Staphylococcus aureus subsp. aureus N315
ugcaggcaucauaucauacca

SEQ ID NO: 2152565 - RNA, 21 nt, Staphylococcus aureus subsp. aureus N315
ugauuugccaaaaguuauaua

SEQ ID NO: 2152566 - RNA, 16 nt, Staphylococcus aureus subsp. aureus N315
ugauuuguuacuucua

SEQ ID NO: 2152567 - RNA, 23 nt, Staphylococcus aureus subsp. aureus N315
ugauuuguuacuucuaauaguaa

SEQ ID NO: 2152568 - RNA, 14 nt, Staphylococcus aureus subsp. aureus N315
ugcacgagcaacau

SEQ ID NO: 2152569 - RNA, 15 nt, Staphylococcus aureus subsp. aureus N315
ugcacgagcaacauc

SEQ ID NO: 2152570 - RNA, 17 nt, Staphylococcus aureus subsp. aureus N315
ugcaccuuuacaacaua

SEQ ID NO: 2152571 - RNA, 13 nt, Staphylococcus aureus subsp. aureus N315
ugcacuuuauuaa

SEQ ID NO: 2152572 - RNA, 14 nt, Staphylococcus aureus subsp. aureus N315
uccauaaauauuua

SEQ ID NO: 2152573 - RNA, 22 nt, Staphylococcus aureus subsp. aureus N315
uccauaacuguaguuucuuaau

SEQ ID NO: 2152574 - RNA, 18 nt, Staphylococcus aureus subsp. aureus N315
uccauaacuguaguuucu

SEQ ID NO: 2152575 - RNA, 13 nt, Staphylococcus aureus subsp. aureus N315
uccauaaauauua

SEQ ID NO: 2152576 - RNA, 18 nt, Staphylococcus aureus subsp. aureus N315
uccauaaucuuuauuaau

SEQ ID NO: 2152577 - RNA, 18 nt, Staphylococcus aureus subsp. aureus N315
uccauaagucacauuuau

SEQ ID NO: 2152578 - RNA, 22 nt, Staphylococcus aureus subsp. aureus N315
uccauacaaaucguaaacauaa

SEQ ID NO: 2152579 - RNA, 16 nt, Staphylococcus aureus subsp. aureus N315
uccaguuuucaauuua

SEQ ID NO: 2152580 - RNA, 14 nt, Staphylococcus aureus subsp. aureus N315
uccaguuuucaauu

SEQ ID NO: 2152581 - RNA, 15 nt, Staphylococcus aureus subsp. aureus N315
uccaguuuucaauuu

SEQ ID NO: 2152582 - RNA, 15 nt, Staphylococcus aureus subsp. aureus N315
uccagucauuuguug

SEQ ID NO: 2152583 - RNA, 15 nt, Staphylococcus aureus subsp. aureus N315
uccaauuuuauugag

SEQ ID NO: 2152584 - RNA, 12 nt, Staphylococcus aureus subsp. aureus N315
uccaauuuaaaa

SEQ ID NO: 2152585 - RNA, 16 nt, Staphylococcus aureus subsp. aureus N315
uccaaauauuaaaaac

SEQ ID NO: 2152586 - RNA, 18 nt, Staphylococcus aureus subsp. aureus N315
uccaaauucauuuguauu

SEQ ID NO: 2152587 - RNA, 18 nt, Staphylococcus aureus subsp. aureus N315
uccaaaucgugauaucuu

SEQ ID NO: 2152588 - RNA, 21 nt, Staphylococcus aureus subsp. aureus N315
uccaaauguucagguucaaaa

SEQ ID NO: 2152589 - RNA, 16 nt, Staphylococcus aureus subsp. aureus N315
uccaaaauccugaaau

SEQ ID NO: 2152590 - RNA, 15 nt, Staphylococcus aureus subsp. aureus N315
uccaaaguaauauga

SEQ ID NO: 2152591 - RNA, 22 nt, Staphylococcus aureus subsp. aureus N315
uccaaaguaacaugugcaagua

SEQ ID NO: 2152592 - RNA, 17 nt, Staphylococcus aureus subsp. aureus N315
ucaucuuucaaaugcuu

SEQ ID NO: 2152593 - RNA, 18 nt, Staphylococcus aureus subsp. aureus N315
ucaucuuuuugaaauuuc

SEQ ID NO: 2152594 - RNA, 14 nt, Staphylococcus aureus subsp. aureus N315
ucaucuuuauuuac

SEQ ID NO: 2152595 - RNA, 13 nt, Staphylococcus aureus subsp. aureus N315
ucaucuuuaugca

SEQ ID NO: 2152596 - RNA, 23 nt, Staphylococcus aureus subsp. aureus N315
ucaucuugcgccuuguucaauuc

SEQ ID NO: 2152597 - RNA, 17 nt, Staphylococcus aureus subsp. aureus N315
ucaucuugagauuuuca

SEQ ID NO: 2152598 - RNA, 18 nt, Staphylococcus aureus subsp. aureus N315
ucaucuuaucaagaauau

SEQ ID NO: 2152599 - RNA, 22 nt, Staphylococcus aureus subsp. aureus N315
ucaucugaugaggcaauauuaa

SEQ ID NO: 2152600 - RNA, 16 nt, Staphylococcus aureus subsp. aureus N315
ucaucugcuuguaaua

SEQ ID NO: 2152601 - RNA, 15 nt, Staphylococcus aureus subsp. aureus N315
ucaucugguauuuua

SEQ ID NO: 2152602 - RNA, 17 nt, Staphylococcus aureus subsp. aureus N315
ucaucguccacgaaucu

SEQ ID NO: 2152603 - RNA, 17 nt, Staphylococcus aureus subsp. aureus N315
ucaucguucauauauuu

SEQ ID NO: 2152604 - RNA, 14 nt, Staphylococcus aureus subsp. aureus N315
ucaucuaaaaugag

SEQ ID NO: 2152605 - RNA, 21 nt, Staphylococcus aureus subsp. aureus N315
ucaucuacuauuuaaucuuaa

SEQ ID NO: 2152606 - RNA, 12 nt, Staphylococcus aureus subsp. aureus N315
ucaucuauuuaa

SEQ ID NO: 2152607 - RNA, 18 nt, Staphylococcus aureus subsp. aureus N315
ucaucuauuuaauaaugu

SEQ ID NO: 2152608 - RNA, 23 nt, Staphylococcus aureus subsp. aureus N315
ucaucuauuuaauaauguaucau

SEQ ID NO: 2152609 - RNA, 18 nt, Staphylococcus aureus subsp. aureus N315
ucaucugauaauucgaaa

SEQ ID NO: 2152610 - RNA, 16 nt, Staphylococcus aureus subsp. aureus N315
ucaugcauaagaaaua

SEQ ID NO: 2152611 - RNA, 15 nt, Staphylococcus aureus subsp. aureus N315
ucaugcaaaauaaua

SEQ ID NO: 2152612 - RNA, 16 nt, Staphylococcus aureus subsp. aureus N315
ucaugaugauaaauug

SEQ ID NO: 2152613 - RNA, 18 nt, Staphylococcus aureus subsp. aureus N315
ucaugcuuaucuguaaau

SEQ ID NO: 2152614 - RNA, 13 nt, Staphylococcus aureus subsp. aureus N315
ucaugcauucuau

SEQ ID NO: 2152615 - RNA, 19 nt, Staphylococcus aureus subsp. aureus N315
ucaugcauaaucaucauug

SEQ ID NO: 2152616 - RNA, 13 nt, Staphylococcus aureus subsp. aureus N315
ucaugccuucauu

SEQ ID NO: 2152617 - RNA, 23 nt, Staphylococcus aureus subsp. aureus N315
ucauuaugcccgauaauucuaac

SEQ ID NO: 2152618 - RNA, 20 nt, Staphylococcus aureus subsp. aureus N315
ucauuacguaacaucacaua

SEQ ID NO: 2152619 - RNA, 10 nt, Staphylococcus aureus subsp. aureus N315
ucauuacgua

SEQ ID NO: 2152620 - RNA, 14 nt, Staphylococcus aureus subsp. aureus N315
ucauuacauuuuau

SEQ ID NO: 2152621 - RNA, 21 nt, Staphylococcus aureus subsp. aureus N315
ucauuauuugauaaauaaaau

SEQ ID NO: 2152622 - RNA, 18 nt, Staphylococcus aureus subsp. aureus N315
ucauuauuugauaaauaa

SEQ ID NO: 2152623 - RNA, 12 nt, Staphylococcus aureus subsp. aureus N315
ucauuauuuaaa

SEQ ID NO: 2152624 - RNA, 21 nt, Staphylococcus aureus subsp. aureus N315
ucauucaaguguaguaaaaau

SEQ ID NO: 2152625 - RNA, 22 nt, Staphylococcus aureus subsp. aureus N315
ucauucaaguguaguaaaaauc

SEQ ID NO: 2152626 - RNA, 20 nt, Staphylococcus aureus subsp. aureus N315
ucauguauauggcaucauca

SEQ ID NO: 2152627 - RNA, 17 nt, Staphylococcus aureus subsp. aureus N315
ucauguauauggcauca

SEQ ID NO: 2152628 - RNA, 20 nt, Staphylococcus aureus subsp. aureus N315
ucauguaaugcuuaaaaaca

SEQ ID NO: 2152629 - RNA, 18 nt, Staphylococcus aureus subsp. aureus N315
ucauguacaguuacuuuc

SEQ ID NO: 2152630 - RNA, 13 nt, Staphylococcus aureus subsp. aureus N315
ucauuaaaucuga

SEQ ID NO: 2152631 - RNA, 19 nt, Staphylococcus aureus subsp. aureus N315
ucauuaaaucugauucauu

SEQ ID NO: 2152632 - RNA, 16 nt, Staphylococcus aureus subsp. aureus N315
ucauuaaccuuacaua

SEQ ID NO: 2152633 - RNA, 13 nt, Staphylococcus aureus subsp. aureus N315
ucauuuuuucaau

SEQ ID NO: 2152634 - RNA, 13 nt, Staphylococcus aureus subsp. aureus N315
uccaaaaauugua

SEQ ID NO: 2152635 - RNA, 23 nt, Staphylococcus aureus subsp. aureus N315
ucauuuguuguuauuauaaauau

SEQ ID NO: 2152636 - RNA, 18 nt, Staphylococcus aureus subsp. aureus N315
ucauuuucaaauaacuga

SEQ ID NO: 2152637 - RNA, 19 nt, Staphylococcus aureus subsp. aureus N315
ucauuuucaacauaauauu

SEQ ID NO: 2152638 - RNA, 12 nt, Staphylococcus aureus subsp. aureus N315
ucauuuucaaua

SEQ ID NO: 2152639 - RNA, 23 nt, Staphylococcus aureus subsp. aureus N315
ucauucuguguaaauauaaauau

SEQ ID NO: 2152640 - RNA, 16 nt, Staphylococcus aureus subsp. aureus N315
ucauucuuuaauauaa

SEQ ID NO: 2152641 - RNA, 20 nt, Staphylococcus aureus subsp. aureus N315
ucauucuuuaauauaaauuu

SEQ ID NO: 2152642 - RNA, 18 nt, Staphylococcus aureus subsp. aureus N315
ucauugaaaauaaucuua

SEQ ID NO: 2152643 - RNA, 18 nt, Staphylococcus aureus subsp. aureus N315
ucauugcuugguuugauu

SEQ ID NO: 2152644 - RNA, 16 nt, Staphylococcus aureus subsp. aureus N315
ucauugguuucaucau

SEQ ID NO: 2152645 - RNA, 19 nt, Staphylococcus aureus subsp. aureus N315
ucauugguuucaucauauc

SEQ ID NO: 2152646 - RNA, 14 nt, Staphylococcus aureus subsp. aureus N315
ucauuuguauagau

SEQ ID NO: 2152647 - RNA, 17 nt, Staphylococcus aureus subsp. aureus N315
ucauuuguguuuuuaau

SEQ ID NO: 2152648 - RNA, 12 nt, Staphylococcus aureus subsp. aureus N315
ucauuuguagga

SEQ ID NO: 2152649 - RNA, 12 nt, Staphylococcus aureus subsp. aureus N315
ucauuucaauca

SEQ ID NO: 2152650 - RNA, 17 nt, Staphylococcus aureus subsp. aureus N315
ucauuucaauauuaaaa

SEQ ID NO: 2152651 - RNA, 18 nt, Staphylococcus aureus subsp. aureus N315
ucauuucaauauuaaaau

SEQ ID NO: 2152652 - RNA, 17 nt, Staphylococcus aureus subsp. aureus N315
ucagccacugucaugug

SEQ ID NO: 2152653 - RNA, 20 nt, Staphylococcus aureus subsp. aureus N315
ucacuuacugugaaaauacc

SEQ ID NO: 2152654 - RNA, 19 nt, Staphylococcus aureus subsp. aureus N315
ucacuuaauaaauaauuuc

SEQ ID NO: 2152655 - RNA, 12 nt, Staphylococcus aureus subsp. aureus N315
ucacuuaauaaa

SEQ ID NO: 2152656 - RNA, 14 nt, Staphylococcus aureus subsp. aureus N315
ucacugaaugcuaa

SEQ ID NO: 2152657 - RNA, 15 nt, Staphylococcus aureus subsp. aureus N315
ucacucuuacucauu

SEQ ID NO: 2152658 - RNA, 14 nt, Staphylococcus aureus subsp. aureus N315
ucaggaauagaugu

SEQ ID NO: 2152659 - RNA, 16 nt, Staphylococcus aureus subsp. aureus N315
ucaggaauagauguca

SEQ ID NO: 2152660 - RNA, 22 nt, Staphylococcus aureus subsp. aureus N315
ucaggaucacguuuuucuuuaa

SEQ ID NO: 2152661 - RNA, 13 nt, Staphylococcus aureus subsp. aureus N315
ucagcuuuuucac

SEQ ID NO: 2152662 - RNA, 22 nt, Staphylococcus aureus subsp. aureus N315
ucagcuuuggcgacauaaauac

SEQ ID NO: 2152663 - RNA, 14 nt, Staphylococcus aureus subsp. aureus N315
ucagcugaugcuuc

SEQ ID NO: 2152664 - RNA, 15 nt, Staphylococcus aureus subsp. aureus N315
ucagcugaugcuucg

SEQ ID NO: 2152665 - RNA, 14 nt, Staphylococcus aureus subsp. aureus N315
ucagcuaaauauuu

SEQ ID NO: 2152666 - RNA, 15 nt, Staphylococcus aureus subsp. aureus N315
ucagcuaaguuaaau

SEQ ID NO: 2152667 - RNA, 16 nt, Staphylococcus aureus subsp. aureus N315
ucaggguuuaagauuu

SEQ ID NO: 2152668 - RNA, 17 nt, Staphylococcus aureus subsp. aureus N315
ucaguaaaaacgaaauu

SEQ ID NO: 2152669 - RNA, 24 nt, Staphylococcus aureus subsp. aureus N315
ucaguaaaaacgaaauuguuaucu

SEQ ID NO: 2152670 - RNA, 15 nt, Staphylococcus aureus subsp. aureus N315
ucaguaauaauguag

SEQ ID NO: 2152671 - RNA, 13 nt, Staphylococcus aureus subsp. aureus N315
ucaguaauaauac

SEQ ID NO: 2152672 - RNA, 16 nt, Staphylococcus aureus subsp. aureus N315
ucaguaccaaagaaau

SEQ ID NO: 2152673 - RNA, 18 nt, Staphylococcus aureus subsp. aureus N315
ucaggcuuuguuuuucac

SEQ ID NO: 2152674 - RNA, 21 nt, Staphylococcus aureus subsp. aureus N315
ucaggggccccaacacagaga

SEQ ID NO: 2152675 - RNA, 20 nt, Staphylococcus aureus subsp. aureus N315
ucauaaaaaucauaaauaac

SEQ ID NO: 2152676 - RNA, 16 nt, Staphylococcus aureus subsp. aureus N315
ucaguuuuuaaaucaa

SEQ ID NO: 2152677 - RNA, 18 nt, Staphylococcus aureus subsp. aureus N315
ucaguucaaacagaaauu

SEQ ID NO: 2152678 - RNA, 18 nt, Staphylococcus aureus subsp. aureus N315
ucaguuauaccauauuua

SEQ ID NO: 2152679 - RNA, 18 nt, Staphylococcus aureus subsp. aureus N315
ucagucaauucaaacuga

SEQ ID NO: 2152680 - RNA, 14 nt, Staphylococcus aureus subsp. aureus N315
ucagucaauucaaa

SEQ ID NO: 2152681 - RNA, 16 nt, Staphylococcus aureus subsp. aureus N315
ucagucaguaaaaaua

SEQ ID NO: 2152682 - RNA, 13 nt, Staphylococcus aureus subsp. aureus N315
ucauaaaauacca

SEQ ID NO: 2152683 - RNA, 13 nt, Staphylococcus aureus subsp. aureus N315
ucauaaaauuuaa

SEQ ID NO: 2152684 - RNA, 15 nt, Staphylococcus aureus subsp. aureus N315
ucauaaaauuuaaaa

SEQ ID NO: 2152685 - RNA, 15 nt, Staphylococcus aureus subsp. aureus N315
ucauaaaguuuauuu

SEQ ID NO: 2152686 - RNA, 18 nt, Staphylococcus aureus subsp. aureus N315
ucauaaaguuuauuuaug

SEQ ID NO: 2152687 - RNA, 16 nt, Staphylococcus aureus subsp. aureus N315
ucauaaauauaaaaua

SEQ ID NO: 2152688 - RNA, 12 nt, Staphylococcus aureus subsp. aureus N315
ucauaaauauuu

SEQ ID NO: 2152689 - RNA, 22 nt, Staphylococcus aureus subsp. aureus N315
ucauaaccgcuucuuuuaaguu

SEQ ID NO: 2152690 - RNA, 13 nt, Staphylococcus aureus subsp. aureus N315
ucauaauaauuca

SEQ ID NO: 2152691 - RNA, 19 nt, Staphylococcus aureus subsp. aureus N315
ucaucauaaucaagaauau

SEQ ID NO: 2152692 - RNA, 13 nt, Staphylococcus aureus subsp. aureus N315
ucaucauaaucug

SEQ ID NO: 2152693 - RNA, 19 nt, Staphylococcus aureus subsp. aureus N315
ucaucauaaucugcugcug

SEQ ID NO: 2152694 - RNA, 19 nt, Staphylococcus aureus subsp. aureus N315
ucaucaguaccaaagaaau

SEQ ID NO: 2152695 - RNA, 16 nt, Staphylococcus aureus subsp. aureus N315
ucaucacuuuuuaaac

SEQ ID NO: 2152696 - RNA, 20 nt, Staphylococcus aureus subsp. aureus N315
ucaucauuuaaaauuugugc

SEQ ID NO: 2152697 - RNA, 20 nt, Staphylococcus aureus subsp. aureus N315
ucaucauuaguuuuuaaaau

SEQ ID NO: 2152698 - RNA, 17 nt, Staphylococcus aureus subsp. aureus N315
ucaucauuaguuuuuaa

SEQ ID NO: 2152699 - RNA, 13 nt, Staphylococcus aureus subsp. aureus N315
ucaucauuacgaa

SEQ ID NO: 2152700 - RNA, 16 nt, Staphylococcus aureus subsp. aureus N315
ucaucauuaaaucuga

SEQ ID NO: 2152701 - RNA, 15 nt, Staphylococcus aureus subsp. aureus N315
ucaucauuaaaucug

SEQ ID NO: 2152702 - RNA, 20 nt, Staphylococcus aureus subsp. aureus N315
ucaucaugacuauuuuccau

SEQ ID NO: 2152703 - RNA, 21 nt, Staphylococcus aureus subsp. aureus N315
ucaucaugacuauuuuccauc

SEQ ID NO: 2152704 - RNA, 22 nt, Staphylococcus aureus subsp. aureus N315
ucaucaugcauaaucaucauug

SEQ ID NO: 2152705 - RNA, 15 nt, Staphylococcus aureus subsp. aureus N315
ucauccauaaaaaua

SEQ ID NO: 2152706 - RNA, 13 nt, Staphylococcus aureus subsp. aureus N315
ucauccauaaaaa

SEQ ID NO: 2152707 - RNA, 15 nt, Staphylococcus aureus subsp. aureus N315
ucauccgccaauuaa

SEQ ID NO: 2152708 - RNA, 18 nt, Staphylococcus aureus subsp. aureus N315
ucauauguuuuauaauaa

SEQ ID NO: 2152709 - RNA, 16 nt, Staphylococcus aureus subsp. aureus N315
ucauauucacaucuuu

SEQ ID NO: 2152710 - RNA, 21 nt, Staphylococcus aureus subsp. aureus N315
ucauauuuauauuuacacaga

SEQ ID NO: 2152711 - RNA, 20 nt, Staphylococcus aureus subsp. aureus N315
ucauauuugaauacuuuauu

SEQ ID NO: 2152712 - RNA, 13 nt, Staphylococcus aureus subsp. aureus N315
ucauauugaauac

SEQ ID NO: 2152713 - RNA, 22 nt, Staphylococcus aureus subsp. aureus N315
ucauaucauaccaaaaaguauu

SEQ ID NO: 2152714 - RNA, 14 nt, Staphylococcus aureus subsp. aureus N315
ucauauauuucuau

SEQ ID NO: 2152715 - RNA, 15 nt, Staphylococcus aureus subsp. aureus N315
ucauaucgauuaaua

SEQ ID NO: 2152716 - RNA, 17 nt, Staphylococcus aureus subsp. aureus N315
ucauaugugccauaugu

SEQ ID NO: 2152717 - RNA, 15 nt, Staphylococcus aureus subsp. aureus N315
ucauauggaauacua

SEQ ID NO: 2152718 - RNA, 15 nt, Staphylococcus aureus subsp. aureus N315
ucauaugcaucaaca

SEQ ID NO: 2152719 - RNA, 14 nt, Staphylococcus aureus subsp. aureus N315
ucauaucuuucaau

SEQ ID NO: 2152720 - RNA, 20 nt, Staphylococcus aureus subsp. aureus N315
ucauaucuuucaauuaauuu

SEQ ID NO: 2152721 - RNA, 14 nt, Staphylococcus aureus subsp. aureus N315
ucaucaaacaacau

SEQ ID NO: 2152722 - RNA, 15 nt, Staphylococcus aureus subsp. aureus N315
ucaucaaguuuaucu

SEQ ID NO: 2152723 - RNA, 12 nt, Staphylococcus aureus subsp. aureus N315
ucaucaauaagg

SEQ ID NO: 2152724 - RNA, 12 nt, Staphylococcus aureus subsp. aureus N315
ucaucaauaauu

SEQ ID NO: 2152725 - RNA, 20 nt, Staphylococcus aureus subsp. aureus N315
ucaucaccauacuaaaacau

SEQ ID NO: 2152726 - RNA, 16 nt, Staphylococcus aureus subsp. aureus N315
ucauagccuauuuaaa

SEQ ID NO: 2152727 - RNA, 21 nt, Staphylococcus aureus subsp. aureus N315
ucauagcaaauaaaacgcuuc

SEQ ID NO: 2152728 - RNA, 17 nt, Staphylococcus aureus subsp. aureus N315
ucauacuucaaacguua

SEQ ID NO: 2152729 - RNA, 15 nt, Staphylococcus aureus subsp. aureus N315
ucauauaugauaaau

SEQ ID NO: 2152730 - RNA, 19 nt, Staphylococcus aureus subsp. aureus N315
ucauauaaugguugaauaa

SEQ ID NO: 2152731 - RNA, 20 nt, Staphylococcus aureus subsp. aureus N315
ucauauaaaucaaauauacu

SEQ ID NO: 2152732 - RNA, 21 nt, Staphylococcus aureus subsp. aureus N315
ucauauaaaucguaauaauuu

SEQ ID NO: 2152733 - RNA, 20 nt, Staphylococcus aureus subsp. aureus N315
ucauauaaaacaaaaacggu

SEQ ID NO: 2152734 - RNA, 14 nt, Staphylococcus aureus subsp. aureus N315
ucauaguugucuuu

SEQ ID NO: 2152735 - RNA, 18 nt, Staphylococcus aureus subsp. aureus N315
ucauaguuauuaaaucuu

SEQ ID NO: 2152736 - RNA, 14 nt, Staphylococcus aureus subsp. aureus N315
ucauaguuauuaaa

SEQ ID NO: 2152737 - RNA, 15 nt, Staphylococcus aureus subsp. aureus N315
ucauaguuauuaaau

SEQ ID NO: 2152738 - RNA, 17 nt, Staphylococcus aureus subsp. aureus N315
ucauaccaaaaacauua

SEQ ID NO: 2152739 - RNA, 19 nt, Staphylococcus aureus subsp. aureus N315
ucauaccaaaaacauuaac

SEQ ID NO: 2152740 - RNA, 13 nt, Staphylococcus aureus subsp. aureus N315
ucauaccaaaaac

SEQ ID NO: 2152741 - RNA, 18 nt, Staphylococcus aureus subsp. aureus N315
ucauaccgaagaaacuaa

SEQ ID NO: 2152742 - RNA, 21 nt, Staphylococcus aureus subsp. aureus N315
ucauaaugaauaauuaaaaaa

SEQ ID NO: 2152743 - RNA, 11 nt, Staphylococcus aureus subsp. aureus N315
ucauaauuaau

SEQ ID NO: 2152744 - RNA, 20 nt, Staphylococcus aureus subsp. aureus N315
ucauaauuaacacauucaaa

SEQ ID NO: 2152745 - RNA, 16 nt, Staphylococcus aureus subsp. aureus N315
ucauaauuaauaacau

SEQ ID NO: 2152746 - RNA, 15 nt, Staphylococcus aureus subsp. aureus N315
ucauaauucaguguu

SEQ ID NO: 2152747 - RNA, 17 nt, Staphylococcus aureus subsp. aureus N315
ucauaaugaucaaguag

SEQ ID NO: 2152748 - RNA, 18 nt, Staphylococcus aureus subsp. aureus N315
ucauaaugaauaauuaaa

SEQ ID NO: 2152749 - RNA, 17 nt, Staphylococcus aureus subsp. aureus N315
ucacuacaguguaugau

SEQ ID NO: 2152750 - RNA, 16 nt, Staphylococcus aureus subsp. aureus N315
ucacuaaaguaaauaa

SEQ ID NO: 2152751 - RNA, 17 nt, Staphylococcus aureus subsp. aureus N315
ucacuaaaguaaauaac

SEQ ID NO: 2152752 - RNA, 22 nt, Staphylococcus aureus subsp. aureus N315
ucacgguuuacccacuuauaaa

SEQ ID NO: 2152753 - RNA, 17 nt, Staphylococcus aureus subsp. aureus N315
ucacguaaugaaucaau

SEQ ID NO: 2152754 - RNA, 14 nt, Staphylococcus aureus subsp. aureus N315
ucacguaaugaauc

SEQ ID NO: 2152755 - RNA, 20 nt, Staphylococcus aureus subsp. aureus N315
ucacuaaucucgguacauuu

SEQ ID NO: 2152756 - RNA, 13 nt, Staphylococcus aureus subsp. aureus N315
ucacgauuuucaa

SEQ ID NO: 2152757 - RNA, 18 nt, Staphylococcus aureus subsp. aureus N315
ucacgauuuuuaaaaugc

SEQ ID NO: 2152758 - RNA, 15 nt, Staphylococcus aureus subsp. aureus N315
ucacgauuuuuaaaa

SEQ ID NO: 2152759 - RNA, 14 nt, Staphylococcus aureus subsp. aureus N315
ucacgcugaaauuu

SEQ ID NO: 2152760 - RNA, 12 nt, Staphylococcus aureus subsp. aureus N315
ucacgcuaacau

SEQ ID NO: 2152761 - RNA, 15 nt, Staphylococcus aureus subsp. aureus N315
ucaccuuaucaugac

SEQ ID NO: 2152762 - RNA, 17 nt, Staphylococcus aureus subsp. aureus N315
ucaccuaaaaagaaaau

SEQ ID NO: 2152763 - RNA, 14 nt, Staphylococcus aureus subsp. aureus N315
ucaccuuuaggcaa

SEQ ID NO: 2152764 - RNA, 14 nt, Staphylococcus aureus subsp. aureus N315
ucaccuuuuuuaac

SEQ ID NO: 2152765 - RNA, 21 nt, Staphylococcus aureus subsp. aureus N315
ucaccuuuaggcaaauaaccu

SEQ ID NO: 2152766 - RNA, 14 nt, Staphylococcus aureus subsp. aureus N315
ucacgaauaucuua

SEQ ID NO: 2152767 - RNA, 14 nt, Staphylococcus aureus subsp. aureus N315
ucacgauauaacau

SEQ ID NO: 2152768 - RNA, 19 nt, Staphylococcus aureus subsp. aureus N315
ucacgauauaacauuaaaa

SEQ ID NO: 2152769 - RNA, 16 nt, Staphylococcus aureus subsp. aureus N315
ucacgaucaaauuuaa

SEQ ID NO: 2152770 - RNA, 13 nt, Staphylococcus aureus subsp. aureus N315
ucacgaucuuuaa

SEQ ID NO: 2152771 - RNA, 20 nt, Staphylococcus aureus subsp. aureus N315
ucacgauuaauaaaauucua

SEQ ID NO: 2152772 - RNA, 21 nt, Staphylococcus aureus subsp. aureus N315
ucacgauuacgcucauauguc

SEQ ID NO: 2152773 - RNA, 19 nt, Staphylococcus aureus subsp. aureus N315
ucacgacuugauagcauuu

SEQ ID NO: 2152774 - RNA, 19 nt, Staphylococcus aureus subsp. aureus N315
ucaccguaaucuuuuaacu

SEQ ID NO: 2152775 - RNA, 19 nt, Staphylococcus aureus subsp. aureus N315
ucacauucuugaauaaauu

SEQ ID NO: 2152776 - RNA, 20 nt, Staphylococcus aureus subsp. aureus N315
ucacauucuugaauaaauuu

SEQ ID NO: 2152777 - RNA, 18 nt, Staphylococcus aureus subsp. aureus N315
ucacauuaaguuaaacgu

SEQ ID NO: 2152778 - RNA, 14 nt, Staphylococcus aureus subsp. aureus N315
ucaccaauauuaau

SEQ ID NO: 2152779 - RNA, 17 nt, Staphylococcus aureus subsp. aureus N315
ucaccaacuuuuuuaac

SEQ ID NO: 2152780 - RNA, 16 nt, Staphylococcus aureus subsp. aureus N315
ucacauuuucaaauuu

SEQ ID NO: 2152781 - RNA, 14 nt, Staphylococcus aureus subsp. aureus N315
ucaccagauuuuaa

SEQ ID NO: 2152782 - RNA, 15 nt, Staphylococcus aureus subsp. aureus N315
ucacaaguucaggau

SEQ ID NO: 2152783 - RNA, 21 nt, Staphylococcus aureus subsp. aureus N315
ucacaaugaccauugucaugc

SEQ ID NO: 2152784 - RNA, 21 nt, Staphylococcus aureus subsp. aureus N315
ucacaauacgaaaucaaaaau

SEQ ID NO: 2152785 - RNA, 14 nt, Staphylococcus aureus subsp. aureus N315
ucacaauauaacau

SEQ ID NO: 2152786 - RNA, 19 nt, Staphylococcus aureus subsp. aureus N315
ucacaaauucaacuuuuca

SEQ ID NO: 2152787 - RNA, 20 nt, Staphylococcus aureus subsp. aureus N315
ucaauguuuaauuuucuaaa

SEQ ID NO: 2152788 - RNA, 16 nt, Staphylococcus aureus subsp. aureus N315
ucaauguuuuaaauuu

SEQ ID NO: 2152789 - RNA, 19 nt, Staphylococcus aureus subsp. aureus N315
ucaauguuuuaaauuuaua

SEQ ID NO: 2152790 - RNA, 16 nt, Staphylococcus aureus subsp. aureus N315
ucaauguuuaauuuuc

SEQ ID NO: 2152791 - RNA, 20 nt, Staphylococcus aureus subsp. aureus N315
ucaauuaaucggaucauuau

SEQ ID NO: 2152792 - RNA, 23 nt, Staphylococcus aureus subsp. aureus N315
ucaauuaauuuagucauuacaaa

SEQ ID NO: 2152793 - RNA, 20 nt, Staphylococcus aureus subsp. aureus N315
ucaauuaauuuaaaugcuua

SEQ ID NO: 2152794 - RNA, 14 nt, Staphylococcus aureus subsp. aureus N315
ucaauuucuauuuc

SEQ ID NO: 2152795 - RNA, 13 nt, Staphylococcus aureus subsp. aureus N315
ucaauuaguucug

SEQ ID NO: 2152796 - RNA, 15 nt, Staphylococcus aureus subsp. aureus N315
ucaauuagaaaauuu

SEQ ID NO: 2152797 - RNA, 15 nt, Staphylococcus aureus subsp. aureus N315
ucaaucgcauuuugu

SEQ ID NO: 2152798 - RNA, 14 nt, Staphylococcus aureus subsp. aureus N315
ucaauguuauuaaa

SEQ ID NO: 2152799 - RNA, 21 nt, Staphylococcus aureus subsp. aureus N315
ucaauauuaaucauaaugaau

SEQ ID NO: 2152800 - RNA, 22 nt, Staphylococcus aureus subsp. aureus N315
ucaauauuaaucauaaugaaua

SEQ ID NO: 2152801 - RNA, 19 nt, Staphylococcus aureus subsp. aureus N315
ucaauauucuuaucauuca

SEQ ID NO: 2152802 - RNA, 19 nt, Staphylococcus aureus subsp. aureus N315
ucaaguucaccguaaucuu

SEQ ID NO: 2152803 - RNA, 20 nt, Staphylococcus aureus subsp. aureus N315
ucaaguucaccguaaucuuu

SEQ ID NO: 2152804 - RNA, 13 nt, Staphylococcus aureus subsp. aureus N315
ucaauauuaaaau

SEQ ID NO: 2152805 - RNA, 20 nt, Staphylococcus aureus subsp. aureus N315
ucaagugccauuuuuaaauu

SEQ ID NO: 2152806 - RNA, 16 nt, Staphylococcus aureus subsp. aureus N315
ucaaguguaguaaaaa

SEQ ID NO: 2152807 - RNA, 13 nt, Staphylococcus aureus subsp. aureus N315
ucaauauuuaaau

SEQ ID NO: 2152808 - RNA, 23 nt, Staphylococcus aureus subsp. aureus N315
ucaaucaacgagucauaaauaua

SEQ ID NO: 2152809 - RNA, 22 nt, Staphylococcus aureus subsp. aureus N315
ucaauccaauuaaauauuuaac

SEQ ID NO: 2152810 - RNA, 21 nt, Staphylococcus aureus subsp. aureus N315
ucaauccuaaauuauaaauag

SEQ ID NO: 2152811 - RNA, 15 nt, Staphylococcus aureus subsp. aureus N315
ucaaguaaugauauu

SEQ ID NO: 2152812 - RNA, 20 nt, Staphylococcus aureus subsp. aureus N315
ucaaguaauggauugauaau

SEQ ID NO: 2152813 - RNA, 20 nt, Staphylococcus aureus subsp. aureus N315
ucaagcugagcuuuaauuuu

SEQ ID NO: 2152814 - RNA, 18 nt, Staphylococcus aureus subsp. aureus N315
ucaagcaucauuuuucgu

SEQ ID NO: 2152815 - RNA, 17 nt, Staphylococcus aureus subsp. aureus N315
ucaaaugacauuuuaaa

SEQ ID NO: 2152816 - RNA, 22 nt, Staphylococcus aureus subsp. aureus N315
ucaaaugacauuuuaaaucuaa

SEQ ID NO: 2152817 - RNA, 21 nt, Staphylococcus aureus subsp. aureus N315
ucaacguauauaaguuaaaau

SEQ ID NO: 2152818 - RNA, 19 nt, Staphylococcus aureus subsp. aureus N315
ucaacguauauaaguuaaa

SEQ ID NO: 2152819 - RNA, 16 nt, Staphylococcus aureus subsp. aureus N315
ucaacgucaucugcuu

SEQ ID NO: 2152820 - RNA, 18 nt, Staphylococcus aureus subsp. aureus N315
ucaacugcugcuaaaaua

SEQ ID NO: 2152821 - RNA, 19 nt, Staphylococcus aureus subsp. aureus N315
ucaacugcugcuaaaauaa

SEQ ID NO: 2152822 - RNA, 15 nt, Staphylococcus aureus subsp. aureus N315
ucaagaaauguuaaa

SEQ ID NO: 2152823 - RNA, 15 nt, Staphylococcus aureus subsp. aureus N315
ucaagaaaaaguuuu

SEQ ID NO: 2152824 - RNA, 17 nt, Staphylococcus aureus subsp. aureus N315
ucaacuuagaauuuaca

SEQ ID NO: 2152825 - RNA, 21 nt, Staphylococcus aureus subsp. aureus N315
ucaacuuauaaaaugaaauau

SEQ ID NO: 2152826 - RNA, 20 nt, Staphylococcus aureus subsp. aureus N315
ucaagaaauguuaaauuaaa

SEQ ID NO: 2152827 - RNA, 12 nt, Staphylococcus aureus subsp. aureus N315
ucaagaauauaa

SEQ ID NO: 2152828 - RNA, 18 nt, Staphylococcus aureus subsp. aureus N315
ucaagaacuuuaaaaauu

SEQ ID NO: 2152829 - RNA, 14 nt, Staphylococcus aureus subsp. aureus N315
ucaagaacuuuaaa

SEQ ID NO: 2152830 - RNA, 15 nt, Staphylococcus aureus subsp. aureus N315
ucaagaacuuuaaaa

SEQ ID NO: 2152831 - RNA, 16 nt, Staphylococcus aureus subsp. aureus N315
ucaagagguaaaucug

SEQ ID NO: 2152832 - RNA, 20 nt, Staphylococcus aureus subsp. aureus N315
ucaagacucccuuuuuaaaa

SEQ ID NO: 2152833 - RNA, 19 nt, Staphylococcus aureus subsp. aureus N315
ucaagaccaaauauuuuau

SEQ ID NO: 2152834 - RNA, 14 nt, Staphylococcus aureus subsp. aureus N315
ucaagaccaugcaa

SEQ ID NO: 2152835 - RNA, 18 nt, Staphylococcus aureus subsp. aureus N315
ucaagaccaugcaaacuc

SEQ ID NO: 2152836 - RNA, 17 nt, Staphylococcus aureus subsp. aureus N315
uauucaauguuuuaaau

SEQ ID NO: 2152837 - RNA, 21 nt, Staphylococcus aureus subsp. aureus N315
uauucagucaguaaaaauaca

SEQ ID NO: 2152838 - RNA, 23 nt, Staphylococcus aureus subsp. aureus N315
uauucauagaccuaugaauuuag

SEQ ID NO: 2152839 - RNA, 16 nt, Staphylococcus aureus subsp. aureus N315
uauuccuucuaacaua

SEQ ID NO: 2152840 - RNA, 16 nt, Staphylococcus aureus subsp. aureus N315
uauucauuuuaaauuu

SEQ ID NO: 2152841 - RNA, 13 nt, Staphylococcus aureus subsp. aureus N315
uauucauuuuaaa

SEQ ID NO: 2152842 - RNA, 21 nt, Staphylococcus aureus subsp. aureus N315
uauuccaaauuugaaacaaug

SEQ ID NO: 2152843 - RNA, 12 nt, Staphylococcus aureus subsp. aureus N315
uauucuauuuuu

SEQ ID NO: 2152844 - RNA, 22 nt, Staphylococcus aureus subsp. aureus N315
uauucucugcuucuaaaacauc

SEQ ID NO: 2152845 - RNA, 21 nt, Staphylococcus aureus subsp. aureus N315
uauucugagauugagaauuca

SEQ ID NO: 2152846 - RNA, 19 nt, Staphylococcus aureus subsp. aureus N315
uauuauccucaaauauauu

SEQ ID NO: 2152847 - RNA, 19 nt, Staphylococcus aureus subsp. aureus N315
uauuaucaaagaaauguau

SEQ ID NO: 2152848 - RNA, 17 nt, Staphylococcus aureus subsp. aureus N315
uauuauauugaauugaa

SEQ ID NO: 2152849 - RNA, 15 nt, Staphylococcus aureus subsp. aureus N315
uauuauuauugaaau

SEQ ID NO: 2152850 - RNA, 14 nt, Staphylococcus aureus subsp. aureus N315
uauuauuauaauuu

SEQ ID NO: 2152851 - RNA, 19 nt, Staphylococcus aureus subsp. aureus N315
uauuauuauaauuuuguuu

SEQ ID NO: 2152852 - RNA, 15 nt, Staphylococcus aureus subsp. aureus N315
uauuauuauguuaua

SEQ ID NO: 2152853 - RNA, 14 nt, Staphylococcus aureus subsp. aureus N315
uauuauuaugugua

SEQ ID NO: 2152854 - RNA, 21 nt, Staphylococcus aureus subsp. aureus N315
uauuauugaaacuaauaauuu

SEQ ID NO: 2152855 - RNA, 13 nt, Staphylococcus aureus subsp. aureus N315
uauuauucucuca

SEQ ID NO: 2152856 - RNA, 12 nt, Staphylococcus aureus subsp. aureus N315
uauuauugaaau

SEQ ID NO: 2152857 - RNA, 19 nt, Staphylococcus aureus subsp. aureus N315
uauuagccaauaaaauguc

SEQ ID NO: 2152858 - RNA, 16 nt, Staphylococcus aureus subsp. aureus N315
uauuagagcagauucu

SEQ ID NO: 2152859 - RNA, 14 nt, Staphylococcus aureus subsp. aureus N315
uauuagauauauuu

SEQ ID NO: 2152860 - RNA, 16 nt, Staphylococcus aureus subsp. aureus N315
uauuaggcuuaaauau

SEQ ID NO: 2152861 - RNA, 21 nt, Staphylococcus aureus subsp. aureus N315
uauuaggcuuaaauauaauga

SEQ ID NO: 2152862 - RNA, 15 nt, Staphylococcus aureus subsp. aureus N315
uauuauaauuuuguu

SEQ ID NO: 2152863 - RNA, 14 nt, Staphylococcus aureus subsp. aureus N315
uauccauuaugaug

SEQ ID NO: 2152864 - RNA, 20 nt, Staphylococcus aureus subsp. aureus N315
uauccauuaugauguagaug

SEQ ID NO: 2152865 - RNA, 23 nt, Staphylococcus aureus subsp. aureus N315
uauccgaaaauugcuaaaaaaau

SEQ ID NO: 2152866 - RNA, 24 nt, Staphylococcus aureus subsp. aureus N315
uauccgcaucuuuugguuuaucug

SEQ ID NO: 2152867 - RNA, 21 nt, Staphylococcus aureus subsp. aureus N315
uauuacuaaccuauuaaaaua

SEQ ID NO: 2152868 - RNA, 22 nt, Staphylococcus aureus subsp. aureus N315
uauuacuacauaauuuaucaau

SEQ ID NO: 2152869 - RNA, 12 nt, Staphylococcus aureus subsp. aureus N315
uauuacuauaaa

SEQ ID NO: 2152870 - RNA, 15 nt, Staphylococcus aureus subsp. aureus N315
uauuacuauaaaaaa

SEQ ID NO: 2152871 - RNA, 14 nt, Staphylococcus aureus subsp. aureus N315
uauuacuugaaaau

SEQ ID NO: 2152872 - RNA, 17 nt, Staphylococcus aureus subsp. aureus N315
uauucuguaacguuacu

SEQ ID NO: 2152873 - RNA, 14 nt, Staphylococcus aureus subsp. aureus N315
aaaucgaacaaaug

SEQ ID NO: 2152874 - RNA, 14 nt, Staphylococcus aureus subsp. aureus N315
uauugaauugaaaa

SEQ ID NO: 2152875 - RNA, 12 nt, Staphylococcus aureus subsp. aureus N315
uauugaauggcu

SEQ ID NO: 2152876 - RNA, 13 nt, Staphylococcus aureus subsp. aureus N315
uauugaauaauca

SEQ ID NO: 2152877 - RNA, 18 nt, Staphylococcus aureus subsp. aureus N315
uauugaauauaaaaaaca

SEQ ID NO: 2152878 - RNA, 14 nt, Staphylococcus aureus subsp. aureus N315
uauugauauucuaa

SEQ ID NO: 2152879 - RNA, 23 nt, Staphylococcus aureus subsp. aureus N315
uauugccgguuaaauuauuuaau

SEQ ID NO: 2152880 - RNA, 13 nt, Staphylococcus aureus subsp. aureus N315
uauugauauucua

SEQ ID NO: 2152881 - RNA, 20 nt, Staphylococcus aureus subsp. aureus N315
uauugaugaaaacaaacaag

SEQ ID NO: 2152882 - RNA, 22 nt, Staphylococcus aureus subsp. aureus N315
uauugaugaaaacaaacaagca

SEQ ID NO: 2152883 - RNA, 12 nt, Staphylococcus aureus subsp. aureus N315
uauuuaaaauca

SEQ ID NO: 2152884 - RNA, 23 nt, Staphylococcus aureus subsp. aureus N315
uauuuaaaauauuauuuuuaagu

SEQ ID NO: 2152885 - RNA, 19 nt, Staphylococcus aureus subsp. aureus N315
uauuuaaaauauuauuuuu

SEQ ID NO: 2152886 - RNA, 18 nt, Staphylococcus aureus subsp. aureus N315
uauuuaaaacuuguaaau

SEQ ID NO: 2152887 - RNA, 16 nt, Staphylococcus aureus subsp. aureus N315
uauuuaaacuaguaau

SEQ ID NO: 2152888 - RNA, 19 nt, Staphylococcus aureus subsp. aureus N315
uauuuaaacucucuaaaaa

SEQ ID NO: 2152889 - RNA, 21 nt, Staphylococcus aureus subsp. aureus N315
uauuuaaacucucuaaaaagc

SEQ ID NO: 2152890 - RNA, 23 nt, Staphylococcus aureus subsp. aureus N315
uauugccguuauuuucaauaaau

SEQ ID NO: 2152891 - RNA, 20 nt, Staphylococcus aureus subsp. aureus N315
uauugccuaaccuguuugag

SEQ ID NO: 2152892 - RNA, 13 nt, Staphylococcus aureus subsp. aureus N315
uauugguugaaau

SEQ ID NO: 2152893 - RNA, 17 nt, Staphylococcus aureus subsp. aureus N315
uauugguugaaauuaau

SEQ ID NO: 2152894 - RNA, 22 nt, Staphylococcus aureus subsp. aureus N315
uauuuacauugccacuuuugug

SEQ ID NO: 2152895 - RNA, 16 nt, Staphylococcus aureus subsp. aureus N315
uauuuacacacaugau

SEQ ID NO: 2152896 - RNA, 14 nt, Staphylococcus aureus subsp. aureus N315
uauuuagaauaaac

SEQ ID NO: 2152897 - RNA, 15 nt, Staphylococcus aureus subsp. aureus N315
uauuuauauuaaaua

SEQ ID NO: 2152898 - RNA, 17 nt, Staphylococcus aureus subsp. aureus N315
uauuuauauuaaauacu

SEQ ID NO: 2152899 - RNA, 14 nt, Staphylococcus aureus subsp. aureus N315
uauuuauauuaaau

SEQ ID NO: 2152900 - RNA, 18 nt, Staphylococcus aureus subsp. aureus N315
uauuuauacuaaauugag

SEQ ID NO: 2152901 - RNA, 17 nt, Staphylococcus aureus subsp. aureus N315
uauuuauacuauaaaua

SEQ ID NO: 2152902 - RNA, 16 nt, Staphylococcus aureus subsp. aureus N315
uauuuauacuaaauug

SEQ ID NO: 2152903 - RNA, 15 nt, Staphylococcus aureus subsp. aureus N315
uauuuauaaacaaua

SEQ ID NO: 2152904 - RNA, 18 nt, Staphylococcus aureus subsp. aureus N315
uauuuauaaaauaaaaug

SEQ ID NO: 2152905 - RNA, 12 nt, Staphylococcus aureus subsp. aureus N315
uauuuauaauuu

SEQ ID NO: 2152906 - RNA, 22 nt, Staphylococcus aureus subsp. aureus N315
uauuuaggacgugccuuaacuu

SEQ ID NO: 2152907 - RNA, 17 nt, Staphylococcus aureus subsp. aureus N315
uauuuaggaguauccug

SEQ ID NO: 2152908 - RNA, 21 nt, Staphylococcus aureus subsp. aureus N315
uauuuagcuugcuuacaauaa

SEQ ID NO: 2152909 - RNA, 21 nt, Staphylococcus aureus subsp. aureus N315
uauuuagcaucuuuaccauau

SEQ ID NO: 2152910 - RNA, 16 nt, Staphylococcus aureus subsp. aureus N315
uauuucagcuuauuaa

SEQ ID NO: 2152911 - RNA, 14 nt, Staphylococcus aureus subsp. aureus N315
uauuucagcuuauu

SEQ ID NO: 2152912 - RNA, 21 nt, Staphylococcus aureus subsp. aureus N315
uauuucacucuacaauccuau

SEQ ID NO: 2152913 - RNA, 16 nt, Staphylococcus aureus subsp. aureus N315
uauuucaacaaacaua

SEQ ID NO: 2152914 - RNA, 17 nt, Staphylococcus aureus subsp. aureus N315
uauuucaaaaauaguaa

SEQ ID NO: 2152915 - RNA, 14 nt, Staphylococcus aureus subsp. aureus N315
uauuucaauaauaa

SEQ ID NO: 2152916 - RNA, 23 nt, Staphylococcus aureus subsp. aureus N315
uauuuauucuaaucuaaauucag

SEQ ID NO: 2152917 - RNA, 19 nt, Staphylococcus aureus subsp. aureus N315
uauuuauucuaaucuaaau

SEQ ID NO: 2152918 - RNA, 21 nt, Staphylococcus aureus subsp. aureus N315
uauuuauguucgauuauucuu

SEQ ID NO: 2152919 - RNA, 12 nt, Staphylococcus aureus subsp. aureus N315
uauuuaucuuua

SEQ ID NO: 2152920 - RNA, 15 nt, Staphylococcus aureus subsp. aureus N315
uauuuaucauacuuc

SEQ ID NO: 2152921 - RNA, 16 nt, Staphylococcus aureus subsp. aureus N315
uauuuaucaauaaauc

SEQ ID NO: 2152922 - RNA, 17 nt, Staphylococcus aureus subsp. aureus N315
uauuuauuuuauaauaa

SEQ ID NO: 2152923 - RNA, 12 nt, Staphylococcus aureus subsp. aureus N315
uauuuauuuaau

SEQ ID NO: 2152924 - RNA, 17 nt, Staphylococcus aureus subsp. aureus N315
ucaaaaccgcuauaaaa

SEQ ID NO: 2152925 - RNA, 21 nt, Staphylococcus aureus subsp. aureus N315
ucaaaacaauuuaaaaagcag

SEQ ID NO: 2152926 - RNA, 12 nt, Staphylococcus aureus subsp. aureus N315
ucaaaaaucaua

SEQ ID NO: 2152927 - RNA, 18 nt, Staphylococcus aureus subsp. aureus N315
ucaaaaaugcuuauauaa

SEQ ID NO: 2152928 - RNA, 13 nt, Staphylococcus aureus subsp. aureus N315
ucaaaaaauaaua

SEQ ID NO: 2152929 - RNA, 21 nt, Staphylococcus aureus subsp. aureus N315
uauuuuuugugccuuucucua

SEQ ID NO: 2152930 - RNA, 22 nt, Staphylococcus aureus subsp. aureus N315
uauuuuuugugccuuucucuaa

SEQ ID NO: 2152931 - RNA, 22 nt, Staphylococcus aureus subsp. aureus N315
uauuuuuuuguccaauaaauug

SEQ ID NO: 2152932 - RNA, 19 nt, Staphylococcus aureus subsp. aureus N315
uauuuuuugagcacuuaau

SEQ ID NO: 2152933 - RNA, 12 nt, Staphylococcus aureus subsp. aureus N315
uauuuuuuucuu

SEQ ID NO: 2152934 - RNA, 14 nt, Staphylococcus aureus subsp. aureus N315
uauuuuuuuaugcu

SEQ ID NO: 2152935 - RNA, 13 nt, Staphylococcus aureus subsp. aureus N315
uauuuuuuuaugc

SEQ ID NO: 2152936 - RNA, 17 nt, Staphylococcus aureus subsp. aureus N315
uauuuuugauuuaauaa

SEQ ID NO: 2152937 - RNA, 21 nt, Staphylococcus aureus subsp. aureus N315
uauuuuuuaaaaugauagcua

SEQ ID NO: 2152938 - RNA, 15 nt, Staphylococcus aureus subsp. aureus N315
uauuuuuuaaaauga

SEQ ID NO: 2152939 - RNA, 13 nt, Staphylococcus aureus subsp. aureus N315
uauuuuuuaaaau

SEQ ID NO: 2152940 - RNA, 15 nt, Staphylococcus aureus subsp. aureus N315
uauuuuuuauggucu

SEQ ID NO: 2152941 - RNA, 21 nt, Staphylococcus aureus subsp. aureus N315
ucaaauacguaucaagaaaaa

SEQ ID NO: 2152942 - RNA, 17 nt, Staphylococcus aureus subsp. aureus N315
ucaaauacauuucaaaa

SEQ ID NO: 2152943 - RNA, 16 nt, Staphylococcus aureus subsp. aureus N315
ucaaauccaaaaucuu

SEQ ID NO: 2152944 - RNA, 14 nt, Staphylococcus aureus subsp. aureus N315
ucaaauaaugaaua

SEQ ID NO: 2152945 - RNA, 22 nt, Staphylococcus aureus subsp. aureus N315
ucaaauaaugugaaaaaucuuc

SEQ ID NO: 2152946 - RNA, 17 nt, Staphylococcus aureus subsp. aureus N315
ucaaauaaccuauuaau

SEQ ID NO: 2152947 - RNA, 15 nt, Staphylococcus aureus subsp. aureus N315
ucaaaguuuucauuu

SEQ ID NO: 2152948 - RNA, 22 nt, Staphylococcus aureus subsp. aureus N315
ucaaaguuuaauugcuguaaau

SEQ ID NO: 2152949 - RNA, 17 nt, Staphylococcus aureus subsp. aureus N315
ucaaagaggcuuuaaaa

SEQ ID NO: 2152950 - RNA, 23 nt, Staphylococcus aureus subsp. aureus N315
ucaaaguagauauugaauggagu

SEQ ID NO: 2152951 - RNA, 14 nt, Staphylococcus aureus subsp. aureus N315
ucaaaguagacauu

SEQ ID NO: 2152952 - RNA, 22 nt, Staphylococcus aureus subsp. aureus N315
ucaaagguuuacuauuaaagga

SEQ ID NO: 2152953 - RNA, 16 nt, Staphylococcus aureus subsp. aureus N315
ucaaagucuucuucaa

SEQ ID NO: 2152954 - RNA, 13 nt, Staphylococcus aureus subsp. aureus N315
ucaaaauauaaaa

SEQ ID NO: 2152955 - RNA, 15 nt, Staphylococcus aureus subsp. aureus N315
ucaaacggaauuaaa

SEQ ID NO: 2152956 - RNA, 12 nt, Staphylococcus aureus subsp. aureus N315
uauuuucuuaga

SEQ ID NO: 2152957 - RNA, 13 nt, Staphylococcus aureus subsp. aureus N315
uauuuucucuaua

SEQ ID NO: 2152958 - RNA, 17 nt, Staphylococcus aureus subsp. aureus N315
uauuuucucuauaauuu

SEQ ID NO: 2152959 - RNA, 18 nt, Staphylococcus aureus subsp. aureus N315
uauuuucugccauaaaca

SEQ ID NO: 2152960 - RNA, 13 nt, Staphylococcus aureus subsp. aureus N315
uauuuucauuuua

SEQ ID NO: 2152961 - RNA, 17 nt, Staphylococcus aureus subsp. aureus N315
uauuuucaguuaaaaua

SEQ ID NO: 2152962 - RNA, 14 nt, Staphylococcus aureus subsp. aureus N315
uauuuucauuuuag

SEQ ID NO: 2152963 - RNA, 20 nt, Staphylococcus aureus subsp. aureus N315
uauuuuuaaaugauucuuua

SEQ ID NO: 2152964 - RNA, 13 nt, Staphylococcus aureus subsp. aureus N315
uauuuuuaucauc

SEQ ID NO: 2152965 - RNA, 16 nt, Staphylococcus aureus subsp. aureus N315
uauuuuguuuuaaaaa

SEQ ID NO: 2152966 - RNA, 15 nt, Staphylococcus aureus subsp. aureus N315
uauuuugcaauugca

SEQ ID NO: 2152967 - RNA, 13 nt, Staphylococcus aureus subsp. aureus N315
uauuuuaauauuu

SEQ ID NO: 2152968 - RNA, 22 nt, Staphylococcus aureus subsp. aureus N315
uauuuuaaacguaucauuuaaa

SEQ ID NO: 2152969 - RNA, 23 nt, Staphylococcus aureus subsp. aureus N315
uauuuuaaacguaucauuuaaaa

SEQ ID NO: 2152970 - RNA, 13 nt, Staphylococcus aureus subsp. aureus N315
uauuuuaaacaug

SEQ ID NO: 2152971 - RNA, 19 nt, Staphylococcus aureus subsp. aureus N315
uauuuuauaagaauuuaaa

SEQ ID NO: 2152972 - RNA, 17 nt, Staphylococcus aureus subsp. aureus N315
uauuuuauaauaaauuu

SEQ ID NO: 2152973 - RNA, 14 nt, Staphylococcus aureus subsp. aureus N315
uauuuuauaauaaa

SEQ ID NO: 2152974 - RNA, 20 nt, Staphylococcus aureus subsp. aureus N315
uauuuuauaagaauuuaaaa

SEQ ID NO: 2152975 - RNA, 19 nt, Staphylococcus aureus subsp. aureus N315
uauuuuaucaucuauucaa

SEQ ID NO: 2152976 - RNA, 12 nt, Staphylococcus aureus subsp. aureus N315
uauuuuaucugu

SEQ ID NO: 2152977 - RNA, 14 nt, Staphylococcus aureus subsp. aureus N315
uauuuuauuuaaaa

SEQ ID NO: 2152978 - RNA, 17 nt, Staphylococcus aureus subsp. aureus N315
uauuuuauuuaaaaaua

SEQ ID NO: 2152979 - RNA, 15 nt, Staphylococcus aureus subsp. aureus N315
uauuuuauuuaaaaa

SEQ ID NO: 2152980 - RNA, 16 nt, Staphylococcus aureus subsp. aureus N315
uauuuucaauaaauuu

SEQ ID NO: 2152981 - RNA, 19 nt, Staphylococcus aureus subsp. aureus N315
uauuuucaauaaauuuuau

SEQ ID NO: 2152982 - RNA, 16 nt, Staphylococcus aureus subsp. aureus N315
uauuuucaauuagaaa

SEQ ID NO: 2152983 - RNA, 15 nt, Staphylococcus aureus subsp. aureus N315
uauuucauuagaaaa

SEQ ID NO: 2152984 - RNA, 16 nt, Staphylococcus aureus subsp. aureus N315
uauuucccuaugaaau

SEQ ID NO: 2152985 - RNA, 13 nt, Staphylococcus aureus subsp. aureus N315
uauuucuaaauua

SEQ ID NO: 2152986 - RNA, 16 nt, Staphylococcus aureus subsp. aureus N315
uauuucuaaauuauuu

SEQ ID NO: 2152987 - RNA, 19 nt, Staphylococcus aureus subsp. aureus N315
uauuucuauaucuauuuau

SEQ ID NO: 2152988 - RNA, 18 nt, Staphylococcus aureus subsp. aureus N315
uauuucuauuccuucuaa

SEQ ID NO: 2152989 - RNA, 21 nt, Staphylococcus aureus subsp. aureus N315
uauuucuauuccuucuaacau

SEQ ID NO: 2152990 - RNA, 18 nt, Staphylococcus aureus subsp. aureus N315
uauuugccuuuugaauaa

SEQ ID NO: 2152991 - RNA, 18 nt, Staphylococcus aureus subsp. aureus N315
uauuugauuauucuucau

SEQ ID NO: 2152992 - RNA, 17 nt, Staphylococcus aureus subsp. aureus N315
uauuugauucuauuucu

SEQ ID NO: 2152993 - RNA, 19 nt, Staphylococcus aureus subsp. aureus N315
uauuugcuagucauaauuu

SEQ ID NO: 2152994 - RNA, 14 nt, Staphylococcus aureus subsp. aureus N315
uauuugaauacuuu

SEQ ID NO: 2152995 - RNA, 16 nt, Staphylococcus aureus subsp. aureus N315
uauuugaaugcaaauc

SEQ ID NO: 2152996 - RNA, 22 nt, Staphylococcus aureus subsp. aureus N315
uauuugaaugcaaaucaaauac

SEQ ID NO: 2152997 - RNA, 19 nt, Staphylococcus aureus subsp. aureus N315
uauuugacacauuauugaa

SEQ ID NO: 2152998 - RNA, 16 nt, Staphylococcus aureus subsp. aureus N315
uauuugauaaauaaaa

SEQ ID NO: 2152999 - RNA, 15 nt, Staphylococcus aureus subsp. aureus N315
uauuugauaauauug

SEQ ID NO: 2153000 - RNA, 21 nt, Staphylococcus aureus subsp. aureus N315
uauuucuuuuugucauuaauc

SEQ ID NO: 2153001 - RNA, 16 nt, Staphylococcus aureus subsp. aureus N315
uauuugaaaauuucac

SEQ ID NO: 2153002 - RNA, 14 nt, Staphylococcus aureus subsp. aureus N315
uacacgcauuacuu

SEQ ID NO: 2153003 - RNA, 24 nt, Staphylococcus aureus subsp. aureus N315
uacacuaucauuaucaaauaaccu

SEQ ID NO: 2153004 - RNA, 17 nt, Staphylococcus aureus subsp. aureus N315
uacacuaucguuuuuau

SEQ ID NO: 2153005 - RNA, 16 nt, Staphylococcus aureus subsp. aureus N315
uacacuaaguuuucuu

SEQ ID NO: 2153006 - RNA, 23 nt, Staphylococcus aureus subsp. aureus N315
uacacuaaguuuucuuucuuuug

SEQ ID NO: 2153007 - RNA, 23 nt, Staphylococcus aureus subsp. aureus N315
uacacguaacgcaguugaaaaag

SEQ ID NO: 2153008 - RNA, 20 nt, Staphylococcus aureus subsp. aureus N315
uacacuccccuuaucaaaac

SEQ ID NO: 2153009 - RNA, 22 nt, Staphylococcus aureus subsp. aureus N315
uacacugcacaucauaauaaau

SEQ ID NO: 2153010 - RNA, 14 nt, Staphylococcus aureus subsp. aureus N315
uacacgaguauuau

SEQ ID NO: 2153011 - RNA, 15 nt, Staphylococcus aureus subsp. aureus N315
uacaccuacaaauau

SEQ ID NO: 2153012 - RNA, 14 nt, Staphylococcus aureus subsp. aureus N315
uacaccuauaccuc

SEQ ID NO: 2153013 - RNA, 17 nt, Staphylococcus aureus subsp. aureus N315
uacagagaaucaauuau

SEQ ID NO: 2153014 - RNA, 19 nt, Staphylococcus aureus subsp. aureus N315
uacagauaggaaacuuaaa

SEQ ID NO: 2153015 - RNA, 22 nt, Staphylococcus aureus subsp. aureus N315
uacagauaggaaacuuaaauau

SEQ ID NO: 2153016 - RNA, 18 nt, Staphylococcus aureus subsp. aureus N315
uacagauaggaaacuuaa

SEQ ID NO: 2153017 - RNA, 17 nt, Staphylococcus aureus subsp. aureus N315
uacagauaagaauauuu

SEQ ID NO: 2153018 - RNA, 14 nt, Staphylococcus aureus subsp. aureus N315
uacacuugauuauc

SEQ ID NO: 2153019 - RNA, 12 nt, Staphylococcus aureus subsp. aureus N315
uacacuuaauau

SEQ ID NO: 2153020 - RNA, 15 nt, Staphylococcus aureus subsp. aureus N315
uacacuuacaaauau

SEQ ID NO: 2153021 - RNA, 12 nt, Staphylococcus aureus subsp. aureus N315
uacacuuuugau

SEQ ID NO: 2153022 - RNA, 16 nt, Staphylococcus aureus subsp. aureus N315
uacacuuuugauuguu

SEQ ID NO: 2153023 - RNA, 23 nt, Staphylococcus aureus subsp. aureus N315
uacacuuuugauuguuuaaacau

SEQ ID NO: 2153024 - RNA, 21 nt, Staphylococcus aureus subsp. aureus N315
uacaacgacacgaacaacauu

SEQ ID NO: 2153025 - RNA, 17 nt, Staphylococcus aureus subsp. aureus N315
uacaauaguauaaauau

SEQ ID NO: 2153026 - RNA, 19 nt, Staphylococcus aureus subsp. aureus N315
uacaauacuucguauugaa

SEQ ID NO: 2153027 - RNA, 14 nt, Staphylococcus aureus subsp. aureus N315
uacaauaaugugca

SEQ ID NO: 2153028 - RNA, 22 nt, Staphylococcus aureus subsp. aureus N315
uaauuucuugauggauauucaa

SEQ ID NO: 2153029 - RNA, 10 nt, Staphylococcus aureus subsp. aureus N315
uaauuuuaau

SEQ ID NO: 2153030 - RNA, 13 nt, Staphylococcus aureus subsp. aureus N315
uaauuuucagaau

SEQ ID NO: 2153031 - RNA, 14 nt, Staphylococcus aureus subsp. aureus N315
uacaacauguguau

SEQ ID NO: 2153032 - RNA, 22 nt, Staphylococcus aureus subsp. aureus N315
uaauuuucaauuagaaaauauc

SEQ ID NO: 2153033 - RNA, 13 nt, Staphylococcus aureus subsp. aureus N315
uacaauauaauuu

SEQ ID NO: 2153034 - RNA, 17 nt, Staphylococcus aureus subsp. aureus N315
uacaauauuaaaauuaa

SEQ ID NO: 2153035 - RNA, 15 nt, Staphylococcus aureus subsp. aureus N315
uacaauaugauuaau

SEQ ID NO: 2153036 - RNA, 14 nt, Staphylococcus aureus subsp. aureus N315
uacaauaugauuaa

SEQ ID NO: 2153037 - RNA, 18 nt, Staphylococcus aureus subsp. aureus N315
uacaauauuaaaauuaaa

SEQ ID NO: 2153038 - RNA, 14 nt, Staphylococcus aureus subsp. aureus N315
uacaaugaaaaaac

SEQ ID NO: 2153039 - RNA, 13 nt, Staphylococcus aureus subsp. aureus N315
uacaauuaauuac

SEQ ID NO: 2153040 - RNA, 23 nt, Staphylococcus aureus subsp. aureus N315
uacaauuaauuacuguaaauaug

SEQ ID NO: 2153041 - RNA, 17 nt, Staphylococcus aureus subsp. aureus N315
uacaaugcgguauugca

SEQ ID NO: 2153042 - RNA, 15 nt, Staphylococcus aureus subsp. aureus N315
uacacaaauuaaaac

SEQ ID NO: 2153043 - RNA, 22 nt, Staphylococcus aureus subsp. aureus N315
uacacaaauuuuuuguaaacau

SEQ ID NO: 2153044 - RNA, 17 nt, Staphylococcus aureus subsp. aureus N315
uacaauuauaaaugauu

SEQ ID NO: 2153045 - RNA, 18 nt, Staphylococcus aureus subsp. aureus N315
uacagcuagcaagaauag

SEQ ID NO: 2153046 - RNA, 23 nt, Staphylococcus aureus subsp. aureus N315
uacagcguauuuuaaugauuuuu

SEQ ID NO: 2153047 - RNA, 14 nt, Staphylococcus aureus subsp. aureus N315
uacaguuuuacuau

SEQ ID NO: 2153048 - RNA, 19 nt, Staphylococcus aureus subsp. aureus N315
uacagauuuuaaaaauuca

SEQ ID NO: 2153049 - RNA, 17 nt, Staphylococcus aureus subsp. aureus N315
uacagauuuuaaaaauu

SEQ ID NO: 2153050 - RNA, 12 nt, Staphylococcus aureus subsp. aureus N315
uacagaugaugc

SEQ ID NO: 2153051 - RNA, 20 nt, Staphylococcus aureus subsp. aureus N315
uacagaucucaauccaauua

SEQ ID NO: 2153052 - RNA, 17 nt, Staphylococcus aureus subsp. aureus N315
uacauaaaucuaauacu

SEQ ID NO: 2153053 - RNA, 12 nt, Staphylococcus aureus subsp. aureus N315
uacauaaaucua

SEQ ID NO: 2153054 - RNA, 13 nt, Staphylococcus aureus subsp. aureus N315
uacauaaaucuaa

SEQ ID NO: 2153055 - RNA, 18 nt, Staphylococcus aureus subsp. aureus N315
uacauaaaauggcaucug

SEQ ID NO: 2153056 - RNA, 15 nt, Staphylococcus aureus subsp. aureus N315
uacauaggauaucua

SEQ ID NO: 2153057 - RNA, 17 nt, Staphylococcus aureus subsp. aureus N315
uacauauaauaugugca

SEQ ID NO: 2153058 - RNA, 14 nt, Staphylococcus aureus subsp. aureus N315
uacauauaauaugu

SEQ ID NO: 2153059 - RNA, 14 nt, Staphylococcus aureus subsp. aureus N315
uacauguauaaaag

SEQ ID NO: 2153060 - RNA, 15 nt, Staphylococcus aureus subsp. aureus N315
uacaugacuccaugc

SEQ ID NO: 2153061 - RNA, 16 nt, Staphylococcus aureus subsp. aureus N315
uacauaugcuauauuu

SEQ ID NO: 2153062 - RNA, 17 nt, Staphylococcus aureus subsp. aureus N315
uacauauucucugcuuc

SEQ ID NO: 2153063 - RNA, 16 nt, Staphylococcus aureus subsp. aureus N315
uacauauucucugcuu

SEQ ID NO: 2153064 - RNA, 18 nt, Staphylococcus aureus subsp. aureus N315
uaccaaagaaaucaccag

SEQ ID NO: 2153065 - RNA, 22 nt, Staphylococcus aureus subsp. aureus N315
uaccaagugcuuuuuuaccagc

SEQ ID NO: 2153066 - RNA, 19 nt, Staphylococcus aureus subsp. aureus N315
uaccaagugcuuuuuuacc

SEQ ID NO: 2153067 - RNA, 15 nt, Staphylococcus aureus subsp. aureus N315
uaccaagaaauacuc

SEQ ID NO: 2153068 - RNA, 22 nt, Staphylococcus aureus subsp. aureus N315
uacauuuaauggucuaauauca

SEQ ID NO: 2153069 - RNA, 18 nt, Staphylococcus aureus subsp. aureus N315
uacauuaaagaaaauauc

SEQ ID NO: 2153070 - RNA, 20 nt, Staphylococcus aureus subsp. aureus N315
uacauuuauuuucaauaaau

SEQ ID NO: 2153071 - RNA, 21 nt, Staphylococcus aureus subsp. aureus N315
uacauuuauuuucaauaaaua

SEQ ID NO: 2153072 - RNA, 23 nt, Staphylococcus aureus subsp. aureus N315
uacauuuaauggucuaauaucaa

SEQ ID NO: 2153073 - RNA, 22 nt, Staphylococcus aureus subsp. aureus N315
uacauuuauuuucaauaaauaa

SEQ ID NO: 2153074 - RNA, 20 nt, Staphylococcus aureus subsp. aureus N315
uacauuucuauacaaucauu

SEQ ID NO: 2153075 - RNA, 23 nt, Staphylococcus aureus subsp. aureus N315
uacauuucucguuucgucagauu

SEQ ID NO: 2153076 - RNA, 22 nt, Staphylococcus aureus subsp. aureus N315
uacauuuuaauaaaaucaucuu

SEQ ID NO: 2153077 - RNA, 14 nt, Staphylococcus aureus subsp. aureus N315
uacauuuguagaga

SEQ ID NO: 2153078 - RNA, 23 nt, Staphylococcus aureus subsp. aureus N315
uaacgaugguugcuucacuguuu

SEQ ID NO: 2153079 - RNA, 20 nt, Staphylococcus aureus subsp. aureus N315
uaacgaugguugcuucacug

SEQ ID NO: 2153080 - RNA, 22 nt, Staphylococcus aureus subsp. aureus N315
uaacgagugaaaauaagauuau

SEQ ID NO: 2153081 - RNA, 18 nt, Staphylococcus aureus subsp. aureus N315
uaacgaguccauuuucuu

SEQ ID NO: 2153082 - RNA, 14 nt, Staphylococcus aureus subsp. aureus N315
uaacgauagacauu

SEQ ID NO: 2153083 - RNA, 19 nt, Staphylococcus aureus subsp. aureus N315
uaaucguauucauaucauu

SEQ ID NO: 2153084 - RNA, 16 nt, Staphylococcus aureus subsp. aureus N315
uaaucgguaauuacuu

SEQ ID NO: 2153085 - RNA, 14 nt, Staphylococcus aureus subsp. aureus N315
uaaucguucccauu

SEQ ID NO: 2153086 - RNA, 15 nt, Staphylococcus aureus subsp. aureus N315
uaaucguuuuuacug

SEQ ID NO: 2153087 - RNA, 14 nt, Staphylococcus aureus subsp. aureus N315
uaaucucauucuuu

SEQ ID NO: 2153088 - RNA, 16 nt, Staphylococcus aureus subsp. aureus N315
uaaucuauuuucugcc

SEQ ID NO: 2153089 - RNA, 15 nt, Staphylococcus aureus subsp. aureus N315
uaaucuauaaauggc

SEQ ID NO: 2153090 - RNA, 14 nt, Staphylococcus aureus subsp. aureus N315
uaaucuauauauau

SEQ ID NO: 2153091 - RNA, 17 nt, Staphylococcus aureus subsp. aureus N315
uaaucuugauuauauuu

SEQ ID NO: 2153092 - RNA, 16 nt, Staphylococcus aureus subsp. aureus N315
uaaucuugauuauauu

SEQ ID NO: 2153093 - RNA, 20 nt, Staphylococcus aureus subsp. aureus N315
uaaucuggguuguaaucuca

SEQ ID NO: 2153094 - RNA, 15 nt, Staphylococcus aureus subsp. aureus N315
uaaucuucacgcuua

SEQ ID NO: 2153095 - RNA, 18 nt, Staphylococcus aureus subsp. aureus N315
uaaugaauucauucaaua

SEQ ID NO: 2153096 - RNA, 18 nt, Staphylococcus aureus subsp. aureus N315
uaaucuuuuuuacuaaaa

SEQ ID NO: 2153097 - RNA, 16 nt, Staphylococcus aureus subsp. aureus N315
uaaugaacaacaaauu

SEQ ID NO: 2153098 - RNA, 13 nt, Staphylococcus aureus subsp. aureus N315
uaaugaaaugaag

SEQ ID NO: 2153099 - RNA, 21 nt, Staphylococcus aureus subsp. aureus N315
uaaugaaaugaaguuuuuagc

SEQ ID NO: 2153100 - RNA, 17 nt, Staphylococcus aureus subsp. aureus N315
uaauggcaccauacuuc

SEQ ID NO: 2153101 - RNA, 14 nt, Staphylococcus aureus subsp. aureus N315
uaauggcaacuaag

SEQ ID NO: 2153102 - RNA, 18 nt, Staphylococcus aureus subsp. aureus N315
uaauggagcacuaucuuu

SEQ ID NO: 2153103 - RNA, 19 nt, Staphylococcus aureus subsp. aureus N315
uaaugccguaguuuucucu

SEQ ID NO: 2153104 - RNA, 15 nt, Staphylococcus aureus subsp. aureus N315
uaaugcauuauuaua

SEQ ID NO: 2153105 - RNA, 14 nt, Staphylococcus aureus subsp. aureus N315
uaaugccaaauaua

SEQ ID NO: 2153106 - RNA, 23 nt, Staphylococcus aureus subsp. aureus N315
uaaugccaaauauaguaauuguu

SEQ ID NO: 2153107 - RNA, 21 nt, Staphylococcus aureus subsp. aureus N315
uaaugcagauucuucaccaac

SEQ ID NO: 2153108 - RNA, 12 nt, Staphylococcus aureus subsp. aureus N315
uaaugagaguaa

SEQ ID NO: 2153109 - RNA, 22 nt, Staphylococcus aureus subsp. aureus N315
uaaugacuucuuuauauuuauc

SEQ ID NO: 2153110 - RNA, 18 nt, Staphylococcus aureus subsp. aureus N315
uaauuaacacauucaaau

SEQ ID NO: 2153111 - RNA, 22 nt, Staphylococcus aureus subsp. aureus N315
uaaugguugaauaacacuagaa

SEQ ID NO: 2153112 - RNA, 22 nt, Staphylococcus aureus subsp. aureus N315
uaaugguucuauaauaaaucga

SEQ ID NO: 2153113 - RNA, 23 nt, Staphylococcus aureus subsp. aureus N315
uaauuaggauuuccggaacaaua

SEQ ID NO: 2153114 - RNA, 22 nt, Staphylococcus aureus subsp. aureus N315
uaauuaggauuuccggaacaau

SEQ ID NO: 2153115 - RNA, 13 nt, Staphylococcus aureus subsp. aureus N315
uaauuaauuaaaa

SEQ ID NO: 2153116 - RNA, 22 nt, Staphylococcus aureus subsp. aureus N315
uaauuaacuuacuuuuguaaaa

SEQ ID NO: 2153117 - RNA, 21 nt, Staphylococcus aureus subsp. aureus N315
uaauuaacacauucaaauaaa

SEQ ID NO: 2153118 - RNA, 22 nt, Staphylococcus aureus subsp. aureus N315
uaauuaacacauucaaauaaau

SEQ ID NO: 2153119 - RNA, 21 nt, Staphylococcus aureus subsp. aureus N315
uaauuaauacaucaauaucuu

SEQ ID NO: 2153120 - RNA, 14 nt, Staphylococcus aureus subsp. aureus N315
uaauuaauuaaaau

SEQ ID NO: 2153121 - RNA, 15 nt, Staphylococcus aureus subsp. aureus N315
uaauuaauuaaaauu

SEQ ID NO: 2153122 - RNA, 15 nt, Staphylococcus aureus subsp. aureus N315
uaauuaauaauuuaa

SEQ ID NO: 2153123 - RNA, 11 nt, Staphylococcus aureus subsp. aureus N315
uaauuaucauu

SEQ ID NO: 2153124 - RNA, 17 nt, Staphylococcus aureus subsp. aureus N315
uaauucaacuuaaaugg

SEQ ID NO: 2153125 - RNA, 16 nt, Staphylococcus aureus subsp. aureus N315
uaauuaucauauaaau

SEQ ID NO: 2153126 - RNA, 17 nt, Staphylococcus aureus subsp. aureus N315
uaauuauauuaaugauu

SEQ ID NO: 2153127 - RNA, 16 nt, Staphylococcus aureus subsp. aureus N315
uaauuaguguuucaug

SEQ ID NO: 2153128 - RNA, 13 nt, Staphylococcus aureus subsp. aureus N315
uaauuaucauaua

SEQ ID NO: 2153129 - RNA, 21 nt, Staphylococcus aureus subsp. aureus N315
uaauucaaugauuuuuaaaaa

SEQ ID NO: 2153130 - RNA, 20 nt, Staphylococcus aureus subsp. aureus N315
uaauucaccaucauauucaa

SEQ ID NO: 2153131 - RNA, 15 nt, Staphylococcus aureus subsp. aureus N315
uaauucauauauacu

SEQ ID NO: 2153132 - RNA, 23 nt, Staphylococcus aureus subsp. aureus N315
uaauucguuuugcuaaccaucau

SEQ ID NO: 2153133 - RNA, 18 nt, Staphylococcus aureus subsp. aureus N315
uaauucauuuauuuucuu

SEQ ID NO: 2153134 - RNA, 13 nt, Staphylococcus aureus subsp. aureus N315
uaauucuaagucu

SEQ ID NO: 2153135 - RNA, 22 nt, Staphylococcus aureus subsp. aureus N315
uaauucuagagauaacuagaau

SEQ ID NO: 2153136 - RNA, 16 nt, Staphylococcus aureus subsp. aureus N315
uaauucuauuuuugau

SEQ ID NO: 2153137 - RNA, 20 nt, Staphylococcus aureus subsp. aureus N315
uaauucuauuuuugauuuaa

SEQ ID NO: 2153138 - RNA, 14 nt, Staphylococcus aureus subsp. aureus N315
uaauucugaaauca

SEQ ID NO: 2153139 - RNA, 12 nt, Staphylococcus aureus subsp. aureus N315
uaauucugaaau

SEQ ID NO: 2153140 - RNA, 17 nt, Staphylococcus aureus subsp. aureus N315
uaauuuccaauaucuuc

SEQ ID NO: 2153141 - RNA, 13 nt, Staphylococcus aureus subsp. aureus N315
uaauuucuucuuc

SEQ ID NO: 2153142 - RNA, 22 nt, Staphylococcus aureus subsp. aureus N315
uaauuuaguuauaauuucuguu

SEQ ID NO: 2153143 - RNA, 15 nt, Staphylococcus aureus subsp. aureus N315
uaauuuauaaaaaga

SEQ ID NO: 2153144 - RNA, 12 nt, Staphylococcus aureus subsp. aureus N315
uaauuuauaaac

SEQ ID NO: 2153145 - RNA, 16 nt, Staphylococcus aureus subsp. aureus N315
uaauuuacaauuaauu

SEQ ID NO: 2153146 - RNA, 14 nt, Staphylococcus aureus subsp. aureus N315
uaauuuaaaugcuu

SEQ ID NO: 2153147 - RNA, 15 nt, Staphylococcus aureus subsp. aureus N315
uaauuuaauaauuaa

SEQ ID NO: 2153148 - RNA, 14 nt, Staphylococcus aureus subsp. aureus N315
uaauuuaaagcauc

SEQ ID NO: 2153149 - RNA, 21 nt, Staphylococcus aureus subsp. aureus N315
uaauuuaaaucuguacuucua

SEQ ID NO: 2153150 - RNA, 20 nt, Staphylococcus aureus subsp. aureus N315
uaauuuaaaugauuucacuu

SEQ ID NO: 2153151 - RNA, 21 nt, Staphylococcus aureus subsp. aureus N315
uaauuuaaaggcauaauaacc

SEQ ID NO: 2153152 - RNA, 22 nt, Staphylococcus aureus subsp. aureus N315
uaauugaauugauuauaaugau

SEQ ID NO: 2153153 - RNA, 17 nt, Staphylococcus aureus subsp. aureus N315
uaauugaaugaaaauaa

SEQ ID NO: 2153154 - RNA, 22 nt, Staphylococcus aureus subsp. aureus N315
uaauugaaguaugcacaucauu

SEQ ID NO: 2153155 - RNA, 23 nt, Staphylococcus aureus subsp. aureus N315
uaauucuucaucaauaacuauaa

SEQ ID NO: 2153156 - RNA, 15 nt, Staphylococcus aureus subsp. aureus N315
uaauuguuaaaucac

SEQ ID NO: 2153157 - RNA, 19 nt, Staphylococcus aureus subsp. aureus N315
uaauuguaaucuauuuucu

SEQ ID NO: 2153158 - RNA, 15 nt, Staphylococcus aureus subsp. aureus N315
uaauugucuuuauaa

SEQ ID NO: 2153159 - RNA, 16 nt, Staphylococcus aureus subsp. aureus N315
uaauugucucaucauu

SEQ ID NO: 2153160 - RNA, 22 nt, Staphylococcus aureus subsp. aureus N315
uaauugucucaucauuuaaaau

SEQ ID NO: 2153161 - RNA, 17 nt, Staphylococcus aureus subsp. aureus N315
uaauuggaaucaucuuu

SEQ ID NO: 2153162 - RNA, 20 nt, Staphylococcus aureus subsp. aureus N315
uaauugguucuucuuucaua

SEQ ID NO: 2153163 - RNA, 15 nt, Staphylococcus aureus subsp. aureus N315
uaauuggauuaaaua

SEQ ID NO: 2153164 - RNA, 21 nt, Staphylococcus aureus subsp. aureus N315
uaauuggauugagaucuguau

SEQ ID NO: 2153165 - RNA, 16 nt, Staphylococcus aureus subsp. aureus N315
uacuuaauuaauaauu

SEQ ID NO: 2153166 - RNA, 17 nt, Staphylococcus aureus subsp. aureus N315
uacuuacgccaaucaca

SEQ ID NO: 2153167 - RNA, 22 nt, Staphylococcus aureus subsp. aureus N315
uacuuacuuuucuaaacaacuu

SEQ ID NO: 2153168 - RNA, 22 nt, Staphylococcus aureus subsp. aureus N315
uacuuacugaaacuaaauuaaa

SEQ ID NO: 2153169 - RNA, 21 nt, Staphylococcus aureus subsp. aureus N315
uacuuacuccguugaauucaa

SEQ ID NO: 2153170 - RNA, 16 nt, Staphylococcus aureus subsp. aureus N315
uacuuaaauuaagaau

SEQ ID NO: 2153171 - RNA, 20 nt, Staphylococcus aureus subsp. aureus N315
uacuguaaaauucuauaaau

SEQ ID NO: 2153172 - RNA, 17 nt, Staphylococcus aureus subsp. aureus N315
uacuuuacauuucucgu

SEQ ID NO: 2153173 - RNA, 17 nt, Staphylococcus aureus subsp. aureus N315
uacuuuaauuuagugaa

SEQ ID NO: 2153174 - RNA, 19 nt, Staphylococcus aureus subsp. aureus N315
uacuuguaauuaauacauc

SEQ ID NO: 2153175 - RNA, 15 nt, Staphylococcus aureus subsp. aureus N315
uacuuguaauuaaua

SEQ ID NO: 2153176 - RNA, 20 nt, Staphylococcus aureus subsp. aureus N315
uacuuguaauuaauacauca

SEQ ID NO: 2153177 - RNA, 14 nt, Staphylococcus aureus subsp. aureus N315
uacuuccauugcuu

SEQ ID NO: 2153178 - RNA, 23 nt, Staphylococcus aureus subsp. aureus N315
uacuuauauauucaauaauuauu

SEQ ID NO: 2153179 - RNA, 15 nt, Staphylococcus aureus subsp. aureus N315
uacuuauauauucaa

SEQ ID NO: 2153180 - RNA, 19 nt, Staphylococcus aureus subsp. aureus N315
uacuucuaauuugcaaaau

SEQ ID NO: 2153181 - RNA, 20 nt, Staphylococcus aureus subsp. aureus N315
uacuucuauuuuauaauaaa

SEQ ID NO: 2153182 - RNA, 15 nt, Staphylococcus aureus subsp. aureus N315
uacuucucaauuuag

SEQ ID NO: 2153183 - RNA, 22 nt, Staphylococcus aureus subsp. aureus N315
uacuuuggaaauuuauuauaaa

SEQ ID NO: 2153184 - RNA, 18 nt, Staphylococcus aureus subsp. aureus N315
uacuuuggacuuuaaagu

SEQ ID NO: 2153185 - RNA, 19 nt, Staphylococcus aureus subsp. aureus N315
uacuuuggacuuuaaaguu

SEQ ID NO: 2153186 - RNA, 18 nt, Staphylococcus aureus subsp. aureus N315
uacuuuggaaauuuauua

SEQ ID NO: 2153187 - RNA, 18 nt, Staphylococcus aureus subsp. aureus N315
uacuuuguucugcuuuuu

SEQ ID NO: 2153188 - RNA, 15 nt, Staphylococcus aureus subsp. aureus N315
uacuuuuuauauaau

SEQ ID NO: 2153189 - RNA, 14 nt, Staphylococcus aureus subsp. aureus N315
uacuuuuucagaau

SEQ ID NO: 2153190 - RNA, 15 nt, Staphylococcus aureus subsp. aureus N315
uacuuuuucaucuuu

SEQ ID NO: 2153191 - RNA, 16 nt, Staphylococcus aureus subsp. aureus N315
uacuuuuauaaucuuu

SEQ ID NO: 2153192 - RNA, 20 nt, Staphylococcus aureus subsp. aureus N315
uacuuuucucgauuaauuuu

SEQ ID NO: 2153193 - RNA, 18 nt, Staphylococcus aureus subsp. aureus N315
uagaaaaauaugauugca

SEQ ID NO: 2153194 - RNA, 19 nt, Staphylococcus aureus subsp. aureus N315
uagaaaaagcaggcaagcu

SEQ ID NO: 2153195 - RNA, 19 nt, Staphylococcus aureus subsp. aureus N315
uagaaaaauuucaaaaaua

SEQ ID NO: 2153196 - RNA, 11 nt, Staphylococcus aureus subsp. aureus N315
uagaaaacuag

SEQ ID NO: 2153197 - RNA, 14 nt, Staphylococcus aureus subsp. aureus N315
uagaaaacuagaac

SEQ ID NO: 2153198 - RNA, 19 nt, Staphylococcus aureus subsp. aureus N315
uagaaaagggacagaaaag

SEQ ID NO: 2153199 - RNA, 19 nt, Staphylococcus aureus subsp. aureus N315
uagaaauuaccguuuauuu

SEQ ID NO: 2153200 - RNA, 16 nt, Staphylococcus aureus subsp. aureus N315
uagaaagcgcauuugu

SEQ ID NO: 2153201 - RNA, 15 nt, Staphylococcus aureus subsp. aureus N315
uagaaaccguaaaau

SEQ ID NO: 2153202 - RNA, 22 nt, Staphylococcus aureus subsp. aureus N315
uagaaacuuccaacauauaaaa

SEQ ID NO: 2153203 - RNA, 14 nt, Staphylococcus aureus subsp. aureus N315
uagaaaauaugacg

SEQ ID NO: 2153204 - RNA, 12 nt, Staphylococcus aureus subsp. aureus N315
uagaaaauuaac

SEQ ID NO: 2153205 - RNA, 18 nt, Staphylococcus aureus subsp. aureus N315
uagaaaaugaguacaaca

SEQ ID NO: 2153206 - RNA, 16 nt, Staphylococcus aureus subsp. aureus N315
uagagacuuauuuuau

SEQ ID NO: 2153207 - RNA, 21 nt, Staphylococcus aureus subsp. aureus N315
uagagaagggaguaccaagaa

SEQ ID NO: 2153208 - RNA, 18 nt, Staphylococcus aureus subsp. aureus N315
uagacuuggauaaaaauu

SEQ ID NO: 2153209 - RNA, 21 nt, Staphylococcus aureus subsp. aureus N315
uagacuuauuugaaugcaaau

SEQ ID NO: 2153210 - RNA, 17 nt, Staphylococcus aureus subsp. aureus N315
uagaauuucuuuucgaa

SEQ ID NO: 2153211 - RNA, 19 nt, Staphylococcus aureus subsp. aureus N315
uagaauuucuuuucgaaaa

SEQ ID NO: 2153212 - RNA, 21 nt, Staphylococcus aureus subsp. aureus N315
uagacaauauuuuuacauauu

SEQ ID NO: 2153213 - RNA, 14 nt, Staphylococcus aureus subsp. aureus N315
uagacauuaaaaaa

SEQ ID NO: 2153214 - RNA, 18 nt, Staphylococcus aureus subsp. aureus N315
uagacauaaaaaaagaga

SEQ ID NO: 2153215 - RNA, 14 nt, Staphylococcus aureus subsp. aureus N315
uagacauaaaaaaa

SEQ ID NO: 2153216 - RNA, 22 nt, Staphylococcus aureus subsp. aureus N315
uagaagaacaauaauugaugaa

SEQ ID NO: 2153217 - RNA, 12 nt, Staphylococcus aureus subsp. aureus N315
uagaacauuuau

SEQ ID NO: 2153218 - RNA, 17 nt, Staphylococcus aureus subsp. aureus N315
uagaacauuuaucguga

SEQ ID NO: 2153219 - RNA, 18 nt, Staphylococcus aureus subsp. aureus N315
uagaauagucaauuaaug

SEQ ID NO: 2153220 - RNA, 20 nt, Staphylococcus aureus subsp. aureus N315
uagaauauauguauaacauu

SEQ ID NO: 2153221 - RNA, 18 nt, Staphylococcus aureus subsp. aureus N315
uagaauacuaaaaguguu

SEQ ID NO: 2153222 - RNA, 15 nt, Staphylococcus aureus subsp. aureus N315
uagaaguuuuuugau

SEQ ID NO: 2153223 - RNA, 19 nt, Staphylococcus aureus subsp. aureus N315
uagaaugucgauauuucua

SEQ ID NO: 2153224 - RNA, 23 nt, Staphylococcus aureus subsp. aureus N315
uagaaugaugaguauacuuacug

SEQ ID NO: 2153225 - RNA, 17 nt, Staphylococcus aureus subsp. aureus N315
uagaauucuaaaagaau

SEQ ID NO: 2153226 - RNA, 19 nt, Staphylococcus aureus subsp. aureus N315
uagaaucuacgauuuucaa

SEQ ID NO: 2153227 - RNA, 23 nt, Staphylococcus aureus subsp. aureus N315
uagaaugaaaccguauuauugga

SEQ ID NO: 2153228 - RNA, 14 nt, Staphylococcus aureus subsp. aureus N315
uagaauauuaacgu

SEQ ID NO: 2153229 - RNA, 16 nt, Staphylococcus aureus subsp. aureus N315
uacggagacaaguaua

SEQ ID NO: 2153230 - RNA, 23 nt, Staphylococcus aureus subsp. aureus N315
uacguuacuaaacuuuucuucaa

SEQ ID NO: 2153231 - RNA, 15 nt, Staphylococcus aureus subsp. aureus N315
uacgugcuuuaaagu

SEQ ID NO: 2153232 - RNA, 17 nt, Staphylococcus aureus subsp. aureus N315
uacgaucauaaauauuu

SEQ ID NO: 2153233 - RNA, 19 nt, Staphylococcus aureus subsp. aureus N315
uacgauugaguugaaaaua

SEQ ID NO: 2153234 - RNA, 15 nt, Staphylococcus aureus subsp. aureus N315
uacgcuuuuuaaaaa

SEQ ID NO: 2153235 - RNA, 16 nt, Staphylococcus aureus subsp. aureus N315
uacgcugucucauuaa

SEQ ID NO: 2153236 - RNA, 21 nt, Staphylococcus aureus subsp. aureus N315
uacuauaaaaauuuauucaaa

SEQ ID NO: 2153237 - RNA, 20 nt, Staphylococcus aureus subsp. aureus N315
uacuauaaaaauuuauucaa

SEQ ID NO: 2153238 - RNA, 20 nt, Staphylococcus aureus subsp. aureus N315
uacuaaaaaugcuuuaacua

SEQ ID NO: 2153239 - RNA, 14 nt, Staphylococcus aureus subsp. aureus N315
uacuauaaauccua

SEQ ID NO: 2153240 - RNA, 13 nt, Staphylococcus aureus subsp. aureus N315
uacuauacuuuga

SEQ ID NO: 2153241 - RNA, 13 nt, Staphylococcus aureus subsp. aureus N315
uacuauauuuauu

SEQ ID NO: 2153242 - RNA, 22 nt, Staphylococcus aureus subsp. aureus N315
uacguuauuuuuuggucaccaa

SEQ ID NO: 2153243 - RNA, 15 nt, Staphylococcus aureus subsp. aureus N315
uacguuuuuuuaaau

SEQ ID NO: 2153244 - RNA, 19 nt, Staphylococcus aureus subsp. aureus N315
uacguuuuuuuaaauacau

SEQ ID NO: 2153245 - RNA, 14 nt, Staphylococcus aureus subsp. aureus N315
uacguuuuaaauaa

SEQ ID NO: 2153246 - RNA, 17 nt, Staphylococcus aureus subsp. aureus N315
uacguuugcauauccuu

SEQ ID NO: 2153247 - RNA, 17 nt, Staphylococcus aureus subsp. aureus N315
uacuauuuguuuuaggu

SEQ ID NO: 2153248 - RNA, 15 nt, Staphylococcus aureus subsp. aureus N315
uacuauggcauuauu

SEQ ID NO: 2153249 - RNA, 13 nt, Staphylococcus aureus subsp. aureus N315
uacuauuaaauaa

SEQ ID NO: 2153250 - RNA, 22 nt, Staphylococcus aureus subsp. aureus N315
uacucacugcacuuaugauacu

SEQ ID NO: 2153251 - RNA, 22 nt, Staphylococcus aureus subsp. aureus N315
uacucaguuuauugaggauaau

SEQ ID NO: 2153252 - RNA, 24 nt, Staphylococcus aureus subsp. aureus N315
uacuccaauuaccaaugaauaaau

SEQ ID NO: 2153253 - RNA, 18 nt, Staphylococcus aureus subsp. aureus N315
uacgaacaacuaacacgu

SEQ ID NO: 2153254 - RNA, 14 nt, Staphylococcus aureus subsp. aureus N315
uaccuuuuucuacc

SEQ ID NO: 2153255 - RNA, 20 nt, Staphylococcus aureus subsp. aureus N315
uaccuuuuucuaaaccaaca

SEQ ID NO: 2153256 - RNA, 16 nt, Staphylococcus aureus subsp. aureus N315
uaccuuugucuuuuuu

SEQ ID NO: 2153257 - RNA, 19 nt, Staphylococcus aureus subsp. aureus N315
uaccuuucaaauauaucua

SEQ ID NO: 2153258 - RNA, 13 nt, Staphylococcus aureus subsp. aureus N315
uaccuuuaauaau

SEQ ID NO: 2153259 - RNA, 18 nt, Staphylococcus aureus subsp. aureus N315
uaccuuuaauaauauuga

SEQ ID NO: 2153260 - RNA, 14 nt, Staphylococcus aureus subsp. aureus N315
uaccuuuaauaucu

SEQ ID NO: 2153261 - RNA, 18 nt, Staphylococcus aureus subsp. aureus N315
uaccuuuaaaucuacuuu

SEQ ID NO: 2153262 - RNA, 17 nt, Staphylococcus aureus subsp. aureus N315
uaccuauuaauaucaua

SEQ ID NO: 2153263 - RNA, 14 nt, Staphylococcus aureus subsp. aureus N315
uaccuauaaacaua

SEQ ID NO: 2153264 - RNA, 15 nt, Staphylococcus aureus subsp. aureus N315
uaccuacagaaugga

SEQ ID NO: 2153265 - RNA, 14 nt, Staphylococcus aureus subsp. aureus N315
uaccuacaaauaug

SEQ ID NO: 2153266 - RNA, 19 nt, Staphylococcus aureus subsp. aureus N315
uaccuacacggucccaaga

SEQ ID NO: 2153267 - RNA, 15 nt, Staphylococcus aureus subsp. aureus N315
uaccuaauaggauuu

SEQ ID NO: 2153268 - RNA, 21 nt, Staphylococcus aureus subsp. aureus N315
uaccuaagcugauuaaaaugu

SEQ ID NO: 2153269 - RNA, 19 nt, Staphylococcus aureus subsp. aureus N315
uaccuaagcugauuaaaau

SEQ ID NO: 2153270 - RNA, 18 nt, Staphylococcus aureus subsp. aureus N315
uaccuaagcugauuaaaa

SEQ ID NO: 2153271 - RNA, 18 nt, Staphylococcus aureus subsp. aureus N315
uaccuaaagcuaauacac

SEQ ID NO: 2153272 - RNA, 19 nt, Staphylococcus aureus subsp. aureus N315
uaccuaaaauagaaaaauu

SEQ ID NO: 2153273 - RNA, 16 nt, Staphylococcus aureus subsp. aureus N315
uaccuaaaauagaaaa

SEQ ID NO: 2153274 - RNA, 22 nt, Staphylococcus aureus subsp. aureus N315
uaccaaugaauaaauugauauu

SEQ ID NO: 2153275 - RNA, 22 nt, Staphylococcus aureus subsp. aureus N315
uaccaauaucaugcaaaauaau

SEQ ID NO: 2153276 - RNA, 15 nt, Staphylococcus aureus subsp. aureus N315
uaccaaugaauaaau

SEQ ID NO: 2153277 - RNA, 18 nt, Staphylococcus aureus subsp. aureus N315
uagauacauauaagaauu

SEQ ID NO: 2153278 - RNA, 15 nt, Staphylococcus aureus subsp. aureus N315
uagauaccaaacugc

SEQ ID NO: 2153279 - RNA, 13 nt, Staphylococcus aureus subsp. aureus N315
uagauaccaaacu

SEQ ID NO: 2153280 - RNA, 19 nt, Staphylococcus aureus subsp. aureus N315
uagauagaaauugugcuuu

SEQ ID NO: 2153281 - RNA, 17 nt, Staphylococcus aureus subsp. aureus N315
uagauagaaauugugcu

SEQ ID NO: 2153282 - RNA, 23 nt, Staphylococcus aureus subsp. aureus N315
uagauaaucucauucuuuaauau

SEQ ID NO: 2153283 - RNA, 14 nt, Staphylococcus aureus subsp. aureus N315
uagauaaaaauuac

SEQ ID NO: 2153284 - RNA, 16 nt, Staphylococcus aureus subsp. aureus N315
uagauaaaaauuacua

SEQ ID NO: 2153285 - RNA, 18 nt, Staphylococcus aureus subsp. aureus N315
uagauaaaucgauaaaau

SEQ ID NO: 2153286 - RNA, 14 nt, Staphylococcus aureus subsp. aureus N315
uagaguaauuuuac

SEQ ID NO: 2153287 - RNA, 18 nt, Staphylococcus aureus subsp. aureus N315
uagaugcuugaccuucag

SEQ ID NO: 2153288 - RNA, 14 nt, Staphylococcus aureus subsp. aureus N315
uagaugauacauuc

SEQ ID NO: 2153289 - RNA, 18 nt, Staphylococcus aureus subsp. aureus N315
uagaugcauaaaaaaaga

SEQ ID NO: 2153290 - RNA, 15 nt, Staphylococcus aureus subsp. aureus N315
uagaugaaaauuuaa

SEQ ID NO: 2153291 - RNA, 23 nt, Staphylococcus aureus subsp. aureus N315
uagaugaaauuguguugaaucaa

SEQ ID NO: 2153292 - RNA, 20 nt, Staphylococcus aureus subsp. aureus N315
uagauucacuguauaaauaa

SEQ ID NO: 2153293 - RNA, 21 nt, Staphylococcus aureus subsp. aureus N315
uagauguguugugauuauaaa

SEQ ID NO: 2153294 - RNA, 15 nt, Staphylococcus aureus subsp. aureus N315
uagauugaucagcuc

SEQ ID NO: 2153295 - RNA, 12 nt, Staphylococcus aureus subsp. aureus N315
uagauucuuuuc

SEQ ID NO: 2153296 - RNA, 21 nt, Staphylococcus aureus subsp. aureus N315
uagaucuaucgguauaucuaa

SEQ ID NO: 2153297 - RNA, 18 nt, Staphylococcus aureus subsp. aureus N315
uagauaucuuaaucuaaa

SEQ ID NO: 2153298 - RNA, 13 nt, Staphylococcus aureus subsp. aureus N315
uagauagcggauu

SEQ ID NO: 2153299 - RNA, 17 nt, Staphylococcus aureus subsp. aureus N315
uagauagcggauuuauu

SEQ ID NO: 2153300 - RNA, 22 nt, Staphylococcus aureus subsp. aureus N315
uagauaucuuaaucuaaaaaua

SEQ ID NO: 2153301 - RNA, 13 nt, Staphylococcus aureus subsp. aureus N315
uagauauuauaaa

SEQ ID NO: 2153302 - RNA, 22 nt, Staphylococcus aureus subsp. aureus N315
uagcaccguaacauauguacua

SEQ ID NO: 2153303 - RNA, 16 nt, Staphylococcus aureus subsp. aureus N315
uagcaaugaauuaaua

SEQ ID NO: 2153304 - RNA, 16 nt, Staphylococcus aureus subsp. aureus N315
uagcaauaucaucauu

SEQ ID NO: 2153305 - RNA, 20 nt, Staphylococcus aureus subsp. aureus N315
uagcaacugaucauuuucau

SEQ ID NO: 2153306 - RNA, 15 nt, Staphylococcus aureus subsp. aureus N315
uagcaaaaauacuuu

SEQ ID NO: 2153307 - RNA, 14 nt, Staphylococcus aureus subsp. aureus N315
uagcaaaaauacuu

SEQ ID NO: 2153308 - RNA, 20 nt, Staphylococcus aureus subsp. aureus N315
uagcaaacaauuuuguacau

SEQ ID NO: 2153309 - RNA, 21 nt, Staphylococcus aureus subsp. aureus N315
uagcaaaagcuuuuacgccuu

SEQ ID NO: 2153310 - RNA, 22 nt, Staphylococcus aureus subsp. aureus N315
uagcaaccauauuuuuagaaaa

SEQ ID NO: 2153311 - RNA, 21 nt, Staphylococcus aureus subsp. aureus N315
uagcaaccauauuuuuagaaa

SEQ ID NO: 2153312 - RNA, 20 nt, Staphylococcus aureus subsp. aureus N315
uagcaaccauauuuuuagaa

SEQ ID NO: 2153313 - RNA, 22 nt, Staphylococcus aureus subsp. aureus N315
uagcaaauauuauuaaaucaaa

SEQ ID NO: 2153314 - RNA, 14 nt, Staphylococcus aureus subsp. aureus N315
uagauuuuaaauca

SEQ ID NO: 2153315 - RNA, 12 nt, Staphylococcus aureus subsp. aureus N315
uagauuuuaaac

SEQ ID NO: 2153316 - RNA, 19 nt, Staphylococcus aureus subsp. aureus N315
uagauuuuauauaaaaaga

SEQ ID NO: 2153317 - RNA, 16 nt, Staphylococcus aureus subsp. aureus N315
uagauuuucacuaaua

SEQ ID NO: 2153318 - RNA, 22 nt, Staphylococcus aureus subsp. aureus N315
uagauuuuguauuagcaucuga

SEQ ID NO: 2153319 - RNA, 13 nt, Staphylococcus aureus subsp. aureus N315
uagauuuaggaga

SEQ ID NO: 2153320 - RNA, 17 nt, Staphylococcus aureus subsp. aureus N315
uagauuguauuuaauaa

SEQ ID NO: 2153321 - RNA, 15 nt, Staphylococcus aureus subsp. aureus N315
uagauuuaaaauguc

SEQ ID NO: 2153322 - RNA, 20 nt, Staphylococcus aureus subsp. aureus N315
uagcagggugcuaaauuuac

SEQ ID NO: 2153323 - RNA, 13 nt, Staphylococcus aureus subsp. aureus N315
uagcaguuucuga

SEQ ID NO: 2153324 - RNA, 18 nt, Staphylococcus aureus subsp. aureus N315
uagcagucaaacauagau

SEQ ID NO: 2153325 - RNA, 14 nt, Staphylococcus aureus subsp. aureus N315
uagcauacauuaag

SEQ ID NO: 2153326 - RNA, 22 nt, Staphylococcus aureus subsp. aureus N315
uagcauaucuuuaucauuauuc

SEQ ID NO: 2153327 - RNA, 18 nt, Staphylococcus aureus subsp. aureus N315
uagcauaucuuuaucauu

SEQ ID NO: 2153328 - RNA, 22 nt, Staphylococcus aureus subsp. aureus N315
uagcacuuggauuuuaauuauu

SEQ ID NO: 2153329 - RNA, 11 nt, Staphylococcus aureus subsp. aureus N315
uagcagcaguu

SEQ ID NO: 2153330 - RNA, 17 nt, Staphylococcus aureus subsp. aureus N315
uagcaucaaaaauaaaa

SEQ ID NO: 2153331 - RNA, 19 nt, Staphylococcus aureus subsp. aureus N315
uagcaucaaaaauaaaaau

SEQ ID NO: 2153332 - RNA, 22 nt, Staphylococcus aureus subsp. aureus N315
uagcauuagcaaauauuauuaa

SEQ ID NO: 2153333 - RNA, 18 nt, Staphylococcus aureus subsp. aureus N315
uagcauuauuauuuuaau

SEQ ID NO: 2153334 - RNA, 15 nt, Staphylococcus aureus subsp. aureus N315
uagcauuccuaauua

SEQ ID NO: 2153335 - RNA, 17 nt, Staphylococcus aureus subsp. aureus N315
uagcauuccuaauuaua

SEQ ID NO: 2153336 - RNA, 20 nt, Staphylococcus aureus subsp. aureus N315
uagcaucuuuaccauauaau

SEQ ID NO: 2153337 - RNA, 13 nt, Staphylococcus aureus subsp. aureus N315
uagccaaauaaau

SEQ ID NO: 2153338 - RNA, 21 nt, Staphylococcus aureus subsp. aureus N315
uagccaaauaaauuuugacgc

SEQ ID NO: 2153339 - RNA, 12 nt, Staphylococcus aureus subsp. aureus N315
uaggacauauaa

SEQ ID NO: 2153340 - RNA, 13 nt, Staphylococcus aureus subsp. aureus N315
uaggacauauaaa

SEQ ID NO: 2153341 - RNA, 18 nt, Staphylococcus aureus subsp. aureus N315
uaggacauauaaauguug

SEQ ID NO: 2153342 - RNA, 19 nt, Staphylococcus aureus subsp. aureus N315
uaggauauuuuuuaauaau

SEQ ID NO: 2153343 - RNA, 17 nt, Staphylococcus aureus subsp. aureus N315
uaggauguucaucaaca

SEQ ID NO: 2153344 - RNA, 14 nt, Staphylococcus aureus subsp. aureus N315
uaggaugaaaauau

SEQ ID NO: 2153345 - RNA, 17 nt, Staphylococcus aureus subsp. aureus N315
uaggauuugcaccuaua

SEQ ID NO: 2153346 - RNA, 18 nt, Staphylococcus aureus subsp. aureus N315
uaggauuugcaccuauac

SEQ ID NO: 2153347 - RNA, 17 nt, Staphylococcus aureus subsp. aureus N315
uaggauuuacaccuaua

SEQ ID NO: 2153348 - RNA, 18 nt, Staphylococcus aureus subsp. aureus N315
uaggauuuacaccuauac

SEQ ID NO: 2153349 - RNA, 13 nt, Staphylococcus aureus subsp. aureus N315
uaggcaagguauu

SEQ ID NO: 2153350 - RNA, 23 nt, Staphylococcus aureus subsp. aureus N315
uaggaauuguuaauuucaacauu

SEQ ID NO: 2153351 - RNA, 16 nt, Staphylococcus aureus subsp. aureus N315
uaggaauccaauuucu

SEQ ID NO: 2153352 - RNA, 14 nt, Staphylococcus aureus subsp. aureus N315
uagcuuuauuauuu

SEQ ID NO: 2153353 - RNA, 13 nt, Staphylococcus aureus subsp. aureus N315
uagcuugaauaau

SEQ ID NO: 2153354 - RNA, 18 nt, Staphylococcus aureus subsp. aureus N315
uagcuugaauaauauauu

SEQ ID NO: 2153355 - RNA, 17 nt, Staphylococcus aureus subsp. aureus N315
uagcuugaauaauauau

SEQ ID NO: 2153356 - RNA, 21 nt, Staphylococcus aureus subsp. aureus N315
uagcuucuuaaaucaacauca

SEQ ID NO: 2153357 - RNA, 21 nt, Staphylococcus aureus subsp. aureus N315
uagcugcaaucguugaaaaau

SEQ ID NO: 2153358 - RNA, 15 nt, Staphylococcus aureus subsp. aureus N315
uagcucuuuuuugau

SEQ ID NO: 2153359 - RNA, 21 nt, Staphylococcus aureus subsp. aureus N315
uagcucuuuuuugauuuggaa

SEQ ID NO: 2153360 - RNA, 14 nt, Staphylococcus aureus subsp. aureus N315
uagcucuucuuuuu

SEQ ID NO: 2153361 - RNA, 12 nt, Staphylococcus aureus subsp. aureus N315
uagcucuucuuu

SEQ ID NO: 2153362 - RNA, 16 nt, Staphylococcus aureus subsp. aureus N315
uagcuggcuuuuuaau

SEQ ID NO: 2153363 - RNA, 20 nt, Staphylococcus aureus subsp. aureus N315
uagcuuagucaauguauauu

SEQ ID NO: 2153364 - RNA, 13 nt, Staphylococcus aureus subsp. aureus N315
uagcuuagucaau

SEQ ID NO: 2153365 - RNA, 15 nt, Staphylococcus aureus subsp. aureus N315
uagcuauuaaaauag

SEQ ID NO: 2153366 - RNA, 23 nt, Staphylococcus aureus subsp. aureus N315
uagcuauaacucuaaauauaaua

SEQ ID NO: 2153367 - RNA, 20 nt, Staphylococcus aureus subsp. aureus N315
uagcucaaaacaauuuaaaa

SEQ ID NO: 2153368 - RNA, 22 nt, Staphylococcus aureus subsp. aureus N315
uagcuaaugcauuauuauaaua

SEQ ID NO: 2153369 - RNA, 12 nt, Staphylococcus aureus subsp. aureus N315
uagcuaaugcaa

SEQ ID NO: 2153370 - RNA, 18 nt, Staphylococcus aureus subsp. aureus N315
uagcuaaugcauuauuau

SEQ ID NO: 2153371 - RNA, 20 nt, Staphylococcus aureus subsp. aureus N315
uagcuaagauacuuuuaaau

SEQ ID NO: 2153372 - RNA, 16 nt, Staphylococcus aureus subsp. aureus N315
uagccauauucauauu

SEQ ID NO: 2153373 - RNA, 14 nt, Staphylococcus aureus subsp. aureus N315
uagccuauuuaaaa

SEQ ID NO: 2153374 - RNA, 15 nt, Staphylococcus aureus subsp. aureus N315
uagccugaaauagaa

SEQ ID NO: 2153375 - RNA, 14 nt, Staphylococcus aureus subsp. aureus N315
uagcgaaaacuaaa

SEQ ID NO: 2153376 - RNA, 20 nt, Staphylococcus aureus subsp. aureus N315
uagcgaaaguaucuaugaaa

SEQ ID NO: 2153377 - RNA, 22 nt, Staphylococcus aureus subsp. aureus N315
uagcgcaagagauaagaaaaua

SEQ ID NO: 2153378 - RNA, 22 nt, Staphylococcus aureus subsp. aureus N315
uagcguaauuauuauaauaaau

SEQ ID NO: 2153379 - RNA, 14 nt, Staphylococcus aureus subsp. aureus N315
uagcguagcgaaag

SEQ ID NO: 2153380 - RNA, 15 nt, Staphylococcus aureus subsp. aureus N315
uagcgucaaguuuuc

SEQ ID NO: 2153381 - RNA, 21 nt, Staphylococcus aureus subsp. aureus N315
uagcgcgcuuauugaaaagau

SEQ ID NO: 2153382 - RNA, 18 nt, Staphylococcus aureus subsp. aureus N315
uagcgcgcuuauugaaaa

SEQ ID NO: 2153383 - RNA, 16 nt, Staphylococcus aureus subsp. aureus N315
uauaacucuaaauaua

SEQ ID NO: 2153384 - RNA, 13 nt, Staphylococcus aureus subsp. aureus N315
uauaacugcaugu

SEQ ID NO: 2153385 - RNA, 15 nt, Staphylococcus aureus subsp. aureus N315
uauaacuuuaaaaau

SEQ ID NO: 2153386 - RNA, 18 nt, Staphylococcus aureus subsp. aureus N315
uauacaguuuuacuauaa

SEQ ID NO: 2153387 - RNA, 20 nt, Staphylococcus aureus subsp. aureus N315
uauacagguuuaauaaauuu

SEQ ID NO: 2153388 - RNA, 22 nt, Staphylococcus aureus subsp. aureus N315
uauacauuuuaccuaguaacuc

SEQ ID NO: 2153389 - RNA, 17 nt, Staphylococcus aureus subsp. aureus N315
uauacauugauaaauuu

SEQ ID NO: 2153390 - RNA, 14 nt, Staphylococcus aureus subsp. aureus N315
uauaccaaccaaaa

SEQ ID NO: 2153391 - RNA, 21 nt, Staphylococcus aureus subsp. aureus N315
uauacauaccacacuuuaaac

SEQ ID NO: 2153392 - RNA, 22 nt, Staphylococcus aureus subsp. aureus N315
uauaccuagggaugauauaguu

SEQ ID NO: 2153393 - RNA, 12 nt, Staphylococcus aureus subsp. aureus N315
uauacuaaucuu

SEQ ID NO: 2153394 - RNA, 21 nt, Staphylococcus aureus subsp. aureus N315
uauacuauaaauacaaauaua

SEQ ID NO: 2153395 - RNA, 13 nt, Staphylococcus aureus subsp. aureus N315
uauacuaaauuga

SEQ ID NO: 2153396 - RNA, 19 nt, Staphylococcus aureus subsp. aureus N315
uauacuaaacuuuuuucaa

SEQ ID NO: 2153397 - RNA, 20 nt, Staphylococcus aureus subsp. aureus N315
uauacgugcuuuaaaguugu

SEQ ID NO: 2153398 - RNA, 14 nt, Staphylococcus aureus subsp. aureus N315
uauacucauuuucu

SEQ ID NO: 2153399 - RNA, 17 nt, Staphylococcus aureus subsp. aureus N315
uauagaaaccaaaaaau

SEQ ID NO: 2153400 - RNA, 20 nt, Staphylococcus aureus subsp. aureus N315
uauacuuuuggucuguugaa

SEQ ID NO: 2153401 - RNA, 21 nt, Staphylococcus aureus subsp. aureus N315
uauagaaaaugaguacaacau

SEQ ID NO: 2153402 - RNA, 13 nt, Staphylococcus aureus subsp. aureus N315
uauacuuuuuaaa

SEQ ID NO: 2153403 - RNA, 19 nt, Staphylococcus aureus subsp. aureus N315
uauacuugaugaaacugau

SEQ ID NO: 2153404 - RNA, 15 nt, Staphylococcus aureus subsp. aureus N315
uauacuugaagaauc

SEQ ID NO: 2153405 - RNA, 22 nt, Staphylococcus aureus subsp. aureus N315
uauacuuacugaaacuaaauua

SEQ ID NO: 2153406 - RNA, 15 nt, Staphylococcus aureus subsp. aureus N315
uauacuuuuaccauu

SEQ ID NO: 2153407 - RNA, 13 nt, Staphylococcus aureus subsp. aureus N315
uauagccuucauu

SEQ ID NO: 2153408 - RNA, 18 nt, Staphylococcus aureus subsp. aureus N315
uauagcaucuaugauugu

SEQ ID NO: 2153409 - RNA, 22 nt, Staphylococcus aureus subsp. aureus N315
uauagaauucacgcaauaucau

SEQ ID NO: 2153410 - RNA, 16 nt, Staphylococcus aureus subsp. aureus N315
uauagaccguugaaau

SEQ ID NO: 2153411 - RNA, 19 nt, Staphylococcus aureus subsp. aureus N315
uauagaccguugaaauguu

SEQ ID NO: 2153412 - RNA, 23 nt, Staphylococcus aureus subsp. aureus N315
uauagaugacuguagaaaacaug

SEQ ID NO: 2153413 - RNA, 17 nt, Staphylococcus aureus subsp. aureus N315
uauagauuguauuuaau

SEQ ID NO: 2153414 - RNA, 14 nt, Staphylococcus aureus subsp. aureus N315
uauagauugccauu

SEQ ID NO: 2153415 - RNA, 15 nt, Staphylococcus aureus subsp. aureus N315
uauagaugugucuuu

SEQ ID NO: 2153416 - RNA, 17 nt, Staphylococcus aureus subsp. aureus N315
uauagauaggauauuuu

SEQ ID NO: 2153417 - RNA, 16 nt, Staphylococcus aureus subsp. aureus N315
uauagaggauauuuau

SEQ ID NO: 2153418 - RNA, 23 nt, Staphylococcus aureus subsp. aureus N315
uauaucaaauacauuucaaaaaa

SEQ ID NO: 2153419 - RNA, 20 nt, Staphylococcus aureus subsp. aureus N315
uauaucaacguuaauauaac

SEQ ID NO: 2153420 - RNA, 19 nt, Staphylococcus aureus subsp. aureus N315
uauaucaacguuaauauaa

SEQ ID NO: 2153421 - RNA, 16 nt, Staphylococcus aureus subsp. aureus N315
uauauaauuuauaaaa

SEQ ID NO: 2153422 - RNA, 16 nt, Staphylococcus aureus subsp. aureus N315
uauauaauuuaaagaa

SEQ ID NO: 2153423 - RNA, 13 nt, Staphylococcus aureus subsp. aureus N315
uauauaauuuaaa

SEQ ID NO: 2153424 - RNA, 23 nt, Staphylococcus aureus subsp. aureus N315
uauauacgauugaguugaaaaua

SEQ ID NO: 2153425 - RNA, 13 nt, Staphylococcus aureus subsp. aureus N315
uauauacuaaucu

SEQ ID NO: 2153426 - RNA, 21 nt, Staphylococcus aureus subsp. aureus N315
uauauaaccauaguaauaaaa

SEQ ID NO: 2153427 - RNA, 22 nt, Staphylococcus aureus subsp. aureus N315
uauagugcuuguuuauuacaua

SEQ ID NO: 2153428 - RNA, 20 nt, Staphylococcus aureus subsp. aureus N315
uauagugucgagauuuuaua

SEQ ID NO: 2153429 - RNA, 18 nt, Staphylococcus aureus subsp. aureus N315
uauaguguuugacaaguu

SEQ ID NO: 2153430 - RNA, 18 nt, Staphylococcus aureus subsp. aureus N315
uauagucuuaaacauaac

SEQ ID NO: 2153431 - RNA, 17 nt, Staphylococcus aureus subsp. aureus N315
uauagucuuaaacauaa

SEQ ID NO: 2153432 - RNA, 17 nt, Staphylococcus aureus subsp. aureus N315
uauauucguuacaaaug

SEQ ID NO: 2153433 - RNA, 16 nt, Staphylococcus aureus subsp. aureus N315
uauauugauagcaccg

SEQ ID NO: 2153434 - RNA, 23 nt, Staphylococcus aureus subsp. aureus N315
uauauugcacauaaaaaauguga

SEQ ID NO: 2153435 - RNA, 19 nt, Staphylococcus aureus subsp. aureus N315
uauauugagacaacauugu

SEQ ID NO: 2153436 - RNA, 15 nt, Staphylococcus aureus subsp. aureus N315
uauaucagcuuguuu

SEQ ID NO: 2153437 - RNA, 21 nt, Staphylococcus aureus subsp. aureus N315
uaucaaaaccgcuauaaaauu

SEQ ID NO: 2153438 - RNA, 20 nt, Staphylococcus aureus subsp. aureus N315
uaucaaaaccgcuauaaaau

SEQ ID NO: 2153439 - RNA, 16 nt, Staphylococcus aureus subsp. aureus N315
uauauuuuguuaauaa

SEQ ID NO: 2153440 - RNA, 11 nt, Staphylococcus aureus subsp. aureus N315
uauauuuuuau

SEQ ID NO: 2153441 - RNA, 15 nt, Staphylococcus aureus subsp. aureus N315
uaucaauagaugaaa

SEQ ID NO: 2153442 - RNA, 14 nt, Staphylococcus aureus subsp. aureus N315
uaucaacaauggaa

SEQ ID NO: 2153443 - RNA, 12 nt, Staphylococcus aureus subsp. aureus N315
uaucaaauucau

SEQ ID NO: 2153444 - RNA, 18 nt, Staphylococcus aureus subsp. aureus N315
uaucaaauuaccauucau

SEQ ID NO: 2153445 - RNA, 16 nt, Staphylococcus aureus subsp. aureus N315
uaucaaaauauaaaau

SEQ ID NO: 2153446 - RNA, 15 nt, Staphylococcus aureus subsp. aureus N315
uaucaaaauauaaaa

SEQ ID NO: 2153447 - RNA, 17 nt, Staphylococcus aureus subsp. aureus N315
uaucaaaauauaaaauc

SEQ ID NO: 2153448 - RNA, 21 nt, Staphylococcus aureus subsp. aureus N315
uaucaaacuuggcaaugaaau

SEQ ID NO: 2153449 - RNA, 18 nt, Staphylococcus aureus subsp. aureus N315
uaucaaacggaauuaaag

SEQ ID NO: 2153450 - RNA, 18 nt, Staphylococcus aureus subsp. aureus N315
uaucaauugaaugaagua

SEQ ID NO: 2153451 - RNA, 16 nt, Staphylococcus aureus subsp. aureus N315
uaucacgagcuuuuaa

SEQ ID NO: 2153452 - RNA, 17 nt, Staphylococcus aureus subsp. aureus N315
uaucaauagaugaaaau

SEQ ID NO: 2153453 - RNA, 14 nt, Staphylococcus aureus subsp. aureus N315
uaucaaugacaucc

SEQ ID NO: 2153454 - RNA, 12 nt, Staphylococcus aureus subsp. aureus N315
uaucaucuauuc

SEQ ID NO: 2153455 - RNA, 22 nt, Staphylococcus aureus subsp. aureus N315
uaucauccacaaucacaguaug

SEQ ID NO: 2153456 - RNA, 18 nt, Staphylococcus aureus subsp. aureus N315
uaucaguuauuuuaauaa

SEQ ID NO: 2153457 - RNA, 16 nt, Staphylococcus aureus subsp. aureus N315
uaucaucauuuaaaua

SEQ ID NO: 2153458 - RNA, 17 nt, Staphylococcus aureus subsp. aureus N315
uaucaugaugauaaauu

SEQ ID NO: 2153459 - RNA, 21 nt, Staphylococcus aureus subsp. aureus N315
uaucaugauagccgcuucauu

SEQ ID NO: 2153460 - RNA, 23 nt, Staphylococcus aureus subsp. aureus N315
uaucaugcaaaacuaaucaaauu

SEQ ID NO: 2153461 - RNA, 20 nt, Staphylococcus aureus subsp. aureus N315
uaucauguucuuauaaaaaa

SEQ ID NO: 2153462 - RNA, 20 nt, Staphylococcus aureus subsp. aureus N315
uaucauuacagauaauuauu

SEQ ID NO: 2153463 - RNA, 19 nt, Staphylococcus aureus subsp. aureus N315
uaucauuaaauugcuugaa

SEQ ID NO: 2153464 - RNA, 20 nt, Staphylococcus aureus subsp. aureus N315
uaucauuaucaaauaaccua

SEQ ID NO: 2153465 - RNA, 16 nt, Staphylococcus aureus subsp. aureus N315
uaucacugaaugcuaa

SEQ ID NO: 2153466 - RNA, 18 nt, Staphylococcus aureus subsp. aureus N315
uaucacuuauuauuuugu

SEQ ID NO: 2153467 - RNA, 17 nt, Staphylococcus aureus subsp. aureus N315
uaucacuuuagauaaac

SEQ ID NO: 2153468 - RNA, 18 nt, Staphylococcus aureus subsp. aureus N315
uaucagugugauuuugga

SEQ ID NO: 2153469 - RNA, 20 nt, Staphylococcus aureus subsp. aureus N315
uaucauuaugcccgauaauu

SEQ ID NO: 2153470 - RNA, 22 nt, Staphylococcus aureus subsp. aureus N315
uaucauuaugcccgauaauucu

SEQ ID NO: 2153471 - RNA, 23 nt, Staphylococcus aureus subsp. aureus N315
uaucauucuguguaaauauaaau

SEQ ID NO: 2153472 - RNA, 23 nt, Staphylococcus aureus subsp. aureus N315
uaucauuuaaaauauuuuuucug

SEQ ID NO: 2153473 - RNA, 21 nt, Staphylococcus aureus subsp. aureus N315
uaucauuguguccauaaauau

SEQ ID NO: 2153474 - RNA, 19 nt, Staphylococcus aureus subsp. aureus N315
uaucauuucaaauaagaau

SEQ ID NO: 2153475 - RNA, 22 nt, Staphylococcus aureus subsp. aureus N315
uaucauuguguccauaaauauu

SEQ ID NO: 2153476 - RNA, 16 nt, Staphylococcus aureus subsp. aureus N315
uaucauuucaaauaag

SEQ ID NO: 2153477 - RNA, 20 nt, Staphylococcus aureus subsp. aureus N315
uauccaaaauccugaaauua

SEQ ID NO: 2153478 - RNA, 21 nt, Staphylococcus aureus subsp. aureus N315
uauccaaggauguuauaaaau

SEQ ID NO: 2153479 - RNA, 20 nt, Staphylococcus aureus subsp. aureus N315
uauccaaggauguuauaaaa

SEQ ID NO: 2153480 - RNA, 16 nt, Staphylococcus aureus subsp. aureus N315
uauccaauguauaaaa

SEQ ID NO: 2153481 - RNA, 23 nt, Staphylococcus aureus subsp. aureus N315
uaguuugauaugcucucuucaaa

SEQ ID NO: 2153482 - RNA, 15 nt, Staphylococcus aureus subsp. aureus N315
uaguuuguaauaauu

SEQ ID NO: 2153483 - RNA, 15 nt, Staphylococcus aureus subsp. aureus N315
uaguuugaauuggga

SEQ ID NO: 2153484 - RNA, 13 nt, Staphylococcus aureus subsp. aureus N315
uaguuucucuacu

SEQ ID NO: 2153485 - RNA, 14 nt, Staphylococcus aureus subsp. aureus N315
uaguuucucuacua

SEQ ID NO: 2153486 - RNA, 15 nt, Staphylococcus aureus subsp. aureus N315
uaguuucucuacuaa

SEQ ID NO: 2153487 - RNA, 17 nt, Staphylococcus aureus subsp. aureus N315
uaguuucucuacuaaua

SEQ ID NO: 2153488 - RNA, 20 nt, Staphylococcus aureus subsp. aureus N315
uaguuucucuacuaauauuc

SEQ ID NO: 2153489 - RNA, 16 nt, Staphylococcus aureus subsp. aureus N315
uauaaaaacagcagug

SEQ ID NO: 2153490 - RNA, 19 nt, Staphylococcus aureus subsp. aureus N315
uauaaaaaauuauuaaaaa

SEQ ID NO: 2153491 - RNA, 23 nt, Staphylococcus aureus subsp. aureus N315
uauaaaaagucccgcuuaaaaug

SEQ ID NO: 2153492 - RNA, 19 nt, Staphylococcus aureus subsp. aureus N315
uauaaaaagaucauuaaaa

SEQ ID NO: 2153493 - RNA, 23 nt, Staphylococcus aureus subsp. aureus N315
uauaaaaagaauaugauauugau

SEQ ID NO: 2153494 - RNA, 14 nt, Staphylococcus aureus subsp. aureus N315
uauaaaaagaauau

SEQ ID NO: 2153495 - RNA, 18 nt, Staphylococcus aureus subsp. aureus N315
uaguuuuuacguuuucua

SEQ ID NO: 2153496 - RNA, 14 nt, Staphylococcus aureus subsp. aureus N315
uaguuuuuaaaauu

SEQ ID NO: 2153497 - RNA, 15 nt, Staphylococcus aureus subsp. aureus N315
uaguuuuuuuuauau

SEQ ID NO: 2153498 - RNA, 14 nt, Staphylococcus aureus subsp. aureus N315
uaguuuuuuuuaua

SEQ ID NO: 2153499 - RNA, 23 nt, Staphylococcus aureus subsp. aureus N315
uauaaaaaaauuaacuauacuuu

SEQ ID NO: 2153500 - RNA, 17 nt, Staphylococcus aureus subsp. aureus N315
uauaaacgucacuuuau

SEQ ID NO: 2153501 - RNA, 22 nt, Staphylococcus aureus subsp. aureus N315
uauaaacgucacuuuauuaaau

SEQ ID NO: 2153502 - RNA, 13 nt, Staphylococcus aureus subsp. aureus N315
uauaaacauuuau

SEQ ID NO: 2153503 - RNA, 21 nt, Staphylococcus aureus subsp. aureus N315
uauaaaaauuuauucaaaauu

SEQ ID NO: 2153504 - RNA, 17 nt, Staphylococcus aureus subsp. aureus N315
uauaaauuaaaugcaau

SEQ ID NO: 2153505 - RNA, 15 nt, Staphylococcus aureus subsp. aureus N315
uauaaaugucauagu

SEQ ID NO: 2153506 - RNA, 20 nt, Staphylococcus aureus subsp. aureus N315
uauaaagaaauaauuuaaag

SEQ ID NO: 2153507 - RNA, 16 nt, Staphylococcus aureus subsp. aureus N315
uauaacgcuuuaauau

SEQ ID NO: 2153508 - RNA, 20 nt, Staphylococcus aureus subsp. aureus N315
uauaacaaaaauugcuauau

SEQ ID NO: 2153509 - RNA, 15 nt, Staphylococcus aureus subsp. aureus N315
uauaacaaaaucuca

SEQ ID NO: 2153510 - RNA, 19 nt, Staphylococcus aureus subsp. aureus N315
uauaacaaaaucucaacag

SEQ ID NO: 2153511 - RNA, 19 nt, Staphylococcus aureus subsp. aureus N315
uauaaauuuguaccaaaua

SEQ ID NO: 2153512 - RNA, 20 nt, Staphylococcus aureus subsp. aureus N315
uauaaauuuguaccaaauaa

SEQ ID NO: 2153513 - RNA, 19 nt, Staphylococcus aureus subsp. aureus N315
uagugcgcuuauuuuacua

SEQ ID NO: 2153514 - RNA, 21 nt, Staphylococcus aureus subsp. aureus N315
uagugcucgaaucucauugau

SEQ ID NO: 2153515 - RNA, 16 nt, Staphylococcus aureus subsp. aureus N315
uagugauuuuuuacau

SEQ ID NO: 2153516 - RNA, 20 nt, Staphylococcus aureus subsp. aureus N315
uagugcgcgauaaauaauaa

SEQ ID NO: 2153517 - RNA, 17 nt, Staphylococcus aureus subsp. aureus N315
uagucauuacaaaucau

SEQ ID NO: 2153518 - RNA, 16 nt, Staphylococcus aureus subsp. aureus N315
uagucauuacaaauca

SEQ ID NO: 2153519 - RNA, 22 nt, Staphylococcus aureus subsp. aureus N315
uagucauguuuggcauaauaau

SEQ ID NO: 2153520 - RNA, 20 nt, Staphylococcus aureus subsp. aureus N315
uagucauguuuggcauaaua

SEQ ID NO: 2153521 - RNA, 17 nt, Staphylococcus aureus subsp. aureus N315
uaguccggggccccaac

SEQ ID NO: 2153522 - RNA, 23 nt, Staphylococcus aureus subsp. aureus N315
uaguucgcgacgacguccagcua

SEQ ID NO: 2153523 - RNA, 22 nt, Staphylococcus aureus subsp. aureus N315
uaguuuaacaauacuacuuaau

SEQ ID NO: 2153524 - RNA, 20 nt, Staphylococcus aureus subsp. aureus N315
uaguuuaagucuaacuuuag

SEQ ID NO: 2153525 - RNA, 12 nt, Staphylococcus aureus subsp. aureus N315
uaguuuauuaau

SEQ ID NO: 2153526 - RNA, 22 nt, Staphylococcus aureus subsp. aureus N315
uaguuuauugccgguuaaauua

SEQ ID NO: 2153527 - RNA, 19 nt, Staphylococcus aureus subsp. aureus N315
uaggggcuuuuaugcaugc

SEQ ID NO: 2153528 - RNA, 17 nt, Staphylococcus aureus subsp. aureus N315
uaggguauugaaauaau

SEQ ID NO: 2153529 - RNA, 15 nt, Staphylococcus aureus subsp. aureus N315
uagguauaaucauuu

SEQ ID NO: 2153530 - RNA, 21 nt, Staphylococcus aureus subsp. aureus N315
uagguaugcguggucuauuuu

SEQ ID NO: 2153531 - RNA, 21 nt, Staphylococcus aureus subsp. aureus N315
uaggucaacuguaguggaaga

SEQ ID NO: 2153532 - RNA, 18 nt, Staphylococcus aureus subsp. aureus N315
uaggucuacgaucaaaau

SEQ ID NO: 2153533 - RNA, 15 nt, Staphylococcus aureus subsp. aureus N315
uaguauggaauaaau

SEQ ID NO: 2153534 - RNA, 18 nt, Staphylococcus aureus subsp. aureus N315
uaguauucaaaaaauauu

SEQ ID NO: 2153535 - RNA, 15 nt, Staphylococcus aureus subsp. aureus N315
uaguauuucaucauu

SEQ ID NO: 2153536 - RNA, 14 nt, Staphylococcus aureus subsp. aureus N315
uaguagcuagaaca

SEQ ID NO: 2153537 - RNA, 16 nt, Staphylococcus aureus subsp. aureus N315
uaguaguacacgaauu

SEQ ID NO: 2153538 - RNA, 14 nt, Staphylococcus aureus subsp. aureus N315
uaguauaaauauca

SEQ ID NO: 2153539 - RNA, 19 nt, Staphylococcus aureus subsp. aureus N315
uaguaaauauaguuaaagu

SEQ ID NO: 2153540 - RNA, 23 nt, Staphylococcus aureus subsp. aureus N315
uaguacuaaaccgauuaauauaa

SEQ ID NO: 2153541 - RNA, 23 nt, Staphylococcus aureus subsp. aureus N315
uaguaaaauaaauacaauagaaa

SEQ ID NO: 2153542 - RNA, 21 nt, Staphylococcus aureus subsp. aureus N315
uaggcucuuaauguacuuuuc

SEQ ID NO: 2153543 - RNA, 19 nt, Staphylococcus aureus subsp. aureus N315
uaggcuuuuuuauuaugug

SEQ ID NO: 2153544 - RNA, 20 nt, Staphylococcus aureus subsp. aureus N315
uaggcgccauaaucauuagu

SEQ ID NO: 2153545 - RNA, 16 nt, Staphylococcus aureus subsp. aureus N315
uaggcaacugcaagug

SEQ ID NO: 2153546 - RNA, 17 nt, Staphylococcus aureus subsp. aureus N315
uaggcaggaaugauaua

SEQ ID NO: 2153547 - RNA, 22 nt, Staphylococcus aureus subsp. aureus N315
uaaaucaaagggcuucgauuca

SEQ ID NO: 2153548 - RNA, 14 nt, Staphylococcus aureus subsp. aureus N315
uaaaucaacaagaa

SEQ ID NO: 2153549 - RNA, 17 nt, Staphylococcus aureus subsp. aureus N315
uaaaucaacaagaacuu

SEQ ID NO: 2153550 - RNA, 13 nt, Staphylococcus aureus subsp. aureus N315
uaaaucaagaaau

SEQ ID NO: 2153551 - RNA, 15 nt, Staphylococcus aureus subsp. aureus N315
uaaauauuuuuuaaa

SEQ ID NO: 2153552 - RNA, 16 nt, Staphylococcus aureus subsp. aureus N315
uaaauauuuuuuaaaa

SEQ ID NO: 2153553 - RNA, 16 nt, Staphylococcus aureus subsp. aureus N315
uaaaucaaagaggaac

SEQ ID NO: 2153554 - RNA, 12 nt, Staphylococcus aureus subsp. aureus N315
uaaaucaaagag

SEQ ID NO: 2153555 - RNA, 22 nt, Staphylococcus aureus subsp. aureus N315
uaaaucuaauacuuucaaacaa

SEQ ID NO: 2153556 - RNA, 21 nt, Staphylococcus aureus subsp. aureus N315
uaaaucacauaugauaauuaa

SEQ ID NO: 2153557 - RNA, 16 nt, Staphylococcus aureus subsp. aureus N315
uaaaucuguuuaaauu

SEQ ID NO: 2153558 - RNA, 20 nt, Staphylococcus aureus subsp. aureus N315
uaaaucuccauuaaucauuu

SEQ ID NO: 2153559 - RNA, 16 nt, Staphylococcus aureus subsp. aureus N315
uaaaucugauucauua

SEQ ID NO: 2153560 - RNA, 20 nt, Staphylococcus aureus subsp. aureus N315
uaaaucuuguuggauuuuaa

SEQ ID NO: 2153561 - RNA, 23 nt, Staphylococcus aureus subsp. aureus N315
uaaaucuuguuggauuuuaacaa

SEQ ID NO: 2153562 - RNA, 19 nt, Staphylococcus aureus subsp. aureus N315
uaaaucuucuaguaauucu

SEQ ID NO: 2153563 - RNA, 18 nt, Staphylococcus aureus subsp. aureus N315
uaaaucuucuauuuucau

SEQ ID NO: 2153564 - RNA, 15 nt, Staphylococcus aureus subsp. aureus N315
uaaaucuucaucauc

SEQ ID NO: 2153565 - RNA, 23 nt, Staphylococcus aureus subsp. aureus N315
uaaaugaaacuuugugugcuuua

SEQ ID NO: 2153566 - RNA, 20 nt, Staphylococcus aureus subsp. aureus N315
uaaaucuuuaacuucugauu

SEQ ID NO: 2153567 - RNA, 23 nt, Staphylococcus aureus subsp. aureus N315
uaaaugaaaguaccuaaaauaga

SEQ ID NO: 2153568 - RNA, 16 nt, Staphylococcus aureus subsp. aureus N315
uaaauguacauuguaa

SEQ ID NO: 2153569 - RNA, 16 nt, Staphylococcus aureus subsp. aureus N315
uaaauguauuaaacau

SEQ ID NO: 2153570 - RNA, 19 nt, Staphylococcus aureus subsp. aureus N315
uaaaugugcaauuagaaua

SEQ ID NO: 2153571 - RNA, 19 nt, Staphylococcus aureus subsp. aureus N315
uaaauguuaaauucuaaaa

SEQ ID NO: 2153572 - RNA, 18 nt, Staphylococcus aureus subsp. aureus N315
uaaauguuaaauucuaaa

SEQ ID NO: 2153573 - RNA, 19 nt, Staphylococcus aureus subsp. aureus N315
uaaauuacaaaaguaugau

SEQ ID NO: 2153574 - RNA, 21 nt, Staphylococcus aureus subsp. aureus N315
uaaaugucuuucaaauacaca

SEQ ID NO: 2153575 - RNA, 17 nt, Staphylococcus aureus subsp. aureus N315
uaaaugucuuucaaaua

SEQ ID NO: 2153576 - RNA, 20 nt, Staphylococcus aureus subsp. aureus N315
uaaaugucuuucaaauacac

SEQ ID NO: 2153577 - RNA, 14 nt, Staphylococcus aureus subsp. aureus N315
uaaaugucuuucaa

SEQ ID NO: 2153578 - RNA, 17 nt, Staphylococcus aureus subsp. aureus N315
uaaaugaauuauuuaaa

SEQ ID NO: 2153579 - RNA, 20 nt, Staphylococcus aureus subsp. aureus N315
uaaaugaauugucuuaauau

SEQ ID NO: 2153580 - RNA, 21 nt, Staphylococcus aureus subsp. aureus N315
uaaaugacuucacauuuaucc

SEQ ID NO: 2153581 - RNA, 18 nt, Staphylococcus aureus subsp. aureus N315
uaaaugacugaauuaaua

SEQ ID NO: 2153582 - RNA, 14 nt, Staphylococcus aureus subsp. aureus N315
uaaaugauuuaaua

SEQ ID NO: 2153583 - RNA, 12 nt, Staphylococcus aureus subsp. aureus N315
uaaaugauuuaa

SEQ ID NO: 2153584 - RNA, 15 nt, Staphylococcus aureus subsp. aureus N315
uaaaugauuucacuu

SEQ ID NO: 2153585 - RNA, 16 nt, Staphylococcus aureus subsp. aureus N315
uaaaugcaauacauua

SEQ ID NO: 2153586 - RNA, 14 nt, Staphylococcus aureus subsp. aureus N315
uaaaugauuaauaa

SEQ ID NO: 2153587 - RNA, 14 nt, Staphylococcus aureus subsp. aureus N315
uaaaugauucuuua

SEQ ID NO: 2153588 - RNA, 21 nt, Staphylococcus aureus subsp. aureus N315
uaacaauacuacuuaaugacu

SEQ ID NO: 2153589 - RNA, 13 nt, Staphylococcus aureus subsp. aureus N315
uaacaaagucucu

SEQ ID NO: 2153590 - RNA, 17 nt, Staphylococcus aureus subsp. aureus N315
uaaauuuuauauauccu

SEQ ID NO: 2153591 - RNA, 18 nt, Staphylococcus aureus subsp. aureus N315
uaaauuuuaucuaaacau

SEQ ID NO: 2153592 - RNA, 14 nt, Staphylococcus aureus subsp. aureus N315
uaaauuugaaagua

SEQ ID NO: 2153593 - RNA, 18 nt, Staphylococcus aureus subsp. aureus N315
uaaauuuuauauauccug

SEQ ID NO: 2153594 - RNA, 18 nt, Staphylococcus aureus subsp. aureus N315
uaaauuuuacgaaaauau

SEQ ID NO: 2153595 - RNA, 20 nt, Staphylococcus aureus subsp. aureus N315
uaaauuuuacgaaaauauca

SEQ ID NO: 2153596 - RNA, 19 nt, Staphylococcus aureus subsp. aureus N315
uaaauuuguaccaaauaaa

SEQ ID NO: 2153597 - RNA, 15 nt, Staphylococcus aureus subsp. aureus N315
uaaauuugaaaguaa

SEQ ID NO: 2153598 - RNA, 14 nt, Staphylococcus aureus subsp. aureus N315
uaaauuucuucaua

SEQ ID NO: 2153599 - RNA, 15 nt, Staphylococcus aureus subsp. aureus N315
uaaauuacuauauuu

SEQ ID NO: 2153600 - RNA, 13 nt, Staphylococcus aureus subsp. aureus N315
uaaauuacuauau

SEQ ID NO: 2153601 - RNA, 18 nt, Staphylococcus aureus subsp. aureus N315
uaaauuagaugaaaugga

SEQ ID NO: 2153602 - RNA, 18 nt, Staphylococcus aureus subsp. aureus N315
uaaauuaucuaaagaaau

SEQ ID NO: 2153603 - RNA, 13 nt, Staphylococcus aureus subsp. aureus N315
uaaauuauauacc

SEQ ID NO: 2153604 - RNA, 22 nt, Staphylococcus aureus subsp. aureus N315
uaaauugaguuuuuuaaaauaa

SEQ ID NO: 2153605 - RNA, 17 nt, Staphylococcus aureus subsp. aureus N315
uaaauuguuuacuauac

SEQ ID NO: 2153606 - RNA, 16 nt, Staphylococcus aureus subsp. aureus N315
uaaauuguguuucuuu

SEQ ID NO: 2153607 - RNA, 14 nt, Staphylococcus aureus subsp. aureus N315
uaaauuguuuuaca

SEQ ID NO: 2153608 - RNA, 19 nt, Staphylococcus aureus subsp. aureus N315
uaaauuguaugaauaauau

SEQ ID NO: 2153609 - RNA, 19 nt, Staphylococcus aureus subsp. aureus N315
uaaauuuaccauaaccuuc

SEQ ID NO: 2153610 - RNA, 19 nt, Staphylococcus aureus subsp. aureus N315
uaaauuuagauauuauaaa

SEQ ID NO: 2153611 - RNA, 17 nt, Staphylococcus aureus subsp. aureus N315
uaaauuuaaaagaaaaa

SEQ ID NO: 2153612 - RNA, 14 nt, Staphylococcus aureus subsp. aureus N315
uaaauuuaaaauaa

SEQ ID NO: 2153613 - RNA, 14 nt, Staphylococcus aureus subsp. aureus N315
uaaauuuaaaagaa

SEQ ID NO: 2153614 - RNA, 15 nt, Staphylococcus aureus subsp. aureus N315
uaaauuuaaaagaaa

SEQ ID NO: 2153615 - RNA, 18 nt, Staphylococcus aureus subsp. aureus N315
uaaauuuaacguuauuca

SEQ ID NO: 2153616 - RNA, 15 nt, Staphylococcus aureus subsp. aureus N315
uaacaauauuaaauu

SEQ ID NO: 2153617 - RNA, 19 nt, Staphylococcus aureus subsp. aureus N315
uaacaauaguuuucuucac

SEQ ID NO: 2153618 - RNA, 23 nt, Staphylococcus aureus subsp. aureus N315
uaacaaugcagcuguauuuaaua

SEQ ID NO: 2153619 - RNA, 17 nt, Staphylococcus aureus subsp. aureus N315
uaacaaucguuuuaaug

SEQ ID NO: 2153620 - RNA, 23 nt, Staphylococcus aureus subsp. aureus N315
uaacagcugcagucgcaauggca

SEQ ID NO: 2153621 - RNA, 20 nt, Staphylococcus aureus subsp. aureus N315
uaacaucacauaaaauacau

SEQ ID NO: 2153622 - RNA, 19 nt, Staphylococcus aureus subsp. aureus N315
uaacaugugcaaguauaau

SEQ ID NO: 2153623 - RNA, 23 nt, Staphylococcus aureus subsp. aureus N315
uaacauguuuguggcaccucuuu

SEQ ID NO: 2153624 - RNA, 21 nt, Staphylococcus aureus subsp. aureus N315
uaacauuagcauuaaauucca

SEQ ID NO: 2153625 - RNA, 13 nt, Staphylococcus aureus subsp. aureus N315
uaacauuuaaaaa

SEQ ID NO: 2153626 - RNA, 14 nt, Staphylococcus aureus subsp. aureus N315
uaacauuuaaaaaa

SEQ ID NO: 2153627 - RNA, 19 nt, Staphylococcus aureus subsp. aureus N315
uaacauucuucaaaaaaua

SEQ ID NO: 2153628 - RNA, 21 nt, Staphylococcus aureus subsp. aureus N315
uaacauucuucaaaaaauaau

SEQ ID NO: 2153629 - RNA, 18 nt, Staphylococcus aureus subsp. aureus N315
uaacauucuucaaaaaau

SEQ ID NO: 2153630 - RNA, 12 nt, Staphylococcus aureus subsp. aureus N315
uaacauuuugaa

SEQ ID NO: 2153631 - RNA, 13 nt, Staphylococcus aureus subsp. aureus N315
uaacauuugucau

SEQ ID NO: 2153632 - RNA, 14 nt, Staphylococcus aureus subsp. aureus N315
uaacauuugucaua

SEQ ID NO: 2153633 - RNA, 20 nt, Staphylococcus aureus subsp. aureus N315
uaacauugaacgauaacaau

SEQ ID NO: 2153634 - RNA, 15 nt, Staphylococcus aureus subsp. aureus N315
uaacauaaaaugagu

SEQ ID NO: 2153635 - RNA, 23 nt, Staphylococcus aureus subsp. aureus N315
uaacauaaaaaggucuauguaca

SEQ ID NO: 2153636 - RNA, 18 nt, Staphylococcus aureus subsp. aureus N315
uaacauagcuuaauaauu

SEQ ID NO: 2153637 - RNA, 21 nt, Staphylococcus aureus subsp. aureus N315
uaacauacuauaaaaauuuau

SEQ ID NO: 2153638 - RNA, 16 nt, Staphylococcus aureus subsp. aureus N315
uaacauacuauaaaaa

SEQ ID NO: 2153639 - RNA, 22 nt, Staphylococcus aureus subsp. aureus N315
uaacauaucgcgcaucaaaaau

SEQ ID NO: 2153640 - RNA, 21 nt, Staphylococcus aureus subsp. aureus N315
uaacauaucgucaauuuuaau

SEQ ID NO: 2153641 - RNA, 15 nt, Staphylococcus aureus subsp. aureus N315
uaacauaucagcuuu

SEQ ID NO: 2153642 - RNA, 14 nt, Staphylococcus aureus subsp. aureus N315
uaacaucaauuacu

SEQ ID NO: 2153643 - RNA, 15 nt, Staphylococcus aureus subsp. aureus N315
uaaccgcauacagau

SEQ ID NO: 2153644 - RNA, 15 nt, Staphylococcus aureus subsp. aureus N315
uaacccacauuaaau

SEQ ID NO: 2153645 - RNA, 15 nt, Staphylococcus aureus subsp. aureus N315
uaaccauuuuuucaa

SEQ ID NO: 2153646 - RNA, 21 nt, Staphylococcus aureus subsp. aureus N315
uaaccauuaugauuaauccua

SEQ ID NO: 2153647 - RNA, 14 nt, Staphylococcus aureus subsp. aureus N315
uaacccacauuaaa

SEQ ID NO: 2153648 - RNA, 14 nt, Staphylococcus aureus subsp. aureus N315
uaaccauuuaaaaa

SEQ ID NO: 2153649 - RNA, 15 nt, Staphylococcus aureus subsp. aureus N315
uaaccauuuaaaaau

SEQ ID NO: 2153650 - RNA, 18 nt, Staphylococcus aureus subsp. aureus N315
uaacccaacgaugaaacu

SEQ ID NO: 2153651 - RNA, 17 nt, Staphylococcus aureus subsp. aureus N315
uaacgacccaaauuaua

SEQ ID NO: 2153652 - RNA, 17 nt, Staphylococcus aureus subsp. aureus N315
uaaccuuuaaaacauca

SEQ ID NO: 2153653 - RNA, 16 nt, Staphylococcus aureus subsp. aureus N315
uaaccuuuaaaacauc

SEQ ID NO: 2153654 - RNA, 19 nt, Staphylococcus aureus subsp. aureus N315
uaaccuuuaaaacaucauu

SEQ ID NO: 2153655 - RNA, 12 nt, Staphylococcus aureus subsp. aureus N315
uaaacuucuuuu

SEQ ID NO: 2153656 - RNA, 15 nt, Staphylococcus aureus subsp. aureus N315
uaaacuuuaugaaau

SEQ ID NO: 2153657 - RNA, 15 nt, Staphylococcus aureus subsp. aureus N315
uaaacuucuuuucuu

SEQ ID NO: 2153658 - RNA, 19 nt, Staphylococcus aureus subsp. aureus N315
uaaacuaauagcauuugua

SEQ ID NO: 2153659 - RNA, 18 nt, Staphylococcus aureus subsp. aureus N315
uaaacguugcaccuauuu

SEQ ID NO: 2153660 - RNA, 19 nt, Staphylococcus aureus subsp. aureus N315
uaaagaaacaugauugaaa

SEQ ID NO: 2153661 - RNA, 20 nt, Staphylococcus aureus subsp. aureus N315
uaaacuuuucuucaaguugu

SEQ ID NO: 2153662 - RNA, 21 nt, Staphylococcus aureus subsp. aureus N315
uaaacuuuucuucaaguuguu

SEQ ID NO: 2153663 - RNA, 20 nt, Staphylococcus aureus subsp. aureus N315
uaaagaacuauuuuaaauua

SEQ ID NO: 2153664 - RNA, 17 nt, Staphylococcus aureus subsp. aureus N315
uaaagaacuauuuuaaa

SEQ ID NO: 2153665 - RNA, 15 nt, Staphylococcus aureus subsp. aureus N315
uaaacauguacaauu

SEQ ID NO: 2153666 - RNA, 19 nt, Staphylococcus aureus subsp. aureus N315
uaaaccauuuucaagagga

SEQ ID NO: 2153667 - RNA, 14 nt, Staphylococcus aureus subsp. aureus N315
uaaacccaaagcuc

SEQ ID NO: 2153668 - RNA, 19 nt, Staphylococcus aureus subsp. aureus N315
uaaaccucuaaauaaaauu

SEQ ID NO: 2153669 - RNA, 15 nt, Staphylococcus aureus subsp. aureus N315
uaaaccuuaauaaug

SEQ ID NO: 2153670 - RNA, 15 nt, Staphylococcus aureus subsp. aureus N315
uaaaauuuacaaaug

SEQ ID NO: 2153671 - RNA, 20 nt, Staphylococcus aureus subsp. aureus N315
uaaaauuuacaaauguauaa

SEQ ID NO: 2153672 - RNA, 18 nt, Staphylococcus aureus subsp. aureus N315
uaaaauuuacaaauguau

SEQ ID NO: 2153673 - RNA, 16 nt, Staphylococcus aureus subsp. aureus N315
uaaaauuuguuaauuu

SEQ ID NO: 2153674 - RNA, 18 nt, Staphylococcus aureus subsp. aureus N315
uaaaauuuguuaauuuaa

SEQ ID NO: 2153675 - RNA, 20 nt, Staphylococcus aureus subsp. aureus N315
uaaaauuucugcuucuuuua

SEQ ID NO: 2153676 - RNA, 22 nt, Staphylococcus aureus subsp. aureus N315
uaaaauugccaguaucucuuuu

SEQ ID NO: 2153677 - RNA, 20 nt, Staphylococcus aureus subsp. aureus N315
uaaaauugccaguaucucuu

SEQ ID NO: 2153678 - RNA, 15 nt, Staphylococcus aureus subsp. aureus N315
uaaaauuguauagaa

SEQ ID NO: 2153679 - RNA, 15 nt, Staphylococcus aureus subsp. aureus N315
uaaaauuuaaaacaa

SEQ ID NO: 2153680 - RNA, 16 nt, Staphylococcus aureus subsp. aureus N315
uaaaauuuaaaacaau

SEQ ID NO: 2153681 - RNA, 13 nt, Staphylococcus aureus subsp. aureus N315
uaaaauuaugauu

SEQ ID NO: 2153682 - RNA, 22 nt, Staphylococcus aureus subsp. aureus N315
uaaaauucucuuuuaaauucuu

SEQ ID NO: 2153683 - RNA, 11 nt, Staphylococcus aureus subsp. aureus N315
uaaaauucuuu

SEQ ID NO: 2153684 - RNA, 19 nt, Staphylococcus aureus subsp. aureus N315
uaaacaauuccccaaagcc

SEQ ID NO: 2153685 - RNA, 12 nt, Staphylococcus aureus subsp. aureus N315
uaaaauuuuaau

SEQ ID NO: 2153686 - RNA, 14 nt, Staphylococcus aureus subsp. aureus N315
uaaaauuugugcau

SEQ ID NO: 2153687 - RNA, 22 nt, Staphylococcus aureus subsp. aureus N315
uaaaauuuuuuucauaauuaau

SEQ ID NO: 2153688 - RNA, 23 nt, Staphylococcus aureus subsp. aureus N315
uaaaauuuuuugggcuuuuucac

SEQ ID NO: 2153689 - RNA, 18 nt, Staphylococcus aureus subsp. aureus N315
uaaacaugaacaaucaga

SEQ ID NO: 2153690 - RNA, 14 nt, Staphylococcus aureus subsp. aureus N315
uaaacaugaacaau

SEQ ID NO: 2153691 - RNA, 18 nt, Staphylococcus aureus subsp. aureus N315
uaaacaucuauaacaaaa

SEQ ID NO: 2153692 - RNA, 15 nt, Staphylococcus aureus subsp. aureus N315
uaaacacaucuaugu

SEQ ID NO: 2153693 - RNA, 21 nt, Staphylococcus aureus subsp. aureus N315
uaaauagacugccaauaaaau

SEQ ID NO: 2153694 - RNA, 19 nt, Staphylococcus aureus subsp. aureus N315
uaaauacgccaaauaucag

SEQ ID NO: 2153695 - RNA, 21 nt, Staphylococcus aureus subsp. aureus N315
uaaauacuuuugcaucacaga

SEQ ID NO: 2153696 - RNA, 21 nt, Staphylococcus aureus subsp. aureus N315
uaaauacuugcucuaauucaa

SEQ ID NO: 2153697 - RNA, 19 nt, Staphylococcus aureus subsp. aureus N315
uaaauaggaugaaaaagau

SEQ ID NO: 2153698 - RNA, 18 nt, Staphylococcus aureus subsp. aureus N315
uaaauagauaauauauag

SEQ ID NO: 2153699 - RNA, 22 nt, Staphylococcus aureus subsp. aureus N315
uaaauauuauuuugcaauugca

SEQ ID NO: 2153700 - RNA, 22 nt, Staphylococcus aureus subsp. aureus N315
uaaauaguaagguuugaacucu

SEQ ID NO: 2153701 - RNA, 19 nt, Staphylococcus aureus subsp. aureus N315
uaaauauuggaauacucuu

SEQ ID NO: 2153702 - RNA, 18 nt, Staphylococcus aureus subsp. aureus N315
uaaauauuggaauacucu

SEQ ID NO: 2153703 - RNA, 13 nt, Staphylococcus aureus subsp. aureus N315
uaaauauuuaauu

SEQ ID NO: 2153704 - RNA, 14 nt, Staphylococcus aureus subsp. aureus N315
uaaauauuuagauu

SEQ ID NO: 2153705 - RNA, 14 nt, Staphylococcus aureus subsp. aureus N315
uaaauauucuuauc

SEQ ID NO: 2153706 - RNA, 19 nt, Staphylococcus aureus subsp. aureus N315
uaaauauugauauaaaaaa

SEQ ID NO: 2153707 - RNA, 13 nt, Staphylococcus aureus subsp. aureus N315
uaaauauugaaga

SEQ ID NO: 2153708 - RNA, 13 nt, Staphylococcus aureus subsp. aureus N315
uaaauauugaaca

SEQ ID NO: 2153709 - RNA, 20 nt, Staphylococcus aureus subsp. aureus N315
uaaauaaugauaaauuaaag

SEQ ID NO: 2153710 - RNA, 18 nt, Staphylococcus aureus subsp. aureus N315
uaaauaaugcauggaaaa

SEQ ID NO: 2153711 - RNA, 13 nt, Staphylococcus aureus subsp. aureus N315
uaaauaaaugacu

SEQ ID NO: 2153712 - RNA, 22 nt, Staphylococcus aureus subsp. aureus N315
uaaauacaaagccuuaauauca

SEQ ID NO: 2153713 - RNA, 14 nt, Staphylococcus aureus subsp. aureus N315
uaaauacaaaaaua

SEQ ID NO: 2153714 - RNA, 18 nt, Staphylococcus aureus subsp. aureus N315
uaaauaaaaggcauucuu

SEQ ID NO: 2153715 - RNA, 14 nt, Staphylococcus aureus subsp. aureus N315
uaaauaaacaggga

SEQ ID NO: 2153716 - RNA, 13 nt, Staphylococcus aureus subsp. aureus N315
uaaauaaaaugcu

SEQ ID NO: 2153717 - RNA, 14 nt, Staphylococcus aureus subsp. aureus N315
uaaauaaaaugcua

SEQ ID NO: 2153718 - RNA, 14 nt, Staphylococcus aureus subsp. aureus N315
uaaauaaaauuaaa

SEQ ID NO: 2153719 - RNA, 15 nt, Staphylococcus aureus subsp. aureus N315
uaaauaaaauuaaaa

SEQ ID NO: 2153720 - RNA, 22 nt, Staphylococcus aureus subsp. aureus N315
uaaauaaaauuuuuuucauaau

SEQ ID NO: 2153721 - RNA, 20 nt, Staphylococcus aureus subsp. aureus N315
uaaauaaacuuuaugaaauu

SEQ ID NO: 2153722 - RNA, 13 nt, Staphylococcus aureus subsp. aureus N315
uaaauaaaaugca

SEQ ID NO: 2153723 - RNA, 13 nt, Staphylococcus aureus subsp. aureus N315
uaaauaaaacuau

SEQ ID NO: 2153724 - RNA, 16 nt, Staphylococcus aureus subsp. aureus N315
uaaagagcaauuaaag

SEQ ID NO: 2153725 - RNA, 15 nt, Staphylococcus aureus subsp. aureus N315
uaaagagcaauuaaa

SEQ ID NO: 2153726 - RNA, 14 nt, Staphylococcus aureus subsp. aureus N315
uaaagauuuaaguc

SEQ ID NO: 2153727 - RNA, 13 nt, Staphylococcus aureus subsp. aureus N315
uaaagcaaauuau

SEQ ID NO: 2153728 - RNA, 19 nt, Staphylococcus aureus subsp. aureus N315
uaaagggcuauuugauaca

SEQ ID NO: 2153729 - RNA, 22 nt, Staphylococcus aureus subsp. aureus N315
uaaaggguguuuagauagcucu

SEQ ID NO: 2153730 - RNA, 18 nt, Staphylococcus aureus subsp. aureus N315
uaaagguuaaauauuuaa

SEQ ID NO: 2153731 - RNA, 16 nt, Staphylococcus aureus subsp. aureus N315
uaaagcgauuuccauc

SEQ ID NO: 2153732 - RNA, 21 nt, Staphylococcus aureus subsp. aureus N315
uaaagcuaacauaccuaauaa

SEQ ID NO: 2153733 - RNA, 15 nt, Staphylococcus aureus subsp. aureus N315
uaaaauaugauuuaa

SEQ ID NO: 2153734 - RNA, 16 nt, Staphylococcus aureus subsp. aureus N315
uaaaauaugacacaua

SEQ ID NO: 2153735 - RNA, 21 nt, Staphylococcus aureus subsp. aureus N315
uaaaaucacuugguaaaacau

SEQ ID NO: 2153736 - RNA, 15 nt, Staphylococcus aureus subsp. aureus N315
uaaaaucaacuuuuc

SEQ ID NO: 2153737 - RNA, 13 nt, Staphylococcus aureus subsp. aureus N315
uaaaaucucauaa

SEQ ID NO: 2153738 - RNA, 17 nt, Staphylococcus aureus subsp. aureus N315
uaaaaucucauaauaau

SEQ ID NO: 2153739 - RNA, 19 nt, Staphylococcus aureus subsp. aureus N315
uaaaauccaagugcuaaga

SEQ ID NO: 2153740 - RNA, 15 nt, Staphylococcus aureus subsp. aureus N315
uaaaaucaucguauu

SEQ ID NO: 2153741 - RNA, 15 nt, Staphylococcus aureus subsp. aureus N315
uaaaaugaauaguag

SEQ ID NO: 2153742 - RNA, 17 nt, Staphylococcus aureus subsp. aureus N315
uaaaaugauuguuuuaa

SEQ ID NO: 2153743 - RNA, 14 nt, Staphylococcus aureus subsp. aureus N315
uaaaaugcauagcu

SEQ ID NO: 2153744 - RNA, 17 nt, Staphylococcus aureus subsp. aureus N315
uaaaaucugcuuuauuu

SEQ ID NO: 2153745 - RNA, 20 nt, Staphylococcus aureus subsp. aureus N315
uaaaaucugcuuuauuuuau

SEQ ID NO: 2153746 - RNA, 17 nt, Staphylococcus aureus subsp. aureus N315
uaaaauguuaauaauga

SEQ ID NO: 2153747 - RNA, 15 nt, Staphylococcus aureus subsp. aureus N315
uaaaauuaaaacagc

SEQ ID NO: 2153748 - RNA, 21 nt, Staphylococcus aureus subsp. aureus N315
uaaaauuaacuuaaaauuuaa

SEQ ID NO: 2153749 - RNA, 22 nt, Staphylococcus aureus subsp. aureus N315
uaaaauuaacuuaaaauuuaaa

SEQ ID NO: 2153750 - RNA, 21 nt, Staphylococcus aureus subsp. aureus N315
uaaaauuaaaccuacaacgaa

SEQ ID NO: 2153751 - RNA, 23 nt, Staphylococcus aureus subsp. aureus N315
uaaaauguuaggugaaaccauac

SEQ ID NO: 2153752 - RNA, 14 nt, Staphylococcus aureus subsp. aureus N315
uaaaauuaaauaau

SEQ ID NO: 2153753 - RNA, 14 nt, Staphylococcus aureus subsp. aureus N315
uaaaauuaaaugcu

SEQ ID NO: 2153754 - RNA, 20 nt, Staphylococcus aureus subsp. aureus N315
uaaaaugcuacaauuuccua

SEQ ID NO: 2153755 - RNA, 20 nt, Staphylococcus aureus subsp. aureus N315
uaaaauggugcgaauaauaa

SEQ ID NO: 2153756 - RNA, 22 nt, Staphylococcus aureus subsp. aureus N315
uaaaaggaagcaucuccaauuu

SEQ ID NO: 2153757 - RNA, 20 nt, Staphylococcus aureus subsp. aureus N315
uaaaaggcgaaacauuaaaa

SEQ ID NO: 2153758 - RNA, 15 nt, Staphylococcus aureus subsp. aureus N315
uaaaaggcgaaacau

SEQ ID NO: 2153759 - RNA, 17 nt, Staphylococcus aureus subsp. aureus N315
uaaaaggcgaaacauua

SEQ ID NO: 2153760 - RNA, 22 nt, Staphylococcus aureus subsp. aureus N315
uaaaaguaacauacuauaaaaa

SEQ ID NO: 2153761 - RNA, 12 nt, Staphylococcus aureus subsp. aureus N315
uaaaauaaacca

SEQ ID NO: 2153762 - RNA, 14 nt, Staphylococcus aureus subsp. aureus N315
uaaaauaaaccacg

SEQ ID NO: 2153763 - RNA, 15 nt, Staphylococcus aureus subsp. aureus N315
uaaaauaaaaugcaa

SEQ ID NO: 2153764 - RNA, 13 nt, Staphylococcus aureus subsp. aureus N315
uaaaauaaaauua

SEQ ID NO: 2153765 - RNA, 14 nt, Staphylococcus aureus subsp. aureus N315
uaaaauaaaauuaa

SEQ ID NO: 2153766 - RNA, 12 nt, Staphylococcus aureus subsp. aureus N315
uaaaauaaaaug

SEQ ID NO: 2153767 - RNA, 20 nt, Staphylococcus aureus subsp. aureus N315
uaaaaguuguaauuuaaaau

SEQ ID NO: 2153768 - RNA, 20 nt, Staphylococcus aureus subsp. aureus N315
uaaaauaaaaaaugcacuga

SEQ ID NO: 2153769 - RNA, 19 nt, Staphylococcus aureus subsp. aureus N315
uaaaaguuguaauuuaaaa

SEQ ID NO: 2153770 - RNA, 16 nt, Staphylococcus aureus subsp. aureus N315
uaaaaguauagauaga

SEQ ID NO: 2153771 - RNA, 17 nt, Staphylococcus aureus subsp. aureus N315
uaaaaguacuuuaaaau

SEQ ID NO: 2153772 - RNA, 17 nt, Staphylococcus aureus subsp. aureus N315
uaaaagucgauaaauau

SEQ ID NO: 2153773 - RNA, 20 nt, Staphylococcus aureus subsp. aureus N315
uaaaauacccauuuuuuucc

SEQ ID NO: 2153774 - RNA, 17 nt, Staphylococcus aureus subsp. aureus N315
uaaaauagaaaaauuuc

SEQ ID NO: 2153775 - RNA, 13 nt, Staphylococcus aureus subsp. aureus N315
uaaaauagaaaaa

SEQ ID NO: 2153776 - RNA, 21 nt, Staphylococcus aureus subsp. aureus N315
uaaaauagaguagacguaagu

SEQ ID NO: 2153777 - RNA, 22 nt, Staphylococcus aureus subsp. aureus N315
uaaaauaguucuuuaaauuaua

SEQ ID NO: 2153778 - RNA, 14 nt, Staphylococcus aureus subsp. aureus N315
uaaaauauaugaau

SEQ ID NO: 2153779 - RNA, 19 nt, Staphylococcus aureus subsp. aureus N315
uaaaauauaugaauaaguc

SEQ ID NO: 2153780 - RNA, 21 nt, Staphylococcus aureus subsp. aureus N315
uaaaauaguucuuuaaauuau

SEQ ID NO: 2153781 - RNA, 20 nt, Staphylococcus aureus subsp. aureus N315
uaaaauaguucuuuaaauua

SEQ ID NO: 2153782 - RNA, 23 nt, Staphylococcus aureus subsp. aureus N315
uaaaauaaaccacgcacaucuaa

SEQ ID NO: 2153783 - RNA, 19 nt, Staphylococcus aureus subsp. aureus N315
uaaaauaaaguuugggcau

SEQ ID NO: 2153784 - RNA, 18 nt, Staphylococcus aureus subsp. aureus N315
uaaaauaagauauauaau

SEQ ID NO: 2153785 - RNA, 19 nt, Staphylococcus aureus subsp. aureus N315
uaaaauaacuaagugaauu

SEQ ID NO: 2153786 - RNA, 23 nt, Staphylococcus aureus subsp. aureus N315
uaaaauaacugcuaauuuuuuca

SEQ ID NO: 2153787 - RNA, 18 nt, Staphylococcus aureus subsp. aureus N315
uaaaauaauagauaauag

SEQ ID NO: 2153788 - RNA, 16 nt, Staphylococcus aureus subsp. aureus N315
uaaaauaauagauaau

SEQ ID NO: 2153789 - RNA, 20 nt, Staphylococcus aureus subsp. aureus N315
uaaaauaauuaaauaaaaau

SEQ ID NO: 2153790 - RNA, 16 nt, Staphylococcus aureus subsp. aureus N315
uaaaauaauuaaauaa

SEQ ID NO: 2153791 - RNA, 17 nt, Staphylococcus aureus subsp. aureus N315
uaaaacgauaauaauaa

SEQ ID NO: 2153792 - RNA, 19 nt, Staphylococcus aureus subsp. aureus N315
uaaaacgaaguuauuuauu

SEQ ID NO: 2153793 - RNA, 22 nt, Staphylococcus aureus subsp. aureus N315
uaaaacgacucauuauaaauga

SEQ ID NO: 2153794 - RNA, 23 nt, Staphylococcus aureus subsp. aureus N315
uaaaaccuuacccaaaaaauugu

SEQ ID NO: 2153795 - RNA, 22 nt, Staphylococcus aureus subsp. aureus N315
uaaaaccuuuucaaauuauaac

SEQ ID NO: 2153796 - RNA, 17 nt, Staphylococcus aureus subsp. aureus N315
uaaaaccuuuucaaauu

SEQ ID NO: 2153797 - RNA, 15 nt, Staphylococcus aureus subsp. aureus N315
uaaaacuaaugauag

SEQ ID NO: 2153798 - RNA, 23 nt, Staphylococcus aureus subsp. aureus N315
uaaaacuacugauuuauugauaa

SEQ ID NO: 2153799 - RNA, 16 nt, Staphylococcus aureus subsp. aureus N315
uaaaacuuauaacuga

SEQ ID NO: 2153800 - RNA, 16 nt, Staphylococcus aureus subsp. aureus N315
uaaaacuauaauaaag

SEQ ID NO: 2153801 - RNA, 19 nt, Staphylococcus aureus subsp. aureus N315
uaaaagacagaaauuacua

SEQ ID NO: 2153802 - RNA, 15 nt, Staphylococcus aureus subsp. aureus N315
uaaaagaauuauuca

SEQ ID NO: 2153803 - RNA, 13 nt, Staphylococcus aureus subsp. aureus N315
uaaaacuuuuuca

SEQ ID NO: 2153804 - RNA, 19 nt, Staphylococcus aureus subsp. aureus N315
uaaaacuuguaaauuuauu

SEQ ID NO: 2153805 - RNA, 14 nt, Staphylococcus aureus subsp. aureus N315
uaaaagauuagaug

SEQ ID NO: 2153806 - RNA, 18 nt, Staphylococcus aureus subsp. aureus N315
uaaaagccaacacauaaa

SEQ ID NO: 2153807 - RNA, 19 nt, Staphylococcus aureus subsp. aureus N315
uaaaagccaucuuaccuuu

SEQ ID NO: 2153808 - RNA, 19 nt, Staphylococcus aureus subsp. aureus N315
uaaaagcaugauacucaau

SEQ ID NO: 2153809 - RNA, 13 nt, Staphylococcus aureus subsp. aureus N315
uaaaagccucuaa

SEQ ID NO: 2153810 - RNA, 14 nt, Staphylococcus aureus subsp. aureus N315
uaaaacauguugau

SEQ ID NO: 2153811 - RNA, 21 nt, Staphylococcus aureus subsp. aureus N315
uaaaaccaaaagaaauuuaau

SEQ ID NO: 2153812 - RNA, 20 nt, Staphylococcus aureus subsp. aureus N315
uaaaacaaauucauauuaac

SEQ ID NO: 2153813 - RNA, 21 nt, Staphylococcus aureus subsp. aureus N315
uaaaacaaauucauauuaacu

SEQ ID NO: 2153814 - RNA, 14 nt, Staphylococcus aureus subsp. aureus N315
uaaaacaaauuauu

SEQ ID NO: 2153815 - RNA, 15 nt, Staphylococcus aureus subsp. aureus N315
uaaaacaaauuauua

SEQ ID NO: 2153816 - RNA, 15 nt, Staphylococcus aureus subsp. aureus N315
uaaaacaaugauuaa

SEQ ID NO: 2153817 - RNA, 21 nt, Staphylococcus aureus subsp. aureus N315
uaaaacagaauuucaucaaau

SEQ ID NO: 2153818 - RNA, 20 nt, Staphylococcus aureus subsp. aureus N315
uaaaacagaauuucaucaaa

SEQ ID NO: 2153819 - RNA, 22 nt, Staphylococcus aureus subsp. aureus N315
uaaaaauugcaaugcuaucaug

SEQ ID NO: 2153820 - RNA, 19 nt, Staphylococcus aureus subsp. aureus N315
uaaaaauugauauugcaaa

SEQ ID NO: 2153821 - RNA, 14 nt, Staphylococcus aureus subsp. aureus N315
uaaaaauuucaaua

SEQ ID NO: 2153822 - RNA, 17 nt, Staphylococcus aureus subsp. aureus N315
uaaaaauuaaguaauag

SEQ ID NO: 2153823 - RNA, 21 nt, Staphylococcus aureus subsp. aureus N315
uaaaaaucuuggugauagucu

SEQ ID NO: 2153824 - RNA, 20 nt, Staphylococcus aureus subsp. aureus N315
uaaaaaugcugguaaauguu

SEQ ID NO: 2153825 - RNA, 14 nt, Staphylococcus aureus subsp. aureus N315
uaaaaaucauaaau

SEQ ID NO: 2153826 - RNA, 15 nt, Staphylococcus aureus subsp. aureus N315
uaaaaauauugaaua

SEQ ID NO: 2153827 - RNA, 15 nt, Staphylococcus aureus subsp. aureus N315
uaaaaauccucacaa

SEQ ID NO: 2153828 - RNA, 19 nt, Staphylococcus aureus subsp. aureus N315
uaaaaauaggaauacauga

SEQ ID NO: 2153829 - RNA, 19 nt, Staphylococcus aureus subsp. aureus N315
uaaaaaucaaagaggcuuu

SEQ ID NO: 2153830 - RNA, 11 nt, Staphylococcus aureus subsp. aureus N315
uaaaaaucaaa

SEQ ID NO: 2153831 - RNA, 14 nt, Staphylococcus aureus subsp. aureus N315
uaaaaaucaaagag

SEQ ID NO: 2153832 - RNA, 18 nt, Staphylococcus aureus subsp. aureus N315
uaaaaaucaaagaggcac

SEQ ID NO: 2153833 - RNA, 16 nt, Staphylococcus aureus subsp. aureus N315
aaaucaguaauaucaa

SEQ ID NO: 2153834 - RNA, 18 nt, Staphylococcus aureus subsp. aureus N315
aaaucagucauucacaua

SEQ ID NO: 2153835 - RNA, 16 nt, Staphylococcus aureus subsp. aureus N315
aaaucauccauaaaaa

SEQ ID NO: 2153836 - RNA, 20 nt, Staphylococcus aureus subsp. aureus N315
aaaucaucguauuucauaua

SEQ ID NO: 2153837 - RNA, 19 nt, Staphylococcus aureus subsp. aureus N315
aaaucaugaaauaaaaaaa

SEQ ID NO: 2153838 - RNA, 23 nt, Staphylococcus aureus subsp. aureus N315
guuuuauggcgguuugaaaauga

SEQ ID NO: 2153839 - RNA, 16 nt, Staphylococcus aureus subsp. aureus N315
guuuuauguauuuauu

SEQ ID NO: 2153840 - RNA, 12 nt, Staphylococcus aureus subsp. aureus N315
guuuuauucaau

SEQ ID NO: 2153841 - RNA, 19 nt, Staphylococcus aureus subsp. aureus N315
guuuuauucgauaauauaa

SEQ ID NO: 2153842 - RNA, 22 nt, Staphylococcus aureus subsp. aureus N315
guuuugguuguucuuuuuguug

SEQ ID NO: 2153843 - RNA, 13 nt, Staphylococcus aureus subsp. aureus N315
guuuuuaaaauua

SEQ ID NO: 2153844 - RNA, 20 nt, Staphylococcus aureus subsp. aureus N315
guuuuguagauauagcaucu

SEQ ID NO: 2153845 - RNA, 10 nt, Staphylococcus aureus subsp. aureus N315
guuuucuagu

SEQ ID NO: 2153846 - RNA, 22 nt, Staphylococcus aureus subsp. aureus N315
guuuggaugaacaaaauaacau

SEQ ID NO: 2153847 - RNA, 23 nt, Staphylococcus aureus subsp. aureus N315
guuugacaaagcuaaagugaagu

SEQ ID NO: 2153848 - RNA, 15 nt, Staphylococcus aureus subsp. aureus N315
guuugaauggcaaau

SEQ ID NO: 2153849 - RNA, 17 nt, Staphylococcus aureus subsp. aureus N315
guuucuuuuauuuucau

SEQ ID NO: 2153850 - RNA, 13 nt, Staphylococcus aureus subsp. aureus N315
guuuuaauuucuu

SEQ ID NO: 2153851 - RNA, 17 nt, Staphylococcus aureus subsp. aureus N315
guuuuaaagguuaaaua

SEQ ID NO: 2153852 - RNA, 21 nt, Staphylococcus aureus subsp. aureus N315
guuuguaagacaacaaaucga

SEQ ID NO: 2153853 - RNA, 22 nt, Staphylococcus aureus subsp. aureus N315
guuuggucaccuacagauaaag

SEQ ID NO: 2153854 - RNA, 12 nt, Staphylococcus aureus subsp. aureus N315
guuuuuacuaua

SEQ ID NO: 2153855 - RNA, 14 nt, Staphylococcus aureus subsp. aureus N315
guuuuucuuuaaac

SEQ ID NO: 2153856 - RNA, 21 nt, Staphylococcus aureus subsp. aureus N315
guuuuuucauuguaauaauaa

SEQ ID NO: 2153857 - RNA, 18 nt, Staphylococcus aureus subsp. aureus N315
guuuuuguggaaaauuga

SEQ ID NO: 2153858 - RNA, 16 nt, Staphylococcus aureus subsp. aureus N315
uaaaaaaggaagaaca

SEQ ID NO: 2153859 - RNA, 17 nt, Staphylococcus aureus subsp. aureus N315
uaaaaaaccaauaaucc

SEQ ID NO: 2153860 - RNA, 13 nt, Staphylococcus aureus subsp. aureus N315
uaaaaaacaauag

SEQ ID NO: 2153861 - RNA, 20 nt, Staphylococcus aureus subsp. aureus N315
uaaaaaaccugaaacaaauu

SEQ ID NO: 2153862 - RNA, 21 nt, Staphylococcus aureus subsp. aureus N315
uaaaaaaaucacgcuaacauu

SEQ ID NO: 2153863 - RNA, 12 nt, Staphylococcus aureus subsp. aureus N315
uaaaaaaauaau

SEQ ID NO: 2153864 - RNA, 15 nt, Staphylococcus aureus subsp. aureus N315
uaaaaacguucaauc

SEQ ID NO: 2153865 - RNA, 15 nt, Staphylococcus aureus subsp. aureus N315
uaaaaacucuaaaag

SEQ ID NO: 2153866 - RNA, 15 nt, Staphylococcus aureus subsp. aureus N315
uaaaaacaaaagaaa

SEQ ID NO: 2153867 - RNA, 20 nt, Staphylococcus aureus subsp. aureus N315
uaaaaaauuuaaauaauaau

SEQ ID NO: 2153868 - RNA, 12 nt, Staphylococcus aureus subsp. aureus N315
uaaaaaauuauu

SEQ ID NO: 2153869 - RNA, 13 nt, Staphylococcus aureus subsp. aureus N315
uaaaaaauuauua

SEQ ID NO: 2153870 - RNA, 13 nt, Staphylococcus aureus subsp. aureus N315
uaaaaaauuaaaa

SEQ ID NO: 2153871 - RNA, 13 nt, Staphylococcus aureus subsp. aureus N315
uaaaaaaugaaug

SEQ ID NO: 2153872 - RNA, 19 nt, Staphylococcus aureus subsp. aureus N315
uaaaaaaguugauuaaaag

SEQ ID NO: 2153873 - RNA, 19 nt, Staphylococcus aureus subsp. aureus N315
uaaaaaguuuaaaguauaa

SEQ ID NO: 2153874 - RNA, 20 nt, Staphylococcus aureus subsp. aureus N315
uaaaaagugaagauauuuau

SEQ ID NO: 2153875 - RNA, 21 nt, Staphylococcus aureus subsp. aureus N315
uaaaaauacauuuugcucuaa

SEQ ID NO: 2153876 - RNA, 15 nt, Staphylococcus aureus subsp. aureus N315
uaaaaagcagcagua

SEQ ID NO: 2153877 - RNA, 19 nt, Staphylococcus aureus subsp. aureus N315
uaaaaagagguuuucauua

SEQ ID NO: 2153878 - RNA, 20 nt, Staphylococcus aureus subsp. aureus N315
uaaaaacugugauucauucg

SEQ ID NO: 2153879 - RNA, 18 nt, Staphylococcus aureus subsp. aureus N315
uaaaaagagguuuucauu

SEQ ID NO: 2153880 - RNA, 22 nt, Staphylococcus aureus subsp. aureus N315
uaaaaagaauaugauauugauu

SEQ ID NO: 2153881 - RNA, 15 nt, Staphylococcus aureus subsp. aureus N315
guuggggcccacacc

SEQ ID NO: 2153882 - RNA, 12 nt, Staphylococcus aureus subsp. aureus N315
guuggggcccac

SEQ ID NO: 2153883 - RNA, 17 nt, Staphylococcus aureus subsp. aureus N315
guuggggcccacacccc

SEQ ID NO: 2153884 - RNA, 22 nt, Staphylococcus aureus subsp. aureus N315
guugccauuaguucuguugaua

SEQ ID NO: 2153885 - RNA, 23 nt, Staphylococcus aureus subsp. aureus N315
guuuauaaucuuuuuuacuaaaa

SEQ ID NO: 2153886 - RNA, 20 nt, Staphylococcus aureus subsp. aureus N315
guuuauaaaaaaucaguuuu

SEQ ID NO: 2153887 - RNA, 15 nt, Staphylococcus aureus subsp. aureus N315
guuuaauuuuaaaua

SEQ ID NO: 2153888 - RNA, 14 nt, Staphylococcus aureus subsp. aureus N315
guuuagauagcucu

SEQ ID NO: 2153889 - RNA, 22 nt, Staphylococcus aureus subsp. aureus N315
guuguuauuuuugcuauuucaa

SEQ ID NO: 2153890 - RNA, 20 nt, Staphylococcus aureus subsp. aureus N315
guuguugcaacuugugguug

SEQ ID NO: 2153891 - RNA, 13 nt, Staphylococcus aureus subsp. aureus N315
guuguugaaauuu

SEQ ID NO: 2153892 - RNA, 19 nt, Staphylococcus aureus subsp. aureus N315
guuguucccauuuuuaaaa

SEQ ID NO: 2153893 - RNA, 17 nt, Staphylococcus aureus subsp. aureus N315
guuguucccauuuuuaa

SEQ ID NO: 2153894 - RNA, 14 nt, Staphylococcus aureus subsp. aureus N315
guuuaaaaaacuac

SEQ ID NO: 2153895 - RNA, 14 nt, Staphylococcus aureus subsp. aureus N315
guuuaaaaauaugu

SEQ ID NO: 2153896 - RNA, 14 nt, Staphylococcus aureus subsp. aureus N315
guuuaaaaaugcug

SEQ ID NO: 2153897 - RNA, 23 nt, Staphylococcus aureus subsp. aureus N315
guuuaauuaaaauacaaauuaca

SEQ ID NO: 2153898 - RNA, 13 nt, Staphylococcus aureus subsp. aureus N315
guuuaaauauuca

SEQ ID NO: 2153899 - RNA, 22 nt, Staphylococcus aureus subsp. aureus N315
guugaauaauuaauguuucuuc

SEQ ID NO: 2153900 - RNA, 15 nt, Staphylococcus aureus subsp. aureus N315
guugaagcuaauuca

SEQ ID NO: 2153901 - RNA, 18 nt, Staphylococcus aureus subsp. aureus N315
guugcauaaucaauuuca

SEQ ID NO: 2153902 - RNA, 14 nt, Staphylococcus aureus subsp. aureus N315
guucuuauaaaaaa

SEQ ID NO: 2153903 - RNA, 17 nt, Staphylococcus aureus subsp. aureus N315
guucuugguauuuuuua

SEQ ID NO: 2153904 - RNA, 17 nt, Staphylococcus aureus subsp. aureus N315
guugaaaaccucuuuuu

SEQ ID NO: 2153905 - RNA, 22 nt, Staphylococcus aureus subsp. aureus N315
guucugcuaaucuucucauaaa

SEQ ID NO: 2153906 - RNA, 14 nt, Staphylococcus aureus subsp. aureus N315
guucugcuuuuucu

SEQ ID NO: 2153907 - RNA, 16 nt, Staphylococcus aureus subsp. aureus N315
guucacuugguacacc

SEQ ID NO: 2153908 - RNA, 17 nt, Staphylococcus aureus subsp. aureus N315
guucacaugaauuuuaa

SEQ ID NO: 2153909 - RNA, 18 nt, Staphylococcus aureus subsp. aureus N315
guucacaacaaaguguaa

SEQ ID NO: 2153910 - RNA, 19 nt, Staphylococcus aureus subsp. aureus N315
guucaaucacuauauuuca

SEQ ID NO: 2153911 - RNA, 23 nt, Staphylococcus aureus subsp. aureus N315
guucaauauuuaucaauaaauca

SEQ ID NO: 2153912 - RNA, 18 nt, Staphylococcus aureus subsp. aureus N315
guucaacuaaauuuucua

SEQ ID NO: 2153913 - RNA, 18 nt, Staphylococcus aureus subsp. aureus N315
guucaucaaacaacauca

SEQ ID NO: 2153914 - RNA, 14 nt, Staphylococcus aureus subsp. aureus N315
guucaguaggaauu

SEQ ID NO: 2153915 - RNA, 22 nt, Staphylococcus aureus subsp. aureus N315
guucauaaugaucaaguaguua

SEQ ID NO: 2153916 - RNA, 15 nt, Staphylococcus aureus subsp. aureus N315
guucagguucaaaau

SEQ ID NO: 2153917 - RNA, 18 nt, Staphylococcus aureus subsp. aureus N315
guucagauuuguauuuug

SEQ ID NO: 2153918 - RNA, 16 nt, Staphylococcus aureus subsp. aureus N315
guucaucaaacaacau

SEQ ID NO: 2153919 - RNA, 15 nt, Staphylococcus aureus subsp. aureus N315
guuccguugaauuaa

SEQ ID NO: 2153920 - RNA, 19 nt, Staphylococcus aureus subsp. aureus N315
guucgauuguaauaaccau

SEQ ID NO: 2153921 - RNA, 17 nt, Staphylococcus aureus subsp. aureus N315
guguuggggcccacacc

SEQ ID NO: 2153922 - RNA, 14 nt, Staphylococcus aureus subsp. aureus N315
guguccuaauaagu

SEQ ID NO: 2153923 - RNA, 22 nt, Staphylococcus aureus subsp. aureus N315
guuaaagucuguugguuuauca

SEQ ID NO: 2153924 - RNA, 23 nt, Staphylococcus aureus subsp. aureus N315
guuaaagaugucgaaaaguauau

SEQ ID NO: 2153925 - RNA, 21 nt, Staphylococcus aureus subsp. aureus N315
guuaaaucuuuaacuucugau

SEQ ID NO: 2153926 - RNA, 14 nt, Staphylococcus aureus subsp. aureus N315
guuaaauucuaaaa

SEQ ID NO: 2153927 - RNA, 21 nt, Staphylococcus aureus subsp. aureus N315
guuaaauauggaugauauuca

SEQ ID NO: 2153928 - RNA, 13 nt, Staphylococcus aureus subsp. aureus N315
guuaaaucaccaa

SEQ ID NO: 2153929 - RNA, 19 nt, Staphylococcus aureus subsp. aureus N315
guguuucuuuuauuuucau

SEQ ID NO: 2153930 - RNA, 14 nt, Staphylococcus aureus subsp. aureus N315
guuaaucaaaauua

SEQ ID NO: 2153931 - RNA, 13 nt, Staphylococcus aureus subsp. aureus N315
guuaauauaauua

SEQ ID NO: 2153932 - RNA, 19 nt, Staphylococcus aureus subsp. aureus N315
guuaauaacccauuuucaa

SEQ ID NO: 2153933 - RNA, 20 nt, Staphylococcus aureus subsp. aureus N315
guuaauaacccauuuucaaa

SEQ ID NO: 2153934 - RNA, 13 nt, Staphylococcus aureus subsp. aureus N315
guuaaauucaucu

SEQ ID NO: 2153935 - RNA, 17 nt, Staphylococcus aureus subsp. aureus N315
guuaccaaguaaugaua

SEQ ID NO: 2153936 - RNA, 23 nt, Staphylococcus aureus subsp. aureus N315
guuauaaguacaaauaauacagg

SEQ ID NO: 2153937 - RNA, 23 nt, Staphylococcus aureus subsp. aureus N315
guuauaauggcgggcccccaaca

SEQ ID NO: 2153938 - RNA, 13 nt, Staphylococcus aureus subsp. aureus N315
guuauaaaaugaa

SEQ ID NO: 2153939 - RNA, 15 nt, Staphylococcus aureus subsp. aureus N315
guuauuauaaaauaa

SEQ ID NO: 2153940 - RNA, 17 nt, Staphylococcus aureus subsp. aureus N315
guuauuaucguaaaaaa

SEQ ID NO: 2153941 - RNA, 17 nt, Staphylococcus aureus subsp. aureus N315
guuauuaaaauuaaaua

SEQ ID NO: 2153942 - RNA, 15 nt, Staphylococcus aureus subsp. aureus N315
guucaaaauacucaa

SEQ ID NO: 2153943 - RNA, 23 nt, Staphylococcus aureus subsp. aureus N315
guuauuagauacuucuuuugcaa

SEQ ID NO: 2153944 - RNA, 14 nt, Staphylococcus aureus subsp. aureus N315
guuauguaugaaag

SEQ ID NO: 2153945 - RNA, 20 nt, Staphylococcus aureus subsp. aureus N315
guggcuuuuuuuauggugug

SEQ ID NO: 2153946 - RNA, 19 nt, Staphylococcus aureus subsp. aureus N315
guggcuuuuuuuauggugu

SEQ ID NO: 2153947 - RNA, 17 nt, Staphylococcus aureus subsp. aureus N315
guggacguugaucuuug

SEQ ID NO: 2153948 - RNA, 16 nt, Staphylococcus aureus subsp. aureus N315
guggucuauuuuauaa

SEQ ID NO: 2153949 - RNA, 12 nt, Staphylococcus aureus subsp. aureus N315
gugguacuuuuu

SEQ ID NO: 2153950 - RNA, 23 nt, Staphylococcus aureus subsp. aureus N315
gugguuuucuuuauuuuaaacau

SEQ ID NO: 2153951 - RNA, 20 nt, Staphylococcus aureus subsp. aureus N315
guguaaucucguuuuuacau

SEQ ID NO: 2153952 - RNA, 14 nt, Staphylococcus aureus subsp. aureus N315
guguauauuauuuu

SEQ ID NO: 2153953 - RNA, 20 nt, Staphylococcus aureus subsp. aureus N315
gugcuauuaauuugauaaau

SEQ ID NO: 2153954 - RNA, 22 nt, Staphylococcus aureus subsp. aureus N315
gugcucgaaucucauugauuug

SEQ ID NO: 2153955 - RNA, 13 nt, Staphylococcus aureus subsp. aureus N315
gugcuuacuuuua

SEQ ID NO: 2153956 - RNA, 12 nt, Staphylococcus aureus subsp. aureus N315
gugcuuuuucaa

SEQ ID NO: 2153957 - RNA, 23 nt, Staphylococcus aureus subsp. aureus N315
gugcuuucaccuuugaauauagu

SEQ ID NO: 2153958 - RNA, 15 nt, Staphylococcus aureus subsp. aureus N315
gugcgguuauuuaua

SEQ ID NO: 2153959 - RNA, 21 nt, Staphylococcus aureus subsp. aureus N315
gugcgugaagagaugaaagau

SEQ ID NO: 2153960 - RNA, 21 nt, Staphylococcus aureus subsp. aureus N315
gugcgcucaucuauaaauacu

SEQ ID NO: 2153961 - RNA, 21 nt, Staphylococcus aureus subsp. aureus N315
gugauauuaauugaaaaacca

SEQ ID NO: 2153962 - RNA, 12 nt, Staphylococcus aureus subsp. aureus N315
gugauaucuugc

SEQ ID NO: 2153963 - RNA, 21 nt, Staphylococcus aureus subsp. aureus N315
gugauagaaguuuuuugauua

SEQ ID NO: 2153964 - RNA, 14 nt, Staphylococcus aureus subsp. aureus N315
gucuauuuuauaaa

SEQ ID NO: 2153965 - RNA, 18 nt, Staphylococcus aureus subsp. aureus N315
gugaugcuugaauguuug

SEQ ID NO: 2153966 - RNA, 22 nt, Staphylococcus aureus subsp. aureus N315
gugauuuuggaacauauucaua

SEQ ID NO: 2153967 - RNA, 17 nt, Staphylococcus aureus subsp. aureus N315
gugauuuguuacuucua

SEQ ID NO: 2153968 - RNA, 19 nt, Staphylococcus aureus subsp. aureus N315
aaauauaaaaagugaagau

SEQ ID NO: 2153969 - RNA, 18 nt, Staphylococcus aureus subsp. aureus N315
aaauauaguaauaaaagu

SEQ ID NO: 2153970 - RNA, 17 nt, Staphylococcus aureus subsp. aureus N315
aaauauaguaauuguua

SEQ ID NO: 2153971 - RNA, 12 nt, Staphylococcus aureus subsp. aureus N315
gugcaugacgau

SEQ ID NO: 2153972 - RNA, 13 nt, Staphylococcus aureus subsp. aureus N315
gugcauuuagaug

SEQ ID NO: 2153973 - RNA, 13 nt, Staphylococcus aureus subsp. aureus N315
gugcauucaucaa

SEQ ID NO: 2153974 - RNA, 21 nt, Staphylococcus aureus subsp. aureus N315
aaauauacuugccuucaaauu

SEQ ID NO: 2153975 - RNA, 23 nt, Staphylococcus aureus subsp. aureus N315
aaauaguuuuucauauucacauc

SEQ ID NO: 2153976 - RNA, 15 nt, Staphylococcus aureus subsp. aureus N315
gugauuuuaaucuau

SEQ ID NO: 2153977 - RNA, 14 nt, Staphylococcus aureus subsp. aureus N315
gugccauuaaaauu

SEQ ID NO: 2153978 - RNA, 13 nt, Staphylococcus aureus subsp. aureus N315
gugccuuucucua

SEQ ID NO: 2153979 - RNA, 15 nt, Staphylococcus aureus subsp. aureus N315
gugccuuucucuaaa

SEQ ID NO: 2153980 - RNA, 15 nt, Staphylococcus aureus subsp. aureus N315
gugccucauccuuuu

SEQ ID NO: 2153981 - RNA, 22 nt, Staphylococcus aureus subsp. aureus N315
gugccggcuuuuucuuuuguuu

SEQ ID NO: 2153982 - RNA, 20 nt, Staphylococcus aureus subsp. aureus N315
gucauaguauacauaauuca

SEQ ID NO: 2153983 - RNA, 12 nt, Staphylococcus aureus subsp. aureus N315
gucauauaaaca

SEQ ID NO: 2153984 - RNA, 23 nt, Staphylococcus aureus subsp. aureus N315
gucauacgcaaugauuauaaaua

SEQ ID NO: 2153985 - RNA, 13 nt, Staphylococcus aureus subsp. aureus N315
gucauaaaauacc

SEQ ID NO: 2153986 - RNA, 23 nt, Staphylococcus aureus subsp. aureus N315
gucaugaauuuucaucauuaaac

SEQ ID NO: 2153987 - RNA, 20 nt, Staphylococcus aureus subsp. aureus N315
gucauauacuauaugucuua

SEQ ID NO: 2153988 - RNA, 12 nt, Staphylococcus aureus subsp. aureus N315
gucaugccuuca

SEQ ID NO: 2153989 - RNA, 18 nt, Staphylococcus aureus subsp. aureus N315
guccauaaucuuuauuaa

SEQ ID NO: 2153990 - RNA, 17 nt, Staphylococcus aureus subsp. aureus N315
guccauuuccaugaaua

SEQ ID NO: 2153991 - RNA, 20 nt, Staphylococcus aureus subsp. aureus N315
guccgacuuaauauugaaua

SEQ ID NO: 2153992 - RNA, 14 nt, Staphylococcus aureus subsp. aureus N315
gucaguaaaaauac

SEQ ID NO: 2153993 - RNA, 12 nt, Staphylococcus aureus subsp. aureus N315
gucagauucaaa

SEQ ID NO: 2153994 - RNA, 14 nt, Staphylococcus aureus subsp. aureus N315
gucacuuuauuaaa

SEQ ID NO: 2153995 - RNA, 13 nt, Staphylococcus aureus subsp. aureus N315
gucaccuuuaaau

SEQ ID NO: 2153996 - RNA, 20 nt, Staphylococcus aureus subsp. aureus N315
gucaccuucuauauugggac

SEQ ID NO: 2153997 - RNA, 20 nt, Staphylococcus aureus subsp. aureus N315
gucaauuuuuucaugauuua

SEQ ID NO: 2153998 - RNA, 22 nt, Staphylococcus aureus subsp. aureus N315
gucaauuuuaccauguuuuaca

SEQ ID NO: 2153999 - RNA, 17 nt, Staphylococcus aureus subsp. aureus N315
gucaauaauuuuaucua

SEQ ID NO: 2154000 - RNA, 21 nt, Staphylococcus aureus subsp. aureus N315
gucguuuaccgucuuuugcaa

SEQ ID NO: 2154001 - RNA, 17 nt, Staphylococcus aureus subsp. aureus N315
gucuaaagcuuauuaaa

SEQ ID NO: 2154002 - RNA, 23 nt, Staphylococcus aureus subsp. aureus N315
gucuacuauuuuuucuaauucaa

SEQ ID NO: 2154003 - RNA, 14 nt, Staphylococcus aureus subsp. aureus N315
gucuacgaucaaaa

SEQ ID NO: 2154004 - RNA, 19 nt, Staphylococcus aureus subsp. aureus N315
gucuaauguuggaaaaggu

SEQ ID NO: 2154005 - RNA, 16 nt, Staphylococcus aureus subsp. aureus N315
gucuaauguuggaaaa

SEQ ID NO: 2154006 - RNA, 14 nt, Staphylococcus aureus subsp. aureus N315
guccucuaaaacau

SEQ ID NO: 2154007 - RNA, 15 nt, Staphylococcus aureus subsp. aureus N315
guccuguacauccac

SEQ ID NO: 2154008 - RNA, 22 nt, Staphylococcus aureus subsp. aureus N315
guccuguacauccacuuuauaa

SEQ ID NO: 2154009 - RNA, 17 nt, Staphylococcus aureus subsp. aureus N315
gucgaauauaauuuuuu

SEQ ID NO: 2154010 - RNA, 19 nt, Staphylococcus aureus subsp. aureus N315
gucgaagaagauuaugaaa

SEQ ID NO: 2154011 - RNA, 15 nt, Staphylococcus aureus subsp. aureus N315
guauuuuuauuuaua

SEQ ID NO: 2154012 - RNA, 23 nt, Staphylococcus aureus subsp. aureus N315
guauuuuuugugccuuucucuaa

SEQ ID NO: 2154013 - RNA, 22 nt, Staphylococcus aureus subsp. aureus N315
guauuucugaaaugauacauua

SEQ ID NO: 2154014 - RNA, 17 nt, Staphylococcus aureus subsp. aureus N315
guauuuuaaugauuuuu

SEQ ID NO: 2154015 - RNA, 13 nt, Staphylococcus aureus subsp. aureus N315
guauuuuaaauuu

SEQ ID NO: 2154016 - RNA, 16 nt, Staphylococcus aureus subsp. aureus N315
guauuuaccuucuucu

SEQ ID NO: 2154017 - RNA, 15 nt, Staphylococcus aureus subsp. aureus N315
guauuuaguaucaug

SEQ ID NO: 2154018 - RNA, 21 nt, Staphylococcus aureus subsp. aureus N315
guauugcauguuuaaauauca

SEQ ID NO: 2154019 - RNA, 20 nt, Staphylococcus aureus subsp. aureus N315
guauuauuauaauuuuguuu

SEQ ID NO: 2154020 - RNA, 22 nt, Staphylococcus aureus subsp. aureus N315
guauuaugauugcuuauuuauu

SEQ ID NO: 2154021 - RNA, 20 nt, Staphylococcus aureus subsp. aureus N315
guauucaaaguuuucauuua

SEQ ID NO: 2154022 - RNA, 19 nt, Staphylococcus aureus subsp. aureus N315
guauuauucucucauuugu

SEQ ID NO: 2154023 - RNA, 23 nt, Staphylococcus aureus subsp. aureus N315
guauucagucaguaaaaauacau

SEQ ID NO: 2154024 - RNA, 21 nt, Staphylococcus aureus subsp. aureus N315
guauucagucaguaaaaauac

SEQ ID NO: 2154025 - RNA, 18 nt, Staphylococcus aureus subsp. aureus N315
guauugaaugaauucauu

SEQ ID NO: 2154026 - RNA, 12 nt, Staphylococcus aureus subsp. aureus N315
guauugauucaa

SEQ ID NO: 2154027 - RNA, 19 nt, Staphylococcus aureus subsp. aureus N315
guauucuuggcguauuuuu

SEQ ID NO: 2154028 - RNA, 23 nt, Staphylococcus aureus subsp. aureus N315
guauucuuggcguauuuuuuguu

SEQ ID NO: 2154029 - RNA, 15 nt, Staphylococcus aureus subsp. aureus N315
guauucuauuuuuca

SEQ ID NO: 2154030 - RNA, 19 nt, Staphylococcus aureus subsp. aureus N315
guauucuauuuuucaauuc

SEQ ID NO: 2154031 - RNA, 15 nt, Staphylococcus aureus subsp. aureus N315
guauuaaacauugcu

SEQ ID NO: 2154032 - RNA, 19 nt, Staphylococcus aureus subsp. aureus N315
guauuagccaauaaaaugu

SEQ ID NO: 2154033 - RNA, 21 nt, Staphylococcus aureus subsp. aureus N315
guaugauagaauacuaaaagu

SEQ ID NO: 2154034 - RNA, 22 nt, Staphylococcus aureus subsp. aureus N315
guaugcuuguacaaaaaauugu

SEQ ID NO: 2154035 - RNA, 13 nt, Staphylococcus aureus subsp. aureus N315
guauggaauaaau

SEQ ID NO: 2154036 - RNA, 18 nt, Staphylococcus aureus subsp. aureus N315
guauggaauaaaugguuu

SEQ ID NO: 2154037 - RNA, 14 nt, Staphylococcus aureus subsp. aureus N315
guaugcguggucua

SEQ ID NO: 2154038 - RNA, 14 nt, Staphylococcus aureus subsp. aureus N315
guaugcgguuauau

SEQ ID NO: 2154039 - RNA, 17 nt, Staphylococcus aureus subsp. aureus N315
guauggacuaagauaua

SEQ ID NO: 2154040 - RNA, 20 nt, Staphylococcus aureus subsp. aureus N315
guaucauuguguccauaaau

SEQ ID NO: 2154041 - RNA, 19 nt, Staphylococcus aureus subsp. aureus N315
guaucaacauuaauaaaua

SEQ ID NO: 2154042 - RNA, 14 nt, Staphylococcus aureus subsp. aureus N315
guauauugaaauua

SEQ ID NO: 2154043 - RNA, 17 nt, Staphylococcus aureus subsp. aureus N315
guaucgccaaucuauug

SEQ ID NO: 2154044 - RNA, 23 nt, Staphylococcus aureus subsp. aureus N315
guaucuaguguucucauuauaau

SEQ ID NO: 2154045 - RNA, 14 nt, Staphylococcus aureus subsp. aureus N315
guaugagucaaauu

SEQ ID NO: 2154046 - RNA, 16 nt, Staphylococcus aureus subsp. aureus N315
guaugagugauagaaa

SEQ ID NO: 2154047 - RNA, 16 nt, Staphylococcus aureus subsp. aureus N315
guaucuugucauuuga

SEQ ID NO: 2154048 - RNA, 19 nt, Staphylococcus aureus subsp. aureus N315
guaucuaugaaauuuuuua

SEQ ID NO: 2154049 - RNA, 19 nt, Staphylococcus aureus subsp. aureus N315
guaucuauacaauuaugga

SEQ ID NO: 2154050 - RNA, 16 nt, Staphylococcus aureus subsp. aureus N315
guaucuauacaauuau

SEQ ID NO: 2154051 - RNA, 21 nt, Staphylococcus aureus subsp. aureus N315
guaucucugaaaaacuucuua

SEQ ID NO: 2154052 - RNA, 20 nt, Staphylococcus aureus subsp. aureus N315
guaucucugaaaaacuucuu

SEQ ID NO: 2154053 - RNA, 22 nt, Staphylococcus aureus subsp. aureus N315
guauagauuguauuuaauaagu

SEQ ID NO: 2154054 - RNA, 13 nt, Staphylococcus aureus subsp. aureus N315
guauauguauaga

SEQ ID NO: 2154055 - RNA, 22 nt, Staphylococcus aureus subsp. aureus N315
guauaugaauuuuauaaauuaa

SEQ ID NO: 2154056 - RNA, 19 nt, Staphylococcus aureus subsp. aureus N315
guauauuaaaaauuucaau

SEQ ID NO: 2154057 - RNA, 13 nt, Staphylococcus aureus subsp. aureus N315
guaucaaaauuuu

SEQ ID NO: 2154058 - RNA, 16 nt, Staphylococcus aureus subsp. aureus N315
guauauacaaugacag

SEQ ID NO: 2154059 - RNA, 20 nt, Staphylococcus aureus subsp. aureus N315
guauauauauauuaaaacaa

SEQ ID NO: 2154060 - RNA, 19 nt, Staphylococcus aureus subsp. aureus N315
guauaugaauuuuauaaau

SEQ ID NO: 2154061 - RNA, 23 nt, Staphylococcus aureus subsp. aureus N315
guauaucauccacaaucacagua

SEQ ID NO: 2154062 - RNA, 15 nt, Staphylococcus aureus subsp. aureus N315
guauaguaaccuuua

SEQ ID NO: 2154063 - RNA, 14 nt, Staphylococcus aureus subsp. aureus N315
guaguuuauaucaa

SEQ ID NO: 2154064 - RNA, 23 nt, Staphylococcus aureus subsp. aureus N315
guaguuggcugauagaugaaaau

SEQ ID NO: 2154065 - RNA, 18 nt, Staphylococcus aureus subsp. aureus N315
guaguucggaugagaaau

SEQ ID NO: 2154066 - RNA, 22 nt, Staphylococcus aureus subsp. aureus N315
guauaaagggcuauuugauaca

SEQ ID NO: 2154067 - RNA, 12 nt, Staphylococcus aureus subsp. aureus N315
guauaaauaaaa

SEQ ID NO: 2154068 - RNA, 14 nt, Staphylococcus aureus subsp. aureus N315
guauaaaacagaau

SEQ ID NO: 2154069 - RNA, 22 nt, Staphylococcus aureus subsp. aureus N315
guauaaauaucauaaaugcaua

SEQ ID NO: 2154070 - RNA, 17 nt, Staphylococcus aureus subsp. aureus N315
guauaaaugcagcugua

SEQ ID NO: 2154071 - RNA, 14 nt, Staphylococcus aureus subsp. aureus N315
guauaaccauaaug

SEQ ID NO: 2154072 - RNA, 16 nt, Staphylococcus aureus subsp. aureus N315
guauacaacaugugua

SEQ ID NO: 2154073 - RNA, 14 nt, Staphylococcus aureus subsp. aureus N315
guauaauuaaacua

SEQ ID NO: 2154074 - RNA, 22 nt, Staphylococcus aureus subsp. aureus N315
guauaauggacgguauuuucaa

SEQ ID NO: 2154075 - RNA, 22 nt, Staphylococcus aureus subsp. aureus N315
guaggaugcuuccuuuuuguua

SEQ ID NO: 2154076 - RNA, 18 nt, Staphylococcus aureus subsp. aureus N315
guaggaggcuuuugcuuu

SEQ ID NO: 2154077 - RNA, 22 nt, Staphylococcus aureus subsp. aureus N315
guagcuuaacguugcagagaau

SEQ ID NO: 2154078 - RNA, 14 nt, Staphylococcus aureus subsp. aureus N315
guagcuugaauaau

SEQ ID NO: 2154079 - RNA, 18 nt, Staphylococcus aureus subsp. aureus N315
guagcuugaauaauauau

SEQ ID NO: 2154080 - RNA, 21 nt, Staphylococcus aureus subsp. aureus N315
guagucgaagaagauuaugaa

SEQ ID NO: 2154081 - RNA, 13 nt, Staphylococcus aureus subsp. aureus N315
guaguuaauauaa

SEQ ID NO: 2154082 - RNA, 17 nt, Staphylococcus aureus subsp. aureus N315
guagugguucuuauaca

SEQ ID NO: 2154083 - RNA, 20 nt, Staphylococcus aureus subsp. aureus N315
guagcaacauuauuuuuguc

SEQ ID NO: 2154084 - RNA, 22 nt, Staphylococcus aureus subsp. aureus N315
guagauugauauccuuaacaug

SEQ ID NO: 2154085 - RNA, 19 nt, Staphylococcus aureus subsp. aureus N315
guagauuuauuaaauauau

SEQ ID NO: 2154086 - RNA, 19 nt, Staphylococcus aureus subsp. aureus N315
guagauaaaucgauaaaau

SEQ ID NO: 2154087 - RNA, 16 nt, Staphylococcus aureus subsp. aureus N315
guagauauugaaugga

SEQ ID NO: 2154088 - RNA, 20 nt, Staphylococcus aureus subsp. aureus N315
guagaaucuacgauuuucaa

SEQ ID NO: 2154089 - RNA, 18 nt, Staphylococcus aureus subsp. aureus N315
guagaaacacaaggaaua

SEQ ID NO: 2154090 - RNA, 14 nt, Staphylococcus aureus subsp. aureus N315
guacuuacaaauau

SEQ ID NO: 2154091 - RNA, 21 nt, Staphylococcus aureus subsp. aureus N315
guacuuaccuuucaaauauau

SEQ ID NO: 2154092 - RNA, 16 nt, Staphylococcus aureus subsp. aureus N315
guacuuaaaaauagga

SEQ ID NO: 2154093 - RNA, 23 nt, Staphylococcus aureus subsp. aureus N315
guacuuugauaucuacagagaau

SEQ ID NO: 2154094 - RNA, 22 nt, Staphylococcus aureus subsp. aureus N315
guacuuuuauguuguuauaaag

SEQ ID NO: 2154095 - RNA, 15 nt, Staphylococcus aureus subsp. aureus N315
guacuuucaaauaau

SEQ ID NO: 2154096 - RNA, 20 nt, Staphylococcus aureus subsp. aureus N315
guacgguuauuuaauaaugc

SEQ ID NO: 2154097 - RNA, 21 nt, Staphylococcus aureus subsp. aureus N315
guacuaggaccuacaauuuuc

SEQ ID NO: 2154098 - RNA, 15 nt, Staphylococcus aureus subsp. aureus N315
guacguuuuaaauaa

SEQ ID NO: 2154099 - RNA, 17 nt, Staphylococcus aureus subsp. aureus N315
guacuaacguuuuaaag

SEQ ID NO: 2154100 - RNA, 15 nt, Staphylococcus aureus subsp. aureus N315
guacuaaucaauacu

SEQ ID NO: 2154101 - RNA, 20 nt, Staphylococcus aureus subsp. aureus N315
guacguuuuuuuaaauacau

SEQ ID NO: 2154102 - RNA, 21 nt, Staphylococcus aureus subsp. aureus N315
guacuguguuuagguauauaa

SEQ ID NO: 2154103 - RNA, 20 nt, Staphylococcus aureus subsp. aureus N315
guaaaaguuuugagccaagu

SEQ ID NO: 2154104 - RNA, 14 nt, Staphylococcus aureus subsp. aureus N315
guaaaauaaaucau

SEQ ID NO: 2154105 - RNA, 13 nt, Staphylococcus aureus subsp. aureus N315
guaaaacugcaau

SEQ ID NO: 2154106 - RNA, 21 nt, Staphylococcus aureus subsp. aureus N315
guaaaaugcucccuucaaagu

SEQ ID NO: 2154107 - RNA, 15 nt, Staphylococcus aureus subsp. aureus N315
guaaaauuaaaugcu

SEQ ID NO: 2154108 - RNA, 14 nt, Staphylococcus aureus subsp. aureus N315
guaaaauucuauaa

SEQ ID NO: 2154109 - RNA, 21 nt, Staphylococcus aureus subsp. aureus N315
guaaaauucuauaaauagaau

SEQ ID NO: 2154110 - RNA, 13 nt, Staphylococcus aureus subsp. aureus N315
guaaacuaauccu

SEQ ID NO: 2154111 - RNA, 22 nt, Staphylococcus aureus subsp. aureus N315
guaaagaguacagcgguuugua

SEQ ID NO: 2154112 - RNA, 21 nt, Staphylococcus aureus subsp. aureus N315
guaaaggugauauuugcuagu

SEQ ID NO: 2154113 - RNA, 14 nt, Staphylococcus aureus subsp. aureus N315
guaaauguuaaauu

SEQ ID NO: 2154114 - RNA, 22 nt, Staphylococcus aureus subsp. aureus N315
guaaauuaauagagaaagaaua

SEQ ID NO: 2154115 - RNA, 21 nt, Staphylococcus aureus subsp. aureus N315
guaaaucgugcuguuaucaug

SEQ ID NO: 2154116 - RNA, 18 nt, Staphylococcus aureus subsp. aureus N315
guaaaucacgauuuucaa

SEQ ID NO: 2154117 - RNA, 12 nt, Staphylococcus aureus subsp. aureus N315
guaaauauaaau

SEQ ID NO: 2154118 - RNA, 19 nt, Staphylococcus aureus subsp. aureus N315
guaaauaaaaauuauauaa

SEQ ID NO: 2154119 - RNA, 13 nt, Staphylococcus aureus subsp. aureus N315
guaaauaacuuau

SEQ ID NO: 2154120 - RNA, 17 nt, Staphylococcus aureus subsp. aureus N315
guaacacgcucuuuuca

SEQ ID NO: 2154121 - RNA, 18 nt, Staphylococcus aureus subsp. aureus N315
guaacacgcucuuuucaa

SEQ ID NO: 2154122 - RNA, 13 nt, Staphylococcus aureus subsp. aureus N315
guaacaauacgca

SEQ ID NO: 2154123 - RNA, 12 nt, Staphylococcus aureus subsp. aureus N315
guaaauuuaaau

SEQ ID NO: 2154124 - RNA, 19 nt, Staphylococcus aureus subsp. aureus N315
guaaauuuuaucuaaacau

SEQ ID NO: 2154125 - RNA, 19 nt, Staphylococcus aureus subsp. aureus N315
guaacauuuaaaaaaugcg

SEQ ID NO: 2154126 - RNA, 18 nt, Staphylococcus aureus subsp. aureus N315
guaacauuuaaaaaaugc

SEQ ID NO: 2154127 - RNA, 19 nt, Staphylococcus aureus subsp. aureus N315
guaacauuagcaugauaaa

SEQ ID NO: 2154128 - RNA, 13 nt, Staphylococcus aureus subsp. aureus N315
guaacauuuaaaa

SEQ ID NO: 2154129 - RNA, 15 nt, Staphylococcus aureus subsp. aureus N315
guaacagugacugau

SEQ ID NO: 2154130 - RNA, 23 nt, Staphylococcus aureus subsp. aureus N315
guaacauaaagcuguuuauuggu

SEQ ID NO: 2154131 - RNA, 16 nt, Staphylococcus aureus subsp. aureus N315
guaacauuaaaaauaa

SEQ ID NO: 2154132 - RNA, 21 nt, Staphylococcus aureus subsp. aureus N315
guaacauaucagcuuuuucau

SEQ ID NO: 2154133 - RNA, 15 nt, Staphylococcus aureus subsp. aureus N315
guaacauaucagcuu

SEQ ID NO: 2154134 - RNA, 22 nt, Staphylococcus aureus subsp. aureus N315
guaauagaacgaaauaguucaa

SEQ ID NO: 2154135 - RNA, 15 nt, Staphylococcus aureus subsp. aureus N315
guaauauauaaaagu

SEQ ID NO: 2154136 - RNA, 20 nt, Staphylococcus aureus subsp. aureus N315
guaauauuuuuguugcaauu

SEQ ID NO: 2154137 - RNA, 12 nt, Staphylococcus aureus subsp. aureus N315
guaauauuuuug

SEQ ID NO: 2154138 - RNA, 19 nt, Staphylococcus aureus subsp. aureus N315
guaauauguugcuuaucaa

SEQ ID NO: 2154139 - RNA, 14 nt, Staphylococcus aureus subsp. aureus N315
guaauaauuuacag

SEQ ID NO: 2154140 - RNA, 14 nt, Staphylococcus aureus subsp. aureus N315
guaauaauuauuaa

SEQ ID NO: 2154141 - RNA, 17 nt, Staphylococcus aureus subsp. aureus N315
guaauaauuauuaauaa

SEQ ID NO: 2154142 - RNA, 16 nt, Staphylococcus aureus subsp. aureus N315
guaauaauauaaauaa

SEQ ID NO: 2154143 - RNA, 19 nt, Staphylococcus aureus subsp. aureus N315
guaauaccuuuacuuucau

SEQ ID NO: 2154144 - RNA, 19 nt, Staphylococcus aureus subsp. aureus N315
guaauacaucaucaaguuc

SEQ ID NO: 2154145 - RNA, 20 nt, Staphylococcus aureus subsp. aureus N315
guaagcuucuguguuggggc

SEQ ID NO: 2154146 - RNA, 23 nt, Staphylococcus aureus subsp. aureus N315
guaaguaaaauaaaaaaugcacu

SEQ ID NO: 2154147 - RNA, 16 nt, Staphylococcus aureus subsp. aureus N315
guaaguagaagcaaaa

SEQ ID NO: 2154148 - RNA, 16 nt, Staphylococcus aureus subsp. aureus N315
guaaguuugguuucuu

SEQ ID NO: 2154149 - RNA, 15 nt, Staphylococcus aureus subsp. aureus N315
guaaguguaaaugaa

SEQ ID NO: 2154150 - RNA, 16 nt, Staphylococcus aureus subsp. aureus N315
guaagacgauuucaau

SEQ ID NO: 2154151 - RNA, 18 nt, Staphylococcus aureus subsp. aureus N315
guaagaccccgaaaagag

SEQ ID NO: 2154152 - RNA, 17 nt, Staphylococcus aureus subsp. aureus N315
guaagcagagccauaau

SEQ ID NO: 2154153 - RNA, 16 nt, Staphylococcus aureus subsp. aureus N315
guaagauaauuuucaa

SEQ ID NO: 2154154 - RNA, 20 nt, Staphylococcus aureus subsp. aureus N315
guaacuuuuuacauuuucaa

SEQ ID NO: 2154155 - RNA, 23 nt, Staphylococcus aureus subsp. aureus N315
guaacugauuuuguuucaaacgu

SEQ ID NO: 2154156 - RNA, 13 nt, Staphylococcus aureus subsp. aureus N315
guaacuaaaaugu

SEQ ID NO: 2154157 - RNA, 22 nt, Staphylococcus aureus subsp. aureus N315
guaacuauaugaaauguucccu

SEQ ID NO: 2154158 - RNA, 14 nt, Staphylococcus aureus subsp. aureus N315
guaacuaaaauguc

SEQ ID NO: 2154159 - RNA, 15 nt, Staphylococcus aureus subsp. aureus N315
guaaccuuaaauaua

SEQ ID NO: 2154160 - RNA, 17 nt, Staphylococcus aureus subsp. aureus N315
guaaccauuuuuuuauc

SEQ ID NO: 2154161 - RNA, 18 nt, Staphylococcus aureus subsp. aureus N315
guaauugaugauuacucc

SEQ ID NO: 2154162 - RNA, 11 nt, Staphylococcus aureus subsp. aureus N315
guaauuguaau

SEQ ID NO: 2154163 - RNA, 18 nt, Staphylococcus aureus subsp. aureus N315
guaauugucuuuauaaaa

SEQ ID NO: 2154164 - RNA, 12 nt, Staphylococcus aureus subsp. aureus N315
guaauuguuaua

SEQ ID NO: 2154165 - RNA, 21 nt, Staphylococcus aureus subsp. aureus N315
guaauuguuauaaguaaauaa

SEQ ID NO: 2154166 - RNA, 14 nt, Staphylococcus aureus subsp. aureus N315
guaauuuaaaauag

SEQ ID NO: 2154167 - RNA, 15 nt, Staphylococcus aureus subsp. aureus N315
guaauuuaaaauagu

SEQ ID NO: 2154168 - RNA, 14 nt, Staphylococcus aureus subsp. aureus N315
guaauuauuauaau

SEQ ID NO: 2154169 - RNA, 23 nt, Staphylococcus aureus subsp. aureus N315
guaauuauuuuucucaacaguuu

SEQ ID NO: 2154170 - RNA, 11 nt, Staphylococcus aureus subsp. aureus N315
guaauguguua

SEQ ID NO: 2154171 - RNA, 21 nt, Staphylococcus aureus subsp. aureus N315
guaauguuccccugaaaagaa

SEQ ID NO: 2154172 - RNA, 17 nt, Staphylococcus aureus subsp. aureus N315
guaauuuuuaaaucuac

SEQ ID NO: 2154173 - RNA, 14 nt, Staphylococcus aureus subsp. aureus N315
guacaaauaauaca

SEQ ID NO: 2154174 - RNA, 19 nt, Staphylococcus aureus subsp. aureus N315
guacacauccucauaauua

SEQ ID NO: 2154175 - RNA, 19 nt, Staphylococcus aureus subsp. aureus N315
aaauagauugaaaaaauaa

SEQ ID NO: 2154176 - RNA, 11 nt, Staphylococcus aureus subsp. aureus N315
guaaucuauuu

SEQ ID NO: 2154177 - RNA, 18 nt, Staphylococcus aureus subsp. aureus N315
guaaugaagauuuuguug

SEQ ID NO: 2154178 - RNA, 13 nt, Staphylococcus aureus subsp. aureus N315
guaaugauacgca

SEQ ID NO: 2154179 - RNA, 17 nt, Staphylococcus aureus subsp. aureus N315
guaaugaaucaauugca

SEQ ID NO: 2154180 - RNA, 16 nt, Staphylococcus aureus subsp. aureus N315
guaaugcuuaaaaaca

SEQ ID NO: 2154181 - RNA, 16 nt, Staphylococcus aureus subsp. aureus N315
guaaugcuugagcuuu

SEQ ID NO: 2154182 - RNA, 12 nt, Staphylococcus aureus subsp. aureus N315
guaaugauuuug

SEQ ID NO: 2154183 - RNA, 16 nt, Staphylococcus aureus subsp. aureus N315
guaaugauuuugcuuu

SEQ ID NO: 2154184 - RNA, 17 nt, Staphylococcus aureus subsp. aureus N315
guaaugccauuaauggu

SEQ ID NO: 2154185 - RNA, 16 nt, Staphylococcus aureus subsp. aureus N315
guaaugcuguacuaua

SEQ ID NO: 2154186 - RNA, 15 nt, Staphylococcus aureus subsp. aureus N315
guaaucccauuuuaa

SEQ ID NO: 2154187 - RNA, 16 nt, Staphylococcus aureus subsp. aureus N315
guaaucauaccagcaa

SEQ ID NO: 2154188 - RNA, 12 nt, Staphylococcus aureus subsp. aureus N315
guaaucaauccu

SEQ ID NO: 2154189 - RNA, 22 nt, Staphylococcus aureus subsp. aureus N315
guaaucacuaucuguuguuaua

SEQ ID NO: 2154190 - RNA, 18 nt, Staphylococcus aureus subsp. aureus N315
aaauagacaccaaaaaac

SEQ ID NO: 2154191 - RNA, 14 nt, Staphylococcus aureus subsp. aureus N315
aaauagauugaaaa

SEQ ID NO: 2154192 - RNA, 20 nt, Staphylococcus aureus subsp. aureus N315
aaauagacugccaauaaaau

SEQ ID NO: 2154193 - RNA, 15 nt, Staphylococcus aureus subsp. aureus N315
guacaguaauauuca

SEQ ID NO: 2154194 - RNA, 18 nt, Staphylococcus aureus subsp. aureus N315
guacaguuacuuucgcuu

SEQ ID NO: 2154195 - RNA, 14 nt, Staphylococcus aureus subsp. aureus N315
guacauauaauaug

SEQ ID NO: 2154196 - RNA, 17 nt, Staphylococcus aureus subsp. aureus N315
guacauauguuguuucu

SEQ ID NO: 2154197 - RNA, 16 nt, Staphylococcus aureus subsp. aureus N315
guacauguauuggcca

SEQ ID NO: 2154198 - RNA, 18 nt, Staphylococcus aureus subsp. aureus N315
guacauccacuuuauaau

SEQ ID NO: 2154199 - RNA, 14 nt, Staphylococcus aureus subsp. aureus N315
guacagauaagaau

SEQ ID NO: 2154200 - RNA, 20 nt, Staphylococcus aureus subsp. aureus N315
guacauuuauuuucaauaaa

SEQ ID NO: 2154201 - RNA, 16 nt, Staphylococcus aureus subsp. aureus N315
guacauuguaaauaua

SEQ ID NO: 2154202 - RNA, 22 nt, Staphylococcus aureus subsp. aureus N315
guacauuuauuuucaauaaaua

SEQ ID NO: 2154203 - RNA, 15 nt, Staphylococcus aureus subsp. aureus N315
guaccaauuagcaug

SEQ ID NO: 2154204 - RNA, 15 nt, Staphylococcus aureus subsp. aureus N315
guaccaccccaacuu

SEQ ID NO: 2154205 - RNA, 13 nt, Staphylococcus aureus subsp. aureus N315
guaccaccccaac

SEQ ID NO: 2154206 - RNA, 21 nt, Staphylococcus aureus subsp. aureus N315
guaccacucauaaucaagucu

SEQ ID NO: 2154207 - RNA, 14 nt, Staphylococcus aureus subsp. aureus N315
guaccgucuuaucu

SEQ ID NO: 2154208 - RNA, 12 nt, Staphylococcus aureus subsp. aureus N315
guaccuaaaaua

SEQ ID NO: 2154209 - RNA, 15 nt, Staphylococcus aureus subsp. aureus N315
guaccuaaaauagaa

SEQ ID NO: 2154210 - RNA, 15 nt, Staphylococcus aureus subsp. aureus N315
guacgaggaccaucu

SEQ ID NO: 2154211 - RNA, 19 nt, Staphylococcus aureus subsp. aureus N315
guacgcaauuuaauauuau

SEQ ID NO: 2154212 - RNA, 14 nt, Staphylococcus aureus subsp. aureus N315
guacgauucaauuu

SEQ ID NO: 2154213 - RNA, 21 nt, Staphylococcus aureus subsp. aureus N315
ggugagggccccaacacagaa

SEQ ID NO: 2154214 - RNA, 23 nt, Staphylococcus aureus subsp. aureus N315
ggugaauuaguaaacuaauccuc

SEQ ID NO: 2154215 - RNA, 21 nt, Staphylococcus aureus subsp. aureus N315
ggugcaauaauaaauaggaug

SEQ ID NO: 2154216 - RNA, 17 nt, Staphylococcus aureus subsp. aureus N315
ggugaguguuucauaau

SEQ ID NO: 2154217 - RNA, 13 nt, Staphylococcus aureus subsp. aureus N315
ggugagggcccca

SEQ ID NO: 2154218 - RNA, 13 nt, Staphylococcus aureus subsp. aureus N315
gguuuauuuaaua

SEQ ID NO: 2154219 - RNA, 11 nt, Staphylococcus aureus subsp. aureus N315
gguuugagaau

SEQ ID NO: 2154220 - RNA, 16 nt, Staphylococcus aureus subsp. aureus N315
guaaaaacucuuggau

SEQ ID NO: 2154221 - RNA, 17 nt, Staphylococcus aureus subsp. aureus N315
gguuuuuuauuuucaua

SEQ ID NO: 2154222 - RNA, 15 nt, Staphylococcus aureus subsp. aureus N315
gguucuucaauaugc

SEQ ID NO: 2154223 - RNA, 19 nt, Staphylococcus aureus subsp. aureus N315
gguuguuuuucaucauuaa

SEQ ID NO: 2154224 - RNA, 14 nt, Staphylococcus aureus subsp. aureus N315
gguuuaaaaaugcu

SEQ ID NO: 2154225 - RNA, 15 nt, Staphylococcus aureus subsp. aureus N315
gguuguuaggggcuu

SEQ ID NO: 2154226 - RNA, 12 nt, Staphylococcus aureus subsp. aureus N315
gguuaaauuacu

SEQ ID NO: 2154227 - RNA, 15 nt, Staphylococcus aureus subsp. aureus N315
gguguuuaacuaaac

SEQ ID NO: 2154228 - RNA, 16 nt, Staphylococcus aureus subsp. aureus N315
ggugugauguacuacu

SEQ ID NO: 2154229 - RNA, 20 nt, Staphylococcus aureus subsp. aureus N315
gguuaaugacuaugcaaaug

SEQ ID NO: 2154230 - RNA, 11 nt, Staphylococcus aureus subsp. aureus N315
gguuauggugu

SEQ ID NO: 2154231 - RNA, 11 nt, Staphylococcus aureus subsp. aureus N315
gguucaaaucc

SEQ ID NO: 2154232 - RNA, 12 nt, Staphylococcus aureus subsp. aureus N315
gguucaucuaaa

SEQ ID NO: 2154233 - RNA, 18 nt, Staphylococcus aureus subsp. aureus N315
gguucccaauucggauua

SEQ ID NO: 2154234 - RNA, 16 nt, Staphylococcus aureus subsp. aureus N315
gccuaaaaauaaaauc

SEQ ID NO: 2154235 - RNA, 22 nt, Staphylococcus aureus subsp. aureus N315
gccuucuguacguuuuaaauaa

SEQ ID NO: 2154236 - RNA, 13 nt, Staphylococcus aureus subsp. aureus N315
gccuucauuagcc

SEQ ID NO: 2154237 - RNA, 11 nt, Staphylococcus aureus subsp. aureus N315
gccuggcaacg

SEQ ID NO: 2154238 - RNA, 16 nt, Staphylococcus aureus subsp. aureus N315
gccuauucguuugaau

SEQ ID NO: 2154239 - RNA, 13 nt, Staphylococcus aureus subsp. aureus N315
gccuauuuaaaag

SEQ ID NO: 2154240 - RNA, 17 nt, Staphylococcus aureus subsp. aureus N315
gccugcaagucguucuc

SEQ ID NO: 2154241 - RNA, 18 nt, Staphylococcus aureus subsp. aureus N315
gcgauacguuuauaucuu

SEQ ID NO: 2154242 - RNA, 22 nt, Staphylococcus aureus subsp. aureus N315
gcgaauagaagguuauuuuuua

SEQ ID NO: 2154243 - RNA, 18 nt, Staphylococcus aureus subsp. aureus N315
gcgacauuuguaaauauu

SEQ ID NO: 2154244 - RNA, 19 nt, Staphylococcus aureus subsp. aureus N315
gcgacauguccauaauauc

SEQ ID NO: 2154245 - RNA, 15 nt, Staphylococcus aureus subsp. aureus N315
aaagcuauaaaaaau

SEQ ID NO: 2154246 - RNA, 23 nt, Staphylococcus aureus subsp. aureus N315
aaagcuauauaugaauugaguau

SEQ ID NO: 2154247 - RNA, 18 nt, Staphylococcus aureus subsp. aureus N315
gcccgucuggcacauuac

SEQ ID NO: 2154248 - RNA, 22 nt, Staphylococcus aureus subsp. aureus N315
aaagcguccucuugugaaauua

SEQ ID NO: 2154249 - RNA, 14 nt, Staphylococcus aureus subsp. aureus N315
aaagcuaaugcaag

SEQ ID NO: 2154250 - RNA, 22 nt, Staphylococcus aureus subsp. aureus N315
aaagcuaauggcuaauacaaaa

SEQ ID NO: 2154251 - RNA, 13 nt, Staphylococcus aureus subsp. aureus N315
aaagcuaauuuuu

SEQ ID NO: 2154252 - RNA, 12 nt, Staphylococcus aureus subsp. aureus N315
gcccugacaauu

SEQ ID NO: 2154253 - RNA, 18 nt, Staphylococcus aureus subsp. aureus N315
gcccugacaauucaucua

SEQ ID NO: 2154254 - RNA, 19 nt, Staphylococcus aureus subsp. aureus N315
gcccugacaauucaucuaa

SEQ ID NO: 2154255 - RNA, 20 nt, Staphylococcus aureus subsp. aureus N315
gccauuuuuauuuaacacuu

SEQ ID NO: 2154256 - RNA, 21 nt, Staphylococcus aureus subsp. aureus N315
gccaucuaggucacuuuuaug

SEQ ID NO: 2154257 - RNA, 23 nt, Staphylococcus aureus subsp. aureus N315
gccaugaaaaggaaaaacuuuuc

SEQ ID NO: 2154258 - RNA, 18 nt, Staphylococcus aureus subsp. aureus N315
gccauacccauauuaaau

SEQ ID NO: 2154259 - RNA, 14 nt, Staphylococcus aureus subsp. aureus N315
gccauaaucuucau

SEQ ID NO: 2154260 - RNA, 16 nt, Staphylococcus aureus subsp. aureus N315
gccaucaauauugaua

SEQ ID NO: 2154261 - RNA, 14 nt, Staphylococcus aureus subsp. aureus N315
gccaggugauugac

SEQ ID NO: 2154262 - RNA, 11 nt, Staphylococcus aureus subsp. aureus N315
gccccaacaca

SEQ ID NO: 2154263 - RNA, 13 nt, Staphylococcus aureus subsp. aureus N315
gccccaacaaaga

SEQ ID NO: 2154264 - RNA, 15 nt, Staphylococcus aureus subsp. aureus N315
gccccaacaaagaag

SEQ ID NO: 2154265 - RNA, 14 nt, Staphylococcus aureus subsp. aureus N315
gccccaacacagaa

SEQ ID NO: 2154266 - RNA, 14 nt, Staphylococcus aureus subsp. aureus N315
gccccaacacagag

SEQ ID NO: 2154267 - RNA, 15 nt, Staphylococcus aureus subsp. aureus N315
gccccaacacagaga

SEQ ID NO: 2154268 - RNA, 17 nt, Staphylococcus aureus subsp. aureus N315
gccccaacacagagaau

SEQ ID NO: 2154269 - RNA, 20 nt, Staphylococcus aureus subsp. aureus N315
gccccuagcaaaaauacuuu

SEQ ID NO: 2154270 - RNA, 15 nt, Staphylococcus aureus subsp. aureus N315
gcccgacaucauaaa

SEQ ID NO: 2154271 - RNA, 22 nt, Staphylococcus aureus subsp. aureus N315
gccaccuuguuuaaguuuuuca

SEQ ID NO: 2154272 - RNA, 13 nt, Staphylococcus aureus subsp. aureus N315
gccaauuaaaauu

SEQ ID NO: 2154273 - RNA, 17 nt, Staphylococcus aureus subsp. aureus N315
gccacaacauguuugga

SEQ ID NO: 2154274 - RNA, 18 nt, Staphylococcus aureus subsp. aureus N315
gcauauaauauuugaaaa

SEQ ID NO: 2154275 - RNA, 22 nt, Staphylococcus aureus subsp. aureus N315
gcauauaaagucauacuuauga

SEQ ID NO: 2154276 - RNA, 19 nt, Staphylococcus aureus subsp. aureus N315
gcauauaaagucauacuua

SEQ ID NO: 2154277 - RNA, 16 nt, Staphylococcus aureus subsp. aureus N315
gcauauauauauagau

SEQ ID NO: 2154278 - RNA, 15 nt, Staphylococcus aureus subsp. aureus N315
gcaucacaaaauugu

SEQ ID NO: 2154279 - RNA, 17 nt, Staphylococcus aureus subsp. aureus N315
gcauacgaauuaaaaua

SEQ ID NO: 2154280 - RNA, 18 nt, Staphylococcus aureus subsp. aureus N315
gcauacgaauuaaaauaa

SEQ ID NO: 2154281 - RNA, 13 nt, Staphylococcus aureus subsp. aureus N315
gcauacguaaaug

SEQ ID NO: 2154282 - RNA, 16 nt, Staphylococcus aureus subsp. aureus N315
gcauaccuauaaacau

SEQ ID NO: 2154283 - RNA, 18 nt, Staphylococcus aureus subsp. aureus N315
gcauacaggaaauugaag

SEQ ID NO: 2154284 - RNA, 20 nt, Staphylococcus aureus subsp. aureus N315
gcauuguaauaccaauuuuu

SEQ ID NO: 2154285 - RNA, 18 nt, Staphylococcus aureus subsp. aureus N315
gcauuuuuucauuauuaa

SEQ ID NO: 2154286 - RNA, 21 nt, Staphylococcus aureus subsp. aureus N315
gcauuauuauuucauuagaaa

SEQ ID NO: 2154287 - RNA, 16 nt, Staphylococcus aureus subsp. aureus N315
gcauuauuauuucauu

SEQ ID NO: 2154288 - RNA, 15 nt, Staphylococcus aureus subsp. aureus N315
gcaugacuguaagua

SEQ ID NO: 2154289 - RNA, 16 nt, Staphylococcus aureus subsp. aureus N315
gcaucuuuuacugcuu

SEQ ID NO: 2154290 - RNA, 21 nt, Staphylococcus aureus subsp. aureus N315
gcaucuuuuacugcuucgaca

SEQ ID NO: 2154291 - RNA, 13 nt, Staphylococcus aureus subsp. aureus N315
gcaugcgcaaaag

SEQ ID NO: 2154292 - RNA, 15 nt, Staphylococcus aureus subsp. aureus N315
gcaugcgcaaaagcg

SEQ ID NO: 2154293 - RNA, 15 nt, Staphylococcus aureus subsp. aureus N315
gcagagaauauagau

SEQ ID NO: 2154294 - RNA, 18 nt, Staphylococcus aureus subsp. aureus N315
gcagggugcuaaauuuac

SEQ ID NO: 2154295 - RNA, 16 nt, Staphylococcus aureus subsp. aureus N315
gcacuucaaaagaaau

SEQ ID NO: 2154296 - RNA, 20 nt, Staphylococcus aureus subsp. aureus N315
gcacuucuauauuaauagaa

SEQ ID NO: 2154297 - RNA, 12 nt, Staphylococcus aureus subsp. aureus N315
gcacuuggauuu

SEQ ID NO: 2154298 - RNA, 19 nt, Staphylococcus aureus subsp. aureus N315
gcacuuggauuuuaauuau

SEQ ID NO: 2154299 - RNA, 22 nt, Staphylococcus aureus subsp. aureus N315
gcacuugucucaaauuaaauca

SEQ ID NO: 2154300 - RNA, 20 nt, Staphylococcus aureus subsp. aureus N315
gcacuugguucauaaugauc

SEQ ID NO: 2154301 - RNA, 22 nt, Staphylococcus aureus subsp. aureus N315
gcacuuuauuaaaaauccucac

SEQ ID NO: 2154302 - RNA, 15 nt, Staphylococcus aureus subsp. aureus N315
gcacuuuaacauaac

SEQ ID NO: 2154303 - RNA, 21 nt, Staphylococcus aureus subsp. aureus N315
gcacuauaaaauucaccaacu

SEQ ID NO: 2154304 - RNA, 16 nt, Staphylococcus aureus subsp. aureus N315
gcacuaucaaugacau

SEQ ID NO: 2154305 - RNA, 14 nt, Staphylococcus aureus subsp. aureus N315
gcacugagcaacaa

SEQ ID NO: 2154306 - RNA, 15 nt, Staphylococcus aureus subsp. aureus N315
gcacugagcaacaaa

SEQ ID NO: 2154307 - RNA, 16 nt, Staphylococcus aureus subsp. aureus N315
gcacgagacaauaaug

SEQ ID NO: 2154308 - RNA, 15 nt, Staphylococcus aureus subsp. aureus N315
gcacgagacaauaau

SEQ ID NO: 2154309 - RNA, 14 nt, Staphylococcus aureus subsp. aureus N315
gcacgagaaauguc

SEQ ID NO: 2154310 - RNA, 17 nt, Staphylococcus aureus subsp. aureus N315
gcacgauaaaaauaaaa

SEQ ID NO: 2154311 - RNA, 22 nt, Staphylococcus aureus subsp. aureus N315
gcacgcgugccaacaucuucaa

SEQ ID NO: 2154312 - RNA, 23 nt, Staphylococcus aureus subsp. aureus N315
gcaccgacaauuauaauaaaacu

SEQ ID NO: 2154313 - RNA, 13 nt, Staphylococcus aureus subsp. aureus N315
gcacaaaugaaug

SEQ ID NO: 2154314 - RNA, 20 nt, Staphylococcus aureus subsp. aureus N315
gcacaacugcauaaaagccu

SEQ ID NO: 2154315 - RNA, 14 nt, Staphylococcus aureus subsp. aureus N315
gcacaagcaucuac

SEQ ID NO: 2154316 - RNA, 14 nt, Staphylococcus aureus subsp. aureus N315
gcacaacugcauaa

SEQ ID NO: 2154317 - RNA, 16 nt, Staphylococcus aureus subsp. aureus N315
gcacauuauuguaagu

SEQ ID NO: 2154318 - RNA, 21 nt, Staphylococcus aureus subsp. aureus N315
gcacauuccaucuuaaaacaa

SEQ ID NO: 2154319 - RNA, 16 nt, Staphylococcus aureus subsp. aureus N315
gcacaucauaauaaau

SEQ ID NO: 2154320 - RNA, 16 nt, Staphylococcus aureus subsp. aureus N315
gcacaucauugauaga

SEQ ID NO: 2154321 - RNA, 19 nt, Staphylococcus aureus subsp. aureus N315
gcacaucagauauaaguag

SEQ ID NO: 2154322 - RNA, 19 nt, Staphylococcus aureus subsp. aureus N315
gcacagcggaauacagaug

SEQ ID NO: 2154323 - RNA, 19 nt, Staphylococcus aureus subsp. aureus N315
gcacagcgauuaaaugaug

SEQ ID NO: 2154324 - RNA, 19 nt, Staphylococcus aureus subsp. aureus N315
gcacaguggauuacagaug

SEQ ID NO: 2154325 - RNA, 13 nt, Staphylococcus aureus subsp. aureus N315
gcaauuuguaaua

SEQ ID NO: 2154326 - RNA, 16 nt, Staphylococcus aureus subsp. aureus N315
gcaauugcaaugaaua

SEQ ID NO: 2154327 - RNA, 19 nt, Staphylococcus aureus subsp. aureus N315
gcaauugaaucaaauacau

SEQ ID NO: 2154328 - RNA, 19 nt, Staphylococcus aureus subsp. aureus N315
gcaauuaaccuugauuuaa

SEQ ID NO: 2154329 - RNA, 14 nt, Staphylococcus aureus subsp. aureus N315
gcaauuagaauaua

SEQ ID NO: 2154330 - RNA, 18 nt, Staphylococcus aureus subsp. aureus N315
gcaauuauuuuucaaaua

SEQ ID NO: 2154331 - RNA, 21 nt, Staphylococcus aureus subsp. aureus N315
gcaauuaaagucaauuuaaau

SEQ ID NO: 2154332 - RNA, 16 nt, Staphylococcus aureus subsp. aureus N315
gcaaugcgaguugggg

SEQ ID NO: 2154333 - RNA, 17 nt, Staphylococcus aureus subsp. aureus N315
gcaaugcgaguuggggu

SEQ ID NO: 2154334 - RNA, 14 nt, Staphylococcus aureus subsp. aureus N315
gcaaucuauauaaa

SEQ ID NO: 2154335 - RNA, 14 nt, Staphylococcus aureus subsp. aureus N315
gcaaucuuaguaca

SEQ ID NO: 2154336 - RNA, 18 nt, Staphylococcus aureus subsp. aureus N315
gcaaucguugaaaaauau

SEQ ID NO: 2154337 - RNA, 15 nt, Staphylococcus aureus subsp. aureus N315
gcaaugcaugcuucu

SEQ ID NO: 2154338 - RNA, 14 nt, Staphylococcus aureus subsp. aureus N315
gcaaugaaauuacc

SEQ ID NO: 2154339 - RNA, 20 nt, Staphylococcus aureus subsp. aureus N315
gcaaugauaucuuuuccaaa

SEQ ID NO: 2154340 - RNA, 14 nt, Staphylococcus aureus subsp. aureus N315
gcaaucauaauacu

SEQ ID NO: 2154341 - RNA, 18 nt, Staphylococcus aureus subsp. aureus N315
gcaagccuucuauauagu

SEQ ID NO: 2154342 - RNA, 19 nt, Staphylococcus aureus subsp. aureus N315
gcaauaacaccaauugaau

SEQ ID NO: 2154343 - RNA, 14 nt, Staphylococcus aureus subsp. aureus N315
gcaauaaaauuagc

SEQ ID NO: 2154344 - RNA, 19 nt, Staphylococcus aureus subsp. aureus N315
gcaaguguaucgcccauac

SEQ ID NO: 2154345 - RNA, 13 nt, Staphylococcus aureus subsp. aureus N315
gcaaguuggggau

SEQ ID NO: 2154346 - RNA, 12 nt, Staphylococcus aureus subsp. aureus N315
gcaaguugggga

SEQ ID NO: 2154347 - RNA, 19 nt, Staphylococcus aureus subsp. aureus N315
gcaagguuuucgccaauaa

SEQ ID NO: 2154348 - RNA, 22 nt, Staphylococcus aureus subsp. aureus N315
gcaagugcuuccacuucaucua

SEQ ID NO: 2154349 - RNA, 22 nt, Staphylococcus aureus subsp. aureus N315
gcaagucucauaucuauuuuuc

SEQ ID NO: 2154350 - RNA, 15 nt, Staphylococcus aureus subsp. aureus N315
gcaauagcuauaacu

SEQ ID NO: 2154351 - RNA, 18 nt, Staphylococcus aureus subsp. aureus N315
gcaauagcuauaacucua

SEQ ID NO: 2154352 - RNA, 24 nt, Staphylococcus aureus subsp. aureus N315
gaucaauuaaacuuaagaauacau

SEQ ID NO: 2154353 - RNA, 14 nt, Staphylococcus aureus subsp. aureus N315
aaagcgccaauaca

SEQ ID NO: 2154354 - RNA, 18 nt, Staphylococcus aureus subsp. aureus N315
gcaacugaucauuuucau

SEQ ID NO: 2154355 - RNA, 18 nt, Staphylococcus aureus subsp. aureus N315
gcaacuaagaugacugaa

SEQ ID NO: 2154356 - RNA, 14 nt, Staphylococcus aureus subsp. aureus N315
gcaacuuguauugu

SEQ ID NO: 2154357 - RNA, 22 nt, Staphylococcus aureus subsp. aureus N315
gcaacuuguauuguuuguagaa

SEQ ID NO: 2154358 - RNA, 16 nt, Staphylococcus aureus subsp. aureus N315
aaagcggacugaaaga

SEQ ID NO: 2154359 - RNA, 15 nt, Staphylococcus aureus subsp. aureus N315
gcggauaguguugcg

SEQ ID NO: 2154360 - RNA, 19 nt, Staphylococcus aureus subsp. aureus N315
gcggauuaucuaacucaua

SEQ ID NO: 2154361 - RNA, 13 nt, Staphylococcus aureus subsp. aureus N315
gcguacauauaau

SEQ ID NO: 2154362 - RNA, 13 nt, Staphylococcus aureus subsp. aureus N315
gcguauuuuaaug

SEQ ID NO: 2154363 - RNA, 17 nt, Staphylococcus aureus subsp. aureus N315
gcgucauuuguucaucu

SEQ ID NO: 2154364 - RNA, 14 nt, Staphylococcus aureus subsp. aureus N315
aaagcugucaacuu

SEQ ID NO: 2154365 - RNA, 18 nt, Staphylococcus aureus subsp. aureus N315
gcugguaauauuuuuguu

SEQ ID NO: 2154366 - RNA, 15 nt, Staphylococcus aureus subsp. aureus N315
aaagcuucauauuua

SEQ ID NO: 2154367 - RNA, 18 nt, Staphylococcus aureus subsp. aureus N315
aaagcuuccaaauguuca

SEQ ID NO: 2154368 - RNA, 20 nt, Staphylococcus aureus subsp. aureus N315
aaagcuucgucaaugacuaa

SEQ ID NO: 2154369 - RNA, 18 nt, Staphylococcus aureus subsp. aureus N315
aaagcuugauuuaacaac

SEQ ID NO: 2154370 - RNA, 22 nt, Staphylococcus aureus subsp. aureus N315
gcugguugcuucuuaucaacaa

SEQ ID NO: 2154371 - RNA, 15 nt, Staphylococcus aureus subsp. aureus N315
gcuggcccccaacac

SEQ ID NO: 2154372 - RNA, 22 nt, Staphylococcus aureus subsp. aureus N315
gcuggcgcaaugauaucuuuuc

SEQ ID NO: 2154373 - RNA, 17 nt, Staphylococcus aureus subsp. aureus N315
gcucuuuuuguaugagu

SEQ ID NO: 2154374 - RNA, 14 nt, Staphylococcus aureus subsp. aureus N315
gcugauaauuuuuc

SEQ ID NO: 2154375 - RNA, 13 nt, Staphylococcus aureus subsp. aureus N315
gcugauaauaaaa

SEQ ID NO: 2154376 - RNA, 15 nt, Staphylococcus aureus subsp. aureus N315
gcucuggauuuuucu

SEQ ID NO: 2154377 - RNA, 18 nt, Staphylococcus aureus subsp. aureus N315
gcucuuaaaucacuagcu

SEQ ID NO: 2154378 - RNA, 22 nt, Staphylococcus aureus subsp. aureus N315
gcucuuaauguacuuuucuguc

SEQ ID NO: 2154379 - RNA, 13 nt, Staphylococcus aureus subsp. aureus N315
gcucuugcuaaag

SEQ ID NO: 2154380 - RNA, 22 nt, Staphylococcus aureus subsp. aureus N315
gcucuuauaaagacaccuucaa

SEQ ID NO: 2154381 - RNA, 20 nt, Staphylococcus aureus subsp. aureus N315
gcucuaaacuucuauuaaua

SEQ ID NO: 2154382 - RNA, 23 nt, Staphylococcus aureus subsp. aureus N315
gcucguuuuuuuagcuauagaaa

SEQ ID NO: 2154383 - RNA, 19 nt, Staphylococcus aureus subsp. aureus N315
gcucguugcagauuuugca

SEQ ID NO: 2154384 - RNA, 20 nt, Staphylococcus aureus subsp. aureus N315
gcucguuaaaucacauauga

SEQ ID NO: 2154385 - RNA, 13 nt, Staphylococcus aureus subsp. aureus N315
gcucguuaaauca

SEQ ID NO: 2154386 - RNA, 15 nt, Staphylococcus aureus subsp. aureus N315
gcuaguucagcuucu

SEQ ID NO: 2154387 - RNA, 22 nt, Staphylococcus aureus subsp. aureus N315
gcuagauuuuaaacgcucauca

SEQ ID NO: 2154388 - RNA, 16 nt, Staphylococcus aureus subsp. aureus N315
gcuagaacagauauac

SEQ ID NO: 2154389 - RNA, 19 nt, Staphylococcus aureus subsp. aureus N315
gcuacuuuuucaucuuuca

SEQ ID NO: 2154390 - RNA, 21 nt, Staphylococcus aureus subsp. aureus N315
gcuauauuuuuguauuuaugu

SEQ ID NO: 2154391 - RNA, 20 nt, Staphylococcus aureus subsp. aureus N315
gcuauauuuuuguauuuaug

SEQ ID NO: 2154392 - RNA, 18 nt, Staphylococcus aureus subsp. aureus N315
gcuauauaauuuauaaaa

SEQ ID NO: 2154393 - RNA, 18 nt, Staphylococcus aureus subsp. aureus N315
gcuauaaaaaaucuuuug

SEQ ID NO: 2154394 - RNA, 14 nt, Staphylococcus aureus subsp. aureus N315
gcuauaaaauuuug

SEQ ID NO: 2154395 - RNA, 20 nt, Staphylococcus aureus subsp. aureus N315
gcuauaaaaguacuuuaaaa

SEQ ID NO: 2154396 - RNA, 19 nt, Staphylococcus aureus subsp. aureus N315
gcuauaagaacuaaugguu

SEQ ID NO: 2154397 - RNA, 15 nt, Staphylococcus aureus subsp. aureus N315
gcuauguauuuuucu

SEQ ID NO: 2154398 - RNA, 13 nt, Staphylococcus aureus subsp. aureus N315
gcuauuaaaauag

SEQ ID NO: 2154399 - RNA, 12 nt, Staphylococcus aureus subsp. aureus N315
gcuauuucaaca

SEQ ID NO: 2154400 - RNA, 19 nt, Staphylococcus aureus subsp. aureus N315
gcuauuucaacaaacauaa

SEQ ID NO: 2154401 - RNA, 15 nt, Staphylococcus aureus subsp. aureus N315
gcuaugaagaaaucu

SEQ ID NO: 2154402 - RNA, 23 nt, Staphylococcus aureus subsp. aureus N315
gcuauuuuggauaauaugagaca

SEQ ID NO: 2154403 - RNA, 18 nt, Staphylococcus aureus subsp. aureus N315
gcuauuuuggauaauaug

SEQ ID NO: 2154404 - RNA, 18 nt, Staphylococcus aureus subsp. aureus N315
gcucauuucaauauuaaa

SEQ ID NO: 2154405 - RNA, 14 nt, Staphylococcus aureus subsp. aureus N315
gcguucaacauuac

SEQ ID NO: 2154406 - RNA, 20 nt, Staphylococcus aureus subsp. aureus N315
gcguuagauaccucuuguac

SEQ ID NO: 2154407 - RNA, 19 nt, Staphylococcus aureus subsp. aureus N315
gcguggucuauuuuauaaa

SEQ ID NO: 2154408 - RNA, 20 nt, Staphylococcus aureus subsp. aureus N315
gcguuuaaucacaucuuuuu

SEQ ID NO: 2154409 - RNA, 13 nt, Staphylococcus aureus subsp. aureus N315
gcuaaaaaaauua

SEQ ID NO: 2154410 - RNA, 18 nt, Staphylococcus aureus subsp. aureus N315
gcuaauguguacuuaaaa

SEQ ID NO: 2154411 - RNA, 19 nt, Staphylococcus aureus subsp. aureus N315
gcuacaaagucauuuucau

SEQ ID NO: 2154412 - RNA, 23 nt, Staphylococcus aureus subsp. aureus N315
gcuacaaagucauuuucauucag

SEQ ID NO: 2154413 - RNA, 17 nt, Staphylococcus aureus subsp. aureus N315
gcuaauuucuaauacau

SEQ ID NO: 2154414 - RNA, 20 nt, Staphylococcus aureus subsp. aureus N315
gcuaauuuuaauuuucagaa

SEQ ID NO: 2154415 - RNA, 14 nt, Staphylococcus aureus subsp. aureus N315
gcuacaauuauaaa

SEQ ID NO: 2154416 - RNA, 23 nt, Staphylococcus aureus subsp. aureus N315
gcuaccuacuuguucaauacuuc

SEQ ID NO: 2154417 - RNA, 15 nt, Staphylococcus aureus subsp. aureus N315
gcuaaugauaaucca

SEQ ID NO: 2154418 - RNA, 18 nt, Staphylococcus aureus subsp. aureus N315
gcuaaugcaacuaaaacu

SEQ ID NO: 2154419 - RNA, 13 nt, Staphylococcus aureus subsp. aureus N315
gcuaaucuucuca

SEQ ID NO: 2154420 - RNA, 12 nt, Staphylococcus aureus subsp. aureus N315
gcuaaucuauuu

SEQ ID NO: 2154421 - RNA, 22 nt, Staphylococcus aureus subsp. aureus N315
gcuaacgaaucgccuacuauaa

SEQ ID NO: 2154422 - RNA, 16 nt, Staphylococcus aureus subsp. aureus N315
gcuaaaauaaaauuaa

SEQ ID NO: 2154423 - RNA, 23 nt, Staphylococcus aureus subsp. aureus N315
gcuaaauguuaaugcuucguaau

SEQ ID NO: 2154424 - RNA, 19 nt, Staphylococcus aureus subsp. aureus N315
gcuaaauuuacgaaaguag

SEQ ID NO: 2154425 - RNA, 18 nt, Staphylococcus aureus subsp. aureus N315
gcuuuuaugcaugcgcaa

SEQ ID NO: 2154426 - RNA, 14 nt, Staphylococcus aureus subsp. aureus N315
gcuuuuauuuauau

SEQ ID NO: 2154427 - RNA, 20 nt, Staphylococcus aureus subsp. aureus N315
gcuuuuauuuauauuauuac

SEQ ID NO: 2154428 - RNA, 18 nt, Staphylococcus aureus subsp. aureus N315
gcuuuuucaaaaucuuua

SEQ ID NO: 2154429 - RNA, 17 nt, Staphylococcus aureus subsp. aureus N315
gcuuuuguaaagcuuua

SEQ ID NO: 2154430 - RNA, 15 nt, Staphylococcus aureus subsp. aureus N315
gcuuuuuuuuauaag

SEQ ID NO: 2154431 - RNA, 15 nt, Staphylococcus aureus subsp. aureus N315
gcuuuuuuuacaaua

SEQ ID NO: 2154432 - RNA, 15 nt, Staphylococcus aureus subsp. aureus N315
ggaaaaagaugaaaa

SEQ ID NO: 2154433 - RNA, 16 nt, Staphylococcus aureus subsp. aureus N315
ggaaaaagaugaaaaa

SEQ ID NO: 2154434 - RNA, 18 nt, Staphylococcus aureus subsp. aureus N315
gcuuuuucuacaccuaca

SEQ ID NO: 2154435 - RNA, 17 nt, Staphylococcus aureus subsp. aureus N315
gcuuuuucuuuuguuuu

SEQ ID NO: 2154436 - RNA, 16 nt, Staphylococcus aureus subsp. aureus N315
gcuuuuuuaccagcau

SEQ ID NO: 2154437 - RNA, 21 nt, Staphylococcus aureus subsp. aureus N315
gcuuuuuuauucuaauacaaa

SEQ ID NO: 2154438 - RNA, 21 nt, Staphylococcus aureus subsp. aureus N315
gcuuuuuugugauuuuuaaua

SEQ ID NO: 2154439 - RNA, 16 nt, Staphylococcus aureus subsp. aureus N315
gcuuucguuucuuuua

SEQ ID NO: 2154440 - RNA, 23 nt, Staphylococcus aureus subsp. aureus N315
gcuuucuuuuuugcuguauauau

SEQ ID NO: 2154441 - RNA, 21 nt, Staphylococcus aureus subsp. aureus N315
gcuuugcauacauaucuuuug

SEQ ID NO: 2154442 - RNA, 19 nt, Staphylococcus aureus subsp. aureus N315
gcuuugcugcuuuuccagu

SEQ ID NO: 2154443 - RNA, 20 nt, Staphylococcus aureus subsp. aureus N315
gcuuuuaauauuauaaaccu

SEQ ID NO: 2154444 - RNA, 22 nt, Staphylococcus aureus subsp. aureus N315
gcuuuguaaaauugugacgcug

SEQ ID NO: 2154445 - RNA, 20 nt, Staphylococcus aureus subsp. aureus N315
gcuuugucacgauagauuua

SEQ ID NO: 2154446 - RNA, 15 nt, Staphylococcus aureus subsp. aureus N315
ggaaauuuauuauaa

SEQ ID NO: 2154447 - RNA, 15 nt, Staphylococcus aureus subsp. aureus N315
ggaauauaaaacugu

SEQ ID NO: 2154448 - RNA, 19 nt, Staphylococcus aureus subsp. aureus N315
ggaauauuaacaccagaua

SEQ ID NO: 2154449 - RNA, 15 nt, Staphylococcus aureus subsp. aureus N315
ggaagcauauuucua

SEQ ID NO: 2154450 - RNA, 16 nt, Staphylococcus aureus subsp. aureus N315
ggaaauaucuuacugc

SEQ ID NO: 2154451 - RNA, 17 nt, Staphylococcus aureus subsp. aureus N315
ggaaauauuccuuacua

SEQ ID NO: 2154452 - RNA, 13 nt, Staphylococcus aureus subsp. aureus N315
ggaaagucagcuu

SEQ ID NO: 2154453 - RNA, 15 nt, Staphylococcus aureus subsp. aureus N315
ggaaauaaaaaauaa

SEQ ID NO: 2154454 - RNA, 18 nt, Staphylococcus aureus subsp. aureus N315
ggagcggaagauaggauu

SEQ ID NO: 2154455 - RNA, 21 nt, Staphylococcus aureus subsp. aureus N315
aaagguuuacuauuaaaggaa

SEQ ID NO: 2154456 - RNA, 23 nt, Staphylococcus aureus subsp. aureus N315
aaagguuguuuuucaucauuaaa

SEQ ID NO: 2154457 - RNA, 23 nt, Staphylococcus aureus subsp. aureus N315
ggacgauaacagcuacaaauaau

SEQ ID NO: 2154458 - RNA, 14 nt, Staphylococcus aureus subsp. aureus N315
aaagggcaaaaaag

SEQ ID NO: 2154459 - RNA, 20 nt, Staphylococcus aureus subsp. aureus N315
ggauuuccucgguuuuauuu

SEQ ID NO: 2154460 - RNA, 15 nt, Staphylococcus aureus subsp. aureus N315
ggcaaagucauuaaa

SEQ ID NO: 2154461 - RNA, 14 nt, Staphylococcus aureus subsp. aureus N315
ggcaaauucaacuu

SEQ ID NO: 2154462 - RNA, 11 nt, Staphylococcus aureus subsp. aureus N315
ggcaaauaggc

SEQ ID NO: 2154463 - RNA, 21 nt, Staphylococcus aureus subsp. aureus N315
ggcaacaacuuuucauauaaa

SEQ ID NO: 2154464 - RNA, 20 nt, Staphylococcus aureus subsp. aureus N315
ggcaaugaaauuaccaacac

SEQ ID NO: 2154465 - RNA, 19 nt, Staphylococcus aureus subsp. aureus N315
aaaguacuuacaaauauac

SEQ ID NO: 2154466 - RNA, 21 nt, Staphylococcus aureus subsp. aureus N315
aaaguaucuaugaaauuuuuu

SEQ ID NO: 2154467 - RNA, 14 nt, Staphylococcus aureus subsp. aureus N315
ggcauccauaucca

SEQ ID NO: 2154468 - RNA, 22 nt, Staphylococcus aureus subsp. aureus N315
ggcagcuaaaaaguauacuaaa

SEQ ID NO: 2154469 - RNA, 23 nt, Staphylococcus aureus subsp. aureus N315
ggcgcuguuccaaauucauuugu

SEQ ID NO: 2154470 - RNA, 18 nt, Staphylococcus aureus subsp. aureus N315
aaauacuauauauaauga

SEQ ID NO: 2154471 - RNA, 23 nt, Staphylococcus aureus subsp. aureus N315
ggcgcuccuacuuuucaacuuua

SEQ ID NO: 2154472 - RNA, 14 nt, Staphylococcus aureus subsp. aureus N315
aaauacaaauauau

SEQ ID NO: 2154473 - RNA, 20 nt, Staphylococcus aureus subsp. aureus N315
aaauacaauuucuucauuuu

SEQ ID NO: 2154474 - RNA, 14 nt, Staphylococcus aureus subsp. aureus N315
aaauacuauacuga

SEQ ID NO: 2154475 - RNA, 15 nt, Staphylococcus aureus subsp. aureus N315
aaauacuaacaauua

SEQ ID NO: 2154476 - RNA, 15 nt, Staphylococcus aureus subsp. aureus N315
aaauacuaagauuag

SEQ ID NO: 2154477 - RNA, 20 nt, Staphylococcus aureus subsp. aureus N315
aaauacguaucaagaaaaag

SEQ ID NO: 2154478 - RNA, 12 nt, Staphylococcus aureus subsp. aureus N315
aaauaaauuaaa

SEQ ID NO: 2154479 - RNA, 15 nt, Staphylococcus aureus subsp. aureus N315
aaauaaauuaaauuu

SEQ ID NO: 2154480 - RNA, 11 nt, Staphylococcus aureus subsp. aureus N315
aaauaaauaag

SEQ ID NO: 2154481 - RNA, 22 nt, Staphylococcus aureus subsp. aureus N315
aaauaaaucuccauuaaucauu

SEQ ID NO: 2154482 - RNA, 18 nt, Staphylococcus aureus subsp. aureus N315
ggcgaauagcgauuuuaa

SEQ ID NO: 2154483 - RNA, 13 nt, Staphylococcus aureus subsp. aureus N315
aaauaaaaaauaa

SEQ ID NO: 2154484 - RNA, 13 nt, Staphylococcus aureus subsp. aureus N315
aaauaaaaauaca

SEQ ID NO: 2154485 - RNA, 14 nt, Staphylococcus aureus subsp. aureus N315
aaauaaaauuaaaa

SEQ ID NO: 2154486 - RNA, 16 nt, Staphylococcus aureus subsp. aureus N315
aaauaaaccacgcaca

SEQ ID NO: 2154487 - RNA, 22 nt, Staphylococcus aureus subsp. aureus N315
aaauaaacgauugauuaucaua

SEQ ID NO: 2154488 - RNA, 12 nt, Staphylococcus aureus subsp. aureus N315
aaauaaaauuuu

SEQ ID NO: 2154489 - RNA, 20 nt, Staphylococcus aureus subsp. aureus N315
ggccgugguaugauuuuuga

SEQ ID NO: 2154490 - RNA, 17 nt, Staphylococcus aureus subsp. aureus N315
ggccuccucuuuuauuu

SEQ ID NO: 2154491 - RNA, 13 nt, Staphylococcus aureus subsp. aureus N315
aaaguuucuccac

SEQ ID NO: 2154492 - RNA, 22 nt, Staphylococcus aureus subsp. aureus N315
aaaguuuucauuuaacauguau

SEQ ID NO: 2154493 - RNA, 18 nt, Staphylococcus aureus subsp. aureus N315
aaaguuuucauuuaacau

SEQ ID NO: 2154494 - RNA, 22 nt, Staphylococcus aureus subsp. aureus N315
aaaguuuugaaccuaaauucca

SEQ ID NO: 2154495 - RNA, 17 nt, Staphylococcus aureus subsp. aureus N315
aaaguuuuugucuuaau

SEQ ID NO: 2154496 - RNA, 23 nt, Staphylococcus aureus subsp. aureus N315
aaauaaaaaaacaccuucguuua

SEQ ID NO: 2154497 - RNA, 14 nt, Staphylococcus aureus subsp. aureus N315
aaaguuaaagacua

SEQ ID NO: 2154498 - RNA, 13 nt, Staphylococcus aureus subsp. aureus N315
aaaguguuucaac

SEQ ID NO: 2154499 - RNA, 15 nt, Staphylococcus aureus subsp. aureus N315
aaaguguuucaacau

SEQ ID NO: 2154500 - RNA, 20 nt, Staphylococcus aureus subsp. aureus N315
aaaguuagacuaaaaaacua

SEQ ID NO: 2154501 - RNA, 17 nt, Staphylococcus aureus subsp. aureus N315
aaaguuacaugcucuuu

SEQ ID NO: 2154502 - RNA, 21 nt, Staphylococcus aureus subsp. aureus N315
aaaguguaauguuccccugaa

SEQ ID NO: 2154503 - RNA, 14 nt, Staphylococcus aureus subsp. aureus N315
aaaguuuauacuua

SEQ ID NO: 2154504 - RNA, 21 nt, Staphylococcus aureus subsp. aureus N315
aaaguuuaauugcuguaaaua

SEQ ID NO: 2154505 - RNA, 16 nt, Staphylococcus aureus subsp. aureus N315
aaaguuguaauuuaaa

SEQ ID NO: 2154506 - RNA, 18 nt, Staphylococcus aureus subsp. aureus N315
aaaguuguaauuuaaaau

SEQ ID NO: 2154507 - RNA, 15 nt, Staphylococcus aureus subsp. aureus N315
aaaguuucccaagca

SEQ ID NO: 2154508 - RNA, 21 nt, Staphylococcus aureus subsp. aureus N315
aaaguugcacuugguucauaa

SEQ ID NO: 2154509 - RNA, 15 nt, Staphylococcus aureus subsp. aureus N315
gagcugcuucaacua

SEQ ID NO: 2154510 - RNA, 16 nt, Staphylococcus aureus subsp. aureus N315
gagggccccaacacag

SEQ ID NO: 2154511 - RNA, 20 nt, Staphylococcus aureus subsp. aureus N315
gauaaauuuuuaguuaaagu

SEQ ID NO: 2154512 - RNA, 22 nt, Staphylococcus aureus subsp. aureus N315
gauaaauauugaacaauuuuug

SEQ ID NO: 2154513 - RNA, 22 nt, Staphylococcus aureus subsp. aureus N315
gauaaauaugauguuaaaaaau

SEQ ID NO: 2154514 - RNA, 12 nt, Staphylococcus aureus subsp. aureus N315
gaguuauaucuu

SEQ ID NO: 2154515 - RNA, 17 nt, Staphylococcus aureus subsp. aureus N315
gaguucaucuuguacag

SEQ ID NO: 2154516 - RNA, 16 nt, Staphylococcus aureus subsp. aureus N315
gaguucaauuaaauua

SEQ ID NO: 2154517 - RNA, 14 nt, Staphylococcus aureus subsp. aureus N315
gaguuaauccucau

SEQ ID NO: 2154518 - RNA, 21 nt, Staphylococcus aureus subsp. aureus N315
gaguaguucggaugagaaaug

SEQ ID NO: 2154519 - RNA, 15 nt, Staphylococcus aureus subsp. aureus N315
gaguaguuucucuac

SEQ ID NO: 2154520 - RNA, 19 nt, Staphylococcus aureus subsp. aureus N315
gaguaguuucucuacuaau

SEQ ID NO: 2154521 - RNA, 20 nt, Staphylococcus aureus subsp. aureus N315
gaguauacuuacugaaacua

SEQ ID NO: 2154522 - RNA, 21 nt, Staphylococcus aureus subsp. aureus N315
gaguauccugauuuaauguua

SEQ ID NO: 2154523 - RNA, 18 nt, Staphylococcus aureus subsp. aureus N315
gaguaucaugcuuuuaau

SEQ ID NO: 2154524 - RNA, 15 nt, Staphylococcus aureus subsp. aureus N315
gaguauauucgcuaa

SEQ ID NO: 2154525 - RNA, 22 nt, Staphylococcus aureus subsp. aureus N315
gaguagcccuauuuuuaaugua

SEQ ID NO: 2154526 - RNA, 14 nt, Staphylococcus aureus subsp. aureus N315
gagucuuauuuuua

SEQ ID NO: 2154527 - RNA, 15 nt, Staphylococcus aureus subsp. aureus N315
gagugaaaauaagau

SEQ ID NO: 2154528 - RNA, 21 nt, Staphylococcus aureus subsp. aureus N315
gauaucuaagucgauaaguuu

SEQ ID NO: 2154529 - RNA, 15 nt, Staphylococcus aureus subsp. aureus N315
gauaucugaaguaga

SEQ ID NO: 2154530 - RNA, 20 nt, Staphylococcus aureus subsp. aureus N315
gauaucugacauuucaucaa

SEQ ID NO: 2154531 - RNA, 16 nt, Staphylococcus aureus subsp. aureus N315
gauauuaggcuuaaau

SEQ ID NO: 2154532 - RNA, 20 nt, Staphylococcus aureus subsp. aureus N315
gauauucauguucuuguaau

SEQ ID NO: 2154533 - RNA, 19 nt, Staphylococcus aureus subsp. aureus N315
gauauucuaaaaaauuaaa

SEQ ID NO: 2154534 - RNA, 20 nt, Staphylococcus aureus subsp. aureus N315
gauauugaccaccuguaucu

SEQ ID NO: 2154535 - RNA, 16 nt, Staphylococcus aureus subsp. aureus N315
gauauugaucugauuu

SEQ ID NO: 2154536 - RNA, 18 nt, Staphylococcus aureus subsp. aureus N315
gauauuucuaaauugucg

SEQ ID NO: 2154537 - RNA, 23 nt, Staphylococcus aureus subsp. aureus N315
gauauuucaacuuuuuaauaaua

SEQ ID NO: 2154538 - RNA, 18 nt, Staphylococcus aureus subsp. aureus N315
gauauuucaucugacuga

SEQ ID NO: 2154539 - RNA, 15 nt, Staphylococcus aureus subsp. aureus N315
gauauuuccaaauug

SEQ ID NO: 2154540 - RNA, 13 nt, Staphylococcus aureus subsp. aureus N315
gauauuuaacaaa

SEQ ID NO: 2154541 - RNA, 23 nt, Staphylococcus aureus subsp. aureus N315
gauauuuaacaaaauuaagaaga

SEQ ID NO: 2154542 - RNA, 19 nt, Staphylococcus aureus subsp. aureus N315
gauagcggauuuauuuuuu

SEQ ID NO: 2154543 - RNA, 18 nt, Staphylococcus aureus subsp. aureus N315
gauagccguuaacaucag

SEQ ID NO: 2154544 - RNA, 14 nt, Staphylococcus aureus subsp. aureus N315
gauagccuuuucua

SEQ ID NO: 2154545 - RNA, 14 nt, Staphylococcus aureus subsp. aureus N315
gauauaaacauuua

SEQ ID NO: 2154546 - RNA, 19 nt, Staphylococcus aureus subsp. aureus N315
gauauaagauucauauuua

SEQ ID NO: 2154547 - RNA, 17 nt, Staphylococcus aureus subsp. aureus N315
gauauaaugaaguuaug

SEQ ID NO: 2154548 - RNA, 20 nt, Staphylococcus aureus subsp. aureus N315
gauaccuaagcugauuaaaa

SEQ ID NO: 2154549 - RNA, 16 nt, Staphylococcus aureus subsp. aureus N315
gauacuaauaucuucu

SEQ ID NO: 2154550 - RNA, 16 nt, Staphylococcus aureus subsp. aureus N315
gauaaucguuaaaaca

SEQ ID NO: 2154551 - RNA, 15 nt, Staphylococcus aureus subsp. aureus N315
gauaaugcaccugug

SEQ ID NO: 2154552 - RNA, 21 nt, Staphylococcus aureus subsp. aureus N315
gauaaugcaccugugauaacu

SEQ ID NO: 2154553 - RNA, 18 nt, Staphylococcus aureus subsp. aureus N315
gauaauacuguuuaaaua

SEQ ID NO: 2154554 - RNA, 23 nt, Staphylococcus aureus subsp. aureus N315
gauaauagccauucgaugcuaaa

SEQ ID NO: 2154555 - RNA, 18 nt, Staphylococcus aureus subsp. aureus N315
gauaauaaggaagcguau

SEQ ID NO: 2154556 - RNA, 19 nt, Staphylococcus aureus subsp. aureus N315
gauaacagcuacaaauaau

SEQ ID NO: 2154557 - RNA, 21 nt, Staphylococcus aureus subsp. aureus N315
gauaacagcuacaaauaauga

SEQ ID NO: 2154558 - RNA, 19 nt, Staphylococcus aureus subsp. aureus N315
gauaccaaauauauuuuua

SEQ ID NO: 2154559 - RNA, 16 nt, Staphylococcus aureus subsp. aureus N315
gauaccaaacugccua

SEQ ID NO: 2154560 - RNA, 23 nt, Staphylococcus aureus subsp. aureus N315
gauacauauucucugcuucuaaa

SEQ ID NO: 2154561 - RNA, 14 nt, Staphylococcus aureus subsp. aureus N315
gauacauaaaacau

SEQ ID NO: 2154562 - RNA, 23 nt, Staphylococcus aureus subsp. aureus N315
gauaauuucuucuucuguaauau

SEQ ID NO: 2154563 - RNA, 15 nt, Staphylococcus aureus subsp. aureus N315
gauaauuuuuaacag

SEQ ID NO: 2154564 - RNA, 21 nt, Staphylococcus aureus subsp. aureus N315
aaagcaucuucaauauuuaaa

SEQ ID NO: 2154565 - RNA, 22 nt, Staphylococcus aureus subsp. aureus N315
aaagcaucuucaauauuuaaau

SEQ ID NO: 2154566 - RNA, 17 nt, Staphylococcus aureus subsp. aureus N315
aaagcaguuaaugaauc

SEQ ID NO: 2154567 - RNA, 17 nt, Staphylococcus aureus subsp. aureus N315
aaagcagucgaacaaug

SEQ ID NO: 2154568 - RNA, 21 nt, Staphylococcus aureus subsp. aureus N315
gauacacguaacgcaguugaa

SEQ ID NO: 2154569 - RNA, 12 nt, Staphylococcus aureus subsp. aureus N315
aaagcaucuuua

SEQ ID NO: 2154570 - RNA, 23 nt, Staphylococcus aureus subsp. aureus N315
aaagcaucuucaauauuuaaauu

SEQ ID NO: 2154571 - RNA, 22 nt, Staphylococcus aureus subsp. aureus N315
gagccauuauuauuuuuuucuu

SEQ ID NO: 2154572 - RNA, 20 nt, Staphylococcus aureus subsp. aureus N315
gagaugaggcgauaaaagaa

SEQ ID NO: 2154573 - RNA, 15 nt, Staphylococcus aureus subsp. aureus N315
gagcaauucuucaau

SEQ ID NO: 2154574 - RNA, 14 nt, Staphylococcus aureus subsp. aureus N315
gagcacgagaaaug

SEQ ID NO: 2154575 - RNA, 15 nt, Staphylococcus aureus subsp. aureus N315
gagcacuaucuuuug

SEQ ID NO: 2154576 - RNA, 19 nt, Staphylococcus aureus subsp. aureus N315
gagcacuaucuuuugcuuc

SEQ ID NO: 2154577 - RNA, 14 nt, Staphylococcus aureus subsp. aureus N315
gagcaguauuuuuu

SEQ ID NO: 2154578 - RNA, 14 nt, Staphylococcus aureus subsp. aureus N315
gagauauaaaggaa

SEQ ID NO: 2154579 - RNA, 17 nt, Staphylococcus aureus subsp. aureus N315
gagagauguauaaaacu

SEQ ID NO: 2154580 - RNA, 12 nt, Staphylococcus aureus subsp. aureus N315
gagaaucuccau

SEQ ID NO: 2154581 - RNA, 15 nt, Staphylococcus aureus subsp. aureus N315
gagacaaguauacuu

SEQ ID NO: 2154582 - RNA, 14 nt, Staphylococcus aureus subsp. aureus N315
gagacaacauuguu

SEQ ID NO: 2154583 - RNA, 18 nt, Staphylococcus aureus subsp. aureus N315
gagacaaaaauaaaccau

SEQ ID NO: 2154584 - RNA, 19 nt, Staphylococcus aureus subsp. aureus N315
gagaauuucgaaaagaaau

SEQ ID NO: 2154585 - RNA, 17 nt, Staphylococcus aureus subsp. aureus N315
gagaaugugcuuguaac

SEQ ID NO: 2154586 - RNA, 14 nt, Staphylococcus aureus subsp. aureus N315
gagaaccuuuaaaa

SEQ ID NO: 2154587 - RNA, 19 nt, Staphylococcus aureus subsp. aureus N315
aaagcaaauuauauagaaa

SEQ ID NO: 2154588 - RNA, 17 nt, Staphylococcus aureus subsp. aureus N315
gacuuuuagauuaucuu

SEQ ID NO: 2154589 - RNA, 21 nt, Staphylococcus aureus subsp. aureus N315
gacuuuuagauuaucuuucaa

SEQ ID NO: 2154590 - RNA, 18 nt, Staphylococcus aureus subsp. aureus N315
gacuuauuuuucaucauu

SEQ ID NO: 2154591 - RNA, 14 nt, Staphylococcus aureus subsp. aureus N315
gacuuauuuuucau

SEQ ID NO: 2154592 - RNA, 23 nt, Staphylococcus aureus subsp. aureus N315
gacuuaauaucauauucaaaaua

SEQ ID NO: 2154593 - RNA, 18 nt, Staphylococcus aureus subsp. aureus N315
gacuuuaaaucuuguucu

SEQ ID NO: 2154594 - RNA, 15 nt, Staphylococcus aureus subsp. aureus N315
gacuuugucauacua

SEQ ID NO: 2154595 - RNA, 16 nt, Staphylococcus aureus subsp. aureus N315
gacuugauagcauuuc

SEQ ID NO: 2154596 - RNA, 14 nt, Staphylococcus aureus subsp. aureus N315
gacuucuuuauauu

SEQ ID NO: 2154597 - RNA, 18 nt, Staphylococcus aureus subsp. aureus N315
gacuucuaucuucacacu

SEQ ID NO: 2154598 - RNA, 15 nt, Staphylococcus aureus subsp. aureus N315
gacuuggugcccaag

SEQ ID NO: 2154599 - RNA, 16 nt, Staphylococcus aureus subsp. aureus N315
gacuuggugcccaagu

SEQ ID NO: 2154600 - RNA, 11 nt, Staphylococcus aureus subsp. aureus N315
gacugaaagaa

SEQ ID NO: 2154601 - RNA, 16 nt, Staphylococcus aureus subsp. aureus N315
gacucuccaaauauug

SEQ ID NO: 2154602 - RNA, 16 nt, Staphylococcus aureus subsp. aureus N315
gacucuccuuuuuuaa

SEQ ID NO: 2154603 - RNA, 16 nt, Staphylococcus aureus subsp. aureus N315
gacguuuuuuuauaaa

SEQ ID NO: 2154604 - RNA, 12 nt, Staphylococcus aureus subsp. aureus N315
gacguuuuccau

SEQ ID NO: 2154605 - RNA, 14 nt, Staphylococcus aureus subsp. aureus N315
gacuguagaaaaca

SEQ ID NO: 2154606 - RNA, 15 nt, Staphylococcus aureus subsp. aureus N315
gacugacuaauaaaa

SEQ ID NO: 2154607 - RNA, 15 nt, Staphylococcus aureus subsp. aureus N315
gacugaacgaaaaug

SEQ ID NO: 2154608 - RNA, 20 nt, Staphylococcus aureus subsp. aureus N315
gaccuucaauaucuucagcu

SEQ ID NO: 2154609 - RNA, 21 nt, Staphylococcus aureus subsp. aureus N315
gaccucagguuguuaggggcu

SEQ ID NO: 2154610 - RNA, 15 nt, Staphylococcus aureus subsp. aureus N315
gaccuacuuuuucaa

SEQ ID NO: 2154611 - RNA, 23 nt, Staphylococcus aureus subsp. aureus N315
gacccuugucaguuuuuuuauaa

SEQ ID NO: 2154612 - RNA, 16 nt, Staphylococcus aureus subsp. aureus N315
gacauaugcagugacu

SEQ ID NO: 2154613 - RNA, 22 nt, Staphylococcus aureus subsp. aureus N315
gacaucgucuucuuuuuguccc

SEQ ID NO: 2154614 - RNA, 23 nt, Staphylococcus aureus subsp. aureus N315
gacauuaaugauagcaaugaauu

SEQ ID NO: 2154615 - RNA, 20 nt, Staphylococcus aureus subsp. aureus N315
gacauucauuuaguuaaaua

SEQ ID NO: 2154616 - RNA, 17 nt, Staphylococcus aureus subsp. aureus N315
gacaguuuuaaaugaaa

SEQ ID NO: 2154617 - RNA, 11 nt, Staphylococcus aureus subsp. aureus N315
gacaguuuuua

SEQ ID NO: 2154618 - RNA, 16 nt, Staphylococcus aureus subsp. aureus N315
gacauaaaacuuacau

SEQ ID NO: 2154619 - RNA, 14 nt, Staphylococcus aureus subsp. aureus N315
gacauaaaaaauaa

SEQ ID NO: 2154620 - RNA, 19 nt, Staphylococcus aureus subsp. aureus N315
gacagcuacaauuuucuca

SEQ ID NO: 2154621 - RNA, 18 nt, Staphylococcus aureus subsp. aureus N315
gacacuuaacuuguguua

SEQ ID NO: 2154622 - RNA, 22 nt, Staphylococcus aureus subsp. aureus N315
gacagcaguaggauaauuucaa

SEQ ID NO: 2154623 - RNA, 13 nt, Staphylococcus aureus subsp. aureus N315
gacauugaauaaa

SEQ ID NO: 2154624 - RNA, 13 nt, Staphylococcus aureus subsp. aureus N315
gaccaaguaugag

SEQ ID NO: 2154625 - RNA, 18 nt, Staphylococcus aureus subsp. aureus N315
gaccagucgcauauuuug

SEQ ID NO: 2154626 - RNA, 21 nt, Staphylococcus aureus subsp. aureus N315
gaccauugucaugccuucauu

SEQ ID NO: 2154627 - RNA, 13 nt, Staphylococcus aureus subsp. aureus N315
gaauuuuaauaua

SEQ ID NO: 2154628 - RNA, 12 nt, Staphylococcus aureus subsp. aureus N315
gaauuuuauaaa

SEQ ID NO: 2154629 - RNA, 23 nt, Staphylococcus aureus subsp. aureus N315
gaauuucguuauuaaacuacgaa

SEQ ID NO: 2154630 - RNA, 18 nt, Staphylococcus aureus subsp. aureus N315
gaauuucuaauuaaacgc

SEQ ID NO: 2154631 - RNA, 19 nt, Staphylococcus aureus subsp. aureus N315
gaauuucguuauuaaacua

SEQ ID NO: 2154632 - RNA, 13 nt, Staphylococcus aureus subsp. aureus N315
gaauugaguauua

SEQ ID NO: 2154633 - RNA, 13 nt, Staphylococcus aureus subsp. aureus N315
gaauucucgauuu

SEQ ID NO: 2154634 - RNA, 21 nt, Staphylococcus aureus subsp. aureus N315
gaauucuaaaagaauuauuca

SEQ ID NO: 2154635 - RNA, 22 nt, Staphylococcus aureus subsp. aureus N315
gaauucaaccaauuauuaaagc

SEQ ID NO: 2154636 - RNA, 22 nt, Staphylococcus aureus subsp. aureus N315
gaauucaacgucgaauguuucu

SEQ ID NO: 2154637 - RNA, 13 nt, Staphylococcus aureus subsp. aureus N315
gaauucauucaau

SEQ ID NO: 2154638 - RNA, 18 nt, Staphylococcus aureus subsp. aureus N315
gaauucacgcaauaucau

SEQ ID NO: 2154639 - RNA, 14 nt, Staphylococcus aureus subsp. aureus N315
gaauggcaaauaug

SEQ ID NO: 2154640 - RNA, 20 nt, Staphylococcus aureus subsp. aureus N315
gacaaucgcuugcuucuuuc

SEQ ID NO: 2154641 - RNA, 15 nt, Staphylococcus aureus subsp. aureus N315
gacaacugauuuaau

SEQ ID NO: 2154642 - RNA, 18 nt, Staphylococcus aureus subsp. aureus N315
gacaaauguucuauagaa

SEQ ID NO: 2154643 - RNA, 17 nt, Staphylococcus aureus subsp. aureus N315
aaagaugauauauucau

SEQ ID NO: 2154644 - RNA, 17 nt, Staphylococcus aureus subsp. aureus N315
aaagaugaaaaucuuua

SEQ ID NO: 2154645 - RNA, 21 nt, Staphylococcus aureus subsp. aureus N315
aaagaugaaaaucuuuaacuc

SEQ ID NO: 2154646 - RNA, 13 nt, Staphylococcus aureus subsp. aureus N315
gaauacuuuuuaa

SEQ ID NO: 2154647 - RNA, 18 nt, Staphylococcus aureus subsp. aureus N315
gaauacucuucaaucuac

SEQ ID NO: 2154648 - RNA, 20 nt, Staphylococcus aureus subsp. aureus N315
gaauacucuucaaucuacca

SEQ ID NO: 2154649 - RNA, 17 nt, Staphylococcus aureus subsp. aureus N315
gaauacuuuauuugaua

SEQ ID NO: 2154650 - RNA, 19 nt, Staphylococcus aureus subsp. aureus N315
gaauauacuuaauuuaaau

SEQ ID NO: 2154651 - RNA, 22 nt, Staphylococcus aureus subsp. aureus N315
gaauauaaguaaucauaauaau

SEQ ID NO: 2154652 - RNA, 17 nt, Staphylococcus aureus subsp. aureus N315
gaauauagcugugauuu

SEQ ID NO: 2154653 - RNA, 23 nt, Staphylococcus aureus subsp. aureus N315
aaagaugguuuuguuuugcucuu

SEQ ID NO: 2154654 - RNA, 23 nt, Staphylococcus aureus subsp. aureus N315
gaauauaacaacuacuuaaauua

SEQ ID NO: 2154655 - RNA, 15 nt, Staphylococcus aureus subsp. aureus N315
gaauauaaaaaacac

SEQ ID NO: 2154656 - RNA, 21 nt, Staphylococcus aureus subsp. aureus N315
gaauauuguauugaucuacau

SEQ ID NO: 2154657 - RNA, 23 nt, Staphylococcus aureus subsp. aureus N315
gaauauuaacguuaguauaaacg

SEQ ID NO: 2154658 - RNA, 18 nt, Staphylococcus aureus subsp. aureus N315
gaauaucuuaaagaauua

SEQ ID NO: 2154659 - RNA, 23 nt, Staphylococcus aureus subsp. aureus N315
gaauaugaauugcuuguuuuaaa

SEQ ID NO: 2154660 - RNA, 21 nt, Staphylococcus aureus subsp. aureus N315
gaauaugaauugcuuguuuua

SEQ ID NO: 2154661 - RNA, 19 nt, Staphylococcus aureus subsp. aureus N315
gaauccuaugccaaauaac

SEQ ID NO: 2154662 - RNA, 14 nt, Staphylococcus aureus subsp. aureus N315
gaaucuagaauaua

SEQ ID NO: 2154663 - RNA, 14 nt, Staphylococcus aureus subsp. aureus N315
gaaugauuuauaaa

SEQ ID NO: 2154664 - RNA, 13 nt, Staphylococcus aureus subsp. aureus N315
gaaugaugaguau

SEQ ID NO: 2154665 - RNA, 22 nt, Staphylococcus aureus subsp. aureus N315
gaaguugcucgcgcucuucuuc

SEQ ID NO: 2154666 - RNA, 13 nt, Staphylococcus aureus subsp. aureus N315
aaagauauacuua

SEQ ID NO: 2154667 - RNA, 14 nt, Staphylococcus aureus subsp. aureus N315
aaagauauaaacau

SEQ ID NO: 2154668 - RNA, 18 nt, Staphylococcus aureus subsp. aureus N315
gaauaauguuuucauugg

SEQ ID NO: 2154669 - RNA, 21 nt, Staphylococcus aureus subsp. aureus N315
gaauaaauuuugcgaaaauau

SEQ ID NO: 2154670 - RNA, 13 nt, Staphylococcus aureus subsp. aureus N315
gaauaacaagaaa

SEQ ID NO: 2154671 - RNA, 14 nt, Staphylococcus aureus subsp. aureus N315
gaauacuaaaagug

SEQ ID NO: 2154672 - RNA, 18 nt, Staphylococcus aureus subsp. aureus N315
gaauaauuuuaaaaauaa

SEQ ID NO: 2154673 - RNA, 23 nt, Staphylococcus aureus subsp. aureus N315
gaauaauuagauuuaaaauguca

SEQ ID NO: 2154674 - RNA, 18 nt, Staphylococcus aureus subsp. aureus N315
gaagcugucuuacugcug

SEQ ID NO: 2154675 - RNA, 20 nt, Staphylococcus aureus subsp. aureus N315
gaagcaguuguugguuuugc

SEQ ID NO: 2154676 - RNA, 17 nt, Staphylococcus aureus subsp. aureus N315
gaagcaaaagaugaaaa

SEQ ID NO: 2154677 - RNA, 18 nt, Staphylococcus aureus subsp. aureus N315
gaagcaaaagaugaaaau

SEQ ID NO: 2154678 - RNA, 16 nt, Staphylococcus aureus subsp. aureus N315
gaacaucugaaaaaau

SEQ ID NO: 2154679 - RNA, 14 nt, Staphylococcus aureus subsp. aureus N315
gaacaucuaguuau

SEQ ID NO: 2154680 - RNA, 11 nt, Staphylococcus aureus subsp. aureus N315
gaacaucuaau

SEQ ID NO: 2154681 - RNA, 18 nt, Staphylococcus aureus subsp. aureus N315
gaacaugguaucuuuaau

SEQ ID NO: 2154682 - RNA, 20 nt, Staphylococcus aureus subsp. aureus N315
gaagaccacuauuuuuaaau

SEQ ID NO: 2154683 - RNA, 13 nt, Staphylococcus aureus subsp. aureus N315
gaagaccauuuua

SEQ ID NO: 2154684 - RNA, 14 nt, Staphylococcus aureus subsp. aureus N315
gaagagaugaaaga

SEQ ID NO: 2154685 - RNA, 21 nt, Staphylococcus aureus subsp. aureus N315
gaaagguauaucuucauuuaa

SEQ ID NO: 2154686 - RNA, 22 nt, Staphylococcus aureus subsp. aureus N315
gaaaguugguuuuauuaauucu

SEQ ID NO: 2154687 - RNA, 16 nt, Staphylococcus aureus subsp. aureus N315
gaaauauauugucgac

SEQ ID NO: 2154688 - RNA, 21 nt, Staphylococcus aureus subsp. aureus N315
gaaauagguaucuuaaagcau

SEQ ID NO: 2154689 - RNA, 23 nt, Staphylococcus aureus subsp. aureus N315
gaaauauaccaaccaaaaccaaa

SEQ ID NO: 2154690 - RNA, 18 nt, Staphylococcus aureus subsp. aureus N315
gaaauaggcgcuuguaaa

SEQ ID NO: 2154691 - RNA, 21 nt, Staphylococcus aureus subsp. aureus N315
gaaauaggcgcuuguaaaauu

SEQ ID NO: 2154692 - RNA, 19 nt, Staphylococcus aureus subsp. aureus N315
gaaaguuucgacguaccaa

SEQ ID NO: 2154693 - RNA, 15 nt, Staphylococcus aureus subsp. aureus N315
gaaaucauauauuuc

SEQ ID NO: 2154694 - RNA, 13 nt, Staphylococcus aureus subsp. aureus N315
gaaacuuguccgu

SEQ ID NO: 2154695 - RNA, 15 nt, Staphylococcus aureus subsp. aureus N315
gaaacuuuaauacua

SEQ ID NO: 2154696 - RNA, 20 nt, Staphylococcus aureus subsp. aureus N315
gaaacuuucguauuuuucuu

SEQ ID NO: 2154697 - RNA, 21 nt, Staphylococcus aureus subsp. aureus N315
gaaacuuucguauuuuucuug

SEQ ID NO: 2154698 - RNA, 19 nt, Staphylococcus aureus subsp. aureus N315
gaacagcggaauacagaug

SEQ ID NO: 2154699 - RNA, 21 nt, Staphylococcus aureus subsp. aureus N315
gaacagauauacuacuuguuu

SEQ ID NO: 2154700 - RNA, 17 nt, Staphylococcus aureus subsp. aureus N315
gaaauuagaaccaucau

SEQ ID NO: 2154701 - RNA, 18 nt, Staphylococcus aureus subsp. aureus N315
gaaauuacuuuaacaguu

SEQ ID NO: 2154702 - RNA, 21 nt, Staphylococcus aureus subsp. aureus N315
gaaauguuuaucaauucccug

SEQ ID NO: 2154703 - RNA, 18 nt, Staphylococcus aureus subsp. aureus N315
gaaauguuuuggaaaaau

SEQ ID NO: 2154704 - RNA, 13 nt, Staphylococcus aureus subsp. aureus N315
gaaauuaaauuca

SEQ ID NO: 2154705 - RNA, 13 nt, Staphylococcus aureus subsp. aureus N315
gaaauuuauuaua

SEQ ID NO: 2154706 - RNA, 16 nt, Staphylococcus aureus subsp. aureus N315
gaaauuuauuauaauu

SEQ ID NO: 2154707 - RNA, 21 nt, Staphylococcus aureus subsp. aureus N315
gaaauuuauuauaaaauagaa

SEQ ID NO: 2154708 - RNA, 13 nt, Staphylococcus aureus subsp. aureus N315
gaaauggaaagua

SEQ ID NO: 2154709 - RNA, 18 nt, Staphylococcus aureus subsp. aureus N315
gaaaucucggcauuuuua

SEQ ID NO: 2154710 - RNA, 14 nt, Staphylococcus aureus subsp. aureus N315
cuuuuaauuuuuuu

SEQ ID NO: 2154711 - RNA, 18 nt, Staphylococcus aureus subsp. aureus N315
cuuuuaauuuuuuuagcu

SEQ ID NO: 2154712 - RNA, 16 nt, Staphylococcus aureus subsp. aureus N315
cuuuuagaguuuuuau

SEQ ID NO: 2154713 - RNA, 18 nt, Staphylococcus aureus subsp. aureus N315
cuuuuagauuaucuuuca

SEQ ID NO: 2154714 - RNA, 15 nt, Staphylococcus aureus subsp. aureus N315
cuuuuauauuuuuau

SEQ ID NO: 2154715 - RNA, 20 nt, Staphylococcus aureus subsp. aureus N315
cuuuuauccaauguauaaaa

SEQ ID NO: 2154716 - RNA, 21 nt, Staphylococcus aureus subsp. aureus N315
cuuuuauccaauguauaaaac

SEQ ID NO: 2154717 - RNA, 14 nt, Staphylococcus aureus subsp. aureus N315
cuuuugauuuugaa

SEQ ID NO: 2154718 - RNA, 15 nt, Staphylococcus aureus subsp. aureus N315
cuuuugauagcuaau

SEQ ID NO: 2154719 - RNA, 13 nt, Staphylococcus aureus subsp. aureus N315
cuuuugauagcua

SEQ ID NO: 2154720 - RNA, 23 nt, Staphylococcus aureus subsp. aureus N315
cuuuuuagccccagcaaauacuu

SEQ ID NO: 2154721 - RNA, 21 nt, Staphylococcus aureus subsp. aureus N315
cuuuuuaggaaugauagauuu

SEQ ID NO: 2154722 - RNA, 17 nt, Staphylococcus aureus subsp. aureus N315
cuuuuuagccccagcaa

SEQ ID NO: 2154723 - RNA, 13 nt, Staphylococcus aureus subsp. aureus N315
cuuuuuacauuuu

SEQ ID NO: 2154724 - RNA, 21 nt, Staphylococcus aureus subsp. aureus N315
cuuuuuacuaggaauauaaaa

SEQ ID NO: 2154725 - RNA, 13 nt, Staphylococcus aureus subsp. aureus N315
cuuuuuauauaau

SEQ ID NO: 2154726 - RNA, 15 nt, Staphylococcus aureus subsp. aureus N315
cuuuuuauaucaaaa

SEQ ID NO: 2154727 - RNA, 22 nt, Staphylococcus aureus subsp. aureus N315
cuuuuuaucaugauuaauuaaa

SEQ ID NO: 2154728 - RNA, 21 nt, Staphylococcus aureus subsp. aureus N315
cuuuuuaacuauguuacuuau

SEQ ID NO: 2154729 - RNA, 21 nt, Staphylococcus aureus subsp. aureus N315
cuuuuuaaaaucguuaaggaa

SEQ ID NO: 2154730 - RNA, 15 nt, Staphylococcus aureus subsp. aureus N315
cuuuuuaaaaucguu

SEQ ID NO: 2154731 - RNA, 23 nt, Staphylococcus aureus subsp. aureus N315
cuuuuuaaacguacauuuuuaug

SEQ ID NO: 2154732 - RNA, 12 nt, Staphylococcus aureus subsp. aureus N315
cuuuuuaaagga

SEQ ID NO: 2154733 - RNA, 21 nt, Staphylococcus aureus subsp. aureus N315
cuuuuguaaagcuuuaguuaa

SEQ ID NO: 2154734 - RNA, 17 nt, Staphylococcus aureus subsp. aureus N315
gaaaaacuguaaaucau

SEQ ID NO: 2154735 - RNA, 14 nt, Staphylococcus aureus subsp. aureus N315
gaaaaacuuuucau

SEQ ID NO: 2154736 - RNA, 18 nt, Staphylococcus aureus subsp. aureus N315
gaaaaacugcucauugug

SEQ ID NO: 2154737 - RNA, 19 nt, Staphylococcus aureus subsp. aureus N315
gaaaaaccaaguuuugcac

SEQ ID NO: 2154738 - RNA, 19 nt, Staphylococcus aureus subsp. aureus N315
gaaaaaccugggacauuaa

SEQ ID NO: 2154739 - RNA, 15 nt, Staphylococcus aureus subsp. aureus N315
cuuuuugcuuaguac

SEQ ID NO: 2154740 - RNA, 17 nt, Staphylococcus aureus subsp. aureus N315
cuuuuugcguuuuuaaa

SEQ ID NO: 2154741 - RNA, 16 nt, Staphylococcus aureus subsp. aureus N315
cuuuuugaucaacuau

SEQ ID NO: 2154742 - RNA, 17 nt, Staphylococcus aureus subsp. aureus N315
cuuuuugacucagaauc

SEQ ID NO: 2154743 - RNA, 20 nt, Staphylococcus aureus subsp. aureus N315
cuuuuugacucagaaucuua

SEQ ID NO: 2154744 - RNA, 16 nt, Staphylococcus aureus subsp. aureus N315
cuuuuuccauuuuuuu

SEQ ID NO: 2154745 - RNA, 15 nt, Staphylococcus aureus subsp. aureus N315
cuuuuucauagaaca

SEQ ID NO: 2154746 - RNA, 15 nt, Staphylococcus aureus subsp. aureus N315
cuuuuucacauugcc

SEQ ID NO: 2154747 - RNA, 12 nt, Staphylococcus aureus subsp. aureus N315
cuuuuucacauu

SEQ ID NO: 2154748 - RNA, 22 nt, Staphylococcus aureus subsp. aureus N315
cuuuuucacgauuuuuaaaaug

SEQ ID NO: 2154749 - RNA, 17 nt, Staphylococcus aureus subsp. aureus N315
gaaacauuauauaacac

SEQ ID NO: 2154750 - RNA, 21 nt, Staphylococcus aureus subsp. aureus N315
gaaaccgcuucucgccuaauu

SEQ ID NO: 2154751 - RNA, 21 nt, Staphylococcus aureus subsp. aureus N315
gaaaccuuucgauaaacuaca

SEQ ID NO: 2154752 - RNA, 16 nt, Staphylococcus aureus subsp. aureus N315
gaaacacacuaaaagc

SEQ ID NO: 2154753 - RNA, 13 nt, Staphylococcus aureus subsp. aureus N315
gaaacaaauuagu

SEQ ID NO: 2154754 - RNA, 16 nt, Staphylococcus aureus subsp. aureus N315
gaaacaucuugauauu

SEQ ID NO: 2154755 - RNA, 11 nt, Staphylococcus aureus subsp. aureus N315
gaaaaauaauu

SEQ ID NO: 2154756 - RNA, 12 nt, Staphylococcus aureus subsp. aureus N315
gaaaaauuaaaa

SEQ ID NO: 2154757 - RNA, 20 nt, Staphylococcus aureus subsp. aureus N315
gaaaaauuucaaaaauagcg

SEQ ID NO: 2154758 - RNA, 20 nt, Staphylococcus aureus subsp. aureus N315
gaaaagggaauggauuacag

SEQ ID NO: 2154759 - RNA, 20 nt, Staphylococcus aureus subsp. aureus N315
gaaaaggucaaaaaauuaau

SEQ ID NO: 2154760 - RNA, 19 nt, Staphylococcus aureus subsp. aureus N315
gaaaagucagcuuacaaua

SEQ ID NO: 2154761 - RNA, 15 nt, Staphylococcus aureus subsp. aureus N315
gaaaaguauaaauau

SEQ ID NO: 2154762 - RNA, 18 nt, Staphylococcus aureus subsp. aureus N315
gaaaauagcuauuaaaau

SEQ ID NO: 2154763 - RNA, 19 nt, Staphylococcus aureus subsp. aureus N315
gaaaauagcuauuaaaaua

SEQ ID NO: 2154764 - RNA, 21 nt, Staphylococcus aureus subsp. aureus N315
gaaaauagcuauuaaaauaga

SEQ ID NO: 2154765 - RNA, 14 nt, Staphylococcus aureus subsp. aureus N315
gaaaauaaaaacca

SEQ ID NO: 2154766 - RNA, 22 nt, Staphylococcus aureus subsp. aureus N315
gaaaaguuuuuuacuuuucauc

SEQ ID NO: 2154767 - RNA, 16 nt, Staphylococcus aureus subsp. aureus N315
gaaaaguuacagugua

SEQ ID NO: 2154768 - RNA, 18 nt, Staphylococcus aureus subsp. aureus N315
gaaaagugaaaacuucuc

SEQ ID NO: 2154769 - RNA, 13 nt, Staphylococcus aureus subsp. aureus N315
gaaaauaugauaa

SEQ ID NO: 2154770 - RNA, 13 nt, Staphylococcus aureus subsp. aureus N315
gaaaauagcuguu

SEQ ID NO: 2154771 - RNA, 12 nt, Staphylococcus aureus subsp. aureus N315
gaaaauuaacuc

SEQ ID NO: 2154772 - RNA, 22 nt, Staphylococcus aureus subsp. aureus N315
gaaaauuacuuagcaaacaauu

SEQ ID NO: 2154773 - RNA, 17 nt, Staphylococcus aureus subsp. aureus N315
gaaaauucgcuuguaac

SEQ ID NO: 2154774 - RNA, 22 nt, Staphylococcus aureus subsp. aureus N315
gaaaauucgcuuguaacaagcu

SEQ ID NO: 2154775 - RNA, 14 nt, Staphylococcus aureus subsp. aureus N315
gaaaauugcuaaaa

SEQ ID NO: 2154776 - RNA, 19 nt, Staphylococcus aureus subsp. aureus N315
cuuucaaaugcuuaauaaa

SEQ ID NO: 2154777 - RNA, 18 nt, Staphylococcus aureus subsp. aureus N315
cuuucaaauauaucuaau

SEQ ID NO: 2154778 - RNA, 12 nt, Staphylococcus aureus subsp. aureus N315
cuuuauuuucuu

SEQ ID NO: 2154779 - RNA, 13 nt, Staphylococcus aureus subsp. aureus N315
cuuuacuuucauu

SEQ ID NO: 2154780 - RNA, 14 nt, Staphylococcus aureus subsp. aureus N315
cuuuacuuucauua

SEQ ID NO: 2154781 - RNA, 23 nt, Staphylococcus aureus subsp. aureus N315
cuuuacuugcuuuuucaaauaau

SEQ ID NO: 2154782 - RNA, 19 nt, Staphylococcus aureus subsp. aureus N315
cuuuagucgguguuuucuu

SEQ ID NO: 2154783 - RNA, 13 nt, Staphylococcus aureus subsp. aureus N315
cuuuagguaaaag

SEQ ID NO: 2154784 - RNA, 12 nt, Staphylococcus aureus subsp. aureus N315
cuuuaguuacua

SEQ ID NO: 2154785 - RNA, 18 nt, Staphylococcus aureus subsp. aureus N315
cuuuaguuguuaggggcu

SEQ ID NO: 2154786 - RNA, 20 nt, Staphylococcus aureus subsp. aureus N315
cuuuauaacgcuuuaauaua

SEQ ID NO: 2154787 - RNA, 18 nt, Staphylococcus aureus subsp. aureus N315
cuuuauaagcuuuuucuu

SEQ ID NO: 2154788 - RNA, 15 nt, Staphylococcus aureus subsp. aureus N315
cuuuauuugauucuu

SEQ ID NO: 2154789 - RNA, 18 nt, Staphylococcus aureus subsp. aureus N315
cuuuauuuuaaacaugaa

SEQ ID NO: 2154790 - RNA, 15 nt, Staphylococcus aureus subsp. aureus N315
cuuuauuuucaguua

SEQ ID NO: 2154791 - RNA, 22 nt, Staphylococcus aureus subsp. aureus N315
cuuuauuuucuuguguauuuuu

SEQ ID NO: 2154792 - RNA, 23 nt, Staphylococcus aureus subsp. aureus N315
cuuuaugggagugggacagaaau

SEQ ID NO: 2154793 - RNA, 17 nt, Staphylococcus aureus subsp. aureus N315
cuuuaauuuuucauuaa

SEQ ID NO: 2154794 - RNA, 13 nt, Staphylococcus aureus subsp. aureus N315
cuuuaauuuuuug

SEQ ID NO: 2154795 - RNA, 15 nt, Staphylococcus aureus subsp. aureus N315
cuuuacuaaagauag

SEQ ID NO: 2154796 - RNA, 19 nt, Staphylococcus aureus subsp. aureus N315
cuuuacucuacacucaaac

SEQ ID NO: 2154797 - RNA, 21 nt, Staphylococcus aureus subsp. aureus N315
cuuuaacuguacgauucaauu

SEQ ID NO: 2154798 - RNA, 23 nt, Staphylococcus aureus subsp. aureus N315
cuuuaacuguacgauucaauuua

SEQ ID NO: 2154799 - RNA, 17 nt, Staphylococcus aureus subsp. aureus N315
cuuuaauugucucauca

SEQ ID NO: 2154800 - RNA, 16 nt, Staphylococcus aureus subsp. aureus N315
cuuuaauuuagugaaa

SEQ ID NO: 2154801 - RNA, 16 nt, Staphylococcus aureus subsp. aureus N315
cuuuaaguaauucauu

SEQ ID NO: 2154802 - RNA, 16 nt, Staphylococcus aureus subsp. aureus N315
aaagaauuauucaagu

SEQ ID NO: 2154803 - RNA, 20 nt, Staphylococcus aureus subsp. aureus N315
aaagaauuucgaaaagaaau

SEQ ID NO: 2154804 - RNA, 17 nt, Staphylococcus aureus subsp. aureus N315
aaagaauuucgaaaaga

SEQ ID NO: 2154805 - RNA, 18 nt, Staphylococcus aureus subsp. aureus N315
aaagaaggggagaguuaa

SEQ ID NO: 2154806 - RNA, 17 nt, Staphylococcus aureus subsp. aureus N315
aaagaauaaauguuaaa

SEQ ID NO: 2154807 - RNA, 23 nt, Staphylococcus aureus subsp. aureus N315
cuuucugaucgacuaauuuuucu

SEQ ID NO: 2154808 - RNA, 16 nt, Staphylococcus aureus subsp. aureus N315
cuuucguccaacaugu

SEQ ID NO: 2154809 - RNA, 16 nt, Staphylococcus aureus subsp. aureus N315
cuuucguauuuuucuu

SEQ ID NO: 2154810 - RNA, 21 nt, Staphylococcus aureus subsp. aureus N315
cuuugaaagaaggaauaauuu

SEQ ID NO: 2154811 - RNA, 22 nt, Staphylococcus aureus subsp. aureus N315
cuuugaaaggaauguuuaaaaa

SEQ ID NO: 2154812 - RNA, 20 nt, Staphylococcus aureus subsp. aureus N315
cuuugaagggguuuuuucuu

SEQ ID NO: 2154813 - RNA, 19 nt, Staphylococcus aureus subsp. aureus N315
cuuugaagggguuuuuucu

SEQ ID NO: 2154814 - RNA, 21 nt, Staphylococcus aureus subsp. aureus N315
cuuugaauauaguccuuccca

SEQ ID NO: 2154815 - RNA, 19 nt, Staphylococcus aureus subsp. aureus N315
cuuugaagggagcauuuca

SEQ ID NO: 2154816 - RNA, 21 nt, Staphylococcus aureus subsp. aureus N315
cuuuccucacuagauaguuua

SEQ ID NO: 2154817 - RNA, 20 nt, Staphylococcus aureus subsp. aureus N315
cuuugauaacaauuuuaaau

SEQ ID NO: 2154818 - RNA, 19 nt, Staphylococcus aureus subsp. aureus N315
cuuuuaauuguauuuucug

SEQ ID NO: 2154819 - RNA, 17 nt, Staphylococcus aureus subsp. aureus N315
cuuuggcaccaguacuu

SEQ ID NO: 2154820 - RNA, 18 nt, Staphylococcus aureus subsp. aureus N315
cuuuggacuuuaaaguua

SEQ ID NO: 2154821 - RNA, 16 nt, Staphylococcus aureus subsp. aureus N315
cuuuggacuuuaaagu

SEQ ID NO: 2154822 - RNA, 18 nt, Staphylococcus aureus subsp. aureus N315
cuuuggauuucuuuuuaa

SEQ ID NO: 2154823 - RNA, 19 nt, Staphylococcus aureus subsp. aureus N315
cuugggcugacauuuuugg

SEQ ID NO: 2154824 - RNA, 19 nt, Staphylococcus aureus subsp. aureus N315
cuuguaaauuuauuuuuaa

SEQ ID NO: 2154825 - RNA, 16 nt, Staphylococcus aureus subsp. aureus N315
cuuguaaauuuaaaug

SEQ ID NO: 2154826 - RNA, 15 nt, Staphylococcus aureus subsp. aureus N315
cuuguaaacuucuuu

SEQ ID NO: 2154827 - RNA, 13 nt, Staphylococcus aureus subsp. aureus N315
cuugguuaaaguu

SEQ ID NO: 2154828 - RNA, 15 nt, Staphylococcus aureus subsp. aureus N315
cuugucaguuuuuuu

SEQ ID NO: 2154829 - RNA, 16 nt, Staphylococcus aureus subsp. aureus N315
cuuguaccgucuuauc

SEQ ID NO: 2154830 - RNA, 18 nt, Staphylococcus aureus subsp. aureus N315
cuuguaccgucuuaucua

SEQ ID NO: 2154831 - RNA, 12 nt, Staphylococcus aureus subsp. aureus N315
cuuguaacaagc

SEQ ID NO: 2154832 - RNA, 21 nt, Staphylococcus aureus subsp. aureus N315
cuuguaacaagcuuuuuucaa

SEQ ID NO: 2154833 - RNA, 15 nt, Staphylococcus aureus subsp. aureus N315
cuuguaauauaacaa

SEQ ID NO: 2154834 - RNA, 18 nt, Staphylococcus aureus subsp. aureus N315
cuuguaauauaacaagua

SEQ ID NO: 2154835 - RNA, 15 nt, Staphylococcus aureus subsp. aureus N315
cuuguacacauccuc

SEQ ID NO: 2154836 - RNA, 13 nt, Staphylococcus aureus subsp. aureus N315
cuuggcguauuuu

SEQ ID NO: 2154837 - RNA, 16 nt, Staphylococcus aureus subsp. aureus N315
cuuggcguauuuuuug

SEQ ID NO: 2154838 - RNA, 17 nt, Staphylococcus aureus subsp. aureus N315
cuuggcgacauuuguaa

SEQ ID NO: 2154839 - RNA, 17 nt, Staphylococcus aureus subsp. aureus N315
cuuggauuuuuugguuu

SEQ ID NO: 2154840 - RNA, 22 nt, Staphylococcus aureus subsp. aureus N315
cuuggaauaauacguuuugcua

SEQ ID NO: 2154841 - RNA, 16 nt, Staphylococcus aureus subsp. aureus N315
cuuggacuaauaauug

SEQ ID NO: 2154842 - RNA, 14 nt, Staphylococcus aureus subsp. aureus N315
cuuggcauuuuuuc

SEQ ID NO: 2154843 - RNA, 19 nt, Staphylococcus aureus subsp. aureus N315
cuuggccaauuaacuugau

SEQ ID NO: 2154844 - RNA, 19 nt, Staphylococcus aureus subsp. aureus N315
cuugugguuggaagucugc

SEQ ID NO: 2154845 - RNA, 14 nt, Staphylococcus aureus subsp. aureus N315
cuugugugaaauua

SEQ ID NO: 2154846 - RNA, 23 nt, Staphylococcus aureus subsp. aureus N315
cuuguuacacaugaguuaaacga

SEQ ID NO: 2154847 - RNA, 14 nt, Staphylococcus aureus subsp. aureus N315
cuugugaaauuaga

SEQ ID NO: 2154848 - RNA, 15 nt, Staphylococcus aureus subsp. aureus N315
cuugugcuuaagaac

SEQ ID NO: 2154849 - RNA, 17 nt, Staphylococcus aureus subsp. aureus N315
cuugugccaacaaagcu

SEQ ID NO: 2154850 - RNA, 12 nt, Staphylococcus aureus subsp. aureus N315
aaagaaaaguuu

SEQ ID NO: 2154851 - RNA, 12 nt, Staphylococcus aureus subsp. aureus N315
aaagaaacauag

SEQ ID NO: 2154852 - RNA, 18 nt, Staphylococcus aureus subsp. aureus N315
aaagaaagcuaauaucaa

SEQ ID NO: 2154853 - RNA, 18 nt, Staphylococcus aureus subsp. aureus N315
cuuguuuagggaauccca

SEQ ID NO: 2154854 - RNA, 18 nt, Staphylococcus aureus subsp. aureus N315
cuuguuggcuuuuuuaau

SEQ ID NO: 2154855 - RNA, 19 nt, Staphylococcus aureus subsp. aureus N315
cuuguugggucuuguaaac

SEQ ID NO: 2154856 - RNA, 21 nt, Staphylococcus aureus subsp. aureus N315
cuuguuguucuguaaugauau

SEQ ID NO: 2154857 - RNA, 13 nt, Staphylococcus aureus subsp. aureus N315
cuuguuuuaaacu

SEQ ID NO: 2154858 - RNA, 14 nt, Staphylococcus aureus subsp. aureus N315
cuuguuuuaaauca

SEQ ID NO: 2154859 - RNA, 23 nt, Staphylococcus aureus subsp. aureus N315
cuuuaaaacguuaguacuuugau

SEQ ID NO: 2154860 - RNA, 19 nt, Staphylococcus aureus subsp. aureus N315
cuuuaaaauuguauagaau

SEQ ID NO: 2154861 - RNA, 17 nt, Staphylococcus aureus subsp. aureus N315
cuuuaaacucguaaauu

SEQ ID NO: 2154862 - RNA, 14 nt, Staphylococcus aureus subsp. aureus N315
cuuuaaacaagcau

SEQ ID NO: 2154863 - RNA, 20 nt, Staphylococcus aureus subsp. aureus N315
cuuguugaacucugauauug

SEQ ID NO: 2154864 - RNA, 16 nt, Staphylococcus aureus subsp. aureus N315
cuuguuggauuuuaac

SEQ ID NO: 2154865 - RNA, 22 nt, Staphylococcus aureus subsp. aureus N315
aaagaacuaacauaauuuuuau

SEQ ID NO: 2154866 - RNA, 19 nt, Staphylococcus aureus subsp. aureus N315
cuuguucuccgaucaugcc

SEQ ID NO: 2154867 - RNA, 13 nt, Staphylococcus aureus subsp. aureus N315
cuuguucuuuacu

SEQ ID NO: 2154868 - RNA, 21 nt, Staphylococcus aureus subsp. aureus N315
aaagaaccacgcaucauguau

SEQ ID NO: 2154869 - RNA, 17 nt, Staphylococcus aureus subsp. aureus N315
cuucaaucuaccaauac

SEQ ID NO: 2154870 - RNA, 15 nt, Staphylococcus aureus subsp. aureus N315
cuucacuaaaaauau

SEQ ID NO: 2154871 - RNA, 16 nt, Staphylococcus aureus subsp. aureus N315
cuucaauccaagcaau

SEQ ID NO: 2154872 - RNA, 16 nt, Staphylococcus aureus subsp. aureus N315
cuucaacgucaucugc

SEQ ID NO: 2154873 - RNA, 13 nt, Staphylococcus aureus subsp. aureus N315
cuuauuuuacuau

SEQ ID NO: 2154874 - RNA, 19 nt, Staphylococcus aureus subsp. aureus N315
cuuauuucaaaaauaguaa

SEQ ID NO: 2154875 - RNA, 13 nt, Staphylococcus aureus subsp. aureus N315
cuuauuuuauacg

SEQ ID NO: 2154876 - RNA, 15 nt, Staphylococcus aureus subsp. aureus N315
cuuauuuuguuuuaa

SEQ ID NO: 2154877 - RNA, 15 nt, Staphylococcus aureus subsp. aureus N315
cuucaaaauuuugac

SEQ ID NO: 2154878 - RNA, 13 nt, Staphylococcus aureus subsp. aureus N315
cuucaaaaugccg

SEQ ID NO: 2154879 - RNA, 15 nt, Staphylococcus aureus subsp. aureus N315
cuucauugaugaugu

SEQ ID NO: 2154880 - RNA, 18 nt, Staphylococcus aureus subsp. aureus N315
cuucauuuauaacauuua

SEQ ID NO: 2154881 - RNA, 15 nt, Staphylococcus aureus subsp. aureus N315
cuucauuugcgauuu

SEQ ID NO: 2154882 - RNA, 22 nt, Staphylococcus aureus subsp. aureus N315
cuucauuaguugccccuagcaa

SEQ ID NO: 2154883 - RNA, 21 nt, Staphylococcus aureus subsp. aureus N315
cuucauuaguugcauaaucaa

SEQ ID NO: 2154884 - RNA, 20 nt, Staphylococcus aureus subsp. aureus N315
cuucaguacgguuauuuaau

SEQ ID NO: 2154885 - RNA, 21 nt, Staphylococcus aureus subsp. aureus N315
cuucaucaauaaauauugauu

SEQ ID NO: 2154886 - RNA, 13 nt, Staphylococcus aureus subsp. aureus N315
cuucaucaauaac

SEQ ID NO: 2154887 - RNA, 13 nt, Staphylococcus aureus subsp. aureus N315
cuucaucaauaaa

SEQ ID NO: 2154888 - RNA, 19 nt, Staphylococcus aureus subsp. aureus N315
cuucaggaauaucuuucaa

SEQ ID NO: 2154889 - RNA, 15 nt, Staphylococcus aureus subsp. aureus N315
cuucagguguaguag

SEQ ID NO: 2154890 - RNA, 16 nt, Staphylococcus aureus subsp. aureus N315
cuuccccuacaaaguu

SEQ ID NO: 2154891 - RNA, 17 nt, Staphylococcus aureus subsp. aureus N315
cuuccaacacccauaua

SEQ ID NO: 2154892 - RNA, 18 nt, Staphylococcus aureus subsp. aureus N315
cuuccaacauauaaaaaa

SEQ ID NO: 2154893 - RNA, 14 nt, Staphylococcus aureus subsp. aureus N315
cuuccacuucaucu

SEQ ID NO: 2154894 - RNA, 15 nt, Staphylococcus aureus subsp. aureus N315
cuuaugaugucaugu

SEQ ID NO: 2154895 - RNA, 14 nt, Staphylococcus aureus subsp. aureus N315
cuuaugguauuuac

SEQ ID NO: 2154896 - RNA, 19 nt, Staphylococcus aureus subsp. aureus N315
cuuaugucauauacuauau

SEQ ID NO: 2154897 - RNA, 16 nt, Staphylococcus aureus subsp. aureus N315
cuuauuuguuuauuag

SEQ ID NO: 2154898 - RNA, 14 nt, Staphylococcus aureus subsp. aureus N315
cuuauuuguuuauu

SEQ ID NO: 2154899 - RNA, 15 nt, Staphylococcus aureus subsp. aureus N315
cuuauuuguuuauua

SEQ ID NO: 2154900 - RNA, 20 nt, Staphylococcus aureus subsp. aureus N315
cuuauuugauucuauuucuu

SEQ ID NO: 2154901 - RNA, 14 nt, Staphylococcus aureus subsp. aureus N315
cuuauuuguuuaau

SEQ ID NO: 2154902 - RNA, 22 nt, Staphylococcus aureus subsp. aureus N315
cuuauuuguuuaauuaucuuua

SEQ ID NO: 2154903 - RNA, 21 nt, Staphylococcus aureus subsp. aureus N315
cuuaucagcauuaaucguauu

SEQ ID NO: 2154904 - RNA, 18 nt, Staphylococcus aureus subsp. aureus N315
cuuaucaacagcuucaaa

SEQ ID NO: 2154905 - RNA, 22 nt, Staphylococcus aureus subsp. aureus N315
cuuauauauucaauaauuauua

SEQ ID NO: 2154906 - RNA, 23 nt, Staphylococcus aureus subsp. aureus N315
cuuaguacacguguauuguauuu

SEQ ID NO: 2154907 - RNA, 19 nt, Staphylococcus aureus subsp. aureus N315
cuuaguaguuguacuucuu

SEQ ID NO: 2154908 - RNA, 22 nt, Staphylococcus aureus subsp. aureus N315
cuuaggugucaucgcuuuaauu

SEQ ID NO: 2154909 - RNA, 21 nt, Staphylococcus aureus subsp. aureus N315
cuuagguuauuauaaaauaaa

SEQ ID NO: 2154910 - RNA, 21 nt, Staphylococcus aureus subsp. aureus N315
cuuaccuuuauguucaaaugu

SEQ ID NO: 2154911 - RNA, 18 nt, Staphylococcus aureus subsp. aureus N315
cuuaccuuucaaauauau

SEQ ID NO: 2154912 - RNA, 19 nt, Staphylococcus aureus subsp. aureus N315
cuuaccuuuauguucaaau

SEQ ID NO: 2154913 - RNA, 17 nt, Staphylococcus aureus subsp. aureus N315
cuuaccuacuuuuuugg

SEQ ID NO: 2154914 - RNA, 15 nt, Staphylococcus aureus subsp. aureus N315
cuuacuacuuaauua

SEQ ID NO: 2154915 - RNA, 15 nt, Staphylococcus aureus subsp. aureus N315
cuuacucauuuuucu

SEQ ID NO: 2154916 - RNA, 19 nt, Staphylococcus aureus subsp. aureus N315
cuuacugcuguucucuauu

SEQ ID NO: 2154917 - RNA, 17 nt, Staphylococcus aureus subsp. aureus N315
cuuacugaaacuaaauu

SEQ ID NO: 2154918 - RNA, 13 nt, Staphylococcus aureus subsp. aureus N315
cuuacugaaacua

SEQ ID NO: 2154919 - RNA, 22 nt, Staphylococcus aureus subsp. aureus N315
cuuacugcuguuuuuuauagua

SEQ ID NO: 2154920 - RNA, 17 nt, Staphylococcus aureus subsp. aureus N315
cuuacugugaaaauacc

SEQ ID NO: 2154921 - RNA, 17 nt, Staphylococcus aureus subsp. aureus N315
cuuacugucaccuucua

SEQ ID NO: 2154922 - RNA, 16 nt, Staphylococcus aureus subsp. aureus N315
cuuagcaaucucuuua

SEQ ID NO: 2154923 - RNA, 21 nt, Staphylococcus aureus subsp. aureus N315
cuuagauuuucacuaauauuu

SEQ ID NO: 2154924 - RNA, 23 nt, Staphylococcus aureus subsp. aureus N315
cuuagcacuuggauuuuaauuau

SEQ ID NO: 2154925 - RNA, 15 nt, Staphylococcus aureus subsp. aureus N315
cuuaaugcuucaaau

SEQ ID NO: 2154926 - RNA, 17 nt, Staphylococcus aureus subsp. aureus N315
cuuaaucgcucuaaaua

SEQ ID NO: 2154927 - RNA, 15 nt, Staphylococcus aureus subsp. aureus N315
cuuacccaaaaaauu

SEQ ID NO: 2154928 - RNA, 18 nt, Staphylococcus aureus subsp. aureus N315
cuuacccaaaaaauugua

SEQ ID NO: 2154929 - RNA, 17 nt, Staphylococcus aureus subsp. aureus N315
cuuacccaaaaaauugu

SEQ ID NO: 2154930 - RNA, 16 nt, Staphylococcus aureus subsp. aureus N315
cuuacauuacauauau

SEQ ID NO: 2154931 - RNA, 17 nt, Staphylococcus aureus subsp. aureus N315
cuuacauaggauaucua

SEQ ID NO: 2154932 - RNA, 11 nt, Staphylococcus aureus subsp. aureus N315
cuuaaaaacaa

SEQ ID NO: 2154933 - RNA, 13 nt, Staphylococcus aureus subsp. aureus N315
cuguuuuuuuaug

SEQ ID NO: 2154934 - RNA, 13 nt, Staphylococcus aureus subsp. aureus N315
cuuaaauuaagaa

SEQ ID NO: 2154935 - RNA, 19 nt, Staphylococcus aureus subsp. aureus N315
cuuaaauagugcuuuuuca

SEQ ID NO: 2154936 - RNA, 18 nt, Staphylococcus aureus subsp. aureus N315
cuuaaauagugcuuuuuc

SEQ ID NO: 2154937 - RNA, 23 nt, Staphylococcus aureus subsp. aureus N315
cuuaaauacaauuucuucauuuu

SEQ ID NO: 2154938 - RNA, 21 nt, Staphylococcus aureus subsp. aureus N315
cuuaaauacaauuucuucauu

SEQ ID NO: 2154939 - RNA, 17 nt, Staphylococcus aureus subsp. aureus N315
cuuaaaagacauccaca

SEQ ID NO: 2154940 - RNA, 14 nt, Staphylococcus aureus subsp. aureus N315
cuuaacauaaaaug

SEQ ID NO: 2154941 - RNA, 12 nt, Staphylococcus aureus subsp. aureus N315
cuuaacaacaug

SEQ ID NO: 2154942 - RNA, 16 nt, Staphylococcus aureus subsp. aureus N315
cuuaaauuaagaauaa

SEQ ID NO: 2154943 - RNA, 18 nt, Staphylococcus aureus subsp. aureus N315
cuuaauaucauauucaaa

SEQ ID NO: 2154944 - RNA, 21 nt, Staphylococcus aureus subsp. aureus N315
cuuaauaggauaugcuaaaca

SEQ ID NO: 2154945 - RNA, 23 nt, Staphylococcus aureus subsp. aureus N315
cuguuaugaaguauccuuauuug

SEQ ID NO: 2154946 - RNA, 16 nt, Staphylococcus aureus subsp. aureus N315
cuguuucaucaccgac

SEQ ID NO: 2154947 - RNA, 20 nt, Staphylococcus aureus subsp. aureus N315
cuguuuaaauuuaaaagaaa

SEQ ID NO: 2154948 - RNA, 12 nt, Staphylococcus aureus subsp. aureus N315
cuugcuuacaau

SEQ ID NO: 2154949 - RNA, 22 nt, Staphylococcus aureus subsp. aureus N315
cuugcuucauuauauaauucuu

SEQ ID NO: 2154950 - RNA, 20 nt, Staphylococcus aureus subsp. aureus N315
cuugcuuacaauaaucacuu

SEQ ID NO: 2154951 - RNA, 16 nt, Staphylococcus aureus subsp. aureus N315
cuugcucaugagcaca

SEQ ID NO: 2154952 - RNA, 10 nt, Staphylococcus aureus subsp. aureus N315
aaacuucuuu

SEQ ID NO: 2154953 - RNA, 14 nt, Staphylococcus aureus subsp. aureus N315
aaacuucuuuucuu

SEQ ID NO: 2154954 - RNA, 17 nt, Staphylococcus aureus subsp. aureus N315
aaacuucuuuucuuuga

SEQ ID NO: 2154955 - RNA, 19 nt, Staphylococcus aureus subsp. aureus N315
aaacuucuuuucuuugaua

SEQ ID NO: 2154956 - RNA, 12 nt, Staphylococcus aureus subsp. aureus N315
aaacuugauuau

SEQ ID NO: 2154957 - RNA, 19 nt, Staphylococcus aureus subsp. aureus N315
aaacuuggcaaugaaauua

SEQ ID NO: 2154958 - RNA, 18 nt, Staphylococcus aureus subsp. aureus N315
aaacuuucguauuuuucu

SEQ ID NO: 2154959 - RNA, 18 nt, Staphylococcus aureus subsp. aureus N315
aaacuuugugugcuuuau

SEQ ID NO: 2154960 - RNA, 23 nt, Staphylococcus aureus subsp. aureus N315
aaacuuugugugcuuuaucucua

SEQ ID NO: 2154961 - RNA, 17 nt, Staphylococcus aureus subsp. aureus N315
cuugcgauaaguucauc

SEQ ID NO: 2154962 - RNA, 22 nt, Staphylococcus aureus subsp. aureus N315
cuugccuggcaacguucuacuc

SEQ ID NO: 2154963 - RNA, 21 nt, Staphylococcus aureus subsp. aureus N315
cuugcauacgaauuaaaauaa

SEQ ID NO: 2154964 - RNA, 20 nt, Staphylococcus aureus subsp. aureus N315
cuugcauacgaauuaaaaua

SEQ ID NO: 2154965 - RNA, 17 nt, Staphylococcus aureus subsp. aureus N315
cuugauuguaaauaaaa

SEQ ID NO: 2154966 - RNA, 21 nt, Staphylococcus aureus subsp. aureus N315
cuugauuuaaaccaucaauuc

SEQ ID NO: 2154967 - RNA, 12 nt, Staphylococcus aureus subsp. aureus N315
cuugauuuaguu

SEQ ID NO: 2154968 - RNA, 17 nt, Staphylococcus aureus subsp. aureus N315
cuugauuuaauuuuuaa

SEQ ID NO: 2154969 - RNA, 17 nt, Staphylococcus aureus subsp. aureus N315
cuugauuuuauaaauca

SEQ ID NO: 2154970 - RNA, 14 nt, Staphylococcus aureus subsp. aureus N315
cuugcacaccagug

SEQ ID NO: 2154971 - RNA, 17 nt, Staphylococcus aureus subsp. aureus N315
cuugcaauaccucccca

SEQ ID NO: 2154972 - RNA, 19 nt, Staphylococcus aureus subsp. aureus N315
cuugauuauauuuuucuuc

SEQ ID NO: 2154973 - RNA, 22 nt, Staphylococcus aureus subsp. aureus N315
cuugauggugguaccacauaca

SEQ ID NO: 2154974 - RNA, 22 nt, Staphylococcus aureus subsp. aureus N315
cuugagcuuuguuagcaucugc

SEQ ID NO: 2154975 - RNA, 16 nt, Staphylococcus aureus subsp. aureus N315
cuugauaaaaaaugaa

SEQ ID NO: 2154976 - RNA, 14 nt, Staphylococcus aureus subsp. aureus N315
cuugauaaaaaaug

SEQ ID NO: 2154977 - RNA, 18 nt, Staphylococcus aureus subsp. aureus N315
cuugaucauuauaaaaug

SEQ ID NO: 2154978 - RNA, 15 nt, Staphylococcus aureus subsp. aureus N315
cuugaccuucaguuu

SEQ ID NO: 2154979 - RNA, 20 nt, Staphylococcus aureus subsp. aureus N315
cuugaccuacuuuuucaaua

SEQ ID NO: 2154980 - RNA, 20 nt, Staphylococcus aureus subsp. aureus N315
cuugaauaaauuuuauucuu

SEQ ID NO: 2154981 - RNA, 16 nt, Staphylococcus aureus subsp. aureus N315
cuugaagcaucgauuu

SEQ ID NO: 2154982 - RNA, 23 nt, Staphylococcus aureus subsp. aureus N315
cuugaagaaaaguauaaauauaa

SEQ ID NO: 2154983 - RNA, 17 nt, Staphylococcus aureus subsp. aureus N315
cuugaaccccauucacu

SEQ ID NO: 2154984 - RNA, 14 nt, Staphylococcus aureus subsp. aureus N315
cuugaauguuugaa

SEQ ID NO: 2154985 - RNA, 22 nt, Staphylococcus aureus subsp. aureus N315
cuugaauaccuuuuauuauuuu

SEQ ID NO: 2154986 - RNA, 15 nt, Staphylococcus aureus subsp. aureus N315
cuugaauaauauauu

SEQ ID NO: 2154987 - RNA, 23 nt, Staphylococcus aureus subsp. aureus N315
cuugaccacuuuuguuaaaaaau

SEQ ID NO: 2154988 - RNA, 15 nt, Staphylococcus aureus subsp. aureus N315
cuucuuuugcaaaac

SEQ ID NO: 2154989 - RNA, 22 nt, Staphylococcus aureus subsp. aureus N315
cuugaaaauagccauauucaua

SEQ ID NO: 2154990 - RNA, 22 nt, Staphylococcus aureus subsp. aureus N315
cuugaaacaucuugauauucau

SEQ ID NO: 2154991 - RNA, 16 nt, Staphylococcus aureus subsp. aureus N315
cuugaaacacaaaaag

SEQ ID NO: 2154992 - RNA, 17 nt, Staphylococcus aureus subsp. aureus N315
cuugaaauuauuauuua

SEQ ID NO: 2154993 - RNA, 13 nt, Staphylococcus aureus subsp. aureus N315
cuucuuguuuuaa

SEQ ID NO: 2154994 - RNA, 14 nt, Staphylococcus aureus subsp. aureus N315
cuucuuguuuuaaa

SEQ ID NO: 2154995 - RNA, 16 nt, Staphylococcus aureus subsp. aureus N315
cuucuuucaauuaauc

SEQ ID NO: 2154996 - RNA, 20 nt, Staphylococcus aureus subsp. aureus N315
cuucuuucuaaaauaacuaa

SEQ ID NO: 2154997 - RNA, 13 nt, Staphylococcus aureus subsp. aureus N315
cuucuuuuaaguu

SEQ ID NO: 2154998 - RNA, 13 nt, Staphylococcus aureus subsp. aureus N315
cuucuuuucuuug

SEQ ID NO: 2154999 - RNA, 21 nt, Staphylococcus aureus subsp. aureus N315
cuucuucaggaauaucuuuca

SEQ ID NO: 2155000 - RNA, 14 nt, Staphylococcus aureus subsp. aureus N315
cuucuguuuauaua

SEQ ID NO: 2155001 - RNA, 16 nt, Staphylococcus aureus subsp. aureus N315
cuucuuacugcaauua

SEQ ID NO: 2155002 - RNA, 23 nt, Staphylococcus aureus subsp. aureus N315
cuucuguguuggggcccacaccc

SEQ ID NO: 2155003 - RNA, 24 nt, Staphylococcus aureus subsp. aureus N315
cuucuuaaaucaacaucaucuuua

SEQ ID NO: 2155004 - RNA, 18 nt, Staphylococcus aureus subsp. aureus N315
cuucuguguuggggccca

SEQ ID NO: 2155005 - RNA, 22 nt, Staphylococcus aureus subsp. aureus N315
cuucuucuaaccacuucuucac

SEQ ID NO: 2155006 - RNA, 22 nt, Staphylococcus aureus subsp. aureus N315
cuucuugagguuuugguucuga

SEQ ID NO: 2155007 - RNA, 16 nt, Staphylococcus aureus subsp. aureus N315
cuucuauuuuauaaua

SEQ ID NO: 2155008 - RNA, 14 nt, Staphylococcus aureus subsp. aureus N315
cuucuaucucuuua

SEQ ID NO: 2155009 - RNA, 13 nt, Staphylococcus aureus subsp. aureus N315
cuucuaucucuuu

SEQ ID NO: 2155010 - RNA, 21 nt, Staphylococcus aureus subsp. aureus N315
cuucuaauuugcaaaaucaac

SEQ ID NO: 2155011 - RNA, 17 nt, Staphylococcus aureus subsp. aureus N315
cuucuaauuugcaaaau

SEQ ID NO: 2155012 - RNA, 17 nt, Staphylococcus aureus subsp. aureus N315
cuucuaaccacuucuuc

SEQ ID NO: 2155013 - RNA, 17 nt, Staphylococcus aureus subsp. aureus N315
cuucuaaucguuaauaa

SEQ ID NO: 2155014 - RNA, 15 nt, Staphylococcus aureus subsp. aureus N315
cuucuaaguaauaua

SEQ ID NO: 2155015 - RNA, 22 nt, Staphylococcus aureus subsp. aureus N315
cuucguuuuuaguguuaauuga

SEQ ID NO: 2155016 - RNA, 19 nt, Staphylococcus aureus subsp. aureus N315
cuucgucaaugacuaagau

SEQ ID NO: 2155017 - RNA, 23 nt, Staphylococcus aureus subsp. aureus N315
cuucgucgcuaagaaccuuucuu

SEQ ID NO: 2155018 - RNA, 20 nt, Staphylococcus aureus subsp. aureus N315
cuucucaucgaauucauuug

SEQ ID NO: 2155019 - RNA, 15 nt, Staphylococcus aureus subsp. aureus N315
cuucucauugaaauc

SEQ ID NO: 2155020 - RNA, 18 nt, Staphylococcus aureus subsp. aureus N315
cuucucaucauuuucaau

SEQ ID NO: 2155021 - RNA, 23 nt, Staphylococcus aureus subsp. aureus N315
cuucuccguauuuaccuucuucu

SEQ ID NO: 2155022 - RNA, 12 nt, Staphylococcus aureus subsp. aureus N315
cuucucuaucag

SEQ ID NO: 2155023 - RNA, 20 nt, Staphylococcus aureus subsp. aureus N315
cuucuggagccccuuguucu

SEQ ID NO: 2155024 - RNA, 11 nt, Staphylococcus aureus subsp. aureus N315
cuucugcuaac

SEQ ID NO: 2155025 - RNA, 16 nt, Staphylococcus aureus subsp. aureus N315
cuucugcauagcgcuc

SEQ ID NO: 2155026 - RNA, 18 nt, Staphylococcus aureus subsp. aureus N315
cggggccccaacacagag

SEQ ID NO: 2155027 - RNA, 20 nt, Staphylococcus aureus subsp. aureus N315
cggggccccaacacagagaa

SEQ ID NO: 2155028 - RNA, 21 nt, Staphylococcus aureus subsp. aureus N315
cggggccccaacaaaaagaau

SEQ ID NO: 2155029 - RNA, 23 nt, Staphylococcus aureus subsp. aureus N315
cgggggacauagguauaaucauu

SEQ ID NO: 2155030 - RNA, 16 nt, Staphylococcus aureus subsp. aureus N315
aaacuaaauuaaaagu

SEQ ID NO: 2155031 - RNA, 18 nt, Staphylococcus aureus subsp. aureus N315
aaacuagcaguaauaugu

SEQ ID NO: 2155032 - RNA, 14 nt, Staphylococcus aureus subsp. aureus N315
cgguauuuucaaaa

SEQ ID NO: 2155033 - RNA, 22 nt, Staphylococcus aureus subsp. aureus N315
cggugaccuuauauuuuauuua

SEQ ID NO: 2155034 - RNA, 16 nt, Staphylococcus aureus subsp. aureus N315
cggucucaacuugccu

SEQ ID NO: 2155035 - RNA, 13 nt, Staphylococcus aureus subsp. aureus N315
cggcuuuggauuu

SEQ ID NO: 2155036 - RNA, 10 nt, Staphylococcus aureus subsp. aureus N315
cgggaaggaa

SEQ ID NO: 2155037 - RNA, 13 nt, Staphylococcus aureus subsp. aureus N315
cuaaaucuuuaaa

SEQ ID NO: 2155038 - RNA, 23 nt, Staphylococcus aureus subsp. aureus N315
cuaaaugcacgagcaacaucuuu

SEQ ID NO: 2155039 - RNA, 17 nt, Staphylococcus aureus subsp. aureus N315
cuaaaugauuuauucua

SEQ ID NO: 2155040 - RNA, 21 nt, Staphylococcus aureus subsp. aureus N315
cuaaaugaauugcuuguucuu

SEQ ID NO: 2155041 - RNA, 15 nt, Staphylococcus aureus subsp. aureus N315
cuaaauuauuguuua

SEQ ID NO: 2155042 - RNA, 22 nt, Staphylococcus aureus subsp. aureus N315
cuaaauuauuguuuaugccaug

SEQ ID NO: 2155043 - RNA, 23 nt, Staphylococcus aureus subsp. aureus N315
cuaaauuauuguuuaugccaugc

SEQ ID NO: 2155044 - RNA, 21 nt, Staphylococcus aureus subsp. aureus N315
cuaaauuuauauagucuauga

SEQ ID NO: 2155045 - RNA, 16 nt, Staphylococcus aureus subsp. aureus N315
cuaaauucuuuuuguu

SEQ ID NO: 2155046 - RNA, 18 nt, Staphylococcus aureus subsp. aureus N315
cuaaauucaauaaucuua

SEQ ID NO: 2155047 - RNA, 22 nt, Staphylococcus aureus subsp. aureus N315
cuaaauuauuuauucauuauag

SEQ ID NO: 2155048 - RNA, 22 nt, Staphylococcus aureus subsp. aureus N315
cuaaauucaguucaaacagaaa

SEQ ID NO: 2155049 - RNA, 14 nt, Staphylococcus aureus subsp. aureus N315
cuaaagcuaaugca

SEQ ID NO: 2155050 - RNA, 24 nt, Staphylococcus aureus subsp. aureus N315
cuaaagcuauaaaaaaucuuuuga

SEQ ID NO: 2155051 - RNA, 16 nt, Staphylococcus aureus subsp. aureus N315
cuaaagcuaauacacc

SEQ ID NO: 2155052 - RNA, 18 nt, Staphylococcus aureus subsp. aureus N315
cuaaagguauucuauuuu

SEQ ID NO: 2155053 - RNA, 13 nt, Staphylococcus aureus subsp. aureus N315
cuaaagguaacuu

SEQ ID NO: 2155054 - RNA, 14 nt, Staphylococcus aureus subsp. aureus N315
cuaaaguaaauaac

SEQ ID NO: 2155055 - RNA, 23 nt, Staphylococcus aureus subsp. aureus N315
cuaaauaguuuuucauauucaca

SEQ ID NO: 2155056 - RNA, 22 nt, Staphylococcus aureus subsp. aureus N315
cuaaauaaaauuaaaacagcaa

SEQ ID NO: 2155057 - RNA, 16 nt, Staphylococcus aureus subsp. aureus N315
cuaaauaauuucucaa

SEQ ID NO: 2155058 - RNA, 15 nt, Staphylococcus aureus subsp. aureus N315
cuaaaaugucuuuga

SEQ ID NO: 2155059 - RNA, 19 nt, Staphylococcus aureus subsp. aureus N315
cuaaaauagaaaaauuuca

SEQ ID NO: 2155060 - RNA, 18 nt, Staphylococcus aureus subsp. aureus N315
cuaaaauacccauuuuuu

SEQ ID NO: 2155061 - RNA, 13 nt, Staphylococcus aureus subsp. aureus N315
cuaaaauaacaac

SEQ ID NO: 2155062 - RNA, 23 nt, Staphylococcus aureus subsp. aureus N315
cuaaaauaucaaaauauaaaauc

SEQ ID NO: 2155063 - RNA, 18 nt, Staphylococcus aureus subsp. aureus N315
cuaaaauaucaaaauaua

SEQ ID NO: 2155064 - RNA, 20 nt, Staphylococcus aureus subsp. aureus N315
cuaaaaacggacaaguugca

SEQ ID NO: 2155065 - RNA, 21 nt, Staphylococcus aureus subsp. aureus N315
cuaaaacaaauucauauuaac

SEQ ID NO: 2155066 - RNA, 20 nt, Staphylococcus aureus subsp. aureus N315
cuaaaacaugauacgugguu

SEQ ID NO: 2155067 - RNA, 21 nt, Staphylococcus aureus subsp. aureus N315
cuaaaaagcgugguucccaau

SEQ ID NO: 2155068 - RNA, 14 nt, Staphylococcus aureus subsp. aureus N315
cuaaaaauaaaauc

SEQ ID NO: 2155069 - RNA, 14 nt, Staphylococcus aureus subsp. aureus N315
cuaaaaaugcuuua

SEQ ID NO: 2155070 - RNA, 15 nt, Staphylococcus aureus subsp. aureus N315
cguuucuguuucauc

SEQ ID NO: 2155071 - RNA, 19 nt, Staphylococcus aureus subsp. aureus N315
cguuucuuuguauaccuau

SEQ ID NO: 2155072 - RNA, 19 nt, Staphylococcus aureus subsp. aureus N315
cguuugaaugaaccuuuac

SEQ ID NO: 2155073 - RNA, 18 nt, Staphylococcus aureus subsp. aureus N315
cguuuaccgucuuuugca

SEQ ID NO: 2155074 - RNA, 21 nt, Staphylococcus aureus subsp. aureus N315
cguuuaacaaacguuguucaa

SEQ ID NO: 2155075 - RNA, 11 nt, Staphylococcus aureus subsp. aureus N315
cguuaaaaaga

SEQ ID NO: 2155076 - RNA, 14 nt, Staphylococcus aureus subsp. aureus N315
cguucucuuaaaua

SEQ ID NO: 2155077 - RNA, 16 nt, Staphylococcus aureus subsp. aureus N315
cguucuuguauuuccu

SEQ ID NO: 2155078 - RNA, 11 nt, Staphylococcus aureus subsp. aureus N315
cguucugcuaa

SEQ ID NO: 2155079 - RNA, 12 nt, Staphylococcus aureus subsp. aureus N315
cguucugcuaau

SEQ ID NO: 2155080 - RNA, 21 nt, Staphylococcus aureus subsp. aureus N315
cguugaauuaacaauauuaaa

SEQ ID NO: 2155081 - RNA, 20 nt, Staphylococcus aureus subsp. aureus N315
cguguuugaauggcaaauau

SEQ ID NO: 2155082 - RNA, 12 nt, Staphylococcus aureus subsp. aureus N315
cguguguaguag

SEQ ID NO: 2155083 - RNA, 15 nt, Staphylococcus aureus subsp. aureus N315
cgugucaaaugccgc

SEQ ID NO: 2155084 - RNA, 19 nt, Staphylococcus aureus subsp. aureus N315
cgugucaaaugccgcuucu

SEQ ID NO: 2155085 - RNA, 21 nt, Staphylococcus aureus subsp. aureus N315
cgugguucaaaaaucauacca

SEQ ID NO: 2155086 - RNA, 14 nt, Staphylococcus aureus subsp. aureus N315
cgugguaugauuuu

SEQ ID NO: 2155087 - RNA, 18 nt, Staphylococcus aureus subsp. aureus N315
cgugcauuguaauaccaa

SEQ ID NO: 2155088 - RNA, 14 nt, Staphylococcus aureus subsp. aureus N315
cgugcaaauaaaaa

SEQ ID NO: 2155089 - RNA, 18 nt, Staphylococcus aureus subsp. aureus N315
cgugcaaauaaaaaaguu

SEQ ID NO: 2155090 - RNA, 23 nt, Staphylococcus aureus subsp. aureus N315
cgucuuaucuaaaucuucaucau

SEQ ID NO: 2155091 - RNA, 13 nt, Staphylococcus aureus subsp. aureus N315
cguaaacaacauc

SEQ ID NO: 2155092 - RNA, 15 nt, Staphylococcus aureus subsp. aureus N315
cguaacuauaugaaa

SEQ ID NO: 2155093 - RNA, 18 nt, Staphylococcus aureus subsp. aureus N315
cguaacauuuaaaaaaug

SEQ ID NO: 2155094 - RNA, 10 nt, Staphylococcus aureus subsp. aureus N315
cguaaaguuu

SEQ ID NO: 2155095 - RNA, 15 nt, Staphylococcus aureus subsp. aureus N315
cgguuugaaaaugac

SEQ ID NO: 2155096 - RNA, 17 nt, Staphylococcus aureus subsp. aureus N315
cgguucaucuaaaauga

SEQ ID NO: 2155097 - RNA, 18 nt, Staphylococcus aureus subsp. aureus N315
cguauacuuucgaucuuc

SEQ ID NO: 2155098 - RNA, 18 nt, Staphylococcus aureus subsp. aureus N315
cucguaaauuuuaucuaa

SEQ ID NO: 2155099 - RNA, 12 nt, Staphylococcus aureus subsp. aureus N315
cucgcuuacuca

SEQ ID NO: 2155100 - RNA, 19 nt, Staphylococcus aureus subsp. aureus N315
cucugaaaagccuacuuug

SEQ ID NO: 2155101 - RNA, 12 nt, Staphylococcus aureus subsp. aureus N315
cucucguaaauu

SEQ ID NO: 2155102 - RNA, 12 nt, Staphylococcus aureus subsp. aureus N315
cucugaucuaaa

SEQ ID NO: 2155103 - RNA, 22 nt, Staphylococcus aureus subsp. aureus N315
cucugcgauuucuaaagcgauu

SEQ ID NO: 2155104 - RNA, 20 nt, Staphylococcus aureus subsp. aureus N315
cucuauuuuaugauuugauu

SEQ ID NO: 2155105 - RNA, 17 nt, Staphylococcus aureus subsp. aureus N315
cucuauuuauaacacuu

SEQ ID NO: 2155106 - RNA, 19 nt, Staphylococcus aureus subsp. aureus N315
cucuauuuacggcauaauu

SEQ ID NO: 2155107 - RNA, 21 nt, Staphylococcus aureus subsp. aureus N315
cucgauacaaaggauuauuaa

SEQ ID NO: 2155108 - RNA, 21 nt, Staphylococcus aureus subsp. aureus N315
cucgacuucagauacauuauc

SEQ ID NO: 2155109 - RNA, 20 nt, Staphylococcus aureus subsp. aureus N315
cuccuucaauguucaauuca

SEQ ID NO: 2155110 - RNA, 12 nt, Staphylococcus aureus subsp. aureus N315
cuccuuacaaua

SEQ ID NO: 2155111 - RNA, 23 nt, Staphylococcus aureus subsp. aureus N315
cucgaaaauaaaacaaauuauua

SEQ ID NO: 2155112 - RNA, 23 nt, Staphylococcus aureus subsp. aureus N315
cuccucuauuuuaugauuugauu

SEQ ID NO: 2155113 - RNA, 15 nt, Staphylococcus aureus subsp. aureus N315
cuccucuauuuuaug

SEQ ID NO: 2155114 - RNA, 13 nt, Staphylococcus aureus subsp. aureus N315
cuccucuauuuua

SEQ ID NO: 2155115 - RNA, 20 nt, Staphylococcus aureus subsp. aureus N315
cuccucuuuuauuuaugagu

SEQ ID NO: 2155116 - RNA, 16 nt, Staphylococcus aureus subsp. aureus N315
cuccaguggaaaugau

SEQ ID NO: 2155117 - RNA, 23 nt, Staphylococcus aureus subsp. aureus N315
cuccaguggaaaugauaauuuaa

SEQ ID NO: 2155118 - RNA, 18 nt, Staphylococcus aureus subsp. aureus N315
cucccuuaaauacaauuu

SEQ ID NO: 2155119 - RNA, 22 nt, Staphylococcus aureus subsp. aureus N315
cucccuuaaauacaauuucuuc

SEQ ID NO: 2155120 - RNA, 15 nt, Staphylococcus aureus subsp. aureus N315
cucccuuuuaucuuu

SEQ ID NO: 2155121 - RNA, 16 nt, Staphylococcus aureus subsp. aureus N315
cucccuuuuaucuuua

SEQ ID NO: 2155122 - RNA, 18 nt, Staphylococcus aureus subsp. aureus N315
cucagguuguuaggggcu

SEQ ID NO: 2155123 - RNA, 17 nt, Staphylococcus aureus subsp. aureus N315
cucaguguugggggcca

SEQ ID NO: 2155124 - RNA, 15 nt, Staphylococcus aureus subsp. aureus N315
cucagugcauuuuuu

SEQ ID NO: 2155125 - RNA, 17 nt, Staphylococcus aureus subsp. aureus N315
cucagugcauuuuuuau

SEQ ID NO: 2155126 - RNA, 17 nt, Staphylococcus aureus subsp. aureus N315
cucauaaaauacgcaaa

SEQ ID NO: 2155127 - RNA, 18 nt, Staphylococcus aureus subsp. aureus N315
cucauaaccgcuucuuuu

SEQ ID NO: 2155128 - RNA, 14 nt, Staphylococcus aureus subsp. aureus N315
cucauaaucaaguc

SEQ ID NO: 2155129 - RNA, 14 nt, Staphylococcus aureus subsp. aureus N315
cucauaauuaucau

SEQ ID NO: 2155130 - RNA, 12 nt, Staphylococcus aureus subsp. aureus N315
cucauaauaauu

SEQ ID NO: 2155131 - RNA, 10 nt, Staphylococcus aureus subsp. aureus N315
cucauaauaa

SEQ ID NO: 2155132 - RNA, 19 nt, Staphylococcus aureus subsp. aureus N315
cucauaccaaaaacauuaa

SEQ ID NO: 2155133 - RNA, 18 nt, Staphylococcus aureus subsp. aureus N315
cucauaccaaaaacauua

SEQ ID NO: 2155134 - RNA, 17 nt, Staphylococcus aureus subsp. aureus N315
cucaucgaauucauuug

SEQ ID NO: 2155135 - RNA, 18 nt, Staphylococcus aureus subsp. aureus N315
cucaucccucuaucaaau

SEQ ID NO: 2155136 - RNA, 18 nt, Staphylococcus aureus subsp. aureus N315
cucaugagcacaaacuaa

SEQ ID NO: 2155137 - RNA, 22 nt, Staphylococcus aureus subsp. aureus N315
cucaucuauuuaauaauguauc

SEQ ID NO: 2155138 - RNA, 18 nt, Staphylococcus aureus subsp. aureus N315
cucaucuaauuuaugaau

SEQ ID NO: 2155139 - RNA, 12 nt, Staphylococcus aureus subsp. aureus N315
cucaucuucuaa

SEQ ID NO: 2155140 - RNA, 17 nt, Staphylococcus aureus subsp. aureus N315
cucaucuucuaaaucaa

SEQ ID NO: 2155141 - RNA, 14 nt, Staphylococcus aureus subsp. aureus N315
cucaucauuuaaaa

SEQ ID NO: 2155142 - RNA, 22 nt, Staphylococcus aureus subsp. aureus N315
cucaucauuuaaaauuugugca

SEQ ID NO: 2155143 - RNA, 15 nt, Staphylococcus aureus subsp. aureus N315
cucauagucaucuua

SEQ ID NO: 2155144 - RNA, 20 nt, Staphylococcus aureus subsp. aureus N315
cucaacgggaacaucauaau

SEQ ID NO: 2155145 - RNA, 20 nt, Staphylococcus aureus subsp. aureus N315
cuauuagauacauauaagaa

SEQ ID NO: 2155146 - RNA, 15 nt, Staphylococcus aureus subsp. aureus N315
cuauuacuauaaaaa

SEQ ID NO: 2155147 - RNA, 22 nt, Staphylococcus aureus subsp. aureus N315
cuauuacuacauaauuuaucaa

SEQ ID NO: 2155148 - RNA, 14 nt, Staphylococcus aureus subsp. aureus N315
cuauuaaugcucua

SEQ ID NO: 2155149 - RNA, 19 nt, Staphylococcus aureus subsp. aureus N315
cuauuaauuacgucauaaa

SEQ ID NO: 2155150 - RNA, 23 nt, Staphylococcus aureus subsp. aureus N315
cucaccuuuagacaauauuuuua

SEQ ID NO: 2155151 - RNA, 15 nt, Staphylococcus aureus subsp. aureus N315
cucaccuuuaucauu

SEQ ID NO: 2155152 - RNA, 23 nt, Staphylococcus aureus subsp. aureus N315
cucaagugauuucccacgugccu

SEQ ID NO: 2155153 - RNA, 13 nt, Staphylococcus aureus subsp. aureus N315
cucaccaaguuca

SEQ ID NO: 2155154 - RNA, 18 nt, Staphylococcus aureus subsp. aureus N315
cuaucgccuaaaaauaaa

SEQ ID NO: 2155155 - RNA, 15 nt, Staphylococcus aureus subsp. aureus N315
cuauccuucaaaagu

SEQ ID NO: 2155156 - RNA, 17 nt, Staphylococcus aureus subsp. aureus N315
cuaucccuguaaaacca

SEQ ID NO: 2155157 - RNA, 13 nt, Staphylococcus aureus subsp. aureus N315
cuaucaauauaau

SEQ ID NO: 2155158 - RNA, 11 nt, Staphylococcus aureus subsp. aureus N315
cuaugauauau

SEQ ID NO: 2155159 - RNA, 23 nt, Staphylococcus aureus subsp. aureus N315
cuaugaugcuucuaacugaauua

SEQ ID NO: 2155160 - RNA, 12 nt, Staphylococcus aureus subsp. aureus N315
cuauguggcuac

SEQ ID NO: 2155161 - RNA, 12 nt, Staphylococcus aureus subsp. aureus N315
cuauuaaauaau

SEQ ID NO: 2155162 - RNA, 13 nt, Staphylococcus aureus subsp. aureus N315
cuauuaaaaccaa

SEQ ID NO: 2155163 - RNA, 13 nt, Staphylococcus aureus subsp. aureus N315
cuauguaacuuua

SEQ ID NO: 2155164 - RNA, 12 nt, Staphylococcus aureus subsp. aureus N315
cuauguaacuuu

SEQ ID NO: 2155165 - RNA, 13 nt, Staphylococcus aureus subsp. aureus N315
cuauauuuauuag

SEQ ID NO: 2155166 - RNA, 24 nt, Staphylococcus aureus subsp. aureus N315
cuauauuugauauaguuauaugug

SEQ ID NO: 2155167 - RNA, 23 nt, Staphylococcus aureus subsp. aureus N315
cuauauuuuuagcuuuauuauuu

SEQ ID NO: 2155168 - RNA, 18 nt, Staphylococcus aureus subsp. aureus N315
cuauauuuuuguauuuau

SEQ ID NO: 2155169 - RNA, 17 nt, Staphylococcus aureus subsp. aureus N315
cuauauugugcuaaguu

SEQ ID NO: 2155170 - RNA, 13 nt, Staphylococcus aureus subsp. aureus N315
cuauauaaaguug

SEQ ID NO: 2155171 - RNA, 23 nt, Staphylococcus aureus subsp. aureus N315
cuauauaaauguuuauaucuuuu

SEQ ID NO: 2155172 - RNA, 18 nt, Staphylococcus aureus subsp. aureus N315
cuauauaguaaaauaaau

SEQ ID NO: 2155173 - RNA, 18 nt, Staphylococcus aureus subsp. aureus N315
cuauauaauuuauaaaaa

SEQ ID NO: 2155174 - RNA, 14 nt, Staphylococcus aureus subsp. aureus N315
cuauauaguaaaau

SEQ ID NO: 2155175 - RNA, 20 nt, Staphylococcus aureus subsp. aureus N315
cuauauaugaauugaguauu

SEQ ID NO: 2155176 - RNA, 13 nt, Staphylococcus aureus subsp. aureus N315
cuauaugaaaaga

SEQ ID NO: 2155177 - RNA, 18 nt, Staphylococcus aureus subsp. aureus N315
cuauacaacaguaaucau

SEQ ID NO: 2155178 - RNA, 17 nt, Staphylococcus aureus subsp. aureus N315
cuauaauuucuuaauua

SEQ ID NO: 2155179 - RNA, 16 nt, Staphylococcus aureus subsp. aureus N315
cuauacaacaguaauc

SEQ ID NO: 2155180 - RNA, 20 nt, Staphylococcus aureus subsp. aureus N315
cuauaauuggcagauagaau

SEQ ID NO: 2155181 - RNA, 16 nt, Staphylococcus aureus subsp. aureus N315
cuauagucauucauaa

SEQ ID NO: 2155182 - RNA, 14 nt, Staphylococcus aureus subsp. aureus N315
cuauaguaagaaaa

SEQ ID NO: 2155183 - RNA, 17 nt, Staphylococcus aureus subsp. aureus N315
cuauagguuuauaaaaa

SEQ ID NO: 2155184 - RNA, 23 nt, Staphylococcus aureus subsp. aureus N315
cuaguaaaucaaagaugacuugg

SEQ ID NO: 2155185 - RNA, 13 nt, Staphylococcus aureus subsp. aureus N315
cuauaauaauuaa

SEQ ID NO: 2155186 - RNA, 17 nt, Staphylococcus aureus subsp. aureus N315
cuauaaucauuaaguaa

SEQ ID NO: 2155187 - RNA, 14 nt, Staphylococcus aureus subsp. aureus N315
cuaggguuaaaauu

SEQ ID NO: 2155188 - RNA, 11 nt, Staphylococcus aureus subsp. aureus N315
cuagcaaaaau

SEQ ID NO: 2155189 - RNA, 12 nt, Staphylococcus aureus subsp. aureus N315
cuagcaaaugca

SEQ ID NO: 2155190 - RNA, 22 nt, Staphylococcus aureus subsp. aureus N315
cuagcuaaugcacgugagaaac

SEQ ID NO: 2155191 - RNA, 20 nt, Staphylococcus aureus subsp. aureus N315
cuagcuacaaagucauuuuc

SEQ ID NO: 2155192 - RNA, 17 nt, Staphylococcus aureus subsp. aureus N315
cuaggauguucaucaac

SEQ ID NO: 2155193 - RNA, 23 nt, Staphylococcus aureus subsp. aureus N315
cuaggauguucaucaacaugaua

SEQ ID NO: 2155194 - RNA, 17 nt, Staphylococcus aureus subsp. aureus N315
cuagauaccaaacugcc

SEQ ID NO: 2155195 - RNA, 15 nt, Staphylococcus aureus subsp. aureus N315
cuagauuuuaaauca

SEQ ID NO: 2155196 - RNA, 16 nt, Staphylococcus aureus subsp. aureus N315
cuagauuuuaaaucaa

SEQ ID NO: 2155197 - RNA, 19 nt, Staphylococcus aureus subsp. aureus N315
cuacuuccuuacagacaaa

SEQ ID NO: 2155198 - RNA, 19 nt, Staphylococcus aureus subsp. aureus N315
cuacuuugauauguuuccu

SEQ ID NO: 2155199 - RNA, 18 nt, Staphylococcus aureus subsp. aureus N315
cuacuuugucugcaauuu

SEQ ID NO: 2155200 - RNA, 17 nt, Staphylococcus aureus subsp. aureus N315
cuacuuuuucaacugua

SEQ ID NO: 2155201 - RNA, 16 nt, Staphylococcus aureus subsp. aureus N315
cuacuauuuaaucuua

SEQ ID NO: 2155202 - RNA, 15 nt, Staphylococcus aureus subsp. aureus N315
cuacuauuaaauaau

SEQ ID NO: 2155203 - RNA, 14 nt, Staphylococcus aureus subsp. aureus N315
cuacuauuaaauaa

SEQ ID NO: 2155204 - RNA, 18 nt, Staphylococcus aureus subsp. aureus N315
cuacuuaauuaauaauuu

SEQ ID NO: 2155205 - RNA, 20 nt, Staphylococcus aureus subsp. aureus N315
cuacuuaauuaauaauuuaa

SEQ ID NO: 2155206 - RNA, 24 nt, Staphylococcus aureus subsp. aureus N315
cuacuuaaauuaagaauaaucgaa

SEQ ID NO: 2155207 - RNA, 14 nt, Staphylococcus aureus subsp. aureus N315
cuacugucucaucu

SEQ ID NO: 2155208 - RNA, 13 nt, Staphylococcus aureus subsp. aureus N315
cuaacauugguac

SEQ ID NO: 2155209 - RNA, 12 nt, Staphylococcus aureus subsp. aureus N315
cuaaccaaauaa

SEQ ID NO: 2155210 - RNA, 14 nt, Staphylococcus aureus subsp. aureus N315
cuaaccaaauaauu

SEQ ID NO: 2155211 - RNA, 24 nt, Staphylococcus aureus subsp. aureus N315
cuaacauuuucuuauuugauucua

SEQ ID NO: 2155212 - RNA, 15 nt, Staphylococcus aureus subsp. aureus N315
cuaaccacuucuuca

SEQ ID NO: 2155213 - RNA, 18 nt, Staphylococcus aureus subsp. aureus N315
cuaacagcauuuccuaug

SEQ ID NO: 2155214 - RNA, 15 nt, Staphylococcus aureus subsp. aureus N315
cuacuaaucguugug

SEQ ID NO: 2155215 - RNA, 15 nt, Staphylococcus aureus subsp. aureus N315
cuacgcccaucauca

SEQ ID NO: 2155216 - RNA, 16 nt, Staphylococcus aureus subsp. aureus N315
cuacgaaguuauauug

SEQ ID NO: 2155217 - RNA, 18 nt, Staphylococcus aureus subsp. aureus N315
cuaaccaucauaaauguu

SEQ ID NO: 2155218 - RNA, 13 nt, Staphylococcus aureus subsp. aureus N315
cugccauauguuu

SEQ ID NO: 2155219 - RNA, 14 nt, Staphylococcus aureus subsp. aureus N315
cugccaauauauuc

SEQ ID NO: 2155220 - RNA, 18 nt, Staphylococcus aureus subsp. aureus N315
cugccaaauauaauuuca

SEQ ID NO: 2155221 - RNA, 17 nt, Staphylococcus aureus subsp. aureus N315
cugcaugggcuucugcu

SEQ ID NO: 2155222 - RNA, 21 nt, Staphylococcus aureus subsp. aureus N315
cugcaauuauuuuucaaauau

SEQ ID NO: 2155223 - RNA, 17 nt, Staphylococcus aureus subsp. aureus N315
cugcaauuauuuuucaa

SEQ ID NO: 2155224 - RNA, 16 nt, Staphylococcus aureus subsp. aureus N315
cugcaaucguugaaaa

SEQ ID NO: 2155225 - RNA, 15 nt, Staphylococcus aureus subsp. aureus N315
cugcaguugauugca

SEQ ID NO: 2155226 - RNA, 20 nt, Staphylococcus aureus subsp. aureus N315
cugcuaacucugaucuaaaa

SEQ ID NO: 2155227 - RNA, 13 nt, Staphylococcus aureus subsp. aureus N315
cugcuaacucuga

SEQ ID NO: 2155228 - RNA, 18 nt, Staphylococcus aureus subsp. aureus N315
cugcuaaaauaaaauuaa

SEQ ID NO: 2155229 - RNA, 14 nt, Staphylococcus aureus subsp. aureus N315
aaacuauuuuaaaa

SEQ ID NO: 2155230 - RNA, 21 nt, Staphylococcus aureus subsp. aureus N315
cuggcaaauugccuuucauuu

SEQ ID NO: 2155231 - RNA, 15 nt, Staphylococcus aureus subsp. aureus N315
cuggcaaauugccuu

SEQ ID NO: 2155232 - RNA, 19 nt, Staphylococcus aureus subsp. aureus N315
cuggcaacguucuacucua

SEQ ID NO: 2155233 - RNA, 14 nt, Staphylococcus aureus subsp. aureus N315
cuggaauugggaaa

SEQ ID NO: 2155234 - RNA, 19 nt, Staphylococcus aureus subsp. aureus N315
cuggaauugggaaauauuu

SEQ ID NO: 2155235 - RNA, 20 nt, Staphylococcus aureus subsp. aureus N315
cugcuuuuuauuauuaugug

SEQ ID NO: 2155236 - RNA, 16 nt, Staphylococcus aureus subsp. aureus N315
cugcuuuauuuuauca

SEQ ID NO: 2155237 - RNA, 16 nt, Staphylococcus aureus subsp. aureus N315
cugcuuaucauuacuu

SEQ ID NO: 2155238 - RNA, 23 nt, Staphylococcus aureus subsp. aureus N315
cugcaaacacaguacaaauaaca

SEQ ID NO: 2155239 - RNA, 19 nt, Staphylococcus aureus subsp. aureus N315
cugcaaaauguuacacaaa

SEQ ID NO: 2155240 - RNA, 21 nt, Staphylococcus aureus subsp. aureus N315
cugcaagugcuuccacuucau

SEQ ID NO: 2155241 - RNA, 16 nt, Staphylococcus aureus subsp. aureus N315
cugauucuucacuaaa

SEQ ID NO: 2155242 - RNA, 22 nt, Staphylococcus aureus subsp. aureus N315
cugauauugaucugauuucacu

SEQ ID NO: 2155243 - RNA, 21 nt, Staphylococcus aureus subsp. aureus N315
cugaucauuuucauuuaaucc

SEQ ID NO: 2155244 - RNA, 14 nt, Staphylococcus aureus subsp. aureus N315
cugaucguaacauu

SEQ ID NO: 2155245 - RNA, 15 nt, Staphylococcus aureus subsp. aureus N315
cugauaauuuuucuu

SEQ ID NO: 2155246 - RNA, 18 nt, Staphylococcus aureus subsp. aureus N315
cugaguucaauuaaauua

SEQ ID NO: 2155247 - RNA, 13 nt, Staphylococcus aureus subsp. aureus N315
cugaguucaauua

SEQ ID NO: 2155248 - RNA, 18 nt, Staphylococcus aureus subsp. aureus N315
cugacauuucaucaauaa

SEQ ID NO: 2155249 - RNA, 21 nt, Staphylococcus aureus subsp. aureus N315
cugacauuguugcuaaucuca

SEQ ID NO: 2155250 - RNA, 14 nt, Staphylococcus aureus subsp. aureus N315
cugacaauucaucu

SEQ ID NO: 2155251 - RNA, 18 nt, Staphylococcus aureus subsp. aureus N315
cugagaaaaauauuucua

SEQ ID NO: 2155252 - RNA, 18 nt, Staphylococcus aureus subsp. aureus N315
cugaaaagaauaaguugu

SEQ ID NO: 2155253 - RNA, 16 nt, Staphylococcus aureus subsp. aureus N315
cugaaaagccuacuuu

SEQ ID NO: 2155254 - RNA, 15 nt, Staphylococcus aureus subsp. aureus N315
cugaaaaacuucuua

SEQ ID NO: 2155255 - RNA, 13 nt, Staphylococcus aureus subsp. aureus N315
cugaaaaaauuaa

SEQ ID NO: 2155256 - RNA, 20 nt, Staphylococcus aureus subsp. aureus N315
cugaaacgccucaacacuuu

SEQ ID NO: 2155257 - RNA, 15 nt, Staphylococcus aureus subsp. aureus N315
cugaaacuaaauuaa

SEQ ID NO: 2155258 - RNA, 21 nt, Staphylococcus aureus subsp. aureus N315
cugaaacuaaauuaaaagugu

SEQ ID NO: 2155259 - RNA, 20 nt, Staphylococcus aureus subsp. aureus N315
cucuuuucacgaauaucuua

SEQ ID NO: 2155260 - RNA, 23 nt, Staphylococcus aureus subsp. aureus N315
cucuuuguuggggcccacacccc

SEQ ID NO: 2155261 - RNA, 19 nt, Staphylococcus aureus subsp. aureus N315
cugaaauuucauaaaguuu

SEQ ID NO: 2155262 - RNA, 14 nt, Staphylococcus aureus subsp. aureus N315
cugaaauuuuuccg

SEQ ID NO: 2155263 - RNA, 15 nt, Staphylococcus aureus subsp. aureus N315
cugaaauuuuuuagu

SEQ ID NO: 2155264 - RNA, 20 nt, Staphylococcus aureus subsp. aureus N315
cugaaauuuuuuagugaaaa

SEQ ID NO: 2155265 - RNA, 23 nt, Staphylococcus aureus subsp. aureus N315
cucuuaaaucacuagcuaaugca

SEQ ID NO: 2155266 - RNA, 14 nt, Staphylococcus aureus subsp. aureus N315
cucuuaaauaugaa

SEQ ID NO: 2155267 - RNA, 14 nt, Staphylococcus aureus subsp. aureus N315
cucuguuuaacagg

SEQ ID NO: 2155268 - RNA, 21 nt, Staphylococcus aureus subsp. aureus N315
cucuuauaaagacaccuucaa

SEQ ID NO: 2155269 - RNA, 22 nt, Staphylococcus aureus subsp. aureus N315
cucuucaaucuaccaauacguu

SEQ ID NO: 2155270 - RNA, 16 nt, Staphylococcus aureus subsp. aureus N315
cucuucaaucuaccaa

SEQ ID NO: 2155271 - RNA, 19 nt, Staphylococcus aureus subsp. aureus N315
cucuguauugaggcccgac

SEQ ID NO: 2155272 - RNA, 15 nt, Staphylococcus aureus subsp. aureus N315
cucuggauuuuucuu

SEQ ID NO: 2155273 - RNA, 15 nt, Staphylococcus aureus subsp. aureus N315
cucuggaacuuuaau

SEQ ID NO: 2155274 - RNA, 15 nt, Staphylococcus aureus subsp. aureus N315
cucuugauaaaauaa

SEQ ID NO: 2155275 - RNA, 20 nt, Staphylococcus aureus subsp. aureus N315
cucuuuaaagcuaaauguua

SEQ ID NO: 2155276 - RNA, 18 nt, Staphylococcus aureus subsp. aureus N315
cucuugggaauugaccac

SEQ ID NO: 2155277 - RNA, 22 nt, Staphylococcus aureus subsp. aureus N315
cucuuguaccgucuuaucuaaa

SEQ ID NO: 2155278 - RNA, 19 nt, Staphylococcus aureus subsp. aureus N315
cucuuccuccgccaucaau

SEQ ID NO: 2155279 - RNA, 23 nt, Staphylococcus aureus subsp. aureus N315
aaaaacaccuucguuuaaauuca

SEQ ID NO: 2155280 - RNA, 16 nt, Staphylococcus aureus subsp. aureus N315
aaaaacaaauauuaga

SEQ ID NO: 2155281 - RNA, 12 nt, Staphylococcus aureus subsp. aureus N315
aaaaaauuuaaa

SEQ ID NO: 2155282 - RNA, 13 nt, Staphylococcus aureus subsp. aureus N315
aaaaacaaaaaaa

SEQ ID NO: 2155283 - RNA, 19 nt, Staphylococcus aureus subsp. aureus N315
aaaaacaaaaaaaccgaac

SEQ ID NO: 2155284 - RNA, 14 nt, Staphylococcus aureus subsp. aureus N315
aaaaaauuauuaaa

SEQ ID NO: 2155285 - RNA, 14 nt, Staphylococcus aureus subsp. aureus N315
aaaaaaugaauguu

SEQ ID NO: 2155286 - RNA, 18 nt, Staphylococcus aureus subsp. aureus N315
aaaaaaucgaacaaauga

SEQ ID NO: 2155287 - RNA, 12 nt, Staphylococcus aureus subsp. aureus N315
aaaaaauaauag

SEQ ID NO: 2155288 - RNA, 16 nt, Staphylococcus aureus subsp. aureus N315
aaaaaaucgaacaaau

SEQ ID NO: 2155289 - RNA, 22 nt, Staphylococcus aureus subsp. aureus N315
aaaaaaggaugaugugaauguu

SEQ ID NO: 2155290 - RNA, 14 nt, Staphylococcus aureus subsp. aureus N315
aaaaaauauuuaca

SEQ ID NO: 2155291 - RNA, 11 nt, Staphylococcus aureus subsp. aureus N315
aaaaaaugaua

SEQ ID NO: 2155292 - RNA, 13 nt, Staphylococcus aureus subsp. aureus N315
aaaaaaucgaauu

SEQ ID NO: 2155293 - RNA, 18 nt, Staphylococcus aureus subsp. aureus N315
aaaaaaucaguuuuuaaa

SEQ ID NO: 2155294 - RNA, 16 nt, Staphylococcus aureus subsp. aureus N315
aaaaacagcaguaaga

SEQ ID NO: 2155295 - RNA, 20 nt, Staphylococcus aureus subsp. aureus N315
aaaaacaucuacaucaaauu

SEQ ID NO: 2155296 - RNA, 14 nt, Staphylococcus aureus subsp. aureus N315
aaaaacauaaaaau

SEQ ID NO: 2155297 - RNA, 13 nt, Staphylococcus aureus subsp. aureus N315
aaaaacauaaaaa

SEQ ID NO: 2155298 - RNA, 21 nt, Staphylococcus aureus subsp. aureus N315
aaaaaaguuaucugcuuuucu

SEQ ID NO: 2155299 - RNA, 17 nt, Staphylococcus aureus subsp. aureus N315
aaaaaaguugauuaaaa

SEQ ID NO: 2155300 - RNA, 23 nt, Staphylococcus aureus subsp. aureus N315
aaaaaauacuaagauuagcuaug

SEQ ID NO: 2155301 - RNA, 15 nt, Staphylococcus aureus subsp. aureus N315
aaaaaaccaauaauc

SEQ ID NO: 2155302 - RNA, 12 nt, Staphylococcus aureus subsp. aureus N315
aaaaaaaucucc

SEQ ID NO: 2155303 - RNA, 13 nt, Staphylococcus aureus subsp. aureus N315
aaaaaacaaauau

SEQ ID NO: 2155304 - RNA, 12 nt, Staphylococcus aureus subsp. aureus N315
aaaaaaacaaau

SEQ ID NO: 2155305 - RNA, 12 nt, Staphylococcus aureus subsp. aureus N315
aaaaaacaauag

SEQ ID NO: 2155306 - RNA, 14 nt, Staphylococcus aureus subsp. aureus N315
aaaaaacaaauauu

SEQ ID NO: 2155307 - RNA, 15 nt, Staphylococcus aureus subsp. aureus N315
aaaaauaauagcaaa

SEQ ID NO: 2155308 - RNA, 17 nt, Staphylococcus aureus subsp. aureus N315
aaaaauaauagcaaaau

SEQ ID NO: 2155309 - RNA, 12 nt, Staphylococcus aureus subsp. aureus N315
aaaaauaaacca

SEQ ID NO: 2155310 - RNA, 20 nt, Staphylococcus aureus subsp. aureus N315
aaaaauaaagucauaugguu

SEQ ID NO: 2155311 - RNA, 20 nt, Staphylococcus aureus subsp. aureus N315
aaaaauaacuguaaaacauu

SEQ ID NO: 2155312 - RNA, 16 nt, Staphylococcus aureus subsp. aureus N315
aaaaauaacuccucca

SEQ ID NO: 2155313 - RNA, 21 nt, Staphylococcus aureus subsp. aureus N315
aaaaaccgaacaucugaaaaa

SEQ ID NO: 2155314 - RNA, 18 nt, Staphylococcus aureus subsp. aureus N315
aaaaaccgaacaucugaa

SEQ ID NO: 2155315 - RNA, 13 nt, Staphylococcus aureus subsp. aureus N315
aaaaaguuuuucu

SEQ ID NO: 2155316 - RNA, 11 nt, Staphylococcus aureus subsp. aureus N315
aaaaauaaaaa

SEQ ID NO: 2155317 - RNA, 14 nt, Staphylococcus aureus subsp. aureus N315
aaaaacaguuacaa

SEQ ID NO: 2155318 - RNA, 18 nt, Staphylococcus aureus subsp. aureus N315
aaaaacaguguagcacaa

SEQ ID NO: 2155319 - RNA, 15 nt, Staphylococcus aureus subsp. aureus N315
aaaaauaauuaugaa

SEQ ID NO: 2155320 - RNA, 14 nt, Staphylococcus aureus subsp. aureus N315
aaaaauaaaucucc

SEQ ID NO: 2155321 - RNA, 19 nt, Staphylococcus aureus subsp. aureus N315
aaaaauaauuaugaaaagu

SEQ ID NO: 2155322 - RNA, 21 nt, Staphylococcus aureus subsp. aureus N315
aaaaauacguuuaauguauaa

SEQ ID NO: 2155323 - RNA, 17 nt, Staphylococcus aureus subsp. aureus N315
aaaaaucauccauaaaa

SEQ ID NO: 2155324 - RNA, 23 nt, Staphylococcus aureus subsp. aureus N315
aaaaaucauucaccuaaaaagaa

SEQ ID NO: 2155325 - RNA, 15 nt, Staphylococcus aureus subsp. aureus N315
aaaaauauauuucaa

SEQ ID NO: 2155326 - RNA, 12 nt, Staphylococcus aureus subsp. aureus N315
aaaaauauccug

SEQ ID NO: 2155327 - RNA, 12 nt, Staphylococcus aureus subsp. aureus N315
aaaaauaguaaa

SEQ ID NO: 2155328 - RNA, 15 nt, Staphylococcus aureus subsp. aureus N315
aaaaauuaaaaaaca

SEQ ID NO: 2155329 - RNA, 23 nt, Staphylococcus aureus subsp. aureus N315
aaaaaucgaauuuucaaagacgu

SEQ ID NO: 2155330 - RNA, 23 nt, Staphylococcus aureus subsp. aureus N315
aaaaauuaacuauacuuuuauag

SEQ ID NO: 2155331 - RNA, 18 nt, Staphylococcus aureus subsp. aureus N315
aaaaauuucaaaaauagc

SEQ ID NO: 2155332 - RNA, 14 nt, Staphylococcus aureus subsp. aureus N315
aaaaauuucaauaa

SEQ ID NO: 2155333 - RNA, 22 nt, Staphylococcus aureus subsp. aureus N315
aaaaauuucgccucaucuaauu

SEQ ID NO: 2155334 - RNA, 13 nt, Staphylococcus aureus subsp. aureus N315
aaaacaauauuga

SEQ ID NO: 2155335 - RNA, 17 nt, Staphylococcus aureus subsp. aureus N315
aaaacaaugauuaaaau

SEQ ID NO: 2155336 - RNA, 19 nt, Staphylococcus aureus subsp. aureus N315
aaaacagaauuucaucaaa

SEQ ID NO: 2155337 - RNA, 16 nt, Staphylococcus aureus subsp. aureus N315
aaaacauuauuaagug

SEQ ID NO: 2155338 - RNA, 19 nt, Staphylococcus aureus subsp. aureus N315
aaaacauucccuuaauaau

SEQ ID NO: 2155339 - RNA, 12 nt, Staphylococcus aureus subsp. aureus N315
aaaaccaaaaga

SEQ ID NO: 2155340 - RNA, 22 nt, Staphylococcus aureus subsp. aureus N315
aaaacaccuucguuuaaauuca

SEQ ID NO: 2155341 - RNA, 22 nt, Staphylococcus aureus subsp. aureus N315
aaaagacggugaccuuauauuu

SEQ ID NO: 2155342 - RNA, 16 nt, Staphylococcus aureus subsp. aureus N315
aaaagacagcaguagg

SEQ ID NO: 2155343 - RNA, 14 nt, Staphylococcus aureus subsp. aureus N315
aaaagacagaaauu

SEQ ID NO: 2155344 - RNA, 12 nt, Staphylococcus aureus subsp. aureus N315
aaaagacagaaa

SEQ ID NO: 2155345 - RNA, 22 nt, Staphylococcus aureus subsp. aureus N315
aaaagaauuauucaaguaauau

SEQ ID NO: 2155346 - RNA, 18 nt, Staphylococcus aureus subsp. aureus N315
aaaagaauuauucaagua

SEQ ID NO: 2155347 - RNA, 16 nt, Staphylococcus aureus subsp. aureus N315
aaaagaaucauuuaaa

SEQ ID NO: 2155348 - RNA, 20 nt, Staphylococcus aureus subsp. aureus N315
aaaagaacuacgcauuuuaa

SEQ ID NO: 2155349 - RNA, 17 nt, Staphylococcus aureus subsp. aureus N315
aaaagaaauucuacagg

SEQ ID NO: 2155350 - RNA, 16 nt, Staphylococcus aureus subsp. aureus N315
aaaagaaauucuacag

SEQ ID NO: 2155351 - RNA, 12 nt, Staphylococcus aureus subsp. aureus N315
aaaagaaauucu

SEQ ID NO: 2155352 - RNA, 17 nt, Staphylococcus aureus subsp. aureus N315
aaaagaaauaucuaccu

SEQ ID NO: 2155353 - RNA, 21 nt, Staphylococcus aureus subsp. aureus N315
aaaagauguugcucgugcauu

SEQ ID NO: 2155354 - RNA, 17 nt, Staphylococcus aureus subsp. aureus N315
aaaagauauaaacauuu

SEQ ID NO: 2155355 - RNA, 16 nt, Staphylococcus aureus subsp. aureus N315
aaaagauaaauaaaag

SEQ ID NO: 2155356 - RNA, 17 nt, Staphylococcus aureus subsp. aureus N315
aaaagauucggaaaaua

SEQ ID NO: 2155357 - RNA, 20 nt, Staphylococcus aureus subsp. aureus N315
aaaagcacuagccguuauuu

SEQ ID NO: 2155358 - RNA, 14 nt, Staphylococcus aureus subsp. aureus N315
aaaacuacauuugg

SEQ ID NO: 2155359 - RNA, 20 nt, Staphylococcus aureus subsp. aureus N315
aaaacuaaucaaauuaguca

SEQ ID NO: 2155360 - RNA, 13 nt, Staphylococcus aureus subsp. aureus N315
aaaacuaaugaua

SEQ ID NO: 2155361 - RNA, 13 nt, Staphylococcus aureus subsp. aureus N315
aaaacuauuuuaa

SEQ ID NO: 2155362 - RNA, 18 nt, Staphylococcus aureus subsp. aureus N315
aaaacuauuuuaaaaaug

SEQ ID NO: 2155363 - RNA, 16 nt, Staphylococcus aureus subsp. aureus N315
aaaacuacugauuuau

SEQ ID NO: 2155364 - RNA, 16 nt, Staphylococcus aureus subsp. aureus N315
aaaacuagaacuuagu

SEQ ID NO: 2155365 - RNA, 12 nt, Staphylococcus aureus subsp. aureus N315
aaaacguuuaau

SEQ ID NO: 2155366 - RNA, 18 nt, Staphylococcus aureus subsp. aureus N315
aaaacguugaguauuacu

SEQ ID NO: 2155367 - RNA, 16 nt, Staphylococcus aureus subsp. aureus N315
aaaacgugcaaauaaa

SEQ ID NO: 2155368 - RNA, 16 nt, Staphylococcus aureus subsp. aureus N315
aaaacgugacauuuuc

SEQ ID NO: 2155369 - RNA, 15 nt, Staphylococcus aureus subsp. aureus N315
aaaacuuguaaucau

SEQ ID NO: 2155370 - RNA, 21 nt, Staphylococcus aureus subsp. aureus N315
aaaacuucccuuuggaagcaa

SEQ ID NO: 2155371 - RNA, 18 nt, Staphylococcus aureus subsp. aureus N315
aaaacuuguuguuauuua

SEQ ID NO: 2155372 - RNA, 16 nt, Staphylococcus aureus subsp. aureus N315
aaaacucuaaaaguug

SEQ ID NO: 2155373 - RNA, 19 nt, Staphylococcus aureus subsp. aureus N315
aaaagcagucgaacaauga

SEQ ID NO: 2155374 - RNA, 23 nt, Staphylococcus aureus subsp. aureus N315
aaaagcaugauacucaauaaaau

SEQ ID NO: 2155375 - RNA, 21 nt, Staphylococcus aureus subsp. aureus N315
aaaagcccaccuaaaaaguac

SEQ ID NO: 2155376 - RNA, 22 nt, Staphylococcus aureus subsp. aureus N315
aaaagccuacuuugucugcaau

SEQ ID NO: 2155377 - RNA, 22 nt, Staphylococcus aureus subsp. aureus N315
aaaagccucuaaugauuaaaaa

SEQ ID NO: 2155378 - RNA, 23 nt, Staphylococcus aureus subsp. aureus N315
aaaagccucuaaugauuaaaaau

SEQ ID NO: 2155379 - RNA, 17 nt, Staphylococcus aureus subsp. aureus N315
aaaaguaauuaaauacu

SEQ ID NO: 2155380 - RNA, 15 nt, Staphylococcus aureus subsp. aureus N315
aaaaguaaguaaaau

SEQ ID NO: 2155381 - RNA, 22 nt, Staphylococcus aureus subsp. aureus N315
aaaaguaaaaucuuuaacauuu

SEQ ID NO: 2155382 - RNA, 21 nt, Staphylococcus aureus subsp. aureus N315
aaaaguauugccguuauuuuc

SEQ ID NO: 2155383 - RNA, 17 nt, Staphylococcus aureus subsp. aureus N315
aaaagugcgauuaucag

SEQ ID NO: 2155384 - RNA, 23 nt, Staphylococcus aureus subsp. aureus N315
aaaagugcaaguccaaauaauau

SEQ ID NO: 2155385 - RNA, 13 nt, Staphylococcus aureus subsp. aureus N315
aaaaguguaaugu

SEQ ID NO: 2155386 - RNA, 22 nt, Staphylococcus aureus subsp. aureus N315
aaaaguguugacuuuaucaauu

SEQ ID NO: 2155387 - RNA, 18 nt, Staphylococcus aureus subsp. aureus N315
aaaaguuaucugcuuuuc

SEQ ID NO: 2155388 - RNA, 15 nt, Staphylococcus aureus subsp. aureus N315
aaaauaaaaaaccaa

SEQ ID NO: 2155389 - RNA, 17 nt, Staphylococcus aureus subsp. aureus N315
aaaauaaaaaaugcacu

SEQ ID NO: 2155390 - RNA, 14 nt, Staphylococcus aureus subsp. aureus N315
aaaauaaaacaaau

SEQ ID NO: 2155391 - RNA, 13 nt, Staphylococcus aureus subsp. aureus N315
aaaauaaaaccga

SEQ ID NO: 2155392 - RNA, 16 nt, Staphylococcus aureus subsp. aureus N315
aaaauaauagauaaua

SEQ ID NO: 2155393 - RNA, 17 nt, Staphylococcus aureus subsp. aureus N315
aaaauaaaaugcaaaga

SEQ ID NO: 2155394 - RNA, 19 nt, Staphylococcus aureus subsp. aureus N315
aaaauaaaauuaacgagcu

SEQ ID NO: 2155395 - RNA, 13 nt, Staphylococcus aureus subsp. aureus N315
aaaauagaaagaa

SEQ ID NO: 2155396 - RNA, 15 nt, Staphylococcus aureus subsp. aureus N315
aaaauagauugaaaa

SEQ ID NO: 2155397 - RNA, 22 nt, Staphylococcus aureus subsp. aureus N315
aaaauagauugaaaaaauaacu

SEQ ID NO: 2155398 - RNA, 20 nt, Staphylococcus aureus subsp. aureus N315
aaaauagccauauucauauu

SEQ ID NO: 2155399 - RNA, 20 nt, Staphylococcus aureus subsp. aureus N315
aaaauagcuauuaaaauaga

SEQ ID NO: 2155400 - RNA, 21 nt, Staphylococcus aureus subsp. aureus N315
aaaauagcguaauuauuauaa

SEQ ID NO: 2155401 - RNA, 22 nt, Staphylococcus aureus subsp. aureus N315
aaaauaguucuuuaaauuauau

SEQ ID NO: 2155402 - RNA, 16 nt, Staphylococcus aureus subsp. aureus N315
aaaauaguucuuuaaa

SEQ ID NO: 2155403 - RNA, 16 nt, Staphylococcus aureus subsp. aureus N315
aaaauacgcaaaccaa

SEQ ID NO: 2155404 - RNA, 16 nt, Staphylococcus aureus subsp. aureus N315
aaaauaauuaaauaaa

SEQ ID NO: 2155405 - RNA, 19 nt, Staphylococcus aureus subsp. aureus N315
aaaauagaaaaauuucaaa

SEQ ID NO: 2155406 - RNA, 17 nt, Staphylococcus aureus subsp. aureus N315
aaaaucacgcuaacauu

SEQ ID NO: 2155407 - RNA, 15 nt, Staphylococcus aureus subsp. aureus N315
aaaaucaacuuuucu

SEQ ID NO: 2155408 - RNA, 24 nt, Staphylococcus aureus subsp. aureus N315
aaaauaguucuuuaaauuauauac

SEQ ID NO: 2155409 - RNA, 21 nt, Staphylococcus aureus subsp. aureus N315
aaaaucaaagaggcuuuaaaa

SEQ ID NO: 2155410 - RNA, 15 nt, Staphylococcus aureus subsp. aureus N315
aaaauauagcuauua

SEQ ID NO: 2155411 - RNA, 21 nt, Staphylococcus aureus subsp. aureus N315
aaaauauagcuauuacuauaa

SEQ ID NO: 2155412 - RNA, 16 nt, Staphylococcus aureus subsp. aureus N315
aaacaaaucuuuuaaa

SEQ ID NO: 2155413 - RNA, 14 nt, Staphylococcus aureus subsp. aureus N315
aaacaaauccauua

SEQ ID NO: 2155414 - RNA, 19 nt, Staphylococcus aureus subsp. aureus N315
aaacaaagguuuguaagac

SEQ ID NO: 2155415 - RNA, 12 nt, Staphylococcus aureus subsp. aureus N315
aaacaacaucac

SEQ ID NO: 2155416 - RNA, 19 nt, Staphylococcus aureus subsp. aureus N315
aaacaaauuaguuugauau

SEQ ID NO: 2155417 - RNA, 17 nt, Staphylococcus aureus subsp. aureus N315
aaacaaaaaauaucuuu

SEQ ID NO: 2155418 - RNA, 21 nt, Staphylococcus aureus subsp. aureus N315
aaacaaaaaauaucuuuuugu

SEQ ID NO: 2155419 - RNA, 15 nt, Staphylococcus aureus subsp. aureus N315
aaacaaaaaacuucc

SEQ ID NO: 2155420 - RNA, 16 nt, Staphylococcus aureus subsp. aureus N315
aaaauuuuuaaaaaaa

SEQ ID NO: 2155421 - RNA, 20 nt, Staphylococcus aureus subsp. aureus N315
aaacaaaaaucuacuaagug

SEQ ID NO: 2155422 - RNA, 19 nt, Staphylococcus aureus subsp. aureus N315
aaaauucaauauuaaucau

SEQ ID NO: 2155423 - RNA, 15 nt, Staphylococcus aureus subsp. aureus N315
aaaauuauguaaaaa

SEQ ID NO: 2155424 - RNA, 23 nt, Staphylococcus aureus subsp. aureus N315
aaaauuuucuugguuugagaauc

SEQ ID NO: 2155425 - RNA, 12 nt, Staphylococcus aureus subsp. aureus N315
aaaauuucugcu

SEQ ID NO: 2155426 - RNA, 22 nt, Staphylococcus aureus subsp. aureus N315
aaaauuucauauuguuuaggau

SEQ ID NO: 2155427 - RNA, 19 nt, Staphylococcus aureus subsp. aureus N315
aaaauuucaccgcuuucaa

SEQ ID NO: 2155428 - RNA, 22 nt, Staphylococcus aureus subsp. aureus N315
aaaaucguauagauuaaaaaau

SEQ ID NO: 2155429 - RNA, 23 nt, Staphylococcus aureus subsp. aureus N315
aaaaugcaauuuuucacuuauaa

SEQ ID NO: 2155430 - RNA, 14 nt, Staphylococcus aureus subsp. aureus N315
aaaaugauuauucu

SEQ ID NO: 2155431 - RNA, 14 nt, Staphylococcus aureus subsp. aureus N315
aaaaugaugcacua

SEQ ID NO: 2155432 - RNA, 15 nt, Staphylococcus aureus subsp. aureus N315
aaaauccugaaauua

SEQ ID NO: 2155433 - RNA, 22 nt, Staphylococcus aureus subsp. aureus N315
aaaaucgaacaaaugaaaaagu

SEQ ID NO: 2155434 - RNA, 23 nt, Staphylococcus aureus subsp. aureus N315
aaaaucgcaaaugcgauuuugga

SEQ ID NO: 2155435 - RNA, 18 nt, Staphylococcus aureus subsp. aureus N315
aaaaucggcuuucuaagu

SEQ ID NO: 2155436 - RNA, 20 nt, Staphylococcus aureus subsp. aureus N315
aaaaucgguuugauuaaaau

SEQ ID NO: 2155437 - RNA, 16 nt, Staphylococcus aureus subsp. aureus N315
aaaauuauguaaaaaa

SEQ ID NO: 2155438 - RNA, 15 nt, Staphylococcus aureus subsp. aureus N315
aaaauuauuaaaaaa

SEQ ID NO: 2155439 - RNA, 16 nt, Staphylococcus aureus subsp. aureus N315
aaaauuauuaaaaaaa

SEQ ID NO: 2155440 - RNA, 18 nt, Staphylococcus aureus subsp. aureus N315
aaaauuauugaauuugaa

SEQ ID NO: 2155441 - RNA, 21 nt, Staphylococcus aureus subsp. aureus N315
aaaauuauugaauuugaauaa

SEQ ID NO: 2155442 - RNA, 10 nt, Staphylococcus aureus subsp. aureus N315
aaaauuauuu

SEQ ID NO: 2155443 - RNA, 17 nt, Staphylococcus aureus subsp. aureus N315
aaaaugcuuuuuugaaa

SEQ ID NO: 2155444 - RNA, 22 nt, Staphylococcus aureus subsp. aureus N315
aaaauuagccuaauugagagaa

SEQ ID NO: 2155445 - RNA, 21 nt, Staphylococcus aureus subsp. aureus N315
aaaaugcgcuuccaauuuaaa

SEQ ID NO: 2155446 - RNA, 23 nt, Staphylococcus aureus subsp. aureus N315
aaaaugcgcuuccaauuuaaaau

SEQ ID NO: 2155447 - RNA, 18 nt, Staphylococcus aureus subsp. aureus N315
aaaaugccaacuauaccu

SEQ ID NO: 2155448 - RNA, 18 nt, Staphylococcus aureus subsp. aureus N315
aaaugcuuaagaaauuuu

SEQ ID NO: 2155449 - RNA, 14 nt, Staphylococcus aureus subsp. aureus N315
aaaugcuguuuuau

SEQ ID NO: 2155450 - RNA, 12 nt, Staphylococcus aureus subsp. aureus N315
aaaugcuuauau

SEQ ID NO: 2155451 - RNA, 20 nt, Staphylococcus aureus subsp. aureus N315
aaaugcuuaauaaaaucaaa

SEQ ID NO: 2155452 - RNA, 22 nt, Staphylococcus aureus subsp. aureus N315
aaaugcuuaauuuguuuuaaau

SEQ ID NO: 2155453 - RNA, 20 nt, Staphylococcus aureus subsp. aureus N315
aaaugcuuauauaaacaaaa

SEQ ID NO: 2155454 - RNA, 23 nt, Staphylococcus aureus subsp. aureus N315
aaaugcuauauuuagaaugauga

SEQ ID NO: 2155455 - RNA, 20 nt, Staphylococcus aureus subsp. aureus N315
aaaugccgagauuauuaugu

SEQ ID NO: 2155456 - RNA, 20 nt, Staphylococcus aureus subsp. aureus N315
aaaugcgcuuccaauuuaaa

SEQ ID NO: 2155457 - RNA, 22 nt, Staphylococcus aureus subsp. aureus N315
aaaucuuuuagcuuuuguaaag

SEQ ID NO: 2155458 - RNA, 15 nt, Staphylococcus aureus subsp. aureus N315
aaaucuuuuacuaaa

SEQ ID NO: 2155459 - RNA, 21 nt, Staphylococcus aureus subsp. aureus N315
aaaucuuuuacuaaaugaauu

SEQ ID NO: 2155460 - RNA, 22 nt, Staphylococcus aureus subsp. aureus N315
aaaucuuuuaaauuuaguaucu

SEQ ID NO: 2155461 - RNA, 22 nt, Staphylococcus aureus subsp. aureus N315
aaaugaaaguaccuaaaauaga

SEQ ID NO: 2155462 - RNA, 13 nt, Staphylococcus aureus subsp. aureus N315
aaaugaaaguacc

SEQ ID NO: 2155463 - RNA, 13 nt, Staphylococcus aureus subsp. aureus N315
aaaugauuaauaa

SEQ ID NO: 2155464 - RNA, 19 nt, Staphylococcus aureus subsp. aureus N315
aaaugaugcaguaaaacca

SEQ ID NO: 2155465 - RNA, 20 nt, Staphylococcus aureus subsp. aureus N315
aaaugauguaacguuucuuu

SEQ ID NO: 2155466 - RNA, 16 nt, Staphylococcus aureus subsp. aureus N315
aaaugauuaauaacau

SEQ ID NO: 2155467 - RNA, 22 nt, Staphylococcus aureus subsp. aureus N315
aaaugauucuuuauaagcuuuu

SEQ ID NO: 2155468 - RNA, 14 nt, Staphylococcus aureus subsp. aureus N315
aaaugauuuauucu

SEQ ID NO: 2155469 - RNA, 23 nt, Staphylococcus aureus subsp. aureus N315
aaaugauuuauucuaaauauauu

SEQ ID NO: 2155470 - RNA, 19 nt, Staphylococcus aureus subsp. aureus N315
aaaugauuuauucuaaaua

SEQ ID NO: 2155471 - RNA, 18 nt, Staphylococcus aureus subsp. aureus N315
aaaugcaaagacuaaaaa

SEQ ID NO: 2155472 - RNA, 10 nt, Staphylococcus aureus subsp. aureus N315
aaaugaacca

SEQ ID NO: 2155473 - RNA, 14 nt, Staphylococcus aureus subsp. aureus N315
aaaugaaauaggcg

SEQ ID NO: 2155474 - RNA, 18 nt, Staphylococcus aureus subsp. aureus N315
aaaugaaauauuugauga

SEQ ID NO: 2155475 - RNA, 19 nt, Staphylococcus aureus subsp. aureus N315
aaaucuuaaagauuuuuca

SEQ ID NO: 2155476 - RNA, 15 nt, Staphylococcus aureus subsp. aureus N315
aaaucuguuuaaauu

SEQ ID NO: 2155477 - RNA, 17 nt, Staphylococcus aureus subsp. aureus N315
aaaucuccauuaaucau

SEQ ID NO: 2155478 - RNA, 18 nt, Staphylococcus aureus subsp. aureus N315
aaaucuccauuaaucauu

SEQ ID NO: 2155479 - RNA, 22 nt, Staphylococcus aureus subsp. aureus N315
aaaucucauaauaauucaguaa

SEQ ID NO: 2155480 - RNA, 14 nt, Staphylococcus aureus subsp. aureus N315
aaaucucaacagca

SEQ ID NO: 2155481 - RNA, 15 nt, Staphylococcus aureus subsp. aureus N315
aaaucucaacagcaa

SEQ ID NO: 2155482 - RNA, 19 nt, Staphylococcus aureus subsp. aureus N315
aaaucguuaaggaaagcuu

SEQ ID NO: 2155483 - RNA, 15 nt, Staphylococcus aureus subsp. aureus N315
aaaucguuauaagua

SEQ ID NO: 2155484 - RNA, 23 nt, Staphylococcus aureus subsp. aureus N315
aaaucuaauccugguauaaugga

SEQ ID NO: 2155485 - RNA, 15 nt, Staphylococcus aureus subsp. aureus N315
aaaucuacaauauua

SEQ ID NO: 2155486 - RNA, 20 nt, Staphylococcus aureus subsp. aureus N315
aaaucuauaaauaucaauaa

SEQ ID NO: 2155487 - RNA, 21 nt, Staphylococcus aureus subsp. aureus N315
aaaucuauaccauuccaaaaa

SEQ ID NO: 2155488 - RNA, 15 nt, Staphylococcus aureus subsp. aureus N315
aaaucuauauaaagu

SEQ ID NO: 2155489 - RNA, 16 nt, Staphylococcus aureus subsp. aureus N315
aaaucuaucuacucaa

SEQ ID NO: 2155490 - RNA, 18 nt, Staphylococcus aureus subsp. aureus N315
aaaucuaucuacucaaau

SEQ ID NO: 2155491 - RNA, 15 nt, Staphylococcus aureus subsp. aureus N315
aaaucgauuaauuau

SEQ ID NO: 2155492 - RNA, 14 nt, Staphylococcus aureus subsp. aureus N315
aaaucgauuaagaa

SEQ ID NO: 2155493 - RNA, 15 nt, Staphylococcus aureus subsp. aureus N315
aaaucgauaacaguu

SEQ ID NO: 2155494 - RNA, 17 nt, Staphylococcus aureus subsp. aureus N315
aaaucauuuaaauuagu

SEQ ID NO: 2155495 - RNA, 18 nt, Staphylococcus aureus subsp. aureus N315
aaaucauuaguuguauca

SEQ ID NO: 2155496 - RNA, 18 nt, Staphylococcus aureus subsp. aureus N315
aaaucauucaccuaaaaa

SEQ ID NO: 2155497 - RNA, 18 nt, Staphylococcus aureus subsp. aureus N315
aaaucauucauuugcaaa

SEQ ID NO: 2155498 - RNA, 14 nt, Staphylococcus aureus subsp. aureus N315
aaaucauucuuuau

SEQ ID NO: 2155499 - RNA, 22 nt, Staphylococcus aureus subsp. aureus N315
aaaucaugacauaaaacuuaca

SEQ ID NO: 2155500 - RNA, 21 nt, Staphylococcus aureus subsp. aureus N315
aaaucaucuuaugacugcuuu

SEQ ID NO: 2155501 - RNA, 11 nt, Staphylococcus aureus subsp. aureus N315
aaaucaucuua

SEQ ID NO: 2155502 - RNA, 13 nt, Staphylococcus aureus subsp. aureus N315
aaaucaucuuaac

SEQ ID NO: 2155503 - RNA, 19 nt, Staphylococcus aureus subsp. aureus N315
aaaaagcugauuucuauca

SEQ ID NO: 2155504 - RNA, 15 nt, Staphylococcus aureus subsp. aureus N315
aaaaagcucaauccu

SEQ ID NO: 2155505 - RNA, 17 nt, Staphylococcus aureus subsp. aureus N315
aaauuacaaauuaucua

SEQ ID NO: 2155506 - RNA, 16 nt, Staphylococcus aureus subsp. aureus N315
aaauuaauugcuuuca

SEQ ID NO: 2155507 - RNA, 11 nt, Staphylococcus aureus subsp. aureus N315
aaauuaacuag

SEQ ID NO: 2155508 - RNA, 17 nt, Staphylococcus aureus subsp. aureus N315
aaauuaacuuaaaauuu

SEQ ID NO: 2155509 - RNA, 20 nt, Staphylococcus aureus subsp. aureus N315
aaauuaacuuaaaauuuaaa

SEQ ID NO: 2155510 - RNA, 20 nt, Staphylococcus aureus subsp. aureus N315
aaaaagcaguaaguugauuu

SEQ ID NO: 2155511 - RNA, 15 nt, Staphylococcus aureus subsp. aureus N315
aaauuaagaagaaau

SEQ ID NO: 2155512 - RNA, 16 nt, Staphylococcus aureus subsp. aureus N315
aaauuaagaagaaaua

SEQ ID NO: 2155513 - RNA, 21 nt, Staphylococcus aureus subsp. aureus N315
aaauuaacuuagguuauuaua

SEQ ID NO: 2155514 - RNA, 22 nt, Staphylococcus aureus subsp. aureus N315
aaauuaacuuaaaauuuaaaua

SEQ ID NO: 2155515 - RNA, 18 nt, Staphylococcus aureus subsp. aureus N315
aaauguugacuacucaau

SEQ ID NO: 2155516 - RNA, 15 nt, Staphylococcus aureus subsp. aureus N315
aaauuaaauuuuguu

SEQ ID NO: 2155517 - RNA, 19 nt, Staphylococcus aureus subsp. aureus N315
aaauguuaaugcuucguaa

SEQ ID NO: 2155518 - RNA, 21 nt, Staphylococcus aureus subsp. aureus N315
aaauguuacacaaauuaaaac

SEQ ID NO: 2155519 - RNA, 22 nt, Staphylococcus aureus subsp. aureus N315
aaauguuaucaauaucuucgcc

SEQ ID NO: 2155520 - RNA, 15 nt, Staphylococcus aureus subsp. aureus N315
aaauguuaaagauua

SEQ ID NO: 2155521 - RNA, 16 nt, Staphylococcus aureus subsp. aureus N315
aaauguuaaauucuaa

SEQ ID NO: 2155522 - RNA, 18 nt, Staphylococcus aureus subsp. aureus N315
aaauguguuaaaauauau

SEQ ID NO: 2155523 - RNA, 14 nt, Staphylococcus aureus subsp. aureus N315
aaauguuauugcuu

SEQ ID NO: 2155524 - RNA, 22 nt, Staphylococcus aureus subsp. aureus N315
aaauguuauugcuuauuuuugu

SEQ ID NO: 2155525 - RNA, 15 nt, Staphylococcus aureus subsp. aureus N315
aaauguuauugcuua

SEQ ID NO: 2155526 - RNA, 18 nt, Staphylococcus aureus subsp. aureus N315
aaauguucagguucaaaa

SEQ ID NO: 2155527 - RNA, 14 nt, Staphylococcus aureus subsp. aureus N315
aaauuaucagaauc

SEQ ID NO: 2155528 - RNA, 18 nt, Staphylococcus aureus subsp. aureus N315
aaauuauauagaaaacua

SEQ ID NO: 2155529 - RNA, 15 nt, Staphylococcus aureus subsp. aureus N315
aaauuacuauauuua

SEQ ID NO: 2155530 - RNA, 13 nt, Staphylococcus aureus subsp. aureus N315
aaauuauauaaau

SEQ ID NO: 2155531 - RNA, 17 nt, Staphylococcus aureus subsp. aureus N315
aaauuauugaauuugaa

SEQ ID NO: 2155532 - RNA, 22 nt, Staphylococcus aureus subsp. aureus N315
aaauuaugauuauauuuucuca

SEQ ID NO: 2155533 - RNA, 13 nt, Staphylococcus aureus subsp. aureus N315
aaauuaugauuau

SEQ ID NO: 2155534 - RNA, 18 nt, Staphylococcus aureus subsp. aureus N315
aaauuaugauuauauuuu

SEQ ID NO: 2155535 - RNA, 18 nt, Staphylococcus aureus subsp. aureus N315
aaauucaacgucaucaaa

SEQ ID NO: 2155536 - RNA, 16 nt, Staphylococcus aureus subsp. aureus N315
aaauucaacgucauca

SEQ ID NO: 2155537 - RNA, 15 nt, Staphylococcus aureus subsp. aureus N315
aaauucaacuuuuca

SEQ ID NO: 2155538 - RNA, 22 nt, Staphylococcus aureus subsp. aureus N315
aaauucuacaggcaaugcgagu

SEQ ID NO: 2155539 - RNA, 17 nt, Staphylococcus aureus subsp. aureus N315
aaauucuacagguaaug

SEQ ID NO: 2155540 - RNA, 21 nt, Staphylococcus aureus subsp. aureus N315
aaauucuacagguaaugcaag

SEQ ID NO: 2155541 - RNA, 21 nt, Staphylococcus aureus subsp. aureus N315
aaauucuacaggcaaugcaag

SEQ ID NO: 2155542 - RNA, 22 nt, Staphylococcus aureus subsp. aureus N315
aaauucuacaggcaaugcaagu

SEQ ID NO: 2155543 - RNA, 22 nt, Staphylococcus aureus subsp. aureus N315
aaauucuacagguaaugcaagu

SEQ ID NO: 2155544 - RNA, 20 nt, Staphylococcus aureus subsp. aureus N315
aaauucuauaauuuuaauua

SEQ ID NO: 2155545 - RNA, 17 nt, Staphylococcus aureus subsp. aureus N315
aaauucucaguguuggg

SEQ ID NO: 2155546 - RNA, 16 nt, Staphylococcus aureus subsp. aureus N315
aaauucgaaaagaaau

SEQ ID NO: 2155547 - RNA, 17 nt, Staphylococcus aureus subsp. aureus N315
aaauucgaaaagaaauu

SEQ ID NO: 2155548 - RNA, 14 nt, Staphylococcus aureus subsp. aureus N315
aaauaauagcaaaa

SEQ ID NO: 2155549 - RNA, 16 nt, Staphylococcus aureus subsp. aureus N315
aaauaagugauaaaua

SEQ ID NO: 2155550 - RNA, 22 nt, Staphylococcus aureus subsp. aureus N315
aaauaauaaguugaauauaaaa

SEQ ID NO: 2155551 - RNA, 18 nt, Staphylococcus aureus subsp. aureus N315
aaauaagcuuguaacaag

SEQ ID NO: 2155552 - RNA, 20 nt, Staphylococcus aureus subsp. aureus N315
aaauaacuuuuuaaaggacc

SEQ ID NO: 2155553 - RNA, 14 nt, Staphylococcus aureus subsp. aureus N315
aaauaacuucguuu

SEQ ID NO: 2155554 - RNA, 19 nt, Staphylococcus aureus subsp. aureus N315
aaauaacugcuaauuuuuu

SEQ ID NO: 2155555 - RNA, 18 nt, Staphylococcus aureus subsp. aureus N315
aaauaacuguaaaacauu

SEQ ID NO: 2155556 - RNA, 19 nt, Staphylococcus aureus subsp. aureus N315
aaauaacguuaauauaauu

SEQ ID NO: 2155557 - RNA, 19 nt, Staphylococcus aureus subsp. aureus N315
aaauaaacacaucuaugug

SEQ ID NO: 2155558 - RNA, 12 nt, Staphylococcus aureus subsp. aureus N315
aaauaaaucucc

SEQ ID NO: 2155559 - RNA, 19 nt, Staphylococcus aureus subsp. aureus N315
aaauaaauuuuacgaaaau

SEQ ID NO: 2155560 - RNA, 19 nt, Staphylococcus aureus subsp. aureus N315
aaauaaaugacauuuaaua

SEQ ID NO: 2155561 - RNA, 22 nt, Staphylococcus aureus subsp. aureus N315
aaauaaaugacuucacauuuau

SEQ ID NO: 2155562 - RNA, 22 nt, Staphylococcus aureus subsp. aureus N315
aaauaaauguccgacuugauaa

SEQ ID NO: 2155563 - RNA, 21 nt, Staphylococcus aureus subsp. aureus N315
aaauaaauuuugcgaaaauau

SEQ ID NO: 2155564 - RNA, 16 nt, Staphylococcus aureus subsp. aureus N315
aaauaacaaacauuaa

SEQ ID NO: 2155565 - RNA, 15 nt, Staphylococcus aureus subsp. aureus N315
aaagucauuaaaugu

SEQ ID NO: 2155566 - RNA, 19 nt, Staphylococcus aureus subsp. aureus N315
aaauaaaacgcuucauaua

SEQ ID NO: 2155567 - RNA, 21 nt, Staphylococcus aureus subsp. aureus N315
aaauaaaacgacucauuauaa

SEQ ID NO: 2155568 - RNA, 15 nt, Staphylococcus aureus subsp. aureus N315
aaauaaaauuaaaac

SEQ ID NO: 2155569 - RNA, 12 nt, Staphylococcus aureus subsp. aureus N315
aaauaaaaugcu

SEQ ID NO: 2155570 - RNA, 22 nt, Staphylococcus aureus subsp. aureus N315
aaauaaaauuuuuuucauaauu

SEQ ID NO: 2155571 - RNA, 18 nt, Staphylococcus aureus subsp. aureus N315
aaauacuugaauuuaaua

SEQ ID NO: 2155572 - RNA, 21 nt, Staphylococcus aureus subsp. aureus N315
aaauacuugaauuuaauaagu

SEQ ID NO: 2155573 - RNA, 20 nt, Staphylococcus aureus subsp. aureus N315
aaauagccauauucauauua

SEQ ID NO: 2155574 - RNA, 22 nt, Staphylococcus aureus subsp. aureus N315
aaauacuuguuuaccuaaaucu

SEQ ID NO: 2155575 - RNA, 17 nt, Staphylococcus aureus subsp. aureus N315
aaauagccauauucaua

SEQ ID NO: 2155576 - RNA, 16 nt, Staphylococcus aureus subsp. aureus N315
aaauagcuguuugaua

SEQ ID NO: 2155577 - RNA, 13 nt, Staphylococcus aureus subsp. aureus N315
aaauagccuucaa

SEQ ID NO: 2155578 - RNA, 20 nt, Staphylococcus aureus subsp. aureus N315
aaauagcguaauuauuauaa

SEQ ID NO: 2155579 - RNA, 17 nt, Staphylococcus aureus subsp. aureus N315
aaauagcguaauuauua

SEQ ID NO: 2155580 - RNA, 21 nt, Staphylococcus aureus subsp. aureus N315
aaauaaugaugcauaagauuu

SEQ ID NO: 2155581 - RNA, 23 nt, Staphylococcus aureus subsp. aureus N315
aaauaaugauauauuacaccauu

SEQ ID NO: 2155582 - RNA, 16 nt, Staphylococcus aureus subsp. aureus N315
aaauacgguacagaua

SEQ ID NO: 2155583 - RNA, 20 nt, Staphylococcus aureus subsp. aureus N315
aaauacuauacugaugaaaa

SEQ ID NO: 2155584 - RNA, 15 nt, Staphylococcus aureus subsp. aureus N315
aaauacuauacugau

SEQ ID NO: 2155585 - RNA, 16 nt, Staphylococcus aureus subsp. aureus N315
aaauacuauucuuucu

SEQ ID NO: 2155586 - RNA, 19 nt, Staphylococcus aureus subsp. aureus N315
aaauacucccuucaacaua

SEQ ID NO: 2155587 - RNA, 13 nt, Staphylococcus aureus subsp. aureus N315
aaauacguuuaau

SEQ ID NO: 2155588 - RNA, 11 nt, Staphylococcus aureus subsp. aureus N315
aaauaaugaau

SEQ ID NO: 2155589 - RNA, 17 nt, Staphylococcus aureus subsp. aureus N315
aaauaaucgaacagaaa

SEQ ID NO: 2155590 - RNA, 17 nt, Staphylococcus aureus subsp. aureus N315
aaauaaucccaaccauu

SEQ ID NO: 2155591 - RNA, 13 nt, Staphylococcus aureus subsp. aureus N315
aaauaauauaaaa

SEQ ID NO: 2155592 - RNA, 14 nt, Staphylococcus aureus subsp. aureus N315
aaauaauauaaaac

SEQ ID NO: 2155593 - RNA, 14 nt, Staphylococcus aureus subsp. aureus N315
aaauaauauaaaaa

SEQ ID NO: 2155594 - RNA, 16 nt, Staphylococcus aureus subsp. aureus N315
aaauaauauaaaacga

SEQ ID NO: 2155595 - RNA, 22 nt, Staphylococcus aureus subsp. aureus N315
aaauaauaugaauuuagaugca

SEQ ID NO: 2155596 - RNA, 17 nt, Staphylococcus aureus subsp. aureus N315
aaauauugauauaaaaa

SEQ ID NO: 2155597 - RNA, 12 nt, Staphylococcus aureus subsp. aureus N315
aaauauucuuau

SEQ ID NO: 2155598 - RNA, 14 nt, Staphylococcus aureus subsp. aureus N315
aaauauucuuaucu

SEQ ID NO: 2155599 - RNA, 14 nt, Staphylococcus aureus subsp. aureus N315
aaauauugaacaau

SEQ ID NO: 2155600 - RNA, 19 nt, Staphylococcus aureus subsp. aureus N315
aaauauugaagaugcuuua

SEQ ID NO: 2155601 - RNA, 17 nt, Staphylococcus aureus subsp. aureus N315
aaauauugaauaaucau

SEQ ID NO: 2155602 - RNA, 18 nt, Staphylococcus aureus subsp. aureus N315
aaauauuauuaaaucaaa

SEQ ID NO: 2155603 - RNA, 21 nt, Staphylococcus aureus subsp. aureus N315
aaauauugauucuagugaaau

SEQ ID NO: 2155604 - RNA, 15 nt, Staphylococcus aureus subsp. aureus N315
aaauauuuaaaauau

SEQ ID NO: 2155605 - RNA, 16 nt, Staphylococcus aureus subsp. aureus N315
aaauauuuaaaauauu

SEQ ID NO: 2155606 - RNA, 19 nt, Staphylococcus aureus subsp. aureus N315
aaauauuuaaccuuuaaaa

SEQ ID NO: 2155607 - RNA, 15 nt, Staphylococcus aureus subsp. aureus N315
aaauauuuaucuuua

SEQ ID NO: 2155608 - RNA, 18 nt, Staphylococcus aureus subsp. aureus N315
aaauauuuuuuaaaauga

SEQ ID NO: 2155609 - RNA, 23 nt, Staphylococcus aureus subsp. aureus N315
aaauauuuuuaauuauuuuaaaa

SEQ ID NO: 2155610 - RNA, 16 nt, Staphylococcus aureus subsp. aureus N315
aaauauuuuuaauuau

SEQ ID NO: 2155611 - RNA, 22 nt, Staphylococcus aureus subsp. aureus N315
aaauauuuuuaauuauuuuaaa

SEQ ID NO: 2155612 - RNA, 18 nt, Staphylococcus aureus subsp. aureus N315
aaauauuuuaucuguaaa

SEQ ID NO: 2155613 - RNA, 14 nt, Staphylococcus aureus subsp. aureus N315
aaauauuugaaaau

SEQ ID NO: 2155614 - RNA, 14 nt, Staphylococcus aureus subsp. aureus N315
aaaucaaagaggaa

SEQ ID NO: 2155615 - RNA, 14 nt, Staphylococcus aureus subsp. aureus N315
aaaucaaaaauaau

SEQ ID NO: 2155616 - RNA, 14 nt, Staphylococcus aureus subsp. aureus N315
aaauaguaagguuu

SEQ ID NO: 2155617 - RNA, 16 nt, Staphylococcus aureus subsp. aureus N315
aaauagugaaauuaua

SEQ ID NO: 2155618 - RNA, 18 nt, Staphylococcus aureus subsp. aureus N315
aaauaucuuuuuguuuau

SEQ ID NO: 2155619 - RNA, 18 nt, Staphylococcus aureus subsp. aureus N315
aaauaguuaagauuuuaa

SEQ ID NO: 2155620 - RNA, 18 nt, Staphylococcus aureus subsp. aureus N315
aaauaggcgcuuguaaaa

SEQ ID NO: 2155621 - RNA, 22 nt, Staphylococcus aureus subsp. aureus N315
aaauaggcgcuuguaaaauuuu

SEQ ID NO: 2155622 - RNA, 21 nt, Staphylococcus aureus subsp. aureus N315
aaauaggcacgugcuuuggug

SEQ ID NO: 2155623 - RNA, 11 nt, Staphylococcus aureus subsp. aureus N315
aaauauuauuu

SEQ ID NO: 2155624 - RNA, 13 nt, Staphylococcus aureus subsp. aureus N315
aaauaugauuuaa

SEQ ID NO: 2155625 - RNA, 15 nt, Staphylococcus aureus subsp. aureus N315
aaauaugauuuaaaa

SEQ ID NO: 2155626 - RNA, 15 nt, Staphylococcus aureus subsp. aureus N315
aaauauggauuuuga

SEQ ID NO: 2155627 - RNA, 22 nt, Staphylococcus aureus subsp. aureus N315
aaauaugacgcgugaauuaaaa

SEQ ID NO: 2155628 - RNA, 18 nt, Staphylococcus aureus subsp. aureus N315
aaauaugauguuaaaaaa

SEQ ID NO: 2155629 - RNA, 16 nt, Staphylococcus aureus subsp. aureus N315
aaauaugauguuaaaa

SEQ ID NO: 2155630 - RNA, 16 nt, Staphylococcus aureus subsp. aureus N315
aaauaugacacauaca

SEQ ID NO: 2155631 - RNA, 15 nt, Staphylococcus aureus subsp. aureus N315
aaaucacaggaaaau

SEQ ID NO: 2155632 - RNA, 13 nt, Staphylococcus aureus subsp. aureus N315
aaaucaauguacu

SEQ ID NO: 2155633 - RNA, 15 nt, Staphylococcus aureus subsp. aureus N315
aaaucaacuuuucua

SEQ ID NO: 2155634 - RNA, 22 nt, Staphylococcus aureus subsp. aureus N315
aaaucaagacucccuuuuuaaa

SEQ ID NO: 2155635 - RNA, 12 nt, Staphylococcus aureus subsp. aureus N315
aaaucaagaaau

SEQ ID NO: 2155636 - RNA, 17 nt, Staphylococcus aureus subsp. aureus N315
aaaucaaauacaucaau

SEQ ID NO: 2155637 - RNA, 14 nt, Staphylococcus aureus subsp. aureus N315
aaaucaacaccaac

SEQ ID NO: 2155638 - RNA, 15 nt, Staphylococcus aureus subsp. aureus N315
aaaucaacaagaacu

SEQ ID NO: 2155639 - RNA, 23 nt, Staphylococcus aureus subsp. aureus N315
aaaucaagacucccuuuuuaaaa

SEQ ID NO: 2155640 - RNA, 13 nt, Staphylococcus aureus subsp. aureus N315
aaaucaauccauc

SEQ ID NO: 2155641 - RNA, 13 nt, Staphylococcus aureus subsp. aureus N315
aaaucaauaccaa

SEQ ID NO: 2155642 - RNA, 15 nt, Staphylococcus aureus subsp. aureus N315
aaaucaauacuuuca

SEQ ID NO: 2155643 - RNA, 15 nt, Staphylococcus aureus subsp. aureus N315
aaaucaguaauauca

SEQ ID NO: 2155644 - RNA, 13 nt, Staphylococcus aureus subsp. aureus N315
aaaucaguaauau

SEQ ID NO: 2155645 - RNA, 18 nt, Staphylococcus aureus subsp. aureus N315
aaaucaguuuuuaaauca

SEQ ID NO: 2155646 - RNA, 21 nt, Staphylococcus aureus subsp. aureus N315
aaaucauacgagaaauuagaa

SEQ ID NO: 2155647 - RNA, 14 nt, Staphylococcus aureus subsp. aureus N315
aaaucauaaauaac

SEQ ID NO: 2155648 - RNA, 15 nt, Staphylococcus aureus subsp. aureus N315
aaaucauaaauuaua

SEQ ID NO: 2155649 - RNA, 15 nt, Staphylococcus aureus subsp. aureus N315
aaaucacugcuuuca

SEQ ID NO: 2155650 - RNA, 17 nt, Staphylococcus aureus subsp. aureus N315
aaaucaccuuuuuuaac

SEQ ID NO: 2155651 - RNA, 20 nt, Staphylococcus aureus subsp. aureus N315
aaaucaccuuuuuuaacuuu

SEQ ID NO: 2155652 - RNA, 19 nt, Staphylococcus aureus subsp. aureus N315
aaaucacugcuuucaagua

SEQ ID NO: 2155653 - RNA, 14 nt, Staphylococcus aureus subsp. aureus N315
aaaguauaugaauc

SEQ ID NO: 2155654 - RNA, 13 nt, Staphylococcus aureus subsp. aureus N315
aaaguauauugcu

SEQ ID NO: 2155655 - RNA, 13 nt, Staphylococcus aureus subsp. aureus N315
aaaguacuuacaa

SEQ ID NO: 2155656 - RNA, 21 nt, Staphylococcus aureus subsp. aureus N315
aaaguaccuaaaauagaaaaa

SEQ ID NO: 2155657 - RNA, 14 nt, Staphylococcus aureus subsp. aureus N315
aaaguaauuaaaua

SEQ ID NO: 2155658 - RNA, 14 nt, Staphylococcus aureus subsp. aureus N315
aaagucaauuuaaa

SEQ ID NO: 2155659 - RNA, 16 nt, Staphylococcus aureus subsp. aureus N315
aaagucaauuuaaaua

SEQ ID NO: 2155660 - RNA, 20 nt, Staphylococcus aureus subsp. aureus N315
aaagucauacuuaugagcaa

SEQ ID NO: 2155661 - RNA, 13 nt, Staphylococcus aureus subsp. aureus N315
aaagucaaaaaau

SEQ ID NO: 2155662 - RNA, 22 nt, Staphylococcus aureus subsp. aureus N315
aaaguaucuaugaaauuuuuua

SEQ ID NO: 2155663 - RNA, 22 nt, Staphylococcus aureus subsp. aureus N315
aaaguaucgccaaucuauugca

SEQ ID NO: 2155664 - RNA, 14 nt, Staphylococcus aureus subsp. aureus N315
aaaguauuacuuua

SEQ ID NO: 2155665 - RNA, 17 nt, Staphylococcus aureus subsp. aureus N315
aaagggcuauuugauac

SEQ ID NO: 2155666 - RNA, 23 nt, Staphylococcus aureus subsp. aureus N315
aaagggcaacacucggaaacaug

SEQ ID NO: 2155667 - RNA, 14 nt, Staphylococcus aureus subsp. aureus N315
aaagguuaaauauu

SEQ ID NO: 2155668 - RNA, 20 nt, Staphylococcus aureus subsp. aureus N315
aaagguuguuuuucaucauu

SEQ ID NO: 2155669 - RNA, 15 nt, Staphylococcus aureus subsp. aureus N315
aaaguaaaagcuuuc

SEQ ID NO: 2155670 - RNA, 18 nt, Staphylococcus aureus subsp. aureus N315
aaaguaaaauauacuuga

SEQ ID NO: 2155671 - RNA, 22 nt, Staphylococcus aureus subsp. aureus N315
aaagcccuauuguuuuuuauaa

SEQ ID NO: 2155672 - RNA, 15 nt, Staphylococcus aureus subsp. aureus N315
aaagcccuaagcucg

SEQ ID NO: 2155673 - RNA, 13 nt, Staphylococcus aureus subsp. aureus N315
aaagcuauaaaaa

SEQ ID NO: 2155674 - RNA, 20 nt, Staphylococcus aureus subsp. aureus N315
aaagcuauaaaaaaucuuuu

SEQ ID NO: 2155675 - RNA, 23 nt, Staphylococcus aureus subsp. aureus N315
aaagcuauaaaaaaucuuuugau

SEQ ID NO: 2155676 - RNA, 18 nt, Staphylococcus aureus subsp. aureus N315
aaagcuauaaaaaaucuu

SEQ ID NO: 2155677 - RNA, 16 nt, Staphylococcus aureus subsp. aureus N315
aaagcgugguucccaa

SEQ ID NO: 2155678 - RNA, 15 nt, Staphylococcus aureus subsp. aureus N315
aaaggaauguuuaaa

SEQ ID NO: 2155679 - RNA, 19 nt, Staphylococcus aureus subsp. aureus N315
aaaggaauguuuaaaaaac

SEQ ID NO: 2155680 - RNA, 16 nt, Staphylococcus aureus subsp. aureus N315
aaaggaccacuuagau

SEQ ID NO: 2155681 - RNA, 15 nt, Staphylococcus aureus subsp. aureus N315
aaagcugucaacuug

SEQ ID NO: 2155682 - RNA, 23 nt, Staphylococcus aureus subsp. aureus N315
aaagcuggggaagaccauuuuau

SEQ ID NO: 2155683 - RNA, 12 nt, Staphylococcus aureus subsp. aureus N315
aaagauacugcu

SEQ ID NO: 2155684 - RNA, 12 nt, Staphylococcus aureus subsp. aureus N315
aaagauauaaac

SEQ ID NO: 2155685 - RNA, 16 nt, Staphylococcus aureus subsp. aureus N315
aaagauauaaacauuu

SEQ ID NO: 2155686 - RNA, 14 nt, Staphylococcus aureus subsp. aureus N315
aaagauauagaauu

SEQ ID NO: 2155687 - RNA, 16 nt, Staphylococcus aureus subsp. aureus N315
aaagauauagaauuca

SEQ ID NO: 2155688 - RNA, 13 nt, Staphylococcus aureus subsp. aureus N315
aaagaucauuaaa

SEQ ID NO: 2155689 - RNA, 22 nt, Staphylococcus aureus subsp. aureus N315
aaagcacccgauagcucugaaa

SEQ ID NO: 2155690 - RNA, 16 nt, Staphylococcus aureus subsp. aureus N315
aaagcaaauuauauag

SEQ ID NO: 2155691 - RNA, 15 nt, Staphylococcus aureus subsp. aureus N315
aaagcaaaggcgcac

SEQ ID NO: 2155692 - RNA, 22 nt, Staphylococcus aureus subsp. aureus N315
aaagcaugauacucaauaaaau

SEQ ID NO: 2155693 - RNA, 22 nt, Staphylococcus aureus subsp. aureus N315
aaagcacuagccguuauuuuuu

SEQ ID NO: 2155694 - RNA, 21 nt, Staphylococcus aureus subsp. aureus N315
aaagcacccuaauuuguuagu

SEQ ID NO: 2155695 - RNA, 15 nt, Staphylococcus aureus subsp. aureus N315
aaagccaauuaauaa

SEQ ID NO: 2155696 - RNA, 18 nt, Staphylococcus aureus subsp. aureus N315
aaagccaccuaaaucucc

SEQ ID NO: 2155697 - RNA, 22 nt, Staphylococcus aureus subsp. aureus N315
aaagaaggggagaguuaauccu

SEQ ID NO: 2155698 - RNA, 20 nt, Staphylococcus aureus subsp. aureus N315
aaacuuugugugcuuuaucu

SEQ ID NO: 2155699 - RNA, 23 nt, Staphylococcus aureus subsp. aureus N315
aaagacggugaccuuauauuuua

SEQ ID NO: 2155700 - RNA, 20 nt, Staphylococcus aureus subsp. aureus N315
aaagacucaauuucauuuga

SEQ ID NO: 2155701 - RNA, 18 nt, Staphylococcus aureus subsp. aureus N315
aaagacguuuuuuuauaa

SEQ ID NO: 2155702 - RNA, 22 nt, Staphylococcus aureus subsp. aureus N315
aaagacgauuuauuaguuuuua

SEQ ID NO: 2155703 - RNA, 12 nt, Staphylococcus aureus subsp. aureus N315
aaagaauaugau

SEQ ID NO: 2155704 - RNA, 22 nt, Staphylococcus aureus subsp. aureus N315
aaagagaaacaaaacaaaaaau

SEQ ID NO: 2155705 - RNA, 16 nt, Staphylococcus aureus subsp. aureus N315
aaagacucauacacaa

SEQ ID NO: 2155706 - RNA, 19 nt, Staphylococcus aureus subsp. aureus N315
aaagacuacaagucauuau

SEQ ID NO: 2155707 - RNA, 22 nt, Staphylococcus aureus subsp. aureus N315
aaagagauacugguuaguaaaa

SEQ ID NO: 2155708 - RNA, 21 nt, Staphylococcus aureus subsp. aureus N315
aaagacuuuccaccauaugug

SEQ ID NO: 2155709 - RNA, 13 nt, Staphylococcus aureus subsp. aureus N315
aaagagcguguua

SEQ ID NO: 2155710 - RNA, 17 nt, Staphylococcus aureus subsp. aureus N315
aaacuuucagagauauu

SEQ ID NO: 2155711 - RNA, 20 nt, Staphylococcus aureus subsp. aureus N315
aaacuuuauggguauccuuc

SEQ ID NO: 2155712 - RNA, 22 nt, Staphylococcus aureus subsp. aureus N315
aaacuuguaaauuuauuuuuaa

SEQ ID NO: 2155713 - RNA, 16 nt, Staphylococcus aureus subsp. aureus N315
aaacuuggcaaugaaa

SEQ ID NO: 2155714 - RNA, 12 nt, Staphylococcus aureus subsp. aureus N315
aaacuucuuuuc

SEQ ID NO: 2155715 - RNA, 22 nt, Staphylococcus aureus subsp. aureus N315
aaacuucuuguuucaaacaaag

SEQ ID NO: 2155716 - RNA, 22 nt, Staphylococcus aureus subsp. aureus N315
aaacuuccugcuuuuuuuauaa

SEQ ID NO: 2155717 - RNA, 21 nt, Staphylococcus aureus subsp. aureus N315
aaacuuauuaauuaauagaga

SEQ ID NO: 2155718 - RNA, 17 nt, Staphylococcus aureus subsp. aureus N315
aaacuuacauuacauau

SEQ ID NO: 2155719 - RNA, 20 nt, Staphylococcus aureus subsp. aureus N315
aaacugauugggcugauaau

SEQ ID NO: 2155720 - RNA, 22 nt, Staphylococcus aureus subsp. aureus N315
aaacucgcccccguaauaauuu

SEQ ID NO: 2155721 - RNA, 18 nt, Staphylococcus aureus subsp. aureus N315
aaacucguaaauuuuauc

SEQ ID NO: 2155722 - RNA, 22 nt, Staphylococcus aureus subsp. aureus N315
aaacucguaaauuuuaucuaaa

SEQ ID NO: 2155723 - RNA, 10 nt, Staphylococcus aureus subsp. aureus N315
aaacucucua

SEQ ID NO: 2155724 - RNA, 23 nt, Staphylococcus aureus subsp. aureus N315
aaacucauccauugaucuuuuau

SEQ ID NO: 2155725 - RNA, 20 nt, Staphylococcus aureus subsp. aureus N315
aaacucauuuauaaacauug

SEQ ID NO: 2155726 - RNA, 21 nt, Staphylococcus aureus subsp. aureus N315
aaacucauuuauaaacauugu

SEQ ID NO: 2155727 - RNA, 23 nt, Staphylococcus aureus subsp. aureus N315
aaacucauaccaaaaacauuaac

SEQ ID NO: 2155728 - RNA, 15 nt, Staphylococcus aureus subsp. aureus N315
aaacuacauuugguu

SEQ ID NO: 2155729 - RNA, 22 nt, Staphylococcus aureus subsp. aureus N315
aaacuaauaauuuguaauuccu

SEQ ID NO: 2155730 - RNA, 15 nt, Staphylococcus aureus subsp. aureus N315
aaacuaaguuauuua

SEQ ID NO: 2155731 - RNA, 12 nt, Staphylococcus aureus subsp. aureus N315
aaacuaauagca

SEQ ID NO: 2155732 - RNA, 21 nt, Staphylococcus aureus subsp. aureus N315
aaacuaauccucacuaacuca

SEQ ID NO: 2155733 - RNA, 15 nt, Staphylococcus aureus subsp. aureus N315
aaacuagaaaacaua

SEQ ID NO: 2155734 - RNA, 15 nt, Staphylococcus aureus subsp. aureus N315
aaacuacgaauucuc

SEQ ID NO: 2155735 - RNA, 13 nt, Staphylococcus aureus subsp. aureus N315
aaacuagcaguaa

SEQ ID NO: 2155736 - RNA, 14 nt, Staphylococcus aureus subsp. aureus N315
aaacuaucuacacc

SEQ ID NO: 2155737 - RNA, 15 nt, Staphylococcus aureus subsp. aureus N315
aaacuaucugauuaa

SEQ ID NO: 2155738 - RNA, 19 nt, Staphylococcus aureus subsp. aureus N315
aaacuauuuuaaaaaugcu

SEQ ID NO: 2155739 - RNA, 12 nt, Staphylococcus aureus subsp. aureus N315
aaacggagcaac

SEQ ID NO: 2155740 - RNA, 13 nt, Staphylococcus aureus subsp. aureus N315
aaacggaaauaac

SEQ ID NO: 2155741 - RNA, 17 nt, Staphylococcus aureus subsp. aureus N315
aaacgcugauuuuauaa

SEQ ID NO: 2155742 - RNA, 14 nt, Staphylococcus aureus subsp. aureus N315
aaacgccuuuccau

SEQ ID NO: 2155743 - RNA, 20 nt, Staphylococcus aureus subsp. aureus N315
aaacgguacagauaagaaua

SEQ ID NO: 2155744 - RNA, 22 nt, Staphylococcus aureus subsp. aureus N315
aaacgucacuuuauuaaauaac

SEQ ID NO: 2155745 - RNA, 22 nt, Staphylococcus aureus subsp. aureus N315
aaacguccaaacacaaauaaag

SEQ ID NO: 2155746 - RNA, 22 nt, Staphylococcus aureus subsp. aureus N315
aaacguaucauuuaaaauauuu

SEQ ID NO: 2155747 - RNA, 13 nt, Staphylococcus aureus subsp. aureus N315
aaacgugauuuua

SEQ ID NO: 2155748 - RNA, 22 nt, Staphylococcus aureus subsp. aureus N315
aaacgugcaaauaaaaaaguua

SEQ ID NO: 2155749 - RNA, 21 nt, Staphylococcus aureus subsp. aureus N315
aaacguucaucuaauuuuccu

SEQ ID NO: 2155750 - RNA, 14 nt, Staphylococcus aureus subsp. aureus N315
aaacuaaauuaaaa

SEQ ID NO: 2155751 - RNA, 15 nt, Staphylococcus aureus subsp. aureus N315
aaacuaaauuaaaag

SEQ ID NO: 2155752 - RNA, 18 nt, Staphylococcus aureus subsp. aureus N315
aaacuaaagguauucuau

SEQ ID NO: 2155753 - RNA, 18 nt, Staphylococcus aureus subsp. aureus N315
aaaccuuuucaaauuaua

SEQ ID NO: 2155754 - RNA, 19 nt, Staphylococcus aureus subsp. aureus N315
aaacgacucauuauaaaug

SEQ ID NO: 2155755 - RNA, 20 nt, Staphylococcus aureus subsp. aureus N315
aaacgagcuggugagaaauu

SEQ ID NO: 2155756 - RNA, 21 nt, Staphylococcus aureus subsp. aureus N315
aaacgauaagaauuaacaaca

SEQ ID NO: 2155757 - RNA, 15 nt, Staphylococcus aureus subsp. aureus N315
aaacgauauagaccg

SEQ ID NO: 2155758 - RNA, 13 nt, Staphylococcus aureus subsp. aureus N315
aaacgauacugcu

SEQ ID NO: 2155759 - RNA, 22 nt, Staphylococcus aureus subsp. aureus N315
aaacgauugauuaucauaugaa

SEQ ID NO: 2155760 - RNA, 19 nt, Staphylococcus aureus subsp. aureus N315
aaacgcacuauuuuuauaa

SEQ ID NO: 2155761 - RNA, 17 nt, Staphylococcus aureus subsp. aureus N315
aaacgccucaacacuuu

SEQ ID NO: 2155762 - RNA, 15 nt, Staphylococcus aureus subsp. aureus N315
auuuaaccuuuaaaa

SEQ ID NO: 2155763 - RNA, 18 nt, Staphylococcus aureus subsp. aureus N315
auuuaauaaaccagugcg

SEQ ID NO: 2155764 - RNA, 12 nt, Staphylococcus aureus subsp. aureus N315
auuuaauaaugu

SEQ ID NO: 2155765 - RNA, 14 nt, Staphylococcus aureus subsp. aureus N315
auuuaauaauacca

SEQ ID NO: 2155766 - RNA, 16 nt, Staphylococcus aureus subsp. aureus N315
auuuaauagacauuaa

SEQ ID NO: 2155767 - RNA, 20 nt, Staphylococcus aureus subsp. aureus N315
auuuaauacuuuucucgauu

SEQ ID NO: 2155768 - RNA, 16 nt, Staphylococcus aureus subsp. aureus N315
auuuaauacuuuucuc

SEQ ID NO: 2155769 - RNA, 19 nt, Staphylococcus aureus subsp. aureus N315
auuuaauaucacgaucuuu

SEQ ID NO: 2155770 - RNA, 19 nt, Staphylococcus aureus subsp. aureus N315
auuuauaagaggagaaagc

SEQ ID NO: 2155771 - RNA, 15 nt, Staphylococcus aureus subsp. aureus N315
auuuauacagugaau

SEQ ID NO: 2155772 - RNA, 18 nt, Staphylococcus aureus subsp. aureus N315
auuuauacugaucaaaug

SEQ ID NO: 2155773 - RNA, 21 nt, Staphylococcus aureus subsp. aureus N315
auuuauauagucuaugaauaa

SEQ ID NO: 2155774 - RNA, 14 nt, Staphylococcus aureus subsp. aureus N315
auuuauaugauuaa

SEQ ID NO: 2155775 - RNA, 17 nt, Staphylococcus aureus subsp. aureus N315
auuuauaugauguucaa

SEQ ID NO: 2155776 - RNA, 23 nt, Staphylococcus aureus subsp. aureus N315
aaaaguauugccguuauuuucaa

SEQ ID NO: 2155777 - RNA, 21 nt, Staphylococcus aureus subsp. aureus N315
aaaagucagcuuacaauaaug

SEQ ID NO: 2155778 - RNA, 14 nt, Staphylococcus aureus subsp. aureus N315
aaaaguauuacuuu

SEQ ID NO: 2155779 - RNA, 19 nt, Staphylococcus aureus subsp. aureus N315
aaaaguauaaauauaaaaa

SEQ ID NO: 2155780 - RNA, 15 nt, Staphylococcus aureus subsp. aureus N315
auuuauauuuagaau

SEQ ID NO: 2155781 - RNA, 13 nt, Staphylococcus aureus subsp. aureus N315
auuuauauuuuau

SEQ ID NO: 2155782 - RNA, 17 nt, Staphylococcus aureus subsp. aureus N315
auuuaucaauuucuauu

SEQ ID NO: 2155783 - RNA, 16 nt, Staphylococcus aureus subsp. aureus N315
auuuaucauacuucaa

SEQ ID NO: 2155784 - RNA, 17 nt, Staphylococcus aureus subsp. aureus N315
auuuaucaccuuuaggc

SEQ ID NO: 2155785 - RNA, 22 nt, Staphylococcus aureus subsp. aureus N315
auuuaucgcgauuauuaccaua

SEQ ID NO: 2155786 - RNA, 22 nt, Staphylococcus aureus subsp. aureus N315
auuuaucuagacucaaggaaau

SEQ ID NO: 2155787 - RNA, 23 nt, Staphylococcus aureus subsp. aureus N315
auuuaucuagacucaaggaaauc

SEQ ID NO: 2155788 - RNA, 14 nt, Staphylococcus aureus subsp. aureus N315
auuuaucgugaaga

SEQ ID NO: 2155789 - RNA, 16 nt, Staphylococcus aureus subsp. aureus N315
auuuaucgugaagaaa

SEQ ID NO: 2155790 - RNA, 13 nt, Staphylococcus aureus subsp. aureus N315
auuuauuuuuaau

SEQ ID NO: 2155791 - RNA, 12 nt, Staphylococcus aureus subsp. aureus N315
auuuauuuuuga

SEQ ID NO: 2155792 - RNA, 17 nt, Staphylococcus aureus subsp. aureus N315
auuuauuuuugauagug

SEQ ID NO: 2155793 - RNA, 20 nt, Staphylococcus aureus subsp. aureus N315
auuuauuuauaaaauaaaau

SEQ ID NO: 2155794 - RNA, 17 nt, Staphylococcus aureus subsp. aureus N315
auuuauuuauaaaauaa

SEQ ID NO: 2155795 - RNA, 18 nt, Staphylococcus aureus subsp. aureus N315
auuuauuuucaauaaaua

SEQ ID NO: 2155796 - RNA, 15 nt, Staphylococcus aureus subsp. aureus N315
auuuauuuucuuugg

SEQ ID NO: 2155797 - RNA, 15 nt, Staphylococcus aureus subsp. aureus N315
auuucaauuuauguu

SEQ ID NO: 2155798 - RNA, 13 nt, Staphylococcus aureus subsp. aureus N315
auuucaauuugga

SEQ ID NO: 2155799 - RNA, 18 nt, Staphylococcus aureus subsp. aureus N315
auuuauuauaauuguuca

SEQ ID NO: 2155800 - RNA, 13 nt, Staphylococcus aureus subsp. aureus N315
auuuauucaaaau

SEQ ID NO: 2155801 - RNA, 14 nt, Staphylococcus aureus subsp. aureus N315
auuuauuaguuuuu

SEQ ID NO: 2155802 - RNA, 14 nt, Staphylococcus aureus subsp. aureus N315
auuuauuauaaaau

SEQ ID NO: 2155803 - RNA, 16 nt, Staphylococcus aureus subsp. aureus N315
auuuauuguuuuuaaa

SEQ ID NO: 2155804 - RNA, 16 nt, Staphylococcus aureus subsp. aureus N315
auuuauucuaaauaua

SEQ ID NO: 2155805 - RNA, 21 nt, Staphylococcus aureus subsp. aureus N315
auuuaucuuuagagacuuauu

SEQ ID NO: 2155806 - RNA, 17 nt, Staphylococcus aureus subsp. aureus N315
auuuaucuuuuaaaauc

SEQ ID NO: 2155807 - RNA, 18 nt, Staphylococcus aureus subsp. aureus N315
auuuauguaacuacuauu

SEQ ID NO: 2155808 - RNA, 20 nt, Staphylococcus aureus subsp. aureus N315
auuuaucuugauuuuauaaa

SEQ ID NO: 2155809 - RNA, 23 nt, Staphylococcus aureus subsp. aureus N315
aaaagugaaaguauuagauauau

SEQ ID NO: 2155810 - RNA, 16 nt, Staphylococcus aureus subsp. aureus N315
aaaagucgauaaauau

SEQ ID NO: 2155811 - RNA, 18 nt, Staphylococcus aureus subsp. aureus N315
auuucccacgugccucau

SEQ ID NO: 2155812 - RNA, 20 nt, Staphylococcus aureus subsp. aureus N315
auuucggggacguucaugga

SEQ ID NO: 2155813 - RNA, 15 nt, Staphylococcus aureus subsp. aureus N315
auuucgccucaucua

SEQ ID NO: 2155814 - RNA, 15 nt, Staphylococcus aureus subsp. aureus N315
auuucagcgauaacg

SEQ ID NO: 2155815 - RNA, 21 nt, Staphylococcus aureus subsp. aureus N315
auuucacgcugaaauuuuuua

SEQ ID NO: 2155816 - RNA, 14 nt, Staphylococcus aureus subsp. aureus N315
auuucaauuuggaa

SEQ ID NO: 2155817 - RNA, 15 nt, Staphylococcus aureus subsp. aureus N315
auuucaccgcuuuca

SEQ ID NO: 2155818 - RNA, 19 nt, Staphylococcus aureus subsp. aureus N315
auuucagcuuauuaagcuu

SEQ ID NO: 2155819 - RNA, 18 nt, Staphylococcus aureus subsp. aureus N315
auuucuaaaccauuuuca

SEQ ID NO: 2155820 - RNA, 20 nt, Staphylococcus aureus subsp. aureus N315
auuucuaaauuauuuauuca

SEQ ID NO: 2155821 - RNA, 17 nt, Staphylococcus aureus subsp. aureus N315
auuucgguauuuuaaau

SEQ ID NO: 2155822 - RNA, 22 nt, Staphylococcus aureus subsp. aureus N315
auuucugaaaugauacauuauu

SEQ ID NO: 2155823 - RNA, 19 nt, Staphylococcus aureus subsp. aureus N315
auuucuggcguacauauaa

SEQ ID NO: 2155824 - RNA, 19 nt, Staphylococcus aureus subsp. aureus N315
auuucuugauggauauuca

SEQ ID NO: 2155825 - RNA, 22 nt, Staphylococcus aureus subsp. aureus N315
auuugaaaauauuacuaacaac

SEQ ID NO: 2155826 - RNA, 15 nt, Staphylococcus aureus subsp. aureus N315
auuugaaauauacca

SEQ ID NO: 2155827 - RNA, 14 nt, Staphylococcus aureus subsp. aureus N315
auuugaaaauauua

SEQ ID NO: 2155828 - RNA, 14 nt, Staphylococcus aureus subsp. aureus N315
auuucuuaccauuu

SEQ ID NO: 2155829 - RNA, 13 nt, Staphylococcus aureus subsp. aureus N315
auuucuucugcua

SEQ ID NO: 2155830 - RNA, 21 nt, Staphylococcus aureus subsp. aureus N315
auuuucaauaaauuuuauaua

SEQ ID NO: 2155831 - RNA, 22 nt, Staphylococcus aureus subsp. aureus N315
auuuucaauacuugaaagauuu

SEQ ID NO: 2155832 - RNA, 16 nt, Staphylococcus aureus subsp. aureus N315
auuuucaauaaauuuu

SEQ ID NO: 2155833 - RNA, 16 nt, Staphylococcus aureus subsp. aureus N315
auuuucaauaaaaaug

SEQ ID NO: 2155834 - RNA, 18 nt, Staphylococcus aureus subsp. aureus N315
auuuucaauaaauuuuau

SEQ ID NO: 2155835 - RNA, 19 nt, Staphylococcus aureus subsp. aureus N315
auuuucaauaaauuuuaua

SEQ ID NO: 2155836 - RNA, 23 nt, Staphylococcus aureus subsp. aureus N315
auuuucacaaucauagauauaag

SEQ ID NO: 2155837 - RNA, 22 nt, Staphylococcus aureus subsp. aureus N315
auuuucaaugauuaaaucuucu

SEQ ID NO: 2155838 - RNA, 16 nt, Staphylococcus aureus subsp. aureus N315
auuuucaauuagaaaa

SEQ ID NO: 2155839 - RNA, 18 nt, Staphylococcus aureus subsp. aureus N315
auuuucaauuagaaaaua

SEQ ID NO: 2155840 - RNA, 22 nt, Staphylococcus aureus subsp. aureus N315
auuuucaauuagaaaauuucuc

SEQ ID NO: 2155841 - RNA, 21 nt, Staphylococcus aureus subsp. aureus N315
auuuucacaaucauagauaua

SEQ ID NO: 2155842 - RNA, 14 nt, Staphylococcus aureus subsp. aureus N315
auuuucaucauuaa

SEQ ID NO: 2155843 - RNA, 15 nt, Staphylococcus aureus subsp. aureus N315
auuuucauauaaaua

SEQ ID NO: 2155844 - RNA, 15 nt, Staphylococcus aureus subsp. aureus N315
auuuucauaaacucu

SEQ ID NO: 2155845 - RNA, 16 nt, Staphylococcus aureus subsp. aureus N315
auuuuaucuaaacauu

SEQ ID NO: 2155846 - RNA, 19 nt, Staphylococcus aureus subsp. aureus N315
auuuucaaaaccaauuaau

SEQ ID NO: 2155847 - RNA, 16 nt, Staphylococcus aureus subsp. aureus N315
auuuucaaaacugcca

SEQ ID NO: 2155848 - RNA, 18 nt, Staphylococcus aureus subsp. aureus N315
auuuucaaaacugccaaa

SEQ ID NO: 2155849 - RNA, 19 nt, Staphylococcus aureus subsp. aureus N315
auuuucaaaacugccaaaa

SEQ ID NO: 2155850 - RNA, 19 nt, Staphylococcus aureus subsp. aureus N315
auuuucaagaccaaauauu

SEQ ID NO: 2155851 - RNA, 20 nt, Staphylococcus aureus subsp. aureus N315
auuuucaaguaaugauauua

SEQ ID NO: 2155852 - RNA, 16 nt, Staphylococcus aureus subsp. aureus N315
auuuucaacacacuau

SEQ ID NO: 2155853 - RNA, 18 nt, Staphylococcus aureus subsp. aureus N315
auuuuauaagaauuuaaa

SEQ ID NO: 2155854 - RNA, 14 nt, Staphylococcus aureus subsp. aureus N315
auuuuauaagaauu

SEQ ID NO: 2155855 - RNA, 22 nt, Staphylococcus aureus subsp. aureus N315
auuuuauaagaauuuaaaagag

SEQ ID NO: 2155856 - RNA, 17 nt, Staphylococcus aureus subsp. aureus N315
auuuuauaaaucauaga

SEQ ID NO: 2155857 - RNA, 12 nt, Staphylococcus aureus subsp. aureus N315
auuuuauaaaau

SEQ ID NO: 2155858 - RNA, 20 nt, Staphylococcus aureus subsp. aureus N315
auuuuauaaaauauauuuaa

SEQ ID NO: 2155859 - RNA, 18 nt, Staphylococcus aureus subsp. aureus N315
auuuuauauaaaaagaag

SEQ ID NO: 2155860 - RNA, 13 nt, Staphylococcus aureus subsp. aureus N315
auuuuauacauaa

SEQ ID NO: 2155861 - RNA, 14 nt, Staphylococcus aureus subsp. aureus N315
auuuuauauuuuag

SEQ ID NO: 2155862 - RNA, 22 nt, Staphylococcus aureus subsp. aureus N315
auuuuaucuaaagcuauaaaaa

SEQ ID NO: 2155863 - RNA, 16 nt, Staphylococcus aureus subsp. aureus N315
auuuuaucugaaaaua

SEQ ID NO: 2155864 - RNA, 12 nt, Staphylococcus aureus subsp. aureus N315
auuuuaucucuu

SEQ ID NO: 2155865 - RNA, 20 nt, Staphylococcus aureus subsp. aureus N315
auuuuaucuaaagcuauaaa

SEQ ID NO: 2155866 - RNA, 17 nt, Staphylococcus aureus subsp. aureus N315
auuuuaggcaauguaau

SEQ ID NO: 2155867 - RNA, 18 nt, Staphylococcus aureus subsp. aureus N315
auuuuagguggcauuuua

SEQ ID NO: 2155868 - RNA, 19 nt, Staphylococcus aureus subsp. aureus N315
auuuuagguggcauuuuau

SEQ ID NO: 2155869 - RNA, 20 nt, Staphylococcus aureus subsp. aureus N315
auuuuaguucacaugaauuu

SEQ ID NO: 2155870 - RNA, 22 nt, Staphylococcus aureus subsp. aureus N315
auuuuaguucacaugaauuuua

SEQ ID NO: 2155871 - RNA, 15 nt, Staphylococcus aureus subsp. aureus N315
auuuuaguucacaug

SEQ ID NO: 2155872 - RNA, 21 nt, Staphylococcus aureus subsp. aureus N315
auuuuagucgucgaaaugccu

SEQ ID NO: 2155873 - RNA, 18 nt, Staphylococcus aureus subsp. aureus N315
auuuuagauuuaguuuuu

SEQ ID NO: 2155874 - RNA, 14 nt, Staphylococcus aureus subsp. aureus N315
auuuuaccaucaau

SEQ ID NO: 2155875 - RNA, 19 nt, Staphylococcus aureus subsp. aureus N315
auuuuaauuaauuauuaua

SEQ ID NO: 2155876 - RNA, 18 nt, Staphylococcus aureus subsp. aureus N315
auuuuacaaaauauggaa

SEQ ID NO: 2155877 - RNA, 18 nt, Staphylococcus aureus subsp. aureus N315
auuuuaauuaauuaucau

SEQ ID NO: 2155878 - RNA, 19 nt, Staphylococcus aureus subsp. aureus N315
auuuuaauauugacauuua

SEQ ID NO: 2155879 - RNA, 17 nt, Staphylococcus aureus subsp. aureus N315
auuuuaaugauuuuuca

SEQ ID NO: 2155880 - RNA, 15 nt, Staphylococcus aureus subsp. aureus N315
auuuuaauauuuucu

SEQ ID NO: 2155881 - RNA, 14 nt, Staphylococcus aureus subsp. aureus N315
auuuuaauauauuu

SEQ ID NO: 2155882 - RNA, 19 nt, Staphylococcus aureus subsp. aureus N315
auuuuacgaaaauaucauu

SEQ ID NO: 2155883 - RNA, 23 nt, Staphylococcus aureus subsp. aureus N315
auuuuaccuguuucuauauuaau

SEQ ID NO: 2155884 - RNA, 17 nt, Staphylococcus aureus subsp. aureus N315
auuuuaccuguuucuau

SEQ ID NO: 2155885 - RNA, 21 nt, Staphylococcus aureus subsp. aureus N315
auuuuaccuguuucuauauua

SEQ ID NO: 2155886 - RNA, 16 nt, Staphylococcus aureus subsp. aureus N315
auuuuaccuaguaacu

SEQ ID NO: 2155887 - RNA, 17 nt, Staphylococcus aureus subsp. aureus N315
auuuuaccauguuuuac

SEQ ID NO: 2155888 - RNA, 19 nt, Staphylococcus aureus subsp. aureus N315
auuuuaccaucaaugagca

SEQ ID NO: 2155889 - RNA, 21 nt, Staphylococcus aureus subsp. aureus N315
auuuuacuugaauauagcugu

SEQ ID NO: 2155890 - RNA, 15 nt, Staphylococcus aureus subsp. aureus N315
auuuuaaauuuauaa

SEQ ID NO: 2155891 - RNA, 22 nt, Staphylococcus aureus subsp. aureus N315
auuuuaaauuuaacuaugaaau

SEQ ID NO: 2155892 - RNA, 15 nt, Staphylococcus aureus subsp. aureus N315
auuuuaaaaaugcug

SEQ ID NO: 2155893 - RNA, 19 nt, Staphylococcus aureus subsp. aureus N315
auuugaugaucccaaaauc

SEQ ID NO: 2155894 - RNA, 24 nt, Staphylococcus aureus subsp. aureus N315
auuuguuuauuaguuauguuaguc

SEQ ID NO: 2155895 - RNA, 13 nt, Staphylococcus aureus subsp. aureus N315
auuuguuuuaaau

SEQ ID NO: 2155896 - RNA, 16 nt, Staphylococcus aureus subsp. aureus N315
auuuguuuuaaauacu

SEQ ID NO: 2155897 - RNA, 12 nt, Staphylococcus aureus subsp. aureus N315
auuuguuuuagg

SEQ ID NO: 2155898 - RNA, 18 nt, Staphylococcus aureus subsp. aureus N315
auuugaggauacauaaau

SEQ ID NO: 2155899 - RNA, 15 nt, Staphylococcus aureus subsp. aureus N315
auuugaagauuuugu

SEQ ID NO: 2155900 - RNA, 23 nt, Staphylococcus aureus subsp. aureus N315
auuuuuaacagcgugaauauaag

SEQ ID NO: 2155901 - RNA, 17 nt, Staphylococcus aureus subsp. aureus N315
auuuuuaaauuacuaua

SEQ ID NO: 2155902 - RNA, 14 nt, Staphylococcus aureus subsp. aureus N315
auuuuucaaauguu

SEQ ID NO: 2155903 - RNA, 14 nt, Staphylococcus aureus subsp. aureus N315
auuuuuaauuauuu

SEQ ID NO: 2155904 - RNA, 23 nt, Staphylococcus aureus subsp. aureus N315
auuuuguugaaacgguaucaaca

SEQ ID NO: 2155905 - RNA, 14 nt, Staphylococcus aureus subsp. aureus N315
auuuuguuucacua

SEQ ID NO: 2155906 - RNA, 12 nt, Staphylococcus aureus subsp. aureus N315
auuuuguuuuaa

SEQ ID NO: 2155907 - RNA, 14 nt, Staphylococcus aureus subsp. aureus N315
auuuuguuuuaaaa

SEQ ID NO: 2155908 - RNA, 18 nt, Staphylococcus aureus subsp. aureus N315
auuuuuaaaugauucuuu

SEQ ID NO: 2155909 - RNA, 15 nt, Staphylococcus aureus subsp. aureus N315
auuuuuaaaauuaug

SEQ ID NO: 2155910 - RNA, 11 nt, Staphylococcus aureus subsp. aureus N315
auuuuuaaaau

SEQ ID NO: 2155911 - RNA, 14 nt, Staphylococcus aureus subsp. aureus N315
auuuugugaauuua

SEQ ID NO: 2155912 - RNA, 17 nt, Staphylococcus aureus subsp. aureus N315
auuuuggcacauaaauc

SEQ ID NO: 2155913 - RNA, 19 nt, Staphylococcus aureus subsp. aureus N315
auuuucauuuaauccuucu

SEQ ID NO: 2155914 - RNA, 21 nt, Staphylococcus aureus subsp. aureus N315
auuuugcugccaaaaaguauu

SEQ ID NO: 2155915 - RNA, 14 nt, Staphylococcus aureus subsp. aureus N315
auuuucuaaauaua

SEQ ID NO: 2155916 - RNA, 15 nt, Staphylococcus aureus subsp. aureus N315
auuuuugaguaauuu

SEQ ID NO: 2155917 - RNA, 15 nt, Staphylococcus aureus subsp. aureus N315
auuuuucuucuuuuu

SEQ ID NO: 2155918 - RNA, 16 nt, Staphylococcus aureus subsp. aureus N315
auuuuugacuguuaaa

SEQ ID NO: 2155919 - RNA, 19 nt, Staphylococcus aureus subsp. aureus N315
auuuuugacuguuaaacaa

SEQ ID NO: 2155920 - RNA, 20 nt, Staphylococcus aureus subsp. aureus N315
auuuuucuuauaaaaaucuu

SEQ ID NO: 2155921 - RNA, 16 nt, Staphylococcus aureus subsp. aureus N315
auuuuucuaaaugauu

SEQ ID NO: 2155922 - RNA, 14 nt, Staphylococcus aureus subsp. aureus N315
caaaaaaacaaaua

SEQ ID NO: 2155923 - RNA, 15 nt, Staphylococcus aureus subsp. aureus N315
caaaaaaacaaauau

SEQ ID NO: 2155924 - RNA, 12 nt, Staphylococcus aureus subsp. aureus N315
caaaaaaacaaa

SEQ ID NO: 2155925 - RNA, 21 nt, Staphylococcus aureus subsp. aureus N315
auuuuuucuauggcacaaaug

SEQ ID NO: 2155926 - RNA, 18 nt, Staphylococcus aureus subsp. aureus N315
auuuuuucaugauuuacu

SEQ ID NO: 2155927 - RNA, 11 nt, Staphylococcus aureus subsp. aureus N315
caaaaaauauc

SEQ ID NO: 2155928 - RNA, 19 nt, Staphylococcus aureus subsp. aureus N315
caaaaaaucgaacaaauga

SEQ ID NO: 2155929 - RNA, 19 nt, Staphylococcus aureus subsp. aureus N315
caaaaaauuguaagucgaa

SEQ ID NO: 2155930 - RNA, 15 nt, Staphylococcus aureus subsp. aureus N315
caaaaaauuguauaa

SEQ ID NO: 2155931 - RNA, 21 nt, Staphylococcus aureus subsp. aureus N315
caaaaaauaauagcaaaauua

SEQ ID NO: 2155932 - RNA, 22 nt, Staphylococcus aureus subsp. aureus N315
caaaaaauaaaucuccauuaau

SEQ ID NO: 2155933 - RNA, 15 nt, Staphylococcus aureus subsp. aureus N315
auugcuuauuuuugu

SEQ ID NO: 2155934 - RNA, 21 nt, Staphylococcus aureus subsp. aureus N315
auugguuuuuacuauaauaau

SEQ ID NO: 2155935 - RNA, 13 nt, Staphylococcus aureus subsp. aureus N315
auugguuucauca

SEQ ID NO: 2155936 - RNA, 15 nt, Staphylococcus aureus subsp. aureus N315
auugguuucaucaua

SEQ ID NO: 2155937 - RNA, 14 nt, Staphylococcus aureus subsp. aureus N315
auuguaaaaugcuc

SEQ ID NO: 2155938 - RNA, 20 nt, Staphylococcus aureus subsp. aureus N315
auugguuuuuagugaaaaga

SEQ ID NO: 2155939 - RNA, 13 nt, Staphylococcus aureus subsp. aureus N315
auuguaaaaugcu

SEQ ID NO: 2155940 - RNA, 18 nt, Staphylococcus aureus subsp. aureus N315
auuguaaaucuuguugga

SEQ ID NO: 2155941 - RNA, 18 nt, Staphylococcus aureus subsp. aureus N315
auuguaaauauaguaaua

SEQ ID NO: 2155942 - RNA, 21 nt, Staphylococcus aureus subsp. aureus N315
auuguaaagcaugaauagcuu

SEQ ID NO: 2155943 - RNA, 22 nt, Staphylococcus aureus subsp. aureus N315
auuguacgcuucaauuauuuca

SEQ ID NO: 2155944 - RNA, 15 nt, Staphylococcus aureus subsp. aureus N315
auugucaucauguuc

SEQ ID NO: 2155945 - RNA, 16 nt, Staphylococcus aureus subsp. aureus N315
auugucaugccuucau

SEQ ID NO: 2155946 - RNA, 21 nt, Staphylococcus aureus subsp. aureus N315
auugucgacuuuuagauuauc

SEQ ID NO: 2155947 - RNA, 13 nt, Staphylococcus aureus subsp. aureus N315
auuuaaacuagua

SEQ ID NO: 2155948 - RNA, 18 nt, Staphylococcus aureus subsp. aureus N315
auuguuucaccagcuugu

SEQ ID NO: 2155949 - RNA, 19 nt, Staphylococcus aureus subsp. aureus N315
auuguuugaaaauuaacua

SEQ ID NO: 2155950 - RNA, 12 nt, Staphylococcus aureus subsp. aureus N315
auuguuuaaaca

SEQ ID NO: 2155951 - RNA, 17 nt, Staphylococcus aureus subsp. aureus N315
auuguuuaauaacaaaa

SEQ ID NO: 2155952 - RNA, 20 nt, Staphylococcus aureus subsp. aureus N315
auuguugcaaaauacgauuu

SEQ ID NO: 2155953 - RNA, 20 nt, Staphylococcus aureus subsp. aureus N315
auuuaaaugucuuucaaaua

SEQ ID NO: 2155954 - RNA, 20 nt, Staphylococcus aureus subsp. aureus N315
auuuaaaggcauaauaacca

SEQ ID NO: 2155955 - RNA, 18 nt, Staphylococcus aureus subsp. aureus N315
auuuaaauugacuuuaau

SEQ ID NO: 2155956 - RNA, 17 nt, Staphylococcus aureus subsp. aureus N315
auuuaacaucaauuacu

SEQ ID NO: 2155957 - RNA, 17 nt, Staphylococcus aureus subsp. aureus N315
auuguguugaaucaaca

SEQ ID NO: 2155958 - RNA, 11 nt, Staphylococcus aureus subsp. aureus N315
auuguguuucu

SEQ ID NO: 2155959 - RNA, 21 nt, Staphylococcus aureus subsp. aureus N315
auugucguuguacaucauuaa

SEQ ID NO: 2155960 - RNA, 15 nt, Staphylococcus aureus subsp. aureus N315
auugugguauuaauu

SEQ ID NO: 2155961 - RNA, 18 nt, Staphylococcus aureus subsp. aureus N315
auugucucaucauuuaaa

SEQ ID NO: 2155962 - RNA, 21 nt, Staphylococcus aureus subsp. aureus N315
auugucucaucauuuaaaauu

SEQ ID NO: 2155963 - RNA, 19 nt, Staphylococcus aureus subsp. aureus N315
auuguuauccaaaacauuu

SEQ ID NO: 2155964 - RNA, 22 nt, Staphylococcus aureus subsp. aureus N315
auuguuauagcguuuaagaaau

SEQ ID NO: 2155965 - RNA, 21 nt, Staphylococcus aureus subsp. aureus N315
auuguuagauaaucucauucu

SEQ ID NO: 2155966 - RNA, 15 nt, Staphylococcus aureus subsp. aureus N315
auuguuacuuuaacu

SEQ ID NO: 2155967 - RNA, 13 nt, Staphylococcus aureus subsp. aureus N315
auuguuaaacauu

SEQ ID NO: 2155968 - RNA, 14 nt, Staphylococcus aureus subsp. aureus N315
auuguugauaaaug

SEQ ID NO: 2155969 - RNA, 13 nt, Staphylococcus aureus subsp. aureus N315
auuguugcaaaau

SEQ ID NO: 2155970 - RNA, 19 nt, Staphylococcus aureus subsp. aureus N315
auuguugcaaaauacgauu

SEQ ID NO: 2155971 - RNA, 17 nt, Staphylococcus aureus subsp. aureus N315
auugcgugcuucacuga

SEQ ID NO: 2155972 - RNA, 23 nt, Staphylococcus aureus subsp. aureus N315
auugcugccacuguagaaacaca

SEQ ID NO: 2155973 - RNA, 16 nt, Staphylococcus aureus subsp. aureus N315
auugccuguagaauuu

SEQ ID NO: 2155974 - RNA, 19 nt, Staphylococcus aureus subsp. aureus N315
auugccuaaccuguuugag

SEQ ID NO: 2155975 - RNA, 19 nt, Staphylococcus aureus subsp. aureus N315
auugcauacguaaauggua

SEQ ID NO: 2155976 - RNA, 23 nt, Staphylococcus aureus subsp. aureus N315
auugcagguaaacggaauaacuu

SEQ ID NO: 2155977 - RNA, 22 nt, Staphylococcus aureus subsp. aureus N315
auugcacgucuuguaucaacau

SEQ ID NO: 2155978 - RNA, 23 nt, Staphylococcus aureus subsp. aureus N315
auugcacuaugcauaauaccaau

SEQ ID NO: 2155979 - RNA, 23 nt, Staphylococcus aureus subsp. aureus N315
auugcaagacuuggugcccaagu

SEQ ID NO: 2155980 - RNA, 14 nt, Staphylococcus aureus subsp. aureus N315
auugcaaaugcaau

SEQ ID NO: 2155981 - RNA, 21 nt, Staphylococcus aureus subsp. aureus N315
auugaaaaauuaaaaaacaaa

SEQ ID NO: 2155982 - RNA, 16 nt, Staphylococcus aureus subsp. aureus N315
auugaaaaaauaacug

SEQ ID NO: 2155983 - RNA, 14 nt, Staphylococcus aureus subsp. aureus N315
auugaaaauagaaa

SEQ ID NO: 2155984 - RNA, 23 nt, Staphylococcus aureus subsp. aureus N315
auucuuuaccuuuaccaguauca

SEQ ID NO: 2155985 - RNA, 23 nt, Staphylococcus aureus subsp. aureus N315
auucuuuauagaaaccaaaaaau

SEQ ID NO: 2155986 - RNA, 20 nt, Staphylococcus aureus subsp. aureus N315
auucuuuauaagcuuuuucu

SEQ ID NO: 2155987 - RNA, 16 nt, Staphylococcus aureus subsp. aureus N315
auugaugucaauuuca

SEQ ID NO: 2155988 - RNA, 14 nt, Staphylococcus aureus subsp. aureus N315
auugaugaauaaau

SEQ ID NO: 2155989 - RNA, 21 nt, Staphylococcus aureus subsp. aureus N315
auugaugaauaaauagauaau

SEQ ID NO: 2155990 - RNA, 19 nt, Staphylococcus aureus subsp. aureus N315
auugaucuuuuauaaugaa

SEQ ID NO: 2155991 - RNA, 14 nt, Staphylococcus aureus subsp. aureus N315
auugaugaaaacaa

SEQ ID NO: 2155992 - RNA, 16 nt, Staphylococcus aureus subsp. aureus N315
auugaugaaaacaaac

SEQ ID NO: 2155993 - RNA, 20 nt, Staphylococcus aureus subsp. aureus N315
auugaugaaagacugacuaa

SEQ ID NO: 2155994 - RNA, 14 nt, Staphylococcus aureus subsp. aureus N315
auucuggaugguua

SEQ ID NO: 2155995 - RNA, 18 nt, Staphylococcus aureus subsp. aureus N315
auucuuguuugauuuuag

SEQ ID NO: 2155996 - RNA, 18 nt, Staphylococcus aureus subsp. aureus N315
auucuugguuuuuuagau

SEQ ID NO: 2155997 - RNA, 19 nt, Staphylococcus aureus subsp. aureus N315
auucuugaauaaauuuuau

SEQ ID NO: 2155998 - RNA, 14 nt, Staphylococcus aureus subsp. aureus N315
auucugaaaucagu

SEQ ID NO: 2155999 - RNA, 20 nt, Staphylococcus aureus subsp. aureus N315
auucucuuuguuggggccca

SEQ ID NO: 2156000 - RNA, 14 nt, Staphylococcus aureus subsp. aureus N315
auucucgguuuuuu

SEQ ID NO: 2156001 - RNA, 17 nt, Staphylococcus aureus subsp. aureus N315
auucucuaacuuuacca

SEQ ID NO: 2156002 - RNA, 22 nt, Staphylococcus aureus subsp. aureus N315
auucucuaacuuuaccaauauc

SEQ ID NO: 2156003 - RNA, 17 nt, Staphylococcus aureus subsp. aureus N315
auucugagauugagaau

SEQ ID NO: 2156004 - RNA, 23 nt, Staphylococcus aureus subsp. aureus N315
auucuaaucgcauuuuuuauucc

SEQ ID NO: 2156005 - RNA, 21 nt, Staphylococcus aureus subsp. aureus N315
auucuacaaacaaugcaaguu

SEQ ID NO: 2156006 - RNA, 13 nt, Staphylococcus aureus subsp. aureus N315
auucuacaaacaa

SEQ ID NO: 2156007 - RNA, 16 nt, Staphylococcus aureus subsp. aureus N315
auucuauacuuuuaau

SEQ ID NO: 2156008 - RNA, 14 nt, Staphylococcus aureus subsp. aureus N315
auucuauacuuuua

SEQ ID NO: 2156009 - RNA, 21 nt, Staphylococcus aureus subsp. aureus N315
auucuacaggcaaugcaaguu

SEQ ID NO: 2156010 - RNA, 12 nt, Staphylococcus aureus subsp. aureus N315
auucuacaggua

SEQ ID NO: 2156011 - RNA, 21 nt, Staphylococcus aureus subsp. aureus N315
auucuacagguaaugcaaguu

SEQ ID NO: 2156012 - RNA, 17 nt, Staphylococcus aureus subsp. aureus N315
auucucgauuuuuuuau

SEQ ID NO: 2156013 - RNA, 13 nt, Staphylococcus aureus subsp. aureus N315
auucuauuuuuca

SEQ ID NO: 2156014 - RNA, 11 nt, Staphylococcus aureus subsp. aureus N315
auucuauuuuu

SEQ ID NO: 2156015 - RNA, 15 nt, Staphylococcus aureus subsp. aureus N315
auucguaauuuauga

SEQ ID NO: 2156016 - RNA, 23 nt, Staphylococcus aureus subsp. aureus N315
auucguaccaacucgcuauaugu

SEQ ID NO: 2156017 - RNA, 13 nt, Staphylococcus aureus subsp. aureus N315
auucguuaacaau

SEQ ID NO: 2156018 - RNA, 17 nt, Staphylococcus aureus subsp. aureus N315
auucgcuuguucaguaa

SEQ ID NO: 2156019 - RNA, 17 nt, Staphylococcus aureus subsp. aureus N315
auucgcgucauuuguuc

SEQ ID NO: 2156020 - RNA, 24 nt, Staphylococcus aureus subsp. aureus N315
auucguaaauccuuuauauucuaa

SEQ ID NO: 2156021 - RNA, 15 nt, Staphylococcus aureus subsp. aureus N315
auucgaaaagaaauu

SEQ ID NO: 2156022 - RNA, 13 nt, Staphylococcus aureus subsp. aureus N315
auucauuuuaaau

SEQ ID NO: 2156023 - RNA, 14 nt, Staphylococcus aureus subsp. aureus N315
auucauuuuauaaa

SEQ ID NO: 2156024 - RNA, 20 nt, Staphylococcus aureus subsp. aureus N315
auucauuuuauaaaucaaag

SEQ ID NO: 2156025 - RNA, 16 nt, Staphylococcus aureus subsp. aureus N315
auucauuuauuuucuu

SEQ ID NO: 2156026 - RNA, 19 nt, Staphylococcus aureus subsp. aureus N315
auucauuuaaaaaucaaag

SEQ ID NO: 2156027 - RNA, 17 nt, Staphylococcus aureus subsp. aureus N315
auucauuuaaaaaucaa

SEQ ID NO: 2156028 - RNA, 15 nt, Staphylococcus aureus subsp. aureus N315
auucauuguuauuua

SEQ ID NO: 2156029 - RNA, 13 nt, Staphylococcus aureus subsp. aureus N315
auucauucaauac

SEQ ID NO: 2156030 - RNA, 19 nt, Staphylococcus aureus subsp. aureus N315
auucauuacauguuacuga

SEQ ID NO: 2156031 - RNA, 15 nt, Staphylococcus aureus subsp. aureus N315
auucaugauauguuc

SEQ ID NO: 2156032 - RNA, 21 nt, Staphylococcus aureus subsp. aureus N315
auucaugaaucgaacuaguac

SEQ ID NO: 2156033 - RNA, 12 nt, Staphylococcus aureus subsp. aureus N315
auucaugaauaa

SEQ ID NO: 2156034 - RNA, 15 nt, Staphylococcus aureus subsp. aureus N315
auucaucgucucacu

SEQ ID NO: 2156035 - RNA, 21 nt, Staphylococcus aureus subsp. aureus N315
auucaucuaaccuuuucauca

SEQ ID NO: 2156036 - RNA, 17 nt, Staphylococcus aureus subsp. aureus N315
auucaucuuaucaagaa

SEQ ID NO: 2156037 - RNA, 16 nt, Staphylococcus aureus subsp. aureus N315
auucaucucagcaaua

SEQ ID NO: 2156038 - RNA, 19 nt, Staphylococcus aureus subsp. aureus N315
auucaucaauggugaccaa

SEQ ID NO: 2156039 - RNA, 19 nt, Staphylococcus aureus subsp. aureus N315
auucauaucuuucaauuaa

SEQ ID NO: 2156040 - RNA, 12 nt, Staphylococcus aureus subsp. aureus N315
auucauauuaac

SEQ ID NO: 2156041 - RNA, 17 nt, Staphylococcus aureus subsp. aureus N315
auucauauuuauauuua

SEQ ID NO: 2156042 - RNA, 14 nt, Staphylococcus aureus subsp. aureus N315
aaaaggaaaaacuu

SEQ ID NO: 2156043 - RNA, 20 nt, Staphylococcus aureus subsp. aureus N315
aaaaggaaaaacuuuucaug

SEQ ID NO: 2156044 - RNA, 17 nt, Staphylococcus aureus subsp. aureus N315
auuccuagcuuuuaugu

SEQ ID NO: 2156045 - RNA, 15 nt, Staphylococcus aureus subsp. aureus N315
auuccguuucauuga

SEQ ID NO: 2156046 - RNA, 15 nt, Staphylococcus aureus subsp. aureus N315
auuccuagcuuuuau

SEQ ID NO: 2156047 - RNA, 17 nt, Staphylococcus aureus subsp. aureus N315
auuccaugucaauuuuu

SEQ ID NO: 2156048 - RNA, 20 nt, Staphylococcus aureus subsp. aureus N315
auuccauacgaucuuuuuca

SEQ ID NO: 2156049 - RNA, 14 nt, Staphylococcus aureus subsp. aureus N315
auuccacuacaauc

SEQ ID NO: 2156050 - RNA, 21 nt, Staphylococcus aureus subsp. aureus N315
auuccaaaaauuguaaaaccu

SEQ ID NO: 2156051 - RNA, 15 nt, Staphylococcus aureus subsp. aureus N315
auuccaaaaauugua

SEQ ID NO: 2156052 - RNA, 17 nt, Staphylococcus aureus subsp. aureus N315
auuccaagagaauuaau

SEQ ID NO: 2156053 - RNA, 15 nt, Staphylococcus aureus subsp. aureus N315
auuccaaauuugaaa

SEQ ID NO: 2156054 - RNA, 13 nt, Staphylococcus aureus subsp. aureus N315
auuagauauauuu

SEQ ID NO: 2156055 - RNA, 22 nt, Staphylococcus aureus subsp. aureus N315
auuagauaucuuaaucuaaaaa

SEQ ID NO: 2156056 - RNA, 14 nt, Staphylococcus aureus subsp. aureus N315
auuagauacuucuu

SEQ ID NO: 2156057 - RNA, 23 nt, Staphylococcus aureus subsp. aureus N315
auuagagagcacgagaaauguca

SEQ ID NO: 2156058 - RNA, 21 nt, Staphylococcus aureus subsp. aureus N315
auuagagagcacgagaaaugu

SEQ ID NO: 2156059 - RNA, 15 nt, Staphylococcus aureus subsp. aureus N315
auuagcaaauauuau

SEQ ID NO: 2156060 - RNA, 22 nt, Staphylococcus aureus subsp. aureus N315
auuagauuuuaugcuuuacuug

SEQ ID NO: 2156061 - RNA, 13 nt, Staphylococcus aureus subsp. aureus N315
auuagauuuuaug

SEQ ID NO: 2156062 - RNA, 18 nt, Staphylococcus aureus subsp. aureus N315
auuagaugaaauggaaag

SEQ ID NO: 2156063 - RNA, 17 nt, Staphylococcus aureus subsp. aureus N315
auuacuguaaauaugaa

SEQ ID NO: 2156064 - RNA, 22 nt, Staphylococcus aureus subsp. aureus N315
auuacuguaaaauucuauaaau

SEQ ID NO: 2156065 - RNA, 15 nt, Staphylococcus aureus subsp. aureus N315
auuacuguuugcuuu

SEQ ID NO: 2156066 - RNA, 16 nt, Staphylococcus aureus subsp. aureus N315
auuacuuccauugcuu

SEQ ID NO: 2156067 - RNA, 22 nt, Staphylococcus aureus subsp. aureus N315
auuacuuagcaaacaauuuugu

SEQ ID NO: 2156068 - RNA, 18 nt, Staphylococcus aureus subsp. aureus N315
auuacuuauuucuuuuca

SEQ ID NO: 2156069 - RNA, 13 nt, Staphylococcus aureus subsp. aureus N315
auuacuuuagaaa

SEQ ID NO: 2156070 - RNA, 22 nt, Staphylococcus aureus subsp. aureus N315
auuacuugaaaauagccauauu

SEQ ID NO: 2156071 - RNA, 15 nt, Staphylococcus aureus subsp. aureus N315
auuacuuuggaaauu

SEQ ID NO: 2156072 - RNA, 18 nt, Staphylococcus aureus subsp. aureus N315
auuacuuuaauuuaguga

SEQ ID NO: 2156073 - RNA, 16 nt, Staphylococcus aureus subsp. aureus N315
auuagaaaauuucuca

SEQ ID NO: 2156074 - RNA, 16 nt, Staphylococcus aureus subsp. aureus N315
auuacauaauuuaucu

SEQ ID NO: 2156075 - RNA, 22 nt, Staphylococcus aureus subsp. aureus N315
auuacauaauuuaucugcaaaa

SEQ ID NO: 2156076 - RNA, 16 nt, Staphylococcus aureus subsp. aureus N315
auuacaggaauugcuu

SEQ ID NO: 2156077 - RNA, 19 nt, Staphylococcus aureus subsp. aureus N315
auuacagguuuaaacaucu

SEQ ID NO: 2156078 - RNA, 18 nt, Staphylococcus aureus subsp. aureus N315
auuacagguuuaauugac

SEQ ID NO: 2156079 - RNA, 20 nt, Staphylococcus aureus subsp. aureus N315
auuacagguuuaauugacac

SEQ ID NO: 2156080 - RNA, 15 nt, Staphylococcus aureus subsp. aureus N315
auuaauagaaagugc

SEQ ID NO: 2156081 - RNA, 16 nt, Staphylococcus aureus subsp. aureus N315
auuaauagagaaagaa

SEQ ID NO: 2156082 - RNA, 16 nt, Staphylococcus aureus subsp. aureus N315
auuaauagguuauuug

SEQ ID NO: 2156083 - RNA, 12 nt, Staphylococcus aureus subsp. aureus N315
auuaauaguaaa

SEQ ID NO: 2156084 - RNA, 21 nt, Staphylococcus aureus subsp. aureus N315
auuaauagagaaagaauaaau

SEQ ID NO: 2156085 - RNA, 20 nt, Staphylococcus aureus subsp. aureus N315
auuaauaggauuauuaucaa

SEQ ID NO: 2156086 - RNA, 17 nt, Staphylococcus aureus subsp. aureus N315
auuaauauaaauaucaa

SEQ ID NO: 2156087 - RNA, 17 nt, Staphylococcus aureus subsp. aureus N315
auuaauaguacagucau

SEQ ID NO: 2156088 - RNA, 20 nt, Staphylococcus aureus subsp. aureus N315
auuaccuggguauacagguu

SEQ ID NO: 2156089 - RNA, 17 nt, Staphylococcus aureus subsp. aureus N315
auuacuaucuucaucau

SEQ ID NO: 2156090 - RNA, 14 nt, Staphylococcus aureus subsp. aureus N315
auuacuauaaaaaa

SEQ ID NO: 2156091 - RNA, 20 nt, Staphylococcus aureus subsp. aureus N315
auuacuacuuuauaaauauc

SEQ ID NO: 2156092 - RNA, 19 nt, Staphylococcus aureus subsp. aureus N315
auuacuaaccuauuaaaau

SEQ ID NO: 2156093 - RNA, 19 nt, Staphylococcus aureus subsp. aureus N315
auuacuaacguaaagguga

SEQ ID NO: 2156094 - RNA, 19 nt, Staphylococcus aureus subsp. aureus N315
auuacuacauaauuuauca

SEQ ID NO: 2156095 - RNA, 13 nt, Staphylococcus aureus subsp. aureus N315
auuacuaaccuau

SEQ ID NO: 2156096 - RNA, 22 nt, Staphylococcus aureus subsp. aureus N315
auuacuccaauuaccaaugaau

SEQ ID NO: 2156097 - RNA, 16 nt, Staphylococcus aureus subsp. aureus N315
auuacucuuuuucuuu

SEQ ID NO: 2156098 - RNA, 16 nt, Staphylococcus aureus subsp. aureus N315
auuauuuaauuuuucu

SEQ ID NO: 2156099 - RNA, 14 nt, Staphylococcus aureus subsp. aureus N315
auuauuuaaaaugc

SEQ ID NO: 2156100 - RNA, 23 nt, Staphylococcus aureus subsp. aureus N315
auuauuuagaauucuaaaagaau

SEQ ID NO: 2156101 - RNA, 17 nt, Staphylococcus aureus subsp. aureus N315
auuauuuagauaaaaau

SEQ ID NO: 2156102 - RNA, 14 nt, Staphylococcus aureus subsp. aureus N315
auuauuuagaauuc

SEQ ID NO: 2156103 - RNA, 21 nt, Staphylococcus aureus subsp. aureus N315
auuauuuagauaaaaauuacu

SEQ ID NO: 2156104 - RNA, 14 nt, Staphylococcus aureus subsp. aureus N315
auuauuuauauuuu

SEQ ID NO: 2156105 - RNA, 16 nt, Staphylococcus aureus subsp. aureus N315
auuauuuauauuuuau

SEQ ID NO: 2156106 - RNA, 15 nt, Staphylococcus aureus subsp. aureus N315
auuauuggauuugaa

SEQ ID NO: 2156107 - RNA, 15 nt, Staphylococcus aureus subsp. aureus N315
auuauuuuguauuuu

SEQ ID NO: 2156108 - RNA, 21 nt, Staphylococcus aureus subsp. aureus N315
auuauuuuguauuuuucaaau

SEQ ID NO: 2156109 - RNA, 17 nt, Staphylococcus aureus subsp. aureus N315
auuauuugcgauaucag

SEQ ID NO: 2156110 - RNA, 23 nt, Staphylococcus aureus subsp. aureus N315
auuauuuggcucuauaucaaauu

SEQ ID NO: 2156111 - RNA, 17 nt, Staphylococcus aureus subsp. aureus N315
auuauuuccuguuacuu

SEQ ID NO: 2156112 - RNA, 16 nt, Staphylococcus aureus subsp. aureus N315
auuauuucauuagaaa

SEQ ID NO: 2156113 - RNA, 13 nt, Staphylococcus aureus subsp. aureus N315
auuauuugauaaa

SEQ ID NO: 2156114 - RNA, 19 nt, Staphylococcus aureus subsp. aureus N315
auucaagcaucauuuuucg

SEQ ID NO: 2156115 - RNA, 19 nt, Staphylococcus aureus subsp. aureus N315
auucaaguguaguaaaaau

SEQ ID NO: 2156116 - RNA, 18 nt, Staphylococcus aureus subsp. aureus N315
auucaacgucaucaaaac

SEQ ID NO: 2156117 - RNA, 22 nt, Staphylococcus aureus subsp. aureus N315
auucaacguauaagugauauca

SEQ ID NO: 2156118 - RNA, 19 nt, Staphylococcus aureus subsp. aureus N315
auucaacuuuaaucaaaaa

SEQ ID NO: 2156119 - RNA, 15 nt, Staphylococcus aureus subsp. aureus N315
auucaacuuuucaaa

SEQ ID NO: 2156120 - RNA, 20 nt, Staphylococcus aureus subsp. aureus N315
auucaacuuuucaaagccac

SEQ ID NO: 2156121 - RNA, 19 nt, Staphylococcus aureus subsp. aureus N315
auucaaaauucaauauuaa

SEQ ID NO: 2156122 - RNA, 14 nt, Staphylococcus aureus subsp. aureus N315
auuauuuuuuuaaa

SEQ ID NO: 2156123 - RNA, 22 nt, Staphylococcus aureus subsp. aureus N315
auuauuuuuuuaaaucuauaua

SEQ ID NO: 2156124 - RNA, 14 nt, Staphylococcus aureus subsp. aureus N315
auuauguguauauu

SEQ ID NO: 2156125 - RNA, 20 nt, Staphylococcus aureus subsp. aureus N315
auuauguuaaugucuuaaaa

SEQ ID NO: 2156126 - RNA, 17 nt, Staphylococcus aureus subsp. aureus N315
auuauguuauaaauucu

SEQ ID NO: 2156127 - RNA, 13 nt, Staphylococcus aureus subsp. aureus N315
auuaugugacaua

SEQ ID NO: 2156128 - RNA, 13 nt, Staphylococcus aureus subsp. aureus N315
auuauguauuuuu

SEQ ID NO: 2156129 - RNA, 19 nt, Staphylococcus aureus subsp. aureus N315
auuauguauuuuuauuuau

SEQ ID NO: 2156130 - RNA, 16 nt, Staphylococcus aureus subsp. aureus N315
auuauguaaaaaauau

SEQ ID NO: 2156131 - RNA, 14 nt, Staphylococcus aureus subsp. aureus N315
auuaucuauccauu

SEQ ID NO: 2156132 - RNA, 15 nt, Staphylococcus aureus subsp. aureus N315
auuaucguaaaaaaa

SEQ ID NO: 2156133 - RNA, 22 nt, Staphylococcus aureus subsp. aureus N315
auuaucuaaagaaaucucuauc

SEQ ID NO: 2156134 - RNA, 21 nt, Staphylococcus aureus subsp. aureus N315
auuaugccuauuugacacauu

SEQ ID NO: 2156135 - RNA, 19 nt, Staphylococcus aureus subsp. aureus N315
auuaugccuuugauuuuac

SEQ ID NO: 2156136 - RNA, 15 nt, Staphylococcus aureus subsp. aureus N315
auuauggagcggaag

SEQ ID NO: 2156137 - RNA, 15 nt, Staphylococcus aureus subsp. aureus N315
auuagucaucaaccu

SEQ ID NO: 2156138 - RNA, 20 nt, Staphylococcus aureus subsp. aureus N315
auuaguucuguugauauuuc

SEQ ID NO: 2156139 - RNA, 21 nt, Staphylococcus aureus subsp. aureus N315
auuaguucuggcaaagaaucc

SEQ ID NO: 2156140 - RNA, 13 nt, Staphylococcus aureus subsp. aureus N315
auuaguuauacua

SEQ ID NO: 2156141 - RNA, 17 nt, Staphylococcus aureus subsp. aureus N315
auuaguucuggcaaaga

SEQ ID NO: 2156142 - RNA, 18 nt, Staphylococcus aureus subsp. aureus N315
auuaguaaugauuaacuu

SEQ ID NO: 2156143 - RNA, 14 nt, Staphylococcus aureus subsp. aureus N315
aaaagcuaaagagu

SEQ ID NO: 2156144 - RNA, 19 nt, Staphylococcus aureus subsp. aureus N315
auuaguauucaaaaaauau

SEQ ID NO: 2156145 - RNA, 13 nt, Staphylococcus aureus subsp. aureus N315
auuaguaugacuu

SEQ ID NO: 2156146 - RNA, 15 nt, Staphylococcus aureus subsp. aureus N315
auuaguauaauuuau

SEQ ID NO: 2156147 - RNA, 20 nt, Staphylococcus aureus subsp. aureus N315
auuaguacuaaaccgauuaa

SEQ ID NO: 2156148 - RNA, 15 nt, Staphylococcus aureus subsp. aureus N315
auuauauauauuaaa

SEQ ID NO: 2156149 - RNA, 20 nt, Staphylococcus aureus subsp. aureus N315
auuauaucgucguaacucuu

SEQ ID NO: 2156150 - RNA, 21 nt, Staphylococcus aureus subsp. aureus N315
auuauaugguucguccauuca

SEQ ID NO: 2156151 - RNA, 20 nt, Staphylococcus aureus subsp. aureus N315
auuaucgaagaaacauuaua

SEQ ID NO: 2156152 - RNA, 22 nt, Staphylococcus aureus subsp. aureus N315
auuaucgaagaaacauuauaua

SEQ ID NO: 2156153 - RNA, 18 nt, Staphylococcus aureus subsp. aureus N315
auuaucgaauuagauuua

SEQ ID NO: 2156154 - RNA, 13 nt, Staphylococcus aureus subsp. aureus N315
auuauauauauua

SEQ ID NO: 2156155 - RNA, 19 nt, Staphylococcus aureus subsp. aureus N315
auuauagggcuguuuuuuu

SEQ ID NO: 2156156 - RNA, 21 nt, Staphylococcus aureus subsp. aureus N315
auuauagaugacuguagaaaa

SEQ ID NO: 2156157 - RNA, 23 nt, Staphylococcus aureus subsp. aureus N315
auuauagcagguggcauccauau

SEQ ID NO: 2156158 - RNA, 17 nt, Staphylococcus aureus subsp. aureus N315
auuauauagaaaacuag

SEQ ID NO: 2156159 - RNA, 20 nt, Staphylococcus aureus subsp. aureus N315
auuauagucuuaaacauaac

SEQ ID NO: 2156160 - RNA, 23 nt, Staphylococcus aureus subsp. aureus N315
auuauaguuucgucuacuauuuu

SEQ ID NO: 2156161 - RNA, 16 nt, Staphylococcus aureus subsp. aureus N315
auuaacgucaacagca

SEQ ID NO: 2156162 - RNA, 18 nt, Staphylococcus aureus subsp. aureus N315
auuaacgucaacagcaua

SEQ ID NO: 2156163 - RNA, 22 nt, Staphylococcus aureus subsp. aureus N315
auuaacuuaaaauuuaaauauu

SEQ ID NO: 2156164 - RNA, 20 nt, Staphylococcus aureus subsp. aureus N315
auuaacuuaaaauuuaaaua

SEQ ID NO: 2156165 - RNA, 22 nt, Staphylococcus aureus subsp. aureus N315
auuaacuguuagacuugguuac

SEQ ID NO: 2156166 - RNA, 20 nt, Staphylococcus aureus subsp. aureus N315
auuaacuguguauggcauaa

SEQ ID NO: 2156167 - RNA, 21 nt, Staphylococcus aureus subsp. aureus N315
auuaaaugcucgauuagauca

SEQ ID NO: 2156168 - RNA, 23 nt, Staphylococcus aureus subsp. aureus N315
auuaaaugcucgauuagaucaca

SEQ ID NO: 2156169 - RNA, 19 nt, Staphylococcus aureus subsp. aureus N315
auuaaauguacauuguaaa

SEQ ID NO: 2156170 - RNA, 20 nt, Staphylococcus aureus subsp. aureus N315
auuaauaagugcuguuacuu

SEQ ID NO: 2156171 - RNA, 18 nt, Staphylococcus aureus subsp. aureus N315
auuaauaagcauuaaugu

SEQ ID NO: 2156172 - RNA, 15 nt, Staphylococcus aureus subsp. aureus N315
auuaagcuaugcuuu

SEQ ID NO: 2156173 - RNA, 14 nt, Staphylococcus aureus subsp. aureus N315
auuaagcuuuguuu

SEQ ID NO: 2156174 - RNA, 19 nt, Staphylococcus aureus subsp. aureus N315
auuaagcuugaaacaaggu

SEQ ID NO: 2156175 - RNA, 17 nt, Staphylococcus aureus subsp. aureus N315
auuaagacugauuaauu

SEQ ID NO: 2156176 - RNA, 21 nt, Staphylococcus aureus subsp. aureus N315
auuaagaauaaucgaacauaa

SEQ ID NO: 2156177 - RNA, 15 nt, Staphylococcus aureus subsp. aureus N315
auuaagaaaaucauu

SEQ ID NO: 2156178 - RNA, 21 nt, Staphylococcus aureus subsp. aureus N315
auuaagccaucccaacuuaau

SEQ ID NO: 2156179 - RNA, 19 nt, Staphylococcus aureus subsp. aureus N315
auuaagauguauaugaauu

SEQ ID NO: 2156180 - RNA, 17 nt, Staphylococcus aureus subsp. aureus N315
auuaagauguauaugaa

SEQ ID NO: 2156181 - RNA, 16 nt, Staphylococcus aureus subsp. aureus N315
auuaaaucgauuaaga

SEQ ID NO: 2156182 - RNA, 22 nt, Staphylococcus aureus subsp. aureus N315
auuaaauccgcuuguucaacua

SEQ ID NO: 2156183 - RNA, 13 nt, Staphylococcus aureus subsp. aureus N315
auuaaaucugcuu

SEQ ID NO: 2156184 - RNA, 19 nt, Staphylococcus aureus subsp. aureus N315
auuaaaugaugcaguaaaa

SEQ ID NO: 2156185 - RNA, 12 nt, Staphylococcus aureus subsp. aureus N315
auuaaaugcaau

SEQ ID NO: 2156186 - RNA, 20 nt, Staphylococcus aureus subsp. aureus N315
auuaaagcuagaaacaaugc

SEQ ID NO: 2156187 - RNA, 20 nt, Staphylococcus aureus subsp. aureus N315
auuaaagcuaucuucagauu

SEQ ID NO: 2156188 - RNA, 22 nt, Staphylococcus aureus subsp. aureus N315
auuaaagcuccagucauuuguu

SEQ ID NO: 2156189 - RNA, 23 nt, Staphylococcus aureus subsp. aureus N315
auuaaagcgauaauagauaccau

SEQ ID NO: 2156190 - RNA, 16 nt, Staphylococcus aureus subsp. aureus N315
auuaaagcaaauuaua

SEQ ID NO: 2156191 - RNA, 20 nt, Staphylococcus aureus subsp. aureus N315
auuaaagcaucuucaauauu

SEQ ID NO: 2156192 - RNA, 13 nt, Staphylococcus aureus subsp. aureus N315
auuaaaaaucaaa

SEQ ID NO: 2156193 - RNA, 15 nt, Staphylococcus aureus subsp. aureus N315
auuaaaaaucaaaga

SEQ ID NO: 2156194 - RNA, 17 nt, Staphylococcus aureus subsp. aureus N315
auguuuucuaguuuaac

SEQ ID NO: 2156195 - RNA, 22 nt, Staphylococcus aureus subsp. aureus N315
auguuugucguuacuaccuauu

SEQ ID NO: 2156196 - RNA, 22 nt, Staphylococcus aureus subsp. aureus N315
auguuugggauauagaaaaggg

SEQ ID NO: 2156197 - RNA, 23 nt, Staphylococcus aureus subsp. aureus N315
auguuugggauauagaaaaggga

SEQ ID NO: 2156198 - RNA, 18 nt, Staphylococcus aureus subsp. aureus N315
auguuuguaaaucaagug

SEQ ID NO: 2156199 - RNA, 21 nt, Staphylococcus aureus subsp. aureus N315
auguuugcauaccuauaaaca

SEQ ID NO: 2156200 - RNA, 16 nt, Staphylococcus aureus subsp. aureus N315
auguuugccagguaaa

SEQ ID NO: 2156201 - RNA, 17 nt, Staphylococcus aureus subsp. aureus N315
auguuuggaugaacaaa

SEQ ID NO: 2156202 - RNA, 16 nt, Staphylococcus aureus subsp. aureus N315
auguuuggaugaacaa

SEQ ID NO: 2156203 - RNA, 18 nt, Staphylococcus aureus subsp. aureus N315
auguucuuauaaaaaaca

SEQ ID NO: 2156204 - RNA, 22 nt, Staphylococcus aureus subsp. aureus N315
auguugaagggaguauuuuuua

SEQ ID NO: 2156205 - RNA, 15 nt, Staphylococcus aureus subsp. aureus N315
auguuacccuaauga

SEQ ID NO: 2156206 - RNA, 21 nt, Staphylococcus aureus subsp. aureus N315
auguuagaugacuuugucaua

SEQ ID NO: 2156207 - RNA, 17 nt, Staphylococcus aureus subsp. aureus N315
auguuacuuauauauuc

SEQ ID NO: 2156208 - RNA, 16 nt, Staphylococcus aureus subsp. aureus N315
auguuacuuauauauu

SEQ ID NO: 2156209 - RNA, 17 nt, Staphylococcus aureus subsp. aureus N315
auguuaaagauuauuau

SEQ ID NO: 2156210 - RNA, 14 nt, Staphylococcus aureus subsp. aureus N315
auguuaaacaauac

SEQ ID NO: 2156211 - RNA, 21 nt, Staphylococcus aureus subsp. aureus N315
auguguuuucaacaguuuuaa

SEQ ID NO: 2156212 - RNA, 12 nt, Staphylococcus aureus subsp. aureus N315
auguuaucaaua

SEQ ID NO: 2156213 - RNA, 13 nt, Staphylococcus aureus subsp. aureus N315
auguuaucgauau

SEQ ID NO: 2156214 - RNA, 22 nt, Staphylococcus aureus subsp. aureus N315
auguuaucgauauagcauaaaa

SEQ ID NO: 2156215 - RNA, 15 nt, Staphylococcus aureus subsp. aureus N315
auguuauuagauacu

SEQ ID NO: 2156216 - RNA, 18 nt, Staphylococcus aureus subsp. aureus N315
auguuauuaaccaucaug

SEQ ID NO: 2156217 - RNA, 18 nt, Staphylococcus aureus subsp. aureus N315
auguuccgcuacaaaaca

SEQ ID NO: 2156218 - RNA, 14 nt, Staphylococcus aureus subsp. aureus N315
auguggcacucaua

SEQ ID NO: 2156219 - RNA, 21 nt, Staphylococcus aureus subsp. aureus N315
augugcuuguaacaagcuuuu

SEQ ID NO: 2156220 - RNA, 16 nt, Staphylococcus aureus subsp. aureus N315
augugcuaaucuauuu

SEQ ID NO: 2156221 - RNA, 17 nt, Staphylococcus aureus subsp. aureus N315
augugcgucacucacuu

SEQ ID NO: 2156222 - RNA, 22 nt, Staphylococcus aureus subsp. aureus N315
augugucaaauaggcauaauga

SEQ ID NO: 2156223 - RNA, 22 nt, Staphylococcus aureus subsp. aureus N315
auguguugcauuacuaucuuca

SEQ ID NO: 2156224 - RNA, 16 nt, Staphylococcus aureus subsp. aureus N315
auguguugugauauau

SEQ ID NO: 2156225 - RNA, 15 nt, Staphylococcus aureus subsp. aureus N315
auguguuaaaccaac

SEQ ID NO: 2156226 - RNA, 15 nt, Staphylococcus aureus subsp. aureus N315
augucuuaucaauua

SEQ ID NO: 2156227 - RNA, 18 nt, Staphylococcus aureus subsp. aureus N315
augucucucuuucuuauu

SEQ ID NO: 2156228 - RNA, 14 nt, Staphylococcus aureus subsp. aureus N315
augucuuugaaaaa

SEQ ID NO: 2156229 - RNA, 15 nt, Staphylococcus aureus subsp. aureus N315
augucuuugaaaaac

SEQ ID NO: 2156230 - RNA, 18 nt, Staphylococcus aureus subsp. aureus N315
augucuuucaaauacaca

SEQ ID NO: 2156231 - RNA, 15 nt, Staphylococcus aureus subsp. aureus N315
augugacauaccagu

SEQ ID NO: 2156232 - RNA, 21 nt, Staphylococcus aureus subsp. aureus N315
augugcaucauuuauaugaug

SEQ ID NO: 2156233 - RNA, 17 nt, Staphylococcus aureus subsp. aureus N315
augugaugcuugaaugu

SEQ ID NO: 2156234 - RNA, 20 nt, Staphylococcus aureus subsp. aureus N315
augugcaacgguuugaaaaa

SEQ ID NO: 2156235 - RNA, 20 nt, Staphylococcus aureus subsp. aureus N315
augugauuuucuuucauaaa

SEQ ID NO: 2156236 - RNA, 23 nt, Staphylococcus aureus subsp. aureus N315
auguacacuuuugauuguuuaaa

SEQ ID NO: 2156237 - RNA, 17 nt, Staphylococcus aureus subsp. aureus N315
auguacauguauaaaag

SEQ ID NO: 2156238 - RNA, 23 nt, Staphylococcus aureus subsp. aureus N315
auguaccgaauccuucaucaaua

SEQ ID NO: 2156239 - RNA, 18 nt, Staphylococcus aureus subsp. aureus N315
auguacauuguaaauaua

SEQ ID NO: 2156240 - RNA, 18 nt, Staphylococcus aureus subsp. aureus N315
augucgcacuauaaaauu

SEQ ID NO: 2156241 - RNA, 17 nt, Staphylococcus aureus subsp. aureus N315
augucgaucuaacaauu

SEQ ID NO: 2156242 - RNA, 16 nt, Staphylococcus aureus subsp. aureus N315
augucuagauuuuaaa

SEQ ID NO: 2156243 - RNA, 16 nt, Staphylococcus aureus subsp. aureus N315
augguuagagaaaaau

SEQ ID NO: 2156244 - RNA, 17 nt, Staphylococcus aureus subsp. aureus N315
augguuccaaguauuuu

SEQ ID NO: 2156245 - RNA, 19 nt, Staphylococcus aureus subsp. aureus N315
augguuccaaguauuuucu

SEQ ID NO: 2156246 - RNA, 15 nt, Staphylococcus aureus subsp. aureus N315
augguugaucgaaua

SEQ ID NO: 2156247 - RNA, 17 nt, Staphylococcus aureus subsp. aureus N315
augguucuauaauaaau

SEQ ID NO: 2156248 - RNA, 14 nt, Staphylococcus aureus subsp. aureus N315
auguaaaauuaaau

SEQ ID NO: 2156249 - RNA, 20 nt, Staphylococcus aureus subsp. aureus N315
augguugauuacaauuguuc

SEQ ID NO: 2156250 - RNA, 21 nt, Staphylococcus aureus subsp. aureus N315
auguacaaccuuugcuuaaac

SEQ ID NO: 2156251 - RNA, 18 nt, Staphylococcus aureus subsp. aureus N315
auguacaauuuuuaaaaa

SEQ ID NO: 2156252 - RNA, 13 nt, Staphylococcus aureus subsp. aureus N315
auguaacauaaag

SEQ ID NO: 2156253 - RNA, 22 nt, Staphylococcus aureus subsp. aureus N315
auguaacauaaagcuguuuauu

SEQ ID NO: 2156254 - RNA, 19 nt, Staphylococcus aureus subsp. aureus N315
auguaacauuaaaaauaaa

SEQ ID NO: 2156255 - RNA, 15 nt, Staphylococcus aureus subsp. aureus N315
auguaauuguuuuuu

SEQ ID NO: 2156256 - RNA, 16 nt, Staphylococcus aureus subsp. aureus N315
auguaacaauuuagca

SEQ ID NO: 2156257 - RNA, 22 nt, Staphylococcus aureus subsp. aureus N315
auguaaaucgugcuguuaucau

SEQ ID NO: 2156258 - RNA, 15 nt, Staphylococcus aureus subsp. aureus N315
auguaaauaaaaauu

SEQ ID NO: 2156259 - RNA, 16 nt, Staphylococcus aureus subsp. aureus N315
auguaaauaaaaauua

SEQ ID NO: 2156260 - RNA, 19 nt, Staphylococcus aureus subsp. aureus N315
auguaaagccaccuaaauc

SEQ ID NO: 2156261 - RNA, 19 nt, Staphylococcus aureus subsp. aureus N315
auguaaauaaaaauuauau

SEQ ID NO: 2156262 - RNA, 18 nt, Staphylococcus aureus subsp. aureus N315
auguaaauaaaaauuaua

SEQ ID NO: 2156263 - RNA, 15 nt, Staphylococcus aureus subsp. aureus N315
auguaaaauuagcaa

SEQ ID NO: 2156264 - RNA, 13 nt, Staphylococcus aureus subsp. aureus N315
auguaaaauuauu

SEQ ID NO: 2156265 - RNA, 19 nt, Staphylococcus aureus subsp. aureus N315
auguaaagaguacagcggu

SEQ ID NO: 2156266 - RNA, 14 nt, Staphylococcus aureus subsp. aureus N315
augguaucuuuaau

SEQ ID NO: 2156267 - RNA, 20 nt, Staphylococcus aureus subsp. aureus N315
auggugaccaagauuccauc

SEQ ID NO: 2156268 - RNA, 19 nt, Staphylococcus aureus subsp. aureus N315
auggugguaccacauacau

SEQ ID NO: 2156269 - RNA, 19 nt, Staphylococcus aureus subsp. aureus N315
auggcugcaucaauaugac

SEQ ID NO: 2156270 - RNA, 21 nt, Staphylococcus aureus subsp. aureus N315
auggcugcaacaauuugcaua

SEQ ID NO: 2156271 - RNA, 20 nt, Staphylococcus aureus subsp. aureus N315
auggcuagucuuuaacuuua

SEQ ID NO: 2156272 - RNA, 19 nt, Staphylococcus aureus subsp. aureus N315
auggcuaauacaaaacaaa

SEQ ID NO: 2156273 - RNA, 20 nt, Staphylococcus aureus subsp. aureus N315
auggcuauguuuuacgccaa

SEQ ID NO: 2156274 - RNA, 15 nt, Staphylococcus aureus subsp. aureus N315
auggcagcgaucuuu

SEQ ID NO: 2156275 - RNA, 17 nt, Staphylococcus aureus subsp. aureus N315
auggaaaggcguuuuuu

SEQ ID NO: 2156276 - RNA, 20 nt, Staphylococcus aureus subsp. aureus N315
auggaaaguugguuuuauua

SEQ ID NO: 2156277 - RNA, 15 nt, Staphylococcus aureus subsp. aureus N315
auggaaaaguuuuuu

SEQ ID NO: 2156278 - RNA, 15 nt, Staphylococcus aureus subsp. aureus N315
auggagcggaagaua

SEQ ID NO: 2156279 - RNA, 18 nt, Staphylococcus aureus subsp. aureus N315
auggagcggaagauagga

SEQ ID NO: 2156280 - RNA, 17 nt, Staphylococcus aureus subsp. aureus N315
auggacuaagauauaag

SEQ ID NO: 2156281 - RNA, 16 nt, Staphylococcus aureus subsp. aureus N315
auggaugaauauauug

SEQ ID NO: 2156282 - RNA, 20 nt, Staphylococcus aureus subsp. aureus N315
augcuuuaugugcagcuuga

SEQ ID NO: 2156283 - RNA, 15 nt, Staphylococcus aureus subsp. aureus N315
augcuuuuaauauua

SEQ ID NO: 2156284 - RNA, 17 nt, Staphylococcus aureus subsp. aureus N315
augcuuuuaauauuaua

SEQ ID NO: 2156285 - RNA, 15 nt, Staphylococcus aureus subsp. aureus N315
augcuugaauguuug

SEQ ID NO: 2156286 - RNA, 17 nt, Staphylococcus aureus subsp. aureus N315
augcuuguacaaaaaau

SEQ ID NO: 2156287 - RNA, 22 nt, Staphylococcus aureus subsp. aureus N315
augcuuguacaaaaaauuguaa

SEQ ID NO: 2156288 - RNA, 22 nt, Staphylococcus aureus subsp. aureus N315
augcuucaaaaauuaaucaccu

SEQ ID NO: 2156289 - RNA, 12 nt, Staphylococcus aureus subsp. aureus N315
augcuguuuuau

SEQ ID NO: 2156290 - RNA, 15 nt, Staphylococcus aureus subsp. aureus N315
augcuucaaagucaa

SEQ ID NO: 2156291 - RNA, 18 nt, Staphylococcus aureus subsp. aureus N315
augcuucaauauucuuau

SEQ ID NO: 2156292 - RNA, 19 nt, Staphylococcus aureus subsp. aureus N315
augcuucaauauucuuauc

SEQ ID NO: 2156293 - RNA, 15 nt, Staphylococcus aureus subsp. aureus N315
augcuucuaacugaa

SEQ ID NO: 2156294 - RNA, 19 nt, Staphylococcus aureus subsp. aureus N315
augcuucgcaucacugcau

SEQ ID NO: 2156295 - RNA, 17 nt, Staphylococcus aureus subsp. aureus N315
augcuucgaauuuaaca

SEQ ID NO: 2156296 - RNA, 21 nt, Staphylococcus aureus subsp. aureus N315
augcuucugguucuucaauau

SEQ ID NO: 2156297 - RNA, 19 nt, Staphylococcus aureus subsp. aureus N315
augcuucucacaacugcau

SEQ ID NO: 2156298 - RNA, 19 nt, Staphylococcus aureus subsp. aureus N315
augcucuauauauccauuc

SEQ ID NO: 2156299 - RNA, 16 nt, Staphylococcus aureus subsp. aureus N315
augcugcacauuccau

SEQ ID NO: 2156300 - RNA, 14 nt, Staphylococcus aureus subsp. aureus N315
augcagauucuuca

SEQ ID NO: 2156301 - RNA, 21 nt, Staphylococcus aureus subsp. aureus N315
augccaucuuuguaaccuaaa

SEQ ID NO: 2156302 - RNA, 17 nt, Staphylococcus aureus subsp. aureus N315
augccauaccugcaccu

SEQ ID NO: 2156303 - RNA, 14 nt, Staphylococcus aureus subsp. aureus N315
augccgagauuauu

SEQ ID NO: 2156304 - RNA, 22 nt, Staphylococcus aureus subsp. aureus N315
augccuuuuauuuaucuuuuaa

SEQ ID NO: 2156305 - RNA, 14 nt, Staphylococcus aureus subsp. aureus N315
augcgaaaccuuuc

SEQ ID NO: 2156306 - RNA, 17 nt, Staphylococcus aureus subsp. aureus N315
augccuuugauuuuacu

SEQ ID NO: 2156307 - RNA, 23 nt, Staphylococcus aureus subsp. aureus N315
augccugcccuuuagucauguuu

SEQ ID NO: 2156308 - RNA, 18 nt, Staphylococcus aureus subsp. aureus N315
augccucaguuagaagau

SEQ ID NO: 2156309 - RNA, 16 nt, Staphylococcus aureus subsp. aureus N315
augagcccguuaaaaa

SEQ ID NO: 2156310 - RNA, 17 nt, Staphylococcus aureus subsp. aureus N315
augaugaacuuaaugcu

SEQ ID NO: 2156311 - RNA, 19 nt, Staphylococcus aureus subsp. aureus N315
augaugagauaaaaucaua

SEQ ID NO: 2156312 - RNA, 15 nt, Staphylococcus aureus subsp. aureus N315
augaugagauaaaau

SEQ ID NO: 2156313 - RNA, 22 nt, Staphylococcus aureus subsp. aureus N315
augauggguauuuuguucaguu

SEQ ID NO: 2156314 - RNA, 14 nt, Staphylococcus aureus subsp. aureus N315
augaugucauguau

SEQ ID NO: 2156315 - RNA, 16 nt, Staphylococcus aureus subsp. aureus N315
augaugucauguauug

SEQ ID NO: 2156316 - RNA, 18 nt, Staphylococcus aureus subsp. aureus N315
augauuauucucuuuauu

SEQ ID NO: 2156317 - RNA, 13 nt, Staphylococcus aureus subsp. aureus N315
augauuauauuuu

SEQ ID NO: 2156318 - RNA, 17 nt, Staphylococcus aureus subsp. aureus N315
augauuauauuuucuca

SEQ ID NO: 2156319 - RNA, 20 nt, Staphylococcus aureus subsp. aureus N315
augauuacuuuaagauuauu

SEQ ID NO: 2156320 - RNA, 22 nt, Staphylococcus aureus subsp. aureus N315
augauuacuuuaagauuauuug

SEQ ID NO: 2156321 - RNA, 17 nt, Staphylococcus aureus subsp. aureus N315
augauuaacuuucuaau

SEQ ID NO: 2156322 - RNA, 14 nt, Staphylococcus aureus subsp. aureus N315
augauuaauuaaag

SEQ ID NO: 2156323 - RNA, 16 nt, Staphylococcus aureus subsp. aureus N315
augauuaauuaaagau

SEQ ID NO: 2156324 - RNA, 22 nt, Staphylococcus aureus subsp. aureus N315
augauuaauuaaagauuaaaau

SEQ ID NO: 2156325 - RNA, 14 nt, Staphylococcus aureus subsp. aureus N315
augauuaaauaauc

SEQ ID NO: 2156326 - RNA, 17 nt, Staphylococcus aureus subsp. aureus N315
augauuaaaaaucaaag

SEQ ID NO: 2156327 - RNA, 23 nt, Staphylococcus aureus subsp. aureus N315
augauucguauucaaaguuuuca

SEQ ID NO: 2156328 - RNA, 16 nt, Staphylococcus aureus subsp. aureus N315
augauuguuaauacaa

SEQ ID NO: 2156329 - RNA, 20 nt, Staphylococcus aureus subsp. aureus N315
augauuggcuugaaguuguu

SEQ ID NO: 2156330 - RNA, 23 nt, Staphylococcus aureus subsp. aureus N315
augauuuagauguguugugauua

SEQ ID NO: 2156331 - RNA, 18 nt, Staphylococcus aureus subsp. aureus N315
augauuuaaguuuauaau

SEQ ID NO: 2156332 - RNA, 15 nt, Staphylococcus aureus subsp. aureus N315
augauugaaauccuu

SEQ ID NO: 2156333 - RNA, 17 nt, Staphylococcus aureus subsp. aureus N315
augauugcaaauuauca

SEQ ID NO: 2156334 - RNA, 12 nt, Staphylococcus aureus subsp. aureus N315
augauuugauuu

SEQ ID NO: 2156335 - RNA, 21 nt, Staphylococcus aureus subsp. aureus N315
augauuucacuucauaaagcg

SEQ ID NO: 2156336 - RNA, 15 nt, Staphylococcus aureus subsp. aureus N315
augauuuauaaaaaa

SEQ ID NO: 2156337 - RNA, 18 nt, Staphylococcus aureus subsp. aureus N315
augauuugugguaaucau

SEQ ID NO: 2156338 - RNA, 23 nt, Staphylococcus aureus subsp. aureus N315
augauuugauuuggguaauguuu

SEQ ID NO: 2156339 - RNA, 13 nt, Staphylococcus aureus subsp. aureus N315
augauuuugcuuu

SEQ ID NO: 2156340 - RNA, 22 nt, Staphylococcus aureus subsp. aureus N315
augcaaaucucgucacauauaa

SEQ ID NO: 2156341 - RNA, 19 nt, Staphylococcus aureus subsp. aureus N315
augcaagcgacgauuggaa

SEQ ID NO: 2156342 - RNA, 19 nt, Staphylococcus aureus subsp. aureus N315
augcaauacauuaauauaa

SEQ ID NO: 2156343 - RNA, 20 nt, Staphylococcus aureus subsp. aureus N315
augcaaguuggcggggcccc

SEQ ID NO: 2156344 - RNA, 12 nt, Staphylococcus aureus subsp. aureus N315
caauucuucaau

SEQ ID NO: 2156345 - RNA, 21 nt, Staphylococcus aureus subsp. aureus N315
caauucugugagguaaaacua

SEQ ID NO: 2156346 - RNA, 17 nt, Staphylococcus aureus subsp. aureus N315
caauucuuacaccugca

SEQ ID NO: 2156347 - RNA, 14 nt, Staphylococcus aureus subsp. aureus N315
caauuccuuggugu

SEQ ID NO: 2156348 - RNA, 14 nt, Staphylococcus aureus subsp. aureus N315
caauguucaauuca

SEQ ID NO: 2156349 - RNA, 15 nt, Staphylococcus aureus subsp. aureus N315
caaugucuuuaauug

SEQ ID NO: 2156350 - RNA, 21 nt, Staphylococcus aureus subsp. aureus N315
caauguuaggugcuugguuaa

SEQ ID NO: 2156351 - RNA, 20 nt, Staphylococcus aureus subsp. aureus N315
caauucauuuuauaaaucaa

SEQ ID NO: 2156352 - RNA, 19 nt, Staphylococcus aureus subsp. aureus N315
caauuuauuaacuguguau

SEQ ID NO: 2156353 - RNA, 17 nt, Staphylococcus aureus subsp. aureus N315
caauuucuucauuuuca

SEQ ID NO: 2156354 - RNA, 15 nt, Staphylococcus aureus subsp. aureus N315
caauuucuucauuuu

SEQ ID NO: 2156355 - RNA, 18 nt, Staphylococcus aureus subsp. aureus N315
caauuucuucauuuucau

SEQ ID NO: 2156356 - RNA, 17 nt, Staphylococcus aureus subsp. aureus N315
caaugcugauaccuaag

SEQ ID NO: 2156357 - RNA, 22 nt, Staphylococcus aureus subsp. aureus N315
caaugaauuucuaauuuaguau

SEQ ID NO: 2156358 - RNA, 17 nt, Staphylococcus aureus subsp. aureus N315
caaugaauucauuuuau

SEQ ID NO: 2156359 - RNA, 13 nt, Staphylococcus aureus subsp. aureus N315
caauguauauuua

SEQ ID NO: 2156360 - RNA, 15 nt, Staphylococcus aureus subsp. aureus N315
caauggaucuguuac

SEQ ID NO: 2156361 - RNA, 16 nt, Staphylococcus aureus subsp. aureus N315
caauggaucuguuaca

SEQ ID NO: 2156362 - RNA, 21 nt, Staphylococcus aureus subsp. aureus N315
cacaacgauagauaucauuuu

SEQ ID NO: 2156363 - RNA, 23 nt, Staphylococcus aureus subsp. aureus N315
caauuugcuguccacuauauccu

SEQ ID NO: 2156364 - RNA, 14 nt, Staphylococcus aureus subsp. aureus N315
cacaauauuuacca

SEQ ID NO: 2156365 - RNA, 19 nt, Staphylococcus aureus subsp. aureus N315
cacaauauuuaccacaaau

SEQ ID NO: 2156366 - RNA, 20 nt, Staphylococcus aureus subsp. aureus N315
cacaauccuuucaucugcaa

SEQ ID NO: 2156367 - RNA, 21 nt, Staphylococcus aureus subsp. aureus N315
cacaauaccuguccaaauaaa

SEQ ID NO: 2156368 - RNA, 23 nt, Staphylococcus aureus subsp. aureus N315
cacaaguuuacagguugaauaaa

SEQ ID NO: 2156369 - RNA, 22 nt, Staphylococcus aureus subsp. aureus N315
cacaagcaucuacaauauucaa

SEQ ID NO: 2156370 - RNA, 20 nt, Staphylococcus aureus subsp. aureus N315
cacacagguaaauuuaaaau

SEQ ID NO: 2156371 - RNA, 22 nt, Staphylococcus aureus subsp. aureus N315
cacacagguaaauuuaaaauaa

SEQ ID NO: 2156372 - RNA, 13 nt, Staphylococcus aureus subsp. aureus N315
cacacauaaaugu

SEQ ID NO: 2156373 - RNA, 15 nt, Staphylococcus aureus subsp. aureus N315
cacacaugauaauuu

SEQ ID NO: 2156374 - RNA, 13 nt, Staphylococcus aureus subsp. aureus N315
aaaauaaaauuaa

SEQ ID NO: 2156375 - RNA, 22 nt, Staphylococcus aureus subsp. aureus N315
aaaauaaaaccgaggaaauccu

SEQ ID NO: 2156376 - RNA, 15 nt, Staphylococcus aureus subsp. aureus N315
aaaauaaaaaugccg

SEQ ID NO: 2156377 - RNA, 12 nt, Staphylococcus aureus subsp. aureus N315
aaaauaaaaacc

SEQ ID NO: 2156378 - RNA, 13 nt, Staphylococcus aureus subsp. aureus N315
aaaauaaaaacca

SEQ ID NO: 2156379 - RNA, 13 nt, Staphylococcus aureus subsp. aureus N315
aaaauaaaaacuu

SEQ ID NO: 2156380 - RNA, 20 nt, Staphylococcus aureus subsp. aureus N315
aaaaguguuaaugucuucau

SEQ ID NO: 2156381 - RNA, 17 nt, Staphylococcus aureus subsp. aureus N315
aaaaguguuuaaaugcu

SEQ ID NO: 2156382 - RNA, 15 nt, Staphylococcus aureus subsp. aureus N315
aaaaguguaauguuc

SEQ ID NO: 2156383 - RNA, 13 nt, Staphylococcus aureus subsp. aureus N315
caccaacaacuuu

SEQ ID NO: 2156384 - RNA, 22 nt, Staphylococcus aureus subsp. aureus N315
caccaaauccaucuaauucaau

SEQ ID NO: 2156385 - RNA, 15 nt, Staphylococcus aureus subsp. aureus N315
cacaucgcauaauau

SEQ ID NO: 2156386 - RNA, 23 nt, Staphylococcus aureus subsp. aureus N315
cacauuuuuaguuagaaaguauu

SEQ ID NO: 2156387 - RNA, 15 nt, Staphylococcus aureus subsp. aureus N315
caccaaaaaucaucc

SEQ ID NO: 2156388 - RNA, 17 nt, Staphylococcus aureus subsp. aureus N315
cacauucaaauaaauga

SEQ ID NO: 2156389 - RNA, 14 nt, Staphylococcus aureus subsp. aureus N315
cacauuuucaaauu

SEQ ID NO: 2156390 - RNA, 14 nt, Staphylococcus aureus subsp. aureus N315
cacgacauguaggu

SEQ ID NO: 2156391 - RNA, 20 nt, Staphylococcus aureus subsp. aureus N315
aaaauagaaaaauuucaaaa

SEQ ID NO: 2156392 - RNA, 13 nt, Staphylococcus aureus subsp. aureus N315
aaaauagaaaaau

SEQ ID NO: 2156393 - RNA, 14 nt, Staphylococcus aureus subsp. aureus N315
aaaauagaaaaauu

SEQ ID NO: 2156394 - RNA, 23 nt, Staphylococcus aureus subsp. aureus N315
aaaauagccauauucauauuacu

SEQ ID NO: 2156395 - RNA, 23 nt, Staphylococcus aureus subsp. aureus N315
caccuggucguacuuucaaauaa

SEQ ID NO: 2156396 - RNA, 20 nt, Staphylococcus aureus subsp. aureus N315
caccugcuaguucagcuucu

SEQ ID NO: 2156397 - RNA, 16 nt, Staphylococcus aureus subsp. aureus N315
aaaauacgauuuguuc

SEQ ID NO: 2156398 - RNA, 13 nt, Staphylococcus aureus subsp. aureus N315
aaaauaauuaaau

SEQ ID NO: 2156399 - RNA, 13 nt, Staphylococcus aureus subsp. aureus N315
aaaauaauuuuau

SEQ ID NO: 2156400 - RNA, 14 nt, Staphylococcus aureus subsp. aureus N315
aaaauacauaauua

SEQ ID NO: 2156401 - RNA, 13 nt, Staphylococcus aureus subsp. aureus N315
aaaauacauaaua

SEQ ID NO: 2156402 - RNA, 14 nt, Staphylococcus aureus subsp. aureus N315
cacgauuuuuaaaa

SEQ ID NO: 2156403 - RNA, 16 nt, Staphylococcus aureus subsp. aureus N315
aaaauagcuauuaaaa

SEQ ID NO: 2156404 - RNA, 20 nt, Staphylococcus aureus subsp. aureus N315
aaaauaguaaagugaaauaa

SEQ ID NO: 2156405 - RNA, 23 nt, Staphylococcus aureus subsp. aureus N315
aaaauagucggggccccaacaca

SEQ ID NO: 2156406 - RNA, 21 nt, Staphylococcus aureus subsp. aureus N315
aaaauaguucuuuaaauuaua

SEQ ID NO: 2156407 - RNA, 19 nt, Staphylococcus aureus subsp. aureus N315
aaaauaguucuuuaaauua

SEQ ID NO: 2156408 - RNA, 21 nt, Staphylococcus aureus subsp. aureus N315
cacgcucauuuucuguugcag

SEQ ID NO: 2156409 - RNA, 23 nt, Staphylococcus aureus subsp. aureus N315
aaaauaacauguuuguggcaccu

SEQ ID NO: 2156410 - RNA, 13 nt, Staphylococcus aureus subsp. aureus N315
caccuaaaaagaa

SEQ ID NO: 2156411 - RNA, 16 nt, Staphylococcus aureus subsp. aureus N315
caccuaaaaagaaaau

SEQ ID NO: 2156412 - RNA, 20 nt, Staphylococcus aureus subsp. aureus N315
caccuauuuuuugagcacuu

SEQ ID NO: 2156413 - RNA, 17 nt, Staphylococcus aureus subsp. aureus N315
caccuauacauaacccu

SEQ ID NO: 2156414 - RNA, 20 nt, Staphylococcus aureus subsp. aureus N315
caccgcguguuuuuaacaua

SEQ ID NO: 2156415 - RNA, 15 nt, Staphylococcus aureus subsp. aureus N315
cacccauuugucuua

SEQ ID NO: 2156416 - RNA, 22 nt, Staphylococcus aureus subsp. aureus N315
caccaguagucacuguuugcca

SEQ ID NO: 2156417 - RNA, 15 nt, Staphylococcus aureus subsp. aureus N315
caaaggauauugaaa

SEQ ID NO: 2156418 - RNA, 16 nt, Staphylococcus aureus subsp. aureus N315
caaaggauauugaaaa

SEQ ID NO: 2156419 - RNA, 20 nt, Staphylococcus aureus subsp. aureus N315
caaagccuucuaucucuuua

SEQ ID NO: 2156420 - RNA, 19 nt, Staphylococcus aureus subsp. aureus N315
caaagauuccuguaacaag

SEQ ID NO: 2156421 - RNA, 21 nt, Staphylococcus aureus subsp. aureus N315
caaagacucaauuucauuuga

SEQ ID NO: 2156422 - RNA, 19 nt, Staphylococcus aureus subsp. aureus N315
caaagacauacagucaaua

SEQ ID NO: 2156423 - RNA, 17 nt, Staphylococcus aureus subsp. aureus N315
caaagacuaaaaagaag

SEQ ID NO: 2156424 - RNA, 22 nt, Staphylococcus aureus subsp. aureus N315
caaagaaauguaugauauaaac

SEQ ID NO: 2156425 - RNA, 20 nt, Staphylococcus aureus subsp. aureus N315
caaagaaagcuaauaucaau

SEQ ID NO: 2156426 - RNA, 16 nt, Staphylococcus aureus subsp. aureus N315
caaagaauuucgaaaa

SEQ ID NO: 2156427 - RNA, 20 nt, Staphylococcus aureus subsp. aureus N315
caaagaauuucgaaaagaaa

SEQ ID NO: 2156428 - RNA, 23 nt, Staphylococcus aureus subsp. aureus N315
caaagaauuucgaaaagaaauuc

SEQ ID NO: 2156429 - RNA, 16 nt, Staphylococcus aureus subsp. aureus N315
caaaccuuuauauaaa

SEQ ID NO: 2156430 - RNA, 15 nt, Staphylococcus aureus subsp. aureus N315
caaacguuauguaca

SEQ ID NO: 2156431 - RNA, 13 nt, Staphylococcus aureus subsp. aureus N315
caaacguuguuca

SEQ ID NO: 2156432 - RNA, 15 nt, Staphylococcus aureus subsp. aureus N315
caaacaauacauaau

SEQ ID NO: 2156433 - RNA, 22 nt, Staphylococcus aureus subsp. aureus N315
caaacaacaucacuuuaggguu

SEQ ID NO: 2156434 - RNA, 21 nt, Staphylococcus aureus subsp. aureus N315
caaacaaccugugauaaaaau

SEQ ID NO: 2156435 - RNA, 18 nt, Staphylococcus aureus subsp. aureus N315
caaacaaagcucaauaaa

SEQ ID NO: 2156436 - RNA, 23 nt, Staphylococcus aureus subsp. aureus N315
caaaagauguuucaaaauaauuu

SEQ ID NO: 2156437 - RNA, 22 nt, Staphylococcus aureus subsp. aureus N315
caaaacuagcaguaauauguug

SEQ ID NO: 2156438 - RNA, 16 nt, Staphylococcus aureus subsp. aureus N315
caaaacuugcgcaugc

SEQ ID NO: 2156439 - RNA, 21 nt, Staphylococcus aureus subsp. aureus N315
caaaacuuguaaucauaccag

SEQ ID NO: 2156440 - RNA, 18 nt, Staphylococcus aureus subsp. aureus N315
caaaaagcccuauuguuu

SEQ ID NO: 2156441 - RNA, 13 nt, Staphylococcus aureus subsp. aureus N315
caaaaagaauuuc

SEQ ID NO: 2156442 - RNA, 20 nt, Staphylococcus aureus subsp. aureus N315
caaaacgcauuucauguguc

SEQ ID NO: 2156443 - RNA, 18 nt, Staphylococcus aureus subsp. aureus N315
caaaacgcauuucaugug

SEQ ID NO: 2156444 - RNA, 20 nt, Staphylococcus aureus subsp. aureus N315
caaaaggauaagaacgagaa

SEQ ID NO: 2156445 - RNA, 15 nt, Staphylococcus aureus subsp. aureus N315
caaaagcgcaggcga

SEQ ID NO: 2156446 - RNA, 13 nt, Staphylococcus aureus subsp. aureus N315
caaaaguaugauu

SEQ ID NO: 2156447 - RNA, 16 nt, Staphylococcus aureus subsp. aureus N315
caaaaugguuaaaauc

SEQ ID NO: 2156448 - RNA, 22 nt, Staphylococcus aureus subsp. aureus N315
caaaaugguuaaaaucgcagca

SEQ ID NO: 2156449 - RNA, 18 nt, Staphylococcus aureus subsp. aureus N315
caaaauguuuaacaauaa

SEQ ID NO: 2156450 - RNA, 19 nt, Staphylococcus aureus subsp. aureus N315
caaaauuauguaaaaaaua

SEQ ID NO: 2156451 - RNA, 18 nt, Staphylococcus aureus subsp. aureus N315
caaaauuauguaaaaaau

SEQ ID NO: 2156452 - RNA, 13 nt, Staphylococcus aureus subsp. aureus N315
caaaauaguaaag

SEQ ID NO: 2156453 - RNA, 12 nt, Staphylococcus aureus subsp. aureus N315
caaaauauaaaa

SEQ ID NO: 2156454 - RNA, 15 nt, Staphylococcus aureus subsp. aureus N315
caaaauauacuaaau

SEQ ID NO: 2156455 - RNA, 20 nt, Staphylococcus aureus subsp. aureus N315
caaaauauacuaaauuugaa

SEQ ID NO: 2156456 - RNA, 19 nt, Staphylococcus aureus subsp. aureus N315
caaaaucucaacagcaaaa

SEQ ID NO: 2156457 - RNA, 22 nt, Staphylococcus aureus subsp. aureus N315
caaaaucucaacagcaaaaaau

SEQ ID NO: 2156458 - RNA, 19 nt, Staphylococcus aureus subsp. aureus N315
caacacccauauaauuugg

SEQ ID NO: 2156459 - RNA, 16 nt, Staphylococcus aureus subsp. aureus N315
caacacccauauaauu

SEQ ID NO: 2156460 - RNA, 15 nt, Staphylococcus aureus subsp. aureus N315
caacaacaaguucuu

SEQ ID NO: 2156461 - RNA, 12 nt, Staphylococcus aureus subsp. aureus N315
caacaaauuuaa

SEQ ID NO: 2156462 - RNA, 17 nt, Staphylococcus aureus subsp. aureus N315
caacaaagcuuccaaau

SEQ ID NO: 2156463 - RNA, 13 nt, Staphylococcus aureus subsp. aureus N315
caacaaauauaau

SEQ ID NO: 2156464 - RNA, 22 nt, Staphylococcus aureus subsp. aureus N315
caacaucuuuuguugcucagug

SEQ ID NO: 2156465 - RNA, 21 nt, Staphylococcus aureus subsp. aureus N315
caacaguuucuuggucugcug

SEQ ID NO: 2156466 - RNA, 23 nt, Staphylococcus aureus subsp. aureus N315
caacaguuucuuggucugcugua

SEQ ID NO: 2156467 - RNA, 15 nt, Staphylococcus aureus subsp. aureus N315
caacaguuuuaaaga

SEQ ID NO: 2156468 - RNA, 21 nt, Staphylococcus aureus subsp. aureus N315
caacaguuuuauuaucuuugu

SEQ ID NO: 2156469 - RNA, 22 nt, Staphylococcus aureus subsp. aureus N315
caaccgcuugggcugacauuuu

SEQ ID NO: 2156470 - RNA, 18 nt, Staphylococcus aureus subsp. aureus N315
caacaucuuuuguuguuu

SEQ ID NO: 2156471 - RNA, 14 nt, Staphylococcus aureus subsp. aureus N315
caacauguuuggau

SEQ ID NO: 2156472 - RNA, 21 nt, Staphylococcus aureus subsp. aureus N315
caacauguuuggaugaacaaa

SEQ ID NO: 2156473 - RNA, 22 nt, Staphylococcus aureus subsp. aureus N315
caacauguuuggaugaacaaaa

SEQ ID NO: 2156474 - RNA, 22 nt, Staphylococcus aureus subsp. aureus N315
caacauguuccgcuacaaaaca

SEQ ID NO: 2156475 - RNA, 14 nt, Staphylococcus aureus subsp. aureus N315
caacauguucguua

SEQ ID NO: 2156476 - RNA, 18 nt, Staphylococcus aureus subsp. aureus N315
caacauuacuaauugauc

SEQ ID NO: 2156477 - RNA, 16 nt, Staphylococcus aureus subsp. aureus N315
caacauuaauaaauaa

SEQ ID NO: 2156478 - RNA, 15 nt, Staphylococcus aureus subsp. aureus N315
caacauuaauaaaua

SEQ ID NO: 2156479 - RNA, 19 nt, Staphylococcus aureus subsp. aureus N315
caacauuaauaaauaauaa

SEQ ID NO: 2156480 - RNA, 15 nt, Staphylococcus aureus subsp. aureus N315
caacauuacaugcac

SEQ ID NO: 2156481 - RNA, 20 nt, Staphylococcus aureus subsp. aureus N315
caacauugagauuaucuuua

SEQ ID NO: 2156482 - RNA, 15 nt, Staphylococcus aureus subsp. aureus N315
caacauuauuuauau

SEQ ID NO: 2156483 - RNA, 23 nt, Staphylococcus aureus subsp. aureus N315
caaaucggcuauacauugauaaa

SEQ ID NO: 2156484 - RNA, 20 nt, Staphylococcus aureus subsp. aureus N315
caaaucggaauaaaauaaau

SEQ ID NO: 2156485 - RNA, 16 nt, Staphylococcus aureus subsp. aureus N315
caaaucggaauaaaau

SEQ ID NO: 2156486 - RNA, 16 nt, Staphylococcus aureus subsp. aureus N315
caaauauaauuucaau

SEQ ID NO: 2156487 - RNA, 14 nt, Staphylococcus aureus subsp. aureus N315
caaauaguucaaau

SEQ ID NO: 2156488 - RNA, 15 nt, Staphylococcus aureus subsp. aureus N315
caaauaucaguaaua

SEQ ID NO: 2156489 - RNA, 17 nt, Staphylococcus aureus subsp. aureus N315
caaauauacuuuuacca

SEQ ID NO: 2156490 - RNA, 14 nt, Staphylococcus aureus subsp. aureus N315
caaauauauuugua

SEQ ID NO: 2156491 - RNA, 17 nt, Staphylococcus aureus subsp. aureus N315
caaauaucaguaauaau

SEQ ID NO: 2156492 - RNA, 15 nt, Staphylococcus aureus subsp. aureus N315
caaauauuucuaaac

SEQ ID NO: 2156493 - RNA, 19 nt, Staphylococcus aureus subsp. aureus N315
caaauauuagaacauuuau

SEQ ID NO: 2156494 - RNA, 20 nt, Staphylococcus aureus subsp. aureus N315
caaaguaccaucucuauuuu

SEQ ID NO: 2156495 - RNA, 19 nt, Staphylococcus aureus subsp. aureus N315
caaaguaccaucucuauuu

SEQ ID NO: 2156496 - RNA, 23 nt, Staphylococcus aureus subsp. aureus N315
caaaguacucaaguaaucaagca

SEQ ID NO: 2156497 - RNA, 18 nt, Staphylococcus aureus subsp. aureus N315
caaaguagauauugaaug

SEQ ID NO: 2156498 - RNA, 17 nt, Staphylococcus aureus subsp. aureus N315
caaagucauuaaaugua

SEQ ID NO: 2156499 - RNA, 17 nt, Staphylococcus aureus subsp. aureus N315
caaagucucuaguaucu

SEQ ID NO: 2156500 - RNA, 13 nt, Staphylococcus aureus subsp. aureus N315
caaauuaaaucac

SEQ ID NO: 2156501 - RNA, 16 nt, Staphylococcus aureus subsp. aureus N315
caaauucauauuaacu

SEQ ID NO: 2156502 - RNA, 17 nt, Staphylococcus aureus subsp. aureus N315
caaauucauauuaacug

SEQ ID NO: 2156503 - RNA, 14 nt, Staphylococcus aureus subsp. aureus N315
caaauucauuugua

SEQ ID NO: 2156504 - RNA, 23 nt, Staphylococcus aureus subsp. aureus N315
caaauuggauaauuucuucuucu

SEQ ID NO: 2156505 - RNA, 21 nt, Staphylococcus aureus subsp. aureus N315
caaauuggauaauuucuucuu

SEQ ID NO: 2156506 - RNA, 19 nt, Staphylococcus aureus subsp. aureus N315
caaauuuaggcaugucaaa

SEQ ID NO: 2156507 - RNA, 16 nt, Staphylococcus aureus subsp. aureus N315
caaauguauaaauaau

SEQ ID NO: 2156508 - RNA, 20 nt, Staphylococcus aureus subsp. aureus N315
caaauguugaauguggaaca

SEQ ID NO: 2156509 - RNA, 23 nt, Staphylococcus aureus subsp. aureus N315
caaaugugguggguauauaauuu

SEQ ID NO: 2156510 - RNA, 15 nt, Staphylococcus aureus subsp. aureus N315
caaaugaaccagcua

SEQ ID NO: 2156511 - RNA, 20 nt, Staphylococcus aureus subsp. aureus N315
caaaugaauggagcaugauu

SEQ ID NO: 2156512 - RNA, 14 nt, Staphylococcus aureus subsp. aureus N315
caaaugacauuuua

SEQ ID NO: 2156513 - RNA, 18 nt, Staphylococcus aureus subsp. aureus N315
caaaugaaaaaguaaaau

SEQ ID NO: 2156514 - RNA, 15 nt, Staphylococcus aureus subsp. aureus N315
caaaucuuuuaaauu

SEQ ID NO: 2156515 - RNA, 19 nt, Staphylococcus aureus subsp. aureus N315
caaaucucgucacauauaa

SEQ ID NO: 2156516 - RNA, 14 nt, Staphylococcus aureus subsp. aureus N315
caaccucugaugug

SEQ ID NO: 2156517 - RNA, 16 nt, Staphylococcus aureus subsp. aureus N315
caacugcuuuuuauua

SEQ ID NO: 2156518 - RNA, 14 nt, Staphylococcus aureus subsp. aureus N315
caacugcuuuuuau

SEQ ID NO: 2156519 - RNA, 22 nt, Staphylococcus aureus subsp. aureus N315
caacuuaauacgauaauaacua

SEQ ID NO: 2156520 - RNA, 15 nt, Staphylococcus aureus subsp. aureus N315
caacuuauaaaauga

SEQ ID NO: 2156521 - RNA, 16 nt, Staphylococcus aureus subsp. aureus N315
caacuuauaaaaugaa

SEQ ID NO: 2156522 - RNA, 15 nt, Staphylococcus aureus subsp. aureus N315
caacuuauaauauua

SEQ ID NO: 2156523 - RNA, 13 nt, Staphylococcus aureus subsp. aureus N315
caacuuagcuuag

SEQ ID NO: 2156524 - RNA, 14 nt, Staphylococcus aureus subsp. aureus N315
caacucguuuuucc

SEQ ID NO: 2156525 - RNA, 21 nt, Staphylococcus aureus subsp. aureus N315
caacguauauaaguuaaaauu

SEQ ID NO: 2156526 - RNA, 15 nt, Staphylococcus aureus subsp. aureus N315
caacuauaugugucg

SEQ ID NO: 2156527 - RNA, 15 nt, Staphylococcus aureus subsp. aureus N315
caacuacuuaaauua

SEQ ID NO: 2156528 - RNA, 20 nt, Staphylococcus aureus subsp. aureus N315
caacguuauucguuaacaau

SEQ ID NO: 2156529 - RNA, 15 nt, Staphylococcus aureus subsp. aureus N315
caacguucuacucua

SEQ ID NO: 2156530 - RNA, 21 nt, Staphylococcus aureus subsp. aureus N315
caagauuaugacaacauaaca

SEQ ID NO: 2156531 - RNA, 18 nt, Staphylococcus aureus subsp. aureus N315
caagaugguauugcuuua

SEQ ID NO: 2156532 - RNA, 20 nt, Staphylococcus aureus subsp. aureus N315
caagaugcucauugcauuuc

SEQ ID NO: 2156533 - RNA, 15 nt, Staphylococcus aureus subsp. aureus N315
caagccguugguugu

SEQ ID NO: 2156534 - RNA, 15 nt, Staphylococcus aureus subsp. aureus N315
caagccaagauaaau

SEQ ID NO: 2156535 - RNA, 18 nt, Staphylococcus aureus subsp. aureus N315
caagcguuucuugaucua

SEQ ID NO: 2156536 - RNA, 16 nt, Staphylococcus aureus subsp. aureus N315
caagaauuaaugaaau

SEQ ID NO: 2156537 - RNA, 22 nt, Staphylococcus aureus subsp. aureus N315
caagaauuauggcagauccaua

SEQ ID NO: 2156538 - RNA, 23 nt, Staphylococcus aureus subsp. aureus N315
caagagauaagaaaauaccuaau

SEQ ID NO: 2156539 - RNA, 19 nt, Staphylococcus aureus subsp. aureus N315
caagacucccuuuuuaaaa

SEQ ID NO: 2156540 - RNA, 18 nt, Staphylococcus aureus subsp. aureus N315
caagagaauuaauaauuu

SEQ ID NO: 2156541 - RNA, 19 nt, Staphylococcus aureus subsp. aureus N315
caagagaauuaauaauuuu

SEQ ID NO: 2156542 - RNA, 15 nt, Staphylococcus aureus subsp. aureus N315
caaucuauuuuaaac

SEQ ID NO: 2156543 - RNA, 13 nt, Staphylococcus aureus subsp. aureus N315
caaucuauauaaa

SEQ ID NO: 2156544 - RNA, 14 nt, Staphylococcus aureus subsp. aureus N315
caaucuauauaaau

SEQ ID NO: 2156545 - RNA, 19 nt, Staphylococcus aureus subsp. aureus N315
caaucgcauuuuguuucaa

SEQ ID NO: 2156546 - RNA, 23 nt, Staphylococcus aureus subsp. aureus N315
caaucauaccggcaaauaacaau

SEQ ID NO: 2156547 - RNA, 20 nt, Staphylococcus aureus subsp. aureus N315
caaucacuccucuauuuuau

SEQ ID NO: 2156548 - RNA, 23 nt, Staphylococcus aureus subsp. aureus N315
caaucaacgagucauaaauauaa

SEQ ID NO: 2156549 - RNA, 15 nt, Staphylococcus aureus subsp. aureus N315
caaucaacuucauau

SEQ ID NO: 2156550 - RNA, 21 nt, Staphylococcus aureus subsp. aureus N315
caauaucuucuaauuccauca

SEQ ID NO: 2156551 - RNA, 20 nt, Staphylococcus aureus subsp. aureus N315
caauauuuuuacauauuuau

SEQ ID NO: 2156552 - RNA, 13 nt, Staphylococcus aureus subsp. aureus N315
caaucacaauaua

SEQ ID NO: 2156553 - RNA, 17 nt, Staphylococcus aureus subsp. aureus N315
caaucacagcaauaaua

SEQ ID NO: 2156554 - RNA, 16 nt, Staphylococcus aureus subsp. aureus N315
caaucacuauauuuca

SEQ ID NO: 2156555 - RNA, 19 nt, Staphylococcus aureus subsp. aureus N315
caauaucaucauuuaaaua

SEQ ID NO: 2156556 - RNA, 20 nt, Staphylococcus aureus subsp. aureus N315
caauauauucaccuacaaca

SEQ ID NO: 2156557 - RNA, 22 nt, Staphylococcus aureus subsp. aureus N315
caauauauaaugguucuauaau

SEQ ID NO: 2156558 - RNA, 13 nt, Staphylococcus aureus subsp. aureus N315
caauacgcaaugu

SEQ ID NO: 2156559 - RNA, 17 nt, Staphylococcus aureus subsp. aureus N315
caauacgauugcaauug

SEQ ID NO: 2156560 - RNA, 15 nt, Staphylococcus aureus subsp. aureus N315
caauacguuuccaau

SEQ ID NO: 2156561 - RNA, 17 nt, Staphylococcus aureus subsp. aureus N315
caauauacuuuuuaaau

SEQ ID NO: 2156562 - RNA, 21 nt, Staphylococcus aureus subsp. aureus N315
caauauagaaaaugaguacaa

SEQ ID NO: 2156563 - RNA, 14 nt, Staphylococcus aureus subsp. aureus N315
caauacgaaaucaa

SEQ ID NO: 2156564 - RNA, 17 nt, Staphylococcus aureus subsp. aureus N315
caauacauaaugguuca

SEQ ID NO: 2156565 - RNA, 15 nt, Staphylococcus aureus subsp. aureus N315
caauacaaagaauua

SEQ ID NO: 2156566 - RNA, 17 nt, Staphylococcus aureus subsp. aureus N315
caauacagaacuuuaau

SEQ ID NO: 2156567 - RNA, 14 nt, Staphylococcus aureus subsp. aureus N315
caauaauaaaucac

SEQ ID NO: 2156568 - RNA, 22 nt, Staphylococcus aureus subsp. aureus N315
caauaauaaaccuaaagauaua

SEQ ID NO: 2156569 - RNA, 22 nt, Staphylococcus aureus subsp. aureus N315
caaguuucauggggcuuaugca

SEQ ID NO: 2156570 - RNA, 19 nt, Staphylococcus aureus subsp. aureus N315
caaguuuauaaucuuuuuu

SEQ ID NO: 2156571 - RNA, 24 nt, Staphylococcus aureus subsp. aureus N315
caaguuuaguaucuccaucaaagu

SEQ ID NO: 2156572 - RNA, 11 nt, Staphylococcus aureus subsp. aureus N315
caauaaaaaug

SEQ ID NO: 2156573 - RNA, 18 nt, Staphylococcus aureus subsp. aureus N315
caagucuucuaaaaaauc

SEQ ID NO: 2156574 - RNA, 15 nt, Staphylococcus aureus subsp. aureus N315
caagucuaacaguua

SEQ ID NO: 2156575 - RNA, 23 nt, Staphylococcus aureus subsp. aureus N315
caagucuaguucgaacacacacu

SEQ ID NO: 2156576 - RNA, 22 nt, Staphylococcus aureus subsp. aureus N315
caagucucauaucuauuuuucg

SEQ ID NO: 2156577 - RNA, 17 nt, Staphylococcus aureus subsp. aureus N315
caagugguaaaaaugaa

SEQ ID NO: 2156578 - RNA, 20 nt, Staphylococcus aureus subsp. aureus N315
caaggauguuauaaaaugaa

SEQ ID NO: 2156579 - RNA, 16 nt, Staphylococcus aureus subsp. aureus N315
caaggauguuauaaaa

SEQ ID NO: 2156580 - RNA, 15 nt, Staphylococcus aureus subsp. aureus N315
caaggauugaaaaaa

SEQ ID NO: 2156581 - RNA, 20 nt, Staphylococcus aureus subsp. aureus N315
caaguaugagacgcauugca

SEQ ID NO: 2156582 - RNA, 15 nt, Staphylococcus aureus subsp. aureus N315
aucagggaaaucauc

SEQ ID NO: 2156583 - RNA, 16 nt, Staphylococcus aureus subsp. aureus N315
aucaguauaaucagca

SEQ ID NO: 2156584 - RNA, 16 nt, Staphylococcus aureus subsp. aureus N315
aucaguaccaaagaaa

SEQ ID NO: 2156585 - RNA, 23 nt, Staphylococcus aureus subsp. aureus N315
aucaguaccaaagaaaucaccag

SEQ ID NO: 2156586 - RNA, 16 nt, Staphylococcus aureus subsp. aureus N315
aucagguccaauucuc

SEQ ID NO: 2156587 - RNA, 17 nt, Staphylococcus aureus subsp. aureus N315
aucagguccaauucucu

SEQ ID NO: 2156588 - RNA, 16 nt, Staphylococcus aureus subsp. aureus N315
aucaguuauuuuaaua

SEQ ID NO: 2156589 - RNA, 15 nt, Staphylococcus aureus subsp. aureus N315
aaaacgauaauaaua

SEQ ID NO: 2156590 - RNA, 18 nt, Staphylococcus aureus subsp. aureus N315
aaaacgacucauuauaaa

SEQ ID NO: 2156591 - RNA, 20 nt, Staphylococcus aureus subsp. aureus N315
aucaguugagugauuuuaau

SEQ ID NO: 2156592 - RNA, 23 nt, Staphylococcus aureus subsp. aureus N315
aucagucucuaaaacuuuuucaa

SEQ ID NO: 2156593 - RNA, 18 nt, Staphylococcus aureus subsp. aureus N315
aucagucauucacauaca

SEQ ID NO: 2156594 - RNA, 17 nt, Staphylococcus aureus subsp. aureus N315
aucaguauuuacuuuuc

SEQ ID NO: 2156595 - RNA, 20 nt, Staphylococcus aureus subsp. aureus N315
aucaguuguguaauaaagca

SEQ ID NO: 2156596 - RNA, 14 nt, Staphylococcus aureus subsp. aureus N315
aucagaaucaagua

SEQ ID NO: 2156597 - RNA, 13 nt, Staphylococcus aureus subsp. aureus N315
aucacugcuuuca

SEQ ID NO: 2156598 - RNA, 15 nt, Staphylococcus aureus subsp. aureus N315
aucagcuaaauauuu

SEQ ID NO: 2156599 - RNA, 16 nt, Staphylococcus aureus subsp. aureus N315
aucagcuauaaaagua

SEQ ID NO: 2156600 - RNA, 20 nt, Staphylococcus aureus subsp. aureus N315
aucacucuuacucauuuuuc

SEQ ID NO: 2156601 - RNA, 21 nt, Staphylococcus aureus subsp. aureus N315
aucacucuuacucauuuuucu

SEQ ID NO: 2156602 - RNA, 21 nt, Staphylococcus aureus subsp. aureus N315
aucacugcauauaaagucaua

SEQ ID NO: 2156603 - RNA, 13 nt, Staphylococcus aureus subsp. aureus N315
aucacuaaaguaa

SEQ ID NO: 2156604 - RNA, 17 nt, Staphylococcus aureus subsp. aureus N315
aucaccuuuuuuaacuu

SEQ ID NO: 2156605 - RNA, 17 nt, Staphylococcus aureus subsp. aureus N315
aucaccuuuuauccccu

SEQ ID NO: 2156606 - RNA, 22 nt, Staphylococcus aureus subsp. aureus N315
aucaccuuauugaugaaaacaa

SEQ ID NO: 2156607 - RNA, 14 nt, Staphylococcus aureus subsp. aureus N315
aucaccagauuuua

SEQ ID NO: 2156608 - RNA, 17 nt, Staphylococcus aureus subsp. aureus N315
aucaccauacuaaaaca

SEQ ID NO: 2156609 - RNA, 23 nt, Staphylococcus aureus subsp. aureus N315
aucaauuucaacuuauaaaauga

SEQ ID NO: 2156610 - RNA, 17 nt, Staphylococcus aureus subsp. aureus N315
aucaauuucuguaauaa

SEQ ID NO: 2156611 - RNA, 15 nt, Staphylococcus aureus subsp. aureus N315
aucacaacacauaaa

SEQ ID NO: 2156612 - RNA, 13 nt, Staphylococcus aureus subsp. aureus N315
aucacauaaaaua

SEQ ID NO: 2156613 - RNA, 15 nt, Staphylococcus aureus subsp. aureus N315
aucacauaaaauaca

SEQ ID NO: 2156614 - RNA, 16 nt, Staphylococcus aureus subsp. aureus N315
aucacauaaaauacau

SEQ ID NO: 2156615 - RNA, 22 nt, Staphylococcus aureus subsp. aureus N315
aucacaguguugaauuucaaaa

SEQ ID NO: 2156616 - RNA, 17 nt, Staphylococcus aureus subsp. aureus N315
aucacaggaaaaucgua

SEQ ID NO: 2156617 - RNA, 20 nt, Staphylococcus aureus subsp. aureus N315
aucacacgcauacaggaaau

SEQ ID NO: 2156618 - RNA, 15 nt, Staphylococcus aureus subsp. aureus N315
aucacacucuccccg

SEQ ID NO: 2156619 - RNA, 22 nt, Staphylococcus aureus subsp. aureus N315
aucacacgacauguagguaauu

SEQ ID NO: 2156620 - RNA, 20 nt, Staphylococcus aureus subsp. aureus N315
auauuauugugaaaucuauu

SEQ ID NO: 2156621 - RNA, 18 nt, Staphylococcus aureus subsp. aureus N315
auauuaugccauucauua

SEQ ID NO: 2156622 - RNA, 14 nt, Staphylococcus aureus subsp. aureus N315
auauuauuaaauca

SEQ ID NO: 2156623 - RNA, 14 nt, Staphylococcus aureus subsp. aureus N315
auauuauaaaaaca

SEQ ID NO: 2156624 - RNA, 12 nt, Staphylococcus aureus subsp. aureus N315
auauuauauaua

SEQ ID NO: 2156625 - RNA, 17 nt, Staphylococcus aureus subsp. aureus N315
auauuaggcuuaaauau

SEQ ID NO: 2156626 - RNA, 18 nt, Staphylococcus aureus subsp. aureus N315
auauuacuucucaucgaa

SEQ ID NO: 2156627 - RNA, 16 nt, Staphylococcus aureus subsp. aureus N315
auauuagaacauuuau

SEQ ID NO: 2156628 - RNA, 23 nt, Staphylococcus aureus subsp. aureus N315
auauucgcuaauguaccaaucaa

SEQ ID NO: 2156629 - RNA, 16 nt, Staphylococcus aureus subsp. aureus N315
auauucgcuuaaaaac

SEQ ID NO: 2156630 - RNA, 15 nt, Staphylococcus aureus subsp. aureus N315
auauucguaaauccu

SEQ ID NO: 2156631 - RNA, 15 nt, Staphylococcus aureus subsp. aureus N315
auauucgcuuaaaaa

SEQ ID NO: 2156632 - RNA, 18 nt, Staphylococcus aureus subsp. aureus N315
auauuauuuugcuuuaau

SEQ ID NO: 2156633 - RNA, 14 nt, Staphylococcus aureus subsp. aureus N315
auauuauuuuuaag

SEQ ID NO: 2156634 - RNA, 24 nt, Staphylococcus aureus subsp. aureus N315
auauuauuuugcaauugcaaugaa

SEQ ID NO: 2156635 - RNA, 16 nt, Staphylococcus aureus subsp. aureus N315
auauucaaauuuacca

SEQ ID NO: 2156636 - RNA, 22 nt, Staphylococcus aureus subsp. aureus N315
auauuccuuacuaaguaaccaa

SEQ ID NO: 2156637 - RNA, 12 nt, Staphylococcus aureus subsp. aureus N315
auauuaaauuca

SEQ ID NO: 2156638 - RNA, 15 nt, Staphylococcus aureus subsp. aureus N315
auauuaacaccagau

SEQ ID NO: 2156639 - RNA, 16 nt, Staphylococcus aureus subsp. aureus N315
auauuaaaguaaaaua

SEQ ID NO: 2156640 - RNA, 15 nt, Staphylococcus aureus subsp. aureus N315
auauuaaacuuauaa

SEQ ID NO: 2156641 - RNA, 17 nt, Staphylococcus aureus subsp. aureus N315
auauuaaucauaaugaa

SEQ ID NO: 2156642 - RNA, 15 nt, Staphylococcus aureus subsp. aureus N315
auauuaagauguaua

SEQ ID NO: 2156643 - RNA, 18 nt, Staphylococcus aureus subsp. aureus N315
auauuaacuguuagacuu

SEQ ID NO: 2156644 - RNA, 19 nt, Staphylococcus aureus subsp. aureus N315
auauuacuaaccuauuaaa

SEQ ID NO: 2156645 - RNA, 23 nt, Staphylococcus aureus subsp. aureus N315
auauuacuaaccuauuaaaauaa

SEQ ID NO: 2156646 - RNA, 21 nt, Staphylococcus aureus subsp. aureus N315
auauuacucaaaauuaaagcu

SEQ ID NO: 2156647 - RNA, 19 nt, Staphylococcus aureus subsp. aureus N315
auauuacuucucaucgaau

SEQ ID NO: 2156648 - RNA, 21 nt, Staphylococcus aureus subsp. aureus N315
auauuacuuuggaaauuuauu

SEQ ID NO: 2156649 - RNA, 19 nt, Staphylococcus aureus subsp. aureus N315
auauuagauaucuuaaucu

SEQ ID NO: 2156650 - RNA, 13 nt, Staphylococcus aureus subsp. aureus N315
auauuacauauaa

SEQ ID NO: 2156651 - RNA, 18 nt, Staphylococcus aureus subsp. aureus N315
auauuaagcgucuaucuc

SEQ ID NO: 2156652 - RNA, 20 nt, Staphylococcus aureus subsp. aureus N315
auauguggcacucauaaccg

SEQ ID NO: 2156653 - RNA, 16 nt, Staphylococcus aureus subsp. aureus N315
auauguguuaacugau

SEQ ID NO: 2156654 - RNA, 19 nt, Staphylococcus aureus subsp. aureus N315
auaugugguggcuauauaa

SEQ ID NO: 2156655 - RNA, 19 nt, Staphylococcus aureus subsp. aureus N315
auauguguaugauagaaua

SEQ ID NO: 2156656 - RNA, 22 nt, Staphylococcus aureus subsp. aureus N315
auaugucucucuuucuuauuca

SEQ ID NO: 2156657 - RNA, 22 nt, Staphylococcus aureus subsp. aureus N315
auauguuuauauugcaaaaaua

SEQ ID NO: 2156658 - RNA, 19 nt, Staphylococcus aureus subsp. aureus N315
auauguuuggauaucuuug

SEQ ID NO: 2156659 - RNA, 22 nt, Staphylococcus aureus subsp. aureus N315
auauguuuuauaauaaauguca

SEQ ID NO: 2156660 - RNA, 21 nt, Staphylococcus aureus subsp. aureus N315
auauuaaaauuaaaacuuuca

SEQ ID NO: 2156661 - RNA, 15 nt, Staphylococcus aureus subsp. aureus N315
auauuaaaacaauga

SEQ ID NO: 2156662 - RNA, 15 nt, Staphylococcus aureus subsp. aureus N315
auauguacuauuauc

SEQ ID NO: 2156663 - RNA, 15 nt, Staphylococcus aureus subsp. aureus N315
auauguaaaugaaau

SEQ ID NO: 2156664 - RNA, 16 nt, Staphylococcus aureus subsp. aureus N315
auauguaaaugaaaua

SEQ ID NO: 2156665 - RNA, 19 nt, Staphylococcus aureus subsp. aureus N315
auauguauaacauuauuaa

SEQ ID NO: 2156666 - RNA, 23 nt, Staphylococcus aureus subsp. aureus N315
auauguauagaggauauuuauuc

SEQ ID NO: 2156667 - RNA, 13 nt, Staphylococcus aureus subsp. aureus N315
auauguaaucaga

SEQ ID NO: 2156668 - RNA, 22 nt, Staphylococcus aureus subsp. aureus N315
auaugccgauugcucuaaucca

SEQ ID NO: 2156669 - RNA, 16 nt, Staphylococcus aureus subsp. aureus N315
auaugcaucaacagau

SEQ ID NO: 2156670 - RNA, 17 nt, Staphylococcus aureus subsp. aureus N315
auauccugccaauauau

SEQ ID NO: 2156671 - RNA, 18 nt, Staphylococcus aureus subsp. aureus N315
auauccuggaauauuaac

SEQ ID NO: 2156672 - RNA, 12 nt, Staphylococcus aureus subsp. aureus N315
auaugcauauau

SEQ ID NO: 2156673 - RNA, 19 nt, Staphylococcus aureus subsp. aureus N315
auaugcguagcaacauuau

SEQ ID NO: 2156674 - RNA, 22 nt, Staphylococcus aureus subsp. aureus N315
auaugcuuuaggugaguuucca

SEQ ID NO: 2156675 - RNA, 23 nt, Staphylococcus aureus subsp. aureus N315
auaugcuuguugugaauaaaauu

SEQ ID NO: 2156676 - RNA, 18 nt, Staphylococcus aureus subsp. aureus N315
aucaaagcuauauaugaa

SEQ ID NO: 2156677 - RNA, 21 nt, Staphylococcus aureus subsp. aureus N315
aucaaaguaucagucauugca

SEQ ID NO: 2156678 - RNA, 21 nt, Staphylococcus aureus subsp. aureus N315
aucaaaguacuaacguuuuaa

SEQ ID NO: 2156679 - RNA, 20 nt, Staphylococcus aureus subsp. aureus N315
aucaaagaggcuuuaaaauu

SEQ ID NO: 2156680 - RNA, 14 nt, Staphylococcus aureus subsp. aureus N315
aucaaagaggcaca

SEQ ID NO: 2156681 - RNA, 14 nt, Staphylococcus aureus subsp. aureus N315
aucaaagaggaaca

SEQ ID NO: 2156682 - RNA, 21 nt, Staphylococcus aureus subsp. aureus N315
aucaaagucuucuucaacaau

SEQ ID NO: 2156683 - RNA, 18 nt, Staphylococcus aureus subsp. aureus N315
aucaaauagacaccaaaa

SEQ ID NO: 2156684 - RNA, 18 nt, Staphylococcus aureus subsp. aureus N315
aucaaauacauuucaaaa

SEQ ID NO: 2156685 - RNA, 23 nt, Staphylococcus aureus subsp. aureus N315
aucaaauccaaaaucuuuacuug

SEQ ID NO: 2156686 - RNA, 18 nt, Staphylococcus aureus subsp. aureus N315
aucaacugaaauuuuucc

SEQ ID NO: 2156687 - RNA, 13 nt, Staphylococcus aureus subsp. aureus N315
aucaaauuuuucg

SEQ ID NO: 2156688 - RNA, 21 nt, Staphylococcus aureus subsp. aureus N315
aucaaauuagucauccaaaga

SEQ ID NO: 2156689 - RNA, 21 nt, Staphylococcus aureus subsp. aureus N315
auauuucugggcuuucuuuuu

SEQ ID NO: 2156690 - RNA, 14 nt, Staphylococcus aureus subsp. aureus N315
auauuucuaaauua

SEQ ID NO: 2156691 - RNA, 13 nt, Staphylococcus aureus subsp. aureus N315
auauuuauuuaau

SEQ ID NO: 2156692 - RNA, 22 nt, Staphylococcus aureus subsp. aureus N315
auauuuaucgcgauuauuacca

SEQ ID NO: 2156693 - RNA, 17 nt, Staphylococcus aureus subsp. aureus N315
auauuuaguuaauuauu

SEQ ID NO: 2156694 - RNA, 22 nt, Staphylococcus aureus subsp. aureus N315
auauucuccaacucuaacagcu

SEQ ID NO: 2156695 - RNA, 22 nt, Staphylococcus aureus subsp. aureus N315
auauucucugcuucuaaaacau

SEQ ID NO: 2156696 - RNA, 20 nt, Staphylococcus aureus subsp. aureus N315
auauucguagcaugacauua

SEQ ID NO: 2156697 - RNA, 13 nt, Staphylococcus aureus subsp. aureus N315
auauucuaaaaaa

SEQ ID NO: 2156698 - RNA, 12 nt, Staphylococcus aureus subsp. aureus N315
auauucuuaucu

SEQ ID NO: 2156699 - RNA, 17 nt, Staphylococcus aureus subsp. aureus N315
auauuuacacagaauga

SEQ ID NO: 2156700 - RNA, 16 nt, Staphylococcus aureus subsp. aureus N315
auauuuuuacauauuu

SEQ ID NO: 2156701 - RNA, 13 nt, Staphylococcus aureus subsp. aureus N315
auauuucuuacca

SEQ ID NO: 2156702 - RNA, 15 nt, Staphylococcus aureus subsp. aureus N315
auauuucuuaccauu

SEQ ID NO: 2156703 - RNA, 16 nt, Staphylococcus aureus subsp. aureus N315
auauuugaaaauuuca

SEQ ID NO: 2156704 - RNA, 18 nt, Staphylococcus aureus subsp. aureus N315
auauuugaaaauuucacc

SEQ ID NO: 2156705 - RNA, 12 nt, Staphylococcus aureus subsp. aureus N315
auauuuuucuuc

SEQ ID NO: 2156706 - RNA, 19 nt, Staphylococcus aureus subsp. aureus N315
auauuuuucuucaguuaaa

SEQ ID NO: 2156707 - RNA, 17 nt, Staphylococcus aureus subsp. aureus N315
auauuuuuaucaucuuc

SEQ ID NO: 2156708 - RNA, 13 nt, Staphylococcus aureus subsp. aureus N315
auauuuuuagaaa

SEQ ID NO: 2156709 - RNA, 15 nt, Staphylococcus aureus subsp. aureus N315
auauuuuucaauuaa

SEQ ID NO: 2156710 - RNA, 16 nt, Staphylococcus aureus subsp. aureus N315
auauuuuuagcuuuau

SEQ ID NO: 2156711 - RNA, 15 nt, Staphylococcus aureus subsp. aureus N315
auauuuuuaggaaua

SEQ ID NO: 2156712 - RNA, 20 nt, Staphylococcus aureus subsp. aureus N315
auauuuuuguauuuauguuu

SEQ ID NO: 2156713 - RNA, 12 nt, Staphylococcus aureus subsp. aureus N315
auauuuuuuaau

SEQ ID NO: 2156714 - RNA, 14 nt, Staphylococcus aureus subsp. aureus N315
auauuuuuuaaauu

SEQ ID NO: 2156715 - RNA, 19 nt, Staphylococcus aureus subsp. aureus N315
aucaaaaauaauuaugaaa

SEQ ID NO: 2156716 - RNA, 22 nt, Staphylococcus aureus subsp. aureus N315
aucaaagaaaaagugauaauua

SEQ ID NO: 2156717 - RNA, 17 nt, Staphylococcus aureus subsp. aureus N315
auauaacauuaaaauga

SEQ ID NO: 2156718 - RNA, 13 nt, Staphylococcus aureus subsp. aureus N315
auauaacauugca

SEQ ID NO: 2156719 - RNA, 22 nt, Staphylococcus aureus subsp. aureus N315
auauaaccgugaugaugugcaa

SEQ ID NO: 2156720 - RNA, 17 nt, Staphylococcus aureus subsp. aureus N315
auauaaauuaucagaau

SEQ ID NO: 2156721 - RNA, 18 nt, Staphylococcus aureus subsp. aureus N315
auauaaauuaucagaauc

SEQ ID NO: 2156722 - RNA, 15 nt, Staphylococcus aureus subsp. aureus N315
auauaaaucaaauau

SEQ ID NO: 2156723 - RNA, 14 nt, Staphylococcus aureus subsp. aureus N315
auauaaauaggcag

SEQ ID NO: 2156724 - RNA, 22 nt, Staphylococcus aureus subsp. aureus N315
auaguccgcguguacuuuacca

SEQ ID NO: 2156725 - RNA, 23 nt, Staphylococcus aureus subsp. aureus N315
auaguccggggccccaacaaaga

SEQ ID NO: 2156726 - RNA, 16 nt, Staphylococcus aureus subsp. aureus N315
auagucuuaaacauaa

SEQ ID NO: 2156727 - RNA, 18 nt, Staphylococcus aureus subsp. aureus N315
auagugugucauaaugaa

SEQ ID NO: 2156728 - RNA, 23 nt, Staphylococcus aureus subsp. aureus N315
auagugguaaaaaguuuaaagua

SEQ ID NO: 2156729 - RNA, 18 nt, Staphylococcus aureus subsp. aureus N315
auaguggugguacuuuuu

SEQ ID NO: 2156730 - RNA, 17 nt, Staphylococcus aureus subsp. aureus N315
auagugucgagauuuua

SEQ ID NO: 2156731 - RNA, 14 nt, Staphylococcus aureus subsp. aureus N315
auauaccaaccaaa

SEQ ID NO: 2156732 - RNA, 13 nt, Staphylococcus aureus subsp. aureus N315
auauaccaaccaa

SEQ ID NO: 2156733 - RNA, 13 nt, Staphylococcus aureus subsp. aureus N315
auauagauuaaac

SEQ ID NO: 2156734 - RNA, 22 nt, Staphylococcus aureus subsp. aureus N315
auauagauggcuuuuuuugcug

SEQ ID NO: 2156735 - RNA, 13 nt, Staphylococcus aureus subsp. aureus N315
auauaauuuauuu

SEQ ID NO: 2156736 - RNA, 24 nt, Staphylococcus aureus subsp. aureus N315
auauaauuuccuaaaaacugugau

SEQ ID NO: 2156737 - RNA, 21 nt, Staphylococcus aureus subsp. aureus N315
auauaacuauggucaucaauu

SEQ ID NO: 2156738 - RNA, 14 nt, Staphylococcus aureus subsp. aureus N315
auauaauuuaaaga

SEQ ID NO: 2156739 - RNA, 13 nt, Staphylococcus aureus subsp. aureus N315
auauaauuuaaag

SEQ ID NO: 2156740 - RNA, 18 nt, Staphylococcus aureus subsp. aureus N315
auauaauuuauaaaaaga

SEQ ID NO: 2156741 - RNA, 21 nt, Staphylococcus aureus subsp. aureus N315
auauaguaggguauugaaaua

SEQ ID NO: 2156742 - RNA, 19 nt, Staphylococcus aureus subsp. aureus N315
auauaguaaaauaaauaca

SEQ ID NO: 2156743 - RNA, 14 nt, Staphylococcus aureus subsp. aureus N315
auauaguaaaauaa

SEQ ID NO: 2156744 - RNA, 22 nt, Staphylococcus aureus subsp. aureus N315
auauaguggugguacuuuuuug

SEQ ID NO: 2156745 - RNA, 15 nt, Staphylococcus aureus subsp. aureus N315
auaucaauaaugcug

SEQ ID NO: 2156746 - RNA, 19 nt, Staphylococcus aureus subsp. aureus N315
auaucaauuucaacuuaua

SEQ ID NO: 2156747 - RNA, 20 nt, Staphylococcus aureus subsp. aureus N315
auaucaauuguugcaaaaua

SEQ ID NO: 2156748 - RNA, 18 nt, Staphylococcus aureus subsp. aureus N315
auaucaauaauucguuga

SEQ ID NO: 2156749 - RNA, 16 nt, Staphylococcus aureus subsp. aureus N315
auaucaauaaugcugc

SEQ ID NO: 2156750 - RNA, 18 nt, Staphylococcus aureus subsp. aureus N315
auauauucguuacaaaug

SEQ ID NO: 2156751 - RNA, 15 nt, Staphylococcus aureus subsp. aureus N315
auauauucaucucuu

SEQ ID NO: 2156752 - RNA, 14 nt, Staphylococcus aureus subsp. aureus N315
auauaugauaaaua

SEQ ID NO: 2156753 - RNA, 18 nt, Staphylococcus aureus subsp. aureus N315
auauaugccgauugcucu

SEQ ID NO: 2156754 - RNA, 15 nt, Staphylococcus aureus subsp. aureus N315
auauauuaaaguaaa

SEQ ID NO: 2156755 - RNA, 20 nt, Staphylococcus aureus subsp. aureus N315
auauauucaauaauuauuaa

SEQ ID NO: 2156756 - RNA, 13 nt, Staphylococcus aureus subsp. aureus N315
auauauaaagaaa

SEQ ID NO: 2156757 - RNA, 16 nt, Staphylococcus aureus subsp. aureus N315
auauauaacaaguaca

SEQ ID NO: 2156758 - RNA, 13 nt, Staphylococcus aureus subsp. aureus N315
auauauaaccaua

SEQ ID NO: 2156759 - RNA, 12 nt, Staphylococcus aureus subsp. aureus N315
auauaugauaaa

SEQ ID NO: 2156760 - RNA, 23 nt, Staphylococcus aureus subsp. aureus N315
auauauaauaaaaccaccuguuu

SEQ ID NO: 2156761 - RNA, 15 nt, Staphylococcus aureus subsp. aureus N315
auauauaaugaaggu

SEQ ID NO: 2156762 - RNA, 21 nt, Staphylococcus aureus subsp. aureus N315
auaucacaacacauaaauuaa

SEQ ID NO: 2156763 - RNA, 17 nt, Staphylococcus aureus subsp. aureus N315
auaucacugaaugcuaa

SEQ ID NO: 2156764 - RNA, 17 nt, Staphylococcus aureus subsp. aureus N315
auaucacuuuagauaaa

SEQ ID NO: 2156765 - RNA, 20 nt, Staphylococcus aureus subsp. aureus N315
auaucagcuaaguuaaauau

SEQ ID NO: 2156766 - RNA, 21 nt, Staphylococcus aureus subsp. aureus N315
auaucagcuuguuucagguuu

SEQ ID NO: 2156767 - RNA, 17 nt, Staphylococcus aureus subsp. aureus N315
auaucaugcaaaacuaa

SEQ ID NO: 2156768 - RNA, 22 nt, Staphylococcus aureus subsp. aureus N315
auaucaugcacaauauucguag

SEQ ID NO: 2156769 - RNA, 15 nt, Staphylococcus aureus subsp. aureus N315
auaucaugcaaaaua

SEQ ID NO: 2156770 - RNA, 21 nt, Staphylococcus aureus subsp. aureus N315
auaucauucuguguaaauaua

SEQ ID NO: 2156771 - RNA, 17 nt, Staphylococcus aureus subsp. aureus N315
auauccacgguuuacca

SEQ ID NO: 2156772 - RNA, 21 nt, Staphylococcus aureus subsp. aureus N315
auauccaaaauccugaaauua

SEQ ID NO: 2156773 - RNA, 19 nt, Staphylococcus aureus subsp. aureus N315
auaguaggguauugaaaua

SEQ ID NO: 2156774 - RNA, 19 nt, Staphylococcus aureus subsp. aureus N315
auaguauuaacuauaaaua

SEQ ID NO: 2156775 - RNA, 23 nt, Staphylococcus aureus subsp. aureus N315
auaguauuaacuauaaauagaag

SEQ ID NO: 2156776 - RNA, 22 nt, Staphylococcus aureus subsp. aureus N315
auagucauucauaauuuguuga

SEQ ID NO: 2156777 - RNA, 12 nt, Staphylococcus aureus subsp. aureus N315
auagucaucuua

SEQ ID NO: 2156778 - RNA, 13 nt, Staphylococcus aureus subsp. aureus N315
auaguaauaaaau

SEQ ID NO: 2156779 - RNA, 16 nt, Staphylococcus aureus subsp. aureus N315
auaguaaccuuuauuu

SEQ ID NO: 2156780 - RNA, 23 nt, Staphylococcus aureus subsp. aureus N315
auaguaaccuuuauuuucaguua

SEQ ID NO: 2156781 - RNA, 14 nt, Staphylococcus aureus subsp. aureus N315
auaggcuugccaau

SEQ ID NO: 2156782 - RNA, 18 nt, Staphylococcus aureus subsp. aureus N315
auaggcuugccaauguga

SEQ ID NO: 2156783 - RNA, 15 nt, Staphylococcus aureus subsp. aureus N315
auagguauaaucauu

SEQ ID NO: 2156784 - RNA, 14 nt, Staphylococcus aureus subsp. aureus N315
auagguaacuaaaa

SEQ ID NO: 2156785 - RNA, 19 nt, Staphylococcus aureus subsp. aureus N315
auagguaaccuuaaauaua

SEQ ID NO: 2156786 - RNA, 14 nt, Staphylococcus aureus subsp. aureus N315
auaggaaacuuaaa

SEQ ID NO: 2156787 - RNA, 16 nt, Staphylococcus aureus subsp. aureus N315
auagcuuucguuucuu

SEQ ID NO: 2156788 - RNA, 22 nt, Staphylococcus aureus subsp. aureus N315
auagcuuucguuucuuuuauau

SEQ ID NO: 2156789 - RNA, 17 nt, Staphylococcus aureus subsp. aureus N315
auaggauuauuaucaaa

SEQ ID NO: 2156790 - RNA, 24 nt, Staphylococcus aureus subsp. aureus N315
auaggauuuacaccuauaccucgu

SEQ ID NO: 2156791 - RNA, 17 nt, Staphylococcus aureus subsp. aureus N315
auaggaaacuuaaauau

SEQ ID NO: 2156792 - RNA, 22 nt, Staphylococcus aureus subsp. aureus N315
auagcgauuuuaaagaaaaguu

SEQ ID NO: 2156793 - RNA, 20 nt, Staphylococcus aureus subsp. aureus N315
auagcgcucuggauuuuucu

SEQ ID NO: 2156794 - RNA, 21 nt, Staphylococcus aureus subsp. aureus N315
auagcgcucuggauuuuucuu

SEQ ID NO: 2156795 - RNA, 17 nt, Staphylococcus aureus subsp. aureus N315
auagaggcacaguggau

SEQ ID NO: 2156796 - RNA, 12 nt, Staphylococcus aureus subsp. aureus N315
auacauacugau

SEQ ID NO: 2156797 - RNA, 13 nt, Staphylococcus aureus subsp. aureus N315
auacauacugauu

SEQ ID NO: 2156798 - RNA, 15 nt, Staphylococcus aureus subsp. aureus N315
auacauaucuuuugc

SEQ ID NO: 2156799 - RNA, 13 nt, Staphylococcus aureus subsp. aureus N315
auacauaaauauu

SEQ ID NO: 2156800 - RNA, 19 nt, Staphylococcus aureus subsp. aureus N315
auacaguuguuauuuuugc

SEQ ID NO: 2156801 - RNA, 21 nt, Staphylococcus aureus subsp. aureus N315
auaauucaguguuacuauaca

SEQ ID NO: 2156802 - RNA, 16 nt, Staphylococcus aureus subsp. aureus N315
auaauucaacuuaaau

SEQ ID NO: 2156803 - RNA, 14 nt, Staphylococcus aureus subsp. aureus N315
auaauuauuaauuu

SEQ ID NO: 2156804 - RNA, 21 nt, Staphylococcus aureus subsp. aureus N315
auaauucgaaaucaaauauuu

SEQ ID NO: 2156805 - RNA, 19 nt, Staphylococcus aureus subsp. aureus N315
auaauucgauuaucuacua

SEQ ID NO: 2156806 - RNA, 17 nt, Staphylococcus aureus subsp. aureus N315
auacaugacauucauuu

SEQ ID NO: 2156807 - RNA, 15 nt, Staphylococcus aureus subsp. aureus N315
auacauuaauauaaa

SEQ ID NO: 2156808 - RNA, 18 nt, Staphylococcus aureus subsp. aureus N315
auacauuaucaagaauaa

SEQ ID NO: 2156809 - RNA, 13 nt, Staphylococcus aureus subsp. aureus N315
auacauuucaaaa

SEQ ID NO: 2156810 - RNA, 17 nt, Staphylococcus aureus subsp. aureus N315
auacauugauaaauuuu

SEQ ID NO: 2156811 - RNA, 15 nt, Staphylococcus aureus subsp. aureus N315
auacauuucaaaaaa

SEQ ID NO: 2156812 - RNA, 15 nt, Staphylococcus aureus subsp. aureus N315
auacauuuugcucua

SEQ ID NO: 2156813 - RNA, 20 nt, Staphylococcus aureus subsp. aureus N315
auacauuuugcucuaaacuu

SEQ ID NO: 2156814 - RNA, 19 nt, Staphylococcus aureus subsp. aureus N315
auaccaguggaaauuaugu

SEQ ID NO: 2156815 - RNA, 20 nt, Staphylococcus aureus subsp. aureus N315
auaccauugugaugauaauu

SEQ ID NO: 2156816 - RNA, 17 nt, Staphylococcus aureus subsp. aureus N315
auaccaucugaaucagu

SEQ ID NO: 2156817 - RNA, 18 nt, Staphylococcus aureus subsp. aureus N315
auaccaaccaaaaccaaa

SEQ ID NO: 2156818 - RNA, 15 nt, Staphylococcus aureus subsp. aureus N315
auaccaaauauauuu

SEQ ID NO: 2156819 - RNA, 18 nt, Staphylococcus aureus subsp. aureus N315
auaccacacuuuaaacaa

SEQ ID NO: 2156820 - RNA, 19 nt, Staphylococcus aureus subsp. aureus N315
auaccacacuuuaaacaag

SEQ ID NO: 2156821 - RNA, 22 nt, Staphylococcus aureus subsp. aureus N315
auaccaauugcugauauaauag

SEQ ID NO: 2156822 - RNA, 14 nt, Staphylococcus aureus subsp. aureus N315
auaccacuuaaucg

SEQ ID NO: 2156823 - RNA, 13 nt, Staphylococcus aureus subsp. aureus N315
auaccacuaagug

SEQ ID NO: 2156824 - RNA, 19 nt, Staphylococcus aureus subsp. aureus N315
auaccacuugaauacuuuu

SEQ ID NO: 2156825 - RNA, 14 nt, Staphylococcus aureus subsp. aureus N315
auacuguauuuaua

SEQ ID NO: 2156826 - RNA, 19 nt, Staphylococcus aureus subsp. aureus N315
auacuguuuaaauaaaauu

SEQ ID NO: 2156827 - RNA, 14 nt, Staphylococcus aureus subsp. aureus N315
auagaacaaaaugu

SEQ ID NO: 2156828 - RNA, 15 nt, Staphylococcus aureus subsp. aureus N315
auagaaauaaucaca

SEQ ID NO: 2156829 - RNA, 12 nt, Staphylococcus aureus subsp. aureus N315
auagaaaugaua

SEQ ID NO: 2156830 - RNA, 23 nt, Staphylococcus aureus subsp. aureus N315
auagaaccuauuuuuuauaugau

SEQ ID NO: 2156831 - RNA, 15 nt, Staphylococcus aureus subsp. aureus N315
auagacaccaaaaaa

SEQ ID NO: 2156832 - RNA, 13 nt, Staphylococcus aureus subsp. aureus N315
auagaauuuuuca

SEQ ID NO: 2156833 - RNA, 15 nt, Staphylococcus aureus subsp. aureus N315
auagaaugaauaauu

SEQ ID NO: 2156834 - RNA, 15 nt, Staphylococcus aureus subsp. aureus N315
auagaaguauggaug

SEQ ID NO: 2156835 - RNA, 14 nt, Staphylococcus aureus subsp. aureus N315
auagaaguuuuuug

SEQ ID NO: 2156836 - RNA, 18 nt, Staphylococcus aureus subsp. aureus N315
auagaaguuuuuugauua

SEQ ID NO: 2156837 - RNA, 13 nt, Staphylococcus aureus subsp. aureus N315
auacuacauauaa

SEQ ID NO: 2156838 - RNA, 16 nt, Staphylococcus aureus subsp. aureus N315
auacuaccguuuuuau

SEQ ID NO: 2156839 - RNA, 22 nt, Staphylococcus aureus subsp. aureus N315
auacugaugaaaacuuaaaaau

SEQ ID NO: 2156840 - RNA, 16 nt, Staphylococcus aureus subsp. aureus N315
auacugauauuuagaa

SEQ ID NO: 2156841 - RNA, 14 nt, Staphylococcus aureus subsp. aureus N315
auacugaaauuuca

SEQ ID NO: 2156842 - RNA, 22 nt, Staphylococcus aureus subsp. aureus N315
auacguguguuuucuuuucaaa

SEQ ID NO: 2156843 - RNA, 14 nt, Staphylococcus aureus subsp. aureus N315
auacguuuauaucu

SEQ ID NO: 2156844 - RNA, 19 nt, Staphylococcus aureus subsp. aureus N315
auacguugauguaauucug

SEQ ID NO: 2156845 - RNA, 13 nt, Staphylococcus aureus subsp. aureus N315
auacuaaauugag

SEQ ID NO: 2156846 - RNA, 15 nt, Staphylococcus aureus subsp. aureus N315
auacuaaauuugaaa

SEQ ID NO: 2156847 - RNA, 13 nt, Staphylococcus aureus subsp. aureus N315
auacguaaauggu

SEQ ID NO: 2156848 - RNA, 20 nt, Staphylococcus aureus subsp. aureus N315
auacguaaacacuuuaguau

SEQ ID NO: 2156849 - RNA, 14 nt, Staphylococcus aureus subsp. aureus N315
auacgcuuuuuaaa

SEQ ID NO: 2156850 - RNA, 18 nt, Staphylococcus aureus subsp. aureus N315
auaccgaauaauuuugau

SEQ ID NO: 2156851 - RNA, 16 nt, Staphylococcus aureus subsp. aureus N315
auaccuaccacaauaa

SEQ ID NO: 2156852 - RNA, 14 nt, Staphylococcus aureus subsp. aureus N315
auaccuaaaauacc

SEQ ID NO: 2156853 - RNA, 14 nt, Staphylococcus aureus subsp. aureus N315
augaagaauacaaa

SEQ ID NO: 2156854 - RNA, 15 nt, Staphylococcus aureus subsp. aureus N315
augaacuuaaugcuu

SEQ ID NO: 2156855 - RNA, 15 nt, Staphylococcus aureus subsp. aureus N315
augaaugccuaauuu

SEQ ID NO: 2156856 - RNA, 21 nt, Staphylococcus aureus subsp. aureus N315
augaaugccuaauuuugugaa

SEQ ID NO: 2156857 - RNA, 13 nt, Staphylococcus aureus subsp. aureus N315
augaauaacaaga

SEQ ID NO: 2156858 - RNA, 16 nt, Staphylococcus aureus subsp. aureus N315
augaauaacaagaaaa

SEQ ID NO: 2156859 - RNA, 21 nt, Staphylococcus aureus subsp. aureus N315
augaagcaguuguugguuuug

SEQ ID NO: 2156860 - RNA, 21 nt, Staphylococcus aureus subsp. aureus N315
augaauaaugcaauugaccaa

SEQ ID NO: 2156861 - RNA, 15 nt, Staphylococcus aureus subsp. aureus N315
augaauuauuuaaaa

SEQ ID NO: 2156862 - RNA, 18 nt, Staphylococcus aureus subsp. aureus N315
augaauuauuuaaaaugc

SEQ ID NO: 2156863 - RNA, 23 nt, Staphylococcus aureus subsp. aureus N315
augaauugaguauuaaauuugaa

SEQ ID NO: 2156864 - RNA, 14 nt, Staphylococcus aureus subsp. aureus N315
augaauuaauagcu

SEQ ID NO: 2156865 - RNA, 20 nt, Staphylococcus aureus subsp. aureus N315
augaauugcuuguuuuaaau

SEQ ID NO: 2156866 - RNA, 19 nt, Staphylococcus aureus subsp. aureus N315
augaauugcuuguuuuaaa

SEQ ID NO: 2156867 - RNA, 23 nt, Staphylococcus aureus subsp. aureus N315
augacuuuuuauuaguauucaaa

SEQ ID NO: 2156868 - RNA, 23 nt, Staphylococcus aureus subsp. aureus N315
augacggugaaaguucauuacaa

SEQ ID NO: 2156869 - RNA, 15 nt, Staphylococcus aureus subsp. aureus N315
augagaagcugucuu

SEQ ID NO: 2156870 - RNA, 14 nt, Staphylococcus aureus subsp. aureus N315
augagauuauucug

SEQ ID NO: 2156871 - RNA, 23 nt, Staphylococcus aureus subsp. aureus N315
augacauuuuaaaucuaauuauu

SEQ ID NO: 2156872 - RNA, 19 nt, Staphylococcus aureus subsp. aureus N315
augaccaauagcaauugaa

SEQ ID NO: 2156873 - RNA, 13 nt, Staphylococcus aureus subsp. aureus N315
augaccaauauuc

SEQ ID NO: 2156874 - RNA, 14 nt, Staphylococcus aureus subsp. aureus N315
augacacauacacc

SEQ ID NO: 2156875 - RNA, 19 nt, Staphylococcus aureus subsp. aureus N315
augaccaugauauauaaca

SEQ ID NO: 2156876 - RNA, 16 nt, Staphylococcus aureus subsp. aureus N315
augaccuaauauauua

SEQ ID NO: 2156877 - RNA, 20 nt, Staphylococcus aureus subsp. aureus N315
aucuucuaguaauucuucau

SEQ ID NO: 2156878 - RNA, 15 nt, Staphylococcus aureus subsp. aureus N315
aucuguuguuauaua

SEQ ID NO: 2156879 - RNA, 19 nt, Staphylococcus aureus subsp. aureus N315
aucuucuaguaauucuuca

SEQ ID NO: 2156880 - RNA, 23 nt, Staphylococcus aureus subsp. aureus N315
aucuguuacagguuuuaaaauua

SEQ ID NO: 2156881 - RNA, 16 nt, Staphylococcus aureus subsp. aureus N315
aucuugauuauauuuu

SEQ ID NO: 2156882 - RNA, 20 nt, Staphylococcus aureus subsp. aureus N315
aucuugauuuaaaccaucaa

SEQ ID NO: 2156883 - RNA, 16 nt, Staphylococcus aureus subsp. aureus N315
aucuugcuuggauaau

SEQ ID NO: 2156884 - RNA, 13 nt, Staphylococcus aureus subsp. aureus N315
aucuucuguuuau

SEQ ID NO: 2156885 - RNA, 16 nt, Staphylococcus aureus subsp. aureus N315
aucuucuguuuauaua

SEQ ID NO: 2156886 - RNA, 15 nt, Staphylococcus aureus subsp. aureus N315
aucuucuuguuuuaa

SEQ ID NO: 2156887 - RNA, 17 nt, Staphylococcus aureus subsp. aureus N315
aucuucuuguuuuaaau

SEQ ID NO: 2156888 - RNA, 21 nt, Staphylococcus aureus subsp. aureus N315
aucuucuuuuaauauuugaua

SEQ ID NO: 2156889 - RNA, 13 nt, Staphylococcus aureus subsp. aureus N315
aucuuuuugaaau

SEQ ID NO: 2156890 - RNA, 15 nt, Staphylococcus aureus subsp. aureus N315
aucuuuuugaaauuu

SEQ ID NO: 2156891 - RNA, 22 nt, Staphylococcus aureus subsp. aureus N315
aucuuuuucaaugugauuuucu

SEQ ID NO: 2156892 - RNA, 13 nt, Staphylococcus aureus subsp. aureus N315
aucuuuuguuguu

SEQ ID NO: 2156893 - RNA, 19 nt, Staphylococcus aureus subsp. aureus N315
aucuuuugcuguaucuuca

SEQ ID NO: 2156894 - RNA, 17 nt, Staphylococcus aureus subsp. aureus N315
aucuuuguaaauuuuua

SEQ ID NO: 2156895 - RNA, 19 nt, Staphylococcus aureus subsp. aureus N315
aucuuuguaaauuuuuaag

SEQ ID NO: 2156896 - RNA, 19 nt, Staphylococcus aureus subsp. aureus N315
aucuuuaguauuucaucau

SEQ ID NO: 2156897 - RNA, 23 nt, Staphylococcus aureus subsp. aureus N315
aucuuguucuucgucaaauucaa

SEQ ID NO: 2156898 - RNA, 17 nt, Staphylococcus aureus subsp. aureus N315
aucuuguucuaauuguu

SEQ ID NO: 2156899 - RNA, 23 nt, Staphylococcus aureus subsp. aureus N315
aucuugucuaguucgauuuuuua

SEQ ID NO: 2156900 - RNA, 22 nt, Staphylococcus aureus subsp. aureus N315
aucuuuaacuucugauucuuca

SEQ ID NO: 2156901 - RNA, 14 nt, Staphylococcus aureus subsp. aureus N315
aucuuuaaucaaag

SEQ ID NO: 2156902 - RNA, 21 nt, Staphylococcus aureus subsp. aureus N315
aucuuuagagacuuauuuuau

SEQ ID NO: 2156903 - RNA, 15 nt, Staphylococcus aureus subsp. aureus N315
aucuuuaauuucauu

SEQ ID NO: 2156904 - RNA, 20 nt, Staphylococcus aureus subsp. aureus N315
aucuuuacgauaaacuaaaa

SEQ ID NO: 2156905 - RNA, 18 nt, Staphylococcus aureus subsp. aureus N315
aucuuuacgauaaacuaa

SEQ ID NO: 2156906 - RNA, 17 nt, Staphylococcus aureus subsp. aureus N315
aucugauaccguuagua

SEQ ID NO: 2156907 - RNA, 16 nt, Staphylococcus aureus subsp. aureus N315
aucugcaaaaugcauu

SEQ ID NO: 2156908 - RNA, 13 nt, Staphylococcus aureus subsp. aureus N315
aucugauuucacu

SEQ ID NO: 2156909 - RNA, 17 nt, Staphylococcus aureus subsp. aureus N315
aucugcaacgauuuuaa

SEQ ID NO: 2156910 - RNA, 13 nt, Staphylococcus aureus subsp. aureus N315
aucugcauuuaau

SEQ ID NO: 2156911 - RNA, 23 nt, Staphylococcus aureus subsp. aureus N315
aucugcuuuauuuuaucaucuau

SEQ ID NO: 2156912 - RNA, 14 nt, Staphylococcus aureus subsp. aureus N315
aucugcuuuucuau

SEQ ID NO: 2156913 - RNA, 16 nt, Staphylococcus aureus subsp. aureus N315
aucuccauuagaacua

SEQ ID NO: 2156914 - RNA, 19 nt, Staphylococcus aureus subsp. aureus N315
aucuccgcuacaauuauau

SEQ ID NO: 2156915 - RNA, 20 nt, Staphylococcus aureus subsp. aureus N315
aucucaauccaauuaaauau

SEQ ID NO: 2156916 - RNA, 14 nt, Staphylococcus aureus subsp. aureus N315
aucucaacagcaaa

SEQ ID NO: 2156917 - RNA, 15 nt, Staphylococcus aureus subsp. aureus N315
aucucaacagcaaaa

SEQ ID NO: 2156918 - RNA, 12 nt, Staphylococcus aureus subsp. aureus N315
aucucaaaauuu

SEQ ID NO: 2156919 - RNA, 18 nt, Staphylococcus aureus subsp. aureus N315
aucuauuuaauaauguau

SEQ ID NO: 2156920 - RNA, 12 nt, Staphylococcus aureus subsp. aureus N315
aucuauuuuucg

SEQ ID NO: 2156921 - RNA, 23 nt, Staphylococcus aureus subsp. aureus N315
aucucgucacauauaaauauuuu

SEQ ID NO: 2156922 - RNA, 18 nt, Staphylococcus aureus subsp. aureus N315
aucucuauuuuuuauguu

SEQ ID NO: 2156923 - RNA, 22 nt, Staphylococcus aureus subsp. aureus N315
aucucuaccuugaucuaaaaua

SEQ ID NO: 2156924 - RNA, 16 nt, Staphylococcus aureus subsp. aureus N315
aucgugcccauaugau

SEQ ID NO: 2156925 - RNA, 17 nt, Staphylococcus aureus subsp. aureus N315
aucgugcccauaugauu

SEQ ID NO: 2156926 - RNA, 19 nt, Staphylococcus aureus subsp. aureus N315
aucguuauaaguacaaaua

SEQ ID NO: 2156927 - RNA, 21 nt, Staphylococcus aureus subsp. aureus N315
aucguuaauaaaccuacaaua

SEQ ID NO: 2156928 - RNA, 21 nt, Staphylococcus aureus subsp. aureus N315
aucguuaaaacacccugcuua

SEQ ID NO: 2156929 - RNA, 15 nt, Staphylococcus aureus subsp. aureus N315
aucuauucaacugau

SEQ ID NO: 2156930 - RNA, 21 nt, Staphylococcus aureus subsp. aureus N315
aucuauuauuauguuauaaau

SEQ ID NO: 2156931 - RNA, 21 nt, Staphylococcus aureus subsp. aureus N315
aucuacucaaauauaaauaaa

SEQ ID NO: 2156932 - RNA, 19 nt, Staphylococcus aureus subsp. aureus N315
aucuacaucaaauuuuucg

SEQ ID NO: 2156933 - RNA, 23 nt, Staphylococcus aureus subsp. aureus N315
aucuaaugcaacuugaucauuau

SEQ ID NO: 2156934 - RNA, 17 nt, Staphylococcus aureus subsp. aureus N315
aucuaaucuuaauuguc

SEQ ID NO: 2156935 - RNA, 12 nt, Staphylococcus aureus subsp. aureus N315
aucguuucuucc

SEQ ID NO: 2156936 - RNA, 14 nt, Staphylococcus aureus subsp. aureus N315
aucguugaaaaaua

SEQ ID NO: 2156937 - RNA, 20 nt, Staphylococcus aureus subsp. aureus N315
aucuaaaucuucaucaucgc

SEQ ID NO: 2156938 - RNA, 13 nt, Staphylococcus aureus subsp. aureus N315
aucuaacuggaaa

SEQ ID NO: 2156939 - RNA, 18 nt, Staphylococcus aureus subsp. aureus N315
aucuaacuggaaaugaua

SEQ ID NO: 2156940 - RNA, 15 nt, Staphylococcus aureus subsp. aureus N315
aucuaaacuauaaua

SEQ ID NO: 2156941 - RNA, 17 nt, Staphylococcus aureus subsp. aureus N315
aucuaaagcuauaaaaa

SEQ ID NO: 2156942 - RNA, 22 nt, Staphylococcus aureus subsp. aureus N315
aucgauuuuggcacauaaauca

SEQ ID NO: 2156943 - RNA, 17 nt, Staphylococcus aureus subsp. aureus N315
aucgcaccgucaaacuu

SEQ ID NO: 2156944 - RNA, 15 nt, Staphylococcus aureus subsp. aureus N315
aucgaaaauuucagg

SEQ ID NO: 2156945 - RNA, 21 nt, Staphylococcus aureus subsp. aureus N315
aucgagaggguacacuucaac

SEQ ID NO: 2156946 - RNA, 19 nt, Staphylococcus aureus subsp. aureus N315
aucgaugacuuugucuuua

SEQ ID NO: 2156947 - RNA, 23 nt, Staphylococcus aureus subsp. aureus N315
aucgaucgguauuuucauuuuag

SEQ ID NO: 2156948 - RNA, 22 nt, Staphylococcus aureus subsp. aureus N315
aucgauuuuaucgaaauauuua

SEQ ID NO: 2156949 - RNA, 20 nt, Staphylococcus aureus subsp. aureus N315
aucgauuaagaaugcaccaa

SEQ ID NO: 2156950 - RNA, 14 nt, Staphylococcus aureus subsp. aureus N315
aucgauuaguuuuu

SEQ ID NO: 2156951 - RNA, 14 nt, Staphylococcus aureus subsp. aureus N315
aucgcgauuauuac

SEQ ID NO: 2156952 - RNA, 16 nt, Staphylococcus aureus subsp. aureus N315
aucgccuaaaaauaaa

SEQ ID NO: 2156953 - RNA, 13 nt, Staphylococcus aureus subsp. aureus N315
aucgccuaaaaau

SEQ ID NO: 2156954 - RNA, 14 nt, Staphylococcus aureus subsp. aureus N315
aucgccuaaaaaua

SEQ ID NO: 2156955 - RNA, 15 nt, Staphylococcus aureus subsp. aureus N315
aucgccuaaaaauaa

SEQ ID NO: 2156956 - RNA, 13 nt, Staphylococcus aureus subsp. aureus N315
aucgcccauacca

SEQ ID NO: 2156957 - RNA, 17 nt, Staphylococcus aureus subsp. aureus N315
auccucauuaauaaauu

SEQ ID NO: 2156958 - RNA, 24 nt, Staphylococcus aureus subsp. aureus N315
auccucacaaauuugaauauacuu

SEQ ID NO: 2156959 - RNA, 20 nt, Staphylococcus aureus subsp. aureus N315
auccucacuaacucaauaug

SEQ ID NO: 2156960 - RNA, 23 nt, Staphylococcus aureus subsp. aureus N315
auccucgguauuuaauguuuuag

SEQ ID NO: 2156961 - RNA, 20 nt, Staphylococcus aureus subsp. aureus N315
auccuuaccuuuuaaaccug

SEQ ID NO: 2156962 - RNA, 16 nt, Staphylococcus aureus subsp. aureus N315
auccuuugcucaccuu

SEQ ID NO: 2156963 - RNA, 15 nt, Staphylococcus aureus subsp. aureus N315
auccuucaaaaguuu

SEQ ID NO: 2156964 - RNA, 23 nt, Staphylococcus aureus subsp. aureus N315
auccuacgacacguguaaaaaug

SEQ ID NO: 2156965 - RNA, 20 nt, Staphylococcus aureus subsp. aureus N315
auccuaaaaagcucaauccu

SEQ ID NO: 2156966 - RNA, 17 nt, Staphylococcus aureus subsp. aureus N315
auccuaaauuauaaaua

SEQ ID NO: 2156967 - RNA, 18 nt, Staphylococcus aureus subsp. aureus N315
aucccgaaaguuagacua

SEQ ID NO: 2156968 - RNA, 19 nt, Staphylococcus aureus subsp. aureus N315
auccccagccauuuguugu

SEQ ID NO: 2156969 - RNA, 13 nt, Staphylococcus aureus subsp. aureus N315
auccaucuaauuc

SEQ ID NO: 2156970 - RNA, 14 nt, Staphylococcus aureus subsp. aureus N315
auccaucuacaccc

SEQ ID NO: 2156971 - RNA, 17 nt, Staphylococcus aureus subsp. aureus N315
auccaguaaucaaagau

SEQ ID NO: 2156972 - RNA, 20 nt, Staphylococcus aureus subsp. aureus N315
auccaucaauaccauaauua

SEQ ID NO: 2156973 - RNA, 15 nt, Staphylococcus aureus subsp. aureus N315
auccacgguuuacca

SEQ ID NO: 2156974 - RNA, 15 nt, Staphylococcus aureus subsp. aureus N315
aucauugguuucauc

SEQ ID NO: 2156975 - RNA, 16 nt, Staphylococcus aureus subsp. aureus N315
auccaaauauuaaaaa

SEQ ID NO: 2156976 - RNA, 22 nt, Staphylococcus aureus subsp. aureus N315
aucauucuuuauagaaaccaaa

SEQ ID NO: 2156977 - RNA, 22 nt, Staphylococcus aureus subsp. aureus N315
aaaagaauuucgaaaagaaauu

SEQ ID NO: 2156978 - RNA, 19 nt, Staphylococcus aureus subsp. aureus N315
aaaagaaucauuuaaauca

SEQ ID NO: 2156979 - RNA, 20 nt, Staphylococcus aureus subsp. aureus N315
aucauguucuaaugcugcuu

SEQ ID NO: 2156980 - RNA, 23 nt, Staphylococcus aureus subsp. aureus N315
aucauguuccccauuaauuaaca

SEQ ID NO: 2156981 - RNA, 16 nt, Staphylococcus aureus subsp. aureus N315
aucauguucuuauaaa

SEQ ID NO: 2156982 - RNA, 16 nt, Staphylococcus aureus subsp. aureus N315
aaaagaaauuuaauac

SEQ ID NO: 2156983 - RNA, 19 nt, Staphylococcus aureus subsp. aureus N315
aaaagaaauuuaauacaau

SEQ ID NO: 2156984 - RNA, 18 nt, Staphylococcus aureus subsp. aureus N315
aaaacuguaaaucaucau

SEQ ID NO: 2156985 - RNA, 17 nt, Staphylococcus aureus subsp. aureus N315
aaaacuguaaaucauca

SEQ ID NO: 2156986 - RNA, 20 nt, Staphylococcus aureus subsp. aureus N315
aucaugcuuuuaauauuaua

SEQ ID NO: 2156987 - RNA, 14 nt, Staphylococcus aureus subsp. aureus N315
aucaugcuuuuaau

SEQ ID NO: 2156988 - RNA, 11 nt, Staphylococcus aureus subsp. aureus N315
aucaugcuuuu

SEQ ID NO: 2156989 - RNA, 19 nt, Staphylococcus aureus subsp. aureus N315
aucaugcuuaucuguaaau

SEQ ID NO: 2156990 - RNA, 20 nt, Staphylococcus aureus subsp. aureus N315
aucaugcuuaucuguaaaua

SEQ ID NO: 2156991 - RNA, 23 nt, Staphylococcus aureus subsp. aureus N315
aucauguaaugcuuaaaaacaau

SEQ ID NO: 2156992 - RNA, 23 nt, Staphylococcus aureus subsp. aureus N315
aucauguauauggcaucaucacc

SEQ ID NO: 2156993 - RNA, 19 nt, Staphylococcus aureus subsp. aureus N315
aucauguacaguuacuuuc

SEQ ID NO: 2156994 - RNA, 14 nt, Staphylococcus aureus subsp. aureus N315
aucaugacacaaag

SEQ ID NO: 2156995 - RNA, 24 nt, Staphylococcus aureus subsp. aureus N315
aucaugacuauuuuccaucacaua

SEQ ID NO: 2156996 - RNA, 17 nt, Staphylococcus aureus subsp. aureus N315
aucaugacacaaaggau

SEQ ID NO: 2156997 - RNA, 19 nt, Staphylococcus aureus subsp. aureus N315
aucaugacuauuucgcuuu

SEQ ID NO: 2156998 - RNA, 19 nt, Staphylococcus aureus subsp. aureus N315
aucaugacuauuuuccauc

SEQ ID NO: 2156999 - RNA, 17 nt, Staphylococcus aureus subsp. aureus N315
aucaugauagccgcuuc

SEQ ID NO: 2157000 - RNA, 19 nt, Staphylococcus aureus subsp. aureus N315
aucaucuucuggauaggua

SEQ ID NO: 2157001 - RNA, 19 nt, Staphylococcus aureus subsp. aureus N315
aucaucuuuaauuuucuug

SEQ ID NO: 2157002 - RNA, 20 nt, Staphylococcus aureus subsp. aureus N315
aucaucucugcuuuaauaua

SEQ ID NO: 2157003 - RNA, 11 nt, Staphylococcus aureus subsp. aureus N315
aucaucuauuc

SEQ ID NO: 2157004 - RNA, 14 nt, Staphylococcus aureus subsp. aureus N315
aucaucuauucaac

SEQ ID NO: 2157005 - RNA, 19 nt, Staphylococcus aureus subsp. aureus N315
aucauaauucccuguuaug

SEQ ID NO: 2157006 - RNA, 15 nt, Staphylococcus aureus subsp. aureus N315
aucauacgagaaauu

SEQ ID NO: 2157007 - RNA, 21 nt, Staphylococcus aureus subsp. aureus N315
aaaacgugcaaauaaaaaagu

SEQ ID NO: 2157008 - RNA, 13 nt, Staphylococcus aureus subsp. aureus N315
aucauaauauuga

SEQ ID NO: 2157009 - RNA, 22 nt, Staphylococcus aureus subsp. aureus N315
aucauaaugaauaauuaaaaaa

SEQ ID NO: 2157010 - RNA, 19 nt, Staphylococcus aureus subsp. aureus N315
aucauaauaagauuuuuua

SEQ ID NO: 2157011 - RNA, 16 nt, Staphylococcus aureus subsp. aureus N315
aaaacuauaauaaaga

SEQ ID NO: 2157012 - RNA, 12 nt, Staphylococcus aureus subsp. aureus N315
auaaauaaaaug

SEQ ID NO: 2157013 - RNA, 13 nt, Staphylococcus aureus subsp. aureus N315
auaaauaaaauuu

SEQ ID NO: 2157014 - RNA, 12 nt, Staphylococcus aureus subsp. aureus N315
auaaauaaacaa

SEQ ID NO: 2157015 - RNA, 15 nt, Staphylococcus aureus subsp. aureus N315
auaaauaaaaauaca

SEQ ID NO: 2157016 - RNA, 19 nt, Staphylococcus aureus subsp. aureus N315
auaaaguugacaauacaaa

SEQ ID NO: 2157017 - RNA, 23 nt, Staphylococcus aureus subsp. aureus N315
auaaaucacgccauaaucuucau

SEQ ID NO: 2157018 - RNA, 14 nt, Staphylococcus aureus subsp. aureus N315
auaaaucaaagagg

SEQ ID NO: 2157019 - RNA, 19 nt, Staphylococcus aureus subsp. aureus N315
auaaaucauacgagaaauu

SEQ ID NO: 2157020 - RNA, 22 nt, Staphylococcus aureus subsp. aureus N315
auaaaucauacgagaaauuaga

SEQ ID NO: 2157021 - RNA, 19 nt, Staphylococcus aureus subsp. aureus N315
auaaaugaauuauuuaaaa

SEQ ID NO: 2157022 - RNA, 13 nt, Staphylococcus aureus subsp. aureus N315
auaaaucuuuuuu

SEQ ID NO: 2157023 - RNA, 19 nt, Staphylococcus aureus subsp. aureus N315
auaaaugacauuuaauacu

SEQ ID NO: 2157024 - RNA, 13 nt, Staphylococcus aureus subsp. aureus N315
auaaauauuggaa

SEQ ID NO: 2157025 - RNA, 16 nt, Staphylococcus aureus subsp. aureus N315
auaaaucaagaaaugu

SEQ ID NO: 2157026 - RNA, 18 nt, Staphylococcus aureus subsp. aureus N315
auaaaucacgccauaauc

SEQ ID NO: 2157027 - RNA, 13 nt, Staphylococcus aureus subsp. aureus N315
auaaauauuuuuu

SEQ ID NO: 2157028 - RNA, 14 nt, Staphylococcus aureus subsp. aureus N315
auaaaucaaacuuu

SEQ ID NO: 2157029 - RNA, 15 nt, Staphylococcus aureus subsp. aureus N315
auaaauuaauaugaa

SEQ ID NO: 2157030 - RNA, 13 nt, Staphylococcus aureus subsp. aureus N315
auaaauugauauu

SEQ ID NO: 2157031 - RNA, 23 nt, Staphylococcus aureus subsp. aureus N315
auaaauugaguuuuuuaaaauaa

SEQ ID NO: 2157032 - RNA, 21 nt, Staphylococcus aureus subsp. aureus N315
auaaaugucacugcaaacaca

SEQ ID NO: 2157033 - RNA, 18 nt, Staphylococcus aureus subsp. aureus N315
auaaauguuauugcuuau

SEQ ID NO: 2157034 - RNA, 19 nt, Staphylococcus aureus subsp. aureus N315
auaaauguuauugcuuauu

SEQ ID NO: 2157035 - RNA, 19 nt, Staphylococcus aureus subsp. aureus N315
auaaauuaaaugcaauaca

SEQ ID NO: 2157036 - RNA, 18 nt, Staphylococcus aureus subsp. aureus N315
auaaaugacuucacauuu

SEQ ID NO: 2157037 - RNA, 19 nt, Staphylococcus aureus subsp. aureus N315
auaaaugcuauauuuagaa

SEQ ID NO: 2157038 - RNA, 20 nt, Staphylococcus aureus subsp. aureus N315
auaaaggcaacaaauauaau

SEQ ID NO: 2157039 - RNA, 17 nt, Staphylococcus aureus subsp. aureus N315
auaaagcuuugacauau

SEQ ID NO: 2157040 - RNA, 16 nt, Staphylococcus aureus subsp. aureus N315
auaaacuuuaugaaau

SEQ ID NO: 2157041 - RNA, 22 nt, Staphylococcus aureus subsp. aureus N315
auaaagaaugauuuauaaaaaa

SEQ ID NO: 2157042 - RNA, 13 nt, Staphylococcus aureus subsp. aureus N315
auaaagaaugauu

SEQ ID NO: 2157043 - RNA, 21 nt, Staphylococcus aureus subsp. aureus N315
auaaaaguuaggcgacuuaac

SEQ ID NO: 2157044 - RNA, 17 nt, Staphylococcus aureus subsp. aureus N315
auaaaaguguaauguuc

SEQ ID NO: 2157045 - RNA, 23 nt, Staphylococcus aureus subsp. aureus N315
auaaaaguuaccuacuacauucu

SEQ ID NO: 2157046 - RNA, 12 nt, Staphylococcus aureus subsp. aureus N315
auaaaauaaaau

SEQ ID NO: 2157047 - RNA, 12 nt, Staphylococcus aureus subsp. aureus N315
auaaacuacaca

SEQ ID NO: 2157048 - RNA, 22 nt, Staphylococcus aureus subsp. aureus N315
aguugguuuuauuaauucugau

SEQ ID NO: 2157049 - RNA, 19 nt, Staphylococcus aureus subsp. aureus N315
aguuuuggucaaguaaaug

SEQ ID NO: 2157050 - RNA, 21 nt, Staphylococcus aureus subsp. aureus N315
aguuuugauugcaaaaaaaca

SEQ ID NO: 2157051 - RNA, 23 nt, Staphylococcus aureus subsp. aureus N315
aguuuugauugcaaaaaaacaaa

SEQ ID NO: 2157052 - RNA, 18 nt, Staphylococcus aureus subsp. aureus N315
aguugguggaugucaugu

SEQ ID NO: 2157053 - RNA, 16 nt, Staphylococcus aureus subsp. aureus N315
aguuggcggggcccca

SEQ ID NO: 2157054 - RNA, 21 nt, Staphylococcus aureus subsp. aureus N315
aguuggcugauagaugaaaau

SEQ ID NO: 2157055 - RNA, 13 nt, Staphylococcus aureus subsp. aureus N315
auaaaaaaagaga

SEQ ID NO: 2157056 - RNA, 14 nt, Staphylococcus aureus subsp. aureus N315
auaaaaaaaucccu

SEQ ID NO: 2157057 - RNA, 14 nt, Staphylococcus aureus subsp. aureus N315
auaaaaaauaacuc

SEQ ID NO: 2157058 - RNA, 22 nt, Staphylococcus aureus subsp. aureus N315
aguuuuuuaaaauaaugauaua

SEQ ID NO: 2157059 - RNA, 13 nt, Staphylococcus aureus subsp. aureus N315
aguuuuuuaaaau

SEQ ID NO: 2157060 - RNA, 22 nt, Staphylococcus aureus subsp. aureus N315
aguuuuugguagcauuuuagau

SEQ ID NO: 2157061 - RNA, 20 nt, Staphylococcus aureus subsp. aureus N315
aguuuuucaggguuuaagau

SEQ ID NO: 2157062 - RNA, 16 nt, Staphylococcus aureus subsp. aureus N315
aguuuuuaaaauuauc

SEQ ID NO: 2157063 - RNA, 16 nt, Staphylococcus aureus subsp. aureus N315
auaaaaauacauaauu

SEQ ID NO: 2157064 - RNA, 18 nt, Staphylococcus aureus subsp. aureus N315
auaaaaaggagcgacaau

SEQ ID NO: 2157065 - RNA, 18 nt, Staphylococcus aureus subsp. aureus N315
auaaaaagaucauuaaaa

SEQ ID NO: 2157066 - RNA, 19 nt, Staphylococcus aureus subsp. aureus N315
auaaaaacagcagugaagu

SEQ ID NO: 2157067 - RNA, 14 nt, Staphylococcus aureus subsp. aureus N315
auaaaaaaugaaug

SEQ ID NO: 2157068 - RNA, 13 nt, Staphylococcus aureus subsp. aureus N315
auaaaacagaauu

SEQ ID NO: 2157069 - RNA, 13 nt, Staphylococcus aureus subsp. aureus N315
auaaaaaucuuau

SEQ ID NO: 2157070 - RNA, 17 nt, Staphylococcus aureus subsp. aureus N315
auaaaaauuauauaaau

SEQ ID NO: 2157071 - RNA, 17 nt, Staphylococcus aureus subsp. aureus N315
auaaaaauuuauucaaa

SEQ ID NO: 2157072 - RNA, 13 nt, Staphylococcus aureus subsp. aureus N315
auaaaaauuuauu

SEQ ID NO: 2157073 - RNA, 23 nt, Staphylococcus aureus subsp. aureus N315
auaaaacuuacauuacauauauc

SEQ ID NO: 2157074 - RNA, 19 nt, Staphylococcus aureus subsp. aureus N315
auaaaacuuauaacugaua

SEQ ID NO: 2157075 - RNA, 22 nt, Staphylococcus aureus subsp. aureus N315
auaaaacuauguguauaugugg

SEQ ID NO: 2157076 - RNA, 20 nt, Staphylococcus aureus subsp. aureus N315
auaaaacgacucauuauaaa

SEQ ID NO: 2157077 - RNA, 16 nt, Staphylococcus aureus subsp. aureus N315
auaaaacuauguguau

SEQ ID NO: 2157078 - RNA, 20 nt, Staphylococcus aureus subsp. aureus N315
auaaaacuaaugauaguaca

SEQ ID NO: 2157079 - RNA, 19 nt, Staphylococcus aureus subsp. aureus N315
auaaaagucgauaaauaug

SEQ ID NO: 2157080 - RNA, 20 nt, Staphylococcus aureus subsp. aureus N315
auaaaagucgauaaauauga

SEQ ID NO: 2157081 - RNA, 22 nt, Staphylococcus aureus subsp. aureus N315
auaaaagucgauaaauaugaug

SEQ ID NO: 2157082 - RNA, 20 nt, Staphylococcus aureus subsp. aureus N315
auaaaaggggaaaucauuug

SEQ ID NO: 2157083 - RNA, 17 nt, Staphylococcus aureus subsp. aureus N315
auaaaagcccaccuaaa

SEQ ID NO: 2157084 - RNA, 18 nt, Staphylococcus aureus subsp. aureus N315
auaaaagccucuaaugau

SEQ ID NO: 2157085 - RNA, 18 nt, Staphylococcus aureus subsp. aureus N315
auaaucccaaccauucua

SEQ ID NO: 2157086 - RNA, 22 nt, Staphylococcus aureus subsp. aureus N315
auaaucaagucugcauuaauuu

SEQ ID NO: 2157087 - RNA, 15 nt, Staphylococcus aureus subsp. aureus N315
auaauauuggacuuu

SEQ ID NO: 2157088 - RNA, 19 nt, Staphylococcus aureus subsp. aureus N315
auaauauugaugaauaaau

SEQ ID NO: 2157089 - RNA, 17 nt, Staphylococcus aureus subsp. aureus N315
auaauacuguuuaaaua

SEQ ID NO: 2157090 - RNA, 16 nt, Staphylococcus aureus subsp. aureus N315
auaauacuguauuuua

SEQ ID NO: 2157091 - RNA, 13 nt, Staphylococcus aureus subsp. aureus N315
auaauagaaauaa

SEQ ID NO: 2157092 - RNA, 16 nt, Staphylococcus aureus subsp. aureus N315
auaauacguuuugcua

SEQ ID NO: 2157093 - RNA, 19 nt, Staphylococcus aureus subsp. aureus N315
auaauacuacauauaaugc

SEQ ID NO: 2157094 - RNA, 13 nt, Staphylococcus aureus subsp. aureus N315
auaauauauuuag

SEQ ID NO: 2157095 - RNA, 22 nt, Staphylococcus aureus subsp. aureus N315
auaauaucaccuuuuuuaagau

SEQ ID NO: 2157096 - RNA, 15 nt, Staphylococcus aureus subsp. aureus N315
auaauagcaaaauua

SEQ ID NO: 2157097 - RNA, 16 nt, Staphylococcus aureus subsp. aureus N315
auaaguaauaauauaa

SEQ ID NO: 2157098 - RNA, 13 nt, Staphylococcus aureus subsp. aureus N315
auaaguaguucag

SEQ ID NO: 2157099 - RNA, 15 nt, Staphylococcus aureus subsp. aureus N315
auaaguacaaauaau

SEQ ID NO: 2157100 - RNA, 18 nt, Staphylococcus aureus subsp. aureus N315
auaaguacaaauaauaca

SEQ ID NO: 2157101 - RNA, 20 nt, Staphylococcus aureus subsp. aureus N315
auaaguacaaauaauacagg

SEQ ID NO: 2157102 - RNA, 17 nt, Staphylococcus aureus subsp. aureus N315
auaaguaauaauuuauu

SEQ ID NO: 2157103 - RNA, 13 nt, Staphylococcus aureus subsp. aureus N315
auaaguaaauaau

SEQ ID NO: 2157104 - RNA, 15 nt, Staphylococcus aureus subsp. aureus N315
auaauuagauuuaaa

SEQ ID NO: 2157105 - RNA, 16 nt, Staphylococcus aureus subsp. aureus N315
auaauuagauuuaaaa

SEQ ID NO: 2157106 - RNA, 17 nt, Staphylococcus aureus subsp. aureus N315
auaauuauuaaacuuug

SEQ ID NO: 2157107 - RNA, 13 nt, Staphylococcus aureus subsp. aureus N315
auaauuaugaaaa

SEQ ID NO: 2157108 - RNA, 16 nt, Staphylococcus aureus subsp. aureus N315
auaauuaugaaaagua

SEQ ID NO: 2157109 - RNA, 23 nt, Staphylococcus aureus subsp. aureus N315
auaauuaacuuacuuuuguaaaa

SEQ ID NO: 2157110 - RNA, 13 nt, Staphylococcus aureus subsp. aureus N315
auaauuaauaaca

SEQ ID NO: 2157111 - RNA, 14 nt, Staphylococcus aureus subsp. aureus N315
auaauuaauaacau

SEQ ID NO: 2157112 - RNA, 23 nt, Staphylococcus aureus subsp. aureus N315
auaauuaccuuuccauucguaua

SEQ ID NO: 2157113 - RNA, 19 nt, Staphylococcus aureus subsp. aureus N315
auaauuaauuuuguaauua

SEQ ID NO: 2157114 - RNA, 18 nt, Staphylococcus aureus subsp. aureus N315
auaauuaauuaaaauucu

SEQ ID NO: 2157115 - RNA, 18 nt, Staphylococcus aureus subsp. aureus N315
auaauuaaacuaauagca

SEQ ID NO: 2157116 - RNA, 12 nt, Staphylococcus aureus subsp. aureus N315
auaauuaaauaa

SEQ ID NO: 2157117 - RNA, 14 nt, Staphylococcus aureus subsp. aureus N315
auaauuaaauaacu

SEQ ID NO: 2157118 - RNA, 16 nt, Staphylococcus aureus subsp. aureus N315
auaauuaaauauaaag

SEQ ID NO: 2157119 - RNA, 14 nt, Staphylococcus aureus subsp. aureus N315
auaauguuuccauu

SEQ ID NO: 2157120 - RNA, 20 nt, Staphylococcus aureus subsp. aureus N315
auaauguuuccugauauuuc

SEQ ID NO: 2157121 - RNA, 12 nt, Staphylococcus aureus subsp. aureus N315
auaauuaaacua

SEQ ID NO: 2157122 - RNA, 14 nt, Staphylococcus aureus subsp. aureus N315
auaaucguuuuuac

SEQ ID NO: 2157123 - RNA, 21 nt, Staphylococcus aureus subsp. aureus N315
auaaucguuuuuacuguaauc

SEQ ID NO: 2157124 - RNA, 23 nt, Staphylococcus aureus subsp. aureus N315
auaaucguuuuuacuguaaucaa

SEQ ID NO: 2157125 - RNA, 19 nt, Staphylococcus aureus subsp. aureus N315
auaaucguauucauaucau

SEQ ID NO: 2157126 - RNA, 19 nt, Staphylococcus aureus subsp. aureus N315
auaaugcuacuauuaaaua

SEQ ID NO: 2157127 - RNA, 15 nt, Staphylococcus aureus subsp. aureus N315
auaaugcuauauuuc

SEQ ID NO: 2157128 - RNA, 16 nt, Staphylococcus aureus subsp. aureus N315
auaaugucuuacuugu

SEQ ID NO: 2157129 - RNA, 22 nt, Staphylococcus aureus subsp. aureus N315
auaaugucuuacuuuuaaauua

SEQ ID NO: 2157130 - RNA, 20 nt, Staphylococcus aureus subsp. aureus N315
auaaugucuuacuuuuaaau

SEQ ID NO: 2157131 - RNA, 21 nt, Staphylococcus aureus subsp. aureus N315
auaagggguauauuaaaaauu

SEQ ID NO: 2157132 - RNA, 19 nt, Staphylococcus aureus subsp. aureus N315
auaaggcaauuuuccgugu

SEQ ID NO: 2157133 - RNA, 21 nt, Staphylococcus aureus subsp. aureus N315
auaagcuuguaacaagcauuu

SEQ ID NO: 2157134 - RNA, 14 nt, Staphylococcus aureus subsp. aureus N315
auaaggacucuguu

SEQ ID NO: 2157135 - RNA, 17 nt, Staphylococcus aureus subsp. aureus N315
auaaggaagcguaugau

SEQ ID NO: 2157136 - RNA, 14 nt, Staphylococcus aureus subsp. aureus N315
auaaggaaaaggau

SEQ ID NO: 2157137 - RNA, 23 nt, Staphylococcus aureus subsp. aureus N315
auaagcuuuuucuuucucuaaca

SEQ ID NO: 2157138 - RNA, 19 nt, Staphylococcus aureus subsp. aureus N315
auaagauuuugaauuuuau

SEQ ID NO: 2157139 - RNA, 18 nt, Staphylococcus aureus subsp. aureus N315
auaagcaaucauaauacu

SEQ ID NO: 2157140 - RNA, 16 nt, Staphylococcus aureus subsp. aureus N315
auaagccuuuucaaac

SEQ ID NO: 2157141 - RNA, 18 nt, Staphylococcus aureus subsp. aureus N315
auaagcacgauaaaaaua

SEQ ID NO: 2157142 - RNA, 22 nt, Staphylococcus aureus subsp. aureus N315
auaacuaagugaauuaucuaua

SEQ ID NO: 2157143 - RNA, 19 nt, Staphylococcus aureus subsp. aureus N315
auaacgagcaguauauauc

SEQ ID NO: 2157144 - RNA, 21 nt, Staphylococcus aureus subsp. aureus N315
auaaauuucaagguauacaca

SEQ ID NO: 2157145 - RNA, 22 nt, Staphylococcus aureus subsp. aureus N315
auaaauuuaacguuauucauuu

SEQ ID NO: 2157146 - RNA, 19 nt, Staphylococcus aureus subsp. aureus N315
auaaccuuuaaaacaucau

SEQ ID NO: 2157147 - RNA, 22 nt, Staphylococcus aureus subsp. aureus N315
auaaccuuuaaaacaucauuca

SEQ ID NO: 2157148 - RNA, 23 nt, Staphylococcus aureus subsp. aureus N315
auaaauuuguaccaaauaaauua

SEQ ID NO: 2157149 - RNA, 15 nt, Staphylococcus aureus subsp. aureus N315
auaacucaaauaucu

SEQ ID NO: 2157150 - RNA, 17 nt, Staphylococcus aureus subsp. aureus N315
auaacuccuccaaagcu

SEQ ID NO: 2157151 - RNA, 21 nt, Staphylococcus aureus subsp. aureus N315
auaacuuuauauauaaagaaa

SEQ ID NO: 2157152 - RNA, 13 nt, Staphylococcus aureus subsp. aureus N315
auaagaggagaaa

SEQ ID NO: 2157153 - RNA, 16 nt, Staphylococcus aureus subsp. aureus N315
auaagaggagaaagcu

SEQ ID NO: 2157154 - RNA, 19 nt, Staphylococcus aureus subsp. aureus N315
auaagacuucccuauaugu

SEQ ID NO: 2157155 - RNA, 22 nt, Staphylococcus aureus subsp. aureus N315
auaagagaacuuuucaaacaau

SEQ ID NO: 2157156 - RNA, 19 nt, Staphylococcus aureus subsp. aureus N315
aguucaucuggugcaauau

SEQ ID NO: 2157157 - RNA, 23 nt, Staphylococcus aureus subsp. aureus N315
aguuccucgguauucaauucugu

SEQ ID NO: 2157158 - RNA, 20 nt, Staphylococcus aureus subsp. aureus N315
aguuccguugaauuaacaau

SEQ ID NO: 2157159 - RNA, 23 nt, Staphylococcus aureus subsp. aureus N315
aguucaaauggacuaacgucauu

SEQ ID NO: 2157160 - RNA, 15 nt, Staphylococcus aureus subsp. aureus N315
aguucacaacaaagu

SEQ ID NO: 2157161 - RNA, 14 nt, Staphylococcus aureus subsp. aureus N315
aguuauaugugcuu

SEQ ID NO: 2157162 - RNA, 14 nt, Staphylococcus aureus subsp. aureus N315
aguuauagaaacuu

SEQ ID NO: 2157163 - RNA, 16 nt, Staphylococcus aureus subsp. aureus N315
aguucgaacacacacu

SEQ ID NO: 2157164 - RNA, 23 nt, Staphylococcus aureus subsp. aureus N315
aguucgacacgcccgacaucaua

SEQ ID NO: 2157165 - RNA, 21 nt, Staphylococcus aureus subsp. aureus N315
aguugaaaauaaucgaacaga

SEQ ID NO: 2157166 - RNA, 23 nt, Staphylococcus aureus subsp. aureus N315
aguugaaaauaaucgaacagaaa

SEQ ID NO: 2157167 - RNA, 16 nt, Staphylococcus aureus subsp. aureus N315
aguugaauauaaaaaa

SEQ ID NO: 2157168 - RNA, 17 nt, Staphylococcus aureus subsp. aureus N315
aguugagucaauuucuu

SEQ ID NO: 2157169 - RNA, 15 nt, Staphylococcus aureus subsp. aureus N315
aguugacaauacaaa

SEQ ID NO: 2157170 - RNA, 14 nt, Staphylococcus aureus subsp. aureus N315
aguugacaauacaa

SEQ ID NO: 2157171 - RNA, 20 nt, Staphylococcus aureus subsp. aureus N315
aguuaacggcguauucaauu

SEQ ID NO: 2157172 - RNA, 18 nt, Staphylococcus aureus subsp. aureus N315
aguuaaauaucauaccgu

SEQ ID NO: 2157173 - RNA, 14 nt, Staphylococcus aureus subsp. aureus N315
aguuaaaucuguau

SEQ ID NO: 2157174 - RNA, 14 nt, Staphylococcus aureus subsp. aureus N315
aguuaaauaguaag

SEQ ID NO: 2157175 - RNA, 18 nt, Staphylococcus aureus subsp. aureus N315
aguuaaagucauaggcuu

SEQ ID NO: 2157176 - RNA, 23 nt, Staphylococcus aureus subsp. aureus N315
aguuaaaguuccaaguuaaugca

SEQ ID NO: 2157177 - RNA, 19 nt, Staphylococcus aureus subsp. aureus N315
aguguugaggcguuucaga

SEQ ID NO: 2157178 - RNA, 11 nt, Staphylococcus aureus subsp. aureus N315
aguuaaaaccu

SEQ ID NO: 2157179 - RNA, 20 nt, Staphylococcus aureus subsp. aureus N315
aguuaaaaccuuuucaaauu

SEQ ID NO: 2157180 - RNA, 18 nt, Staphylococcus aureus subsp. aureus N315
aguuaaaaccuuuucaaa

SEQ ID NO: 2157181 - RNA, 16 nt, Staphylococcus aureus subsp. aureus N315
aguuaaaaauguaaau

SEQ ID NO: 2157182 - RNA, 22 nt, Staphylococcus aureus subsp. aureus N315
aguguucucauuauaaugauuu

SEQ ID NO: 2157183 - RNA, 22 nt, Staphylococcus aureus subsp. aureus N315
aguguaauguuccccugaaaag

SEQ ID NO: 2157184 - RNA, 19 nt, Staphylococcus aureus subsp. aureus N315
aguguagccaaauaaauuu

SEQ ID NO: 2157185 - RNA, 17 nt, Staphylococcus aureus subsp. aureus N315
aguguagccaaauaaau

SEQ ID NO: 2157186 - RNA, 16 nt, Staphylococcus aureus subsp. aureus N315
aguguagcacaagauu

SEQ ID NO: 2157187 - RNA, 15 nt, Staphylococcus aureus subsp. aureus N315
aguguaguaaaaauc

SEQ ID NO: 2157188 - RNA, 18 nt, Staphylococcus aureus subsp. aureus N315
agugguuuucuuuauuuu

SEQ ID NO: 2157189 - RNA, 14 nt, Staphylococcus aureus subsp. aureus N315
aguggaaauuaugu

SEQ ID NO: 2157190 - RNA, 18 nt, Staphylococcus aureus subsp. aureus N315
aguggaucacgauaaugu

SEQ ID NO: 2157191 - RNA, 15 nt, Staphylococcus aureus subsp. aureus N315
agugauaauuaaaau

SEQ ID NO: 2157192 - RNA, 13 nt, Staphylococcus aureus subsp. aureus N315
agugauaauuaaa

SEQ ID NO: 2157193 - RNA, 19 nt, Staphylococcus aureus subsp. aureus N315
agugcuugauuaacauuuu

SEQ ID NO: 2157194 - RNA, 13 nt, Staphylococcus aureus subsp. aureus N315
agugcuaagaggu

SEQ ID NO: 2157195 - RNA, 16 nt, Staphylococcus aureus subsp. aureus N315
agugauaaauaaugca

SEQ ID NO: 2157196 - RNA, 20 nt, Staphylococcus aureus subsp. aureus N315
agugaguuuuauuuauaaac

SEQ ID NO: 2157197 - RNA, 16 nt, Staphylococcus aureus subsp. aureus N315
agugagcguauuauua

SEQ ID NO: 2157198 - RNA, 14 nt, Staphylococcus aureus subsp. aureus N315
agucccgcuuaaaa

SEQ ID NO: 2157199 - RNA, 19 nt, Staphylococcus aureus subsp. aureus N315
agucgcaauggcaauugau

SEQ ID NO: 2157200 - RNA, 14 nt, Staphylococcus aureus subsp. aureus N315
agucgaacaaugau

SEQ ID NO: 2157201 - RNA, 18 nt, Staphylococcus aureus subsp. aureus N315
aguccuucuuugaaauca

SEQ ID NO: 2157202 - RNA, 21 nt, Staphylococcus aureus subsp. aureus N315
aguccuucuuugaaaucaaug

SEQ ID NO: 2157203 - RNA, 13 nt, Staphylococcus aureus subsp. aureus N315
agucuaugaauaa

SEQ ID NO: 2157204 - RNA, 12 nt, Staphylococcus aureus subsp. aureus N315
agucuaugaaua

SEQ ID NO: 2157205 - RNA, 19 nt, Staphylococcus aureus subsp. aureus N315
agucguucucuuaaauaug

SEQ ID NO: 2157206 - RNA, 18 nt, Staphylococcus aureus subsp. aureus N315
agucguucucuuaaauau

SEQ ID NO: 2157207 - RNA, 19 nt, Staphylococcus aureus subsp. aureus N315
agugaaagucguuguugaa

SEQ ID NO: 2157208 - RNA, 19 nt, Staphylococcus aureus subsp. aureus N315
agugaacuauuaaaaccaa

SEQ ID NO: 2157209 - RNA, 16 nt, Staphylococcus aureus subsp. aureus N315
agucuuaaacauaaca

SEQ ID NO: 2157210 - RNA, 21 nt, Staphylococcus aureus subsp. aureus N315
agucuguauauggcgauaaca

SEQ ID NO: 2157211 - RNA, 22 nt, Staphylococcus aureus subsp. aureus N315
agucuuggacauuguaaaaugc

SEQ ID NO: 2157212 - RNA, 23 nt, Staphylococcus aureus subsp. aureus N315
agucuucuuacugcaauuauuuu

SEQ ID NO: 2157213 - RNA, 12 nt, Staphylococcus aureus subsp. aureus N315
agucuucuucaa

SEQ ID NO: 2157214 - RNA, 16 nt, Staphylococcus aureus subsp. aureus N315
agucuucuuacugcaa

SEQ ID NO: 2157215 - RNA, 21 nt, Staphylococcus aureus subsp. aureus N315
agucauaaauugauuucuaau

SEQ ID NO: 2157216 - RNA, 15 nt, Staphylococcus aureus subsp. aureus N315
agucauaauuuaaaa

SEQ ID NO: 2157217 - RNA, 22 nt, Staphylococcus aureus subsp. aureus N315
agucaggggccccaacacagag

SEQ ID NO: 2157218 - RNA, 20 nt, Staphylococcus aureus subsp. aureus N315
agucaggggccccaacacag

SEQ ID NO: 2157219 - RNA, 16 nt, Staphylococcus aureus subsp. aureus N315
agucaggggccccaac

SEQ ID NO: 2157220 - RNA, 19 nt, Staphylococcus aureus subsp. aureus N315
agucaucaaccucauuuga

SEQ ID NO: 2157221 - RNA, 22 nt, Staphylococcus aureus subsp. aureus N315
agucaucuugagauuuucaaca

SEQ ID NO: 2157222 - RNA, 17 nt, Staphylococcus aureus subsp. aureus N315
agucauuguauaaaaag

SEQ ID NO: 2157223 - RNA, 16 nt, Staphylococcus aureus subsp. aureus N315
aguccauuuucuuuuu

SEQ ID NO: 2157224 - RNA, 17 nt, Staphylococcus aureus subsp. aureus N315
aguacuuuuacaaacuu

SEQ ID NO: 2157225 - RNA, 23 nt, Staphylococcus aureus subsp. aureus N315
aguacuuggaaaauacuauacug

SEQ ID NO: 2157226 - RNA, 23 nt, Staphylococcus aureus subsp. aureus N315
aguacuuuaaaauuguauagaau

SEQ ID NO: 2157227 - RNA, 21 nt, Staphylococcus aureus subsp. aureus N315
aguacuuucgaguaauacuuu

SEQ ID NO: 2157228 - RNA, 16 nt, Staphylococcus aureus subsp. aureus N315
agucaauguauauuua

SEQ ID NO: 2157229 - RNA, 19 nt, Staphylococcus aureus subsp. aureus N315
agucaauguauauuuaaca

SEQ ID NO: 2157230 - RNA, 22 nt, Staphylococcus aureus subsp. aureus N315
agucaauucgacuccaaccuuu

SEQ ID NO: 2157231 - RNA, 13 nt, Staphylococcus aureus subsp. aureus N315
agucaaucaaguu

SEQ ID NO: 2157232 - RNA, 18 nt, Staphylococcus aureus subsp. aureus N315
aguagaauuauuuagaaa

SEQ ID NO: 2157233 - RNA, 16 nt, Staphylococcus aureus subsp. aureus N315
aguagacauugaaagg

SEQ ID NO: 2157234 - RNA, 15 nt, Staphylococcus aureus subsp. aureus N315
agucaauuuuuucau

SEQ ID NO: 2157235 - RNA, 17 nt, Staphylococcus aureus subsp. aureus N315
agucaccauauuuaaca

SEQ ID NO: 2157236 - RNA, 13 nt, Staphylococcus aureus subsp. aureus N315
agucagaaagaau

SEQ ID NO: 2157237 - RNA, 16 nt, Staphylococcus aureus subsp. aureus N315
agguaaauuuaaaaua

SEQ ID NO: 2157238 - RNA, 19 nt, Staphylococcus aureus subsp. aureus N315
agguaaauuuaaaauaaua

SEQ ID NO: 2157239 - RNA, 19 nt, Staphylococcus aureus subsp. aureus N315
agguaaaucuguuuaaauu

SEQ ID NO: 2157240 - RNA, 23 nt, Staphylococcus aureus subsp. aureus N315
agguaaaucuguuuaaauuuaaa

SEQ ID NO: 2157241 - RNA, 19 nt, Staphylococcus aureus subsp. aureus N315
aggucaaaaaauuaaucaa

SEQ ID NO: 2157242 - RNA, 14 nt, Staphylococcus aureus subsp. aureus N315
aggugacuuuccua

SEQ ID NO: 2157243 - RNA, 20 nt, Staphylococcus aureus subsp. aureus N315
aggugacuuuccuaauucuu

SEQ ID NO: 2157244 - RNA, 23 nt, Staphylococcus aureus subsp. aureus N315
agguuaaccucuaagguuaaauu

SEQ ID NO: 2157245 - RNA, 14 nt, Staphylococcus aureus subsp. aureus N315
agguuauauuuaaa

SEQ ID NO: 2157246 - RNA, 16 nt, Staphylococcus aureus subsp. aureus N315
agguuauauuuaaaug

SEQ ID NO: 2157247 - RNA, 18 nt, Staphylococcus aureus subsp. aureus N315
aguacggcugcuuuaacu

SEQ ID NO: 2157248 - RNA, 22 nt, Staphylococcus aureus subsp. aureus N315
aguacggcugcuuuaacuguac

SEQ ID NO: 2157249 - RNA, 16 nt, Staphylococcus aureus subsp. aureus N315
aguacgguuauuuaau

SEQ ID NO: 2157250 - RNA, 21 nt, Staphylococcus aureus subsp. aureus N315
aguacuaaaccgauuaauaua

SEQ ID NO: 2157251 - RNA, 15 nt, Staphylococcus aureus subsp. aureus N315
aguacgaacaacuaa

SEQ ID NO: 2157252 - RNA, 19 nt, Staphylococcus aureus subsp. aureus N315
aguaccuaaaauagaaaaa

SEQ ID NO: 2157253 - RNA, 23 nt, Staphylococcus aureus subsp. aureus N315
aguaccucuuuauuuuaucucuu

SEQ ID NO: 2157254 - RNA, 13 nt, Staphylococcus aureus subsp. aureus N315
aguaccuaaaaua

SEQ ID NO: 2157255 - RNA, 14 nt, Staphylococcus aureus subsp. aureus N315
aguaauuaauuccu

SEQ ID NO: 2157256 - RNA, 16 nt, Staphylococcus aureus subsp. aureus N315
aguaauuaaauacuug

SEQ ID NO: 2157257 - RNA, 12 nt, Staphylococcus aureus subsp. aureus N315
aguacaaauaau

SEQ ID NO: 2157258 - RNA, 13 nt, Staphylococcus aureus subsp. aureus N315
aguacaaauaaua

SEQ ID NO: 2157259 - RNA, 17 nt, Staphylococcus aureus subsp. aureus N315
aguacaguuaguggcau

SEQ ID NO: 2157260 - RNA, 16 nt, Staphylococcus aureus subsp. aureus N315
aguacagcgguuugua

SEQ ID NO: 2157261 - RNA, 14 nt, Staphylococcus aureus subsp. aureus N315
aguaaugaagcuuc

SEQ ID NO: 2157262 - RNA, 22 nt, Staphylococcus aureus subsp. aureus N315
aguaaucuuguuuucauuuaaa

SEQ ID NO: 2157263 - RNA, 14 nt, Staphylococcus aureus subsp. aureus N315
aguaaugauuaacu

SEQ ID NO: 2157264 - RNA, 11 nt, Staphylococcus aureus subsp. aureus N315
aguaaaucaaa

SEQ ID NO: 2157265 - RNA, 12 nt, Staphylococcus aureus subsp. aureus N315
aguaaauguuuu

SEQ ID NO: 2157266 - RNA, 15 nt, Staphylococcus aureus subsp. aureus N315
aguaacucaagugau

SEQ ID NO: 2157267 - RNA, 16 nt, Staphylococcus aureus subsp. aureus N315
aguaacucaacauuuu

SEQ ID NO: 2157268 - RNA, 16 nt, Staphylococcus aureus subsp. aureus N315
aguaagacgauuucaa

SEQ ID NO: 2157269 - RNA, 20 nt, Staphylococcus aureus subsp. aureus N315
aguaagacgauuucaaugag

SEQ ID NO: 2157270 - RNA, 19 nt, Staphylococcus aureus subsp. aureus N315
aguaagauaauuuucaauu

SEQ ID NO: 2157271 - RNA, 17 nt, Staphylococcus aureus subsp. aureus N315
aguaagauuauuuucaa

SEQ ID NO: 2157272 - RNA, 18 nt, Staphylococcus aureus subsp. aureus N315
aguaagauauuuccaaau

SEQ ID NO: 2157273 - RNA, 16 nt, Staphylococcus aureus subsp. aureus N315
aguaaagugaaauaaa

SEQ ID NO: 2157274 - RNA, 18 nt, Staphylococcus aureus subsp. aureus N315
agguuuguaagacaacaa

SEQ ID NO: 2157275 - RNA, 15 nt, Staphylococcus aureus subsp. aureus N315
agguucuucaucuuu

SEQ ID NO: 2157276 - RNA, 14 nt, Staphylococcus aureus subsp. aureus N315
agguugaagaagga

SEQ ID NO: 2157277 - RNA, 16 nt, Staphylococcus aureus subsp. aureus N315
agguucaucuuuaugc

SEQ ID NO: 2157278 - RNA, 18 nt, Staphylococcus aureus subsp. aureus N315
agguucaucuuuaugcaa

SEQ ID NO: 2157279 - RNA, 17 nt, Staphylococcus aureus subsp. aureus N315
aggcuuaaauauaauga

SEQ ID NO: 2157280 - RNA, 19 nt, Staphylococcus aureus subsp. aureus N315
aggcuuaaauauaaugauc

SEQ ID NO: 2157281 - RNA, 15 nt, Staphylococcus aureus subsp. aureus N315
aggcuuauuaacuuu

SEQ ID NO: 2157282 - RNA, 14 nt, Staphylococcus aureus subsp. aureus N315
aggggcuuuuaugc

SEQ ID NO: 2157283 - RNA, 15 nt, Staphylococcus aureus subsp. aureus N315
aggggcuuuuaugca

SEQ ID NO: 2157284 - RNA, 16 nt, Staphylococcus aureus subsp. aureus N315
aggggcuuuuaugcau

SEQ ID NO: 2157285 - RNA, 21 nt, Staphylococcus aureus subsp. aureus N315
aggggcuucuuucuaaaauaa

SEQ ID NO: 2157286 - RNA, 23 nt, Staphylococcus aureus subsp. aureus N315
aggggacuuaaccauuuaaaaau

SEQ ID NO: 2157287 - RNA, 14 nt, Staphylococcus aureus subsp. aureus N315
aggcgucuuaaauu

SEQ ID NO: 2157288 - RNA, 14 nt, Staphylococcus aureus subsp. aureus N315
aggcugggacauaa

SEQ ID NO: 2157289 - RNA, 23 nt, Staphylococcus aureus subsp. aureus N315
aggcugaguauaccaauugcuga

SEQ ID NO: 2157290 - RNA, 14 nt, Staphylococcus aureus subsp. aureus N315
aggauguucaucaa

SEQ ID NO: 2157291 - RNA, 20 nt, Staphylococcus aureus subsp. aureus N315
aggauguucaucaacaugau

SEQ ID NO: 2157292 - RNA, 15 nt, Staphylococcus aureus subsp. aureus N315
aggauguuauaaaau

SEQ ID NO: 2157293 - RNA, 18 nt, Staphylococcus aureus subsp. aureus N315
aggauguuauaaaaugaa

SEQ ID NO: 2157294 - RNA, 19 nt, Staphylococcus aureus subsp. aureus N315
aggauggaaugauacgccu

SEQ ID NO: 2157295 - RNA, 23 nt, Staphylococcus aureus subsp. aureus N315
aggcaaauaggcacgugcuuugg

SEQ ID NO: 2157296 - RNA, 21 nt, Staphylococcus aureus subsp. aureus N315
aggcaauguaaugguuaauaa

SEQ ID NO: 2157297 - RNA, 23 nt, Staphylococcus aureus subsp. aureus N315
aggcauaauuugugguaugacug

SEQ ID NO: 2157298 - RNA, 14 nt, Staphylococcus aureus subsp. aureus N315
aggcauaacuguau

SEQ ID NO: 2157299 - RNA, 17 nt, Staphylococcus aureus subsp. aureus N315
aggaugaguuuaaaaau

SEQ ID NO: 2157300 - RNA, 14 nt, Staphylococcus aureus subsp. aureus N315
aggaugaguuuaaa

SEQ ID NO: 2157301 - RNA, 21 nt, Staphylococcus aureus subsp. aureus N315
aggauaugcuguguaucauca

SEQ ID NO: 2157302 - RNA, 22 nt, Staphylococcus aureus subsp. aureus N315
aggauaugcuguguaucaucau

SEQ ID NO: 2157303 - RNA, 22 nt, Staphylococcus aureus subsp. aureus N315
aggaucacguuuuucuuuaaac

SEQ ID NO: 2157304 - RNA, 23 nt, Staphylococcus aureus subsp. aureus N315
aggauauuuauucuaaguuaaaa

SEQ ID NO: 2157305 - RNA, 18 nt, Staphylococcus aureus subsp. aureus N315
aggaucaacugaaauuuu

SEQ ID NO: 2157306 - RNA, 19 nt, Staphylococcus aureus subsp. aureus N315
aggaccacucaauucucua

SEQ ID NO: 2157307 - RNA, 15 nt, Staphylococcus aureus subsp. aureus N315
aggaauccaaagcug

SEQ ID NO: 2157308 - RNA, 13 nt, Staphylococcus aureus subsp. aureus N315
aggacggaaaagg

SEQ ID NO: 2157309 - RNA, 17 nt, Staphylococcus aureus subsp. aureus N315
aggaauaccacuuaauc

SEQ ID NO: 2157310 - RNA, 19 nt, Staphylococcus aureus subsp. aureus N315
aggaauacaugaguaaaac

SEQ ID NO: 2157311 - RNA, 13 nt, Staphylococcus aureus subsp. aureus N315
aggaaacuuaaau

SEQ ID NO: 2157312 - RNA, 18 nt, Staphylococcus aureus subsp. aureus N315
aggaauaucuuucaaauu

SEQ ID NO: 2157313 - RNA, 16 nt, Staphylococcus aureus subsp. aureus N315
aggaauaugaauugcu

SEQ ID NO: 2157314 - RNA, 17 nt, Staphylococcus aureus subsp. aureus N315
aggaauaucuuucaaau

SEQ ID NO: 2157315 - RNA, 14 nt, Staphylococcus aureus subsp. aureus N315
aggaauauaaaacu

SEQ ID NO: 2157316 - RNA, 19 nt, Staphylococcus aureus subsp. aureus N315
agcuuaauaaauuguauga

SEQ ID NO: 2157317 - RNA, 22 nt, Staphylococcus aureus subsp. aureus N315
agcuuauuaagcuugaaacaag

SEQ ID NO: 2157318 - RNA, 20 nt, Staphylococcus aureus subsp. aureus N315
agcuucuguguuggggccca

SEQ ID NO: 2157319 - RNA, 16 nt, Staphylococcus aureus subsp. aureus N315
agcuugaauaauauau

SEQ ID NO: 2157320 - RNA, 15 nt, Staphylococcus aureus subsp. aureus N315
agcuugaauaauaua

SEQ ID NO: 2157321 - RNA, 16 nt, Staphylococcus aureus subsp. aureus N315
agcuucuuuaacaauu

SEQ ID NO: 2157322 - RNA, 15 nt, Staphylococcus aureus subsp. aureus N315
agcuucuuuaacaau

SEQ ID NO: 2157323 - RNA, 12 nt, Staphylococcus aureus subsp. aureus N315
agcuuuuguaaa

SEQ ID NO: 2157324 - RNA, 17 nt, Staphylococcus aureus subsp. aureus N315
agcuuuuucuuucucua

SEQ ID NO: 2157325 - RNA, 22 nt, Staphylococcus aureus subsp. aureus N315
agcuuuuucuuucucuaacauu

SEQ ID NO: 2157326 - RNA, 19 nt, Staphylococcus aureus subsp. aureus N315
agcuuuaaguuauuuuguc

SEQ ID NO: 2157327 - RNA, 22 nt, Staphylococcus aureus subsp. aureus N315
agcuuuaaucauagcauuaaga

SEQ ID NO: 2157328 - RNA, 16 nt, Staphylococcus aureus subsp. aureus N315
agcuugcuuacaauaa

SEQ ID NO: 2157329 - RNA, 18 nt, Staphylococcus aureus subsp. aureus N315
agcuugcuuacaauaauc

SEQ ID NO: 2157330 - RNA, 22 nt, Staphylococcus aureus subsp. aureus N315
agcuugcuuacaauaaucacuu

SEQ ID NO: 2157331 - RNA, 14 nt, Staphylococcus aureus subsp. aureus N315
agcugcgauauaac

SEQ ID NO: 2157332 - RNA, 18 nt, Staphylococcus aureus subsp. aureus N315
agcugauuccauuucgau

SEQ ID NO: 2157333 - RNA, 15 nt, Staphylococcus aureus subsp. aureus N315
agcugauuaaaaugu

SEQ ID NO: 2157334 - RNA, 13 nt, Staphylococcus aureus subsp. aureus N315
agcugauuuuuca

SEQ ID NO: 2157335 - RNA, 21 nt, Staphylococcus aureus subsp. aureus N315
agcuguuggugaguguuucau

SEQ ID NO: 2157336 - RNA, 19 nt, Staphylococcus aureus subsp. aureus N315
agcucuuaaaucacuagcu

SEQ ID NO: 2157337 - RNA, 15 nt, Staphylococcus aureus subsp. aureus N315
agcucuucaaauuua

SEQ ID NO: 2157338 - RNA, 21 nt, Staphylococcus aureus subsp. aureus N315
agcucuuuuuugauuuggaaa

SEQ ID NO: 2157339 - RNA, 17 nt, Staphylococcus aureus subsp. aureus N315
agcucguuaaaucacau

SEQ ID NO: 2157340 - RNA, 22 nt, Staphylococcus aureus subsp. aureus N315
agcucugaaggagacauuuccc

SEQ ID NO: 2157341 - RNA, 19 nt, Staphylococcus aureus subsp. aureus N315
accgacaauuauaauaaaa

SEQ ID NO: 2157342 - RNA, 20 nt, Staphylococcus aureus subsp. aureus N315
accgacaaggauugaaaaaa

SEQ ID NO: 2157343 - RNA, 22 nt, Staphylococcus aureus subsp. aureus N315
accgacacuccacaaguggaac

SEQ ID NO: 2157344 - RNA, 20 nt, Staphylococcus aureus subsp. aureus N315
acccuugucaguuuuuuuau

SEQ ID NO: 2157345 - RNA, 21 nt, Staphylococcus aureus subsp. aureus N315
acccuaaugagcccguuaaaa

SEQ ID NO: 2157346 - RNA, 23 nt, Staphylococcus aureus subsp. aureus N315
acccuaauuuguuaguuuaaguc

SEQ ID NO: 2157347 - RNA, 16 nt, Staphylococcus aureus subsp. aureus N315
acccauauuaaauuuu

SEQ ID NO: 2157348 - RNA, 19 nt, Staphylococcus aureus subsp. aureus N315
accaucuuuaauacgaauu

SEQ ID NO: 2157349 - RNA, 23 nt, Staphylococcus aureus subsp. aureus N315
acccauuuuuuuccaagcaucau

SEQ ID NO: 2157350 - RNA, 13 nt, Staphylococcus aureus subsp. aureus N315
accaagauuccau

SEQ ID NO: 2157351 - RNA, 21 nt, Staphylococcus aureus subsp. aureus N315
accaacugucgguucaucuaa

SEQ ID NO: 2157352 - RNA, 22 nt, Staphylococcus aureus subsp. aureus N315
accaacugucgguucaucuaaa

SEQ ID NO: 2157353 - RNA, 20 nt, Staphylococcus aureus subsp. aureus N315
accagccucuguguuggggc

SEQ ID NO: 2157354 - RNA, 14 nt, Staphylococcus aureus subsp. aureus N315
accagcuaaccaaa

SEQ ID NO: 2157355 - RNA, 18 nt, Staphylococcus aureus subsp. aureus N315
accagcuaaccaaauaau

SEQ ID NO: 2157356 - RNA, 14 nt, Staphylococcus aureus subsp. aureus N315
accagucguaauga

SEQ ID NO: 2157357 - RNA, 16 nt, Staphylococcus aureus subsp. aureus N315
accauaguaauaaaau

SEQ ID NO: 2157358 - RNA, 16 nt, Staphylococcus aureus subsp. aureus N315
accauauuuuuagaaa

SEQ ID NO: 2157359 - RNA, 17 nt, Staphylococcus aureus subsp. aureus N315
accgauuguuaauuuaa

SEQ ID NO: 2157360 - RNA, 16 nt, Staphylococcus aureus subsp. aureus N315
accgcuuaauucuuca

SEQ ID NO: 2157361 - RNA, 18 nt, Staphylococcus aureus subsp. aureus N315
accgcuucuuuuaaguua

SEQ ID NO: 2157362 - RNA, 19 nt, Staphylococcus aureus subsp. aureus N315
accgcuucucgccuaauua

SEQ ID NO: 2157363 - RNA, 19 nt, Staphylococcus aureus subsp. aureus N315
accguaacuauaugaaaug

SEQ ID NO: 2157364 - RNA, 16 nt, Staphylococcus aureus subsp. aureus N315
accguaacauauguac

SEQ ID NO: 2157365 - RNA, 22 nt, Staphylococcus aureus subsp. aureus N315
accguauuauuggauuugaagu

SEQ ID NO: 2157366 - RNA, 18 nt, Staphylococcus aureus subsp. aureus N315
accuaagcaagauaauag

SEQ ID NO: 2157367 - RNA, 23 nt, Staphylococcus aureus subsp. aureus N315
accuaauauauuacuaaccuauu

SEQ ID NO: 2157368 - RNA, 20 nt, Staphylococcus aureus subsp. aureus N315
accuacaacgaagaauccua

SEQ ID NO: 2157369 - RNA, 21 nt, Staphylococcus aureus subsp. aureus N315
accuacacgaccaagacgaac

SEQ ID NO: 2157370 - RNA, 14 nt, Staphylococcus aureus subsp. aureus N315
accuacaacaccaa

SEQ ID NO: 2157371 - RNA, 22 nt, Staphylococcus aureus subsp. aureus N315
accuaauuguuaagagguuuug

SEQ ID NO: 2157372 - RNA, 20 nt, Staphylococcus aureus subsp. aureus N315
accuaauucgccaucuuuuu

SEQ ID NO: 2157373 - RNA, 16 nt, Staphylococcus aureus subsp. aureus N315
accuaauucauauaua

SEQ ID NO: 2157374 - RNA, 12 nt, Staphylococcus aureus subsp. aureus N315
accuaaaauacc

SEQ ID NO: 2157375 - RNA, 21 nt, Staphylococcus aureus subsp. aureus N315
accuaaaugauuaauaacaua

SEQ ID NO: 2157376 - RNA, 19 nt, Staphylococcus aureus subsp. aureus N315
accuaaaugauuaauaaca

SEQ ID NO: 2157377 - RNA, 16 nt, Staphylococcus aureus subsp. aureus N315
accuaaaaacagcagu

SEQ ID NO: 2157378 - RNA, 16 nt, Staphylococcus aureus subsp. aureus N315
accuacacggucccaa

SEQ ID NO: 2157379 - RNA, 15 nt, Staphylococcus aureus subsp. aureus N315
accuacagauaaagc

SEQ ID NO: 2157380 - RNA, 21 nt, Staphylococcus aureus subsp. aureus N315
accuacgauucgaaauaggua

SEQ ID NO: 2157381 - RNA, 16 nt, Staphylococcus aureus subsp. aureus N315
accuauuaauaucaua

SEQ ID NO: 2157382 - RNA, 17 nt, Staphylococcus aureus subsp. aureus N315
accuauuccuauuacua

SEQ ID NO: 2157383 - RNA, 15 nt, Staphylococcus aureus subsp. aureus N315
accucauuugacaua

SEQ ID NO: 2157384 - RNA, 20 nt, Staphylococcus aureus subsp. aureus N315
accucauccgccaauuaaaa

SEQ ID NO: 2157385 - RNA, 18 nt, Staphylococcus aureus subsp. aureus N315
accuauuaaaauaaacca

SEQ ID NO: 2157386 - RNA, 12 nt, Staphylococcus aureus subsp. aureus N315
accuauuguauu

SEQ ID NO: 2157387 - RNA, 21 nt, Staphylococcus aureus subsp. aureus N315
accgucuuaucuaaaucuuca

SEQ ID NO: 2157388 - RNA, 19 nt, Staphylococcus aureus subsp. aureus N315
accguguuguugaauaauu

SEQ ID NO: 2157389 - RNA, 12 nt, Staphylococcus aureus subsp. aureus N315
acgacaauucca

SEQ ID NO: 2157390 - RNA, 16 nt, Staphylococcus aureus subsp. aureus N315
acgaaauaaauuuuac

SEQ ID NO: 2157391 - RNA, 23 nt, Staphylococcus aureus subsp. aureus N315
acgaaucacaguuauauauuccu

SEQ ID NO: 2157392 - RNA, 18 nt, Staphylococcus aureus subsp. aureus N315
acgaaaagucagcuuaca

SEQ ID NO: 2157393 - RNA, 13 nt, Staphylococcus aureus subsp. aureus N315
accuuugucuuuu

SEQ ID NO: 2157394 - RNA, 22 nt, Staphylococcus aureus subsp. aureus N315
accuuuugauguuuaugacaaa

SEQ ID NO: 2157395 - RNA, 18 nt, Staphylococcus aureus subsp. aureus N315
acgacguccagcuaauaa

SEQ ID NO: 2157396 - RNA, 16 nt, Staphylococcus aureus subsp. aureus N315
acgacgaaauaaauuu

SEQ ID NO: 2157397 - RNA, 20 nt, Staphylococcus aureus subsp. aureus N315
acgaguguuuuaaucuuauu

SEQ ID NO: 2157398 - RNA, 20 nt, Staphylococcus aureus subsp. aureus N315
acgauaacaauuuauuaaaa

SEQ ID NO: 2157399 - RNA, 19 nt, Staphylococcus aureus subsp. aureus N315
acgauaacaauuuauuaaa

SEQ ID NO: 2157400 - RNA, 20 nt, Staphylococcus aureus subsp. aureus N315
acgauaaauagugauugcuu

SEQ ID NO: 2157401 - RNA, 21 nt, Staphylococcus aureus subsp. aureus N315
acgauaacagcuacaaauaau

SEQ ID NO: 2157402 - RNA, 23 nt, Staphylococcus aureus subsp. aureus N315
acgauaacagcuacaaauaauga

SEQ ID NO: 2157403 - RNA, 17 nt, Staphylococcus aureus subsp. aureus N315
acgauauaacauuaaaa

SEQ ID NO: 2157404 - RNA, 20 nt, Staphylococcus aureus subsp. aureus N315
acgagucauaaauauaaaau

SEQ ID NO: 2157405 - RNA, 16 nt, Staphylococcus aureus subsp. aureus N315
acgagcuggugagaaa

SEQ ID NO: 2157406 - RNA, 19 nt, Staphylococcus aureus subsp. aureus N315
acgacucuccaaauauugu

SEQ ID NO: 2157407 - RNA, 19 nt, Staphylococcus aureus subsp. aureus N315
acgagcaacaucuuuuguu

SEQ ID NO: 2157408 - RNA, 18 nt, Staphylococcus aureus subsp. aureus N315
accuugaaugauauuaac

SEQ ID NO: 2157409 - RNA, 16 nt, Staphylococcus aureus subsp. aureus N315
accuugaaugauauua

SEQ ID NO: 2157410 - RNA, 19 nt, Staphylococcus aureus subsp. aureus N315
accuucuauauugggacuu

SEQ ID NO: 2157411 - RNA, 12 nt, Staphylococcus aureus subsp. aureus N315
accuucuauauu

SEQ ID NO: 2157412 - RNA, 15 nt, Staphylococcus aureus subsp. aureus N315
accuucguuuaaauu

SEQ ID NO: 2157413 - RNA, 20 nt, Staphylococcus aureus subsp. aureus N315
accuuguucuuuacuccaaa

SEQ ID NO: 2157414 - RNA, 14 nt, Staphylococcus aureus subsp. aureus N315
accuuguuaaaaua

SEQ ID NO: 2157415 - RNA, 14 nt, Staphylococcus aureus subsp. aureus N315
accuuucgauaaac

SEQ ID NO: 2157416 - RNA, 15 nt, Staphylococcus aureus subsp. aureus N315
accuuguaaauuuaa

SEQ ID NO: 2157417 - RNA, 19 nt, Staphylococcus aureus subsp. aureus N315
accuucaguuucuacugua

SEQ ID NO: 2157418 - RNA, 17 nt, Staphylococcus aureus subsp. aureus N315
accugcgccuucuuuuu

SEQ ID NO: 2157419 - RNA, 16 nt, Staphylococcus aureus subsp. aureus N315
accugcauauguguuu

SEQ ID NO: 2157420 - RNA, 13 nt, Staphylococcus aureus subsp. aureus N315
acgguauuuucaa

SEQ ID NO: 2157421 - RNA, 17 nt, Staphylococcus aureus subsp. aureus N315
acggcacauucauaccg

SEQ ID NO: 2157422 - RNA, 17 nt, Staphylococcus aureus subsp. aureus N315
acguaucaagaaaaagu

SEQ ID NO: 2157423 - RNA, 20 nt, Staphylococcus aureus subsp. aureus N315
acguauagaugcuaauguaa

SEQ ID NO: 2157424 - RNA, 14 nt, Staphylococcus aureus subsp. aureus N315
acgucauuuuuaau

SEQ ID NO: 2157425 - RNA, 22 nt, Staphylococcus aureus subsp. aureus N315
acgugaggcccauaaauuacuu

SEQ ID NO: 2157426 - RNA, 10 nt, Staphylococcus aureus subsp. aureus N315
acgucuaccu

SEQ ID NO: 2157427 - RNA, 15 nt, Staphylococcus aureus subsp. aureus N315
acgcugguaauauuu

SEQ ID NO: 2157428 - RNA, 17 nt, Staphylococcus aureus subsp. aureus N315
acgcuaauuuuacucug

SEQ ID NO: 2157429 - RNA, 20 nt, Staphylococcus aureus subsp. aureus N315
acgauauguugugcugccaa

SEQ ID NO: 2157430 - RNA, 20 nt, Staphylococcus aureus subsp. aureus N315
acgaucaacugcuucacgau

SEQ ID NO: 2157431 - RNA, 16 nt, Staphylococcus aureus subsp. aureus N315
acgaucacuuggcuua

SEQ ID NO: 2157432 - RNA, 13 nt, Staphylococcus aureus subsp. aureus N315
acgccuuuccauu

SEQ ID NO: 2157433 - RNA, 21 nt, Staphylococcus aureus subsp. aureus N315
acgccucaacacuuucuacuc

SEQ ID NO: 2157434 - RNA, 18 nt, Staphylococcus aureus subsp. aureus N315
acugucaccuucuauauu

SEQ ID NO: 2157435 - RNA, 20 nt, Staphylococcus aureus subsp. aureus N315
acuguaugccgccuaauaau

SEQ ID NO: 2157436 - RNA, 21 nt, Staphylococcus aureus subsp. aureus N315
acuguauggucuggaauaaau

SEQ ID NO: 2157437 - RNA, 12 nt, Staphylococcus aureus subsp. aureus N315
acuguauaccuc

SEQ ID NO: 2157438 - RNA, 22 nt, Staphylococcus aureus subsp. aureus N315
acuguuaaagucuguugguuua

SEQ ID NO: 2157439 - RNA, 19 nt, Staphylococcus aureus subsp. aureus N315
acuguguuuagguauauaa

SEQ ID NO: 2157440 - RNA, 20 nt, Staphylococcus aureus subsp. aureus N315
acuguuuguuuauugagaau

SEQ ID NO: 2157441 - RNA, 16 nt, Staphylococcus aureus subsp. aureus N315
acuguuacugcacaca

SEQ ID NO: 2157442 - RNA, 18 nt, Staphylococcus aureus subsp. aureus N315
acuguuuuauuaugaauu

SEQ ID NO: 2157443 - RNA, 13 nt, Staphylococcus aureus subsp. aureus N315
acuuaauaucaua

SEQ ID NO: 2157444 - RNA, 15 nt, Staphylococcus aureus subsp. aureus N315
acuuaguaauaagac

SEQ ID NO: 2157445 - RNA, 22 nt, Staphylococcus aureus subsp. aureus N315
acuuaguagauuuauuaaauau

SEQ ID NO: 2157446 - RNA, 20 nt, Staphylococcus aureus subsp. aureus N315
acuuagggugacucaaugaa

SEQ ID NO: 2157447 - RNA, 17 nt, Staphylococcus aureus subsp. aureus N315
acuuaaugcuucaaaug

SEQ ID NO: 2157448 - RNA, 23 nt, Staphylococcus aureus subsp. aureus N315
acuuaaugacuucuuuauauuua

SEQ ID NO: 2157449 - RNA, 22 nt, Staphylococcus aureus subsp. aureus N315
acugcuuuggacacaauaccuu

SEQ ID NO: 2157450 - RNA, 15 nt, Staphylococcus aureus subsp. aureus N315
acugcuguucucuau

SEQ ID NO: 2157451 - RNA, 18 nt, Staphylococcus aureus subsp. aureus N315
acugggacauagaucaau

SEQ ID NO: 2157452 - RNA, 18 nt, Staphylococcus aureus subsp. aureus N315
acuggguuguuauuuaua

SEQ ID NO: 2157453 - RNA, 13 nt, Staphylococcus aureus subsp. aureus N315
acuguaaaacaau

SEQ ID NO: 2157454 - RNA, 15 nt, Staphylococcus aureus subsp. aureus N315
acucguaaauuuuau

SEQ ID NO: 2157455 - RNA, 19 nt, Staphylococcus aureus subsp. aureus N315
acucguaaauuuuaucuaa

SEQ ID NO: 2157456 - RNA, 15 nt, Staphylococcus aureus subsp. aureus N315
acugaaauuuuuccg

SEQ ID NO: 2157457 - RNA, 17 nt, Staphylococcus aureus subsp. aureus N315
acugacuaauaaaacuu

SEQ ID NO: 2157458 - RNA, 14 nt, Staphylococcus aureus subsp. aureus N315
acugcaccuccaac

SEQ ID NO: 2157459 - RNA, 13 nt, Staphylococcus aureus subsp. aureus N315
acugauuaaacug

SEQ ID NO: 2157460 - RNA, 13 nt, Staphylococcus aureus subsp. aureus N315
acugcuaauauua

SEQ ID NO: 2157461 - RNA, 14 nt, Staphylococcus aureus subsp. aureus N315
acugcuaauuuuuu

SEQ ID NO: 2157462 - RNA, 19 nt, Staphylococcus aureus subsp. aureus N315
acugcuaauuuuuucauca

SEQ ID NO: 2157463 - RNA, 23 nt, Staphylococcus aureus subsp. aureus N315
acugccuaauacacuugauaaaa

SEQ ID NO: 2157464 - RNA, 14 nt, Staphylococcus aureus subsp. aureus N315
acucccuuuuuaaa

SEQ ID NO: 2157465 - RNA, 16 nt, Staphylococcus aureus subsp. aureus N315
acucggggaauuuuua

SEQ ID NO: 2157466 - RNA, 19 nt, Staphylococcus aureus subsp. aureus N315
acuccuuaaacaaauaaau

SEQ ID NO: 2157467 - RNA, 15 nt, Staphylococcus aureus subsp. aureus N315
acuccuuacaauaaa

SEQ ID NO: 2157468 - RNA, 15 nt, Staphylococcus aureus subsp. aureus N315
acuccuuauuuuucg

SEQ ID NO: 2157469 - RNA, 15 nt, Staphylococcus aureus subsp. aureus N315
acuccuuaaacaaau

SEQ ID NO: 2157470 - RNA, 21 nt, Staphylococcus aureus subsp. aureus N315
acucaucuguccgauaucuuu

SEQ ID NO: 2157471 - RNA, 17 nt, Staphylococcus aureus subsp. aureus N315
acucauuuauaaacauu

SEQ ID NO: 2157472 - RNA, 15 nt, Staphylococcus aureus subsp. aureus N315
acucauaccaaaaac

SEQ ID NO: 2157473 - RNA, 21 nt, Staphylococcus aureus subsp. aureus N315
acucauaccaaaaacauuaac

SEQ ID NO: 2157474 - RNA, 16 nt, Staphylococcus aureus subsp. aureus N315
acucaggcuuaauuaa

SEQ ID NO: 2157475 - RNA, 18 nt, Staphylococcus aureus subsp. aureus N315
acucagaaucuuacauug

SEQ ID NO: 2157476 - RNA, 14 nt, Staphylococcus aureus subsp. aureus N315
acuaucguuuuuau

SEQ ID NO: 2157477 - RNA, 14 nt, Staphylococcus aureus subsp. aureus N315
acuaucuauaauac

SEQ ID NO: 2157478 - RNA, 18 nt, Staphylococcus aureus subsp. aureus N315
acuaucuucaucauauuc

SEQ ID NO: 2157479 - RNA, 18 nt, Staphylococcus aureus subsp. aureus N315
acuaucuguuguuauaua

SEQ ID NO: 2157480 - RNA, 13 nt, Staphylococcus aureus subsp. aureus N315
acuaucuguuguu

SEQ ID NO: 2157481 - RNA, 14 nt, Staphylococcus aureus subsp. aureus N315
acuaguuuguaaua

SEQ ID NO: 2157482 - RNA, 22 nt, Staphylococcus aureus subsp. aureus N315
acuaguaauagaauagucaauu

SEQ ID NO: 2157483 - RNA, 16 nt, Staphylococcus aureus subsp. aureus N315
acuagggguuuuuaau

SEQ ID NO: 2157484 - RNA, 19 nt, Staphylococcus aureus subsp. aureus N315
acuacugucucaucuucua

SEQ ID NO: 2157485 - RNA, 14 nt, Staphylococcus aureus subsp. aureus N315
acuacuuaauuaau

SEQ ID NO: 2157486 - RNA, 23 nt, Staphylococcus aureus subsp. aureus N315
acuaggaauauaaaacugugcau

SEQ ID NO: 2157487 - RNA, 16 nt, Staphylococcus aureus subsp. aureus N315
acuacuacauuauuac

SEQ ID NO: 2157488 - RNA, 21 nt, Staphylococcus aureus subsp. aureus N315
acguucgauaacguugccaua

SEQ ID NO: 2157489 - RNA, 15 nt, Staphylococcus aureus subsp. aureus N315
acuacgcauuuuaaa

SEQ ID NO: 2157490 - RNA, 17 nt, Staphylococcus aureus subsp. aureus N315
acuacgcauuuuaaaua

SEQ ID NO: 2157491 - RNA, 16 nt, Staphylococcus aureus subsp. aureus N315
acuaccuguuggcuuu

SEQ ID NO: 2157492 - RNA, 17 nt, Staphylococcus aureus subsp. aureus N315
acucaaagauauacuua

SEQ ID NO: 2157493 - RNA, 19 nt, Staphylococcus aureus subsp. aureus N315
acuauuaaaggaaaucaau

SEQ ID NO: 2157494 - RNA, 15 nt, Staphylococcus aureus subsp. aureus N315
acuauuaaaggaaau

SEQ ID NO: 2157495 - RNA, 16 nt, Staphylococcus aureus subsp. aureus N315
acuauuaaaaccaaaa

SEQ ID NO: 2157496 - RNA, 17 nt, Staphylococcus aureus subsp. aureus N315
acucaaaauuaaagcuu

SEQ ID NO: 2157497 - RNA, 23 nt, Staphylococcus aureus subsp. aureus N315
acucaaaauguuuaacaauaaua

SEQ ID NO: 2157498 - RNA, 12 nt, Staphylococcus aureus subsp. aureus N315
acuaugugaagu

SEQ ID NO: 2157499 - RNA, 14 nt, Staphylococcus aureus subsp. aureus N315
acuaugcaaaugaa

SEQ ID NO: 2157500 - RNA, 16 nt, Staphylococcus aureus subsp. aureus N315
acucaaggaaaucaua

SEQ ID NO: 2157501 - RNA, 18 nt, Staphylococcus aureus subsp. aureus N315
acucaaggaaaucauaua

SEQ ID NO: 2157502 - RNA, 22 nt, Staphylococcus aureus subsp. aureus N315
acucaaggaaaucauauauuuc

SEQ ID NO: 2157503 - RNA, 13 nt, Staphylococcus aureus subsp. aureus N315
acucaauaaaauu

SEQ ID NO: 2157504 - RNA, 15 nt, Staphylococcus aureus subsp. aureus N315
acucaccugcagcau

SEQ ID NO: 2157505 - RNA, 16 nt, Staphylococcus aureus subsp. aureus N315
acucaauucucuaacu

SEQ ID NO: 2157506 - RNA, 22 nt, Staphylococcus aureus subsp. aureus N315
acucacauucugcccugcaaug

SEQ ID NO: 2157507 - RNA, 20 nt, Staphylococcus aureus subsp. aureus N315
agauucaaacguuuucacuu

SEQ ID NO: 2157508 - RNA, 21 nt, Staphylococcus aureus subsp. aureus N315
agauuaugaaaacauuauuaa

SEQ ID NO: 2157509 - RNA, 15 nt, Staphylococcus aureus subsp. aureus N315
agauuaugacaacau

SEQ ID NO: 2157510 - RNA, 17 nt, Staphylococcus aureus subsp. aureus N315
agauuauuuaaaacuug

SEQ ID NO: 2157511 - RNA, 23 nt, Staphylococcus aureus subsp. aureus N315
agauuauuuaaaacuuguaaauu

SEQ ID NO: 2157512 - RNA, 13 nt, Staphylococcus aureus subsp. aureus N315
agauuauuaugug

SEQ ID NO: 2157513 - RNA, 19 nt, Staphylococcus aureus subsp. aureus N315
agcaauaucaucauuuaaa

SEQ ID NO: 2157514 - RNA, 14 nt, Staphylococcus aureus subsp. aureus N315
agcaauaucaucau

SEQ ID NO: 2157515 - RNA, 15 nt, Staphylococcus aureus subsp. aureus N315
agcaaucauaauacu

SEQ ID NO: 2157516 - RNA, 22 nt, Staphylococcus aureus subsp. aureus N315
agcaauuucgauugcguuuucu

SEQ ID NO: 2157517 - RNA, 20 nt, Staphylococcus aureus subsp. aureus N315
agcaauuaaagucaauuuaa

SEQ ID NO: 2157518 - RNA, 14 nt, Staphylococcus aureus subsp. aureus N315
agcacaauauuuac

SEQ ID NO: 2157519 - RNA, 21 nt, Staphylococcus aureus subsp. aureus N315
agcacaauauuuaccacaaau

SEQ ID NO: 2157520 - RNA, 22 nt, Staphylococcus aureus subsp. aureus N315
agcacaauauuuaccacaaaua

SEQ ID NO: 2157521 - RNA, 14 nt, Staphylococcus aureus subsp. aureus N315
agcacaaacuaaaa

SEQ ID NO: 2157522 - RNA, 16 nt, Staphylococcus aureus subsp. aureus N315
agcacgagacaauaau

SEQ ID NO: 2157523 - RNA, 14 nt, Staphylococcus aureus subsp. aureus N315
agcacgagaaaugu

SEQ ID NO: 2157524 - RNA, 20 nt, Staphylococcus aureus subsp. aureus N315
agcacagcgauuaaaugaug

SEQ ID NO: 2157525 - RNA, 17 nt, Staphylococcus aureus subsp. aureus N315
agcacagcgauuaaaug

SEQ ID NO: 2157526 - RNA, 13 nt, Staphylococcus aureus subsp. aureus N315
agcacauuuuuag

SEQ ID NO: 2157527 - RNA, 22 nt, Staphylococcus aureus subsp. aureus N315
agcauugagauggucuuuuaau

SEQ ID NO: 2157528 - RNA, 16 nt, Staphylococcus aureus subsp. aureus N315
agcaucugcaugguuu

SEQ ID NO: 2157529 - RNA, 23 nt, Staphylococcus aureus subsp. aureus N315
agcaucugcaugguuugcugguu

SEQ ID NO: 2157530 - RNA, 22 nt, Staphylococcus aureus subsp. aureus N315
agcauuagcaaauauuauuaaa

SEQ ID NO: 2157531 - RNA, 19 nt, Staphylococcus aureus subsp. aureus N315
agcauuaaucguauuuuua

SEQ ID NO: 2157532 - RNA, 14 nt, Staphylococcus aureus subsp. aureus N315
agcauuaucaucac

SEQ ID NO: 2157533 - RNA, 14 nt, Staphylococcus aureus subsp. aureus N315
agccacagcgaccu

SEQ ID NO: 2157534 - RNA, 22 nt, Staphylococcus aureus subsp. aureus N315
agccacagcuuuaaguuauuuu

SEQ ID NO: 2157535 - RNA, 23 nt, Staphylococcus aureus subsp. aureus N315
agccaaaucuuuaauaaccuuua

SEQ ID NO: 2157536 - RNA, 22 nt, Staphylococcus aureus subsp. aureus N315
agccaaaucuuuaauaaccuuu

SEQ ID NO: 2157537 - RNA, 16 nt, Staphylococcus aureus subsp. aureus N315
agccaacacauaaaug

SEQ ID NO: 2157538 - RNA, 21 nt, Staphylococcus aureus subsp. aureus N315
agcaguugcacaaauugcaau

SEQ ID NO: 2157539 - RNA, 21 nt, Staphylococcus aureus subsp. aureus N315
agcaguugacuguaaaacaau

SEQ ID NO: 2157540 - RNA, 19 nt, Staphylococcus aureus subsp. aureus N315
agcaucgauuuauuauuac

SEQ ID NO: 2157541 - RNA, 14 nt, Staphylococcus aureus subsp. aureus N315
agcaucauuuuucg

SEQ ID NO: 2157542 - RNA, 13 nt, Staphylococcus aureus subsp. aureus N315
agcauauuucuaa

SEQ ID NO: 2157543 - RNA, 15 nt, Staphylococcus aureus subsp. aureus N315
agcaucaaaaauaaa

SEQ ID NO: 2157544 - RNA, 19 nt, Staphylococcus aureus subsp. aureus N315
agcauaucuuuaucauuau

SEQ ID NO: 2157545 - RNA, 19 nt, Staphylococcus aureus subsp. aureus N315
aaaaccuuacccaaaaaau

SEQ ID NO: 2157546 - RNA, 22 nt, Staphylococcus aureus subsp. aureus N315
aaaaccuguaucuuaaauuacu

SEQ ID NO: 2157547 - RNA, 21 nt, Staphylococcus aureus subsp. aureus N315
aaaaccuuuucaaauuauaac

SEQ ID NO: 2157548 - RNA, 14 nt, Staphylococcus aureus subsp. aureus N315
aaaaccugaaacaa

SEQ ID NO: 2157549 - RNA, 18 nt, Staphylococcus aureus subsp. aureus N315
aaaaccugggacauuaau

SEQ ID NO: 2157550 - RNA, 21 nt, Staphylococcus aureus subsp. aureus N315
aaaaccuauuccuaauaaaua

SEQ ID NO: 2157551 - RNA, 20 nt, Staphylococcus aureus subsp. aureus N315
aaaaccuauuccuaauaaau

SEQ ID NO: 2157552 - RNA, 22 nt, Staphylococcus aureus subsp. aureus N315
agcguagcgaaaguaucuauga

SEQ ID NO: 2157553 - RNA, 16 nt, Staphylococcus aureus subsp. aureus N315
agcguauuuuaaugau

SEQ ID NO: 2157554 - RNA, 19 nt, Staphylococcus aureus subsp. aureus N315
agcggaauacagaugaugc

SEQ ID NO: 2157555 - RNA, 18 nt, Staphylococcus aureus subsp. aureus N315
agcggacugaaagaaaag

SEQ ID NO: 2157556 - RNA, 17 nt, Staphylococcus aureus subsp. aureus N315
agcgcaggcgaaccgaa

SEQ ID NO: 2157557 - RNA, 18 nt, Staphylococcus aureus subsp. aureus N315
agcgaccgugguucaaaa

SEQ ID NO: 2157558 - RNA, 20 nt, Staphylococcus aureus subsp. aureus N315
agcgcauaaauuuucuguuu

SEQ ID NO: 2157559 - RNA, 17 nt, Staphylococcus aureus subsp. aureus N315
agcgcagugaccucagg

SEQ ID NO: 2157560 - RNA, 22 nt, Staphylococcus aureus subsp. aureus N315
agccuagaacauugauuauugu

SEQ ID NO: 2157561 - RNA, 15 nt, Staphylococcus aureus subsp. aureus N315
agccuaggaguaucu

SEQ ID NO: 2157562 - RNA, 20 nt, Staphylococcus aureus subsp. aureus N315
agccuacuuugucugcaauu

SEQ ID NO: 2157563 - RNA, 13 nt, Staphylococcus aureus subsp. aureus N315
agccuauccauuc

SEQ ID NO: 2157564 - RNA, 15 nt, Staphylococcus aureus subsp. aureus N315
agccuauccauucaa

SEQ ID NO: 2157565 - RNA, 15 nt, Staphylococcus aureus subsp. aureus N315
agccuacaaccuuug

SEQ ID NO: 2157566 - RNA, 19 nt, Staphylococcus aureus subsp. aureus N315
agccugaaauagaaauguc

SEQ ID NO: 2157567 - RNA, 13 nt, Staphylococcus aureus subsp. aureus N315
agccuucuaucuu

SEQ ID NO: 2157568 - RNA, 14 nt, Staphylococcus aureus subsp. aureus N315
agcccguuaaaaag

SEQ ID NO: 2157569 - RNA, 19 nt, Staphylococcus aureus subsp. aureus N315
agcccugacaauucaucua

SEQ ID NO: 2157570 - RNA, 21 nt, Staphylococcus aureus subsp. aureus N315
acuuggcgacauuuguaaaua

SEQ ID NO: 2157571 - RNA, 13 nt, Staphylococcus aureus subsp. aureus N315
acuuggauuuuaa

SEQ ID NO: 2157572 - RNA, 17 nt, Staphylococcus aureus subsp. aureus N315
acuuggauucaaaugac

SEQ ID NO: 2157573 - RNA, 19 nt, Staphylococcus aureus subsp. aureus N315
acuuggauucaaaugacau

SEQ ID NO: 2157574 - RNA, 13 nt, Staphylococcus aureus subsp. aureus N315
acuugggauuuuu

SEQ ID NO: 2157575 - RNA, 19 nt, Staphylococcus aureus subsp. aureus N315
acuuguaaauuuauuuuua

SEQ ID NO: 2157576 - RNA, 15 nt, Staphylococcus aureus subsp. aureus N315
acuuguaauauaaca

SEQ ID NO: 2157577 - RNA, 18 nt, Staphylococcus aureus subsp. aureus N315
acuuguaauauaacaagu

SEQ ID NO: 2157578 - RNA, 21 nt, Staphylococcus aureus subsp. aureus N315
acuugguauugguaaauuuau

SEQ ID NO: 2157579 - RNA, 18 nt, Staphylococcus aureus subsp. aureus N315
acuugucguauucuucaa

SEQ ID NO: 2157580 - RNA, 23 nt, Staphylococcus aureus subsp. aureus N315
acuugugacaaucgcuugcuucu

SEQ ID NO: 2157581 - RNA, 17 nt, Staphylococcus aureus subsp. aureus N315
acuugucguauucuuca

SEQ ID NO: 2157582 - RNA, 21 nt, Staphylococcus aureus subsp. aureus N315
acuuguccguuuuauauuuau

SEQ ID NO: 2157583 - RNA, 22 nt, Staphylococcus aureus subsp. aureus N315
acuuguucaauacuucuuguuc

SEQ ID NO: 2157584 - RNA, 13 nt, Staphylococcus aureus subsp. aureus N315
acuuauaauauua

SEQ ID NO: 2157585 - RNA, 23 nt, Staphylococcus aureus subsp. aureus N315
acuuauauauucaauaauuauua

SEQ ID NO: 2157586 - RNA, 15 nt, Staphylococcus aureus subsp. aureus N315
acuuauaacugauaa

SEQ ID NO: 2157587 - RNA, 16 nt, Staphylococcus aureus subsp. aureus N315
acuuauaaaaugaaau

SEQ ID NO: 2157588 - RNA, 22 nt, Staphylococcus aureus subsp. aureus N315
acuugcacauuaucguaagcug

SEQ ID NO: 2157589 - RNA, 20 nt, Staphylococcus aureus subsp. aureus N315
acuugcuguugcaauaaaau

SEQ ID NO: 2157590 - RNA, 17 nt, Staphylococcus aureus subsp. aureus N315
acuuggaaauguauaug

SEQ ID NO: 2157591 - RNA, 22 nt, Staphylococcus aureus subsp. aureus N315
acuuuauuucuauaucuauuua

SEQ ID NO: 2157592 - RNA, 23 nt, Staphylococcus aureus subsp. aureus N315
acuuucaaacaaaucuuuuaaau

SEQ ID NO: 2157593 - RNA, 15 nt, Staphylococcus aureus subsp. aureus N315
acuuuauaauuuuug

SEQ ID NO: 2157594 - RNA, 14 nt, Staphylococcus aureus subsp. aureus N315
acuuuaguauuaua

SEQ ID NO: 2157595 - RNA, 13 nt, Staphylococcus aureus subsp. aureus N315
acuuuaguauauu

SEQ ID NO: 2157596 - RNA, 20 nt, Staphylococcus aureus subsp. aureus N315
acuuuagauaaacucuaaau

SEQ ID NO: 2157597 - RNA, 23 nt, Staphylococcus aureus subsp. aureus N315
acuuuagaaagugauucccaaag

SEQ ID NO: 2157598 - RNA, 22 nt, Staphylococcus aureus subsp. aureus N315
acuuuagaaagugauucccaaa

SEQ ID NO: 2157599 - RNA, 15 nt, Staphylococcus aureus subsp. aureus N315
acuuuagaaagugau

SEQ ID NO: 2157600 - RNA, 20 nt, Staphylococcus aureus subsp. aureus N315
acuuuaauaccagcauccau

SEQ ID NO: 2157601 - RNA, 22 nt, Staphylococcus aureus subsp. aureus N315
acuuuaauaccagcauccauug

SEQ ID NO: 2157602 - RNA, 23 nt, Staphylococcus aureus subsp. aureus N315
acuuuaauaucagguacaaaugg

SEQ ID NO: 2157603 - RNA, 20 nt, Staphylococcus aureus subsp. aureus N315
acuuuaauugcucuuuaaca

SEQ ID NO: 2157604 - RNA, 21 nt, Staphylococcus aureus subsp. aureus N315
acuuuaauuuagugaaacaau

SEQ ID NO: 2157605 - RNA, 11 nt, Staphylococcus aureus subsp. aureus N315
acuuuaccauc

SEQ ID NO: 2157606 - RNA, 13 nt, Staphylococcus aureus subsp. aureus N315
acuuuaccaucuu

SEQ ID NO: 2157607 - RNA, 14 nt, Staphylococcus aureus subsp. aureus N315
acuuuaauuuuuca

SEQ ID NO: 2157608 - RNA, 13 nt, Staphylococcus aureus subsp. aureus N315
acuuuaauuuuuc

SEQ ID NO: 2157609 - RNA, 15 nt, Staphylococcus aureus subsp. aureus N315
acuuuaauuuuucau

SEQ ID NO: 2157610 - RNA, 15 nt, Staphylococcus aureus subsp. aureus N315
acuuuaaaauuguau

SEQ ID NO: 2157611 - RNA, 13 nt, Staphylococcus aureus subsp. aureus N315
acuuguuuccuac

SEQ ID NO: 2157612 - RNA, 22 nt, Staphylococcus aureus subsp. aureus N315
acuuuaaaauuguauagaaugu

SEQ ID NO: 2157613 - RNA, 19 nt, Staphylococcus aureus subsp. aureus N315
acuuguucaacaacugcga

SEQ ID NO: 2157614 - RNA, 12 nt, Staphylococcus aureus subsp. aureus N315
agaaaaaaugau

SEQ ID NO: 2157615 - RNA, 23 nt, Staphylococcus aureus subsp. aureus N315
agaaaauuacuuagcaaacaauu

SEQ ID NO: 2157616 - RNA, 20 nt, Staphylococcus aureus subsp. aureus N315
agaaacaaaacaaaaaauau

SEQ ID NO: 2157617 - RNA, 21 nt, Staphylococcus aureus subsp. aureus N315
agaaaauaugacgaucuucau

SEQ ID NO: 2157618 - RNA, 15 nt, Staphylococcus aureus subsp. aureus N315
agaaaaugaguacaa

SEQ ID NO: 2157619 - RNA, 22 nt, Staphylococcus aureus subsp. aureus N315
agaaaaucguuauaaguacaaa

SEQ ID NO: 2157620 - RNA, 15 nt, Staphylococcus aureus subsp. aureus N315
acuuuuauuuuuuau

SEQ ID NO: 2157621 - RNA, 17 nt, Staphylococcus aureus subsp. aureus N315
acuuuucaacuuuaguu

SEQ ID NO: 2157622 - RNA, 15 nt, Staphylococcus aureus subsp. aureus N315
acuuuuauugccaua

SEQ ID NO: 2157623 - RNA, 22 nt, Staphylococcus aureus subsp. aureus N315
acuuuuagaguuuuuauuauua

SEQ ID NO: 2157624 - RNA, 17 nt, Staphylococcus aureus subsp. aureus N315
acuuuuauaaucuuuua

SEQ ID NO: 2157625 - RNA, 20 nt, Staphylococcus aureus subsp. aureus N315
acuuuuccuugauucuuaua

SEQ ID NO: 2157626 - RNA, 14 nt, Staphylococcus aureus subsp. aureus N315
acuuuucauauaaa

SEQ ID NO: 2157627 - RNA, 15 nt, Staphylococcus aureus subsp. aureus N315
acuuuuucaacugua

SEQ ID NO: 2157628 - RNA, 22 nt, Staphylococcus aureus subsp. aureus N315
acuuuuugaguauccaauacua

SEQ ID NO: 2157629 - RNA, 22 nt, Staphylococcus aureus subsp. aureus N315
acuuuuugacauauuuuuuaaa

SEQ ID NO: 2157630 - RNA, 21 nt, Staphylococcus aureus subsp. aureus N315
acuuucuacucugauuacaua

SEQ ID NO: 2157631 - RNA, 22 nt, Staphylococcus aureus subsp. aureus N315
acuuucucaucuauuuaauaau

SEQ ID NO: 2157632 - RNA, 18 nt, Staphylococcus aureus subsp. aureus N315
acuuucuuuuguuuuuau

SEQ ID NO: 2157633 - RNA, 20 nt, Staphylococcus aureus subsp. aureus N315
acuuugauaucuacagagaa

SEQ ID NO: 2157634 - RNA, 17 nt, Staphylococcus aureus subsp. aureus N315
acuuugauauguuuccu

SEQ ID NO: 2157635 - RNA, 17 nt, Staphylococcus aureus subsp. aureus N315
acuuuccgccuucaauc

SEQ ID NO: 2157636 - RNA, 16 nt, Staphylococcus aureus subsp. aureus N315
acuuucgcuugcaaag

SEQ ID NO: 2157637 - RNA, 14 nt, Staphylococcus aureus subsp. aureus N315
acuuucgaucuucu

SEQ ID NO: 2157638 - RNA, 16 nt, Staphylococcus aureus subsp. aureus N315
acuuucguauuuuucu

SEQ ID NO: 2157639 - RNA, 19 nt, Staphylococcus aureus subsp. aureus N315
acuuuggaaauuuauuaua

SEQ ID NO: 2157640 - RNA, 16 nt, Staphylococcus aureus subsp. aureus N315
acuuuuacaaucauca

SEQ ID NO: 2157641 - RNA, 23 nt, Staphylococcus aureus subsp. aureus N315
acuuuuacuuucucaucuauuua

SEQ ID NO: 2157642 - RNA, 15 nt, Staphylococcus aureus subsp. aureus N315
acuuuuagaguuuuu

SEQ ID NO: 2157643 - RNA, 21 nt, Staphylococcus aureus subsp. aureus N315
acuuuguucugcuuuuucuuu

SEQ ID NO: 2157644 - RNA, 19 nt, Staphylococcus aureus subsp. aureus N315
acuuuguucugcuuuuucu

SEQ ID NO: 2157645 - RNA, 22 nt, Staphylococcus aureus subsp. aureus N315
acuuuguucugcuuuuucuuua

SEQ ID NO: 2157646 - RNA, 20 nt, Staphylococcus aureus subsp. aureus N315
acuuuguggauucucuuuau

SEQ ID NO: 2157647 - RNA, 21 nt, Staphylococcus aureus subsp. aureus N315
acuuugugugcuuuaucucua

SEQ ID NO: 2157648 - RNA, 14 nt, Staphylococcus aureus subsp. aureus N315
agaaucaauuauug

SEQ ID NO: 2157649 - RNA, 19 nt, Staphylococcus aureus subsp. aureus N315
agaaucaauuauugaaaac

SEQ ID NO: 2157650 - RNA, 18 nt, Staphylococcus aureus subsp. aureus N315
agaaucaaccguuuuauu

SEQ ID NO: 2157651 - RNA, 13 nt, Staphylococcus aureus subsp. aureus N315
agaaucaucuaaa

SEQ ID NO: 2157652 - RNA, 13 nt, Staphylococcus aureus subsp. aureus N315
agaauauauguau

SEQ ID NO: 2157653 - RNA, 11 nt, Staphylococcus aureus subsp. aureus N315
agaauauuaag

SEQ ID NO: 2157654 - RNA, 13 nt, Staphylococcus aureus subsp. aureus N315
agaauauucagau

SEQ ID NO: 2157655 - RNA, 23 nt, Staphylococcus aureus subsp. aureus N315
agaaucuuggaaguaucugugaa

SEQ ID NO: 2157656 - RNA, 15 nt, Staphylococcus aureus subsp. aureus N315
agaaucuccauuuaa

SEQ ID NO: 2157657 - RNA, 20 nt, Staphylococcus aureus subsp. aureus N315
agaauuaguacuugaaacau

SEQ ID NO: 2157658 - RNA, 12 nt, Staphylococcus aureus subsp. aureus N315
agaauuauucaa

SEQ ID NO: 2157659 - RNA, 19 nt, Staphylococcus aureus subsp. aureus N315
agaauucacgcaauaucau

SEQ ID NO: 2157660 - RNA, 17 nt, Staphylococcus aureus subsp. aureus N315
agaauucagcugaugcu

SEQ ID NO: 2157661 - RNA, 19 nt, Staphylococcus aureus subsp. aureus N315
agaaguuguuuagaaaagu

SEQ ID NO: 2157662 - RNA, 14 nt, Staphylococcus aureus subsp. aureus N315
agaaguuguuuaga

SEQ ID NO: 2157663 - RNA, 15 nt, Staphylococcus aureus subsp. aureus N315
agaaguuuuuugauu

SEQ ID NO: 2157664 - RNA, 16 nt, Staphylococcus aureus subsp. aureus N315
agaauaguuaccaaaa

SEQ ID NO: 2157665 - RNA, 18 nt, Staphylococcus aureus subsp. aureus N315
agaauaguuaccaaaauu

SEQ ID NO: 2157666 - RNA, 17 nt, Staphylococcus aureus subsp. aureus N315
agaauaguuaccaaaau

SEQ ID NO: 2157667 - RNA, 13 nt, Staphylococcus aureus subsp. aureus N315
agaauaaaaaagu

SEQ ID NO: 2157668 - RNA, 14 nt, Staphylococcus aureus subsp. aureus N315
agaauaaacuuuau

SEQ ID NO: 2157669 - RNA, 12 nt, Staphylococcus aureus subsp. aureus N315
agaauaaaaggc

SEQ ID NO: 2157670 - RNA, 17 nt, Staphylococcus aureus subsp. aureus N315
agaauacaaauauuaag

SEQ ID NO: 2157671 - RNA, 14 nt, Staphylococcus aureus subsp. aureus N315
agaauacaaauauu

SEQ ID NO: 2157672 - RNA, 20 nt, Staphylococcus aureus subsp. aureus N315
agaauaacgucauauguuuu

SEQ ID NO: 2157673 - RNA, 13 nt, Staphylococcus aureus subsp. aureus N315
agaaacacaagga

SEQ ID NO: 2157674 - RNA, 16 nt, Staphylococcus aureus subsp. aureus N315
agaaacacaaggaaua

SEQ ID NO: 2157675 - RNA, 22 nt, Staphylococcus aureus subsp. aureus N315
aaaacagaggucuucgcaauca

SEQ ID NO: 2157676 - RNA, 22 nt, Staphylococcus aureus subsp. aureus N315
aaaacacccugcuuaucauuac

SEQ ID NO: 2157677 - RNA, 23 nt, Staphylococcus aureus subsp. aureus N315
agaaacuauagauaggauauuuu

SEQ ID NO: 2157678 - RNA, 16 nt, Staphylococcus aureus subsp. aureus N315
agaaaugucaguuuug

SEQ ID NO: 2157679 - RNA, 22 nt, Staphylococcus aureus subsp. aureus N315
agaaauguuaacgauagacauu

SEQ ID NO: 2157680 - RNA, 15 nt, Staphylococcus aureus subsp. aureus N315
agaaauuuaauacaa

SEQ ID NO: 2157681 - RNA, 17 nt, Staphylococcus aureus subsp. aureus N315
agaaauuuaauacaauu

SEQ ID NO: 2157682 - RNA, 17 nt, Staphylococcus aureus subsp. aureus N315
agaaaucucuaucgccu

SEQ ID NO: 2157683 - RNA, 14 nt, Staphylococcus aureus subsp. aureus N315
agaaaucaccagau

SEQ ID NO: 2157684 - RNA, 12 nt, Staphylococcus aureus subsp. aureus N315
agaaaucaccag

SEQ ID NO: 2157685 - RNA, 23 nt, Staphylococcus aureus subsp. aureus N315
agaacuuuaaaaauugcaaugcu

SEQ ID NO: 2157686 - RNA, 16 nt, Staphylococcus aureus subsp. aureus N315
agaagaaacuuaauca

SEQ ID NO: 2157687 - RNA, 14 nt, Staphylococcus aureus subsp. aureus N315
agaaccaacaauaa

SEQ ID NO: 2157688 - RNA, 18 nt, Staphylococcus aureus subsp. aureus N315
agaaccacgcaucaugua

SEQ ID NO: 2157689 - RNA, 15 nt, Staphylococcus aureus subsp. aureus N315
agaaccaaaauuaua

SEQ ID NO: 2157690 - RNA, 23 nt, Staphylococcus aureus subsp. aureus N315
agaacauuuaucgugaagaaaaa

SEQ ID NO: 2157691 - RNA, 14 nt, Staphylococcus aureus subsp. aureus N315
agaacgagaauuuc

SEQ ID NO: 2157692 - RNA, 21 nt, Staphylococcus aureus subsp. aureus N315
agaaccuuuaaaaguaacaua

SEQ ID NO: 2157693 - RNA, 15 nt, Staphylococcus aureus subsp. aureus N315
agaaccuuuaaaagu

SEQ ID NO: 2157694 - RNA, 18 nt, Staphylococcus aureus subsp. aureus N315
agaaccuuuaaaaguaac

SEQ ID NO: 2157695 - RNA, 19 nt, Staphylococcus aureus subsp. aureus N315
agaaccuuuuuguuuucaa

SEQ ID NO: 2157696 - RNA, 13 nt, Staphylococcus aureus subsp. aureus N315
agaaccuuucuug

SEQ ID NO: 2157697 - RNA, 21 nt, Staphylococcus aureus subsp. aureus N315
agaaccuugaaugauauuaac

SEQ ID NO: 2157698 - RNA, 14 nt, Staphylococcus aureus subsp. aureus N315
agauaauuauuucu

SEQ ID NO: 2157699 - RNA, 15 nt, Staphylococcus aureus subsp. aureus N315
agauaggaaacuuaa

SEQ ID NO: 2157700 - RNA, 20 nt, Staphylococcus aureus subsp. aureus N315
agauaggaaacuuaaauauu

SEQ ID NO: 2157701 - RNA, 23 nt, Staphylococcus aureus subsp. aureus N315
agauauagcaucuaugauuguau

SEQ ID NO: 2157702 - RNA, 23 nt, Staphylococcus aureus subsp. aureus N315
agaguaguucggaugagaaaugu

SEQ ID NO: 2157703 - RNA, 20 nt, Staphylococcus aureus subsp. aureus N315
agaguuuuuauuauuaggcg

SEQ ID NO: 2157704 - RNA, 17 nt, Staphylococcus aureus subsp. aureus N315
agaguuuuuauuauuag

SEQ ID NO: 2157705 - RNA, 17 nt, Staphylococcus aureus subsp. aureus N315
agauaaauuaauaugaa

SEQ ID NO: 2157706 - RNA, 16 nt, Staphylococcus aureus subsp. aureus N315
agauaaauuaauauga

SEQ ID NO: 2157707 - RNA, 21 nt, Staphylococcus aureus subsp. aureus N315
agaucucaauccaauuaaaua

SEQ ID NO: 2157708 - RNA, 16 nt, Staphylococcus aureus subsp. aureus N315
agaugauacauucuau

SEQ ID NO: 2157709 - RNA, 21 nt, Staphylococcus aureus subsp. aureus N315
agaugaucagggaaaucaucu

SEQ ID NO: 2157710 - RNA, 19 nt, Staphylococcus aureus subsp. aureus N315
agaugauugucuagcagag

SEQ ID NO: 2157711 - RNA, 16 nt, Staphylococcus aureus subsp. aureus N315
agaugauugucuagca

SEQ ID NO: 2157712 - RNA, 16 nt, Staphylococcus aureus subsp. aureus N315
agaugauucuuaucau

SEQ ID NO: 2157713 - RNA, 15 nt, Staphylococcus aureus subsp. aureus N315
agaugaugcuucgca

SEQ ID NO: 2157714 - RNA, 15 nt, Staphylococcus aureus subsp. aureus N315
agauguuucaaaaua

SEQ ID NO: 2157715 - RNA, 21 nt, Staphylococcus aureus subsp. aureus N315
agauguugguucaucaaacaa

SEQ ID NO: 2157716 - RNA, 16 nt, Staphylococcus aureus subsp. aureus N315
agauguugaugaagua

SEQ ID NO: 2157717 - RNA, 19 nt, Staphylococcus aureus subsp. aureus N315
agauuaaaauaugacacau

SEQ ID NO: 2157718 - RNA, 22 nt, Staphylococcus aureus subsp. aureus N315
agauguuugcaacauauuuuca

SEQ ID NO: 2157719 - RNA, 13 nt, Staphylococcus aureus subsp. aureus N315
agauuaaaaaauc

SEQ ID NO: 2157720 - RNA, 16 nt, Staphylococcus aureus subsp. aureus N315
agauuaaaaaaucauu

SEQ ID NO: 2157721 - RNA, 19 nt, Staphylococcus aureus subsp. aureus N315
agaugcuugaccuucaguu

SEQ ID NO: 2157722 - RNA, 17 nt, Staphylococcus aureus subsp. aureus N315
agauggcugcaucaaua

SEQ ID NO: 2157723 - RNA, 20 nt, Staphylococcus aureus subsp. aureus N315
agauggucuuuuaauuaaaa

SEQ ID NO: 2157724 - RNA, 17 nt, Staphylococcus aureus subsp. aureus N315
agauggcuuuuuuugcu

SEQ ID NO: 2157725 - RNA, 17 nt, Staphylococcus aureus subsp. aureus N315
agagacuuauuuuauac

SEQ ID NO: 2157726 - RNA, 12 nt, Staphylococcus aureus subsp. aureus N315
agagacauuuua

SEQ ID NO: 2157727 - RNA, 17 nt, Staphylococcus aureus subsp. aureus N315
agagaauuucgaaaaga

SEQ ID NO: 2157728 - RNA, 18 nt, Staphylococcus aureus subsp. aureus N315
agagaauuucgaaaagaa

SEQ ID NO: 2157729 - RNA, 19 nt, Staphylococcus aureus subsp. aureus N315
agagaauuucgaaaagaaa

SEQ ID NO: 2157730 - RNA, 21 nt, Staphylococcus aureus subsp. aureus N315
agagaauuucgaaaagaaauu

SEQ ID NO: 2157731 - RNA, 23 nt, Staphylococcus aureus subsp. aureus N315
agagaauuuuaauuaauuaucau

SEQ ID NO: 2157732 - RNA, 19 nt, Staphylococcus aureus subsp. aureus N315
agagaauauagauuuugua

SEQ ID NO: 2157733 - RNA, 20 nt, Staphylococcus aureus subsp. aureus N315
agagaaguuucuauagaauu

SEQ ID NO: 2157734 - RNA, 13 nt, Staphylococcus aureus subsp. aureus N315
agagaagggagua

SEQ ID NO: 2157735 - RNA, 20 nt, Staphylococcus aureus subsp. aureus N315
agagaaucaauuauugaaaa

SEQ ID NO: 2157736 - RNA, 13 nt, Staphylococcus aureus subsp. aureus N315
agagaaucaauua

SEQ ID NO: 2157737 - RNA, 21 nt, Staphylococcus aureus subsp. aureus N315
agagaaacaaaacaaaaaaua

SEQ ID NO: 2157738 - RNA, 17 nt, Staphylococcus aureus subsp. aureus N315
agagaaacgugacggua

SEQ ID NO: 2157739 - RNA, 16 nt, Staphylococcus aureus subsp. aureus N315
agagaacgcuuuauua

SEQ ID NO: 2157740 - RNA, 20 nt, Staphylococcus aureus subsp. aureus N315
agagaacgcuuuauuacuuu

SEQ ID NO: 2157741 - RNA, 19 nt, Staphylococcus aureus subsp. aureus N315
agagaaauucgaaaagaaa

SEQ ID NO: 2157742 - RNA, 20 nt, Staphylococcus aureus subsp. aureus N315
agagaaauucgaaaagaaau

SEQ ID NO: 2157743 - RNA, 22 nt, Staphylococcus aureus subsp. aureus N315
agacuugguuacuuaguaagga

SEQ ID NO: 2157744 - RNA, 22 nt, Staphylococcus aureus subsp. aureus N315
agacuuucuugaugaauuaaac

SEQ ID NO: 2157745 - RNA, 16 nt, Staphylococcus aureus subsp. aureus N315
agacuucuuucaauua

SEQ ID NO: 2157746 - RNA, 19 nt, Staphylococcus aureus subsp. aureus N315
agacuuauuugaaugcaaa

SEQ ID NO: 2157747 - RNA, 16 nt, Staphylococcus aureus subsp. aureus N315
agacuccuaaauuauu

SEQ ID NO: 2157748 - RNA, 22 nt, Staphylococcus aureus subsp. aureus N315
agacucaauuucauuugaaaua

SEQ ID NO: 2157749 - RNA, 13 nt, Staphylococcus aureus subsp. aureus N315
agacucacuucuu

SEQ ID NO: 2157750 - RNA, 14 nt, Staphylococcus aureus subsp. aureus N315
agacucacuucuua

SEQ ID NO: 2157751 - RNA, 13 nt, Staphylococcus aureus subsp. aureus N315
agacucaaggaaa

SEQ ID NO: 2157752 - RNA, 17 nt, Staphylococcus aureus subsp. aureus N315
agacucaaggaaaucau

SEQ ID NO: 2157753 - RNA, 16 nt, Staphylococcus aureus subsp. aureus N315
agacgcuguuuuaaau

SEQ ID NO: 2157754 - RNA, 17 nt, Staphylococcus aureus subsp. aureus N315
agaauuucgaaaagaaa

SEQ ID NO: 2157755 - RNA, 18 nt, Staphylococcus aureus subsp. aureus N315
agaauuucgaaaagaaau

SEQ ID NO: 2157756 - RNA, 20 nt, Staphylococcus aureus subsp. aureus N315
agaauuuuaauuaauuauca

SEQ ID NO: 2157757 - RNA, 22 nt, Staphylococcus aureus subsp. aureus N315
agacccaccguuaaaauauaug

SEQ ID NO: 2157758 - RNA, 14 nt, Staphylococcus aureus subsp. aureus N315
agaccccgaaaaga

SEQ ID NO: 2157759 - RNA, 13 nt, Staphylococcus aureus subsp. aureus N315
agaccuaugaauu

SEQ ID NO: 2157760 - RNA, 15 nt, Staphylococcus aureus subsp. aureus N315
aaaacaucuacauca

SEQ ID NO: 2157761 - RNA, 12 nt, Staphylococcus aureus subsp. aureus N315
agacgaacauca

SEQ ID NO: 2157762 - RNA, 15 nt, Staphylococcus aureus subsp. aureus N315
acagcuacaaauaau

SEQ ID NO: 2157763 - RNA, 14 nt, Staphylococcus aureus subsp. aureus N315
acagcuuuuucuac

SEQ ID NO: 2157764 - RNA, 14 nt, Staphylococcus aureus subsp. aureus N315
acacguguaaaaau

SEQ ID NO: 2157765 - RNA, 18 nt, Staphylococcus aureus subsp. aureus N315
acagcaguaggauaauuu

SEQ ID NO: 2157766 - RNA, 22 nt, Staphylococcus aureus subsp. aureus N315
acagcaguaggauaauuucaau

SEQ ID NO: 2157767 - RNA, 22 nt, Staphylococcus aureus subsp. aureus N315
acagcaguaagacgauuucaau

SEQ ID NO: 2157768 - RNA, 14 nt, Staphylococcus aureus subsp. aureus N315
acagcaguaagaua

SEQ ID NO: 2157769 - RNA, 17 nt, Staphylococcus aureus subsp. aureus N315
acaguggauuacagaug

SEQ ID NO: 2157770 - RNA, 15 nt, Staphylococcus aureus subsp. aureus N315
acaguuacuucaguu

SEQ ID NO: 2157771 - RNA, 22 nt, Staphylococcus aureus subsp. aureus N315
acaguuacuuucgcuugcaaag

SEQ ID NO: 2157772 - RNA, 14 nt, Staphylococcus aureus subsp. aureus N315
acaguuauauauuc

SEQ ID NO: 2157773 - RNA, 20 nt, Staphylococcus aureus subsp. aureus N315
acaguucuauagguuuauaa

SEQ ID NO: 2157774 - RNA, 23 nt, Staphylococcus aureus subsp. aureus N315
acaguuuuauuaucuuuguaaau

SEQ ID NO: 2157775 - RNA, 13 nt, Staphylococcus aureus subsp. aureus N315
acaguuuuaaaug

SEQ ID NO: 2157776 - RNA, 13 nt, Staphylococcus aureus subsp. aureus N315
acauaaaauuuaa

SEQ ID NO: 2157777 - RNA, 14 nt, Staphylococcus aureus subsp. aureus N315
acauaaaauuuaaa

SEQ ID NO: 2157778 - RNA, 17 nt, Staphylococcus aureus subsp. aureus N315
acauaacagcuaaaaau

SEQ ID NO: 2157779 - RNA, 18 nt, Staphylococcus aureus subsp. aureus N315
acauaaaucccuaaaaaa

SEQ ID NO: 2157780 - RNA, 14 nt, Staphylococcus aureus subsp. aureus N315
acauaacacaaguu

SEQ ID NO: 2157781 - RNA, 15 nt, Staphylococcus aureus subsp. aureus N315
acauaaccuugcuuu

SEQ ID NO: 2157782 - RNA, 18 nt, Staphylococcus aureus subsp. aureus N315
acauaaaugcuaaaagua

SEQ ID NO: 2157783 - RNA, 12 nt, Staphylococcus aureus subsp. aureus N315
acauaaaucaau

SEQ ID NO: 2157784 - RNA, 21 nt, Staphylococcus aureus subsp. aureus N315
acauaaauauggauuuugaag

SEQ ID NO: 2157785 - RNA, 16 nt, Staphylococcus aureus subsp. aureus N315
acauaaauacaaaaau

SEQ ID NO: 2157786 - RNA, 17 nt, Staphylococcus aureus subsp. aureus N315
acauaaauacaaaaaua

SEQ ID NO: 2157787 - RNA, 22 nt, Staphylococcus aureus subsp. aureus N315
acaguaguuaauugaaugaaaa

SEQ ID NO: 2157788 - RNA, 23 nt, Staphylococcus aureus subsp. aureus N315
acaguaguuaauugaaugaaaau

SEQ ID NO: 2157789 - RNA, 14 nt, Staphylococcus aureus subsp. aureus N315
acaguaucuucagu

SEQ ID NO: 2157790 - RNA, 17 nt, Staphylococcus aureus subsp. aureus N315
acaguacaaauaacaaa

SEQ ID NO: 2157791 - RNA, 20 nt, Staphylococcus aureus subsp. aureus N315
acaguacacuaaguuuucuu

SEQ ID NO: 2157792 - RNA, 15 nt, Staphylococcus aureus subsp. aureus N315
acagguuuaaacauc

SEQ ID NO: 2157793 - RNA, 15 nt, Staphylococcus aureus subsp. aureus N315
acaucauucacaagu

SEQ ID NO: 2157794 - RNA, 15 nt, Staphylococcus aureus subsp. aureus N315
acaucauuaaauauu

SEQ ID NO: 2157795 - RNA, 22 nt, Staphylococcus aureus subsp. aureus N315
acaucauugauagauagaaauu

SEQ ID NO: 2157796 - RNA, 22 nt, Staphylococcus aureus subsp. aureus N315
acauccucauaauuaucauaua

SEQ ID NO: 2157797 - RNA, 17 nt, Staphylococcus aureus subsp. aureus N315
acaucaucuuuaauuuu

SEQ ID NO: 2157798 - RNA, 14 nt, Staphylococcus aureus subsp. aureus N315
acaucaauaucuuc

SEQ ID NO: 2157799 - RNA, 21 nt, Staphylococcus aureus subsp. aureus N315
acauaaggucuuggacuaaua

SEQ ID NO: 2157800 - RNA, 18 nt, Staphylococcus aureus subsp. aureus N315
acauaagaugauuuagac

SEQ ID NO: 2157801 - RNA, 12 nt, Staphylococcus aureus subsp. aureus N315
acauaaugacau

SEQ ID NO: 2157802 - RNA, 20 nt, Staphylococcus aureus subsp. aureus N315
acauaauuaacuuucuuuug

SEQ ID NO: 2157803 - RNA, 13 nt, Staphylococcus aureus subsp. aureus N315
acauguacaauuu

SEQ ID NO: 2157804 - RNA, 20 nt, Staphylococcus aureus subsp. aureus N315
acauguacguuuuuuuaaau

SEQ ID NO: 2157805 - RNA, 18 nt, Staphylococcus aureus subsp. aureus N315
acauguauuuaguaucau

SEQ ID NO: 2157806 - RNA, 18 nt, Staphylococcus aureus subsp. aureus N315
acauguauuggccaaaca

SEQ ID NO: 2157807 - RNA, 12 nt, Staphylococcus aureus subsp. aureus N315
acaugugaaaua

SEQ ID NO: 2157808 - RNA, 18 nt, Staphylococcus aureus subsp. aureus N315
acaucuacaucaaauuuu

SEQ ID NO: 2157809 - RNA, 16 nt, Staphylococcus aureus subsp. aureus N315
acaucuaauaaauaua

SEQ ID NO: 2157810 - RNA, 14 nt, Staphylococcus aureus subsp. aureus N315
acaucuaauaaaua

SEQ ID NO: 2157811 - RNA, 19 nt, Staphylococcus aureus subsp. aureus N315
acaucuaagugauauacga

SEQ ID NO: 2157812 - RNA, 21 nt, Staphylococcus aureus subsp. aureus N315
acaucuauguggcuacuugaa

SEQ ID NO: 2157813 - RNA, 16 nt, Staphylococcus aureus subsp. aureus N315
acaucuauaacaaaau

SEQ ID NO: 2157814 - RNA, 19 nt, Staphylococcus aureus subsp. aureus N315
acaucuauaacaaaaucuc

SEQ ID NO: 2157815 - RNA, 14 nt, Staphylococcus aureus subsp. aureus N315
acaucugaaaaaau

SEQ ID NO: 2157816 - RNA, 15 nt, Staphylococcus aureus subsp. aureus N315
acauuugguucuucu

SEQ ID NO: 2157817 - RNA, 20 nt, Staphylococcus aureus subsp. aureus N315
acauuuaggagccuagaaca

SEQ ID NO: 2157818 - RNA, 14 nt, Staphylococcus aureus subsp. aureus N315
acauuuaagaaacg

SEQ ID NO: 2157819 - RNA, 13 nt, Staphylococcus aureus subsp. aureus N315
acauuuaaauaua

SEQ ID NO: 2157820 - RNA, 22 nt, Staphylococcus aureus subsp. aureus N315
acauuuaagaaacgucuuaauu

SEQ ID NO: 2157821 - RNA, 22 nt, Staphylococcus aureus subsp. aureus N315
acauuuguaaauauuuuuuaaa

SEQ ID NO: 2157822 - RNA, 20 nt, Staphylococcus aureus subsp. aureus N315
acauuuguaaauauuuuuua

SEQ ID NO: 2157823 - RNA, 14 nt, Staphylococcus aureus subsp. aureus N315
acauuuuaugucca

SEQ ID NO: 2157824 - RNA, 17 nt, Staphylococcus aureus subsp. aureus N315
acauuuucaaaaccaau

SEQ ID NO: 2157825 - RNA, 22 nt, Staphylococcus aureus subsp. aureus N315
acauuuuaaaucuaauuauuca

SEQ ID NO: 2157826 - RNA, 14 nt, Staphylococcus aureus subsp. aureus N315
acauuuuaaaucua

SEQ ID NO: 2157827 - RNA, 16 nt, Staphylococcus aureus subsp. aureus N315
acauugauaaaauaau

SEQ ID NO: 2157828 - RNA, 22 nt, Staphylococcus aureus subsp. aureus N315
acauugaacgauaacaauuuau

SEQ ID NO: 2157829 - RNA, 12 nt, Staphylococcus aureus subsp. aureus N315
acauugaauaaa

SEQ ID NO: 2157830 - RNA, 13 nt, Staphylococcus aureus subsp. aureus N315
acauugaauaaau

SEQ ID NO: 2157831 - RNA, 22 nt, Staphylococcus aureus subsp. aureus N315
acauuaaugauagcaaugaauu

SEQ ID NO: 2157832 - RNA, 19 nt, Staphylococcus aureus subsp. aureus N315
acauuaaugauagcaauga

SEQ ID NO: 2157833 - RNA, 15 nt, Staphylococcus aureus subsp. aureus N315
acauuaaucuauaua

SEQ ID NO: 2157834 - RNA, 12 nt, Staphylococcus aureus subsp. aureus N315
acauuaauauaa

SEQ ID NO: 2157835 - RNA, 15 nt, Staphylococcus aureus subsp. aureus N315
acaugugggauaucu

SEQ ID NO: 2157836 - RNA, 16 nt, Staphylococcus aureus subsp. aureus N315
acauuagcaugauaaa

SEQ ID NO: 2157837 - RNA, 18 nt, Staphylococcus aureus subsp. aureus N315
acauucuugaauaaauuu

SEQ ID NO: 2157838 - RNA, 16 nt, Staphylococcus aureus subsp. aureus N315
acauucuucaaaaaau

SEQ ID NO: 2157839 - RNA, 14 nt, Staphylococcus aureus subsp. aureus N315
acauuuuuggcuua

SEQ ID NO: 2157840 - RNA, 16 nt, Staphylococcus aureus subsp. aureus N315
accaaaagaaauuuaa

SEQ ID NO: 2157841 - RNA, 19 nt, Staphylococcus aureus subsp. aureus N315
accaaaucggaauaaaaua

SEQ ID NO: 2157842 - RNA, 22 nt, Staphylococcus aureus subsp. aureus N315
accaaauaaauaagugauaaau

SEQ ID NO: 2157843 - RNA, 15 nt, Staphylococcus aureus subsp. aureus N315
accaaauaaauuaaa

SEQ ID NO: 2157844 - RNA, 17 nt, Staphylococcus aureus subsp. aureus N315
accaacaccuaauauuu

SEQ ID NO: 2157845 - RNA, 18 nt, Staphylococcus aureus subsp. aureus N315
accaacaccuaauauuuu

SEQ ID NO: 2157846 - RNA, 18 nt, Staphylococcus aureus subsp. aureus N315
accaaauuggccauugga

SEQ ID NO: 2157847 - RNA, 13 nt, Staphylococcus aureus subsp. aureus N315
acaaccaucagca

SEQ ID NO: 2157848 - RNA, 17 nt, Staphylococcus aureus subsp. aureus N315
acaaccgucccauaaaa

SEQ ID NO: 2157849 - RNA, 21 nt, Staphylococcus aureus subsp. aureus N315
acaacaucgauuuaucauuau

SEQ ID NO: 2157850 - RNA, 21 nt, Staphylococcus aureus subsp. aureus N315
acaaauuugaauauacuuaau

SEQ ID NO: 2157851 - RNA, 23 nt, Staphylococcus aureus subsp. aureus N315
acaaauuugaauauacuuaauuu

SEQ ID NO: 2157852 - RNA, 22 nt, Staphylococcus aureus subsp. aureus N315
acaaauugcaauggcaaccuuu

SEQ ID NO: 2157853 - RNA, 14 nt, Staphylococcus aureus subsp. aureus N315
acaacauaacaaag

SEQ ID NO: 2157854 - RNA, 14 nt, Staphylococcus aureus subsp. aureus N315
acaacacauaaauu

SEQ ID NO: 2157855 - RNA, 16 nt, Staphylococcus aureus subsp. aureus N315
acaaagucauuuucau

SEQ ID NO: 2157856 - RNA, 21 nt, Staphylococcus aureus subsp. aureus N315
acaaauaaaggcaacaaauau

SEQ ID NO: 2157857 - RNA, 14 nt, Staphylococcus aureus subsp. aureus N315
acaaaguuaaccau

SEQ ID NO: 2157858 - RNA, 14 nt, Staphylococcus aureus subsp. aureus N315
acaaauauuucuaa

SEQ ID NO: 2157859 - RNA, 12 nt, Staphylococcus aureus subsp. aureus N315
acaaauauguaa

SEQ ID NO: 2157860 - RNA, 18 nt, Staphylococcus aureus subsp. aureus N315
acaaauauuagaacauuu

SEQ ID NO: 2157861 - RNA, 23 nt, Staphylococcus aureus subsp. aureus N315
acaaauauacuugccuucaaauu

SEQ ID NO: 2157862 - RNA, 23 nt, Staphylococcus aureus subsp. aureus N315
acaaauauaauguauaaaacaga

SEQ ID NO: 2157863 - RNA, 13 nt, Staphylococcus aureus subsp. aureus N315
acaaauaucaauu

SEQ ID NO: 2157864 - RNA, 11 nt, Staphylococcus aureus subsp. aureus N315
acaaaugaaaa

SEQ ID NO: 2157865 - RNA, 22 nt, Staphylococcus aureus subsp. aureus N315
acaaaugaagguguugaaaagu

SEQ ID NO: 2157866 - RNA, 19 nt, Staphylococcus aureus subsp. aureus N315
acaaaucuuuuaaauuuag

SEQ ID NO: 2157867 - RNA, 16 nt, Staphylococcus aureus subsp. aureus N315
acaaaucuauaaauau

SEQ ID NO: 2157868 - RNA, 20 nt, Staphylococcus aureus subsp. aureus N315
acaaaucaugacauaaaacu

SEQ ID NO: 2157869 - RNA, 18 nt, Staphylococcus aureus subsp. aureus N315
acaaauuaaaaagguacu

SEQ ID NO: 2157870 - RNA, 16 nt, Staphylococcus aureus subsp. aureus N315
acaaauguauaaauaa

SEQ ID NO: 2157871 - RNA, 18 nt, Staphylococcus aureus subsp. aureus N315
acaaauguauaaauaaua

SEQ ID NO: 2157872 - RNA, 19 nt, Staphylococcus aureus subsp. aureus N315
acaaagcucaauaaauuau

SEQ ID NO: 2157873 - RNA, 21 nt, Staphylococcus aureus subsp. aureus N315
acaaaggauuauuaacuuuaa

SEQ ID NO: 2157874 - RNA, 13 nt, Staphylococcus aureus subsp. aureus N315
acaaacuucacau

SEQ ID NO: 2157875 - RNA, 20 nt, Staphylococcus aureus subsp. aureus N315
acaaagaauuucgaaaagaa

SEQ ID NO: 2157876 - RNA, 22 nt, Staphylococcus aureus subsp. aureus N315
acaaagaauuucgaaaagaaau

SEQ ID NO: 2157877 - RNA, 18 nt, Staphylococcus aureus subsp. aureus N315
acaaaauugucucacuug

SEQ ID NO: 2157878 - RNA, 15 nt, Staphylococcus aureus subsp. aureus N315
acaaacaaaagcacc

SEQ ID NO: 2157879 - RNA, 23 nt, Staphylococcus aureus subsp. aureus N315
acaaacauaaauaagcaguaaga

SEQ ID NO: 2157880 - RNA, 18 nt, Staphylococcus aureus subsp. aureus N315
acaaaaucucaacagcaa

SEQ ID NO: 2157881 - RNA, 14 nt, Staphylococcus aureus subsp. aureus N315
acaaaauaacaugu

SEQ ID NO: 2157882 - RNA, 16 nt, Staphylococcus aureus subsp. aureus N315
acaaaauaacauguuu

SEQ ID NO: 2157883 - RNA, 19 nt, Staphylococcus aureus subsp. aureus N315
acaaaaguaugauuuguuu

SEQ ID NO: 2157884 - RNA, 20 nt, Staphylococcus aureus subsp. aureus N315
acaaaacaaauccauuaaau

SEQ ID NO: 2157885 - RNA, 16 nt, Staphylococcus aureus subsp. aureus N315
aauuuagugaaacaau

SEQ ID NO: 2157886 - RNA, 15 nt, Staphylococcus aureus subsp. aureus N315
aauuuaguccuucuu

SEQ ID NO: 2157887 - RNA, 17 nt, Staphylococcus aureus subsp. aureus N315
aauuuauaaaaagagau

SEQ ID NO: 2157888 - RNA, 19 nt, Staphylococcus aureus subsp. aureus N315
acaaaaagaauuucgaaaa

SEQ ID NO: 2157889 - RNA, 22 nt, Staphylococcus aureus subsp. aureus N315
acaaaaagaauuucgaaaagaa

SEQ ID NO: 2157890 - RNA, 12 nt, Staphylococcus aureus subsp. aureus N315
acaaaacauauu

SEQ ID NO: 2157891 - RNA, 22 nt, Staphylococcus aureus subsp. aureus N315
acaccaauugaauauuuuucaa

SEQ ID NO: 2157892 - RNA, 18 nt, Staphylococcus aureus subsp. aureus N315
acacccauuugucuuaau

SEQ ID NO: 2157893 - RNA, 14 nt, Staphylococcus aureus subsp. aureus N315
acaccccaacuugc

SEQ ID NO: 2157894 - RNA, 12 nt, Staphylococcus aureus subsp. aureus N315
acaccccaacuc

SEQ ID NO: 2157895 - RNA, 21 nt, Staphylococcus aureus subsp. aureus N315
acacauuauugaaauuuuuaa

SEQ ID NO: 2157896 - RNA, 22 nt, Staphylococcus aureus subsp. aureus N315
acacauucuuauuugaaaugau

SEQ ID NO: 2157897 - RNA, 17 nt, Staphylococcus aureus subsp. aureus N315
acacaaauuaaaacucg

SEQ ID NO: 2157898 - RNA, 22 nt, Staphylococcus aureus subsp. aureus N315
acacaaauuuuuuguaaacaug

SEQ ID NO: 2157899 - RNA, 12 nt, Staphylococcus aureus subsp. aureus N315
acacaaagaauu

SEQ ID NO: 2157900 - RNA, 22 nt, Staphylococcus aureus subsp. aureus N315
acacaaagaauuucgaaaagaa

SEQ ID NO: 2157901 - RNA, 15 nt, Staphylococcus aureus subsp. aureus N315
acaauuuuguacauu

SEQ ID NO: 2157902 - RNA, 18 nt, Staphylococcus aureus subsp. aureus N315
acaauuuuguacauuucu

SEQ ID NO: 2157903 - RNA, 16 nt, Staphylococcus aureus subsp. aureus N315
acaauuuucucauuaa

SEQ ID NO: 2157904 - RNA, 18 nt, Staphylococcus aureus subsp. aureus N315
acaauuuuugggaagaau

SEQ ID NO: 2157905 - RNA, 22 nt, Staphylococcus aureus subsp. aureus N315
acaccugguacauaaauaccug

SEQ ID NO: 2157906 - RNA, 20 nt, Staphylococcus aureus subsp. aureus N315
acaccuuaucacuuggaaua

SEQ ID NO: 2157907 - RNA, 14 nt, Staphylococcus aureus subsp. aureus N315
acaccuucaauauc

SEQ ID NO: 2157908 - RNA, 14 nt, Staphylococcus aureus subsp. aureus N315
acacgauaauuaua

SEQ ID NO: 2157909 - RNA, 15 nt, Staphylococcus aureus subsp. aureus N315
acaagguuucaagag

SEQ ID NO: 2157910 - RNA, 15 nt, Staphylococcus aureus subsp. aureus N315
acaaguacaauaaua

SEQ ID NO: 2157911 - RNA, 16 nt, Staphylococcus aureus subsp. aureus N315
acaauaaugugcaagu

SEQ ID NO: 2157912 - RNA, 16 nt, Staphylococcus aureus subsp. aureus N315
acaaguugcugaauaa

SEQ ID NO: 2157913 - RNA, 19 nt, Staphylococcus aureus subsp. aureus N315
acaaguugcugaauaaaau

SEQ ID NO: 2157914 - RNA, 20 nt, Staphylococcus aureus subsp. aureus N315
acaaguugcugaauaaaaua

SEQ ID NO: 2157915 - RNA, 15 nt, Staphylococcus aureus subsp. aureus N315
acaauacaaaucgau

SEQ ID NO: 2157916 - RNA, 15 nt, Staphylococcus aureus subsp. aureus N315
acaauacgaaaucaa

SEQ ID NO: 2157917 - RNA, 17 nt, Staphylococcus aureus subsp. aureus N315
acaauacgaaaucaaaa

SEQ ID NO: 2157918 - RNA, 22 nt, Staphylococcus aureus subsp. aureus N315
acaauacgaaaucaaaaauaau

SEQ ID NO: 2157919 - RNA, 19 nt, Staphylococcus aureus subsp. aureus N315
acaauacuucguauugaau

SEQ ID NO: 2157920 - RNA, 19 nt, Staphylococcus aureus subsp. aureus N315
acaauauuaaaauuaaaac

SEQ ID NO: 2157921 - RNA, 13 nt, Staphylococcus aureus subsp. aureus N315
acaauugcagaga

SEQ ID NO: 2157922 - RNA, 22 nt, Staphylococcus aureus subsp. aureus N315
acaauuuuccuuccaauaauaa

SEQ ID NO: 2157923 - RNA, 15 nt, Staphylococcus aureus subsp. aureus N315
acaauugcuaaucca

SEQ ID NO: 2157924 - RNA, 13 nt, Staphylococcus aureus subsp. aureus N315
acaaugcagcugu

SEQ ID NO: 2157925 - RNA, 17 nt, Staphylococcus aureus subsp. aureus N315
acaaugcgcaaugaaaa

SEQ ID NO: 2157926 - RNA, 17 nt, Staphylococcus aureus subsp. aureus N315
acaauucauaagaaaaa

SEQ ID NO: 2157927 - RNA, 14 nt, Staphylococcus aureus subsp. aureus N315
acaauucaagacca

SEQ ID NO: 2157928 - RNA, 20 nt, Staphylococcus aureus subsp. aureus N315
acaauucaagaccaugcaaa

SEQ ID NO: 2157929 - RNA, 14 nt, Staphylococcus aureus subsp. aureus N315
acaauucauuaaua

SEQ ID NO: 2157930 - RNA, 14 nt, Staphylococcus aureus subsp. aureus N315
acaaugauuaaaau

SEQ ID NO: 2157931 - RNA, 19 nt, Staphylococcus aureus subsp. aureus N315
acaaucguuuuaaugccug

SEQ ID NO: 2157932 - RNA, 15 nt, Staphylococcus aureus subsp. aureus N315
acaaucagauaaguu

SEQ ID NO: 2157933 - RNA, 24 nt, Staphylococcus aureus subsp. aureus N315
acaaucagauaaguuacuagcauu

SEQ ID NO: 2157934 - RNA, 14 nt, Staphylococcus aureus subsp. aureus N315
acaaucacagcaau

SEQ ID NO: 2157935 - RNA, 15 nt, Staphylococcus aureus subsp. aureus N315
acaaucacaaauuca

SEQ ID NO: 2157936 - RNA, 15 nt, Staphylococcus aureus subsp. aureus N315
acaaucacaguauga

SEQ ID NO: 2157937 - RNA, 19 nt, Staphylococcus aureus subsp. aureus N315
acaaucacaguaugauuag

SEQ ID NO: 2157938 - RNA, 18 nt, Staphylococcus aureus subsp. aureus N315
acaaucacagcaauaaua

SEQ ID NO: 2157939 - RNA, 19 nt, Staphylococcus aureus subsp. aureus N315
acaaucacagcaauaauaa

SEQ ID NO: 2157940 - RNA, 24 nt, Staphylococcus aureus subsp. aureus N315
acaaucaaauuacaaauuaucuag

SEQ ID NO: 2157941 - RNA, 21 nt, Staphylococcus aureus subsp. aureus N315
acaaucaacuuagaauuuaca

SEQ ID NO: 2157942 - RNA, 23 nt, Staphylococcus aureus subsp. aureus N315
acaauauuuuuacauauuuauac

SEQ ID NO: 2157943 - RNA, 19 nt, Staphylococcus aureus subsp. aureus N315
acaauauuuaccacaaaua

SEQ ID NO: 2157944 - RNA, 21 nt, Staphylococcus aureus subsp. aureus N315
aauccagccacaccaaauugg

SEQ ID NO: 2157945 - RNA, 21 nt, Staphylococcus aureus subsp. aureus N315
aauccaaaaucuuuacuugua

SEQ ID NO: 2157946 - RNA, 19 nt, Staphylococcus aureus subsp. aureus N315
aauccaaagcugaauuuua

SEQ ID NO: 2157947 - RNA, 15 nt, Staphylococcus aureus subsp. aureus N315
aaucaugcauucuau

SEQ ID NO: 2157948 - RNA, 15 nt, Staphylococcus aureus subsp. aureus N315
aaucaugacauaaaa

SEQ ID NO: 2157949 - RNA, 15 nt, Staphylococcus aureus subsp. aureus N315
aaucaucuuuuugaa

SEQ ID NO: 2157950 - RNA, 13 nt, Staphylococcus aureus subsp. aureus N315
aaucaugacauaa

SEQ ID NO: 2157951 - RNA, 17 nt, Staphylococcus aureus subsp. aureus N315
aaucaugaaauaaaaaa

SEQ ID NO: 2157952 - RNA, 22 nt, Staphylococcus aureus subsp. aureus N315
aaucaugaaauaaaaaaacacc

SEQ ID NO: 2157953 - RNA, 16 nt, Staphylococcus aureus subsp. aureus N315
aaucauuuauguagau

SEQ ID NO: 2157954 - RNA, 12 nt, Staphylococcus aureus subsp. aureus N315
aaucauuuaaau

SEQ ID NO: 2157955 - RNA, 17 nt, Staphylococcus aureus subsp. aureus N315
aaucauuuaaaucaaua

SEQ ID NO: 2157956 - RNA, 22 nt, Staphylococcus aureus subsp. aureus N315
aaucauguaaugcuuaaaaaca

SEQ ID NO: 2157957 - RNA, 16 nt, Staphylococcus aureus subsp. aureus N315
aaucagaugauuuaau

SEQ ID NO: 2157958 - RNA, 21 nt, Staphylococcus aureus subsp. aureus N315
aaucgauuaagaaugcaccaa

SEQ ID NO: 2157959 - RNA, 14 nt, Staphylococcus aureus subsp. aureus N315
aaucgauaacaguu

SEQ ID NO: 2157960 - RNA, 15 nt, Staphylococcus aureus subsp. aureus N315
aaucgauauaaugaa

SEQ ID NO: 2157961 - RNA, 13 nt, Staphylococcus aureus subsp. aureus N315
aauccucacuaac

SEQ ID NO: 2157962 - RNA, 17 nt, Staphylococcus aureus subsp. aureus N315
aauccuuggaaacgaua

SEQ ID NO: 2157963 - RNA, 23 nt, Staphylococcus aureus subsp. aureus N315
aauccguaacgaugguugcuuca

SEQ ID NO: 2157964 - RNA, 20 nt, Staphylococcus aureus subsp. aureus N315
aaucccuucaaaauuuugac

SEQ ID NO: 2157965 - RNA, 18 nt, Staphylococcus aureus subsp. aureus N315
aaucuacgauuuucaaga

SEQ ID NO: 2157966 - RNA, 19 nt, Staphylococcus aureus subsp. aureus N315
aaucuaaggccauuuguag

SEQ ID NO: 2157967 - RNA, 20 nt, Staphylococcus aureus subsp. aureus N315
aaucguuccaacaacuaaga

SEQ ID NO: 2157968 - RNA, 14 nt, Staphylococcus aureus subsp. aureus N315
aaucuauugcaaua

SEQ ID NO: 2157969 - RNA, 19 nt, Staphylococcus aureus subsp. aureus N315
aaucucaacagcaaaaaau

SEQ ID NO: 2157970 - RNA, 13 nt, Staphylococcus aureus subsp. aureus N315
aaucucaucuaac

SEQ ID NO: 2157971 - RNA, 16 nt, Staphylococcus aureus subsp. aureus N315
aaucucauaauaauuc

SEQ ID NO: 2157972 - RNA, 21 nt, Staphylococcus aureus subsp. aureus N315
aaucguauuagccaauaaaau

SEQ ID NO: 2157973 - RNA, 18 nt, Staphylococcus aureus subsp. aureus N315
aaucgugcccauaugauu

SEQ ID NO: 2157974 - RNA, 21 nt, Staphylococcus aureus subsp. aureus N315
aaaaauugcaaugcuaucaug

SEQ ID NO: 2157975 - RNA, 19 nt, Staphylococcus aureus subsp. aureus N315
aaaaauuguucaauauuua

SEQ ID NO: 2157976 - RNA, 22 nt, Staphylococcus aureus subsp. aureus N315
aaaaauuguucaauauuuauca

SEQ ID NO: 2157977 - RNA, 12 nt, Staphylococcus aureus subsp. aureus N315
aaaaauuucaau

SEQ ID NO: 2157978 - RNA, 16 nt, Staphylococcus aureus subsp. aureus N315
aaaaauuucaaaaaua

SEQ ID NO: 2157979 - RNA, 13 nt, Staphylococcus aureus subsp. aureus N315
aaaaauuuauuca

SEQ ID NO: 2157980 - RNA, 16 nt, Staphylococcus aureus subsp. aureus N315
aaucgcagcaaugaca

SEQ ID NO: 2157981 - RNA, 20 nt, Staphylococcus aureus subsp. aureus N315
aaucugcaacgauuuuaaaa

SEQ ID NO: 2157982 - RNA, 15 nt, Staphylococcus aureus subsp. aureus N315
aaucugauucauuaa

SEQ ID NO: 2157983 - RNA, 17 nt, Staphylococcus aureus subsp. aureus N315
aaucuuaguacaaaauu

SEQ ID NO: 2157984 - RNA, 18 nt, Staphylococcus aureus subsp. aureus N315
aaucuuaguacaaaauug

SEQ ID NO: 2157985 - RNA, 21 nt, Staphylococcus aureus subsp. aureus N315
aaucuuaugaugucauguauu

SEQ ID NO: 2157986 - RNA, 23 nt, Staphylococcus aureus subsp. aureus N315
aaucuuauuuuguuuuaaaaaac

SEQ ID NO: 2157987 - RNA, 22 nt, Staphylococcus aureus subsp. aureus N315
aaucuuauuuuguuuuaaaaaa

SEQ ID NO: 2157988 - RNA, 18 nt, Staphylococcus aureus subsp. aureus N315
aaucuucuaauuaagaau

SEQ ID NO: 2157989 - RNA, 17 nt, Staphylococcus aureus subsp. aureus N315
aaucuucauuaauuaca

SEQ ID NO: 2157990 - RNA, 18 nt, Staphylococcus aureus subsp. aureus N315
aaucuuaauauugauuaa

SEQ ID NO: 2157991 - RNA, 14 nt, Staphylococcus aureus subsp. aureus N315
aaucuuaauugucu

SEQ ID NO: 2157992 - RNA, 17 nt, Staphylococcus aureus subsp. aureus N315
aaucuguuuaaauuuaa

SEQ ID NO: 2157993 - RNA, 20 nt, Staphylococcus aureus subsp. aureus N315
aauauuuuuacauauuuaua

SEQ ID NO: 2157994 - RNA, 22 nt, Staphylococcus aureus subsp. aureus N315
aauauuuucuuagaaaaucaag

SEQ ID NO: 2157995 - RNA, 22 nt, Staphylococcus aureus subsp. aureus N315
aauauuuucauguccaucuuuu

SEQ ID NO: 2157996 - RNA, 22 nt, Staphylococcus aureus subsp. aureus N315
aauauuugauaaguagaaaaua

SEQ ID NO: 2157997 - RNA, 17 nt, Staphylococcus aureus subsp. aureus N315
aauauuuuuuaaaauga

SEQ ID NO: 2157998 - RNA, 15 nt, Staphylococcus aureus subsp. aureus N315
aaucaaaaaagacau

SEQ ID NO: 2157999 - RNA, 17 nt, Staphylococcus aureus subsp. aureus N315
aauauuucuaaaccauu

SEQ ID NO: 2158000 - RNA, 15 nt, Staphylococcus aureus subsp. aureus N315
aauauuucuuaccau

SEQ ID NO: 2158001 - RNA, 17 nt, Staphylococcus aureus subsp. aureus N315
aauauuuaaauuuuaag

SEQ ID NO: 2158002 - RNA, 18 nt, Staphylococcus aureus subsp. aureus N315
aauauuuaaccuuuaaaa

SEQ ID NO: 2158003 - RNA, 16 nt, Staphylococcus aureus subsp. aureus N315
aauauuuaaauuuuaa

SEQ ID NO: 2158004 - RNA, 21 nt, Staphylococcus aureus subsp. aureus N315
aauauuuacauugccacuuuu

SEQ ID NO: 2158005 - RNA, 18 nt, Staphylococcus aureus subsp. aureus N315
aauauuuaccacaaauau

SEQ ID NO: 2158006 - RNA, 21 nt, Staphylococcus aureus subsp. aureus N315
aauauuuaucaauaaaucagu

SEQ ID NO: 2158007 - RNA, 23 nt, Staphylococcus aureus subsp. aureus N315
aauauuuaucaauaaaucaguag

SEQ ID NO: 2158008 - RNA, 19 nt, Staphylococcus aureus subsp. aureus N315
aauauuuauuguuuuuaaa

SEQ ID NO: 2158009 - RNA, 15 nt, Staphylococcus aureus subsp. aureus N315
aauauugaugaauaa

SEQ ID NO: 2158010 - RNA, 15 nt, Staphylococcus aureus subsp. aureus N315
aauauugaacaauuu

SEQ ID NO: 2158011 - RNA, 18 nt, Staphylococcus aureus subsp. aureus N315
aauauugaacaauuuuug

SEQ ID NO: 2158012 - RNA, 12 nt, Staphylococcus aureus subsp. aureus N315
aauauugaauaa

SEQ ID NO: 2158013 - RNA, 20 nt, Staphylococcus aureus subsp. aureus N315
aauauugauucuagugaaau

SEQ ID NO: 2158014 - RNA, 20 nt, Staphylococcus aureus subsp. aureus N315
aauauucgauacauaaaaca

SEQ ID NO: 2158015 - RNA, 22 nt, Staphylococcus aureus subsp. aureus N315
aauauucuaugcucuacgaagu

SEQ ID NO: 2158016 - RNA, 18 nt, Staphylococcus aureus subsp. aureus N315
aauauggaauuucauaua

SEQ ID NO: 2158017 - RNA, 20 nt, Staphylococcus aureus subsp. aureus N315
aauauuauaaguugcauaua

SEQ ID NO: 2158018 - RNA, 13 nt, Staphylococcus aureus subsp. aureus N315
aauauuaaugaau

SEQ ID NO: 2158019 - RNA, 18 nt, Staphylococcus aureus subsp. aureus N315
aauauuaaaauuaaaacu

SEQ ID NO: 2158020 - RNA, 12 nt, Staphylococcus aureus subsp. aureus N315
aauauuaaaauc

SEQ ID NO: 2158021 - RNA, 14 nt, Staphylococcus aureus subsp. aureus N315
aauauuaaauucau

SEQ ID NO: 2158022 - RNA, 21 nt, Staphylococcus aureus subsp. aureus N315
aauauuaaauucaucuugcaa

SEQ ID NO: 2158023 - RNA, 17 nt, Staphylococcus aureus subsp. aureus N315
aauaugcuuuuaauagu

SEQ ID NO: 2158024 - RNA, 14 nt, Staphylococcus aureus subsp. aureus N315
aauaugauauuaag

SEQ ID NO: 2158025 - RNA, 17 nt, Staphylococcus aureus subsp. aureus N315
aauaugauguuaaaaaa

SEQ ID NO: 2158026 - RNA, 23 nt, Staphylococcus aureus subsp. aureus N315
aauaugauguuaaaaaauaugua

SEQ ID NO: 2158027 - RNA, 19 nt, Staphylococcus aureus subsp. aureus N315
aauaugauugaaugaagcu

SEQ ID NO: 2158028 - RNA, 18 nt, Staphylococcus aureus subsp. aureus N315
aauaugauugcaaauuau

SEQ ID NO: 2158029 - RNA, 22 nt, Staphylococcus aureus subsp. aureus N315
aauaugauugcaaauuaucauu

SEQ ID NO: 2158030 - RNA, 13 nt, Staphylococcus aureus subsp. aureus N315
aauagcauuugua

SEQ ID NO: 2158031 - RNA, 15 nt, Staphylococcus aureus subsp. aureus N315
aauagcaguuucuga

SEQ ID NO: 2158032 - RNA, 17 nt, Staphylococcus aureus subsp. aureus N315
aauagauaaugcaccug

SEQ ID NO: 2158033 - RNA, 15 nt, Staphylococcus aureus subsp. aureus N315
aauagauaauauaua

SEQ ID NO: 2158034 - RNA, 15 nt, Staphylococcus aureus subsp. aureus N315
aaucacgauuuucaa

SEQ ID NO: 2158035 - RNA, 23 nt, Staphylococcus aureus subsp. aureus N315
aaucacuaucuguuguuauauaa

SEQ ID NO: 2158036 - RNA, 20 nt, Staphylococcus aureus subsp. aureus N315
aaucacuaucuguuguuaua

SEQ ID NO: 2158037 - RNA, 22 nt, Staphylococcus aureus subsp. aureus N315
aaucacuccucuauuuuaugau

SEQ ID NO: 2158038 - RNA, 21 nt, Staphylococcus aureus subsp. aureus N315
aaucacuccucuauuuuauga

SEQ ID NO: 2158039 - RNA, 23 nt, Staphylococcus aureus subsp. aureus N315
aaucacuuggcgacauuuguaaa

SEQ ID NO: 2158040 - RNA, 15 nt, Staphylococcus aureus subsp. aureus N315
aaucacugcuuucaa

SEQ ID NO: 2158041 - RNA, 20 nt, Staphylococcus aureus subsp. aureus N315
aaucagaaggcuguucugga

SEQ ID NO: 2158042 - RNA, 18 nt, Staphylococcus aureus subsp. aureus N315
aaucagaaggcuguucug

SEQ ID NO: 2158043 - RNA, 18 nt, Staphylococcus aureus subsp. aureus N315
aaucaccucaauaugagu

SEQ ID NO: 2158044 - RNA, 19 nt, Staphylococcus aureus subsp. aureus N315
aaucaccuuauugaugaaa

SEQ ID NO: 2158045 - RNA, 22 nt, Staphylococcus aureus subsp. aureus N315
aaucaccuuauugaugaaaaca

SEQ ID NO: 2158046 - RNA, 14 nt, Staphylococcus aureus subsp. aureus N315
aaucacaguuauau

SEQ ID NO: 2158047 - RNA, 18 nt, Staphylococcus aureus subsp. aureus N315
aaucacaggaaaaucgua

SEQ ID NO: 2158048 - RNA, 14 nt, Staphylococcus aureus subsp. aureus N315
aaucacaauacgaa

SEQ ID NO: 2158049 - RNA, 14 nt, Staphylococcus aureus subsp. aureus N315
aaucacauaugaua

SEQ ID NO: 2158050 - RNA, 12 nt, Staphylococcus aureus subsp. aureus N315
aaucaauacuaa

SEQ ID NO: 2158051 - RNA, 13 nt, Staphylococcus aureus subsp. aureus N315
aaucaauuauuga

SEQ ID NO: 2158052 - RNA, 13 nt, Staphylococcus aureus subsp. aureus N315
aaucacaaauuca

SEQ ID NO: 2158053 - RNA, 15 nt, Staphylococcus aureus subsp. aureus N315
aaucaagaaauguua

SEQ ID NO: 2158054 - RNA, 12 nt, Staphylococcus aureus subsp. aureus N315
aaucaagaauau

SEQ ID NO: 2158055 - RNA, 21 nt, Staphylococcus aureus subsp. aureus N315
aaucaagacucccuuuuuaaa

SEQ ID NO: 2158056 - RNA, 13 nt, Staphylococcus aureus subsp. aureus N315
aaucaagcaaugc

SEQ ID NO: 2158057 - RNA, 16 nt, Staphylococcus aureus subsp. aureus N315
aaucaagcuagcauca

SEQ ID NO: 2158058 - RNA, 18 nt, Staphylococcus aureus subsp. aureus N315
aaucaagucugcauuaau

SEQ ID NO: 2158059 - RNA, 19 nt, Staphylococcus aureus subsp. aureus N315
aaucaacguauauaaguua

SEQ ID NO: 2158060 - RNA, 21 nt, Staphylococcus aureus subsp. aureus N315
aaucaacaucaucuuuaauuu

SEQ ID NO: 2158061 - RNA, 17 nt, Staphylococcus aureus subsp. aureus N315
aaucaacaguuuuauua

SEQ ID NO: 2158062 - RNA, 20 nt, Staphylococcus aureus subsp. aureus N315
aaucaaauuagucauccaaa

SEQ ID NO: 2158063 - RNA, 20 nt, Staphylococcus aureus subsp. aureus N315
aaucaacaagaacuuagaaa

SEQ ID NO: 2158064 - RNA, 23 nt, Staphylococcus aureus subsp. aureus N315
aaucaaagggcuucgauucauaa

SEQ ID NO: 2158065 - RNA, 17 nt, Staphylococcus aureus subsp. aureus N315
aaucaaagcuauauaug

SEQ ID NO: 2158066 - RNA, 12 nt, Staphylococcus aureus subsp. aureus N315
aaucaaagagga

SEQ ID NO: 2158067 - RNA, 21 nt, Staphylococcus aureus subsp. aureus N315
aaucaaagaggcacagcggaa

SEQ ID NO: 2158068 - RNA, 20 nt, Staphylococcus aureus subsp. aureus N315
aaucaaagaggcuuuaaaau

SEQ ID NO: 2158069 - RNA, 17 nt, Staphylococcus aureus subsp. aureus N315
aaucaaauacaucaauu

SEQ ID NO: 2158070 - RNA, 13 nt, Staphylococcus aureus subsp. aureus N315
aaucaaaaauaau

SEQ ID NO: 2158071 - RNA, 23 nt, Staphylococcus aureus subsp. aureus N315
aaucaaaaauaauuaugaaaagu

SEQ ID NO: 2158072 - RNA, 13 nt, Staphylococcus aureus subsp. aureus N315
aauucuuuuguaa

SEQ ID NO: 2158073 - RNA, 15 nt, Staphylococcus aureus subsp. aureus N315
aauucuuuuguaauu

SEQ ID NO: 2158074 - RNA, 18 nt, Staphylococcus aureus subsp. aureus N315
aauucuuuuucagcuaau

SEQ ID NO: 2158075 - RNA, 14 nt, Staphylococcus aureus subsp. aureus N315
aauucugguuuaau

SEQ ID NO: 2158076 - RNA, 18 nt, Staphylococcus aureus subsp. aureus N315
aauugaaauuaacuguau

SEQ ID NO: 2158077 - RNA, 13 nt, Staphylococcus aureus subsp. aureus N315
aauugaaaugaua

SEQ ID NO: 2158078 - RNA, 11 nt, Staphylococcus aureus subsp. aureus N315
aauugaaaauc

SEQ ID NO: 2158079 - RNA, 21 nt, Staphylococcus aureus subsp. aureus N315
aauucuuuuucagcuaauugu

SEQ ID NO: 2158080 - RNA, 17 nt, Staphylococcus aureus subsp. aureus N315
aauugaaauagaaacua

SEQ ID NO: 2158081 - RNA, 17 nt, Staphylococcus aureus subsp. aureus N315
aaaacaaagguuuguaa

SEQ ID NO: 2158082 - RNA, 16 nt, Staphylococcus aureus subsp. aureus N315
aaaacaaauauuagaa

SEQ ID NO: 2158083 - RNA, 19 nt, Staphylococcus aureus subsp. aureus N315
aauugcauguaaaauuaaa

SEQ ID NO: 2158084 - RNA, 16 nt, Staphylococcus aureus subsp. aureus N315
aauugggaaauauuug

SEQ ID NO: 2158085 - RNA, 23 nt, Staphylococcus aureus subsp. aureus N315
aauuggcaccucuaccaguucaa

SEQ ID NO: 2158086 - RNA, 14 nt, Staphylococcus aureus subsp. aureus N315
aauugggaaauauu

SEQ ID NO: 2158087 - RNA, 18 nt, Staphylococcus aureus subsp. aureus N315
aauugcuuguuuuaaaug

SEQ ID NO: 2158088 - RNA, 22 nt, Staphylococcus aureus subsp. aureus N315
aauugcuuguuuuaaaugaccu

SEQ ID NO: 2158089 - RNA, 16 nt, Staphylococcus aureus subsp. aureus N315
aauuggauuaaauacg

SEQ ID NO: 2158090 - RNA, 14 nt, Staphylococcus aureus subsp. aureus N315
aauuggauugagau

SEQ ID NO: 2158091 - RNA, 22 nt, Staphylococcus aureus subsp. aureus N315
aauuggcaacggcacauucaua

SEQ ID NO: 2158092 - RNA, 13 nt, Staphylococcus aureus subsp. aureus N315
aauugcuuguucu

SEQ ID NO: 2158093 - RNA, 16 nt, Staphylococcus aureus subsp. aureus N315
aauugcuugaaauuau

SEQ ID NO: 2158094 - RNA, 18 nt, Staphylococcus aureus subsp. aureus N315
aauugcucuuuaacaaug

SEQ ID NO: 2158095 - RNA, 17 nt, Staphylococcus aureus subsp. aureus N315
aauuuaggcaugucaaa

SEQ ID NO: 2158096 - RNA, 15 nt, Staphylococcus aureus subsp. aureus N315
aauuuaguauaaaua

SEQ ID NO: 2158097 - RNA, 18 nt, Staphylococcus aureus subsp. aureus N315
aauuuagucauuacaaau

SEQ ID NO: 2158098 - RNA, 16 nt, Staphylococcus aureus subsp. aureus N315
aauuuaauauuauaag

SEQ ID NO: 2158099 - RNA, 15 nt, Staphylococcus aureus subsp. aureus N315
aauuuaauugguucu

SEQ ID NO: 2158100 - RNA, 18 nt, Staphylococcus aureus subsp. aureus N315
aauuuaauugguucuucu

SEQ ID NO: 2158101 - RNA, 15 nt, Staphylococcus aureus subsp. aureus N315
aauuuaauauuauaa

SEQ ID NO: 2158102 - RNA, 16 nt, Staphylococcus aureus subsp. aureus N315
aauuuaauauuguuaa

SEQ ID NO: 2158103 - RNA, 16 nt, Staphylococcus aureus subsp. aureus N315
aauuuaauaauuaaau

SEQ ID NO: 2158104 - RNA, 19 nt, Staphylococcus aureus subsp. aureus N315
aauuuaauacuauaguaag

SEQ ID NO: 2158105 - RNA, 18 nt, Staphylococcus aureus subsp. aureus N315
aauuuaauagacauuaac

SEQ ID NO: 2158106 - RNA, 20 nt, Staphylococcus aureus subsp. aureus N315
aauuuaauaggcuauguaaa

SEQ ID NO: 2158107 - RNA, 15 nt, Staphylococcus aureus subsp. aureus N315
aauuuaaacgcacua

SEQ ID NO: 2158108 - RNA, 13 nt, Staphylococcus aureus subsp. aureus N315
aauuuaauaauua

SEQ ID NO: 2158109 - RNA, 15 nt, Staphylococcus aureus subsp. aureus N315
aauuuaaaagaaaaa

SEQ ID NO: 2158110 - RNA, 15 nt, Staphylococcus aureus subsp. aureus N315
aauuuaaaagagaau

SEQ ID NO: 2158111 - RNA, 12 nt, Staphylococcus aureus subsp. aureus N315
aauuuaaaacaa

SEQ ID NO: 2158112 - RNA, 19 nt, Staphylococcus aureus subsp. aureus N315
aauugucucaucauuuaaa

SEQ ID NO: 2158113 - RNA, 20 nt, Staphylococcus aureus subsp. aureus N315
aauugucucaucauuuaaaa

SEQ ID NO: 2158114 - RNA, 22 nt, Staphylococcus aureus subsp. aureus N315
aauugucucaucauuuaaaauu

SEQ ID NO: 2158115 - RNA, 23 nt, Staphylococcus aureus subsp. aureus N315
aauugucucaucauuuaaaauuu

SEQ ID NO: 2158116 - RNA, 23 nt, Staphylococcus aureus subsp. aureus N315
aauugucguucucguguaaaaug

SEQ ID NO: 2158117 - RNA, 11 nt, Staphylococcus aureus subsp. aureus N315
aauuguuaucg

SEQ ID NO: 2158118 - RNA, 19 nt, Staphylococcus aureus subsp. aureus N315
aauuguucuaauacaccaa

SEQ ID NO: 2158119 - RNA, 23 nt, Staphylococcus aureus subsp. aureus N315
aauuguucuaauacaccaaaucc

SEQ ID NO: 2158120 - RNA, 17 nt, Staphylococcus aureus subsp. aureus N315
aauuguuaaaucaccaa

SEQ ID NO: 2158121 - RNA, 16 nt, Staphylococcus aureus subsp. aureus N315
aauuguguugaaucaa

SEQ ID NO: 2158122 - RNA, 20 nt, Staphylococcus aureus subsp. aureus N315
aauuguggagaucuaacaau

SEQ ID NO: 2158123 - RNA, 16 nt, Staphylococcus aureus subsp. aureus N315
aauuguaaucuauuuu

SEQ ID NO: 2158124 - RNA, 22 nt, Staphylococcus aureus subsp. aureus N315
aauuguaaagcaugaauagcuu

SEQ ID NO: 2158125 - RNA, 17 nt, Staphylococcus aureus subsp. aureus N315
aauuguaaagcaugaau

SEQ ID NO: 2158126 - RNA, 22 nt, Staphylococcus aureus subsp. aureus N315
aauugguuuggauaaaaugaua

SEQ ID NO: 2158127 - RNA, 20 nt, Staphylococcus aureus subsp. aureus N315
aauugguuuggauaaaauga

SEQ ID NO: 2158128 - RNA, 14 nt, Staphylococcus aureus subsp. aureus N315
aauugguuuucaug

SEQ ID NO: 2158129 - RNA, 23 nt, Staphylococcus aureus subsp. aureus N315
aauugguuuuuagugaaaagaac

SEQ ID NO: 2158130 - RNA, 17 nt, Staphylococcus aureus subsp. aureus N315
aauuguacuuaaaccua

SEQ ID NO: 2158131 - RNA, 11 nt, Staphylococcus aureus subsp. aureus N315
aauuguauaaa

SEQ ID NO: 2158132 - RNA, 16 nt, Staphylococcus aureus subsp. aureus N315
aauuauuuaaaaugcu

SEQ ID NO: 2158133 - RNA, 11 nt, Staphylococcus aureus subsp. aureus N315
aauuauuuaau

SEQ ID NO: 2158134 - RNA, 15 nt, Staphylococcus aureus subsp. aureus N315
aauuauuuagaaacu

SEQ ID NO: 2158135 - RNA, 16 nt, Staphylococcus aureus subsp. aureus N315
aauuauuuagaaacuu

SEQ ID NO: 2158136 - RNA, 18 nt, Staphylococcus aureus subsp. aureus N315
aauuauugagaauauuua

SEQ ID NO: 2158137 - RNA, 20 nt, Staphylococcus aureus subsp. aureus N315
aauuauuauuuaaauuuuca

SEQ ID NO: 2158138 - RNA, 13 nt, Staphylococcus aureus subsp. aureus N315
aauuauuauaaua

SEQ ID NO: 2158139 - RNA, 19 nt, Staphylococcus aureus subsp. aureus N315
aauuauuauaauaaauaga

SEQ ID NO: 2158140 - RNA, 18 nt, Staphylococcus aureus subsp. aureus N315
aauuauuauaguuuagau

SEQ ID NO: 2158141 - RNA, 12 nt, Staphylococcus aureus subsp. aureus N315
aauuauuauaau

SEQ ID NO: 2158142 - RNA, 17 nt, Staphylococcus aureus subsp. aureus N315
aauucacgcaauaucau

SEQ ID NO: 2158143 - RNA, 23 nt, Staphylococcus aureus subsp. aureus N315
aauucaguaaucuuguuuucauu

SEQ ID NO: 2158144 - RNA, 14 nt, Staphylococcus aureus subsp. aureus N315
aauucauaaaugcu

SEQ ID NO: 2158145 - RNA, 16 nt, Staphylococcus aureus subsp. aureus N315
aauucauaagaaaaau

SEQ ID NO: 2158146 - RNA, 17 nt, Staphylococcus aureus subsp. aureus N315
aauucauaagaaaaaug

SEQ ID NO: 2158147 - RNA, 15 nt, Staphylococcus aureus subsp. aureus N315
aauucagaugaauaa

SEQ ID NO: 2158148 - RNA, 12 nt, Staphylococcus aureus subsp. aureus N315
aauuaagaaaag

SEQ ID NO: 2158149 - RNA, 16 nt, Staphylococcus aureus subsp. aureus N315
aauuaacuaguguaau

SEQ ID NO: 2158150 - RNA, 22 nt, Staphylococcus aureus subsp. aureus N315
aauuauaaguagugauuuuuua

SEQ ID NO: 2158151 - RNA, 21 nt, Staphylococcus aureus subsp. aureus N315
aauuaguuuuuguuuacagau

SEQ ID NO: 2158152 - RNA, 17 nt, Staphylococcus aureus subsp. aureus N315
aauuauaaaugauuaaa

SEQ ID NO: 2158153 - RNA, 16 nt, Staphylococcus aureus subsp. aureus N315
aauuauaaaugauuaa

SEQ ID NO: 2158154 - RNA, 20 nt, Staphylococcus aureus subsp. aureus N315
aauuaucuuaagucaucaau

SEQ ID NO: 2158155 - RNA, 15 nt, Staphylococcus aureus subsp. aureus N315
aauuauccuacugcu

SEQ ID NO: 2158156 - RNA, 18 nt, Staphylococcus aureus subsp. aureus N315
aauuauccuacugcuguc

SEQ ID NO: 2158157 - RNA, 20 nt, Staphylococcus aureus subsp. aureus N315
aauuaucauaugugauuuaa

SEQ ID NO: 2158158 - RNA, 17 nt, Staphylococcus aureus subsp. aureus N315
aauuaucauaaagauaa

SEQ ID NO: 2158159 - RNA, 14 nt, Staphylococcus aureus subsp. aureus N315
aauuaucauauaaa

SEQ ID NO: 2158160 - RNA, 23 nt, Staphylococcus aureus subsp. aureus N315
aauuauaguuucgucuacuauuu

SEQ ID NO: 2158161 - RNA, 21 nt, Staphylococcus aureus subsp. aureus N315
aauuccucuggaacuuuaaua

SEQ ID NO: 2158162 - RNA, 20 nt, Staphylococcus aureus subsp. aureus N315
aauucauuuuauaaaucaaa

SEQ ID NO: 2158163 - RNA, 21 nt, Staphylococcus aureus subsp. aureus N315
aauucauuuuauaaaucaaag

SEQ ID NO: 2158164 - RNA, 16 nt, Staphylococcus aureus subsp. aureus N315
aauucauuuuauaaau

SEQ ID NO: 2158165 - RNA, 21 nt, Staphylococcus aureus subsp. aureus N315
aauucaucuuaucaagaauau

SEQ ID NO: 2158166 - RNA, 14 nt, Staphylococcus aureus subsp. aureus N315
aauucaucuaaccu

SEQ ID NO: 2158167 - RNA, 14 nt, Staphylococcus aureus subsp. aureus N315
aauucgaaaagaaa

SEQ ID NO: 2158168 - RNA, 13 nt, Staphylococcus aureus subsp. aureus N315
aauucgaaaagaa

SEQ ID NO: 2158169 - RNA, 12 nt, Staphylococcus aureus subsp. aureus N315
aauucuauaaau

SEQ ID NO: 2158170 - RNA, 13 nt, Staphylococcus aureus subsp. aureus N315
aauucuauaaaua

SEQ ID NO: 2158171 - RNA, 19 nt, Staphylococcus aureus subsp. aureus N315
aauucuauaaauagaauuu

SEQ ID NO: 2158172 - RNA, 19 nt, Staphylococcus aureus subsp. aureus N315
aauucgacucaaacaauaa

SEQ ID NO: 2158173 - RNA, 19 nt, Staphylococcus aureus subsp. aureus N315
aauucuacagguaaugcaa

SEQ ID NO: 2158174 - RNA, 11 nt, Staphylococcus aureus subsp. aureus N315
aauucuauuuu

SEQ ID NO: 2158175 - RNA, 21 nt, Staphylococcus aureus subsp. aureus N315
aauucuauuuuugauuuaaua

SEQ ID NO: 2158176 - RNA, 23 nt, Staphylococcus aureus subsp. aureus N315
aauucuacuaaaaaugcuuuaac

SEQ ID NO: 2158177 - RNA, 19 nt, Staphylococcus aureus subsp. aureus N315
aauucucgauuuuuuuaua

SEQ ID NO: 2158178 - RNA, 18 nt, Staphylococcus aureus subsp. aureus N315
aauucucuaacuuuacca

SEQ ID NO: 2158179 - RNA, 12 nt, Staphylococcus aureus subsp. aureus N315
aauucucuuauc

SEQ ID NO: 2158180 - RNA, 22 nt, Staphylococcus aureus subsp. aureus N315
aauucucuuaucuugauuuaaa

SEQ ID NO: 2158181 - RNA, 21 nt, Staphylococcus aureus subsp. aureus N315
aauucucuuuguuggggccca

SEQ ID NO: 2158182 - RNA, 17 nt, Staphylococcus aureus subsp. aureus N315
aauucugaaaucaguuu

SEQ ID NO: 2158183 - RNA, 23 nt, Staphylococcus aureus subsp. aureus N315
aauguuggaaaaggucaaaaaau

SEQ ID NO: 2158184 - RNA, 21 nt, Staphylococcus aureus subsp. aureus N315
aauguugucguuucuagcaac

SEQ ID NO: 2158185 - RNA, 15 nt, Staphylococcus aureus subsp. aureus N315
aauguuuauaucuuu

SEQ ID NO: 2158186 - RNA, 14 nt, Staphylococcus aureus subsp. aureus N315
aauguuuaaaaaac

SEQ ID NO: 2158187 - RNA, 23 nt, Staphylococcus aureus subsp. aureus N315
aauguuguuugcggcuuccucuc

SEQ ID NO: 2158188 - RNA, 14 nt, Staphylococcus aureus subsp. aureus N315
aauguuucagaacu

SEQ ID NO: 2158189 - RNA, 19 nt, Staphylococcus aureus subsp. aureus N315
aauguuucuucaauugucu

SEQ ID NO: 2158190 - RNA, 21 nt, Staphylococcus aureus subsp. aureus N315
aauguuugaguguuuaugaaa

SEQ ID NO: 2158191 - RNA, 23 nt, Staphylococcus aureus subsp. aureus N315
aauguuugaagugauuugccaaa

SEQ ID NO: 2158192 - RNA, 12 nt, Staphylococcus aureus subsp. aureus N315
aauguuugcuuu

SEQ ID NO: 2158193 - RNA, 18 nt, Staphylococcus aureus subsp. aureus N315
aauguuugcuuuuuguaa

SEQ ID NO: 2158194 - RNA, 13 nt, Staphylococcus aureus subsp. aureus N315
aauguuuuaaauu

SEQ ID NO: 2158195 - RNA, 12 nt, Staphylococcus aureus subsp. aureus N315
aauguuuuaugu

SEQ ID NO: 2158196 - RNA, 23 nt, Staphylococcus aureus subsp. aureus N315
aauguuuucagccacugucaugu

SEQ ID NO: 2158197 - RNA, 16 nt, Staphylococcus aureus subsp. aureus N315
aauguuuuggaaaaau

SEQ ID NO: 2158198 - RNA, 14 nt, Staphylococcus aureus subsp. aureus N315
aauuaaaaaaccug

SEQ ID NO: 2158199 - RNA, 17 nt, Staphylococcus aureus subsp. aureus N315
aauuaaaacagcaaaua

SEQ ID NO: 2158200 - RNA, 14 nt, Staphylococcus aureus subsp. aureus N315
aauuaaaacuauaa

SEQ ID NO: 2158201 - RNA, 22 nt, Staphylococcus aureus subsp. aureus N315
aauuaaaacagcaaauaaaauc

SEQ ID NO: 2158202 - RNA, 14 nt, Staphylococcus aureus subsp. aureus N315
aauuaaauucaaau

SEQ ID NO: 2158203 - RNA, 13 nt, Staphylococcus aureus subsp. aureus N315
aauuaaauguuua

SEQ ID NO: 2158204 - RNA, 13 nt, Staphylococcus aureus subsp. aureus N315
aauuaaagugaau

SEQ ID NO: 2158205 - RNA, 14 nt, Staphylococcus aureus subsp. aureus N315
aauuaaaguuaaag

SEQ ID NO: 2158206 - RNA, 18 nt, Staphylococcus aureus subsp. aureus N315
aauuaaccuugauuuaau

SEQ ID NO: 2158207 - RNA, 11 nt, Staphylococcus aureus subsp. aureus N315
aauuaacaaua

SEQ ID NO: 2158208 - RNA, 19 nt, Staphylococcus aureus subsp. aureus N315
aauuaacaauauuaaauuu

SEQ ID NO: 2158209 - RNA, 12 nt, Staphylococcus aureus subsp. aureus N315
aauuaacaauau

SEQ ID NO: 2158210 - RNA, 16 nt, Staphylococcus aureus subsp. aureus N315
aauuaacaauauuaaa

SEQ ID NO: 2158211 - RNA, 23 nt, Staphylococcus aureus subsp. aureus N315
aauuaaacgcucaacuauauaua

SEQ ID NO: 2158212 - RNA, 20 nt, Staphylococcus aureus subsp. aureus N315
aauuaaaauaagauauauaa

SEQ ID NO: 2158213 - RNA, 13 nt, Staphylococcus aureus subsp. aureus N315
aauuaaauaauga

SEQ ID NO: 2158214 - RNA, 16 nt, Staphylococcus aureus subsp. aureus N315
aauuaaauaaaaauau

SEQ ID NO: 2158215 - RNA, 20 nt, Staphylococcus aureus subsp. aureus N315
aauuaaagucaauuuaaaua

SEQ ID NO: 2158216 - RNA, 20 nt, Staphylococcus aureus subsp. aureus N315
aauuaaacgcucaacuauau

SEQ ID NO: 2158217 - RNA, 18 nt, Staphylococcus aureus subsp. aureus N315
aauuaaagauuaaaauau

SEQ ID NO: 2158218 - RNA, 14 nt, Staphylococcus aureus subsp. aureus N315
aaugucguauaugu

SEQ ID NO: 2158219 - RNA, 15 nt, Staphylococcus aureus subsp. aureus N315
aaugucuaaaaaugu

SEQ ID NO: 2158220 - RNA, 15 nt, Staphylococcus aureus subsp. aureus N315
aaugucuuacuuguc

SEQ ID NO: 2158221 - RNA, 14 nt, Staphylococcus aureus subsp. aureus N315
aaugugaugauuaa

SEQ ID NO: 2158222 - RNA, 15 nt, Staphylococcus aureus subsp. aureus N315
aaugugagauauaaa

SEQ ID NO: 2158223 - RNA, 17 nt, Staphylococcus aureus subsp. aureus N315
aaugugagauauaaagg

SEQ ID NO: 2158224 - RNA, 22 nt, Staphylococcus aureus subsp. aureus N315
aaugucgaucuaacaauugcag

SEQ ID NO: 2158225 - RNA, 20 nt, Staphylococcus aureus subsp. aureus N315
aauguccgacuugauaaaaa

SEQ ID NO: 2158226 - RNA, 22 nt, Staphylococcus aureus subsp. aureus N315
aauguccgacuugauaaaaaau

SEQ ID NO: 2158227 - RNA, 21 nt, Staphylococcus aureus subsp. aureus N315
aauguauuuuuacuuuuauaa

SEQ ID NO: 2158228 - RNA, 14 nt, Staphylococcus aureus subsp. aureus N315
aauguguaugguuu

SEQ ID NO: 2158229 - RNA, 21 nt, Staphylococcus aureus subsp. aureus N315
aauguguggauuuaauuuuua

SEQ ID NO: 2158230 - RNA, 18 nt, Staphylococcus aureus subsp. aureus N315
aauguguacuuaaaaaua

SEQ ID NO: 2158231 - RNA, 15 nt, Staphylococcus aureus subsp. aureus N315
aauguguuaaaauau

SEQ ID NO: 2158232 - RNA, 22 nt, Staphylococcus aureus subsp. aureus N315
aauguguaugguuuuguacaua

SEQ ID NO: 2158233 - RNA, 14 nt, Staphylococcus aureus subsp. aureus N315
aauguguuaauacu

SEQ ID NO: 2158234 - RNA, 20 nt, Staphylococcus aureus subsp. aureus N315
aaugugcaauuagaauauau

SEQ ID NO: 2158235 - RNA, 23 nt, Staphylococcus aureus subsp. aureus N315
aaugugauuuucuuucauaaauu

SEQ ID NO: 2158236 - RNA, 16 nt, Staphylococcus aureus subsp. aureus N315
aaugugauuuucuuuc

SEQ ID NO: 2158237 - RNA, 17 nt, Staphylococcus aureus subsp. aureus N315
aauguuaaauucuaaaa

SEQ ID NO: 2158238 - RNA, 17 nt, Staphylococcus aureus subsp. aureus N315
aauguuaaagauuauua

SEQ ID NO: 2158239 - RNA, 16 nt, Staphylococcus aureus subsp. aureus N315
aauguuaaagauuauu

SEQ ID NO: 2158240 - RNA, 22 nt, Staphylococcus aureus subsp. aureus N315
aauguuauugcuuauuuuugua

SEQ ID NO: 2158241 - RNA, 16 nt, Staphylococcus aureus subsp. aureus N315
aauguuauuaaccauc

SEQ ID NO: 2158242 - RNA, 15 nt, Staphylococcus aureus subsp. aureus N315
aauguucaauuuaua

SEQ ID NO: 2158243 - RNA, 17 nt, Staphylococcus aureus subsp. aureus N315
aaugauugcauugauuu

SEQ ID NO: 2158244 - RNA, 23 nt, Staphylococcus aureus subsp. aureus N315
aaugauuuaauaaaaaccaauau

SEQ ID NO: 2158245 - RNA, 19 nt, Staphylococcus aureus subsp. aureus N315
aaugauuugugguaaucau

SEQ ID NO: 2158246 - RNA, 19 nt, Staphylococcus aureus subsp. aureus N315
aaugauuuuauaauauuau

SEQ ID NO: 2158247 - RNA, 15 nt, Staphylococcus aureus subsp. aureus N315
aaugauuugugguaa

SEQ ID NO: 2158248 - RNA, 13 nt, Staphylococcus aureus subsp. aureus N315
aaugauuuugcuu

SEQ ID NO: 2158249 - RNA, 20 nt, Staphylococcus aureus subsp. aureus N315
aaucuugauuauauuuuucu

SEQ ID NO: 2158250 - RNA, 23 nt, Staphylococcus aureus subsp. aureus N315
aaucuucuccaaucaucauuaaa

SEQ ID NO: 2158251 - RNA, 20 nt, Staphylococcus aureus subsp. aureus N315
aaucuucuccaaucaucauu

SEQ ID NO: 2158252 - RNA, 19 nt, Staphylococcus aureus subsp. aureus N315
aaugcagauucuucaccaa

SEQ ID NO: 2158253 - RNA, 21 nt, Staphylococcus aureus subsp. aureus N315
aaugcacgagcaacaucuuuu

SEQ ID NO: 2158254 - RNA, 16 nt, Staphylococcus aureus subsp. aureus N315
aaugcaccugugauaa

SEQ ID NO: 2158255 - RNA, 21 nt, Staphylococcus aureus subsp. aureus N315
aaugcaauacauuaauauaaa

SEQ ID NO: 2158256 - RNA, 21 nt, Staphylococcus aureus subsp. aureus N315
aaugcaaguuggcggggcccc

SEQ ID NO: 2158257 - RNA, 16 nt, Staphylococcus aureus subsp. aureus N315
aaugcaacuugaucau

SEQ ID NO: 2158258 - RNA, 13 nt, Staphylococcus aureus subsp. aureus N315
aaugcgcaaugaa

SEQ ID NO: 2158259 - RNA, 16 nt, Staphylococcus aureus subsp. aureus N315
aaugcgacaucgccaa

SEQ ID NO: 2158260 - RNA, 18 nt, Staphylococcus aureus subsp. aureus N315
aaugcgaagauuuuuaac

SEQ ID NO: 2158261 - RNA, 23 nt, Staphylococcus aureus subsp. aureus N315
aaugcagauucuucaccaacuuu

SEQ ID NO: 2158262 - RNA, 20 nt, Staphylococcus aureus subsp. aureus N315
aaugccauuguuauccaaaa

SEQ ID NO: 2158263 - RNA, 21 nt, Staphylococcus aureus subsp. aureus N315
aaugccauuguuauccaaaac

SEQ ID NO: 2158264 - RNA, 15 nt, Staphylococcus aureus subsp. aureus N315
aaugcuuuaauaaau

SEQ ID NO: 2158265 - RNA, 18 nt, Staphylococcus aureus subsp. aureus N315
aaugcuugaauuuuauua

SEQ ID NO: 2158266 - RNA, 16 nt, Staphylococcus aureus subsp. aureus N315
aaugcuucaaauguaa

SEQ ID NO: 2158267 - RNA, 16 nt, Staphylococcus aureus subsp. aureus N315
aaugcuuaaaaacaau

SEQ ID NO: 2158268 - RNA, 15 nt, Staphylococcus aureus subsp. aureus N315
aaugcuguacuauau

SEQ ID NO: 2158269 - RNA, 21 nt, Staphylococcus aureus subsp. aureus N315
aauguacauuguaaauauagu

SEQ ID NO: 2158270 - RNA, 13 nt, Staphylococcus aureus subsp. aureus N315
aacagcauaaaua

SEQ ID NO: 2158271 - RNA, 17 nt, Staphylococcus aureus subsp. aureus N315
aacagcauuuccuaugu

SEQ ID NO: 2158272 - RNA, 13 nt, Staphylococcus aureus subsp. aureus N315
aacagcaaaaaau

SEQ ID NO: 2158273 - RNA, 14 nt, Staphylococcus aureus subsp. aureus N315
aacagcaaaaaaua

SEQ ID NO: 2158274 - RNA, 19 nt, Staphylococcus aureus subsp. aureus N315
aacagcaaaaaauaaaucu

SEQ ID NO: 2158275 - RNA, 21 nt, Staphylococcus aureus subsp. aureus N315
aacacucaaaauguuuaacaa

SEQ ID NO: 2158276 - RNA, 22 nt, Staphylococcus aureus subsp. aureus N315
aacacucaaaauguuuaacaau

SEQ ID NO: 2158277 - RNA, 21 nt, Staphylococcus aureus subsp. aureus N315
aacacguucuugguauuuuuu

SEQ ID NO: 2158278 - RNA, 16 nt, Staphylococcus aureus subsp. aureus N315
aacacgcucuuuucaa

SEQ ID NO: 2158279 - RNA, 16 nt, Staphylococcus aureus subsp. aureus N315
aacaccuaauauuuua

SEQ ID NO: 2158280 - RNA, 22 nt, Staphylococcus aureus subsp. aureus N315
aacacgacaaucgaauguauug

SEQ ID NO: 2158281 - RNA, 12 nt, Staphylococcus aureus subsp. aureus N315
aacaccaauuga

SEQ ID NO: 2158282 - RNA, 21 nt, Staphylococcus aureus subsp. aureus N315
aacaccacacagcauuuucaa

SEQ ID NO: 2158283 - RNA, 22 nt, Staphylococcus aureus subsp. aureus N315
aacaccagauaucauaauauug

SEQ ID NO: 2158284 - RNA, 20 nt, Staphylococcus aureus subsp. aureus N315
aaaaaguaaaaucuuuaaca

SEQ ID NO: 2158285 - RNA, 18 nt, Staphylococcus aureus subsp. aureus N315
aaaaagucccgcuuaaaa

SEQ ID NO: 2158286 - RNA, 23 nt, Staphylococcus aureus subsp. aureus N315
aaaaagucccgcuuaaaaugauu

SEQ ID NO: 2158287 - RNA, 18 nt, Staphylococcus aureus subsp. aureus N315
aaaaagugauaauuaaaa

SEQ ID NO: 2158288 - RNA, 22 nt, Staphylococcus aureus subsp. aureus N315
aacacacuuauaaucuauaaau

SEQ ID NO: 2158289 - RNA, 12 nt, Staphylococcus aureus subsp. aureus N315
aacacaaagaau

SEQ ID NO: 2158290 - RNA, 16 nt, Staphylococcus aureus subsp. aureus N315
aacacaaauaaaggca

SEQ ID NO: 2158291 - RNA, 14 nt, Staphylococcus aureus subsp. aureus N315
aacacauaaauuaa

SEQ ID NO: 2158292 - RNA, 23 nt, Staphylococcus aureus subsp. aureus N315
aacacagagaauuucgaaaagaa

SEQ ID NO: 2158293 - RNA, 11 nt, Staphylococcus aureus subsp. aureus N315
aacacaucuau

SEQ ID NO: 2158294 - RNA, 24 nt, Staphylococcus aureus subsp. aureus N315
aacaaucggaagcauauuucuaaa

SEQ ID NO: 2158295 - RNA, 18 nt, Staphylococcus aureus subsp. aureus N315
aacaaucggaagcauauu

SEQ ID NO: 2158296 - RNA, 13 nt, Staphylococcus aureus subsp. aureus N315
aacaaucagauaa

SEQ ID NO: 2158297 - RNA, 16 nt, Staphylococcus aureus subsp. aureus N315
aacaaucaaauuacaa

SEQ ID NO: 2158298 - RNA, 18 nt, Staphylococcus aureus subsp. aureus N315
aacaaugaggauugugua

SEQ ID NO: 2158299 - RNA, 19 nt, Staphylococcus aureus subsp. aureus N315
aacaaugcgaagaaaucau

SEQ ID NO: 2158300 - RNA, 21 nt, Staphylococcus aureus subsp. aureus N315
aacaaugcgguaaaaacucuu

SEQ ID NO: 2158301 - RNA, 20 nt, Staphylococcus aureus subsp. aureus N315
aacaauuuuaaaucuuuuag

SEQ ID NO: 2158302 - RNA, 22 nt, Staphylococcus aureus subsp. aureus N315
aacaauuugaggauacauaaau

SEQ ID NO: 2158303 - RNA, 15 nt, Staphylococcus aureus subsp. aureus N315
aacaauuuauuaaaa

SEQ ID NO: 2158304 - RNA, 16 nt, Staphylococcus aureus subsp. aureus N315
aacaauugcuaaucca

SEQ ID NO: 2158305 - RNA, 14 nt, Staphylococcus aureus subsp. aureus N315
aacaauucauuaau

SEQ ID NO: 2158306 - RNA, 16 nt, Staphylococcus aureus subsp. aureus N315
aacaauucuucaucau

SEQ ID NO: 2158307 - RNA, 20 nt, Staphylococcus aureus subsp. aureus N315
aaauucuuauaaaauaaaaa

SEQ ID NO: 2158308 - RNA, 17 nt, Staphylococcus aureus subsp. aureus N315
aaauucuuauaaaauaa

SEQ ID NO: 2158309 - RNA, 12 nt, Staphylococcus aureus subsp. aureus N315
aaauucucuuuu

SEQ ID NO: 2158310 - RNA, 17 nt, Staphylococcus aureus subsp. aureus N315
aacaauacauaaugguu

SEQ ID NO: 2158311 - RNA, 13 nt, Staphylococcus aureus subsp. aureus N315
aacaauauaauau

SEQ ID NO: 2158312 - RNA, 14 nt, Staphylococcus aureus subsp. aureus N315
aacaauauaauaua

SEQ ID NO: 2158313 - RNA, 21 nt, Staphylococcus aureus subsp. aureus N315
aacaauagguacaacuaaaua

SEQ ID NO: 2158314 - RNA, 21 nt, Staphylococcus aureus subsp. aureus N315
aacaauauuaaauuucugaac

SEQ ID NO: 2158315 - RNA, 14 nt, Staphylococcus aureus subsp. aureus N315
aacaauaacaccug

SEQ ID NO: 2158316 - RNA, 15 nt, Staphylococcus aureus subsp. aureus N315
aaccaucauaaaugu

SEQ ID NO: 2158317 - RNA, 14 nt, Staphylococcus aureus subsp. aureus N315
aaccauuuaaaaau

SEQ ID NO: 2158318 - RNA, 16 nt, Staphylococcus aureus subsp. aureus N315
aaccauuuaaaaauug

SEQ ID NO: 2158319 - RNA, 21 nt, Staphylococcus aureus subsp. aureus N315
aaccgccaacuaauguuaaaa

SEQ ID NO: 2158320 - RNA, 15 nt, Staphylococcus aureus subsp. aureus N315
aaccgaagcgcagug

SEQ ID NO: 2158321 - RNA, 22 nt, Staphylococcus aureus subsp. aureus N315
aacccuaauguguggauuuaau

SEQ ID NO: 2158322 - RNA, 23 nt, Staphylococcus aureus subsp. aureus N315
aacauauucaguauauguauaga

SEQ ID NO: 2158323 - RNA, 13 nt, Staphylococcus aureus subsp. aureus N315
aacauauuauaua

SEQ ID NO: 2158324 - RNA, 16 nt, Staphylococcus aureus subsp. aureus N315
aacauauuauauauau

SEQ ID NO: 2158325 - RNA, 19 nt, Staphylococcus aureus subsp. aureus N315
aacauauuauauauauucc

SEQ ID NO: 2158326 - RNA, 21 nt, Staphylococcus aureus subsp. aureus N315
aacauauuuaucucuuucuuc

SEQ ID NO: 2158327 - RNA, 14 nt, Staphylococcus aureus subsp. aureus N315
aacauauucauaau

SEQ ID NO: 2158328 - RNA, 18 nt, Staphylococcus aureus subsp. aureus N315
aacauauucauaauaucg

SEQ ID NO: 2158329 - RNA, 13 nt, Staphylococcus aureus subsp. aureus N315
aacaucaucuuua

SEQ ID NO: 2158330 - RNA, 21 nt, Staphylococcus aureus subsp. aureus N315
aacaucuuuuguuguuuuuga

SEQ ID NO: 2158331 - RNA, 14 nt, Staphylococcus aureus subsp. aureus N315
aacaucugaaaaaa

SEQ ID NO: 2158332 - RNA, 16 nt, Staphylococcus aureus subsp. aureus N315
aacaucugaaucugaa

SEQ ID NO: 2158333 - RNA, 22 nt, Staphylococcus aureus subsp. aureus N315
aacauccugcuuauuaauuguu

SEQ ID NO: 2158334 - RNA, 13 nt, Staphylococcus aureus subsp. aureus N315
aacauaauauuuc

SEQ ID NO: 2158335 - RNA, 13 nt, Staphylococcus aureus subsp. aureus N315
aacauaauuuuua

SEQ ID NO: 2158336 - RNA, 12 nt, Staphylococcus aureus subsp. aureus N315
aacauaaugaca

SEQ ID NO: 2158337 - RNA, 16 nt, Staphylococcus aureus subsp. aureus N315
aacauaucgucaauuu

SEQ ID NO: 2158338 - RNA, 20 nt, Staphylococcus aureus subsp. aureus N315
aacauaucgucaauuuuaau

SEQ ID NO: 2158339 - RNA, 16 nt, Staphylococcus aureus subsp. aureus N315
aacauauuauaaaagu

SEQ ID NO: 2158340 - RNA, 22 nt, Staphylococcus aureus subsp. aureus N315
aacauacuauaaaaauuuauuc

SEQ ID NO: 2158341 - RNA, 18 nt, Staphylococcus aureus subsp. aureus N315
aacauacguuauuuuuug

SEQ ID NO: 2158342 - RNA, 18 nt, Staphylococcus aureus subsp. aureus N315
aacauuacccuuuaaacu

SEQ ID NO: 2158343 - RNA, 17 nt, Staphylococcus aureus subsp. aureus N315
aacauuaauaaauaaua

SEQ ID NO: 2158344 - RNA, 20 nt, Staphylococcus aureus subsp. aureus N315
aacauuaaucuauauaaaaa

SEQ ID NO: 2158345 - RNA, 23 nt, Staphylococcus aureus subsp. aureus N315
aacauuaaucuauauaaaaacug

SEQ ID NO: 2158346 - RNA, 18 nt, Staphylococcus aureus subsp. aureus N315
aacauuaaaauaauuaaa

SEQ ID NO: 2158347 - RNA, 20 nt, Staphylococcus aureus subsp. aureus N315
aacauuaaaauaauuaaaua

SEQ ID NO: 2158348 - RNA, 21 nt, Staphylococcus aureus subsp. aureus N315
aacauuaaaauaauuaaauaa

SEQ ID NO: 2158349 - RNA, 13 nt, Staphylococcus aureus subsp. aureus N315
aacauuaaaaugu

SEQ ID NO: 2158350 - RNA, 15 nt, Staphylococcus aureus subsp. aureus N315
aacauuaaaaugaua

SEQ ID NO: 2158351 - RNA, 17 nt, Staphylococcus aureus subsp. aureus N315
aacauguacaauuuuua

SEQ ID NO: 2158352 - RNA, 15 nt, Staphylococcus aureus subsp. aureus N315
aacauguauuuagua

SEQ ID NO: 2158353 - RNA, 23 nt, Staphylococcus aureus subsp. aureus N315
aacauguacaauuuuuaaaaacc

SEQ ID NO: 2158354 - RNA, 18 nt, Staphylococcus aureus subsp. aureus N315
aacauguacaauuuuuaa

SEQ ID NO: 2158355 - RNA, 13 nt, Staphylococcus aureus subsp. aureus N315
aacauguucguua

SEQ ID NO: 2158356 - RNA, 22 nt, Staphylococcus aureus subsp. aureus N315
aacauguuccgcuacaaaacau

SEQ ID NO: 2158357 - RNA, 16 nt, Staphylococcus aureus subsp. aureus N315
aacauguguaugauca

SEQ ID NO: 2158358 - RNA, 20 nt, Staphylococcus aureus subsp. aureus N315
aacauguuccgcuacaaaac

SEQ ID NO: 2158359 - RNA, 13 nt, Staphylococcus aureus subsp. aureus N315
aacaugugcaagu

SEQ ID NO: 2158360 - RNA, 13 nt, Staphylococcus aureus subsp. aureus N315
aacauguguauga

SEQ ID NO: 2158361 - RNA, 20 nt, Staphylococcus aureus subsp. aureus N315
aacauucuucaaaaaauaau

SEQ ID NO: 2158362 - RNA, 19 nt, Staphylococcus aureus subsp. aureus N315
aacauucuucaaaaaauaa

SEQ ID NO: 2158363 - RNA, 17 nt, Staphylococcus aureus subsp. aureus N315
aacauucuucaaaaaau

SEQ ID NO: 2158364 - RNA, 19 nt, Staphylococcus aureus subsp. aureus N315
aacauuauuuauauuuaga

SEQ ID NO: 2158365 - RNA, 18 nt, Staphylococcus aureus subsp. aureus N315
aacauuauuuauauuuag

SEQ ID NO: 2158366 - RNA, 14 nt, Staphylococcus aureus subsp. aureus N315
aacauuauuuuugu

SEQ ID NO: 2158367 - RNA, 18 nt, Staphylococcus aureus subsp. aureus N315
aacauuaggauguucagc

SEQ ID NO: 2158368 - RNA, 20 nt, Staphylococcus aureus subsp. aureus N315
aaccaaaucggaauaaaaua

SEQ ID NO: 2158369 - RNA, 14 nt, Staphylococcus aureus subsp. aureus N315
aacauuuaaaaaau

SEQ ID NO: 2158370 - RNA, 19 nt, Staphylococcus aureus subsp. aureus N315
aaccaaugauuguuaauac

SEQ ID NO: 2158371 - RNA, 14 nt, Staphylococcus aureus subsp. aureus N315
aaccaauuaauugu

SEQ ID NO: 2158372 - RNA, 21 nt, Staphylococcus aureus subsp. aureus N315
aaccaauuuuaacuuauauac

SEQ ID NO: 2158373 - RNA, 14 nt, Staphylococcus aureus subsp. aureus N315
aagaauaaacaaca

SEQ ID NO: 2158374 - RNA, 15 nt, Staphylococcus aureus subsp. aureus N315
aagaauacaaauauu

SEQ ID NO: 2158375 - RNA, 15 nt, Staphylococcus aureus subsp. aureus N315
aagaauauaacgaau

SEQ ID NO: 2158376 - RNA, 15 nt, Staphylococcus aureus subsp. aureus N315
aagaaucauuuaaau

SEQ ID NO: 2158377 - RNA, 15 nt, Staphylococcus aureus subsp. aureus N315
aagaaguuuccaacg

SEQ ID NO: 2158378 - RNA, 19 nt, Staphylococcus aureus subsp. aureus N315
aagaauaaaaaaguugauu

SEQ ID NO: 2158379 - RNA, 16 nt, Staphylococcus aureus subsp. aureus N315
aagaaguaauguuaaa

SEQ ID NO: 2158380 - RNA, 19 nt, Staphylococcus aureus subsp. aureus N315
aagaaggaugaguuuaaaa

SEQ ID NO: 2158381 - RNA, 15 nt, Staphylococcus aureus subsp. aureus N315
aagaacuuuaaaaau

SEQ ID NO: 2158382 - RNA, 16 nt, Staphylococcus aureus subsp. aureus N315
aagaacuuagaaaugc

SEQ ID NO: 2158383 - RNA, 16 nt, Staphylococcus aureus subsp. aureus N315
aagaacuaacauaauu

SEQ ID NO: 2158384 - RNA, 18 nt, Staphylococcus aureus subsp. aureus N315
aagaagauuaugaaaaca

SEQ ID NO: 2158385 - RNA, 22 nt, Staphylococcus aureus subsp. aureus N315
aagaaaaagugauaauuaaaau

SEQ ID NO: 2158386 - RNA, 20 nt, Staphylococcus aureus subsp. aureus N315
aagaaaaguauaaauauaaa

SEQ ID NO: 2158387 - RNA, 15 nt, Staphylococcus aureus subsp. aureus N315
aagaaagaaacauag

SEQ ID NO: 2158388 - RNA, 14 nt, Staphylococcus aureus subsp. aureus N315
aacuuggcaaugaa

SEQ ID NO: 2158389 - RNA, 16 nt, Staphylococcus aureus subsp. aureus N315
aacuuggcaaugaaau

SEQ ID NO: 2158390 - RNA, 14 nt, Staphylococcus aureus subsp. aureus N315
aacuugauuaugua

SEQ ID NO: 2158391 - RNA, 21 nt, Staphylococcus aureus subsp. aureus N315
aacuugaucauuauaaaaugg

SEQ ID NO: 2158392 - RNA, 15 nt, Staphylococcus aureus subsp. aureus N315
aacuugcgauaaguu

SEQ ID NO: 2158393 - RNA, 13 nt, Staphylococcus aureus subsp. aureus N315
aagaaauguuaaa

SEQ ID NO: 2158394 - RNA, 16 nt, Staphylococcus aureus subsp. aureus N315
aagaaauuuaauacaa

SEQ ID NO: 2158395 - RNA, 12 nt, Staphylococcus aureus subsp. aureus N315
aagaaauuuaau

SEQ ID NO: 2158396 - RNA, 18 nt, Staphylococcus aureus subsp. aureus N315
aagaaauguuaaauuaaa

SEQ ID NO: 2158397 - RNA, 15 nt, Staphylococcus aureus subsp. aureus N315
aagaaauguuaaauu

SEQ ID NO: 2158398 - RNA, 19 nt, Staphylococcus aureus subsp. aureus N315
aagaaauucuacaggcaau

SEQ ID NO: 2158399 - RNA, 13 nt, Staphylococcus aureus subsp. aureus N315
aagaaauucuaca

SEQ ID NO: 2158400 - RNA, 15 nt, Staphylococcus aureus subsp. aureus N315
aacuuauuugccaua

SEQ ID NO: 2158401 - RNA, 20 nt, Staphylococcus aureus subsp. aureus N315
aacuuauauacguugauuaa

SEQ ID NO: 2158402 - RNA, 18 nt, Staphylococcus aureus subsp. aureus N315
aacuuauucaaacagucc

SEQ ID NO: 2158403 - RNA, 18 nt, Staphylococcus aureus subsp. aureus N315
aacuucacgcaaaacaau

SEQ ID NO: 2158404 - RNA, 17 nt, Staphylococcus aureus subsp. aureus N315
aacuugaucauuauaaa

SEQ ID NO: 2158405 - RNA, 19 nt, Staphylococcus aureus subsp. aureus N315
aacuugaucauuauaaaau

SEQ ID NO: 2158406 - RNA, 21 nt, Staphylococcus aureus subsp. aureus N315
aacuucuuuuguuuuaccauc

SEQ ID NO: 2158407 - RNA, 13 nt, Staphylococcus aureus subsp. aureus N315
aacuuaaaaauga

SEQ ID NO: 2158408 - RNA, 11 nt, Staphylococcus aureus subsp. aureus N315
aacuuaaauau

SEQ ID NO: 2158409 - RNA, 14 nt, Staphylococcus aureus subsp. aureus N315
aacuuacuuuugua

SEQ ID NO: 2158410 - RNA, 20 nt, Staphylococcus aureus subsp. aureus N315
aacuuagguuauuauaaaau

SEQ ID NO: 2158411 - RNA, 20 nt, Staphylococcus aureus subsp. aureus N315
aacuuauaaaaugaaauauu

SEQ ID NO: 2158412 - RNA, 18 nt, Staphylococcus aureus subsp. aureus N315
aacuuacauuacauauau

SEQ ID NO: 2158413 - RNA, 20 nt, Staphylococcus aureus subsp. aureus N315
aacuuaaugcuucaaaugua

SEQ ID NO: 2158414 - RNA, 16 nt, Staphylococcus aureus subsp. aureus N315
aacugaauuaaagcau

SEQ ID NO: 2158415 - RNA, 20 nt, Staphylococcus aureus subsp. aureus N315
aacugcaaagccauguguag

SEQ ID NO: 2158416 - RNA, 17 nt, Staphylococcus aureus subsp. aureus N315
aacugauuuuguuucaa

SEQ ID NO: 2158417 - RNA, 22 nt, Staphylococcus aureus subsp. aureus N315
aacugauugggcugauaauaaa

SEQ ID NO: 2158418 - RNA, 18 nt, Staphylococcus aureus subsp. aureus N315
aacucuuuaauuuuacca

SEQ ID NO: 2158419 - RNA, 17 nt, Staphylococcus aureus subsp. aureus N315
aacucaaaaagccaaca

SEQ ID NO: 2158420 - RNA, 18 nt, Staphylococcus aureus subsp. aureus N315
aacugcugcuaaaauaaa

SEQ ID NO: 2158421 - RNA, 14 nt, Staphylococcus aureus subsp. aureus N315
aacugcuaauuuuu

SEQ ID NO: 2158422 - RNA, 22 nt, Staphylococcus aureus subsp. aureus N315
aacgucacaugccaucuuugua

SEQ ID NO: 2158423 - RNA, 15 nt, Staphylococcus aureus subsp. aureus N315
aacguaucauuuaaa

SEQ ID NO: 2158424 - RNA, 22 nt, Staphylococcus aureus subsp. aureus N315
aacgucauauguuuuauaauaa

SEQ ID NO: 2158425 - RNA, 18 nt, Staphylococcus aureus subsp. aureus N315
aacguuauucguuaacaa

SEQ ID NO: 2158426 - RNA, 20 nt, Staphylococcus aureus subsp. aureus N315
aacguuauucguuaacaauc

SEQ ID NO: 2158427 - RNA, 16 nt, Staphylococcus aureus subsp. aureus N315
aacguuauuuucaaua

SEQ ID NO: 2158428 - RNA, 17 nt, Staphylococcus aureus subsp. aureus N315
aacguucauauaugaua

SEQ ID NO: 2158429 - RNA, 15 nt, Staphylococcus aureus subsp. aureus N315
aacguuugaagaaug

SEQ ID NO: 2158430 - RNA, 11 nt, Staphylococcus aureus subsp. aureus N315
aacuaaaaugu

SEQ ID NO: 2158431 - RNA, 14 nt, Staphylococcus aureus subsp. aureus N315
aacuaaauguagac

SEQ ID NO: 2158432 - RNA, 22 nt, Staphylococcus aureus subsp. aureus N315
aacuaaauacgagcguugguaa

SEQ ID NO: 2158433 - RNA, 13 nt, Staphylococcus aureus subsp. aureus N315
aacuaaauuaaaa

SEQ ID NO: 2158434 - RNA, 20 nt, Staphylococcus aureus subsp. aureus N315
aacuaaagguauucuauuuu

SEQ ID NO: 2158435 - RNA, 18 nt, Staphylococcus aureus subsp. aureus N315
aacuaacacgucacaugg

SEQ ID NO: 2158436 - RNA, 17 nt, Staphylococcus aureus subsp. aureus N315
aacuaacauaauuuuua

SEQ ID NO: 2158437 - RNA, 17 nt, Staphylococcus aureus subsp. aureus N315
aacuaaguuauuuagua

SEQ ID NO: 2158438 - RNA, 12 nt, Staphylococcus aureus subsp. aureus N315
aacuaagauaua

SEQ ID NO: 2158439 - RNA, 13 nt, Staphylococcus aureus subsp. aureus N315
aacuaauuuaaag

SEQ ID NO: 2158440 - RNA, 21 nt, Staphylococcus aureus subsp. aureus N315
aacuaauuuaaagcaucauau

SEQ ID NO: 2158441 - RNA, 14 nt, Staphylococcus aureus subsp. aureus N315
aacuaaugucgcac

SEQ ID NO: 2158442 - RNA, 16 nt, Staphylococcus aureus subsp. aureus N315
aacuaauaacaaauag

SEQ ID NO: 2158443 - RNA, 17 nt, Staphylococcus aureus subsp. aureus N315
aacuaauagcauuugua

SEQ ID NO: 2158444 - RNA, 17 nt, Staphylococcus aureus subsp. aureus N315
aacuagaaaacauaaau

SEQ ID NO: 2158445 - RNA, 15 nt, Staphylococcus aureus subsp. aureus N315
aacuagaaugauuaa

SEQ ID NO: 2158446 - RNA, 15 nt, Staphylococcus aureus subsp. aureus N315
aacuauugaaaauag

SEQ ID NO: 2158447 - RNA, 22 nt, Staphylococcus aureus subsp. aureus N315
aacuaguguaaugucucuuuuc

SEQ ID NO: 2158448 - RNA, 14 nt, Staphylococcus aureus subsp. aureus N315
aacuauaaucauua

SEQ ID NO: 2158449 - RNA, 14 nt, Staphylococcus aureus subsp. aureus N315
aacuauugaaaaua

SEQ ID NO: 2158450 - RNA, 18 nt, Staphylococcus aureus subsp. aureus N315
aacuauaauaaagauuau

SEQ ID NO: 2158451 - RNA, 16 nt, Staphylococcus aureus subsp. aureus N315
aacuacgcauuuuaaa

SEQ ID NO: 2158452 - RNA, 14 nt, Staphylococcus aureus subsp. aureus N315
aacuacgcauuuua

SEQ ID NO: 2158453 - RNA, 18 nt, Staphylococcus aureus subsp. aureus N315
aacuacaauucauaagaa

SEQ ID NO: 2158454 - RNA, 18 nt, Staphylococcus aureus subsp. aureus N315
aacgguaaauaaccacuu

SEQ ID NO: 2158455 - RNA, 20 nt, Staphylococcus aureus subsp. aureus N315
aacgcuugaaaaauuuuacu

SEQ ID NO: 2158456 - RNA, 17 nt, Staphylococcus aureus subsp. aureus N315
aacgcuuuauuacuuua

SEQ ID NO: 2158457 - RNA, 14 nt, Staphylococcus aureus subsp. aureus N315
aacggaaauaacca

SEQ ID NO: 2158458 - RNA, 17 nt, Staphylococcus aureus subsp. aureus N315
aacgaucacuuggcuua

SEQ ID NO: 2158459 - RNA, 13 nt, Staphylococcus aureus subsp. aureus N315
aacgauauuuuaa

SEQ ID NO: 2158460 - RNA, 23 nt, Staphylococcus aureus subsp. aureus N315
aagcuuuuacgccuucuuuauaa

SEQ ID NO: 2158461 - RNA, 24 nt, Staphylococcus aureus subsp. aureus N315
aagcuucauauuuagguaauacau

SEQ ID NO: 2158462 - RNA, 23 nt, Staphylococcus aureus subsp. aureus N315
aagcuuuuuugcuuuuauaauaa

SEQ ID NO: 2158463 - RNA, 16 nt, Staphylococcus aureus subsp. aureus N315
aagcuuuuucuuucuc

SEQ ID NO: 2158464 - RNA, 18 nt, Staphylococcus aureus subsp. aureus N315
aagcuuuuucuuucucua

SEQ ID NO: 2158465 - RNA, 20 nt, Staphylococcus aureus subsp. aureus N315
aagcuuuuucuuucucuaac

SEQ ID NO: 2158466 - RNA, 14 nt, Staphylococcus aureus subsp. aureus N315
aaggauugaaaaaa

SEQ ID NO: 2158467 - RNA, 17 nt, Staphylococcus aureus subsp. aureus N315
aaggauaagaacgagaa

SEQ ID NO: 2158468 - RNA, 18 nt, Staphylococcus aureus subsp. aureus N315
aagcugauuuuucauuga

SEQ ID NO: 2158469 - RNA, 23 nt, Staphylococcus aureus subsp. aureus N315
aagcugauuucuaucaaauaaug

SEQ ID NO: 2158470 - RNA, 21 nt, Staphylococcus aureus subsp. aureus N315
aagcugauuucuaucaaauaa

SEQ ID NO: 2158471 - RNA, 14 nt, Staphylococcus aureus subsp. aureus N315
aagcugauuaaaau

SEQ ID NO: 2158472 - RNA, 15 nt, Staphylococcus aureus subsp. aureus N315
aagcugagcuuuaau

SEQ ID NO: 2158473 - RNA, 23 nt, Staphylococcus aureus subsp. aureus N315
aagcuguuggugaguguuucaua

SEQ ID NO: 2158474 - RNA, 20 nt, Staphylococcus aureus subsp. aureus N315
aagcugcgauauaacuaaaa

SEQ ID NO: 2158475 - RNA, 15 nt, Staphylococcus aureus subsp. aureus N315
aagcuaaagaguuau

SEQ ID NO: 2158476 - RNA, 14 nt, Staphylococcus aureus subsp. aureus N315
aagcuaaguuugaa

SEQ ID NO: 2158477 - RNA, 16 nt, Staphylococcus aureus subsp. aureus N315
aagcuaaguuugaagg

SEQ ID NO: 2158478 - RNA, 15 nt, Staphylococcus aureus subsp. aureus N315
aagcguucucccuuu

SEQ ID NO: 2158479 - RNA, 21 nt, Staphylococcus aureus subsp. aureus N315
aagggaucggucuugaaaacc

SEQ ID NO: 2158480 - RNA, 15 nt, Staphylococcus aureus subsp. aureus N315
aagggagguauauac

SEQ ID NO: 2158481 - RNA, 16 nt, Staphylococcus aureus subsp. aureus N315
aaggcgaaacauuaaa

SEQ ID NO: 2158482 - RNA, 16 nt, Staphylococcus aureus subsp. aureus N315
aaggcgcucucuuuuu

SEQ ID NO: 2158483 - RNA, 18 nt, Staphylococcus aureus subsp. aureus N315
aaggcgcucucuuuuuag

SEQ ID NO: 2158484 - RNA, 15 nt, Staphylococcus aureus subsp. aureus N315
aaggucccauuaaaa

SEQ ID NO: 2158485 - RNA, 18 nt, Staphylococcus aureus subsp. aureus N315
aaggucaccuuuaaauuu

SEQ ID NO: 2158486 - RNA, 13 nt, Staphylococcus aureus subsp. aureus N315
aagguacauaaau

SEQ ID NO: 2158487 - RNA, 17 nt, Staphylococcus aureus subsp. aureus N315
aagguacuuauuucaaa

SEQ ID NO: 2158488 - RNA, 16 nt, Staphylococcus aureus subsp. aureus N315
aaggucaaaaaauuaa

SEQ ID NO: 2158489 - RNA, 15 nt, Staphylococcus aureus subsp. aureus N315
aagguauucuauuuu

SEQ ID NO: 2158490 - RNA, 16 nt, Staphylococcus aureus subsp. aureus N315
aaggugauugaacaau

SEQ ID NO: 2158491 - RNA, 17 nt, Staphylococcus aureus subsp. aureus N315
aagguuguucuauacau

SEQ ID NO: 2158492 - RNA, 23 nt, Staphylococcus aureus subsp. aureus N315
aagguuguuuuucaucauuaaaa

SEQ ID NO: 2158493 - RNA, 22 nt, Staphylococcus aureus subsp. aureus N315
aaguaaagggagguauauacaa

SEQ ID NO: 2158494 - RNA, 12 nt, Staphylococcus aureus subsp. aureus N315
aaguaaauaaua

SEQ ID NO: 2158495 - RNA, 11 nt, Staphylococcus aureus subsp. aureus N315
aagcauuuguc

SEQ ID NO: 2158496 - RNA, 16 nt, Staphylococcus aureus subsp. aureus N315
aagccaacacauaaau

SEQ ID NO: 2158497 - RNA, 14 nt, Staphylococcus aureus subsp. aureus N315
aagcauuuuucaau

SEQ ID NO: 2158498 - RNA, 20 nt, Staphylococcus aureus subsp. aureus N315
aagcauuuuucaauuauagu

SEQ ID NO: 2158499 - RNA, 13 nt, Staphylococcus aureus subsp. aureus N315
aagccacagcuuu

SEQ ID NO: 2158500 - RNA, 23 nt, Staphylococcus aureus subsp. aureus N315
aagcccaugcccgauaaaaccac

SEQ ID NO: 2158501 - RNA, 14 nt, Staphylococcus aureus subsp. aureus N315
aagccaucuuucuu

SEQ ID NO: 2158502 - RNA, 15 nt, Staphylococcus aureus subsp. aureus N315
aagccaucuuucuuu

SEQ ID NO: 2158503 - RNA, 16 nt, Staphylococcus aureus subsp. aureus N315
aagccaugauuuagau

SEQ ID NO: 2158504 - RNA, 23 nt, Staphylococcus aureus subsp. aureus N315
aagcacgugguugguuaccaucu

SEQ ID NO: 2158505 - RNA, 14 nt, Staphylococcus aureus subsp. aureus N315
aagcaucgaacaau

SEQ ID NO: 2158506 - RNA, 15 nt, Staphylococcus aureus subsp. aureus N315
aagcaucguaaaaaa

SEQ ID NO: 2158507 - RNA, 19 nt, Staphylococcus aureus subsp. aureus N315
aagcaucguaaaaaacaaa

SEQ ID NO: 2158508 - RNA, 21 nt, Staphylococcus aureus subsp. aureus N315
aagcaucuucaauauuuaaau

SEQ ID NO: 2158509 - RNA, 18 nt, Staphylococcus aureus subsp. aureus N315
aagcaucuccaauuuaau

SEQ ID NO: 2158510 - RNA, 20 nt, Staphylococcus aureus subsp. aureus N315
aagcaugacacucauucaau

SEQ ID NO: 2158511 - RNA, 14 nt, Staphylococcus aureus subsp. aureus N315
aagcaucauauaca

SEQ ID NO: 2158512 - RNA, 14 nt, Staphylococcus aureus subsp. aureus N315
aagcauauuucuaa

SEQ ID NO: 2158513 - RNA, 16 nt, Staphylococcus aureus subsp. aureus N315
aagcaguuguugguuu

SEQ ID NO: 2158514 - RNA, 14 nt, Staphylococcus aureus subsp. aureus N315
aagcaaaagaugaa

SEQ ID NO: 2158515 - RNA, 23 nt, Staphylococcus aureus subsp. aureus N315
aagauuuguagcuugaauaauau

SEQ ID NO: 2158516 - RNA, 12 nt, Staphylococcus aureus subsp. aureus N315
aagauuuaaguc

SEQ ID NO: 2158517 - RNA, 20 nt, Staphylococcus aureus subsp. aureus N315
aagauuuaagucauuacgua

SEQ ID NO: 2158518 - RNA, 17 nt, Staphylococcus aureus subsp. aureus N315
aagcacagaaaauuaua

SEQ ID NO: 2158519 - RNA, 18 nt, Staphylococcus aureus subsp. aureus N315
aagcaaucuuaguacaaa

SEQ ID NO: 2158520 - RNA, 20 nt, Staphylococcus aureus subsp. aureus N315
aagcaauuauggagcggaag

SEQ ID NO: 2158521 - RNA, 13 nt, Staphylococcus aureus subsp. aureus N315
aagcaaucauaau

SEQ ID NO: 2158522 - RNA, 14 nt, Staphylococcus aureus subsp. aureus N315
aagcaauacgauug

SEQ ID NO: 2158523 - RNA, 23 nt, Staphylococcus aureus subsp. aureus N315
aagcaauacgauugcaauugcuu

SEQ ID NO: 2158524 - RNA, 15 nt, Staphylococcus aureus subsp. aureus N315
aagauuaugaaaaca

SEQ ID NO: 2158525 - RNA, 19 nt, Staphylococcus aureus subsp. aureus N315
aagauuagcuaugaagaaa

SEQ ID NO: 2158526 - RNA, 20 nt, Staphylococcus aureus subsp. aureus N315
aagaugcuuuaauuaaaguu

SEQ ID NO: 2158527 - RNA, 21 nt, Staphylococcus aureus subsp. aureus N315
aagaugcuuuaauuaaaguua

SEQ ID NO: 2158528 - RNA, 22 nt, Staphylococcus aureus subsp. aureus N315
aagaugugcaucccgaaaguua

SEQ ID NO: 2158529 - RNA, 22 nt, Staphylococcus aureus subsp. aureus N315
aagaugguuugaguaaauuaau

SEQ ID NO: 2158530 - RNA, 18 nt, Staphylococcus aureus subsp. aureus N315
aagaugguuuuguuuugc

SEQ ID NO: 2158531 - RNA, 16 nt, Staphylococcus aureus subsp. aureus N315
aagaugucgaaaagua

SEQ ID NO: 2158532 - RNA, 18 nt, Staphylococcus aureus subsp. aureus N315
aagaauguuucauaugca

SEQ ID NO: 2158533 - RNA, 22 nt, Staphylococcus aureus subsp. aureus N315
aagaauuaacaacaaauauaau

SEQ ID NO: 2158534 - RNA, 21 nt, Staphylococcus aureus subsp. aureus N315
aagaauuaauucgccuaaaug

SEQ ID NO: 2158535 - RNA, 13 nt, Staphylococcus aureus subsp. aureus N315
aagaauuauucaa

SEQ ID NO: 2158536 - RNA, 16 nt, Staphylococcus aureus subsp. aureus N315
aagaauuauucaagua

SEQ ID NO: 2158537 - RNA, 20 nt, Staphylococcus aureus subsp. aureus N315
aagaugaaaaagucuuucuc

SEQ ID NO: 2158538 - RNA, 18 nt, Staphylococcus aureus subsp. aureus N315
aauacucccgcauuauua

SEQ ID NO: 2158539 - RNA, 16 nt, Staphylococcus aureus subsp. aureus N315
aauacucccuucaaca

SEQ ID NO: 2158540 - RNA, 14 nt, Staphylococcus aureus subsp. aureus N315
aauacuauaugaaa

SEQ ID NO: 2158541 - RNA, 14 nt, Staphylococcus aureus subsp. aureus N315
aauacucaguuuau

SEQ ID NO: 2158542 - RNA, 15 nt, Staphylococcus aureus subsp. aureus N315
aauacucaguuuauu

SEQ ID NO: 2158543 - RNA, 22 nt, Staphylococcus aureus subsp. aureus N315
aauacuaccguuuuuauauacu

SEQ ID NO: 2158544 - RNA, 14 nt, Staphylococcus aureus subsp. aureus N315
aauacuaaucaaag

SEQ ID NO: 2158545 - RNA, 18 nt, Staphylococcus aureus subsp. aureus N315
aauacuaaucaaagaaaa

SEQ ID NO: 2158546 - RNA, 22 nt, Staphylococcus aureus subsp. aureus N315
aauacuacacuccccuuaucaa

SEQ ID NO: 2158547 - RNA, 14 nt, Staphylococcus aureus subsp. aureus N315
aauacuacauauaa

SEQ ID NO: 2158548 - RNA, 12 nt, Staphylococcus aureus subsp. aureus N315
aauagaaauaau

SEQ ID NO: 2158549 - RNA, 14 nt, Staphylococcus aureus subsp. aureus N315
aauagaaauaauca

SEQ ID NO: 2158550 - RNA, 16 nt, Staphylococcus aureus subsp. aureus N315
aauagagaaagaauaa

SEQ ID NO: 2158551 - RNA, 22 nt, Staphylococcus aureus subsp. aureus N315
aauacuuucacuuuuuauauca

SEQ ID NO: 2158552 - RNA, 17 nt, Staphylococcus aureus subsp. aureus N315
aauacuuucacuuuuua

SEQ ID NO: 2158553 - RNA, 16 nt, Staphylococcus aureus subsp. aureus N315
aauacuuuauuugaua

SEQ ID NO: 2158554 - RNA, 19 nt, Staphylococcus aureus subsp. aureus N315
aauacuugaauuuaauaag

SEQ ID NO: 2158555 - RNA, 13 nt, Staphylococcus aureus subsp. aureus N315
aauacuugaaaga

SEQ ID NO: 2158556 - RNA, 19 nt, Staphylococcus aureus subsp. aureus N315
aauacuucuuguucgauaa

SEQ ID NO: 2158557 - RNA, 17 nt, Staphylococcus aureus subsp. aureus N315
aauagaaaaauuucaaa

SEQ ID NO: 2158558 - RNA, 14 nt, Staphylococcus aureus subsp. aureus N315
aauacuuuuuaacu

SEQ ID NO: 2158559 - RNA, 13 nt, Staphylococcus aureus subsp. aureus N315
aauacuuuuuaua

SEQ ID NO: 2158560 - RNA, 15 nt, Staphylococcus aureus subsp. aureus N315
aauacuuuuuauaua

SEQ ID NO: 2158561 - RNA, 13 nt, Staphylococcus aureus subsp. aureus N315
aauacuuuuuaac

SEQ ID NO: 2158562 - RNA, 15 nt, Staphylococcus aureus subsp. aureus N315
aauaccuuuuucuaa

SEQ ID NO: 2158563 - RNA, 20 nt, Staphylococcus aureus subsp. aureus N315
aauaccuuuuucuaaaccaa

SEQ ID NO: 2158564 - RNA, 16 nt, Staphylococcus aureus subsp. aureus N315
aauacgaauuucauag

SEQ ID NO: 2158565 - RNA, 18 nt, Staphylococcus aureus subsp. aureus N315
aauaccgccuacuguuuc

SEQ ID NO: 2158566 - RNA, 17 nt, Staphylococcus aureus subsp. aureus N315
aauacauacugauuaaa

SEQ ID NO: 2158567 - RNA, 21 nt, Staphylococcus aureus subsp. aureus N315
aauacauacugauuaaacugu

SEQ ID NO: 2158568 - RNA, 16 nt, Staphylococcus aureus subsp. aureus N315
aauacauacugauuaa

SEQ ID NO: 2158569 - RNA, 11 nt, Staphylococcus aureus subsp. aureus N315
aauacaucuaa

SEQ ID NO: 2158570 - RNA, 16 nt, Staphylococcus aureus subsp. aureus N315
aauacauccauacuuc

SEQ ID NO: 2158571 - RNA, 17 nt, Staphylococcus aureus subsp. aureus N315
aauacaucuaauaaaua

SEQ ID NO: 2158572 - RNA, 18 nt, Staphylococcus aureus subsp. aureus N315
aauacaucuaauaaauau

SEQ ID NO: 2158573 - RNA, 19 nt, Staphylococcus aureus subsp. aureus N315
aauacaucuaauaaauaua

SEQ ID NO: 2158574 - RNA, 14 nt, Staphylococcus aureus subsp. aureus N315
aauacaucaucaag

SEQ ID NO: 2158575 - RNA, 18 nt, Staphylococcus aureus subsp. aureus N315
aauacuaacugaagacac

SEQ ID NO: 2158576 - RNA, 14 nt, Staphylococcus aureus subsp. aureus N315
aauacuaagauuag

SEQ ID NO: 2158577 - RNA, 23 nt, Staphylococcus aureus subsp. aureus N315
aauacguuuauccuuuaaaucau

SEQ ID NO: 2158578 - RNA, 20 nt, Staphylococcus aureus subsp. aureus N315
aauacguuuaauaaugguuc

SEQ ID NO: 2158579 - RNA, 20 nt, Staphylococcus aureus subsp. aureus N315
aauacguguguuuucuuuuc

SEQ ID NO: 2158580 - RNA, 21 nt, Staphylococcus aureus subsp. aureus N315
aauacguguguuuucuuuuca

SEQ ID NO: 2158581 - RNA, 17 nt, Staphylococcus aureus subsp. aureus N315
aauacguguguuuucuu

SEQ ID NO: 2158582 - RNA, 15 nt, Staphylococcus aureus subsp. aureus N315
aauacgucaucuuua

SEQ ID NO: 2158583 - RNA, 21 nt, Staphylococcus aureus subsp. aureus N315
aauacgaguguuuuaaucuua

SEQ ID NO: 2158584 - RNA, 14 nt, Staphylococcus aureus subsp. aureus N315
aauacgcaaaccaa

SEQ ID NO: 2158585 - RNA, 21 nt, Staphylococcus aureus subsp. aureus N315
aauacgaugaugauuuauaaa

SEQ ID NO: 2158586 - RNA, 14 nt, Staphylococcus aureus subsp. aureus N315
aauaauauauuuag

SEQ ID NO: 2158587 - RNA, 13 nt, Staphylococcus aureus subsp. aureus N315
aauaauauaaaaa

SEQ ID NO: 2158588 - RNA, 12 nt, Staphylococcus aureus subsp. aureus N315
aauaaucaaacc

SEQ ID NO: 2158589 - RNA, 19 nt, Staphylococcus aureus subsp. aureus N315
aauaauaugccauaguaau

SEQ ID NO: 2158590 - RNA, 18 nt, Staphylococcus aureus subsp. aureus N315
aaaaaucauaaauaacac

SEQ ID NO: 2158591 - RNA, 20 nt, Staphylococcus aureus subsp. aureus N315
aaaaaucauucaccuaaaaa

SEQ ID NO: 2158592 - RNA, 15 nt, Staphylococcus aureus subsp. aureus N315
aaaaaucaaagaggc

SEQ ID NO: 2158593 - RNA, 17 nt, Staphylococcus aureus subsp. aureus N315
aaaaaucacaggaaaau

SEQ ID NO: 2158594 - RNA, 17 nt, Staphylococcus aureus subsp. aureus N315
aaaaaucacgcuaacau

SEQ ID NO: 2158595 - RNA, 14 nt, Staphylococcus aureus subsp. aureus N315
aaaaauauuuacau

SEQ ID NO: 2158596 - RNA, 10 nt, Staphylococcus aureus subsp. aureus N315
aaaaaucaaa

SEQ ID NO: 2158597 - RNA, 20 nt, Staphylococcus aureus subsp. aureus N315
aaaaauauugcguuuaauuu

SEQ ID NO: 2158598 - RNA, 17 nt, Staphylococcus aureus subsp. aureus N315
aauaauaccuucaauug

SEQ ID NO: 2158599 - RNA, 18 nt, Staphylococcus aureus subsp. aureus N315
aauaauacgcuugauaaa

SEQ ID NO: 2158600 - RNA, 14 nt, Staphylococcus aureus subsp. aureus N315
aaaaauaauuaaau

SEQ ID NO: 2158601 - RNA, 11 nt, Staphylococcus aureus subsp. aureus N315
aaaaauaauug

SEQ ID NO: 2158602 - RNA, 13 nt, Staphylococcus aureus subsp. aureus N315
aaaaauacauaau

SEQ ID NO: 2158603 - RNA, 19 nt, Staphylococcus aureus subsp. aureus N315
aauaaccuagguuaaagau

SEQ ID NO: 2158604 - RNA, 22 nt, Staphylococcus aureus subsp. aureus N315
aauaacuagauguucacauucu

SEQ ID NO: 2158605 - RNA, 16 nt, Staphylococcus aureus subsp. aureus N315
aauacaaauauaucua

SEQ ID NO: 2158606 - RNA, 16 nt, Staphylococcus aureus subsp. aureus N315
aauacaaauauuaagu

SEQ ID NO: 2158607 - RNA, 14 nt, Staphylococcus aureus subsp. aureus N315
aauacaaaacaaau

SEQ ID NO: 2158608 - RNA, 22 nt, Staphylococcus aureus subsp. aureus N315
aauacaaagccuuaauaucaug

SEQ ID NO: 2158609 - RNA, 14 nt, Staphylococcus aureus subsp. aureus N315
aauacaaagaauua

SEQ ID NO: 2158610 - RNA, 11 nt, Staphylococcus aureus subsp. aureus N315
aauaauugucc

SEQ ID NO: 2158611 - RNA, 20 nt, Staphylococcus aureus subsp. aureus N315
aauaauuggaaucaucuuuu

SEQ ID NO: 2158612 - RNA, 16 nt, Staphylococcus aureus subsp. aureus N315
aauaauuggaaucauc

SEQ ID NO: 2158613 - RNA, 12 nt, Staphylococcus aureus subsp. aureus N315
aauacaauucaa

SEQ ID NO: 2158614 - RNA, 13 nt, Staphylococcus aureus subsp. aureus N315
aauacaaccauca

SEQ ID NO: 2158615 - RNA, 19 nt, Staphylococcus aureus subsp. aureus N315
aauacaagucuuuacucua

SEQ ID NO: 2158616 - RNA, 19 nt, Staphylococcus aureus subsp. aureus N315
aauacagcuagcaagaaua

SEQ ID NO: 2158617 - RNA, 20 nt, Staphylococcus aureus subsp. aureus N315
aauaaucgguaauuacuugu

SEQ ID NO: 2158618 - RNA, 18 nt, Staphylococcus aureus subsp. aureus N315
aauaaucgaacagaaaau

SEQ ID NO: 2158619 - RNA, 18 nt, Staphylococcus aureus subsp. aureus N315
aauaaucgaacauaaaua

SEQ ID NO: 2158620 - RNA, 23 nt, Staphylococcus aureus subsp. aureus N315
aauaaucccaaccauucuaccag

SEQ ID NO: 2158621 - RNA, 15 nt, Staphylococcus aureus subsp. aureus N315
aauaauccaagauau

SEQ ID NO: 2158622 - RNA, 15 nt, Staphylococcus aureus subsp. aureus N315
aauaaucauccauau

SEQ ID NO: 2158623 - RNA, 12 nt, Staphylococcus aureus subsp. aureus N315
aauaauuauuaa

SEQ ID NO: 2158624 - RNA, 18 nt, Staphylococcus aureus subsp. aureus N315
aauaauucauaaaugcuu

SEQ ID NO: 2158625 - RNA, 19 nt, Staphylococcus aureus subsp. aureus N315
aauaauucauaaaugcuuc

SEQ ID NO: 2158626 - RNA, 16 nt, Staphylococcus aureus subsp. aureus N315
aauaauuagauuuaaa

SEQ ID NO: 2158627 - RNA, 18 nt, Staphylococcus aureus subsp. aureus N315
aauaauuacuaaccuaaa

SEQ ID NO: 2158628 - RNA, 11 nt, Staphylococcus aureus subsp. aureus N315
aauaauguuuc

SEQ ID NO: 2158629 - RNA, 13 nt, Staphylococcus aureus subsp. aureus N315
aagugguaaaaau

SEQ ID NO: 2158630 - RNA, 17 nt, Staphylococcus aureus subsp. aureus N315
aagugguuguucccauu

SEQ ID NO: 2158631 - RNA, 14 nt, Staphylococcus aureus subsp. aureus N315
aaguguaaaugaaa

SEQ ID NO: 2158632 - RNA, 18 nt, Staphylococcus aureus subsp. aureus N315
aaguguaaaugaaaguac

SEQ ID NO: 2158633 - RNA, 19 nt, Staphylococcus aureus subsp. aureus N315
aaguuagacuaaaaaacua

SEQ ID NO: 2158634 - RNA, 15 nt, Staphylococcus aureus subsp. aureus N315
aaguuacuuacgcca

SEQ ID NO: 2158635 - RNA, 15 nt, Staphylococcus aureus subsp. aureus N315
aaguuauauaaauuu

SEQ ID NO: 2158636 - RNA, 15 nt, Staphylococcus aureus subsp. aureus N315
aaguucuagauuauu

SEQ ID NO: 2158637 - RNA, 13 nt, Staphylococcus aureus subsp. aureus N315
aaguuuccuaucu

SEQ ID NO: 2158638 - RNA, 19 nt, Staphylococcus aureus subsp. aureus N315
aaguuuacagguugaauaa

SEQ ID NO: 2158639 - RNA, 22 nt, Staphylococcus aureus subsp. aureus N315
aaguuucgcugcuacaccaccu

SEQ ID NO: 2158640 - RNA, 22 nt, Staphylococcus aureus subsp. aureus N315
aaguuucgcagcuuuauaaugu

SEQ ID NO: 2158641 - RNA, 23 nt, Staphylococcus aureus subsp. aureus N315
aaguuuguauauucuuuuuaacu

SEQ ID NO: 2158642 - RNA, 21 nt, Staphylococcus aureus subsp. aureus N315
aaguuugguuucuuaacauaa

SEQ ID NO: 2158643 - RNA, 18 nt, Staphylococcus aureus subsp. aureus N315
aaguuggcuggcccccaa

SEQ ID NO: 2158644 - RNA, 18 nt, Staphylococcus aureus subsp. aureus N315
aaguugcugaauaaaaua

SEQ ID NO: 2158645 - RNA, 17 nt, Staphylococcus aureus subsp. aureus N315
aaguugcacauuauaaa

SEQ ID NO: 2158646 - RNA, 21 nt, Staphylococcus aureus subsp. aureus N315
aaguaauaugagugaaaguuu

SEQ ID NO: 2158647 - RNA, 18 nt, Staphylococcus aureus subsp. aureus N315
aaguaauaaguaauaauu

SEQ ID NO: 2158648 - RNA, 20 nt, Staphylococcus aureus subsp. aureus N315
aaguaauaauauaaauaaaa

SEQ ID NO: 2158649 - RNA, 15 nt, Staphylococcus aureus subsp. aureus N315
aaguaauaauauaaa

SEQ ID NO: 2158650 - RNA, 21 nt, Staphylococcus aureus subsp. aureus N315
aagucuguugguuuaucagcu

SEQ ID NO: 2158651 - RNA, 23 nt, Staphylococcus aureus subsp. aureus N315
aagucuguugguuuaucagcuuu

SEQ ID NO: 2158652 - RNA, 21 nt, Staphylococcus aureus subsp. aureus N315
aagucuucaucuuuaaagaaa

SEQ ID NO: 2158653 - RNA, 20 nt, Staphylococcus aureus subsp. aureus N315
aagucugcugguaacucuuc

SEQ ID NO: 2158654 - RNA, 16 nt, Staphylococcus aureus subsp. aureus N315
aaguaagcaccuguua

SEQ ID NO: 2158655 - RNA, 19 nt, Staphylococcus aureus subsp. aureus N315
aaguaauaaaauaaaaaaa

SEQ ID NO: 2158656 - RNA, 13 nt, Staphylococcus aureus subsp. aureus N315
aaguaaguaaaau

SEQ ID NO: 2158657 - RNA, 13 nt, Staphylococcus aureus subsp. aureus N315
aaguaacucaagu

SEQ ID NO: 2158658 - RNA, 16 nt, Staphylococcus aureus subsp. aureus N315
aaguaacucaagugau

SEQ ID NO: 2158659 - RNA, 22 nt, Staphylococcus aureus subsp. aureus N315
aagugauuucuucauuaucaau

SEQ ID NO: 2158660 - RNA, 15 nt, Staphylococcus aureus subsp. aureus N315
aagugaugaccaaua

SEQ ID NO: 2158661 - RNA, 19 nt, Staphylococcus aureus subsp. aureus N315
aagugaugaccaauauucu

SEQ ID NO: 2158662 - RNA, 20 nt, Staphylococcus aureus subsp. aureus N315
aagugcuugauuaacauuuu

SEQ ID NO: 2158663 - RNA, 23 nt, Staphylococcus aureus subsp. aureus N315
aaguggaagguacuuauuucaaa

SEQ ID NO: 2158664 - RNA, 17 nt, Staphylococcus aureus subsp. aureus N315
aagugguaaaaaugaac

SEQ ID NO: 2158665 - RNA, 15 nt, Staphylococcus aureus subsp. aureus N315
aaguggcaaacauuu

SEQ ID NO: 2158666 - RNA, 17 nt, Staphylococcus aureus subsp. aureus N315
aauaacaaaauuaaaua

SEQ ID NO: 2158667 - RNA, 18 nt, Staphylococcus aureus subsp. aureus N315
aauaacaaaauuaaauau

SEQ ID NO: 2158668 - RNA, 21 nt, Staphylococcus aureus subsp. aureus N315
aauaaauuuagauauuauaaa

SEQ ID NO: 2158669 - RNA, 17 nt, Staphylococcus aureus subsp. aureus N315
aauaaauuuugcgaaaa

SEQ ID NO: 2158670 - RNA, 20 nt, Staphylococcus aureus subsp. aureus N315
aauaaauuuugcgaaaauau

SEQ ID NO: 2158671 - RNA, 21 nt, Staphylococcus aureus subsp. aureus N315
aauaaauuuugcgaaaauauc

SEQ ID NO: 2158672 - RNA, 23 nt, Staphylococcus aureus subsp. aureus N315
aauaaauugcacgucuuguauca

SEQ ID NO: 2158673 - RNA, 18 nt, Staphylococcus aureus subsp. aureus N315
aauaaauuguaugaauaa

SEQ ID NO: 2158674 - RNA, 21 nt, Staphylococcus aureus subsp. aureus N315
aauaaauuaugaaagugaauu

SEQ ID NO: 2158675 - RNA, 17 nt, Staphylococcus aureus subsp. aureus N315
aauaaauagauaauaua

SEQ ID NO: 2158676 - RNA, 17 nt, Staphylococcus aureus subsp. aureus N315
aauaaccgcuuaauucu

SEQ ID NO: 2158677 - RNA, 19 nt, Staphylococcus aureus subsp. aureus N315
aauaacaggugcuuacuuu

SEQ ID NO: 2158678 - RNA, 22 nt, Staphylococcus aureus subsp. aureus N315
aauaacacgauuugguugaacu

SEQ ID NO: 2158679 - RNA, 23 nt, Staphylococcus aureus subsp. aureus N315
aauaacaccuuucauuuggaaac

SEQ ID NO: 2158680 - RNA, 15 nt, Staphylococcus aureus subsp. aureus N315
aauaacaccaauuga

SEQ ID NO: 2158681 - RNA, 22 nt, Staphylococcus aureus subsp. aureus N315
aauaaagcugauuuuucauuga

SEQ ID NO: 2158682 - RNA, 19 nt, Staphylococcus aureus subsp. aureus N315
aauaaagggaguccguuaa

SEQ ID NO: 2158683 - RNA, 21 nt, Staphylococcus aureus subsp. aureus N315
aauaaagggaguccguuaauu

SEQ ID NO: 2158684 - RNA, 14 nt, Staphylococcus aureus subsp. aureus N315
aauaaauacaaugu

SEQ ID NO: 2158685 - RNA, 21 nt, Staphylococcus aureus subsp. aureus N315
aauaaauaggaugaaaaagau

SEQ ID NO: 2158686 - RNA, 22 nt, Staphylococcus aureus subsp. aureus N315
aauaaauagacugccaauaaaa

SEQ ID NO: 2158687 - RNA, 12 nt, Staphylococcus aureus subsp. aureus N315
aauaaauaacuu

SEQ ID NO: 2158688 - RNA, 12 nt, Staphylococcus aureus subsp. aureus N315
aauaaaccagug

SEQ ID NO: 2158689 - RNA, 22 nt, Staphylococcus aureus subsp. aureus N315
aauaaaccgauuguuucaccag

SEQ ID NO: 2158690 - RNA, 20 nt, Staphylococcus aureus subsp. aureus N315
aauaaaccacgcacaucuaa

SEQ ID NO: 2158691 - RNA, 18 nt, Staphylococcus aureus subsp. aureus N315
aauaaagcaauguugcau

SEQ ID NO: 2158692 - RNA, 22 nt, Staphylococcus aureus subsp. aureus N315
aauaaagcguccucuugugaaa

SEQ ID NO: 2158693 - RNA, 20 nt, Staphylococcus aureus subsp. aureus N315
aauaaaacgcuucauauaaa

SEQ ID NO: 2158694 - RNA, 18 nt, Staphylococcus aureus subsp. aureus N315
aauaaaaggcuuuguuaa

SEQ ID NO: 2158695 - RNA, 15 nt, Staphylococcus aureus subsp. aureus N315
aauaaaauauaucuu

SEQ ID NO: 2158696 - RNA, 15 nt, Staphylococcus aureus subsp. aureus N315
aauaaaaugcuacaa

SEQ ID NO: 2158697 - RNA, 22 nt, Staphylococcus aureus subsp. aureus N315
aauaaaauugugccauuugcaa

SEQ ID NO: 2158698 - RNA, 22 nt, Staphylococcus aureus subsp. aureus N315
aauaaacaacugcaauagcuau

SEQ ID NO: 2158699 - RNA, 15 nt, Staphylococcus aureus subsp. aureus N315
aauaaacaacugcaa

SEQ ID NO: 2158700 - RNA, 16 nt, Staphylococcus aureus subsp. aureus N315
aauaaacaacuaaagg

SEQ ID NO: 2158701 - RNA, 19 nt, Staphylococcus aureus subsp. aureus N315
aaguuugucuuugaacaua

SEQ ID NO: 2158702 - RNA, 20 nt, Staphylococcus aureus subsp. aureus N315
aaguuugucuuugaacauau

SEQ ID NO: 2158703 - RNA, 13 nt, Staphylococcus aureus subsp. aureus N315
aaguuuucauuua

SEQ ID NO: 2158704 - RNA, 19 nt, Staphylococcus aureus subsp. aureus N315
aaguuuucagagauucugu

SEQ ID NO: 2158705 - RNA, 13 nt, Staphylococcus aureus subsp. aureus N315
aauaaaaaaugca

SEQ ID NO: 2158706 - RNA, 15 nt, Staphylococcus aureus subsp. aureus N315
aauaaaaaaugcacu

SEQ ID NO: 2158707 - RNA, 21 nt, Staphylococcus aureus subsp. aureus N315
aauaaaaaaaucacgcuaaca

SEQ ID NO: 2158708 - RNA, 13 nt, Staphylococcus aureus subsp. aureus N315
aauaaaaaaccaa

SEQ ID NO: 2158709 - RNA, 16 nt, Staphylococcus aureus subsp. aureus N315
aauaaaaaggagcgac

SEQ ID NO: 2158710 - RNA, 17 nt, Staphylococcus aureus subsp. aureus N315
aauaaaaauacauaauu

SEQ ID NO: 2158711 - RNA, 15 nt, Staphylococcus aureus subsp. aureus N315
aauaaaaauacauaa

SEQ ID NO: 2158712 - RNA, 17 nt, Staphylococcus aureus subsp. aureus N315
aauaaaaauuauauaaa

SEQ ID NO: 2158713 - RNA, 19 nt, Staphylococcus aureus subsp. aureus N315
aauaaaaauuauauaaauu

SEQ ID NO: 2158714 - RNA, 13 nt, Staphylococcus aureus subsp. aureus N315
aauaaaacaaauu

SEQ ID NO: 2158715 - RNA, 14 nt, Staphylococcus aureus subsp. aureus N315
cggcacauucauac

SEQ ID NO: 2158716 - RNA, 22 nt, Staphylococcus aureus subsp. aureus N315
cggcacauucauaccgaagaaa

SEQ ID NO: 2158717 - RNA, 13 nt, Staphylococcus aureus subsp. aureus N315
cggaugagaaaug

SEQ ID NO: 2158718 - RNA, 21 nt, Staphylococcus aureus subsp. aureus N315
cggauguuucuucaauuuaau

SEQ ID NO: 2158719 - RNA, 22 nt, Staphylococcus aureus subsp. aureus N315
cggaauugguuuuuagugaaaa

SEQ ID NO: 2158720 - RNA, 21 nt, Staphylococcus aureus subsp. aureus N315
cggaauugguuuuuagugaaa

SEQ ID NO: 2158721 - RNA, 10 nt, Staphylococcus aureus subsp. aureus N315
cggacugaug

SEQ ID NO: 2158722 - RNA, 21 nt, Staphylococcus aureus subsp. aureus N315
cggaagcauauuucuaaauua

SEQ ID NO: 2158723 - RNA, 15 nt, Staphylococcus aureus subsp. aureus N315
cggaagauaggauuu

SEQ ID NO: 2158724 - RNA, 21 nt, Staphylococcus aureus subsp. aureus N315
cggaagauaggauuuacaccu

SEQ ID NO: 2158725 - RNA, 14 nt, Staphylococcus aureus subsp. aureus N315
cgcuacaaaacaua

SEQ ID NO: 2158726 - RNA, 11 nt, Staphylococcus aureus subsp. aureus N315
cgcuuuuuaau

SEQ ID NO: 2158727 - RNA, 16 nt, Staphylococcus aureus subsp. aureus N315
cgcuuuuuaauuugua

SEQ ID NO: 2158728 - RNA, 13 nt, Staphylococcus aureus subsp. aureus N315
cgcuuuugaaguu

SEQ ID NO: 2158729 - RNA, 17 nt, Staphylococcus aureus subsp. aureus N315
cgcuuuauuacuuuaau

SEQ ID NO: 2158730 - RNA, 17 nt, Staphylococcus aureus subsp. aureus N315
cgcuuuauucuucccaa

SEQ ID NO: 2158731 - RNA, 14 nt, Staphylococcus aureus subsp. aureus N315
cgcuuugcccgucu

SEQ ID NO: 2158732 - RNA, 14 nt, Staphylococcus aureus subsp. aureus N315
cggcauuuuuauau

SEQ ID NO: 2158733 - RNA, 17 nt, Staphylococcus aureus subsp. aureus N315
cgauaacaauuuauuaa

SEQ ID NO: 2158734 - RNA, 11 nt, Staphylococcus aureus subsp. aureus N315
cgauaaaugua

SEQ ID NO: 2158735 - RNA, 13 nt, Staphylococcus aureus subsp. aureus N315
cgauaaauaauaa

SEQ ID NO: 2158736 - RNA, 12 nt, Staphylococcus aureus subsp. aureus N315
cgauaaaagaac

SEQ ID NO: 2158737 - RNA, 19 nt, Staphylococcus aureus subsp. aureus N315
cgaguuuguuucuaaauuc

SEQ ID NO: 2158738 - RNA, 23 nt, Staphylococcus aureus subsp. aureus N315
cgaguuuguuucuaaauucuuuu

SEQ ID NO: 2158739 - RNA, 17 nt, Staphylococcus aureus subsp. aureus N315
cgauaauucuaacuuga

SEQ ID NO: 2158740 - RNA, 18 nt, Staphylococcus aureus subsp. aureus N315
cgauagcucugaaaacaa

SEQ ID NO: 2158741 - RNA, 19 nt, Staphylococcus aureus subsp. aureus N315
cgauagcucugaaaacaau

SEQ ID NO: 2158742 - RNA, 15 nt, Staphylococcus aureus subsp. aureus N315
cgagcguugguaacg

SEQ ID NO: 2158743 - RNA, 20 nt, Staphylococcus aureus subsp. aureus N315
cgagcugcuucaacuacuuc

SEQ ID NO: 2158744 - RNA, 23 nt, Staphylococcus aureus subsp. aureus N315
cgagcuuagggcuuuguuuucug

SEQ ID NO: 2158745 - RNA, 20 nt, Staphylococcus aureus subsp. aureus N315
cgagcuuugcucauagauga

SEQ ID NO: 2158746 - RNA, 16 nt, Staphylococcus aureus subsp. aureus N315
cgagcguaauggauua

SEQ ID NO: 2158747 - RNA, 14 nt, Staphylococcus aureus subsp. aureus N315
cgacguuuaaaugc

SEQ ID NO: 2158748 - RNA, 16 nt, Staphylococcus aureus subsp. aureus N315
cgacguuuaaaugccc

SEQ ID NO: 2158749 - RNA, 21 nt, Staphylococcus aureus subsp. aureus N315
cgacuuuuagauuaucuuuca

SEQ ID NO: 2158750 - RNA, 13 nt, Staphylococcus aureus subsp. aureus N315
cgacuucagauac

SEQ ID NO: 2158751 - RNA, 11 nt, Staphylococcus aureus subsp. aureus N315
cgagaaucucc

SEQ ID NO: 2158752 - RNA, 20 nt, Staphylococcus aureus subsp. aureus N315
cgagauguguccuaauaagu

SEQ ID NO: 2158753 - RNA, 13 nt, Staphylococcus aureus subsp. aureus N315
cgagcaauucuuc

SEQ ID NO: 2158754 - RNA, 18 nt, Staphylococcus aureus subsp. aureus N315
cgagcaguauauaucaaa

SEQ ID NO: 2158755 - RNA, 23 nt, Staphylococcus aureus subsp. aureus N315
cgccaauacagaacuuuaauaau

SEQ ID NO: 2158756 - RNA, 12 nt, Staphylococcus aureus subsp. aureus N315
cgcauuguugua

SEQ ID NO: 2158757 - RNA, 14 nt, Staphylococcus aureus subsp. aureus N315
cgcauuuaaauaua

SEQ ID NO: 2158758 - RNA, 16 nt, Staphylococcus aureus subsp. aureus N315
cgccaacuaauguuaa

SEQ ID NO: 2158759 - RNA, 23 nt, Staphylococcus aureus subsp. aureus N315
cgcauuuuuuauuccaaauuuga

SEQ ID NO: 2158760 - RNA, 15 nt, Staphylococcus aureus subsp. aureus N315
cgcaucaaaaaugag

SEQ ID NO: 2158761 - RNA, 14 nt, Staphylococcus aureus subsp. aureus N315
cgcaauuuaauauu

SEQ ID NO: 2158762 - RNA, 16 nt, Staphylococcus aureus subsp. aureus N315
cgcaauuuuuaacaaa

SEQ ID NO: 2158763 - RNA, 13 nt, Staphylococcus aureus subsp. aureus N315
cgcaagagauaag

SEQ ID NO: 2158764 - RNA, 20 nt, Staphylococcus aureus subsp. aureus N315
cgauuuuaaaagauaaauaa

SEQ ID NO: 2158765 - RNA, 12 nt, Staphylococcus aureus subsp. aureus N315
cgauuuuaaaga

SEQ ID NO: 2158766 - RNA, 15 nt, Staphylococcus aureus subsp. aureus N315
cgauuuuaaagaaaa

SEQ ID NO: 2158767 - RNA, 21 nt, Staphylococcus aureus subsp. aureus N315
cgaugaugauuuauaaaaacu

SEQ ID NO: 2158768 - RNA, 21 nt, Staphylococcus aureus subsp. aureus N315
cgauauguuuggauaucuuug

SEQ ID NO: 2158769 - RNA, 15 nt, Staphylococcus aureus subsp. aureus N315
cgaugcuaaaaauau

SEQ ID NO: 2158770 - RNA, 17 nt, Staphylococcus aureus subsp. aureus N315
aaacgugacauuuucaa

SEQ ID NO: 2158771 - RNA, 21 nt, Staphylococcus aureus subsp. aureus N315
aaacgugcaaauaaaaaaguu

SEQ ID NO: 2158772 - RNA, 22 nt, Staphylococcus aureus subsp. aureus N315
aaacguugaguauuacuugaaa

SEQ ID NO: 2158773 - RNA, 18 nt, Staphylococcus aureus subsp. aureus N315
aaacguugaguauuacuu

SEQ ID NO: 2158774 - RNA, 14 nt, Staphylococcus aureus subsp. aureus N315
aaacguuauguaca

SEQ ID NO: 2158775 - RNA, 16 nt, Staphylococcus aureus subsp. aureus N315
ccguauuuuaauauug

SEQ ID NO: 2158776 - RNA, 22 nt, Staphylococcus aureus subsp. aureus N315
ccguaaaaucagucauucacau

SEQ ID NO: 2158777 - RNA, 14 nt, Staphylococcus aureus subsp. aureus N315
aaaccuuacccaaa

SEQ ID NO: 2158778 - RNA, 17 nt, Staphylococcus aureus subsp. aureus N315
aaaccuuacccaaaaaa

SEQ ID NO: 2158779 - RNA, 16 nt, Staphylococcus aureus subsp. aureus N315
aaacgauucauuauau

SEQ ID NO: 2158780 - RNA, 14 nt, Staphylococcus aureus subsp. aureus N315
ccggcuuuuucuuu

SEQ ID NO: 2158781 - RNA, 17 nt, Staphylococcus aureus subsp. aureus N315
aaaccucuaaauaaaau

SEQ ID NO: 2158782 - RNA, 12 nt, Staphylococcus aureus subsp. aureus N315
aaaccucuaaau

SEQ ID NO: 2158783 - RNA, 16 nt, Staphylococcus aureus subsp. aureus N315
aaaccugggacauuaa

SEQ ID NO: 2158784 - RNA, 17 nt, Staphylococcus aureus subsp. aureus N315
aaaccugggacauuaau

SEQ ID NO: 2158785 - RNA, 16 nt, Staphylococcus aureus subsp. aureus N315
ccggaacauuaaaagg

SEQ ID NO: 2158786 - RNA, 12 nt, Staphylococcus aureus subsp. aureus N315
ccgcuauaaaau

SEQ ID NO: 2158787 - RNA, 12 nt, Staphylococcus aureus subsp. aureus N315
aaaccgauuaau

SEQ ID NO: 2158788 - RNA, 23 nt, Staphylococcus aureus subsp. aureus N315
aaaccgcacuucuauauuaauag

SEQ ID NO: 2158789 - RNA, 14 nt, Staphylococcus aureus subsp. aureus N315
ccucuaaauaaaau

SEQ ID NO: 2158790 - RNA, 21 nt, Staphylococcus aureus subsp. aureus N315
ccucuaacguuaacaauauuc

SEQ ID NO: 2158791 - RNA, 14 nt, Staphylococcus aureus subsp. aureus N315
ccucuccuucggcu

SEQ ID NO: 2158792 - RNA, 18 nt, Staphylococcus aureus subsp. aureus N315
ccucucguaaauuguugu

SEQ ID NO: 2158793 - RNA, 22 nt, Staphylococcus aureus subsp. aureus N315
ccucugauacuucaccaucuuu

SEQ ID NO: 2158794 - RNA, 19 nt, Staphylococcus aureus subsp. aureus N315
ccucguaggcauaggcuua

SEQ ID NO: 2158795 - RNA, 21 nt, Staphylococcus aureus subsp. aureus N315
aaacgcacuaucaaugacauc

SEQ ID NO: 2158796 - RNA, 15 nt, Staphylococcus aureus subsp. aureus N315
aaacgccucaacacu

SEQ ID NO: 2158797 - RNA, 20 nt, Staphylococcus aureus subsp. aureus N315
ccuauggcgcaauuuuuaac

SEQ ID NO: 2158798 - RNA, 13 nt, Staphylococcus aureus subsp. aureus N315
ccuauucccaaaa

SEQ ID NO: 2158799 - RNA, 12 nt, Staphylococcus aureus subsp. aureus N315
ccuauuaggauc

SEQ ID NO: 2158800 - RNA, 19 nt, Staphylococcus aureus subsp. aureus N315
ccucacuagauaguuuaua

SEQ ID NO: 2158801 - RNA, 15 nt, Staphylococcus aureus subsp. aureus N315
ccugauaaugcaugu

SEQ ID NO: 2158802 - RNA, 20 nt, Staphylococcus aureus subsp. aureus N315
ccugacaauucaucuaaccu

SEQ ID NO: 2158803 - RNA, 12 nt, Staphylococcus aureus subsp. aureus N315
ccucuugccuug

SEQ ID NO: 2158804 - RNA, 18 nt, Staphylococcus aureus subsp. aureus N315
ccugcauauucacgauau

SEQ ID NO: 2158805 - RNA, 23 nt, Staphylococcus aureus subsp. aureus N315
cgaagggcggucaauuuuaccau

SEQ ID NO: 2158806 - RNA, 22 nt, Staphylococcus aureus subsp. aureus N315
cgaauaacuguuuaucaugaug

SEQ ID NO: 2158807 - RNA, 21 nt, Staphylococcus aureus subsp. aureus N315
cgaagucagucaauucaaacu

SEQ ID NO: 2158808 - RNA, 13 nt, Staphylococcus aureus subsp. aureus N315
cgaaauucucuuu

SEQ ID NO: 2158809 - RNA, 23 nt, Staphylococcus aureus subsp. aureus N315
cgaaccgaagcgcagugaccuca

SEQ ID NO: 2158810 - RNA, 22 nt, Staphylococcus aureus subsp. aureus N315
cgaacaucugaaaaaauuaaua

SEQ ID NO: 2158811 - RNA, 21 nt, Staphylococcus aureus subsp. aureus N315
cgaacaugguaucuuuaauuu

SEQ ID NO: 2158812 - RNA, 19 nt, Staphylococcus aureus subsp. aureus N315
cgaaauaguucaaaauacu

SEQ ID NO: 2158813 - RNA, 21 nt, Staphylococcus aureus subsp. aureus N315
cgaaaugcaaugagcaucuug

SEQ ID NO: 2158814 - RNA, 15 nt, Staphylococcus aureus subsp. aureus N315
cgaaacauuaaaaua

SEQ ID NO: 2158815 - RNA, 23 nt, Staphylococcus aureus subsp. aureus N315
cgaaaauuucaggcguuaauaca

SEQ ID NO: 2158816 - RNA, 20 nt, Staphylococcus aureus subsp. aureus N315
cgaaaauagcuauuaaaaua

SEQ ID NO: 2158817 - RNA, 14 nt, Staphylococcus aureus subsp. aureus N315
cgaaaauaaaacaa

SEQ ID NO: 2158818 - RNA, 16 nt, Staphylococcus aureus subsp. aureus N315
cgaaaaguauaugaau

SEQ ID NO: 2158819 - RNA, 23 nt, Staphylococcus aureus subsp. aureus N315
cgaaaagaaauucuacaggcaau

SEQ ID NO: 2158820 - RNA, 23 nt, Staphylococcus aureus subsp. aureus N315
cgaaaaccucuguuuuguuggug

SEQ ID NO: 2158821 - RNA, 17 nt, Staphylococcus aureus subsp. aureus N315
ccuuuuugacucagaau

SEQ ID NO: 2158822 - RNA, 11 nt, Staphylococcus aureus subsp. aureus N315
ccuuuuuucuc

SEQ ID NO: 2158823 - RNA, 12 nt, Staphylococcus aureus subsp. aureus N315
ccuuuuuuaaag

SEQ ID NO: 2158824 - RNA, 14 nt, Staphylococcus aureus subsp. aureus N315
ccuuucuuuuucga

SEQ ID NO: 2158825 - RNA, 22 nt, Staphylococcus aureus subsp. aureus N315
ccuuucucuaaauaauuucuca

SEQ ID NO: 2158826 - RNA, 11 nt, Staphylococcus aureus subsp. aureus N315
ccuuucucuaa

SEQ ID NO: 2158827 - RNA, 16 nt, Staphylococcus aureus subsp. aureus N315
ccuucuauauaguaaa

SEQ ID NO: 2158828 - RNA, 12 nt, Staphylococcus aureus subsp. aureus N315
ccuucuaacaua

SEQ ID NO: 2158829 - RNA, 13 nt, Staphylococcus aureus subsp. aureus N315
ccuucauauuuug

SEQ ID NO: 2158830 - RNA, 13 nt, Staphylococcus aureus subsp. aureus N315
ccuuauauuuuau

SEQ ID NO: 2158831 - RNA, 12 nt, Staphylococcus aureus subsp. aureus N315
ccugugauaaaa

SEQ ID NO: 2158832 - RNA, 19 nt, Staphylococcus aureus subsp. aureus N315
ccuguaaaaccauagauaa

SEQ ID NO: 2158833 - RNA, 17 nt, Staphylococcus aureus subsp. aureus N315
ccugcuacaacuucuuc

SEQ ID NO: 2158834 - RNA, 13 nt, Staphylococcus aureus subsp. aureus N315
aaacauuuuugaa

SEQ ID NO: 2158835 - RNA, 23 nt, Staphylococcus aureus subsp. aureus N315
aaacauuuugugacuuuguucau

SEQ ID NO: 2158836 - RNA, 16 nt, Staphylococcus aureus subsp. aureus N315
aaacauuuuuagaauc

SEQ ID NO: 2158837 - RNA, 13 nt, Staphylococcus aureus subsp. aureus N315
aaaccaaaagaaa

SEQ ID NO: 2158838 - RNA, 14 nt, Staphylococcus aureus subsp. aureus N315
aaaccaaaagaaau

SEQ ID NO: 2158839 - RNA, 15 nt, Staphylococcus aureus subsp. aureus N315
aaaccaauuuuaacu

SEQ ID NO: 2158840 - RNA, 17 nt, Staphylococcus aureus subsp. aureus N315
aaaccaaugauuguuaa

SEQ ID NO: 2158841 - RNA, 13 nt, Staphylococcus aureus subsp. aureus N315
aaaccaauauuuc

SEQ ID NO: 2158842 - RNA, 20 nt, Staphylococcus aureus subsp. aureus N315
aaaccaauaauccgagucau

SEQ ID NO: 2158843 - RNA, 13 nt, Staphylococcus aureus subsp. aureus N315
aaaccaauacgaa

SEQ ID NO: 2158844 - RNA, 22 nt, Staphylococcus aureus subsp. aureus N315
aaacauuucgguaugauauuuc

SEQ ID NO: 2158845 - RNA, 16 nt, Staphylococcus aureus subsp. aureus N315
aaacaugaacaaucag

SEQ ID NO: 2158846 - RNA, 20 nt, Staphylococcus aureus subsp. aureus N315
aaacaucuaaauaguuuuuc

SEQ ID NO: 2158847 - RNA, 16 nt, Staphylococcus aureus subsp. aureus N315
aaacaucuauaacaaa

SEQ ID NO: 2158848 - RNA, 17 nt, Staphylococcus aureus subsp. aureus N315
aaacaucuauaacaaaa

SEQ ID NO: 2158849 - RNA, 21 nt, Staphylococcus aureus subsp. aureus N315
aaacaugcuuggacauauacu

SEQ ID NO: 2158850 - RNA, 18 nt, Staphylococcus aureus subsp. aureus N315
cccuuuuuaaaauacguu

SEQ ID NO: 2158851 - RNA, 19 nt, Staphylococcus aureus subsp. aureus N315
ccgaacaucugaaaaaauu

SEQ ID NO: 2158852 - RNA, 18 nt, Staphylococcus aureus subsp. aureus N315
ccgaacacaaaaaugaag

SEQ ID NO: 2158853 - RNA, 15 nt, Staphylococcus aureus subsp. aureus N315
cccugcuguuuuauu

SEQ ID NO: 2158854 - RNA, 19 nt, Staphylococcus aureus subsp. aureus N315
aaacacuuuuaguuguaac

SEQ ID NO: 2158855 - RNA, 14 nt, Staphylococcus aureus subsp. aureus N315
cccuuuagucaugu

SEQ ID NO: 2158856 - RNA, 20 nt, Staphylococcus aureus subsp. aureus N315
cccuuccuagggugccgucu

SEQ ID NO: 2158857 - RNA, 21 nt, Staphylococcus aureus subsp. aureus N315
ccgauauaauuaauuugucca

SEQ ID NO: 2158858 - RNA, 18 nt, Staphylococcus aureus subsp. aureus N315
aaacacucaaaauguuua

SEQ ID NO: 2158859 - RNA, 21 nt, Staphylococcus aureus subsp. aureus N315
ccccauuuauguguuggcuuu

SEQ ID NO: 2158860 - RNA, 12 nt, Staphylococcus aureus subsp. aureus N315
cccccaacacaa

SEQ ID NO: 2158861 - RNA, 19 nt, Staphylococcus aureus subsp. aureus N315
cccauugcuuguccucuaa

SEQ ID NO: 2158862 - RNA, 17 nt, Staphylococcus aureus subsp. aureus N315
ccccucauucacaauga

SEQ ID NO: 2158863 - RNA, 21 nt, Staphylococcus aureus subsp. aureus N315
ccccuagcaaaaauacuuuuu

SEQ ID NO: 2158864 - RNA, 21 nt, Staphylococcus aureus subsp. aureus N315
ccauucaauguuuaauuuucu

SEQ ID NO: 2158865 - RNA, 18 nt, Staphylococcus aureus subsp. aureus N315
ccauucaaaguauauacu

SEQ ID NO: 2158866 - RNA, 18 nt, Staphylococcus aureus subsp. aureus N315
ccauugaucuuuuauaau

SEQ ID NO: 2158867 - RNA, 17 nt, Staphylococcus aureus subsp. aureus N315
ccauugcacuaugcaua

SEQ ID NO: 2158868 - RNA, 15 nt, Staphylococcus aureus subsp. aureus N315
ccauuguuauccaaa

SEQ ID NO: 2158869 - RNA, 22 nt, Staphylococcus aureus subsp. aureus N315
ccauuguccaacugcuuuuuau

SEQ ID NO: 2158870 - RNA, 17 nt, Staphylococcus aureus subsp. aureus N315
ccauuuaaggauuuccu

SEQ ID NO: 2158871 - RNA, 18 nt, Staphylococcus aureus subsp. aureus N315
ccauuuaacucaccuuua

SEQ ID NO: 2158872 - RNA, 19 nt, Staphylococcus aureus subsp. aureus N315
cccaaccacgauaucuagc

SEQ ID NO: 2158873 - RNA, 22 nt, Staphylococcus aureus subsp. aureus N315
cccaacacugagaauuucuaau

SEQ ID NO: 2158874 - RNA, 20 nt, Staphylococcus aureus subsp. aureus N315
cccaauucggauuauauuua

SEQ ID NO: 2158875 - RNA, 12 nt, Staphylococcus aureus subsp. aureus N315
cccaacacagaa

SEQ ID NO: 2158876 - RNA, 13 nt, Staphylococcus aureus subsp. aureus N315
cccaacauaucac

SEQ ID NO: 2158877 - RNA, 15 nt, Staphylococcus aureus subsp. aureus N315
cccaacacagagaaa

SEQ ID NO: 2158878 - RNA, 12 nt, Staphylococcus aureus subsp. aureus N315
cccaacacagag

SEQ ID NO: 2158879 - RNA, 14 nt, Staphylococcus aureus subsp. aureus N315
cccacaccccaacu

SEQ ID NO: 2158880 - RNA, 12 nt, Staphylococcus aureus subsp. aureus N315
cccacaccccaa

SEQ ID NO: 2158881 - RNA, 11 nt, Staphylococcus aureus subsp. aureus N315
cccacacccca

SEQ ID NO: 2158882 - RNA, 21 nt, Staphylococcus aureus subsp. aureus N315
ccaucccaacuuaauaaccau

SEQ ID NO: 2158883 - RNA, 14 nt, Staphylococcus aureus subsp. aureus N315
ccaucccauucacc

SEQ ID NO: 2158884 - RNA, 16 nt, Staphylococcus aureus subsp. aureus N315
ccaucgcaacugauaa

SEQ ID NO: 2158885 - RNA, 19 nt, Staphylococcus aureus subsp. aureus N315
ccaugauuagcgcaccaau

SEQ ID NO: 2158886 - RNA, 15 nt, Staphylococcus aureus subsp. aureus N315
ccauaaauauuaaau

SEQ ID NO: 2158887 - RNA, 20 nt, Staphylococcus aureus subsp. aureus N315
ccauacuucuauuuuauaau

SEQ ID NO: 2158888 - RNA, 20 nt, Staphylococcus aureus subsp. aureus N315
ccauacucugggcauuuuga

SEQ ID NO: 2158889 - RNA, 14 nt, Staphylococcus aureus subsp. aureus N315
ccauacucuaacuu

SEQ ID NO: 2158890 - RNA, 14 nt, Staphylococcus aureus subsp. aureus N315
ccauacucugggca

SEQ ID NO: 2158891 - RNA, 21 nt, Staphylococcus aureus subsp. aureus N315
ccauacuaaauaaguaguuca

SEQ ID NO: 2158892 - RNA, 20 nt, Staphylococcus aureus subsp. aureus N315
ccauacuaaucguuccaaca

SEQ ID NO: 2158893 - RNA, 19 nt, Staphylococcus aureus subsp. aureus N315
ccauacuaaaacaugauac

SEQ ID NO: 2158894 - RNA, 15 nt, Staphylococcus aureus subsp. aureus N315
ccauacuaaauaagu

SEQ ID NO: 2158895 - RNA, 22 nt, Staphylococcus aureus subsp. aureus N315
ccauaaggauuuuuaauuuuau

SEQ ID NO: 2158896 - RNA, 17 nt, Staphylococcus aureus subsp. aureus N315
ccauaagguacauaaau

SEQ ID NO: 2158897 - RNA, 13 nt, Staphylococcus aureus subsp. aureus N315
ccauaaguaaaac

SEQ ID NO: 2158898 - RNA, 19 nt, Staphylococcus aureus subsp. aureus N315
ccauaaguaaaacugcaau

SEQ ID NO: 2158899 - RNA, 19 nt, Staphylococcus aureus subsp. aureus N315
ccauaacuuuauauauaaa

SEQ ID NO: 2158900 - RNA, 20 nt, Staphylococcus aureus subsp. aureus N315
ccaucaauauuuauauuaaa

SEQ ID NO: 2158901 - RNA, 15 nt, Staphylococcus aureus subsp. aureus N315
ccagccuauucguuu

SEQ ID NO: 2158902 - RNA, 19 nt, Staphylococcus aureus subsp. aureus N315
ccacucauaaucaagucug

SEQ ID NO: 2158903 - RNA, 21 nt, Staphylococcus aureus subsp. aureus N315
cauuucgauaccuaaaauacc

SEQ ID NO: 2158904 - RNA, 15 nt, Staphylococcus aureus subsp. aureus N315
cauuucguauauaua

SEQ ID NO: 2158905 - RNA, 21 nt, Staphylococcus aureus subsp. aureus N315
cauuucaucaauaauuucuug

SEQ ID NO: 2158906 - RNA, 21 nt, Staphylococcus aureus subsp. aureus N315
cauuuauguguuggcuuuuau

SEQ ID NO: 2158907 - RNA, 14 nt, Staphylococcus aureus subsp. aureus N315
cauuuauaaacauu

SEQ ID NO: 2158908 - RNA, 18 nt, Staphylococcus aureus subsp. aureus N315
cauuuacuugauuagauu

SEQ ID NO: 2158909 - RNA, 23 nt, Staphylococcus aureus subsp. aureus N315
cauuuacuugauuagauuugugu

SEQ ID NO: 2158910 - RNA, 13 nt, Staphylococcus aureus subsp. aureus N315
cauuucagaaaua

SEQ ID NO: 2158911 - RNA, 12 nt, Staphylococcus aureus subsp. aureus N315
cauuuauuuuca

SEQ ID NO: 2158912 - RNA, 15 nt, Staphylococcus aureus subsp. aureus N315
cauuucaauauuaaa

SEQ ID NO: 2158913 - RNA, 19 nt, Staphylococcus aureus subsp. aureus N315
cauuugcgauuucuucugc

SEQ ID NO: 2158914 - RNA, 13 nt, Staphylococcus aureus subsp. aureus N315
cauuugaccaagu

SEQ ID NO: 2158915 - RNA, 15 nt, Staphylococcus aureus subsp. aureus N315
cauuugucauaauag

SEQ ID NO: 2158916 - RNA, 14 nt, Staphylococcus aureus subsp. aureus N315
cauuuguauagauu

SEQ ID NO: 2158917 - RNA, 13 nt, Staphylococcus aureus subsp. aureus N315
cauuuguguuuuu

SEQ ID NO: 2158918 - RNA, 17 nt, Staphylococcus aureus subsp. aureus N315
cauuuguucugcagagu

SEQ ID NO: 2158919 - RNA, 22 nt, Staphylococcus aureus subsp. aureus N315
cauuuguaaauauuuuuuaaaa

SEQ ID NO: 2158920 - RNA, 18 nt, Staphylococcus aureus subsp. aureus N315
cauuugguuuaacuuuau

SEQ ID NO: 2158921 - RNA, 15 nt, Staphylococcus aureus subsp. aureus N315
cauuugguucuucua

SEQ ID NO: 2158922 - RNA, 16 nt, Staphylococcus aureus subsp. aureus N315
cauuuuaauaaaauca

SEQ ID NO: 2158923 - RNA, 16 nt, Staphylococcus aureus subsp. aureus N315
cauuuuauaaaucaaa

SEQ ID NO: 2158924 - RNA, 15 nt, Staphylococcus aureus subsp. aureus N315
cauuuuauccaaacc

SEQ ID NO: 2158925 - RNA, 16 nt, Staphylococcus aureus subsp. aureus N315
cauuuuauauuuuagu

SEQ ID NO: 2158926 - RNA, 14 nt, Staphylococcus aureus subsp. aureus N315
cauuuuaaauaaaa

SEQ ID NO: 2158927 - RNA, 11 nt, Staphylococcus aureus subsp. aureus N315
cauuuuaagug

SEQ ID NO: 2158928 - RNA, 21 nt, Staphylococcus aureus subsp. aureus N315
cauuuuaaauuuaacuaugaa

SEQ ID NO: 2158929 - RNA, 17 nt, Staphylococcus aureus subsp. aureus N315
cauuuuaaaucuaauua

SEQ ID NO: 2158930 - RNA, 17 nt, Staphylococcus aureus subsp. aureus N315
cauuuguuguuauuaua

SEQ ID NO: 2158931 - RNA, 17 nt, Staphylococcus aureus subsp. aureus N315
cauugucaugccuucau

SEQ ID NO: 2158932 - RNA, 13 nt, Staphylococcus aureus subsp. aureus N315
cauuguauaaaaa

SEQ ID NO: 2158933 - RNA, 22 nt, Staphylococcus aureus subsp. aureus N315
cauuguaaauauaguaauaaaa

SEQ ID NO: 2158934 - RNA, 15 nt, Staphylococcus aureus subsp. aureus N315
cauuguaaaaugcuc

SEQ ID NO: 2158935 - RNA, 13 nt, Staphylococcus aureus subsp. aureus N315
cauuguaaaaugu

SEQ ID NO: 2158936 - RNA, 15 nt, Staphylococcus aureus subsp. aureus N315
cauugguuucaucau

SEQ ID NO: 2158937 - RNA, 23 nt, Staphylococcus aureus subsp. aureus N315
cauugguaccuuuuuauuaucuu

SEQ ID NO: 2158938 - RNA, 13 nt, Staphylococcus aureus subsp. aureus N315
cauuuaaauauaa

SEQ ID NO: 2158939 - RNA, 15 nt, Staphylococcus aureus subsp. aureus N315
cauuuaaaaaucaaa

SEQ ID NO: 2158940 - RNA, 14 nt, Staphylococcus aureus subsp. aureus N315
cauuuaaaauauuu

SEQ ID NO: 2158941 - RNA, 14 nt, Staphylococcus aureus subsp. aureus N315
cauuuaauacuuuu

SEQ ID NO: 2158942 - RNA, 13 nt, Staphylococcus aureus subsp. aureus N315
cauuuacauccaa

SEQ ID NO: 2158943 - RNA, 11 nt, Staphylococcus aureus subsp. aureus N315
cauuuaagccu

SEQ ID NO: 2158944 - RNA, 18 nt, Staphylococcus aureus subsp. aureus N315
cauuguuauuuauacuaa

SEQ ID NO: 2158945 - RNA, 22 nt, Staphylococcus aureus subsp. aureus N315
cauuguguccauaaauauuaaa

SEQ ID NO: 2158946 - RNA, 17 nt, Staphylococcus aureus subsp. aureus N315
cauugcacuaugcauaa

SEQ ID NO: 2158947 - RNA, 22 nt, Staphylococcus aureus subsp. aureus N315
cauugauuugggcgcuuuuuaa

SEQ ID NO: 2158948 - RNA, 12 nt, Staphylococcus aureus subsp. aureus N315
cauucguuuaau

SEQ ID NO: 2158949 - RNA, 19 nt, Staphylococcus aureus subsp. aureus N315
cauuccucuauuguaucuu

SEQ ID NO: 2158950 - RNA, 17 nt, Staphylococcus aureus subsp. aureus N315
cauucauaaaugacuga

SEQ ID NO: 2158951 - RNA, 23 nt, Staphylococcus aureus subsp. aureus N315
cauucaucaauggugaccaagau

SEQ ID NO: 2158952 - RNA, 17 nt, Staphylococcus aureus subsp. aureus N315
cauuaggauguucagcu

SEQ ID NO: 2158953 - RNA, 14 nt, Staphylococcus aureus subsp. aureus N315
cauuaguacuaaac

SEQ ID NO: 2158954 - RNA, 17 nt, Staphylococcus aureus subsp. aureus N315
cauuaguuaugugcuaa

SEQ ID NO: 2158955 - RNA, 20 nt, Staphylococcus aureus subsp. aureus N315
cauuaguuguaucagugaca

SEQ ID NO: 2158956 - RNA, 18 nt, Staphylococcus aureus subsp. aureus N315
cauuaguuuuuaaaauua

SEQ ID NO: 2158957 - RNA, 17 nt, Staphylococcus aureus subsp. aureus N315
cauuauaaugauuuuua

SEQ ID NO: 2158958 - RNA, 19 nt, Staphylococcus aureus subsp. aureus N315
cauucaaguguaguaaaaa

SEQ ID NO: 2158959 - RNA, 16 nt, Staphylococcus aureus subsp. aureus N315
cauuauuugcugcuaa

SEQ ID NO: 2158960 - RNA, 16 nt, Staphylococcus aureus subsp. aureus N315
cauuauugccuaaccu

SEQ ID NO: 2158961 - RNA, 16 nt, Staphylococcus aureus subsp. aureus N315
caugugucuuccaauc

SEQ ID NO: 2158962 - RNA, 15 nt, Staphylococcus aureus subsp. aureus N315
cauguguugcaauug

SEQ ID NO: 2158963 - RNA, 18 nt, Staphylococcus aureus subsp. aureus N315
caugucuagauuuuaaau

SEQ ID NO: 2158964 - RNA, 22 nt, Staphylococcus aureus subsp. aureus N315
caugucuagauuuuaaaucaau

SEQ ID NO: 2158965 - RNA, 18 nt, Staphylococcus aureus subsp. aureus N315
cauuaaguacuuuuacaa

SEQ ID NO: 2158966 - RNA, 19 nt, Staphylococcus aureus subsp. aureus N315
cauuaaguaaucugcaaau

SEQ ID NO: 2158967 - RNA, 15 nt, Staphylococcus aureus subsp. aureus N315
cauuaaggcuuuagu

SEQ ID NO: 2158968 - RNA, 19 nt, Staphylococcus aureus subsp. aureus N315
cauuaagcuaugcuuuuuu

SEQ ID NO: 2158969 - RNA, 14 nt, Staphylococcus aureus subsp. aureus N315
cauuaauauaaaua

SEQ ID NO: 2158970 - RNA, 13 nt, Staphylococcus aureus subsp. aureus N315
cauuaaucauuua

SEQ ID NO: 2158971 - RNA, 17 nt, Staphylococcus aureus subsp. aureus N315
cauuaauaaauaauaac

SEQ ID NO: 2158972 - RNA, 19 nt, Staphylococcus aureus subsp. aureus N315
cauuacuaaaacaaauuca

SEQ ID NO: 2158973 - RNA, 18 nt, Staphylococcus aureus subsp. aureus N315
cauuacuaucuucaucau

SEQ ID NO: 2158974 - RNA, 17 nt, Staphylococcus aureus subsp. aureus N315
cauuacuaucuucauca

SEQ ID NO: 2158975 - RNA, 20 nt, Staphylococcus aureus subsp. aureus N315
cauuacuacuuuauaaauau

SEQ ID NO: 2158976 - RNA, 22 nt, Staphylococcus aureus subsp. aureus N315
cauuagccacagcuaaugugua

SEQ ID NO: 2158977 - RNA, 17 nt, Staphylococcus aureus subsp. aureus N315
cauuagcaugauaaagu

SEQ ID NO: 2158978 - RNA, 15 nt, Staphylococcus aureus subsp. aureus N315
cauuagcauuaaauu

SEQ ID NO: 2158979 - RNA, 15 nt, Staphylococcus aureus subsp. aureus N315
cauuagcaaauauua

SEQ ID NO: 2158980 - RNA, 19 nt, Staphylococcus aureus subsp. aureus N315
cauuacauguuacugauga

SEQ ID NO: 2158981 - RNA, 22 nt, Staphylococcus aureus subsp. aureus N315
cauuacauuuggcguaaugaua

SEQ ID NO: 2158982 - RNA, 19 nt, Staphylococcus aureus subsp. aureus N315
cauuacauauaucaacaug

SEQ ID NO: 2158983 - RNA, 14 nt, Staphylococcus aureus subsp. aureus N315
cauuaccagcaauu

SEQ ID NO: 2158984 - RNA, 16 nt, Staphylococcus aureus subsp. aureus N315
cauuacccuuuaaacu

SEQ ID NO: 2158985 - RNA, 17 nt, Staphylococcus aureus subsp. aureus N315
cauuacccuuuaaacuc

SEQ ID NO: 2158986 - RNA, 19 nt, Staphylococcus aureus subsp. aureus N315
cauuacgcucaucaccuuu

SEQ ID NO: 2158987 - RNA, 22 nt, Staphylococcus aureus subsp. aureus N315
caucuucaauauuuaaauuuua

SEQ ID NO: 2158988 - RNA, 15 nt, Staphylococcus aureus subsp. aureus N315
caugguaucuuuaau

SEQ ID NO: 2158989 - RNA, 15 nt, Staphylococcus aureus subsp. aureus N315
cauguacauugguuu

SEQ ID NO: 2158990 - RNA, 19 nt, Staphylococcus aureus subsp. aureus N315
cauguaaugcuuaaaaaca

SEQ ID NO: 2158991 - RNA, 20 nt, Staphylococcus aureus subsp. aureus N315
cauguacguuuuuuuaaaua

SEQ ID NO: 2158992 - RNA, 11 nt, Staphylococcus aureus subsp. aureus N315
ccaccugauaa

SEQ ID NO: 2158993 - RNA, 14 nt, Staphylococcus aureus subsp. aureus N315
ccacgguuuaccac

SEQ ID NO: 2158994 - RNA, 15 nt, Staphylococcus aureus subsp. aureus N315
ccacuauauccuuuu

SEQ ID NO: 2158995 - RNA, 22 nt, Staphylococcus aureus subsp. aureus N315
ccacuaagugaacuauuaaaac

SEQ ID NO: 2158996 - RNA, 22 nt, Staphylococcus aureus subsp. aureus N315
ccacagcuaauguguacuuaaa

SEQ ID NO: 2158997 - RNA, 23 nt, Staphylococcus aureus subsp. aureus N315
ccaaugcguggauguguuuuaau

SEQ ID NO: 2158998 - RNA, 19 nt, Staphylococcus aureus subsp. aureus N315
ccaauggaaguuuuuuagu

SEQ ID NO: 2158999 - RNA, 12 nt, Staphylococcus aureus subsp. aureus N315
ccaauguguuua

SEQ ID NO: 2159000 - RNA, 20 nt, Staphylococcus aureus subsp. aureus N315
ccaauuuaauagcuuguaca

SEQ ID NO: 2159001 - RNA, 14 nt, Staphylococcus aureus subsp. aureus N315
ccaauguguuuaac

SEQ ID NO: 2159002 - RNA, 13 nt, Staphylococcus aureus subsp. aureus N315
ccaaucaauaguu

SEQ ID NO: 2159003 - RNA, 21 nt, Staphylococcus aureus subsp. aureus N315
ccaauauuaaugaauauaggc

SEQ ID NO: 2159004 - RNA, 18 nt, Staphylococcus aureus subsp. aureus N315
ccaaucaucauuaaaucu

SEQ ID NO: 2159005 - RNA, 15 nt, Staphylococcus aureus subsp. aureus N315
ccaauacuuuuuaua

SEQ ID NO: 2159006 - RNA, 17 nt, Staphylococcus aureus subsp. aureus N315
ccaauaucauauuugaa

SEQ ID NO: 2159007 - RNA, 18 nt, Staphylococcus aureus subsp. aureus N315
ccaauagguucauuauuu

SEQ ID NO: 2159008 - RNA, 13 nt, Staphylococcus aureus subsp. aureus N315
ccaaguauuuucu

SEQ ID NO: 2159009 - RNA, 17 nt, Staphylococcus aureus subsp. aureus N315
ccaaguccaauuccaau

SEQ ID NO: 2159010 - RNA, 20 nt, Staphylococcus aureus subsp. aureus N315
ccaagauaaaucaucauucu

SEQ ID NO: 2159011 - RNA, 15 nt, Staphylococcus aureus subsp. aureus N315
ccaagauauauaacu

SEQ ID NO: 2159012 - RNA, 16 nt, Staphylococcus aureus subsp. aureus N315
ccaagaugguauugcu

SEQ ID NO: 2159013 - RNA, 17 nt, Staphylococcus aureus subsp. aureus N315
ccaagcucguuaaauca

SEQ ID NO: 2159014 - RNA, 15 nt, Staphylococcus aureus subsp. aureus N315
cauuuuaucugaaaa

SEQ ID NO: 2159015 - RNA, 14 nt, Staphylococcus aureus subsp. aureus N315
cauuuucaagagga

SEQ ID NO: 2159016 - RNA, 19 nt, Staphylococcus aureus subsp. aureus N315
cauuuucaacauaauauuu

SEQ ID NO: 2159017 - RNA, 23 nt, Staphylococcus aureus subsp. aureus N315
cauuuucaaguuuaaaauacgac

SEQ ID NO: 2159018 - RNA, 23 nt, Staphylococcus aureus subsp. aureus N315
cauuuucaauacuugaaagauuu

SEQ ID NO: 2159019 - RNA, 22 nt, Staphylococcus aureus subsp. aureus N315
cauuuucauuguauguugaaag

SEQ ID NO: 2159020 - RNA, 17 nt, Staphylococcus aureus subsp. aureus N315
cauuuucauuuaauccu

SEQ ID NO: 2159021 - RNA, 16 nt, Staphylococcus aureus subsp. aureus N315
ccaaauauuaaaaaca

SEQ ID NO: 2159022 - RNA, 21 nt, Staphylococcus aureus subsp. aureus N315
ccaacaauagguacaacuaaa

SEQ ID NO: 2159023 - RNA, 12 nt, Staphylococcus aureus subsp. aureus N315
ccaacaacuaag

SEQ ID NO: 2159024 - RNA, 21 nt, Staphylococcus aureus subsp. aureus N315
ccaaaucggaauaaaauaaau

SEQ ID NO: 2159025 - RNA, 18 nt, Staphylococcus aureus subsp. aureus N315
caucuguaacuaauauga

SEQ ID NO: 2159026 - RNA, 22 nt, Staphylococcus aureus subsp. aureus N315
caucuucaagacgcauuguugu

SEQ ID NO: 2159027 - RNA, 12 nt, Staphylococcus aureus subsp. aureus N315
caucuucaacau

SEQ ID NO: 2159028 - RNA, 22 nt, Staphylococcus aureus subsp. aureus N315
caucuuagacgcuguuuuaaau

SEQ ID NO: 2159029 - RNA, 15 nt, Staphylococcus aureus subsp. aureus N315
caucuuaucaagaau

SEQ ID NO: 2159030 - RNA, 19 nt, Staphylococcus aureus subsp. aureus N315
caucuuaucaagaauauaa

SEQ ID NO: 2159031 - RNA, 12 nt, Staphylococcus aureus subsp. aureus N315
caucucuucugg

SEQ ID NO: 2159032 - RNA, 15 nt, Staphylococcus aureus subsp. aureus N315
caucugcaagugcuu

SEQ ID NO: 2159033 - RNA, 23 nt, Staphylococcus aureus subsp. aureus N315
caucugaugaggcaauauuaaaa

SEQ ID NO: 2159034 - RNA, 15 nt, Staphylococcus aureus subsp. aureus N315
caucugcaagggauc

SEQ ID NO: 2159035 - RNA, 21 nt, Staphylococcus aureus subsp. aureus N315
caucugaugaggcaauauuaa

SEQ ID NO: 2159036 - RNA, 14 nt, Staphylococcus aureus subsp. aureus N315
caucucuaugucuc

SEQ ID NO: 2159037 - RNA, 13 nt, Staphylococcus aureus subsp. aureus N315
caucucuauuuuu

SEQ ID NO: 2159038 - RNA, 19 nt, Staphylococcus aureus subsp. aureus N315
caucuaaccuuuucaucag

SEQ ID NO: 2159039 - RNA, 22 nt, Staphylococcus aureus subsp. aureus N315
caucuaaccuuuucaucaguug

SEQ ID NO: 2159040 - RNA, 22 nt, Staphylococcus aureus subsp. aureus N315
caucgucaucacuuuuuaaacg

SEQ ID NO: 2159041 - RNA, 14 nt, Staphylococcus aureus subsp. aureus N315
caucguauucuuuu

SEQ ID NO: 2159042 - RNA, 14 nt, Staphylococcus aureus subsp. aureus N315
caucguauagaugu

SEQ ID NO: 2159043 - RNA, 18 nt, Staphylococcus aureus subsp. aureus N315
caucguaaagaucauuuu

SEQ ID NO: 2159044 - RNA, 22 nt, Staphylococcus aureus subsp. aureus N315
caucuacaacgccaauagguuc

SEQ ID NO: 2159045 - RNA, 13 nt, Staphylococcus aureus subsp. aureus N315
caucuauguggcu

SEQ ID NO: 2159046 - RNA, 18 nt, Staphylococcus aureus subsp. aureus N315
caucuauuuaauaaugua

SEQ ID NO: 2159047 - RNA, 18 nt, Staphylococcus aureus subsp. aureus N315
caucuccaccauuaauag

SEQ ID NO: 2159048 - RNA, 22 nt, Staphylococcus aureus subsp. aureus N315
caucuccaaaggccaugagcuc

SEQ ID NO: 2159049 - RNA, 21 nt, Staphylococcus aureus subsp. aureus N315
caucauucauauggaauacua

SEQ ID NO: 2159050 - RNA, 23 nt, Staphylococcus aureus subsp. aureus N315
caucauuauacgugcuuuaaagu

SEQ ID NO: 2159051 - RNA, 13 nt, Staphylococcus aureus subsp. aureus N315
caucauucucaaa

SEQ ID NO: 2159052 - RNA, 16 nt, Staphylococcus aureus subsp. aureus N315
caucgauaucuaaguc

SEQ ID NO: 2159053 - RNA, 20 nt, Staphylococcus aureus subsp. aureus N315
caucauaaucaagaauauaa

SEQ ID NO: 2159054 - RNA, 23 nt, Staphylococcus aureus subsp. aureus N315
caucauaaucuuuuccuaaaccu

SEQ ID NO: 2159055 - RNA, 15 nt, Staphylococcus aureus subsp. aureus N315
caucauaauaaaucu

SEQ ID NO: 2159056 - RNA, 23 nt, Staphylococcus aureus subsp. aureus N315
caucauaucauaccaaaaaguau

SEQ ID NO: 2159057 - RNA, 12 nt, Staphylococcus aureus subsp. aureus N315
caucauauacau

SEQ ID NO: 2159058 - RNA, 14 nt, Staphylococcus aureus subsp. aureus N315
caucaguuaauaau

SEQ ID NO: 2159059 - RNA, 21 nt, Staphylococcus aureus subsp. aureus N315
caucaguaccaaagaaaucac

SEQ ID NO: 2159060 - RNA, 12 nt, Staphylococcus aureus subsp. aureus N315
caucaucaccau

SEQ ID NO: 2159061 - RNA, 22 nt, Staphylococcus aureus subsp. aureus N315
caucaucacuguagauucaaau

SEQ ID NO: 2159062 - RNA, 16 nt, Staphylococcus aureus subsp. aureus N315
caucaucaaguucacc

SEQ ID NO: 2159063 - RNA, 12 nt, Staphylococcus aureus subsp. aureus N315
caucaucuauuu

SEQ ID NO: 2159064 - RNA, 22 nt, Staphylococcus aureus subsp. aureus N315
caucaugaacuuuuauugccau

SEQ ID NO: 2159065 - RNA, 22 nt, Staphylococcus aureus subsp. aureus N315
caucaaucgcuuuagcaauuga

SEQ ID NO: 2159066 - RNA, 21 nt, Staphylococcus aureus subsp. aureus N315
caucaaucgcuuuagcaauug

SEQ ID NO: 2159067 - RNA, 18 nt, Staphylococcus aureus subsp. aureus N315
cauacuauaaaaauuuau

SEQ ID NO: 2159068 - RNA, 16 nt, Staphylococcus aureus subsp. aureus N315
cauacucacaaaaaac

SEQ ID NO: 2159069 - RNA, 20 nt, Staphylococcus aureus subsp. aureus N315
cauauaauuugggucguuag

SEQ ID NO: 2159070 - RNA, 16 nt, Staphylococcus aureus subsp. aureus N315
cauaguuauuaaaucu

SEQ ID NO: 2159071 - RNA, 15 nt, Staphylococcus aureus subsp. aureus N315
cauauacgacauuuu

SEQ ID NO: 2159072 - RNA, 18 nt, Staphylococcus aureus subsp. aureus N315
cauauacgacauuuuuag

SEQ ID NO: 2159073 - RNA, 13 nt, Staphylococcus aureus subsp. aureus N315
cauaucuauuuuu

SEQ ID NO: 2159074 - RNA, 16 nt, Staphylococcus aureus subsp. aureus N315
cauaucuuuaucauua

SEQ ID NO: 2159075 - RNA, 15 nt, Staphylococcus aureus subsp. aureus N315
cauaucuuuugcugu

SEQ ID NO: 2159076 - RNA, 17 nt, Staphylococcus aureus subsp. aureus N315
cauauacucuaaaaaag

SEQ ID NO: 2159077 - RNA, 16 nt, Staphylococcus aureus subsp. aureus N315
cauauacucuaaaaaa

SEQ ID NO: 2159078 - RNA, 17 nt, Staphylococcus aureus subsp. aureus N315
cauaucagcuuuuucau

SEQ ID NO: 2159079 - RNA, 21 nt, Staphylococcus aureus subsp. aureus N315
cauaucaugaaugucagucgu

SEQ ID NO: 2159080 - RNA, 15 nt, Staphylococcus aureus subsp. aureus N315
cauauguaauacaaa

SEQ ID NO: 2159081 - RNA, 22 nt, Staphylococcus aureus subsp. aureus N315
cauauguuguuucuaaugcuca

SEQ ID NO: 2159082 - RNA, 20 nt, Staphylococcus aureus subsp. aureus N315
cauauugugccgcuucuaca

SEQ ID NO: 2159083 - RNA, 22 nt, Staphylococcus aureus subsp. aureus N315
cauauuuagguaauacaucauc

SEQ ID NO: 2159084 - RNA, 18 nt, Staphylococcus aureus subsp. aureus N315
cauauucaauguuuuaaa

SEQ ID NO: 2159085 - RNA, 19 nt, Staphylococcus aureus subsp. aureus N315
cauauucaauguuuuaaau

SEQ ID NO: 2159086 - RNA, 15 nt, Staphylococcus aureus subsp. aureus N315
cauauucaaaauaac

SEQ ID NO: 2159087 - RNA, 20 nt, Staphylococcus aureus subsp. aureus N315
cauauuacuuuggaaauuua

SEQ ID NO: 2159088 - RNA, 20 nt, Staphylococcus aureus subsp. aureus N315
caucaaacaacaucacuuua

SEQ ID NO: 2159089 - RNA, 19 nt, Staphylococcus aureus subsp. aureus N315
cauauuucuaaauuauuua

SEQ ID NO: 2159090 - RNA, 13 nt, Staphylococcus aureus subsp. aureus N315
cauauuuauggug

SEQ ID NO: 2159091 - RNA, 20 nt, Staphylococcus aureus subsp. aureus N315
cauauuuaucgcgauuauua

SEQ ID NO: 2159092 - RNA, 11 nt, Staphylococcus aureus subsp. aureus N315
cauauuuauau

SEQ ID NO: 2159093 - RNA, 13 nt, Staphylococcus aureus subsp. aureus N315
cauauuucuaaau

SEQ ID NO: 2159094 - RNA, 19 nt, Staphylococcus aureus subsp. aureus N315
caucaauaucuucuucuaa

SEQ ID NO: 2159095 - RNA, 23 nt, Staphylococcus aureus subsp. aureus N315
cauaacgacaacuugaacuaaaa

SEQ ID NO: 2159096 - RNA, 22 nt, Staphylococcus aureus subsp. aureus N315
cauaacgagcaguauauaucaa

SEQ ID NO: 2159097 - RNA, 18 nt, Staphylococcus aureus subsp. aureus N315
cauaacauagaaaagcag

SEQ ID NO: 2159098 - RNA, 14 nt, Staphylococcus aureus subsp. aureus N315
cauaacaaagaacc

SEQ ID NO: 2159099 - RNA, 19 nt, Staphylococcus aureus subsp. aureus N315
cauaacuguagcuccuaaa

SEQ ID NO: 2159100 - RNA, 15 nt, Staphylococcus aureus subsp. aureus N315
cauaagaaaauacua

SEQ ID NO: 2159101 - RNA, 14 nt, Staphylococcus aureus subsp. aureus N315
cauaagaaaauacu

SEQ ID NO: 2159102 - RNA, 18 nt, Staphylococcus aureus subsp. aureus N315
cauaacuguagcuccuaa

SEQ ID NO: 2159103 - RNA, 16 nt, Staphylococcus aureus subsp. aureus N315
cauaacugaauaaacc

SEQ ID NO: 2159104 - RNA, 18 nt, Staphylococcus aureus subsp. aureus N315
cauaacucaaauaucuaa

SEQ ID NO: 2159105 - RNA, 14 nt, Staphylococcus aureus subsp. aureus N315
cauaacugaauaaa

SEQ ID NO: 2159106 - RNA, 16 nt, Staphylococcus aureus subsp. aureus N315
cauaagguacauaaau

SEQ ID NO: 2159107 - RNA, 18 nt, Staphylococcus aureus subsp. aureus N315
cauaaggacucuguuuaa

SEQ ID NO: 2159108 - RNA, 23 nt, Staphylococcus aureus subsp. aureus N315
cauaagauacaggcugauuuuuu

SEQ ID NO: 2159109 - RNA, 17 nt, Staphylococcus aureus subsp. aureus N315
cauaaagugcguuuuuc

SEQ ID NO: 2159110 - RNA, 14 nt, Staphylococcus aureus subsp. aureus N315
cauaaaguuuauuu

SEQ ID NO: 2159111 - RNA, 20 nt, Staphylococcus aureus subsp. aureus N315
cauaaauaaacuuuaugaaa

SEQ ID NO: 2159112 - RNA, 15 nt, Staphylococcus aureus subsp. aureus N315
cauaaauacaaaaau

SEQ ID NO: 2159113 - RNA, 17 nt, Staphylococcus aureus subsp. aureus N315
cauaaauacaaaaauau

SEQ ID NO: 2159114 - RNA, 16 nt, Staphylococcus aureus subsp. aureus N315
cauaaagcuguuuauu

SEQ ID NO: 2159115 - RNA, 21 nt, Staphylococcus aureus subsp. aureus N315
cauaaauuguuuuacaugauu

SEQ ID NO: 2159116 - RNA, 15 nt, Staphylococcus aureus subsp. aureus N315
cauaaauuagaugaa

SEQ ID NO: 2159117 - RNA, 18 nt, Staphylococcus aureus subsp. aureus N315
cauaaauuaauauaguag

SEQ ID NO: 2159118 - RNA, 23 nt, Staphylococcus aureus subsp. aureus N315
cauaaaugcuucugguucuucaa

SEQ ID NO: 2159119 - RNA, 17 nt, Staphylococcus aureus subsp. aureus N315
cauaaaugcuaaaagua

SEQ ID NO: 2159120 - RNA, 20 nt, Staphylococcus aureus subsp. aureus N315
cauaaaugcuaaaaguauaa

SEQ ID NO: 2159121 - RNA, 15 nt, Staphylococcus aureus subsp. aureus N315
cauaaauagugaaau

SEQ ID NO: 2159122 - RNA, 17 nt, Staphylococcus aureus subsp. aureus N315
cauaaaucccuaaaaaa

SEQ ID NO: 2159123 - RNA, 18 nt, Staphylococcus aureus subsp. aureus N315
cauaaaucccuaaaaaaa

SEQ ID NO: 2159124 - RNA, 19 nt, Staphylococcus aureus subsp. aureus N315
cauaaaucccuaaaaaaac

SEQ ID NO: 2159125 - RNA, 12 nt, Staphylococcus aureus subsp. aureus N315
cauaaaucaaug

SEQ ID NO: 2159126 - RNA, 16 nt, Staphylococcus aureus subsp. aureus N315
cauaaaagacagaaau

SEQ ID NO: 2159127 - RNA, 18 nt, Staphylococcus aureus subsp. aureus N315
cauaaaacuuacauuaca

SEQ ID NO: 2159128 - RNA, 20 nt, Staphylococcus aureus subsp. aureus N315
cauaaaaaucauaaauaaca

SEQ ID NO: 2159129 - RNA, 20 nt, Staphylococcus aureus subsp. aureus N315
cauaaacaauaacuguucuu

SEQ ID NO: 2159130 - RNA, 12 nt, Staphylococcus aureus subsp. aureus N315
cauaaaauuuaa

SEQ ID NO: 2159131 - RNA, 22 nt, Staphylococcus aureus subsp. aureus N315
cauaaaauuaacuuaaaauuua

SEQ ID NO: 2159132 - RNA, 17 nt, Staphylococcus aureus subsp. aureus N315
cauaauaaucguaaaca

SEQ ID NO: 2159133 - RNA, 17 nt, Staphylococcus aureus subsp. aureus N315
cauaauccauucuucuu

SEQ ID NO: 2159134 - RNA, 22 nt, Staphylococcus aureus subsp. aureus N315
cauaaucauuaguuaugugcua

SEQ ID NO: 2159135 - RNA, 20 nt, Staphylococcus aureus subsp. aureus N315
cauaauccagccacaccaaa

SEQ ID NO: 2159136 - RNA, 18 nt, Staphylococcus aureus subsp. aureus N315
cauaauuaccuuuccauu

SEQ ID NO: 2159137 - RNA, 11 nt, Staphylococcus aureus subsp. aureus N315
cauaauuuaaa

SEQ ID NO: 2159138 - RNA, 17 nt, Staphylococcus aureus subsp. aureus N315
cauaauuuaaaagauua

SEQ ID NO: 2159139 - RNA, 22 nt, Staphylococcus aureus subsp. aureus N315
cauaauuugauguucuugaaaa

SEQ ID NO: 2159140 - RNA, 20 nt, Staphylococcus aureus subsp. aureus N315
cauaaugacuauaacaccaa

SEQ ID NO: 2159141 - RNA, 23 nt, Staphylococcus aureus subsp. aureus N315
cauaaucuuuauuaauaaauucu

SEQ ID NO: 2159142 - RNA, 15 nt, Staphylococcus aureus subsp. aureus N315
cauaaugaucaagua

SEQ ID NO: 2159143 - RNA, 12 nt, Staphylococcus aureus subsp. aureus N315
cauaaucuuuau

SEQ ID NO: 2159144 - RNA, 20 nt, Staphylococcus aureus subsp. aureus N315
cauaaugaauucauucaaua

SEQ ID NO: 2159145 - RNA, 22 nt, Staphylococcus aureus subsp. aureus N315
cauaaugacaucauguucaugu

SEQ ID NO: 2159146 - RNA, 15 nt, Staphylococcus aureus subsp. aureus N315
cauacauaucuuuug

SEQ ID NO: 2159147 - RNA, 13 nt, Staphylococcus aureus subsp. aureus N315
cauacauaugcua

SEQ ID NO: 2159148 - RNA, 23 nt, Staphylococcus aureus subsp. aureus N315
cauaccacuugaauacuuuuuaa

SEQ ID NO: 2159149 - RNA, 17 nt, Staphylococcus aureus subsp. aureus N315
cauaccuacaaauaugu

SEQ ID NO: 2159150 - RNA, 19 nt, Staphylococcus aureus subsp. aureus N315
cauaccuugauuauaugcu

SEQ ID NO: 2159151 - RNA, 18 nt, Staphylococcus aureus subsp. aureus N315
cauacgaauuaaaauaac

SEQ ID NO: 2159152 - RNA, 23 nt, Staphylococcus aureus subsp. aureus N315
cauacgaucuuuuucaaugugau

SEQ ID NO: 2159153 - RNA, 17 nt, Staphylococcus aureus subsp. aureus N315
cauaccggcaaauaaca

SEQ ID NO: 2159154 - RNA, 16 nt, Staphylococcus aureus subsp. aureus N315
caguuuuaaaugaaac

SEQ ID NO: 2159155 - RNA, 14 nt, Staphylococcus aureus subsp. aureus N315
cauaaaaaaagaac

SEQ ID NO: 2159156 - RNA, 12 nt, Staphylococcus aureus subsp. aureus N315
caguuuuuaaau

SEQ ID NO: 2159157 - RNA, 21 nt, Staphylococcus aureus subsp. aureus N315
caguuucaagugcuugguuaa

SEQ ID NO: 2159158 - RNA, 15 nt, Staphylococcus aureus subsp. aureus N315
caguuucaagugcuu

SEQ ID NO: 2159159 - RNA, 18 nt, Staphylococcus aureus subsp. aureus N315
caguuguuuuuuugucag

SEQ ID NO: 2159160 - RNA, 22 nt, Staphylococcus aureus subsp. aureus N315
caguugguauaucgaaagguaa

SEQ ID NO: 2159161 - RNA, 15 nt, Staphylococcus aureus subsp. aureus N315
caguugagucaauuu

SEQ ID NO: 2159162 - RNA, 19 nt, Staphylococcus aureus subsp. aureus N315
caguugacuguaaaacaau

SEQ ID NO: 2159163 - RNA, 12 nt, Staphylococcus aureus subsp. aureus N315
caguuagugcuu

SEQ ID NO: 2159164 - RNA, 23 nt, Staphylococcus aureus subsp. aureus N315
caguuagugcuuguuacacauga

SEQ ID NO: 2159165 - RNA, 18 nt, Staphylococcus aureus subsp. aureus N315
caguuauuuuaauaacga

SEQ ID NO: 2159166 - RNA, 14 nt, Staphylococcus aureus subsp. aureus N315
caguuaauaauuuu

SEQ ID NO: 2159167 - RNA, 12 nt, Staphylococcus aureus subsp. aureus N315
caguuaauaauu

SEQ ID NO: 2159168 - RNA, 15 nt, Staphylococcus aureus subsp. aureus N315
caguuaaaucacugc

SEQ ID NO: 2159169 - RNA, 21 nt, Staphylococcus aureus subsp. aureus N315
caguuaaaauaaccauuuuuu

SEQ ID NO: 2159170 - RNA, 19 nt, Staphylococcus aureus subsp. aureus N315
caguuacugcgcuuuuaau

SEQ ID NO: 2159171 - RNA, 21 nt, Staphylococcus aureus subsp. aureus N315
caguuacuuucgcuugcaaag

SEQ ID NO: 2159172 - RNA, 15 nt, Staphylococcus aureus subsp. aureus N315
caguuacuucaguuu

SEQ ID NO: 2159173 - RNA, 13 nt, Staphylococcus aureus subsp. aureus N315
caguuaauaugaa

SEQ ID NO: 2159174 - RNA, 16 nt, Staphylococcus aureus subsp. aureus N315
cagugcuauguauuuu

SEQ ID NO: 2159175 - RNA, 19 nt, Staphylococcus aureus subsp. aureus N315
caguggauuacagaugaug

SEQ ID NO: 2159176 - RNA, 20 nt, Staphylococcus aureus subsp. aureus N315
cagcaagagauagguuuugu

SEQ ID NO: 2159177 - RNA, 13 nt, Staphylococcus aureus subsp. aureus N315
aaaaugcacugag

SEQ ID NO: 2159178 - RNA, 16 nt, Staphylococcus aureus subsp. aureus N315
aaaaugcauuacuacu

SEQ ID NO: 2159179 - RNA, 13 nt, Staphylococcus aureus subsp. aureus N315
aaaaugccaacua

SEQ ID NO: 2159180 - RNA, 12 nt, Staphylococcus aureus subsp. aureus N315
cagcaaauaaaa

SEQ ID NO: 2159181 - RNA, 15 nt, Staphylococcus aureus subsp. aureus N315
aaaaugaguacaaca

SEQ ID NO: 2159182 - RNA, 17 nt, Staphylococcus aureus subsp. aureus N315
aaaaugaguacaacaua

SEQ ID NO: 2159183 - RNA, 21 nt, Staphylococcus aureus subsp. aureus N315
aaaaugauucuuaucuuuaau

SEQ ID NO: 2159184 - RNA, 23 nt, Staphylococcus aureus subsp. aureus N315
aaaaugauguaacguuucuuugu

SEQ ID NO: 2159185 - RNA, 15 nt, Staphylococcus aureus subsp. aureus N315
aaaaugcauagcucu

SEQ ID NO: 2159186 - RNA, 22 nt, Staphylococcus aureus subsp. aureus N315
aaaaugauuguuuuaaguggga

SEQ ID NO: 2159187 - RNA, 23 nt, Staphylococcus aureus subsp. aureus N315
cagcaaaaaauaaaucuccauua

SEQ ID NO: 2159188 - RNA, 23 nt, Staphylococcus aureus subsp. aureus N315
cagcaaaaagcccuauuguuuuu

SEQ ID NO: 2159189 - RNA, 23 nt, Staphylococcus aureus subsp. aureus N315
aaaaucucauaauaauucaguaa

SEQ ID NO: 2159190 - RNA, 21 nt, Staphylococcus aureus subsp. aureus N315
aaaaucguauagauuaaaaaa

SEQ ID NO: 2159191 - RNA, 23 nt, Staphylococcus aureus subsp. aureus N315
aaaaucguauagauuaaaaaauc

SEQ ID NO: 2159192 - RNA, 19 nt, Staphylococcus aureus subsp. aureus N315
aaaaucggauuaacauuau

SEQ ID NO: 2159193 - RNA, 17 nt, Staphylococcus aureus subsp. aureus N315
aaaaugucuuugaaaaa

SEQ ID NO: 2159194 - RNA, 16 nt, Staphylococcus aureus subsp. aureus N315
aaaauguuaauaauga

SEQ ID NO: 2159195 - RNA, 15 nt, Staphylococcus aureus subsp. aureus N315
aaaauguuacacaaa

SEQ ID NO: 2159196 - RNA, 15 nt, Staphylococcus aureus subsp. aureus N315
aaaauguguuaaaau

SEQ ID NO: 2159197 - RNA, 24 nt, Staphylococcus aureus subsp. aureus N315
aaaauguuaggugaaaccauacua

SEQ ID NO: 2159198 - RNA, 23 nt, Staphylococcus aureus subsp. aureus N315
aaaauggugauccgccuugauuu

SEQ ID NO: 2159199 - RNA, 18 nt, Staphylococcus aureus subsp. aureus N315
aaaauggcgaaaaagcua

SEQ ID NO: 2159200 - RNA, 20 nt, Staphylococcus aureus subsp. aureus N315
aaaaugucauuugaauccaa

SEQ ID NO: 2159201 - RNA, 22 nt, Staphylococcus aureus subsp. aureus N315
aaaauguaggcgccauaaucau

SEQ ID NO: 2159202 - RNA, 21 nt, Staphylococcus aureus subsp. aureus N315
aaaauccucacaaauuugaau

SEQ ID NO: 2159203 - RNA, 21 nt, Staphylococcus aureus subsp. aureus N315
aaaauccuaagcaucguaaaa

SEQ ID NO: 2159204 - RNA, 15 nt, Staphylococcus aureus subsp. aureus N315
cagauagguacuuau

SEQ ID NO: 2159205 - RNA, 23 nt, Staphylococcus aureus subsp. aureus N315
cagauagaaugucgauauuucua

SEQ ID NO: 2159206 - RNA, 17 nt, Staphylococcus aureus subsp. aureus N315
cagauaggaaacuuaaa

SEQ ID NO: 2159207 - RNA, 16 nt, Staphylococcus aureus subsp. aureus N315
cagauaauuauuucua

SEQ ID NO: 2159208 - RNA, 13 nt, Staphylococcus aureus subsp. aureus N315
cagauaauuauuu

SEQ ID NO: 2159209 - RNA, 18 nt, Staphylococcus aureus subsp. aureus N315
aaaaucacgcuaacauuc

SEQ ID NO: 2159210 - RNA, 20 nt, Staphylococcus aureus subsp. aureus N315
cagaaugaacuucucuuagu

SEQ ID NO: 2159211 - RNA, 17 nt, Staphylococcus aureus subsp. aureus N315
cagacaaccgauauaau

SEQ ID NO: 2159212 - RNA, 14 nt, Staphylococcus aureus subsp. aureus N315
cagacgaaucaaag

SEQ ID NO: 2159213 - RNA, 21 nt, Staphylococcus aureus subsp. aureus N315
cagaacuacaauucauaagaa

SEQ ID NO: 2159214 - RNA, 13 nt, Staphylococcus aureus subsp. aureus N315
cagaacuaaugua

SEQ ID NO: 2159215 - RNA, 12 nt, Staphylococcus aureus subsp. aureus N315
cagaaaguugca

SEQ ID NO: 2159216 - RNA, 14 nt, Staphylococcus aureus subsp. aureus N315
cagaacugccaaua

SEQ ID NO: 2159217 - RNA, 17 nt, Staphylococcus aureus subsp. aureus N315
cagaaaagggcaaaaaa

SEQ ID NO: 2159218 - RNA, 16 nt, Staphylococcus aureus subsp. aureus N315
cacuuuaggguucauu

SEQ ID NO: 2159219 - RNA, 23 nt, Staphylococcus aureus subsp. aureus N315
cacuuuaaacaagcaucaugaaa

SEQ ID NO: 2159220 - RNA, 17 nt, Staphylococcus aureus subsp. aureus N315
aaaauaugacacauaca

SEQ ID NO: 2159221 - RNA, 17 nt, Staphylococcus aureus subsp. aureus N315
aaaauaugauuuaaaau

SEQ ID NO: 2159222 - RNA, 19 nt, Staphylococcus aureus subsp. aureus N315
cacuuugaauacauguauu

SEQ ID NO: 2159223 - RNA, 13 nt, Staphylococcus aureus subsp. aureus N315
cacuuuauaauuu

SEQ ID NO: 2159224 - RNA, 18 nt, Staphylococcus aureus subsp. aureus N315
aaaauauuuaaacuagua

SEQ ID NO: 2159225 - RNA, 20 nt, Staphylococcus aureus subsp. aureus N315
cacuucgccaagccaucuuu

SEQ ID NO: 2159226 - RNA, 16 nt, Staphylococcus aureus subsp. aureus N315
cacuucaguuaaaccu

SEQ ID NO: 2159227 - RNA, 20 nt, Staphylococcus aureus subsp. aureus N315
cacuucaguuaaaccuucua

SEQ ID NO: 2159228 - RNA, 11 nt, Staphylococcus aureus subsp. aureus N315
cacuucauaaa

SEQ ID NO: 2159229 - RNA, 20 nt, Staphylococcus aureus subsp. aureus N315
cacuugaauacuuuuuaacu

SEQ ID NO: 2159230 - RNA, 12 nt, Staphylococcus aureus subsp. aureus N315
cacuucuucacc

SEQ ID NO: 2159231 - RNA, 13 nt, Staphylococcus aureus subsp. aureus N315
cacuugguacacc

SEQ ID NO: 2159232 - RNA, 13 nt, Staphylococcus aureus subsp. aureus N315
cacuuacaaauau

SEQ ID NO: 2159233 - RNA, 23 nt, Staphylococcus aureus subsp. aureus N315
cacuuagauuccccuuuuugucu

SEQ ID NO: 2159234 - RNA, 23 nt, Staphylococcus aureus subsp. aureus N315
cacuuaaucguucccauucuuug

SEQ ID NO: 2159235 - RNA, 21 nt, Staphylococcus aureus subsp. aureus N315
cacuuaaucguucccauucuu

SEQ ID NO: 2159236 - RNA, 22 nt, Staphylococcus aureus subsp. aureus N315
cacuuaaucguucccauucuuu

SEQ ID NO: 2159237 - RNA, 16 nt, Staphylococcus aureus subsp. aureus N315
cacuuaauauaaggaa

SEQ ID NO: 2159238 - RNA, 20 nt, Staphylococcus aureus subsp. aureus N315
cacuucaacauauaaaucau

SEQ ID NO: 2159239 - RNA, 14 nt, Staphylococcus aureus subsp. aureus N315
cacuuaucaucaca

SEQ ID NO: 2159240 - RNA, 14 nt, Staphylococcus aureus subsp. aureus N315
cacuuauaaacaaa

SEQ ID NO: 2159241 - RNA, 16 nt, Staphylococcus aureus subsp. aureus N315
cacuuaagcuuuaauc

SEQ ID NO: 2159242 - RNA, 13 nt, Staphylococcus aureus subsp. aureus N315
cacuuaacucaaa

SEQ ID NO: 2159243 - RNA, 18 nt, Staphylococcus aureus subsp. aureus N315
cacuguuuuauaaaugaa

SEQ ID NO: 2159244 - RNA, 22 nt, Staphylococcus aureus subsp. aureus N315
cacuguaacgaguccauuuucu

SEQ ID NO: 2159245 - RNA, 21 nt, Staphylococcus aureus subsp. aureus N315
cacuguauggucuggaauaaa

SEQ ID NO: 2159246 - RNA, 14 nt, Staphylococcus aureus subsp. aureus N315
cacuguauuuacua

SEQ ID NO: 2159247 - RNA, 18 nt, Staphylococcus aureus subsp. aureus N315
cacucauaaccgcuucuu

SEQ ID NO: 2159248 - RNA, 20 nt, Staphylococcus aureus subsp. aureus N315
cacucauaaccgcuucuuuu

SEQ ID NO: 2159249 - RNA, 15 nt, Staphylococcus aureus subsp. aureus N315
cacucauucaauuua

SEQ ID NO: 2159250 - RNA, 20 nt, Staphylococcus aureus subsp. aureus N315
cacucacuucaacgucaucu

SEQ ID NO: 2159251 - RNA, 16 nt, Staphylococcus aureus subsp. aureus N315
cacuauuuuuaaauga

SEQ ID NO: 2159252 - RNA, 12 nt, Staphylococcus aureus subsp. aureus N315
cacuauuuuuau

SEQ ID NO: 2159253 - RNA, 18 nt, Staphylococcus aureus subsp. aureus N315
cacuagucuuuuuauuuu

SEQ ID NO: 2159254 - RNA, 18 nt, Staphylococcus aureus subsp. aureus N315
cacuaggauguucaucaa

SEQ ID NO: 2159255 - RNA, 13 nt, Staphylococcus aureus subsp. aureus N315
cacuaucauuauc

SEQ ID NO: 2159256 - RNA, 19 nt, Staphylococcus aureus subsp. aureus N315
cacuaucauuaucaaauaa

SEQ ID NO: 2159257 - RNA, 13 nt, Staphylococcus aureus subsp. aureus N315
cacuauaauuucu

SEQ ID NO: 2159258 - RNA, 11 nt, Staphylococcus aureus subsp. aureus N315
cacuauaaaag

SEQ ID NO: 2159259 - RNA, 15 nt, Staphylococcus aureus subsp. aureus N315
cacuaucuuuugcuu

SEQ ID NO: 2159260 - RNA, 18 nt, Staphylococcus aureus subsp. aureus N315
cacguguauuguauuuua

SEQ ID NO: 2159261 - RNA, 16 nt, Staphylococcus aureus subsp. aureus N315
cacuaaugcauaauua

SEQ ID NO: 2159262 - RNA, 19 nt, Staphylococcus aureus subsp. aureus N315
cacuaaaugugacuuuaaa

SEQ ID NO: 2159263 - RNA, 14 nt, Staphylococcus aureus subsp. aureus N315
cacuaaauucaaua

SEQ ID NO: 2159264 - RNA, 20 nt, Staphylococcus aureus subsp. aureus N315
cacuaacucaauaugauaau

SEQ ID NO: 2159265 - RNA, 13 nt, Staphylococcus aureus subsp. aureus N315
cacuaaguuuucu

SEQ ID NO: 2159266 - RNA, 22 nt, Staphylococcus aureus subsp. aureus N315
cacuccucuauuuuaugauuug

SEQ ID NO: 2159267 - RNA, 15 nt, Staphylococcus aureus subsp. aureus N315
cacuccuauuguuuu

SEQ ID NO: 2159268 - RNA, 18 nt, Staphylococcus aureus subsp. aureus N315
cacuccuuaaacaaauaa

SEQ ID NO: 2159269 - RNA, 20 nt, Staphylococcus aureus subsp. aureus N315
cacuccuuaaacaaauaaau

SEQ ID NO: 2159270 - RNA, 23 nt, Staphylococcus aureus subsp. aureus N315
cacucuagagguaaaucuaucua

SEQ ID NO: 2159271 - RNA, 14 nt, Staphylococcus aureus subsp. aureus N315
cacugcaacauuug

SEQ ID NO: 2159272 - RNA, 20 nt, Staphylococcus aureus subsp. aureus N315
cacugcacaucauaauaaau

SEQ ID NO: 2159273 - RNA, 17 nt, Staphylococcus aureus subsp. aureus N315
cacugagaauuucuaau

SEQ ID NO: 2159274 - RNA, 17 nt, Staphylococcus aureus subsp. aureus N315
cacugagcaacaaaaga

SEQ ID NO: 2159275 - RNA, 21 nt, Staphylococcus aureus subsp. aureus N315
aaaauuccuagcuuuuauguc

SEQ ID NO: 2159276 - RNA, 20 nt, Staphylococcus aureus subsp. aureus N315
aaaauucgcuuguaacaagc

SEQ ID NO: 2159277 - RNA, 18 nt, Staphylococcus aureus subsp. aureus N315
aaaauuauauaaauuacc

SEQ ID NO: 2159278 - RNA, 11 nt, Staphylococcus aureus subsp. aureus N315
aaaauuauaug

SEQ ID NO: 2159279 - RNA, 14 nt, Staphylococcus aureus subsp. aureus N315
aaaauucaccaacu

SEQ ID NO: 2159280 - RNA, 14 nt, Staphylococcus aureus subsp. aureus N315
aaaauucaauauua

SEQ ID NO: 2159281 - RNA, 12 nt, Staphylococcus aureus subsp. aureus N315
aaaauuaucaau

SEQ ID NO: 2159282 - RNA, 12 nt, Staphylococcus aureus subsp. aureus N315
aaaauuauuaaa

SEQ ID NO: 2159283 - RNA, 14 nt, Staphylococcus aureus subsp. aureus N315
aaaauuauuaaaaa

SEQ ID NO: 2159284 - RNA, 15 nt, Staphylococcus aureus subsp. aureus N315
aaaauuaacuuaaaa

SEQ ID NO: 2159285 - RNA, 15 nt, Staphylococcus aureus subsp. aureus N315
aaaauuaaauaauga

SEQ ID NO: 2159286 - RNA, 16 nt, Staphylococcus aureus subsp. aureus N315
aaaauguuuaacaaua

SEQ ID NO: 2159287 - RNA, 14 nt, Staphylococcus aureus subsp. aureus N315
aaaauuaaaacagc

SEQ ID NO: 2159288 - RNA, 17 nt, Staphylococcus aureus subsp. aureus N315
aaaauguuuaacaauaa

SEQ ID NO: 2159289 - RNA, 13 nt, Staphylococcus aureus subsp. aureus N315
aaaauuaaaaaac

SEQ ID NO: 2159290 - RNA, 16 nt, Staphylococcus aureus subsp. aureus N315
cagcgauuaaaugaug

SEQ ID NO: 2159291 - RNA, 20 nt, Staphylococcus aureus subsp. aureus N315
cagcgauaacguacaaugua

SEQ ID NO: 2159292 - RNA, 14 nt, Staphylococcus aureus subsp. aureus N315
cagcgacauuuuua

SEQ ID NO: 2159293 - RNA, 15 nt, Staphylococcus aureus subsp. aureus N315
aaacaaaaaucuacu

SEQ ID NO: 2159294 - RNA, 14 nt, Staphylococcus aureus subsp. aureus N315
aaacaaaagaaagu

SEQ ID NO: 2159295 - RNA, 13 nt, Staphylococcus aureus subsp. aureus N315
aaacaaaaaauau

SEQ ID NO: 2159296 - RNA, 14 nt, Staphylococcus aureus subsp. aureus N315
aaacaaaacaaaaa

SEQ ID NO: 2159297 - RNA, 21 nt, Staphylococcus aureus subsp. aureus N315
cagggucuagggcauugauuc

SEQ ID NO: 2159298 - RNA, 14 nt, Staphylococcus aureus subsp. aureus N315
cagguaaugcaagu

SEQ ID NO: 2159299 - RNA, 19 nt, Staphylococcus aureus subsp. aureus N315
cagguaaugcaaguuggcg

SEQ ID NO: 2159300 - RNA, 17 nt, Staphylococcus aureus subsp. aureus N315
caggcgaaccgaagcgc

SEQ ID NO: 2159301 - RNA, 20 nt, Staphylococcus aureus subsp. aureus N315
caggcgaaccgaagcgcagu

SEQ ID NO: 2159302 - RNA, 23 nt, Staphylococcus aureus subsp. aureus N315
caggcgaaccgaagcgcagugac

SEQ ID NO: 2159303 - RNA, 14 nt, Staphylococcus aureus subsp. aureus N315
cagggaaaucaucu

SEQ ID NO: 2159304 - RNA, 14 nt, Staphylococcus aureus subsp. aureus N315
caggcaaugcaagu

SEQ ID NO: 2159305 - RNA, 20 nt, Staphylococcus aureus subsp. aureus N315
caggaccacucaauucucua

SEQ ID NO: 2159306 - RNA, 20 nt, Staphylococcus aureus subsp. aureus N315
aaaauuucauauuguuuagg

SEQ ID NO: 2159307 - RNA, 10 nt, Staphylococcus aureus subsp. aureus N315
caggaaggaa

SEQ ID NO: 2159308 - RNA, 14 nt, Staphylococcus aureus subsp. aureus N315
cagcuuuaauaaua

SEQ ID NO: 2159309 - RNA, 17 nt, Staphylococcus aureus subsp. aureus N315
cagcuuuaauaauauga

SEQ ID NO: 2159310 - RNA, 23 nt, Staphylococcus aureus subsp. aureus N315
aaaauugaaggaaaauaaaaacc

SEQ ID NO: 2159311 - RNA, 16 nt, Staphylococcus aureus subsp. aureus N315
aaaauugaauaucacu

SEQ ID NO: 2159312 - RNA, 19 nt, Staphylococcus aureus subsp. aureus N315
cagcuaaaaguuucccaag

SEQ ID NO: 2159313 - RNA, 18 nt, Human
uaacgaaguauccuucag

SEQ ID NO: 2159314 - RNA, 22 nt, Human
uaacugauuuguaacaagccuc

SEQ ID NO: 2159315 - RNA, 20 nt, Human
uauaaauaaaaauaauccuc

SEQ ID NO: 2159316 - RNA, 18 nt, Human
ucagccagcccucuucug

SEQ ID NO: 2159317 - RNA, 22 nt, Human
ucauuaaaguucuagugaccga

SEQ ID NO: 2159318 - RNA, 16 nt, Human
ucauucugccugcccu

SEQ ID NO: 2159319 - RNA, 15 nt, Human
gcccagcuugaaacc

SEQ ID NO: 2159320 - RNA, 20 nt, Human
cuuacuaguuucccuugcau

SEQ ID NO: 2159321 - RNA, 18 nt, Human
gaccauacuaauuauacc

SEQ ID NO: 2159322 - RNA, 16 nt, Human
ccugaucaccugcccu

SEQ ID NO: 2159323 - RNA, 16 nt, Human
ccucaccccuugccau

SEQ ID NO: 2159324 - RNA, 15 nt, Human
uucuacuacauggaa

SEQ ID NO: 2159325 - RNA, 13 nt, Human
cuaucuuugagcg

SEQ ID NO: 2159326 - RNA, 19 nt, Human
cgcucggccugcucgccca

SEQ ID NO: 2159327 - RNA, 19 nt, Human
cuagcaugucgucaaagcu

SEQ ID NO: 2159328 - RNA, 13 nt, Human
aaaguucuaguga

SEQ ID NO: 2159329 - RNA, 20 nt, Human
acccuacaaaaccacuggaa

SEQ ID NO: 2159330 - RNA, 12 nt, Human
aagcucuaucac

SEQ ID NO: 2159331 - RNA, 13 nt, Human
aauucugaaagca

SEQ ID NO: 2159332 - RNA, 19 nt, Human
auauuguuugcuaagcauu

SEQ ID NO: 2159333 - RNA, 20 nt, Human
agaccuuugaacuagaguuu

SEQ ID NO: 2159334 - RNA, 23 nt, Human
acuuguguuuugcaagccagauu

SEQ ID NO: 2159335 - RNA, 17 nt, Human
auuaaaguucuagugac

SEQ ID NO: 2159336 - RNA, 15 nt, Human
gccucauguccacug

SEQ ID NO: 2159337 - RNA, 13 nt, Human
ggaauuucuucaa

SEQ ID NO: 2159338 - RNA, 15 nt, Human
gaauuggagcucgug

SEQ ID NO: 2159339 - RNA, 16 nt, Human
gagccuccagcugccc

SEQ ID NO: 2159340 - RNA, 22 nt, Human
gagcucccaggaggggcuucug

SEQ ID NO: 2159341 - RNA, 17 nt, Human
cgcuguuccucgccacg

SEQ ID NO: 2159342 - RNA, 16 nt, Human
uagguagaucuggucu

SEQ ID NO: 2159343 - RNA, 22 nt, Human
uaaaauggugugaccacugcag

SEQ ID NO: 2159344 - RNA, 17 nt, Human
uaaaguguuugaaagcu

SEQ ID NO: 2159345 - RNA, 13 nt, Human
uaacaaugaaagu

SEQ ID NO: 2159346 - RNA, 18 nt, Human
gucaccucauggaauugg

SEQ ID NO: 2159347 - RNA, 17 nt, Human
guauggugggaaguugg

SEQ ID NO: 2159348 - RNA, 20 nt, Human
ucccuggaaucuuguaaagg

SEQ ID NO: 2159349 - RNA, 19 nt, Human
ucccuugaugaagaaguug

SEQ ID NO: 2159350 - RNA, 14 nt, Human
ugagaugcuagaac

SEQ ID NO: 2159351 - RNA, 21 nt, Human
uguaauuuuuuugugggaaau

SEQ ID NO: 2159352 - RNA, 12 nt, Human
uguaaaauggug

SEQ ID NO: 2159353 - RNA, 18 nt, Human
ugucuuugccaaguucuc

SEQ ID NO: 2159354 - RNA, 18 nt, Human
ugaaaaucuacacuccag

SEQ ID NO: 2159355 - RNA, 19 nt, Human
uugacacuuaaaaaugguu

SEQ ID NO: 2159356 - RNA, 21 nt, Human
ccccggggaggggcgcucgcu

SEQ ID NO: 2159357 - RNA, 21 nt, Human
guuauuuuuaaacuguaaagc

SEQ ID NO: 2159358 - RNA, 18 nt, Human
gucugugagaugcuagaa

SEQ ID NO: 2159359 - RNA, 19 nt, Human
gucgucaaagcugaaaugg

SEQ ID NO: 2159360 - RNA, 15 nt, Human
uacauggaagaccuc

SEQ ID NO: 2159361 - RNA, 16 nt, Human
uauguuagugcaaauu

SEQ ID NO: 2159362 - RNA, 19 nt, Human
ucaagaagcaucgugucug

SEQ ID NO: 2159363 - RNA, 21 nt, Human
ucaaaggacaccauuuuggca

SEQ ID NO: 2159364 - RNA, 16 nt, Human
aaaguguuugaaagcu

SEQ ID NO: 2159365 - RNA, 17 nt, Human
aaaauaacaaugaaagu

SEQ ID NO: 2159366 - RNA, 18 nt, Human
acaugaaguccaagcauu

SEQ ID NO: 2159367 - RNA, 22 nt, Human
acuguaaaauaauaacugggaa

SEQ ID NO: 2159368 - RNA, 16 nt, Human
agccagcccucuucug

SEQ ID NO: 2159369 - RNA, 14 nt, Human
cacagauuugagcu

SEQ ID NO: 2159370 - RNA, 22 nt, Human
cauccugaggcuccacuugguc

SEQ ID NO: 2159371 - RNA, 17 nt, Human
ccaagugauugaaaccu

SEQ ID NO: 2159372 - RNA, 19 nt, Human
ccagaucaagccugccuca

SEQ ID NO: 2159373 - RNA, 17 nt, Human
augaucaguaugaaaau

SEQ ID NO: 2159374 - RNA, 17 nt, Human
aucacaugaacuuguaa

SEQ ID NO: 2159375 - RNA, 11 nt, Human
uuugaaauugu

SEQ ID NO: 2159376 - RNA, 14 nt, Human
aggggcgcucgcuu

SEQ ID NO: 2159377 - RNA, 12 nt, Human
agucucuaucau

SEQ ID NO: 2159378 - RNA, 20 nt, Human
uaauuuugugaagcaaaauu

SEQ ID NO: 2159379 - RNA, 14 nt, Human
uaauucugaaagca

SEQ ID NO: 2159380 - RNA, 14 nt, Human
guuggugaacuugg

SEQ ID NO: 2159381 - RNA, 13 nt, Human
guucugauauugg

SEQ ID NO: 2159382 - RNA, 15 nt, Human
ucaacucccugcccc

SEQ ID NO: 2159383 - RNA, 15 nt, Human
ucagcugccucccca

SEQ ID NO: 2159384 - RNA, 17 nt, Human
ugcaaauacucuggucc

SEQ ID NO: 2159385 - RNA, 13 nt, Human
ucuuagaugcagu

SEQ ID NO: 2159386 - RNA, 14 nt, Human
gcucauggaauugg

SEQ ID NO: 2159387 - RNA, 18 nt, Human
cuuggucugugagaugcu

SEQ ID NO: 2159388 - RNA, 12 nt, Human
cuccauccugag

SEQ ID NO: 2159389 - RNA, 18 nt, Human
cacuuggucugugagaug

SEQ ID NO: 2159390 - RNA, 10 nt, Human
cugaugcagu

SEQ ID NO: 2159391 - RNA, 15 nt, Human
cccggccggcgcgcu

SEQ ID NO: 2159392 - RNA, 17 nt, Human
uuucacauuuaaauaaa

SEQ ID NO: 2159393 - RNA, 17 nt, Human
uucugacacuaaaacac

SEQ ID NO: 2159394 - RNA, 16 nt, Human
cuacacuccagugaga

SEQ ID NO: 2159395 - RNA, 20 nt, Human
cucuucugacacuaaaacac

SEQ ID NO: 2159396 - RNA, 13 nt, Human
cuccagcugcccc

SEQ ID NO: 2159397 - RNA, 22 nt, Human
agcgcgcgcgcccucuggcugc

SEQ ID NO: 2159398 - RNA, 16 nt, Human
acggagccgggaaaga

SEQ ID NO: 2159399 - RNA, 20 nt, Human
caagcucuaucaccaaggag

SEQ ID NO: 2159400 - RNA, 19 nt, Human
aaagacagugaaagaaaau

SEQ ID NO: 2159401 - RNA, 20 nt, Human
ucgugucuggcguugugggg

SEQ ID NO: 2159402 - RNA, 13 nt, Human
augacauuuuguu

SEQ ID NO: 2159403 - RNA, 22 nt, Human
auaacaaugcuguauuuuaaaa

SEQ ID NO: 2159404 - RNA, 19 nt, Human
gagccugaucaccugcccu

SEQ ID NO: 2159405 - RNA, 15 nt, Human
gugaacuugguuuua

SEQ ID NO: 2159406 - RNA, 17 nt, Human
uaaaagacagugaaaga

SEQ ID NO: 2159407 - RNA, 21 nt, Human
gcccugcugagucccaggcug

SEQ ID NO: 2159408 - RNA, 16 nt, Human
ggcauggguuuuauua

SEQ ID NO: 2159409 - RNA, 14 nt, Human
ucuauaauuuaaau

SEQ ID NO: 2159410 - RNA, 22 nt, Human
ccauuucuugagguaaaagcau

SEQ ID NO: 2159411 - RNA, 15 nt, Human
aucaguaugaaaaug

SEQ ID NO: 2159412 - RNA, 21 nt, Human
caacacacagauuugagcuca

SEQ ID NO: 2159413 - RNA, 20 nt, Human
gcgcugcgcgccgcgcuccu

SEQ ID NO: 2159414 - RNA, 20 nt, Human
agcuucacuguaaaauaaua

SEQ ID NO: 2159415 - RNA, 21 nt, Human
acagcccuucuuuccacagaa

SEQ ID NO: 2159416 - RNA, 14 nt, Human
cuccagugagacag

SEQ ID NO: 2159417 - RNA, 16 nt, Human
ucagucucccucccuu

SEQ ID NO: 2159418 - RNA, 18 nt, Human
uaaaagacaaggaaaaaa

SEQ ID NO: 2159419 - RNA, 12 nt, Human
aaaauaacaaua

SEQ ID NO: 2159420 - RNA, 18 nt, Human
acuuuaugcuaagugaaa

SEQ ID NO: 2159421 - RNA, 19 nt, Human
acuaucucauuuccaagca

SEQ ID NO: 2159422 - RNA, 17 nt, Human
caagccuccuuuuaaag

SEQ ID NO: 2159423 - RNA, 22 nt, Human
aggauggcuaguaucaaaagaa

SEQ ID NO: 2159424 - RNA, 16 nt, Human
agguacuucaaauccu

SEQ ID NO: 2159425 - RNA, 19 nt, Human
uugagaaggagcucccagg

SEQ ID NO: 2159426 - RNA, 18 nt, Human
uaaauugacacuuaaaaa

SEQ ID NO: 2159427 - RNA, 14 nt, Human
aaccagagccugag

SEQ ID NO: 2159428 - RNA, 13 nt, Human
uccugugggaccu

SEQ ID NO: 2159429 - RNA, 12 nt, Human
cucccugccccc

SEQ ID NO: 2159430 - RNA, 17 nt, Human
cugaucaccugcccugc

SEQ ID NO: 2159431 - RNA, 18 nt, Human
cuccagccugagcgacag

SEQ ID NO: 2159432 - RNA, 23 nt, Human
ugaauuacauuuguauaaaauaa

SEQ ID NO: 2159433 - RNA, 16 nt, Human
ggccuccauccugagg

SEQ ID NO: 2159434 - RNA, 22 nt, Human
aacucccugccccccagcccuc

SEQ ID NO: 2159435 - RNA, 18 nt, Human
gaauaauccuaaacauau

SEQ ID NO: 2159436 - RNA, 12 nt, Human
uuuugaaaccaa

SEQ ID NO: 2159437 - RNA, 14 nt, Human
caguucugaagaag

SEQ ID NO: 2159438 - RNA, 11 nt, Human
gagguaaaagc

SEQ ID NO: 2159439 - RNA, 19 nt, Human
cccagcuagaauucacucc

SEQ ID NO: 2159440 - RNA, 18 nt, Human
gacauuugcucauggaau

SEQ ID NO: 2159441 - RNA, 17 nt, Human
cugagcgacagugagac

SEQ ID NO: 2159442 - RNA, 20 nt, Human
gaccauacuaauuauacccc

SEQ ID NO: 2159443 - RNA, 15 nt, Human
uccaagccucauguc

SEQ ID NO: 2159444 - RNA, 17 nt, Human
cagacaucaacagauaa

SEQ ID NO: 2159445 - RNA, 16 nt, Human
uaaauaaaaauaaucc

SEQ ID NO: 2159446 - RNA, 16 nt, Human
augccccgucccccuc

SEQ ID NO: 2159447 - RNA, 14 nt, Human
cuacaagacacagu

SEQ ID NO: 2159448 - RNA, 14 nt, Human
ucuuuuuuuuaaua

SEQ ID NO: 2159449 - RNA, 17 nt, Human
uccaaaggcuccugaga

SEQ ID NO: 2159450 - RNA, 16 nt, Human
uugccauaauuacuau

SEQ ID NO: 2159451 - RNA, 13 nt, Human
aacaagccuccuu

SEQ ID NO: 2159452 - RNA, 18 nt, Human
cugcagcgaguacuuccc

SEQ ID NO: 2159453 - RNA, 15 nt, Human
aagccuggcaaggga

SEQ ID NO: 2159454 - RNA, 16 nt, Human
aauuuuuaauuauaug

SEQ ID NO: 2159455 - RNA, 20 nt, Human
cccagcuagaauucacucca

SEQ ID NO: 2159456 - RNA, 16 nt, Human
caauguucccccucuc

SEQ ID NO: 2159457 - RNA, 19 nt, Human
aauaaaacuuuuccaauga

SEQ ID NO: 2159458 - RNA, 21 nt, Human
augaauacuuuauaaaggauu

SEQ ID NO: 2159459 - RNA, 18 nt, Human
uucucuaggaaauauuua

SEQ ID NO: 2159460 - RNA, 14 nt, Human
gcgcugcgcgccgc

SEQ ID NO: 2159461 - RNA, 20 nt, Human
caggcugagccucagucucc

SEQ ID NO: 2159462 - RNA, 22 nt, Human
auuacuguaagaaaauaucacu

SEQ ID NO: 2159463 - RNA, 22 nt, Human
cuaagcuucacuguaaaauaau

SEQ ID NO: 2159464 - RNA, 21 nt, Human
cuuucaugaaggggcggcggc

SEQ ID NO: 2159465 - RNA, 13 nt, Human
agguaccuucuca

SEQ ID NO: 2159466 - RNA, 12 nt, Human
acuauaaaacua

SEQ ID NO: 2159467 - RNA, 12 nt, Human
acacuaaaacac

SEQ ID NO: 2159468 - RNA, 17 nt, Human
guuuaauucugaaagca

SEQ ID NO: 2159469 - RNA, 15 nt, Human
gcccacuagacccac

SEQ ID NO: 2159470 - RNA, 15 nt, Human
aagccuccuuuuaaa

SEQ ID NO: 2159471 - RNA, 20 nt, Human
gcuugcagagaugaggccgc

SEQ ID NO: 2159472 - RNA, 16 nt, Human
aaauauuuauuuuaau

SEQ ID NO: 2159473 - RNA, 14 nt, Human
uauaaauaaaaaua

SEQ ID NO: 2159474 - RNA, 20 nt, Human
guucugcagauaaacaguag

SEQ ID NO: 2159475 - RNA, 18 nt, Human
agucauucugccugcccu

SEQ ID NO: 2159476 - RNA, 17 nt, Human
cuuccucugagccuugg

SEQ ID NO: 2159477 - RNA, 16 nt, Human
gcugcagccccuggga

SEQ ID NO: 2159478 - RNA, 19 nt, Human
aaaguucuagugaccgaga

SEQ ID NO: 2159479 - RNA, 16 nt, Human
ucccugccccccagcc

SEQ ID NO: 2159480 - RNA, 21 nt, Human
cagagguccacaacacacaga

SEQ ID NO: 2159481 - RNA, 13 nt, Human
auaaauaaaaaua

SEQ ID NO: 2159482 - RNA, 17 nt, Human
cuaagcuucacuguaaa

SEQ ID NO: 2159483 - RNA, 17 nt, Human
augcagagguccacaac

SEQ ID NO: 2159484 - RNA, 14 nt, Human
aaacuuuuccaaug

SEQ ID NO: 2159485 - RNA, 14 nt, Human
cggacggcuccgga

SEQ ID NO: 2159486 - RNA, 21 nt, Human
aaagaaaauaacgauaaaaga

SEQ ID NO: 2159487 - RNA, 14 nt, Human
uugccaugugcuag

SEQ ID NO: 2159488 - RNA, 13 nt, Human
uccuacuuccccu

SEQ ID NO: 2159489 - RNA, 21 nt, Human
auaugcucuaaacauguuuau

SEQ ID NO: 2159490 - RNA, 23 nt, Human
agcuaggggggucagccagcccu

SEQ ID NO: 2159491 - RNA, 16 nt, Human
agccucagucucccuc

SEQ ID NO: 2159492 - RNA, 12 nt, Human
acacugaagaag

SEQ ID NO: 2159493 - RNA, 13 nt, Human
aaaguguuugaaa

SEQ ID NO: 2159494 - RNA, 13 nt, Human
cacaacuauauug

SEQ ID NO: 2159495 - RNA, 22 nt, Human
ccaaacauccuacaagacacag

SEQ ID NO: 2159496 - RNA, 16 nt, Human
ugaaguacucauacau

SEQ ID NO: 2159497 - RNA, 12 nt, Human
auggguuuuauu

SEQ ID NO: 2159498 - RNA, 21 nt, Human
acucauuaaauggaaguaaau

SEQ ID NO: 2159499 - RNA, 14 nt, Human
ccacuggacucacc

SEQ ID NO: 2159500 - RNA, 14 nt, Human
caugaacuuguaaa

SEQ ID NO: 2159501 - RNA, 18 nt, Human
auuauuuuuuaaaaaaau

SEQ ID NO: 2159502 - RNA, 21 nt, Human
cucuucuggguuccuuccucu

SEQ ID NO: 2159503 - RNA, 17 nt, Human
acuguaaagcuuugugc

SEQ ID NO: 2159504 - RNA, 13 nt, Human
gcagaacagugau

SEQ ID NO: 2159505 - RNA, 15 nt, Human
gccgacggagccggg

SEQ ID NO: 2159506 - RNA, 24 nt, Human
uuugugggaaauccacacugagcu

SEQ ID NO: 2159507 - RNA, 16 nt, Human
uucaguuauuauauuu

SEQ ID NO: 2159508 - RNA, 21 nt, Human
ucccagaucaagccugccuca

SEQ ID NO: 2159509 - RNA, 22 nt, Human
gugaacaaauuuacagagacag

SEQ ID NO: 2159510 - RNA, 22 nt, Human
gaugcaguuguugcccacagcu

SEQ ID NO: 2159511 - RNA, 19 nt, Human
agauaccaugaugcugagc

SEQ ID NO: 2159512 - RNA, 14 nt, Human
ggacucaccucccc

SEQ ID NO: 2159513 - RNA, 13 nt, Human
uuccucugagccu

SEQ ID NO: 2159514 - RNA, 19 nt, Human
uccagaaagugacaagcuc

SEQ ID NO: 2159515 - RNA, 15 nt, Human
agucaccucauggaa

SEQ ID NO: 2159516 - RNA, 20 nt, Human
cccuuccuaauuccacagcu

SEQ ID NO: 2159517 - RNA, 17 nt, Human
cggccgcgcugcgcgcc

SEQ ID NO: 2159518 - RNA, 21 nt, Human
cugagccucagucucccuccc

SEQ ID NO: 2159519 - RNA, 19 nt, Human
ucaauucuugccaaauaua

SEQ ID NO: 2159520 - RNA, 16 nt, Human
cuccacauccuguggg

SEQ ID NO: 2159521 - RNA, 21 nt, Human
cucaaaacuucagacauagaa

SEQ ID NO: 2159522 - RNA, 16 nt, Human
cucagcugccucccca

SEQ ID NO: 2159523 - RNA, 19 nt, Human
auagugaggagcuuugaaa

SEQ ID NO: 2159524 - RNA, 18 nt, Human
ccaagccuggcaagggaa

SEQ ID NO: 2159525 - RNA, 22 nt, Human
ugaguguugccuaauuuguuuu

SEQ ID NO: 2159526 - RNA, 16 nt, Human
gagaaacuggaacucu

SEQ ID NO: 2159527 - RNA, 20 nt, Human
ccccuauccuacuuccccuu

SEQ ID NO: 2159528 - RNA, 20 nt, Human
acuuuauuuucuauaauuua

SEQ ID NO: 2159529 - RNA, 19 nt, Human
guuauuauauuuacaaaug

SEQ ID NO: 2159530 - RNA, 15 nt, Human
ugagguaaccucauu

SEQ ID NO: 2159531 - RNA, 24 nt, Human
uaauuuaaaauaugcucuaaacau

SEQ ID NO: 2159532 - RNA, 19 nt, Human
cugagcccggaaacuccac

SEQ ID NO: 2159533 - RNA, 23 nt, Human
aagucccagaucaagccugccuc

SEQ ID NO: 2159534 - RNA, 19 nt, Human
augugcauauuuuauuaua

SEQ ID NO: 2159535 - RNA, 21 nt, Human
cugccccggggaggggcgcuc

SEQ ID NO: 2159536 - RNA, 16 nt, Human
ucgcuuccgcauccua

SEQ ID NO: 2159537 - RNA, 24 nt, Human
ccccugagcuugcagagaugaggc

SEQ ID NO: 2159538 - RNA, 15 nt, Human
cucccuuggggccua

SEQ ID NO: 2159539 - RNA, 15 nt, Human
auuucuaugaaauau

SEQ ID NO: 2159540 - RNA, 16 nt, Human
gugagacagcucugca

SEQ ID NO: 2159541 - RNA, 17 nt, Human
uggcuaagcaaaaugug

SEQ ID NO: 2159542 - RNA, 18 nt, Human
uucaauaucuuuuuuuua

SEQ ID NO: 2159543 - RNA, 17 nt, Human
acuugaacccauauuug

SEQ ID NO: 2159544 - RNA, 18 nt, Human
ggggucagccagcccucu

SEQ ID NO: 2159545 - RNA, 15 nt, Human
aaaaacguauugcau

SEQ ID NO: 2159546 - RNA, 19 nt, Human
uggugagugccuguaauca

SEQ ID NO: 2159547 - RNA, 14 nt, Human
cccggccggcgcgc

SEQ ID NO: 2159548 - RNA, 18 nt, Human
ugcauagguuuaauaauu

SEQ ID NO: 2159549 - RNA, 17 nt, Human
aguuauuuuuaaacugu

SEQ ID NO: 2159550 - RNA, 12 nt, Human
gacgagaaaaca

SEQ ID NO: 2159551 - RNA, 18 nt, Human
aucuuauaauuuaaaaua

SEQ ID NO: 2159552 - RNA, 14 nt, Human
gaucaagccugccu

SEQ ID NO: 2159553 - RNA, 20 nt, Human
guuccuuccucugagccuug

SEQ ID NO: 2159554 - RNA, 23 nt, Human
aggcuuuaaaacuuauccuccau

SEQ ID NO: 2159555 - RNA, 15 nt, Human
aagccagauuuuccu

SEQ ID NO: 2159556 - RNA, 19 nt, Human
cuuccuaauuccacagcug

SEQ ID NO: 2159557 - RNA, 17 nt, Human
uggccgcagugaggcgg

SEQ ID NO: 2159558 - RNA, 21 nt, Human
augugcauauuuuauuauagu

SEQ ID NO: 2159559 - RNA, 14 nt, Human
uuucuaugaaauau

SEQ ID NO: 2159560 - RNA, 19 nt, Human
uguuggacgagaaaacaau

SEQ ID NO: 2159561 - RNA, 23 nt, Human
uaacgauaaaagacagugaaaga

SEQ ID NO: 2159562 - RNA, 14 nt, Human
cacuaaacaaagag

SEQ ID NO: 2159563 - RNA, 15 nt, Human
ggacucaccuccccc

SEQ ID NO: 2159564 - RNA, 13 nt, Human
cucagaaaacaag

SEQ ID NO: 2159565 - RNA, 20 nt, Human
cacuguggguagacacacau

SEQ ID NO: 2159566 - RNA, 13 nt, Human
cuccccagcucua

SEQ ID NO: 2159567 - RNA, 16 nt, Human
aaaauaacaauaaaag

SEQ ID NO: 2159568 - RNA, 15 nt, Human
agccccugggaccag

SEQ ID NO: 2159569 - RNA, 15 nt, Human
caaauugagcuaggg

SEQ ID NO: 2159570 - RNA, 15 nt, Human
gucaaugcagccccc

SEQ ID NO: 2159571 - RNA, 14 nt, Human
gcucgcccacuucc

SEQ ID NO: 2159572 - RNA, 23 nt, Human
auucaauaucuuuuuuuuaauaa

SEQ ID NO: 2159573 - RNA, 16 nt, Human
aacuugguuuuaauua

SEQ ID NO: 2159574 - RNA, 13 nt, Human
ccugagcuugcag

SEQ ID NO: 2159575 - RNA, 13 nt, Human
ucaucccacccgc

SEQ ID NO: 2159576 - RNA, 21 nt, Human
ucgcccacuuccucccggccg

SEQ ID NO: 2159577 - RNA, 13 nt, Human
uaacgauaaaaga

SEQ ID NO: 2159578 - RNA, 19 nt, Human
agcagcuuauucacaagac

SEQ ID NO: 2159579 - RNA, 23 nt, Human
aucgugucuggcguuguggggau

SEQ ID NO: 2159580 - RNA, 19 nt, Human
gccugaucaccugcccugc

SEQ ID NO: 2159581 - RNA, 22 nt, Human
aaacauccuacaagacacagug

SEQ ID NO: 2159582 - RNA, 14 nt, Human
guaacugauuugua

SEQ ID NO: 2159583 - RNA, 18 nt, Human
cugagaccaaggcccccg

SEQ ID NO: 2159584 - RNA, 18 nt, Human
auagucaaauugugugaa

SEQ ID NO: 2159585 - RNA, 19 nt, Human
ggugcugcagccccuggga

SEQ ID NO: 2159586 - RNA, 14 nt, Human
ggaaagaagagccg

SEQ ID NO: 2159587 - RNA, 23 nt, Human
uguucuugugaacccaaagugug

SEQ ID NO: 2159588 - RNA, 21 nt, Human
gaaagcagggacuugaaccca

SEQ ID NO: 2159589 - RNA, 17 nt, Human
acaaaugcauuucuaaa

SEQ ID NO: 2159590 - RNA, 15 nt, Human
gaaagaaaauaacga

SEQ ID NO: 2159591 - RNA, 16 nt, Human
ccugagcuugcagaga

SEQ ID NO: 2159592 - RNA, 16 nt, Human
cgcuguuccucgccac

SEQ ID NO: 2159593 - RNA, 22 nt, Human
auuuucuucucacauuuauauu

SEQ ID NO: 2159594 - RNA, 12 nt, Human
ggcugaugcagu

SEQ ID NO: 2159595 - RNA, 16 nt, Human
auuauacccccugcaa

SEQ ID NO: 2159596 - RNA, 19 nt, Human
uauauuuuuuguuaaauga

SEQ ID NO: 2159597 - RNA, 22 nt, Human
aaaaaaccugagccccaaaagg

SEQ ID NO: 2159598 - RNA, 13 nt, Human
ccucauggaauug

SEQ ID NO: 2159599 - RNA, 23 nt, Human
ggucuaucuuugagcgcccacua

SEQ ID NO: 2159600 - RNA, 16 nt, Human
auuuguauaaaauaau

SEQ ID NO: 2159601 - RNA, 15 nt, Human
cuuuaaaacuuaucc

SEQ ID NO: 2159602 - RNA, 20 nt, Human
uaacaagccuccuuuuaaag

SEQ ID NO: 2159603 - RNA, 22 nt, Human
gcauccuagucucuaucauuaa

SEQ ID NO: 2159604 - RNA, 20 nt, Human
ucgcaggaccaucccggccg

SEQ ID NO: 2159605 - RNA, 22 nt, Human
cuuguaaaggaauuuaaaaauc

SEQ ID NO: 2159606 - RNA, 14 nt, Human
accauuuuuacuug

SEQ ID NO: 2159607 - RNA, 22 nt, Human
gcagagagguagggauggggcu

SEQ ID NO: 2159608 - RNA, 20 nt, Human
uuuaaauaaaguguuugaaa

SEQ ID NO: 2159609 - RNA, 16 nt, Human
ccaaauugagcuaggg

SEQ ID NO: 2159610 - RNA, 18 nt, Human
uuuuaaaaaagaaacauu

SEQ ID NO: 2159611 - RNA, 19 nt, Human
aaaauaacgauaaaagaca

SEQ ID NO: 2159612 - RNA, 21 nt, Human
agccuuggauacuccaugggg

SEQ ID NO: 2159613 - RNA, 14 nt, Human
auuguccaggucua

SEQ ID NO: 2159614 - RNA, 23 nt, Human
uagacacacaugaaguccaagca

SEQ ID NO: 2159615 - RNA, 14 nt, Human
cucgcccacuuccu

SEQ ID NO: 2159616 - RNA, 14 nt, Human
uaaauaguuuauga

SEQ ID NO: 2159617 - RNA, 16 nt, Human
gcuccggacgcugcug

SEQ ID NO: 2159618 - RNA, 11 nt, Human
gguuuuauuau

SEQ ID NO: 2159619 - RNA, 14 nt, Human
uucuggaauaaucc

SEQ ID NO: 2159620 - RNA, 13 nt, Human
ccaggcugagccu

SEQ ID NO: 2159621 - RNA, 21 nt, Human
cccccucuccucucuuccucc

SEQ ID NO: 2159622 - RNA, 12 nt, Human
accuucucaccu

SEQ ID NO: 2159623 - RNA, 21 nt, Human
uauuauuuuauagcuacuaau

SEQ ID NO: 2159624 - RNA, 19 nt, Human
cucuguucugcacacagca

SEQ ID NO: 2159625 - RNA, 14 nt, Human
gcugauuaaaccaa

SEQ ID NO: 2159626 - RNA, 14 nt, Human
ccccagaaugaccu

SEQ ID NO: 2159627 - RNA, 20 nt, Human
cagccugagcgacagugaga

SEQ ID NO: 2159628 - RNA, 22 nt, Human
aaacaaggaugaauuaaguuuu

SEQ ID NO: 2159629 - RNA, 20 nt, Human
uaugcuucuguuuuauaauu

SEQ ID NO: 2159630 - RNA, 19 nt, Human
auuuugugaagcaaaauuu

SEQ ID NO: 2159631 - RNA, 10 nt, Human
uuuuuaaaaa

SEQ ID NO: 2159632 - RNA, 11 nt, Human
auuuuugaagc

SEQ ID NO: 2159633 - RNA, 18 nt, Human
agcugccuccccagcucu

SEQ ID NO: 2159634 - RNA, 17 nt, Human
cuggcugcgcucggccu

SEQ ID NO: 2159635 - RNA, 14 nt, Human
aaagaggaaugaag

SEQ ID NO: 2159636 - RNA, 15 nt, Human
agacaaggaaaaaau

SEQ ID NO: 2159637 - RNA, 20 nt, Human
cagugaaagaaaauaacgau

SEQ ID NO: 2159638 - RNA, 13 nt, Human
acagcccuucuuu

SEQ ID NO: 2159639 - RNA, 14 nt, Human
cuaagcauuccaac

SEQ ID NO: 2159640 - RNA, 20 nt, Human
uuaaauggucaauuuuguua

SEQ ID NO: 2159641 - RNA, 22 nt, Human
cgggucgcaggaccaucccggc

SEQ ID NO: 2159642 - RNA, 19 nt, Human
ccucagcugccuccccagc

SEQ ID NO: 2159643 - RNA, 22 nt, Human
caaaugggaaacaaaaggauaa

SEQ ID NO: 2159644 - RNA, 21 nt, Human
ccuagucucuaucauuaaagu

SEQ ID NO: 2159645 - RNA, 23 nt, Human
auaucuuuuuuuuaauaaaccau

SEQ ID NO: 2159646 - RNA, 21 nt, Human
cacuaaaacaccucagcugcc

SEQ ID NO: 2159647 - RNA, 16 nt, Human
caggcugagccucagu

SEQ ID NO: 2159648 - RNA, 17 nt, Human
cuggcugcugguggcgc

SEQ ID NO: 2159649 - RNA, 16 nt, Human
ucugcagauaaacagu

SEQ ID NO: 2159650 - RNA, 10 nt, Human
ccugagcccc

SEQ ID NO: 2159651 - RNA, 15 nt, Human
cugggaccaggcacc

SEQ ID NO: 2159652 - RNA, 16 nt, Human
uacauuuguauaaaau

SEQ ID NO: 2159653 - RNA, 18 nt, Human
aauuuuuuugugggaaau

SEQ ID NO: 2159654 - RNA, 20 nt, Human
auuacauuuguauaaaauaa

SEQ ID NO: 2159655 - RNA, 22 nt, Human
ggguuccuuccucugagccuug

SEQ ID NO: 2159656 - RNA, 14 nt, Human
auaaaauaauuuuu

SEQ ID NO: 2159657 - RNA, 14 nt, Human
ugcuguauuuuaaa

SEQ ID NO: 2159658 - RNA, 19 nt, Human
cuaccuguucgcgcgccuc

SEQ ID NO: 2159659 - RNA, 16 nt, Human
acuaaacaaagaguga

SEQ ID NO: 2159660 - RNA, 20 nt, Human
cuucaacucccugcccccca

SEQ ID NO: 2159661 - RNA, 18 nt, Human
guauuauuuuuuaaaaaa

SEQ ID NO: 2159662 - RNA, 14 nt, Human
cacuuauaggaauu

SEQ ID NO: 2159663 - RNA, 19 nt, Human
cccauggcacucuauguuc

SEQ ID NO: 2159664 - RNA, 14 nt, Human
cuuucauaauaagu

SEQ ID NO: 2159665 - RNA, 15 nt, Human
ucaaaggacaccauu

SEQ ID NO: 2159666 - RNA, 23 nt, Human
caucucuucuggguuccuuccuc

SEQ ID NO: 2159667 - RNA, 14 nt, Human
ugcuggagcucugc

SEQ ID NO: 2159668 - RNA, 12 nt, Human
uauaauuuaaaa

SEQ ID NO: 2159669 - RNA, 21 nt, Human
gcccauccugccccugagccc

SEQ ID NO: 2159670 - RNA, 13 nt, Human
cugccuccccagc

SEQ ID NO: 2159671 - RNA, 15 nt, Human
aagaagugaaaaucu

SEQ ID NO: 2159672 - RNA, 15 nt, Human
uucggccuccauccu

SEQ ID NO: 2159673 - RNA, 16 nt, Human
ucucuaggaaauauuu

SEQ ID NO: 2159674 - RNA, 16 nt, Human
cuagaauucacuccac

SEQ ID NO: 2159675 - RNA, 15 nt, Human
agccugaaagaggaa

SEQ ID NO: 2159676 - RNA, 22 nt, Human
gugucuggcguuguggggauga

SEQ ID NO: 2159677 - RNA, 13 nt, Human
agacacagugacc

SEQ ID NO: 2159678 - RNA, 19 nt, Human
ccaaggcccccgggccgac

SEQ ID NO: 2159679 - RNA, 15 nt, Human
cgcauccuagucucu

SEQ ID NO: 2159680 - RNA, 15 nt, Human
ugucaauaaaaucca

SEQ ID NO: 2159681 - RNA, 17 nt, Human
agucugacuguuuccau

SEQ ID NO: 2159682 - RNA, 20 nt, Human
ccauuguggucacaggaagu

SEQ ID NO: 2159683 - RNA, 17 nt, Human
uuuaaaaaaaaaacgua

SEQ ID NO: 2159684 - RNA, 15 nt, Human
gccccugggaccagg

SEQ ID NO: 2159685 - RNA, 22 nt, Human
gaauuaaguuuuuuuuuaaaaa

SEQ ID NO: 2159686 - RNA, 13 nt, Human
uacuuuauuuucu

SEQ ID NO: 2159687 - RNA, 13 nt, Human
aaaaaugguuuaa

SEQ ID NO: 2159688 - RNA, 19 nt, Human
gccccccagcccuccuuau

SEQ ID NO: 2159689 - RNA, 20 nt, Human
ccacuuggacaugggcccca

SEQ ID NO: 2159690 - RNA, 20 nt, Human
ccugagcggaccuucccagc

SEQ ID NO: 2159691 - RNA, 18 nt, Human
gaggcggauugagaagga

SEQ ID NO: 2159692 - RNA, 14 nt, Human
uuucaauaaaacuu

SEQ ID NO: 2159693 - RNA, 22 nt, Human
accaaucaugaauuaguuuuau

SEQ ID NO: 2159694 - RNA, 17 nt, Human
cuggacucaccuccccc

SEQ ID NO: 2159695 - RNA, 19 nt, Human
aguuguaauuuuuuugugg

SEQ ID NO: 2159696 - RNA, 23 nt, Human
caauaacgauaaaagacagugaa

SEQ ID NO: 2159697 - RNA, 19 nt, Human
ugagucccaggcugagccu

SEQ ID NO: 2159698 - RNA, 23 nt, Human
aaagcccagcuugaaaccuucac

SEQ ID NO: 2159699 - RNA, 15 nt, Human
aauaacgauaaaaga

SEQ ID NO: 2159700 - RNA, 13 nt, Human
acaauaaaagaca

SEQ ID NO: 2159701 - RNA, 16 nt, Human
uucccaacuccagaaa

SEQ ID NO: 2159702 - RNA, 14 nt, Human
cuugagguaaaagc

SEQ ID NO: 2159703 - RNA, 21 nt, Human
cccugggaccaggcaccccca

SEQ ID NO: 2159704 - RNA, 15 nt, Human
cuuccucccggccgc

SEQ ID NO: 2159705 - RNA, 17 nt, Human
agccuccagcugccccg

SEQ ID NO: 2159706 - RNA, 20 nt, Human
gggagccccaauucgauccc

SEQ ID NO: 2159707 - RNA, 16 nt, Human
ccuacaugagguacug

SEQ ID NO: 2159708 - RNA, 16 nt, Human
cuagaacucccuuuca

SEQ ID NO: 2159709 - RNA, 22 nt, Human
uuuaauaauguuucaaacauau

SEQ ID NO: 2159710 - RNA, 20 nt, Human
aauaauuuuuauauuugaaa

SEQ ID NO: 2159711 - RNA, 14 nt, Human
caaggaaaaaauaa

SEQ ID NO: 2159712 - RNA, 11 nt, Human
gcgcuggcugc

SEQ ID NO: 2159713 - RNA, 16 nt, Human
uaggauguugaaaaag

SEQ ID NO: 2159714 - RNA, 18 nt, Human
uuggggccuaugcagagg

SEQ ID NO: 2159715 - RNA, 17 nt, Human
cugguggcgcuggcugc

SEQ ID NO: 2159716 - RNA, 23 nt, Human
aguaauuggaaaggcagcucuaa

SEQ ID NO: 2159717 - RNA, 18 nt, Human
auuuaggccaugggacag

SEQ ID NO: 2159718 - RNA, 18 nt, Human
uuuucaauaaaacuuuuc

SEQ ID NO: 2159719 - RNA, 13 nt, Human
uauuucuaugaaa

SEQ ID NO: 2159720 - RNA, 19 nt, Human
cagguaccuucucaccugu

SEQ ID NO: 2159721 - RNA, 20 nt, Human
ugguuguauuauuuuuuaaa

SEQ ID NO: 2159722 - RNA, 17 nt, Human
agcucugcccauccugc

SEQ ID NO: 2159723 - RNA, 19 nt, Human
uuauauauauauauuuuuu

SEQ ID NO: 2159724 - RNA, 14 nt, Human
aagaagugaaaauc

SEQ ID NO: 2159725 - RNA, 23 nt, Human
ugaauuauguuugcauguucacu

SEQ ID NO: 2159726 - RNA, 12 nt, Human
aaaaaaacguau

SEQ ID NO: 2159727 - RNA, 19 nt, Human
ccauccugccccugagccc

SEQ ID NO: 2159728 - RNA, 21 nt, Human
uauacugugugcuaaaacaag

SEQ ID NO: 2159729 - RNA, 17 nt, Human
uuauaucaauuuaaaaa

SEQ ID NO: 2159730 - RNA, 16 nt, Human
cagucucccucccuug

SEQ ID NO: 2159731 - RNA, 14 nt, Human
caccucagcugccu

SEQ ID NO: 2159732 - RNA, 16 nt, Human
gcugcugguggcgcug

SEQ ID NO: 2159733 - RNA, 16 nt, Human
augcuguauuuuaaaa

SEQ ID NO: 2159734 - RNA, 22 nt, Human
auauuuacaaaugggaaacaaa

SEQ ID NO: 2159735 - RNA, 14 nt, Human
gcuggcaccgcugu

SEQ ID NO: 2159736 - RNA, 22 nt, Human
aucaucaagucuuucacauuua

SEQ ID NO: 2159737 - RNA, 21 nt, Human
ccacauccugugggaccuggg

SEQ ID NO: 2159738 - RNA, 22 nt, Human
cccccugcaaagcccagcuuga

SEQ ID NO: 2159739 - RNA, 12 nt, Human
acacuuaaaaau

SEQ ID NO: 2159740 - RNA, 19 nt, Human
uuuccugaaaacccuugcc

SEQ ID NO: 2159741 - RNA, 13 nt, Human
cacacugaagaag

SEQ ID NO: 2159742 - RNA, 21 nt, Human
gcucggccugcucgcccacuu

SEQ ID NO: 2159743 - RNA, 15 nt, Human
gagaugcuagaacuc

SEQ ID NO: 2159744 - RNA, 13 nt, Human
agggagggaaggg

SEQ ID NO: 2159745 - RNA, 19 nt, Human
auuuacagagacagaaagc

SEQ ID NO: 2159746 - RNA, 22 nt, Human
ggacagcccuucuuuccacaga

SEQ ID NO: 2159747 - RNA, 21 nt, Human
uguaaaauggugugaccacug

SEQ ID NO: 2159748 - RNA, 18 nt, Human
cccaggcugagccucagu

SEQ ID NO: 2159749 - RNA, 17 nt, Human
uaugugcauauuuuauu

SEQ ID NO: 2159750 - RNA, 13 nt, Human
agagguccacaac

SEQ ID NO: 2159751 - RNA, 14 nt, Human
agcaaguauuagaa

SEQ ID NO: 2159752 - RNA, 20 nt, Human
accuacacgagauacagaau

SEQ ID NO: 2159753 - RNA, 13 nt, Human
uuauguuuaauuc

SEQ ID NO: 2159754 - RNA, 17 nt, Human
cuaccuguucgcgcgcc

SEQ ID NO: 2159755 - RNA, 16 nt, Human
cgcccacuuccucccg

SEQ ID NO: 2159756 - RNA, 18 nt, Human
gacccacuggacucaccu

SEQ ID NO: 2159757 - RNA, 19 nt, Human
uggauacuccauggggugg

SEQ ID NO: 2159758 - RNA, 15 nt, Human
aaauauaaauaaaaa

SEQ ID NO: 2159759 - RNA, 19 nt, Human
ugggccccagauaccauga

SEQ ID NO: 2159760 - RNA, 15 nt, Human
auccugccccugagc

SEQ ID NO: 2159761 - RNA, 22 nt, Human
ggccggcgcgcucaucccaccc

SEQ ID NO: 2159762 - RNA, 12 nt, Human
ucuuucaugaag

SEQ ID NO: 2159763 - RNA, 22 nt, Human
cccacuuccucccggccgcgcu

SEQ ID NO: 2159764 - RNA, 12 nt, Human
uaagaagacugc

SEQ ID NO: 2159765 - RNA, 15 nt, Human
guaaggggaauugag

SEQ ID NO: 2159766 - RNA, 19 nt, Human
auaauuuuuauauuugaaa

SEQ ID NO: 2159767 - RNA, 20 nt, Human
uugauaaguacaugauaagc

SEQ ID NO: 2159768 - RNA, 19 nt, Human
ggcgggagggcgcggggcg

SEQ ID NO: 2159769 - RNA, 19 nt, Human
cagcacgggggccaaggau

SEQ ID NO: 2159770 - RNA, 21 nt, Human
ugggaggcugagaugggagaa

SEQ ID NO: 2159771 - RNA, 13 nt, Human
ucuuauaauuuaa

SEQ ID NO: 2159772 - RNA, 19 nt, Human
augaaguacucauacaugu

SEQ ID NO: 2159773 - RNA, 16 nt, Human
ggaugccccguccccc

SEQ ID NO: 2159774 - RNA, 19 nt, Human
augcagagguccacaacac

SEQ ID NO: 2159775 - RNA, 13 nt, Human
cggauugagaagg

SEQ ID NO: 2159776 - RNA, 12 nt, Human
caugggaaguga

SEQ ID NO: 2159777 - RNA, 22 nt, Human
agcacagccucuuagaugcagu

SEQ ID NO: 2159778 - RNA, 15 nt, Human
caggcacccccagaa

SEQ ID NO: 2159779 - RNA, 12 nt, Human
cagccccuggga

SEQ ID NO: 2159780 - RNA, 23 nt, Human
cccggccggcgcgcucaucccac

SEQ ID NO: 2159781 - RNA, 14 nt, Human
ugacacuaaaacac

SEQ ID NO: 2159782 - RNA, 19 nt, Human
uccauccugaggcuccacu

SEQ ID NO: 2159783 - RNA, 15 nt, Human
auauaaauaaaaaua

SEQ ID NO: 2159784 - RNA, 20 nt, Human
ccaaauguucaucaaugaau

SEQ ID NO: 2159785 - RNA, 19 nt, Human
cuucccgcuguuccucgcc

SEQ ID NO: 2159786 - RNA, 16 nt, Human
gaaaaaauaacaauga

SEQ ID NO: 2159787 - RNA, 14 nt, Human
ccucuucugacacu

SEQ ID NO: 2159788 - RNA, 20 nt, Human
acuagaguuuagcuggaaaa

SEQ ID NO: 2159789 - RNA, 17 nt, Human
ugcccugaaagucccag

SEQ ID NO: 2159790 - RNA, 15 nt, Human
cagccagcacagccu

SEQ ID NO: 2159791 - RNA, 23 nt, Human
ugucacgugugggcaauguuccc

SEQ ID NO: 2159792 - RNA, 18 nt, Human
cucuggccuucggccucc

SEQ ID NO: 2159793 - RNA, 13 nt, Human
aagcauuccaacu

SEQ ID NO: 2159794 - RNA, 18 nt, Human
agaucaagccugccucaa

SEQ ID NO: 2159795 - RNA, 21 nt, Human
ccucccuuggggccuaugcag

SEQ ID NO: 2159796 - RNA, 21 nt, Human
aaacaauaacgauaaaagaca

SEQ ID NO: 2159797 - RNA, 13 nt, Human
aucucaauauuuc

SEQ ID NO: 2159798 - RNA, 19 nt, Human
auccuacaagacacaguga

SEQ ID NO: 2159799 - RNA, 16 nt, Human
ccaggcacccccagaa

SEQ ID NO: 2159800 - RNA, 20 nt, Human
aacaaugcuguauuuuaaaa

SEQ ID NO: 2159801 - RNA, 19 nt, Human
uccugugggaccugggcca

SEQ ID NO: 2159802 - RNA, 12 nt, Human
cagugaaagaaa

SEQ ID NO: 2159803 - RNA, 23 nt, Human
gaaaacaauaacgauaaaagaca

SEQ ID NO: 2159804 - RNA, 15 nt, Human
agaaaacaauaacga

SEQ ID NO: 2159805 - RNA, 21 nt, Human
uuacauuuguauaaaauaauu

SEQ ID NO: 2159806 - RNA, 20 nt, Human
agugaggcggauugagaagg

SEQ ID NO: 2159807 - RNA, 20 nt, Human
cuuuuuuaguucuucaaaga

SEQ ID NO: 2159808 - RNA, 13 nt, Human
auuggacaguaaa

SEQ ID NO: 2159809 - RNA, 15 nt, Human
cgcgcugcgcgccgc

SEQ ID NO: 2159810 - RNA, 23 nt, Human
aacuuuuccaaugacauuuuguu

SEQ ID NO: 2159811 - RNA, 15 nt, Human
aaggguacacugccu

SEQ ID NO: 2159812 - RNA, 14 nt, Human
cugcugguggcgcu

SEQ ID NO: 2159813 - RNA, 22 nt, Human
caucgcaauguaagacucggga

SEQ ID NO: 2159814 - RNA, 17 nt, Human
uguaaaggaauuuaaaa

SEQ ID NO: 2159815 - RNA, 13 nt, Human
caguuauuauauu

SEQ ID NO: 2159816 - RNA, 21 nt, Human
agagccggagccuccagcugc

SEQ ID NO: 2159817 - RNA, 12 nt, Human
agggauggggcu

SEQ ID NO: 2159818 - RNA, 14 nt, Human
ggggaacaugagcc

SEQ ID NO: 2159819 - RNA, 21 nt, Human
gccggcgcgcucaucccaccc

SEQ ID NO: 2159820 - RNA, 16 nt, Human
ccacuuggucugugag

SEQ ID NO: 2159821 - RNA, 18 nt, Human
gccccgucccccucuggc

SEQ ID NO: 2159822 - RNA, 15 nt, Human
ccacaagaaaugaaa

SEQ ID NO: 2159823 - RNA, 16 nt, Human
ggugcugcagccccug

SEQ ID NO: 2159824 - RNA, 17 nt, Human
uauuuguacauuuuuuu

SEQ ID NO: 2159825 - RNA, 21 nt, Human
ucauucacucaacaaacauaa

SEQ ID NO: 2159826 - RNA, 17 nt, Human
agcucccaggaggggcu

SEQ ID NO: 2159827 - RNA, 17 nt, Human
ugaaauaagccagacau

SEQ ID NO: 2159828 - RNA, 14 nt, Human
agaauucauucacu

SEQ ID NO: 2159829 - RNA, 17 nt, Human
ccagggcuacgcgcgcu

SEQ ID NO: 2159830 - RNA, 16 nt, Human
gauggcaggaggcauc

SEQ ID NO: 2159831 - RNA, 16 nt, Human
cuccaugggguggggg

SEQ ID NO: 2159832 - RNA, 17 nt, Human
ggugcugcagccccugg

SEQ ID NO: 2159833 - RNA, 20 nt, Human
acuaaaacaccucagcugcc

SEQ ID NO: 2159834 - RNA, 17 nt, Human
aguugauaaguacauga

SEQ ID NO: 2159835 - RNA, 16 nt, Human
cuucaacucccugccc

SEQ ID NO: 2159836 - RNA, 17 nt, Human
ggauacuccauggggug

SEQ ID NO: 2159837 - RNA, 20 nt, Human
caaauguucaucaaugaaug

SEQ ID NO: 2159838 - RNA, 11 nt, Human
aauuccacagc

SEQ ID NO: 2159839 - RNA, 23 nt, Human
cagaccgggguucccgugugccu

SEQ ID NO: 2159840 - RNA, 22 nt, Human
ucuacuaaaaauacaaaaaaaa

SEQ ID NO: 2159841 - RNA, 21 nt, Human
gcggcgggagggcgcggggcg

SEQ ID NO: 2159842 - RNA, 15 nt, Human
gcacagccucuuaga

SEQ ID NO: 2159843 - RNA, 16 nt, Human
aaacuaggugcugcag

SEQ ID NO: 2159844 - RNA, 22 nt, Human
acaggauggcaggaggcaucca

SEQ ID NO: 2159845 - RNA, 22 nt, Human
augcagagguccacaacacaca

SEQ ID NO: 2159846 - RNA, 17 nt, Human
ccucagcugccucccca

SEQ ID NO: 2159847 - RNA, 15 nt, Human
uaggaaauauuuauu

SEQ ID NO: 2159848 - RNA, 12 nt, Human
ggaggcugagau

SEQ ID NO: 2159849 - RNA, 14 nt, Human
acgcgcgcuccgcg

SEQ ID NO: 2159850 - RNA, 21 nt, Human
ccaaauauaaauaaaaauaau

SEQ ID NO: 2159851 - RNA, 22 nt, Human
ugauaguuguaccgcaauguga

SEQ ID NO: 2159852 - RNA, 19 nt, Human
caauucuugccaaauauaa

SEQ ID NO: 2159853 - RNA, 19 nt, Human
gacggagccgggaaagaag

SEQ ID NO: 2159854 - RNA, 20 nt, Human
ccaggcggguccgggucgca

SEQ ID NO: 2159855 - RNA, 16 nt, Human
cagggcucacagaauu

SEQ ID NO: 2159856 - RNA, 13 nt, Human
cgaguacuucccg

SEQ ID NO: 2159857 - RNA, 20 nt, Human
ucaagucuuucacauuuaaa

SEQ ID NO: 2159858 - RNA, 22 nt, Human
aauuacauuuguauaaaauaau

SEQ ID NO: 2159859 - RNA, 19 nt, Human
agaguuuagcuggaaaagu

SEQ ID NO: 2159860 - RNA, 13 nt, Human
aaaaauccuacuu

SEQ ID NO: 2159861 - RNA, 12 nt, Human
ggggcggcggcc

SEQ ID NO: 2159862 - RNA, 20 nt, Human
uguaaagcuuugugcagauu

SEQ ID NO: 2159863 - RNA, 19 nt, Human
gcuuguauuccuuuuucuc

SEQ ID NO: 2159864 - RNA, 21 nt, Human
ucacaugaacuuguaaaggaa

SEQ ID NO: 2159865 - RNA, 22 nt, Human
caguauggcagcuuuccucaaa

SEQ ID NO: 2159866 - RNA, 17 nt, Human
uaugcuaagugaaauaa

SEQ ID NO: 2159867 - RNA, 16 nt, Human
uuaaauuguaauaggc

SEQ ID NO: 2159868 - RNA, 19 nt, Human
agaaaauaacgauaaaaga

SEQ ID NO: 2159869 - RNA, 14 nt, Human
ggggcggggagcga

SEQ ID NO: 2159870 - RNA, 22 nt, Human
ugaguuuuucuuuucauuuacc

SEQ ID NO: 2159871 - RNA, 19 nt, Human
ggcaccgcuguacgcgagc

SEQ ID NO: 2159872 - RNA, 15 nt, Human
cagucucccucccuu

SEQ ID NO: 2159873 - RNA, 13 nt, Human
uacagagacagaa

SEQ ID NO: 2159874 - RNA, 19 nt, Human
ccaccugccuauauuuuuu

SEQ ID NO: 2159875 - RNA, 14 nt, Human
ccucagucucccuc

SEQ ID NO: 2159876 - RNA, 22 nt, Human
cgcgcagcucaggcuggcaccg

SEQ ID NO: 2159877 - RNA, 17 nt, Human
gauacuccauggggugg

SEQ ID NO: 2159878 - RNA, 16 nt, Human
ucaaaagaaagaaaau

SEQ ID NO: 2159879 - RNA, 14 nt, Human
ccacauccuguggg

SEQ ID NO: 2159880 - RNA, 18 nt, Human
uggucaauuuuguuaugu

SEQ ID NO: 2159881 - RNA, 13 nt, Human
cgcuuccgcaucc

SEQ ID NO: 2159882 - RNA, 23 nt, Human
uagauguauagguugaugguggu

SEQ ID NO: 2159883 - RNA, 21 nt, Human
guccccuauccuacuuccccu

SEQ ID NO: 2159884 - RNA, 22 nt, Human
gagcuaggggggucagccagcc

SEQ ID NO: 2159885 - RNA, 20 nt, Human
accaggcacccccagaauga

SEQ ID NO: 2159886 - RNA, 20 nt, Human
ccauacuaauuauacccccu

SEQ ID NO: 2159887 - RNA, 18 nt, Human
cauccaaaggcuccugag

SEQ ID NO: 2159888 - RNA, 20 nt, Human
uccaaaggcuccugagacac

SEQ ID NO: 2159889 - RNA, 21 nt, Human
cucuaucccaaccucucccaa

SEQ ID NO: 2159890 - RNA, 21 nt, Human
gcucccaggaggggcuucugg

SEQ ID NO: 2159891 - RNA, 18 nt, Human
gcugcugccgugggccug

SEQ ID NO: 2159892 - RNA, 15 nt, Human
gugaccacugcagaa

SEQ ID NO: 2159893 - RNA, 14 nt, Human
gagcucagcccugg

SEQ ID NO: 2159894 - RNA, 17 nt, Human
gucaaagcugaaaugga

SEQ ID NO: 2159895 - RNA, 16 nt, Human
ugaaguccaagcauuu

SEQ ID NO: 2159896 - RNA, 18 nt, Human
auuuguauaaaauaauuu

SEQ ID NO: 2159897 - RNA, 23 nt, Human
cagccagcccucuucugacacua

SEQ ID NO: 2159898 - RNA, 18 nt, Human
gaugccccgucccccucu

SEQ ID NO: 2159899 - RNA, 14 nt, Human
cucccuuggggccu

SEQ ID NO: 2159900 - RNA, 23 nt, Human
gaaugagagacacacugaagaag

SEQ ID NO: 2159901 - RNA, 14 nt, Human
ccaugggacaggga

SEQ ID NO: 2159902 - RNA, 17 nt, Human
accucagcugccucccc

SEQ ID NO: 2159903 - RNA, 16 nt, Human
acauuuauauuuuugu

SEQ ID NO: 2159904 - RNA, 16 nt, Human
ccugagaccaaggccc

SEQ ID NO: 2159905 - RNA, 19 nt, Human
cggccugcucgcccacuuc

SEQ ID NO: 2159906 - RNA, 15 nt, Human
ugcuucuguuuuaua

SEQ ID NO: 2159907 - RNA, 15 nt, Human
ccugagcggaccuuc

SEQ ID NO: 2159908 - RNA, 21 nt, Human
gccacgcucugggucgccggc

SEQ ID NO: 2159909 - RNA, 18 nt, Human
uaaaagacagugaaagaa

SEQ ID NO: 2159910 - RNA, 22 nt, Human
uauuccuuuuucucuccucucc

SEQ ID NO: 2159911 - RNA, 19 nt, Human
uuguggggaugaacuuuuu

SEQ ID NO: 2159912 - RNA, 14 nt, Human
ugagcuugcagaga

SEQ ID NO: 2159913 - RNA, 17 nt, Human
auuauuuuuuaaaaaaa

SEQ ID NO: 2159914 - RNA, 23 nt, Human
uccaacuaucucauuuccaagca

SEQ ID NO: 2159915 - RNA, 21 nt, Human
aaugucauuguucuugugaac

SEQ ID NO: 2159916 - RNA, 22 nt, Human
agugagcagucaggaaagagaa

SEQ ID NO: 2159917 - RNA, 23 nt, Human
ugccccggggaggggcgcucgcu

SEQ ID NO: 2159918 - RNA, 12 nt, Human
caacccaaaugu

SEQ ID NO: 2159919 - RNA, 17 nt, Human
uaucuuuuuuuuaauaa

SEQ ID NO: 2159920 - RNA, 14 nt, Human
augggccauaugaa

SEQ ID NO: 2159921 - RNA, 22 nt, Human
uguauacugugugcuaaaacaa

SEQ ID NO: 2159922 - RNA, 16 nt, Human
auccuccaugaauauc

SEQ ID NO: 2159923 - RNA, 12 nt, Human
cuccagcugccc

SEQ ID NO: 2159924 - RNA, 15 nt, Human
cgggagccugaucac

SEQ ID NO: 2159925 - RNA, 19 nt, Human
acagucaccucauggaauu

SEQ ID NO: 2159926 - RNA, 21 nt, Human
uaguauuucuaugaaauauua

SEQ ID NO: 2159927 - RNA, 13 nt, Human
agccuccagcugc

SEQ ID NO: 2159928 - RNA, 16 nt, Human
cccuauccuacuuccc

SEQ ID NO: 2159929 - RNA, 23 nt, Human
uggcuugaguuuaaauuguaaua

SEQ ID NO: 2159930 - RNA, 23 nt, Human
cgagccccaggcggguccggguc

SEQ ID NO: 2159931 - RNA, 13 nt, Human
uccagcugccccg

SEQ ID NO: 2159932 - RNA, 18 nt, Human
uauaacaaugcuguauuu

SEQ ID NO: 2159933 - RNA, 20 nt, Human
ccagaaugaccuggccgcag

SEQ ID NO: 2159934 - RNA, 16 nt, Human
ugcaugguuuagaaag

SEQ ID NO: 2159935 - RNA, 22 nt, Human
caaugcuguauuuuaaaagaau

SEQ ID NO: 2159936 - RNA, 17 nt, Human
gcgcucaucccacccgc

SEQ ID NO: 2159937 - RNA, 20 nt, Human
gcacccccagaaugaccugg

SEQ ID NO: 2159938 - RNA, 18 nt, Human
uaaugaauacuuuauaaa

SEQ ID NO: 2159939 - RNA, 18 nt, Human
ccaaaggcuccugagaca

SEQ ID NO: 2159940 - RNA, 21 nt, Human
cagcucaggcuggcaccgcug

SEQ ID NO: 2159941 - RNA, 20 nt, Human
acuucuuaggguuaugauua

SEQ ID NO: 2159942 - RNA, 16 nt, Human
aauuccacagcugcuc

SEQ ID NO: 2159943 - RNA, 21 nt, Human
cuaagcuucacuguaaaauaa

SEQ ID NO: 2159944 - RNA, 15 nt, Human
gcugcgcucggccug

SEQ ID NO: 2159945 - RNA, 18 nt, Human
acugacucuuaagaagac

SEQ ID NO: 2159946 - RNA, 19 nt, Human
ucgcccacuuccucccggc

SEQ ID NO: 2159947 - RNA, 23 nt, Human
ggccuccauccugaggcuccacu

SEQ ID NO: 2159948 - RNA, 12 nt, Human
ucagcugccucc

SEQ ID NO: 2159949 - RNA, 13 nt, Human
gggaaagaagagc

SEQ ID NO: 2159950 - RNA, 12 nt, Human
aucguguccccu

SEQ ID NO: 2159951 - RNA, 17 nt, Human
ggagcucguggaacagu

SEQ ID NO: 2159952 - RNA, 22 nt, Human
accauuucuugagguaaaagca

SEQ ID NO: 2159953 - RNA, 17 nt, Human
ccagguaccuucucacc

SEQ ID NO: 2159954 - RNA, 19 nt, Human
aagcauuccaacuaucuca

SEQ ID NO: 2159955 - RNA, 23 nt, Human
uuagaugcaguucugaagaagau

SEQ ID NO: 2159956 - RNA, 19 nt, Human
guacaagagcuuaacagug

SEQ ID NO: 2159957 - RNA, 21 nt, Human
gucucagugucaaugcagccc

SEQ ID NO: 2159958 - RNA, 17 nt, Human
aauucuugccaaauaua

SEQ ID NO: 2159959 - RNA, 16 nt, Human
cagggacuugaaccca

SEQ ID NO: 2159960 - RNA, 15 nt, Human
ucccccaucucuucu

SEQ ID NO: 2159961 - RNA, 20 nt, Human
augcuucuguuuuauaauuu

SEQ ID NO: 2159962 - RNA, 21 nt, Human
gacagaaagcagaacagugau

SEQ ID NO: 2159963 - RNA, 19 nt, Human
gcggcccugugcggccugg

SEQ ID NO: 2159964 - RNA, 17 nt, Human
cugcacuccagccugag

SEQ ID NO: 2159965 - RNA, 19 nt, Human
acuuauuuguacauuuuuu

SEQ ID NO: 2159966 - RNA, 15 nt, Human
cauguccacugguuc

SEQ ID NO: 2159967 - RNA, 15 nt, Human
ucugucucaguccau

SEQ ID NO: 2159968 - RNA, 18 nt, Human
ccugcaaagcccagcuug

SEQ ID NO: 2159969 - RNA, 23 nt, Human
uaaaagacagugaaagaaaauaa

SEQ ID NO: 2159970 - RNA, 19 nt, Human
caugaguaacugauuugua

SEQ ID NO: 2159971 - RNA, 12 nt, Human
gcaaagcccagc

SEQ ID NO: 2159972 - RNA, 17 nt, Human
auaaguacaugauaagc

SEQ ID NO: 2159973 - RNA, 24 nt, Human
ucucuaucauuaaaguucuaguga

SEQ ID NO: 2159974 - RNA, 20 nt, Human
cacagcacgggggccaagga

SEQ ID NO: 2159975 - RNA, 17 nt, Human
guccaaagggcaugggu

SEQ ID NO: 2159976 - RNA, 18 nt, Human
gaagcaccaaucaugaau

SEQ ID NO: 2159977 - RNA, 21 nt, Human
aaucaccaaggcugauuaaac

SEQ ID NO: 2159978 - RNA, 15 nt, Human
cuuaagaagacugca

SEQ ID NO: 2159979 - RNA, 20 nt, Human
cugagcggaccuucccagcu

SEQ ID NO: 2159980 - RNA, 19 nt, Human
gcugccccggggaggggcg

SEQ ID NO: 2159981 - RNA, 22 nt, Human
uuuccaagcaaguauuagaaua

SEQ ID NO: 2159982 - RNA, 20 nt, Human
gcgcgcucaucccacccgcc

SEQ ID NO: 2159983 - RNA, 12 nt, Human
aauaaaguacaa

SEQ ID NO: 2159984 - RNA, 17 nt, Human
agcgacagugagacucu

SEQ ID NO: 2159985 - RNA, 13 nt, Human
cuuaucaaaggac

SEQ ID NO: 2159986 - RNA, 18 nt, Human
ggaccaucccggccggcg

SEQ ID NO: 2159987 - RNA, 16 nt, Human
aauuucuucaacuccc

SEQ ID NO: 2159988 - RNA, 16 nt, Human
caggaaguagaggagg

SEQ ID NO: 2159989 - RNA, 21 nt, Human
auucauagcagcuuauucaca

SEQ ID NO: 2159990 - RNA, 20 nt, Human
auucccagccagcacagccu

SEQ ID NO: 2159991 - RNA, 16 nt, Human
uuucacauuuaaauaa

SEQ ID NO: 2159992 - RNA, 17 nt, Human
agccagguaccuucuca

SEQ ID NO: 2159993 - RNA, 14 nt, Human
aaaggaauuuaaaa

SEQ ID NO: 2159994 - RNA, 15 nt, Human
auagaaguaaaaaca

SEQ ID NO: 2159995 - RNA, 13 nt, Human
agcccagcuugaa

SEQ ID NO: 2159996 - RNA, 13 nt, Human
caagccugccuca

SEQ ID NO: 2159997 - RNA, 13 nt, Human
gcgcgccuccgcu

SEQ ID NO: 2159998 - RNA, 21 nt, Human
cuuguuggacgagaaaacaau

SEQ ID NO: 2159999 - RNA, 16 nt, Human
agcggaccuucccagc

SEQ ID NO: 2160000 - RNA, 20 nt, Human
auacugugugcuaaaacaag

SEQ ID NO: 2160001 - RNA, 15 nt, Human
cucguggaacaguua

SEQ ID NO: 2160002 - RNA, 16 nt, Human
gaauggcuaagcaaaa

SEQ ID NO: 2160003 - RNA, 19 nt, Human
acagugauuaccagggacu

SEQ ID NO: 2160004 - RNA, 14 nt, Human
ccagcuagaauuca

SEQ ID NO: 2160005 - RNA, 20 nt, Human
caauaaaacuuuuccaauga

SEQ ID NO: 2160006 - RNA, 17 nt, Human
uucucuaggaaauauuu

SEQ ID NO: 2160007 - RNA, 22 nt, Human
aaagacagugaaagaaaauaac

SEQ ID NO: 2160008 - RNA, 19 nt, Human
agacagugaaagaaaauaa

SEQ ID NO: 2160009 - RNA, 18 nt, Human
acaaaugggaaacaaaag

SEQ ID NO: 2160010 - RNA, 17 nt, Human
gugccuguaaucacagc

SEQ ID NO: 2160011 - RNA, 13 nt, Human
agacagcucugca

SEQ ID NO: 2160012 - RNA, 19 nt, Human
cuccagcuggccgggagcc

SEQ ID NO: 2160013 - RNA, 12 nt, Human
gucccaggcuga

SEQ ID NO: 2160014 - RNA, 16 nt, Human
cucucuuccucccugg

SEQ ID NO: 2160015 - RNA, 22 nt, Human
cacuuccaagagccuuuuuuug

SEQ ID NO: 2160016 - RNA, 15 nt, Human
cgcccacuuccuccc

SEQ ID NO: 2160017 - RNA, 14 nt, Human
ggcaauagucaaau

SEQ ID NO: 2160018 - RNA, 18 nt, Human
ucccaacuauaaaacuag

SEQ ID NO: 2160019 - RNA, 16 nt, Human
cacuggacucaccucc

SEQ ID NO: 2160020 - RNA, 19 nt, Human
aaucuacacuccagugaga

SEQ ID NO: 2160021 - RNA, 13 nt, Human
agccucagucucc

SEQ ID NO: 2160022 - RNA, 15 nt, Human
aaaauacaaaaaaaa

SEQ ID NO: 2160023 - RNA, 19 nt, Human
ucccgcuguuccucgccac

SEQ ID NO: 2160024 - RNA, 20 nt, Human
ugagagacacacugaagaag

SEQ ID NO: 2160025 - RNA, 14 nt, Human
acaagagcuuaaca

SEQ ID NO: 2160026 - RNA, 20 nt, Human
augcaguuguugcccacagc

SEQ ID NO: 2160027 - RNA, 20 nt, Human
caggaggggcuucugggcag

SEQ ID NO: 2160028 - RNA, 17 nt, Human
acaagaaaugaaagcag

SEQ ID NO: 2160029 - RNA, 19 nt, Human
ccccugagcuugcagagau

SEQ ID NO: 2160030 - RNA, 18 nt, Human
auugagaaggagcuccca

SEQ ID NO: 2160031 - RNA, 22 nt, Human
agagccggagccuccagcugcc

SEQ ID NO: 2160032 - RNA, 18 nt, Human
cccgggccgacggagccg

SEQ ID NO: 2160033 - RNA, 18 nt, Human
aagucuuucacauuuaaa

SEQ ID NO: 2160034 - RNA, 17 nt, Human
acacuaagagagaauga

SEQ ID NO: 2160035 - RNA, 16 nt, Human
aggccaugggacaggg

SEQ ID NO: 2160036 - RNA, 23 nt, Human
gaccccugagcuugcagagauga

SEQ ID NO: 2160037 - RNA, 14 nt, Human
ugcuaagucuuaua

SEQ ID NO: 2160038 - RNA, 23 nt, Human
auuauauggcuugaguuuaaauu

SEQ ID NO: 2160039 - RNA, 20 nt, Human
aauuaaguuuuuuuuuaaaa

SEQ ID NO: 2160040 - RNA, 15 nt, Human
uauaauuuaaauaua

SEQ ID NO: 2160041 - RNA, 23 nt, Human
ggaugaauuaaguuuuuuuuuaa

SEQ ID NO: 2160042 - RNA, 19 nt, Human
cgcucugggucgccggcau

SEQ ID NO: 2160043 - RNA, 19 nt, Human
ugcagcgaguacuucccgc

SEQ ID NO: 2160044 - RNA, 15 nt, Human
auuuuaaaagaauga

SEQ ID NO: 2160045 - RNA, 15 nt, Human
aauucugaaagcaac

SEQ ID NO: 2160046 - RNA, 22 nt, Human
uuuauggcacuaguauuucuau

SEQ ID NO: 2160047 - RNA, 13 nt, Human
cacaacacacaga

SEQ ID NO: 2160048 - RNA, 16 nt, Human
ucccagaucaagccug

SEQ ID NO: 2160049 - RNA, 17 nt, Human
uaauuccacagcugcuc

SEQ ID NO: 2160050 - RNA, 16 nt, Human
cgcucaucccacccgc

SEQ ID NO: 2160051 - RNA, 14 nt, Human
cagugaaagaaaau

SEQ ID NO: 2160052 - RNA, 13 nt, Human
aagacagugaaag

SEQ ID NO: 2160053 - RNA, 17 nt, Human
caccucccccaucucuu

SEQ ID NO: 2160054 - RNA, 18 nt, Human
aauaaaacuuuuccaaug

SEQ ID NO: 2160055 - RNA, 17 nt, Human
ccucuggcuccagcugg

SEQ ID NO: 2160056 - RNA, 18 nt, Human
cugcagccccugggacca

SEQ ID NO: 2160057 - RNA, 11 nt, Human
uuauauuuauu

SEQ ID NO: 2160058 - RNA, 12 nt, Human
uaguacacacuu

SEQ ID NO: 2160059 - RNA, 22 nt, Human
uccgcauccuagucucuaucau

SEQ ID NO: 2160060 - RNA, 14 nt, Human
auuuauguuuaauu

SEQ ID NO: 2160061 - RNA, 19 nt, Human
ugagguaaccucauuauca

SEQ ID NO: 2160062 - RNA, 12 nt, Human
aaaugaaagcag

SEQ ID NO: 2160063 - RNA, 18 nt, Human
uccugugggaccugggcc

SEQ ID NO: 2160064 - RNA, 22 nt, Human
ugaaaaaguucugcagauaaac

SEQ ID NO: 2160065 - RNA, 19 nt, Human
aaaguaugugcauauuuua

SEQ ID NO: 2160066 - RNA, 22 nt, Human
uuccccuuccuaauuccacagc

SEQ ID NO: 2160067 - RNA, 16 nt, Human
acagagacagaaagca

SEQ ID NO: 2160068 - RNA, 17 nt, Human
uguucuaagaagugaaa

SEQ ID NO: 2160069 - RNA, 18 nt, Human
cccagaaugaccuggccg

SEQ ID NO: 2160070 - RNA, 12 nt, Human
gccccugagccc

SEQ ID NO: 2160071 - RNA, 12 nt, Human
aaacuccacauc

SEQ ID NO: 2160072 - RNA, 20 nt, Human
cugccgugggccugagacca

SEQ ID NO: 2160073 - RNA, 21 nt, Human
ugaaauggacuuuuguacaua

SEQ ID NO: 2160074 - RNA, 20 nt, Human
aaagacaaggaaaaaauaac

SEQ ID NO: 2160075 - RNA, 15 nt, Human
acucaccucccccau

SEQ ID NO: 2160076 - RNA, 15 nt, Human
ugccgugggccugag

SEQ ID NO: 2160077 - RNA, 19 nt, Human
ugggccauagucauucugc

SEQ ID NO: 2160078 - RNA, 18 nt, Human
cagcugcucaauaaagua

SEQ ID NO: 2160079 - RNA, 15 nt, Human
gggucagccagcccu

SEQ ID NO: 2160080 - RNA, 22 nt, Human
uuugaaacgaggauugggaaaa

SEQ ID NO: 2160081 - RNA, 18 nt, Human
ggcuccggacgcugcugc

SEQ ID NO: 2160082 - RNA, 14 nt, Human
uccacuuggucugu

SEQ ID NO: 2160083 - RNA, 19 nt, Human
uacuucuuaggguuaugau

SEQ ID NO: 2160084 - RNA, 13 nt, Human
uaacaauaaaaga

SEQ ID NO: 2160085 - RNA, 20 nt, Human
gaaaauaacaauaaaagaca

SEQ ID NO: 2160086 - RNA, 17 nt, Human
agucccaggcugagccu

SEQ ID NO: 2160087 - RNA, 12 nt, Human
acaugagguacu

SEQ ID NO: 2160088 - RNA, 19 nt, Human
cccugcaaagcccagcuug

SEQ ID NO: 2160089 - RNA, 23 nt, Human
uuauagcuacuaauuuuaaaaug

SEQ ID NO: 2160090 - RNA, 13 nt, Human
ggaccuucccagc

SEQ ID NO: 2160091 - RNA, 18 nt, Human
uuacuguaagaaaauauc

SEQ ID NO: 2160092 - RNA, 17 nt, Human
aacaguuaccucugccu

SEQ ID NO: 2160093 - RNA, 16 nt, Human
acaaggaugaauuaag

SEQ ID NO: 2160094 - RNA, 14 nt, Human
cacaacacacagau

SEQ ID NO: 2160095 - RNA, 15 nt, Human
gcgcgccuccgcuac

SEQ ID NO: 2160096 - RNA, 23 nt, Human
caaagcugaaauggacuuuugua

SEQ ID NO: 2160097 - RNA, 16 nt, Human
auuuuuuuuuuuaaaa

SEQ ID NO: 2160098 - RNA, 21 nt, Human
uuauguuuaauucugaaagca

SEQ ID NO: 2160099 - RNA, 13 nt, Human
cacaggauggcag

SEQ ID NO: 2160100 - RNA, 22 nt, Human
ugggcacuguggguagacacac

SEQ ID NO: 2160101 - RNA, 11 nt, Human
accauuuuuac

SEQ ID NO: 2160102 - RNA, 23 nt, Human
ggcugcgcucggccugcucgccc

SEQ ID NO: 2160103 - RNA, 14 nt, Human
agagguccacaaca

SEQ ID NO: 2160104 - RNA, 19 nt, Human
cucugccucagaaaacaag

SEQ ID NO: 2160105 - RNA, 14 nt, Human
gccucagucucccu

SEQ ID NO: 2160106 - RNA, 19 nt, Human
ugcucgcccacuuccuccc

SEQ ID NO: 2160107 - RNA, 21 nt, Human
caucuagcaugucgucaaagc

SEQ ID NO: 2160108 - RNA, 13 nt, Human
uuuuuuuuuucaa

SEQ ID NO: 2160109 - RNA, 12 nt, Human
cacaacacacag

SEQ ID NO: 2160110 - RNA, 21 nt, Human
uuauuuucuauaauuuaaaua

SEQ ID NO: 2160111 - RNA, 19 nt, Human
aguuauuuuuaaacuguaa

SEQ ID NO: 2160112 - RNA, 15 nt, Human
gaaaacaaggaugaa

SEQ ID NO: 2160113 - RNA, 15 nt, Human
ccaucccggccggcg

SEQ ID NO: 2160114 - RNA, 21 nt, Human
caaagcccagcuugaaaccuu

SEQ ID NO: 2160115 - RNA, 21 nt, Human
aaaauaugccccauucaacau

SEQ ID NO: 2160116 - RNA, 13 nt, Human
uuaaauuguaaua

SEQ ID NO: 2160117 - RNA, 21 nt, Human
acaggauggcaggaggcaucc

SEQ ID NO: 2160118 - RNA, 18 nt, Human
uucugauauuggacagua

SEQ ID NO: 2160119 - RNA, 13 nt, Human
cagcugccucccc

SEQ ID NO: 2160120 - RNA, 17 nt, Human
agacagugaaagaaaau

SEQ ID NO: 2160121 - RNA, 21 nt, Human
agccucuuagaugcaguucug

SEQ ID NO: 2160122 - RNA, 17 nt, Human
agaaucacuugaacccg

SEQ ID NO: 2160123 - RNA, 19 nt, Human
guacugagagugaacaaau

SEQ ID NO: 2160124 - RNA, 23 nt, Human
ccuuuguugcuaucaauccaaga

SEQ ID NO: 2160125 - RNA, 17 nt, Human
uucugagcauuuaauau

SEQ ID NO: 2160126 - RNA, 18 nt, Human
cuucucacauuuauauuu

SEQ ID NO: 2160127 - RNA, 18 nt, Human
auccccaagccuggcaag

SEQ ID NO: 2160128 - RNA, 14 nt, Human
uugcuggagcucug

SEQ ID NO: 2160129 - RNA, 21 nt, Human
gagaaggagcucccaggaggg

SEQ ID NO: 2160130 - RNA, 15 nt, Human
ucugcagauaaacag

SEQ ID NO: 2160131 - RNA, 14 nt, Human
ggaccaucccggcc

SEQ ID NO: 2160132 - RNA, 18 nt, Human
aauaucaguuauuuuuaa

SEQ ID NO: 2160133 - RNA, 16 nt, Human
ggcagagagguaggga

SEQ ID NO: 2160134 - RNA, 19 nt, Human
ccccuauccuacuuccccu

SEQ ID NO: 2160135 - RNA, 19 nt, Human
ccaggcacccccagaauga

SEQ ID NO: 2160136 - RNA, 19 nt, Human
cucacauuuauauuuuugu

SEQ ID NO: 2160137 - RNA, 16 nt, Human
ugccucaccccuugcc

SEQ ID NO: 2160138 - RNA, 17 nt, Human
uuuuuaauuauauggcu

SEQ ID NO: 2160139 - RNA, 19 nt, Human
guaaagcuuugugcagauu

SEQ ID NO: 2160140 - RNA, 13 nt, Human
aaaugggaaacaa

SEQ ID NO: 2160141 - RNA, 13 nt, Human
uggacgagaaaac

SEQ ID NO: 2160142 - RNA, 11 nt, Human
agccagguacc

SEQ ID NO: 2160143 - RNA, 16 nt, Human
uauguucuaagaagug

SEQ ID NO: 2160144 - RNA, 15 nt, Human
cuacaagacacagug

SEQ ID NO: 2160145 - RNA, 22 nt, Human
cugcucaauaaaguacaagagc

SEQ ID NO: 2160146 - RNA, 23 nt, Human
aucauuaaaguucuagugaccga

SEQ ID NO: 2160147 - RNA, 23 nt, Human
ccccggggaggggcgcucgcuuc

SEQ ID NO: 2160148 - RNA, 15 nt, Human
cugcagauaaacagu

SEQ ID NO: 2160149 - RNA, 19 nt, Human
cucggccugcucgcccacu

SEQ ID NO: 2160150 - RNA, 20 nt, Human
gagccucagucucccucccu

SEQ ID NO: 2160151 - RNA, 17 nt, Human
agcuacuaauuuuaaaa

SEQ ID NO: 2160152 - RNA, 13 nt, Human
gcuguacgcgagc

SEQ ID NO: 2160153 - RNA, 18 nt, Human
uccucgccacgcucuggg

SEQ ID NO: 2160154 - RNA, 19 nt, Human
agaaaauaacaauaaaaga

SEQ ID NO: 2160155 - RNA, 19 nt, Human
uucccuugaugaagaaguu

SEQ ID NO: 2160156 - RNA, 19 nt, Human
cggggcggggagcgagccc

SEQ ID NO: 2160157 - RNA, 21 nt, Human
guuguaauuuuuuugugggaa

SEQ ID NO: 2160158 - RNA, 21 nt, Human
auuauauuuauuacuguaaga

SEQ ID NO: 2160159 - RNA, 14 nt, Human
uaaaguaugugcau

SEQ ID NO: 2160160 - RNA, 18 nt, Human
gcaaagcccagcuugaaa

SEQ ID NO: 2160161 - RNA, 18 nt, Human
cugagccuugggaccccu

SEQ ID NO: 2160162 - RNA, 16 nt, Human
ugacaagcucacagac

SEQ ID NO: 2160163 - RNA, 14 nt, Human
ccaaugaaaugagu

SEQ ID NO: 2160164 - RNA, 13 nt, Human
aguguuugaaagc

SEQ ID NO: 2160165 - RNA, 19 nt, Human
uccuagucucuaucauuaa

SEQ ID NO: 2160166 - RNA, 22 nt, Human
cggggagcgagccccaggcggg

SEQ ID NO: 2160167 - RNA, 14 nt, Human
cuucugacacuaaa

SEQ ID NO: 2160168 - RNA, 13 nt, Human
cgcugcgcgccgc

SEQ ID NO: 2160169 - RNA, 17 nt, Human
cccacuagacccacugg

SEQ ID NO: 2160170 - RNA, 21 nt, Human
ugcccugaaagucccagauca

SEQ ID NO: 2160171 - RNA, 21 nt, Human
auuuguauaaaauaauuuuua

SEQ ID NO: 2160172 - RNA, 11 nt, Human
gccaugggaca

SEQ ID NO: 2160173 - RNA, 15 nt, Human
ugaaauuguauuaca

SEQ ID NO: 2160174 - RNA, 15 nt, Human
uccagauccuggaaa

SEQ ID NO: 2160175 - RNA, 17 nt, Human
uuauaaucuuucacagg

SEQ ID NO: 2160176 - RNA, 15 nt, Human
cccugcaaagcccag

SEQ ID NO: 2160177 - RNA, 23 nt, Human
uauguuaaaacugggacagggga

SEQ ID NO: 2160178 - RNA, 22 nt, Human
agcagcauaaauguugacaugg

SEQ ID NO: 2160179 - RNA, 14 nt, Human
acccgcccaccgca

SEQ ID NO: 2160180 - RNA, 22 nt, Human
ggcugcugguggcgcuggcugc

SEQ ID NO: 2160181 - RNA, 17 nt, Human
agugagacagcucugca

SEQ ID NO: 2160182 - RNA, 22 nt, Human
cugagcggaccuucccagcuag

SEQ ID NO: 2160183 - RNA, 15 nt, Human
agccucagucucccu

SEQ ID NO: 2160184 - RNA, 12 nt, Human
gcgagcgcgcgc

SEQ ID NO: 2160185 - RNA, 15 nt, Human
caagcucacagaccu

SEQ ID NO: 2160186 - RNA, 18 nt, Human
auuuuuagugaaauauua

SEQ ID NO: 2160187 - RNA, 13 nt, Human
cugggucgccggc

SEQ ID NO: 2160188 - RNA, 19 nt, Human
acucugucucaguccauga

SEQ ID NO: 2160189 - RNA, 23 nt, Human
aggaugguucccuugaugaagaa

SEQ ID NO: 2160190 - RNA, 12 nt, Human
ggggugggggug

SEQ ID NO: 2160191 - RNA, 16 nt, Human
ccuaagugcagccccg

SEQ ID NO: 2160192 - RNA, 12 nt, Human
ucaccccuugcc

SEQ ID NO: 2160193 - RNA, 18 nt, Human
cugcucaauaaaguacaa

SEQ ID NO: 2160194 - RNA, 21 nt, Human
cuaaauugacacuuaaaaaug

SEQ ID NO: 2160195 - RNA, 14 nt, Human
gcuggagcucugcc

SEQ ID NO: 2160196 - RNA, 16 nt, Human
ggaggggcgcucgcuu

SEQ ID NO: 2160197 - RNA, 15 nt, Human
cucaacaaacauaau

SEQ ID NO: 2160198 - RNA, 22 nt, Human
cuucaacucccugccccccagc

SEQ ID NO: 2160199 - RNA, 12 nt, Human
cgcucggccugc

SEQ ID NO: 2160200 - RNA, 15 nt, Human
aaucucaauauuuca

SEQ ID NO: 2160201 - RNA, 14 nt, Human
aguuuuuuuuuaaa

SEQ ID NO: 2160202 - RNA, 15 nt, Human
ugagaaggagcuccc

SEQ ID NO: 2160203 - RNA, 13 nt, Human
caucccacccgcc

SEQ ID NO: 2160204 - RNA, 13 nt, Human
agaaguaaaaaca

SEQ ID NO: 2160205 - RNA, 13 nt, Human
ccaaccucuccca

SEQ ID NO: 2160206 - RNA, 18 nt, Human
auagaauuaacacaugau

SEQ ID NO: 2160207 - RNA, 19 nt, Human
auagcuacuaauuuuaaaa

SEQ ID NO: 2160208 - RNA, 18 nt, Human
aggcggauugagaaggag

SEQ ID NO: 2160209 - RNA, 13 nt, Human
gccuccagcugcc

SEQ ID NO: 2160210 - RNA, 22 nt, Human
ggguggaaaaacagaccggggu

SEQ ID NO: 2160211 - RNA, 21 nt, Human
cagugagacagcucugcauac

SEQ ID NO: 2160212 - RNA, 19 nt, Human
auuuucuauaauuuaaaua

SEQ ID NO: 2160213 - RNA, 22 nt, Human
ucaacuccaaacugacucuuaa

SEQ ID NO: 2160214 - RNA, 21 nt, Human
uaauaggcguaacuaauuuua

SEQ ID NO: 2160215 - RNA, 16 nt, Human
ccuagucucuaucauu

SEQ ID NO: 2160216 - RNA, 13 nt, Human
uaaacauguuuau

SEQ ID NO: 2160217 - RNA, 13 nt, Human
cucugagccuugg

SEQ ID NO: 2160218 - RNA, 24 nt, Human
uggccgggagccugaucaccugcc

SEQ ID NO: 2160219 - RNA, 21 nt, Human
auggcagcuuuccucaaaacu

SEQ ID NO: 2160220 - RNA, 17 nt, Human
gauaaaagacagugaaa

SEQ ID NO: 2160221 - RNA, 16 nt, Human
ggcugagccucagucu

SEQ ID NO: 2160222 - RNA, 23 nt, Human
uaggauggcuaguaucaaaagaa

SEQ ID NO: 2160223 - RNA, 15 nt, Human
acaaaugggaaacaa

SEQ ID NO: 2160224 - RNA, 23 nt, Human
ggccugagaccaaggcccccggg

SEQ ID NO: 2160225 - RNA, 14 nt, Human
cugaggcuccacuu

SEQ ID NO: 2160226 - RNA, 14 nt, Human
cucuggcuccagcu

SEQ ID NO: 2160227 - RNA, 16 nt, Human
ucauucugccugcccu

SEQ ID NO: 2160228 - RNA, 15 nt, Human
ccucagucucccucc

SEQ ID NO: 2160229 - RNA, 11 nt, Human
aaccugagccc

SEQ ID NO: 2160230 - RNA, 19 nt, Human
aguauuucuaugaaauauu

SEQ ID NO: 2160231 - RNA, 19 nt, Human
cuggccuucggccuccauc

SEQ ID NO: 2160232 - RNA, 20 nt, Human
caaauauaaauaaaaauaau

SEQ ID NO: 2160233 - RNA, 16 nt, Human
ugaaauuguauuacaa

SEQ ID NO: 2160234 - RNA, 17 nt, Human
aaauaacaauaaaagac

SEQ ID NO: 2160235 - RNA, 13 nt, Human
ucucccucccuug

SEQ ID NO: 2160236 - RNA, 23 nt, Human
gagcucccaggaggggcuucugg

SEQ ID NO: 2160237 - RNA, 16 nt, Human
uggucugugagaugcu

SEQ ID NO: 2160238 - RNA, 15 nt, Human
ccucucuuccucccu

SEQ ID NO: 2160239 - RNA, 20 nt, Human
uaugaaaaggcuaagcuuca

SEQ ID NO: 2160240 - RNA, 13 nt, Human
gacaaggaaaaaa

SEQ ID NO: 2160241 - RNA, 21 nt, Human
ugaugcuacaggauuugaaau

SEQ ID NO: 2160242 - RNA, 19 nt, Human
gaggcauccaaaggcuccu

SEQ ID NO: 2160243 - RNA, 23 nt, Human
aaaauaucacuugucaauaaaau

SEQ ID NO: 2160244 - RNA, 21 nt, Human
ccuccagcugccccggggagg

SEQ ID NO: 2160245 - RNA, 20 nt, Human
uauacugugugcuaaaacaa

SEQ ID NO: 2160246 - RNA, 18 nt, Human
ugagcuaggggggucagc

SEQ ID NO: 2160247 - RNA, 22 nt, Human
agccugccucaaucaguauuca

SEQ ID NO: 2160248 - RNA, 14 nt, Human
cagaaugaccuggc

SEQ ID NO: 2160249 - RNA, 16 nt, Human
acuaggugcugcagcc

SEQ ID NO: 2160250 - RNA, 21 nt, Human
cgagccccaggcggguccggg

SEQ ID NO: 2160251 - RNA, 16 nt, Human
uguucuaagaagugaa

SEQ ID NO: 2160252 - RNA, 17 nt, Human
ccgcgcagcucaggcug

SEQ ID NO: 2160253 - RNA, 17 nt, Human
ggagggcgcggggcggg

SEQ ID NO: 2160254 - RNA, 15 nt, Human
uacuaauuuuaaaau

SEQ ID NO: 2160255 - RNA, 12 nt, Human
acaagacacagu

SEQ ID NO: 2160256 - RNA, 20 nt, Human
uccacuuggacaugggcccc

SEQ ID NO: 2160257 - RNA, 19 nt, Human
aagucuuucacauuuaaau

SEQ ID NO: 2160258 - RNA, 22 nt, Human
gcacagccucuuagaugcaguu

SEQ ID NO: 2160259 - RNA, 14 nt, Human
gagcccauggcacu

SEQ ID NO: 2160260 - RNA, 15 nt, Human
acagugaaagaaaau

SEQ ID NO: 2160261 - RNA, 15 nt, Human
ccccagaaugaccug

SEQ ID NO: 2160262 - RNA, 14 nt, Human
cugccccccagccc

SEQ ID NO: 2160263 - RNA, 21 nt, Human
ccggggaggggcgcucgcuuc

SEQ ID NO: 2160264 - RNA, 20 nt, Human
acuaaauugacacuuaaaaa

SEQ ID NO: 2160265 - RNA, 22 nt, Human
gcugguggcgcuggcugcgcuc

SEQ ID NO: 2160266 - RNA, 22 nt, Human
gaggggagcaugggaagugacg

SEQ ID NO: 2160267 - RNA, 22 nt, Human
uauccuacuuccccuuccuaau

SEQ ID NO: 2160268 - RNA, 15 nt, Human
ccggggaggggcgcu

SEQ ID NO: 2160269 - RNA, 13 nt, Human
uauuuauuuuaau

SEQ ID NO: 2160270 - RNA, 21 nt, Human
aucuuguaaagguccuggcaa

SEQ ID NO: 2160271 - RNA, 18 nt, Human
ggaggacgcucucuggcc

SEQ ID NO: 2160272 - RNA, 21 nt, Human
aaacgaggauugggaaaaagu

SEQ ID NO: 2160273 - RNA, 16 nt, Human
gugcugcagccccugg

SEQ ID NO: 2160274 - RNA, 13 nt, Human
ucuacuaaaaaua

SEQ ID NO: 2160275 - RNA, 23 nt, Human
acgaggauugggaaaaaguaauu

SEQ ID NO: 2160276 - RNA, 12 nt, Human
uauucacaagac

SEQ ID NO: 2160277 - RNA, 20 nt, Human
cugagaccaaggcccccggg

SEQ ID NO: 2160278 - RNA, 11 nt, Human
cauaugaaaag

SEQ ID NO: 2160279 - RNA, 18 nt, Human
auuaaguuuuuuuuuaaa

SEQ ID NO: 2160280 - RNA, 18 nt, Human
cagauuugagcucagccc

SEQ ID NO: 2160281 - RNA, 16 nt, Human
uucugacacuaaaaca

SEQ ID NO: 2160282 - RNA, 15 nt, Human
cucccugccccccag

SEQ ID NO: 2160283 - RNA, 17 nt, Human
cccacuggacucaccuc

SEQ ID NO: 2160284 - RNA, 16 nt, Human
acaugaaguccaagca

SEQ ID NO: 2160285 - RNA, 19 nt, Human
ccacuuggacaugggcccc

SEQ ID NO: 2160286 - RNA, 12 nt, Human
cucauggaauug

SEQ ID NO: 2160287 - RNA, 20 nt, Human
cggagccuccagcugccccg

SEQ ID NO: 2160288 - RNA, 20 nt, Human
aauaucuuuuuuuuaauaaa

SEQ ID NO: 2160289 - RNA, 17 nt, Human
agggaagggggaacaug

SEQ ID NO: 2160290 - RNA, 19 nt, Human
cuucuuacaaugcauucug

SEQ ID NO: 2160291 - RNA, 16 nt, Human
ggggagcgagccccag

SEQ ID NO: 2160292 - RNA, 22 nt, Human
uacugagagugaacaaauuuac

SEQ ID NO: 2160293 - RNA, 15 nt, Human
uaacaauaaaagaca

SEQ ID NO: 2160294 - RNA, 21 nt, Human
aaaaaguucugcagauaaaca

SEQ ID NO: 2160295 - RNA, 13 nt, Human
uauauauuuuuuu

SEQ ID NO: 2160296 - RNA, 15 nt, Human
caggauggcaggagg

SEQ ID NO: 2160297 - RNA, 16 nt, Human
ugaauuaguuuuauau

SEQ ID NO: 2160298 - RNA, 14 nt, Human
aacaccucagcugc

SEQ ID NO: 2160299 - RNA, 18 nt, Human
uuauuauauauauauauu

SEQ ID NO: 2160300 - RNA, 15 nt, Human
ugguuuagaaagcuu

SEQ ID NO: 2160301 - RNA, 16 nt, Human
uggcaagcucuaucac

SEQ ID NO: 2160302 - RNA, 18 nt, Human
agccugaucaccugcccu

SEQ ID NO: 2160303 - RNA, 12 nt, Human
cuuccucugagc

SEQ ID NO: 2160304 - RNA, 13 nt, Human
caacaucuaguga

SEQ ID NO: 2160305 - RNA, 20 nt, Human
cucgcuuccgcauccuaguc

SEQ ID NO: 2160306 - RNA, 20 nt, Human
gacauuugcucauggaauug

SEQ ID NO: 2160307 - RNA, 20 nt, Human
agcucaggcuggcaccgcug

SEQ ID NO: 2160308 - RNA, 19 nt, Human
agagccuuuuuuugaaaaa

SEQ ID NO: 2160309 - RNA, 23 nt, Human
gguggcgcuggcugcgcucggcc

SEQ ID NO: 2160310 - RNA, 21 nt, Human
cuggcugcgcucggccugcuc

SEQ ID NO: 2160311 - RNA, 14 nt, Human
uugggaaaaaguaa

SEQ ID NO: 2160312 - RNA, 12 nt, Human
accaggcacccc

SEQ ID NO: 2160313 - RNA, 19 nt, Human
augaaagcagggacuugaa

SEQ ID NO: 2160314 - RNA, 17 nt, Human
uucacuguaaaauaaua

SEQ ID NO: 2160315 - RNA, 21 nt, Human
aaugugacuuaaugccacuaa

SEQ ID NO: 2160316 - RNA, 16 nt, Human
acauccuacaagacac

SEQ ID NO: 2160317 - RNA, 14 nt, Human
aaaacuucagacau

SEQ ID NO: 2160318 - RNA, 13 nt, Human
gcgcucggccugc

SEQ ID NO: 2160319 - RNA, 20 nt, Human
uuaacacaugauccugcaau

SEQ ID NO: 2160320 - RNA, 23 nt, Human
cuacacgagauacagaauuuuau

SEQ ID NO: 2160321 - RNA, 12 nt, Human
cauucugccugc

SEQ ID NO: 2160322 - RNA, 13 nt, Human
acacacaugaagu

SEQ ID NO: 2160323 - RNA, 13 nt, Human
uuuaaaaauccua

SEQ ID NO: 2160324 - RNA, 16 nt, Human
agaugcuagaacuccc

SEQ ID NO: 2160325 - RNA, 13 nt, Human
aaacauccuacaa

SEQ ID NO: 2160326 - RNA, 18 nt, Human
acaaaaggauaaugaaua

SEQ ID NO: 2160327 - RNA, 16 nt, Human
gccaugugcuaguaau

SEQ ID NO: 2160328 - RNA, 16 nt, Human
aaaagcuccauuuuua

SEQ ID NO: 2160329 - RNA, 21 nt, Human
aaaauuuuuucucuaggaaau

SEQ ID NO: 2160330 - RNA, 14 nt, Human
uucacauuuaaaua

SEQ ID NO: 2160331 - RNA, 18 nt, Human
ccucagcugccuccccag

SEQ ID NO: 2160332 - RNA, 13 nt, Human
auugucuagugaa

SEQ ID NO: 2160333 - RNA, 12 nt, Human
acagagacagaa

SEQ ID NO: 2160334 - RNA, 19 nt, Human
gccauagucauucugccug

SEQ ID NO: 2160335 - RNA, 14 nt, Human
aagcucuaucacca

SEQ ID NO: 2160336 - RNA, 19 nt, Human
auuuucaguuauuauauuu

SEQ ID NO: 2160337 - RNA, 22 nt, Human
uugacccacaagaaaugaaagc

SEQ ID NO: 2160338 - RNA, 14 nt, Human
agauguagaggaga

SEQ ID NO: 2160339 - RNA, 21 nt, Human
cugauauuggacaguaaaauc

SEQ ID NO: 2160340 - RNA, 20 nt, Human
ggccuaugcagagguccaca

SEQ ID NO: 2160341 - RNA, 19 nt, Human
ugggacaggggagaaccua

SEQ ID NO: 2160342 - RNA, 13 nt, Human
aggagcucccagg

SEQ ID NO: 2160343 - RNA, 22 nt, Human
cgcuggcugcgcucggccugcu

SEQ ID NO: 2160344 - RNA, 14 nt, Human
ucuaggaaauauuu

SEQ ID NO: 2160345 - RNA, 14 nt, Human
aacgauaaaagaca

SEQ ID NO: 2160346 - RNA, 17 nt, Human
cuauccuacuuccccuu

SEQ ID NO: 2160347 - RNA, 20 nt, Human
ggagccugaucaccugcccu

SEQ ID NO: 2160348 - RNA, 14 nt, Human
uuuuaaaaaagaaa

SEQ ID NO: 2160349 - RNA, 13 nt, Human
cccagauaccaug

SEQ ID NO: 2160350 - RNA, 19 nt, Human
gcacuaguauuucuaugaa

SEQ ID NO: 2160351 - RNA, 17 nt, Human
ccccagaaugaccuggc

SEQ ID NO: 2160352 - RNA, 20 nt, Human
cgcucggccugcucgcccac

SEQ ID NO: 2160353 - RNA, 16 nt, Human
cugagcgacagugaga

SEQ ID NO: 2160354 - RNA, 17 nt, Human
cccaggcugagccucag

SEQ ID NO: 2160355 - RNA, 14 nt, Human
aaccugagccccaa

SEQ ID NO: 2160356 - RNA, 19 nt, Human
cggccuccauccugaggcu

SEQ ID NO: 2160357 - RNA, 17 nt, Human
uaucaguuauuuuuaaa

SEQ ID NO: 2160358 - RNA, 17 nt, Human
cgccuccgcuacuucca

SEQ ID NO: 2160359 - RNA, 17 nt, Human
cauccuagucucuauca

SEQ ID NO: 2160360 - RNA, 14 nt, Human
aguacuucccgcug

SEQ ID NO: 2160361 - RNA, 21 nt, Human
agucucccucccuuggggccu

SEQ ID NO: 2160362 - RNA, 14 nt, Human
gcuccgcgcagcuc

SEQ ID NO: 2160363 - RNA, 20 nt, Human
gaagagccggagccuccagc

SEQ ID NO: 2160364 - RNA, 18 nt, Human
agggugcacacaggaugg

SEQ ID NO: 2160365 - RNA, 14 nt, Human
aagagugaaggauu

SEQ ID NO: 2160366 - RNA, 22 nt, Human
aggcuccacuuggucugugaga

SEQ ID NO: 2160367 - RNA, 14 nt, Human
auccaaugaaauga

SEQ ID NO: 2160368 - RNA, 15 nt, Human
ggccuccauccugag

SEQ ID NO: 2160369 - RNA, 20 nt, Human
uuccacagaagcuccaggua

SEQ ID NO: 2160370 - RNA, 17 nt, Human
aagacagugaaagaaaa

SEQ ID NO: 2160371 - RNA, 14 nt, Human
ggccuucggccucc

SEQ ID NO: 2160372 - RNA, 15 nt, Human
uugcucauggaauug

SEQ ID NO: 2160373 - RNA, 17 nt, Human
uccacaacacacagauu

SEQ ID NO: 2160374 - RNA, 14 nt, Human
ccccugagcuugca

SEQ ID NO: 2160375 - RNA, 22 nt, Human
agucuuucacauuuaaauaaag

SEQ ID NO: 2160376 - RNA, 18 nt, Human
gaggcuccacuuggucug

SEQ ID NO: 2160377 - RNA, 18 nt, Human
caagccucauguccacug

SEQ ID NO: 2160378 - RNA, 14 nt, Human
cagauccuggaaau

SEQ ID NO: 2160379 - RNA, 14 nt, Human
gcgagcgcgcgcgc

SEQ ID NO: 2160380 - RNA, 17 nt, Human
agccgggaaagaagagc

SEQ ID NO: 2160381 - RNA, 18 nt, Human
aaauaacgauaaaagaca

SEQ ID NO: 2160382 - RNA, 21 nt, Human
aguuguugcccacagcuguau

SEQ ID NO: 2160383 - RNA, 14 nt, Human
ccaaauauaaauaa

SEQ ID NO: 2160384 - RNA, 17 nt, Human
aaucuuauaauuuaaaa

SEQ ID NO: 2160385 - RNA, 14 nt, Human
acauauauaacaau

SEQ ID NO: 2160386 - RNA, 23 nt, Human
ugucaauucuugccaaauauaaa

SEQ ID NO: 2160387 - RNA, 13 nt, Human
aaaauaacgauaa

SEQ ID NO: 2160388 - RNA, 16 nt, Human
cacuaguauuucuaug

SEQ ID NO: 2160389 - RNA, 16 nt, Human
ccucaaucaguauuca

SEQ ID NO: 2160390 - RNA, 17 nt, Human
cauccugugggaccugg

SEQ ID NO: 2160391 - RNA, 15 nt, Human
gugggccugagacca

SEQ ID NO: 2160392 - RNA, 22 nt, Human
gggccugagaccaaggcccccg

SEQ ID NO: 2160393 - RNA, 18 nt, Human
uguggucacaggaaguag

SEQ ID NO: 2160394 - RNA, 17 nt, Human
ugaacuugguuuuaauu

SEQ ID NO: 2160395 - RNA, 22 nt, Human
guauucauauuuauagccaggu

SEQ ID NO: 2160396 - RNA, 12 nt, Human
uuauuauaguca

SEQ ID NO: 2160397 - RNA, 22 nt, Human
ccacagcuguaugauucccagc

SEQ ID NO: 2160398 - RNA, 21 nt, Human
cuucucacauuuauauuuuug

SEQ ID NO: 2160399 - RNA, 21 nt, Human
auauaugcuaagucuuauaua

SEQ ID NO: 2160400 - RNA, 20 nt, Human
guccccuauccuacuucccc

SEQ ID NO: 2160401 - RNA, 20 nt, Human
ucacaugaacuuguaaagga

SEQ ID NO: 2160402 - RNA, 23 nt, Human
augaauuaaguuuuuuuuuaaaa

SEQ ID NO: 2160403 - RNA, 13 nt, Human
uccucccggccgc

SEQ ID NO: 2160404 - RNA, 13 nt, Human
aggcuagauguau

SEQ ID NO: 2160405 - RNA, 22 nt, Human
uucauucacucaacaaacauaa

SEQ ID NO: 2160406 - RNA, 14 nt, Human
cugagucccaggcu

SEQ ID NO: 2160407 - RNA, 23 nt, Human
cacagauuugagcucagcccugg

SEQ ID NO: 2160408 - RNA, 13 nt, Human
cucaccuccccca

SEQ ID NO: 2160409 - RNA, 18 nt, Human
cccaagccuggcaaggga

SEQ ID NO: 2160410 - RNA, 18 nt, Human
acauguuacaacacggac

SEQ ID NO: 2160411 - RNA, 15 nt, Human
agagacagaaagcag

SEQ ID NO: 2160412 - RNA, 21 nt, Human
auuauauggcuugaguuuaaa

SEQ ID NO: 2160413 - RNA, 17 nt, Human
acuaguuguaauuuuuu

SEQ ID NO: 2160414 - RNA, 14 nt, Human
cagccccugggacc

SEQ ID NO: 2160415 - RNA, 18 nt, Human
ugagcucagcccuggugg

SEQ ID NO: 2160416 - RNA, 23 nt, Human
gggccuaugcagagguccacaac

SEQ ID NO: 2160417 - RNA, 21 nt, Human
cacuugaacccgggaggcaga

SEQ ID NO: 2160418 - RNA, 19 nt, Human
agguaaccucauuaucagu

SEQ ID NO: 2160419 - RNA, 19 nt, Human
cuaguaucaaaagaaagaa

SEQ ID NO: 2160420 - RNA, 13 nt, Human
acacuuaaaaaug

SEQ ID NO: 2160421 - RNA, 15 nt, Human
uccaaugacauuuug

SEQ ID NO: 2160422 - RNA, 18 nt, Human
uuuucucuccucucccca

SEQ ID NO: 2160423 - RNA, 17 nt, Human
gaagcaccaaucaugaa

SEQ ID NO: 2160424 - RNA, 14 nt, Human
agcccucuucugac

SEQ ID NO: 2160425 - RNA, 18 nt, Human
gcccacuuccucccggcc

SEQ ID NO: 2160426 - RNA, 20 nt, Human
gccuaauuuguuuucccuuc

SEQ ID NO: 2160427 - RNA, 15 nt, Human
cgcgcuccgcgcagc

SEQ ID NO: 2160428 - RNA, 14 nt, Human
aagugugacucauu

SEQ ID NO: 2160429 - RNA, 20 nt, Human
cucggacggcuccggacgcu

SEQ ID NO: 2160430 - RNA, 15 nt, Human
ucccacccgcccacc

SEQ ID NO: 2160431 - RNA, 22 nt, Human
aauaauccuaaacauaugaauu

SEQ ID NO: 2160432 - RNA, 23 nt, Human
gaggcauuuaggccaugggacag

SEQ ID NO: 2160433 - RNA, 20 nt, Human
gaacguaaucguguccccua

SEQ ID NO: 2160434 - RNA, 22 nt, Human
gagucccaggcugagccucagu

SEQ ID NO: 2160435 - RNA, 13 nt, Human
gcccccgggccga

SEQ ID NO: 2160436 - RNA, 17 nt, Human
ccaaggaugccccgucc

SEQ ID NO: 2160437 - RNA, 19 nt, Human
aauguuuacagauccccaa

SEQ ID NO: 2160438 - RNA, 13 nt, Human
gaagagccggagc

SEQ ID NO: 2160439 - RNA, 23 nt, Human
guuguaauuuuuuugugggaaau

SEQ ID NO: 2160440 - RNA, 17 nt, Human
gggaaauccacacugag

SEQ ID NO: 2160441 - RNA, 19 nt, Human
agcuacuaauuuuaaaaug

SEQ ID NO: 2160442 - RNA, 16 nt, Human
gacaaggaaaaaauaa

SEQ ID NO: 2160443 - RNA, 18 nt, Human
aauccacacugagcugag

SEQ ID NO: 2160444 - RNA, 14 nt, Human
ggaaucuuguaaag

SEQ ID NO: 2160445 - RNA, 13 nt, Human
uaagugcagcccc

SEQ ID NO: 2160446 - RNA, 19 nt, Human
ugaucaguaugaaaauguc

SEQ ID NO: 2160447 - RNA, 17 nt, Human
gacagugaaagaaaaua

SEQ ID NO: 2160448 - RNA, 15 nt, Human
uuuuaggaauacaua

SEQ ID NO: 2160449 - RNA, 23 nt, Human
agggcgcggggcggggagcgagc

SEQ ID NO: 2160450 - RNA, 18 nt, Human
cccacuagacccacugga

SEQ ID NO: 2160451 - RNA, 21 nt, Human
aauucauucacucaacaaaca

SEQ ID NO: 2160452 - RNA, 19 nt, Human
uacaaaaaaaaaaaaaaau

SEQ ID NO: 2160453 - RNA, 21 nt, Human
gacagucaccucauggaauug

SEQ ID NO: 2160454 - RNA, 15 nt, Human
ugccccccagcccuc

SEQ ID NO: 2160455 - RNA, 22 nt, Human
ggcauuuaggccaugggacagg

SEQ ID NO: 2160456 - RNA, 20 nt, Human
ugagagugaacaaauuuaca

SEQ ID NO: 2160457 - RNA, 18 nt, Human
uacauaaaguaugugcau

SEQ ID NO: 2160458 - RNA, 17 nt, Human
ggcccugugcggccugg

SEQ ID NO: 2160459 - RNA, 14 nt, Human
agcucuaucaccaa

SEQ ID NO: 2160460 - RNA, 18 nt, Human
gagucccaggcugagccu

SEQ ID NO: 2160461 - RNA, 14 nt, Human
acccaaaaggcaga

SEQ ID NO: 2160462 - RNA, 15 nt, Human
cuguaaaauaauaac

SEQ ID NO: 2160463 - RNA, 15 nt, Human
cagcgaguacuuccc

SEQ ID NO: 2160464 - RNA, 21 nt, Human
uguauaaaauaauuuuuauau

SEQ ID NO: 2160465 - RNA, 21 nt, Human
ggucaagaagcaucgugucug

SEQ ID NO: 2160466 - RNA, 22 nt, Human
guacacugccuucucaacucca

SEQ ID NO: 2160467 - RNA, 13 nt, Human
aucaagccugccu

SEQ ID NO: 2160468 - RNA, 17 nt, Human
cugcgcucggccugcuc

SEQ ID NO: 2160469 - RNA, 16 nt, Human
ccugccccccagcccu

SEQ ID NO: 2160470 - RNA, 13 nt, Human
gggcggcggcccu

SEQ ID NO: 2160471 - RNA, 18 nt, Human
gccuucggccuccauccu

SEQ ID NO: 2160472 - RNA, 15 nt, Human
uuauuuuuaaacugu

SEQ ID NO: 2160473 - RNA, 14 nt, Human
cuggaaaucagggu

SEQ ID NO: 2160474 - RNA, 22 nt, Human
ccggcgcgcucaucccacccgc

SEQ ID NO: 2160475 - RNA, 20 nt, Human
ggguuccuuccucugagccu

SEQ ID NO: 2160476 - RNA, 21 nt, Human
ugagcuaggggggucagccag

SEQ ID NO: 2160477 - RNA, 22 nt, Human
gaaugaccuggccgcagugagg

SEQ ID NO: 2160478 - RNA, 18 nt, Human
acaagccuccuuuuaaag

SEQ ID NO: 2160479 - RNA, 17 nt, Human
caauaacgauaaaagac

SEQ ID NO: 2160480 - RNA, 21 nt, Human
caccagucugacuguuuccau

SEQ ID NO: 2160481 - RNA, 22 nt, Human
uugagaaggagcucccaggagg

SEQ ID NO: 2160482 - RNA, 18 nt, Human
gcccuggugggcagagag

SEQ ID NO: 2160483 - RNA, 15 nt, Human
guuuuauuauauaua

SEQ ID NO: 2160484 - RNA, 15 nt, Human
ccgucccccucuggc

SEQ ID NO: 2160485 - RNA, 20 nt, Human
uguaagaaaauaucacuugu

SEQ ID NO: 2160486 - RNA, 14 nt, Human
cuagaauucacucc

SEQ ID NO: 2160487 - RNA, 17 nt, Human
ugcacaucaaaauaugc

SEQ ID NO: 2160488 - RNA, 14 nt, Human
cuucucuucacagu

SEQ ID NO: 2160489 - RNA, 14 nt, Human
augauguuuagaaa

SEQ ID NO: 2160490 - RNA, 11 nt, Human
gcauccuaguc

SEQ ID NO: 2160491 - RNA, 14 nt, Human
acgagaaaacaaua

SEQ ID NO: 2160492 - RNA, 14 nt, Human
aaucucaauauuuc

SEQ ID NO: 2160493 - RNA, 19 nt, Human
cgccacgcucugggucgcc

SEQ ID NO: 2160494 - RNA, 21 nt, Human
gcgccgcgcuccucggacggc

SEQ ID NO: 2160495 - RNA, 15 nt, Human
uuuaauaauuuuuaa

SEQ ID NO: 2160496 - RNA, 14 nt, Human
gcgcccucuggcug

SEQ ID NO: 2160497 - RNA, 18 nt, Human
ccugccuaagugcagccc

SEQ ID NO: 2160498 - RNA, 22 nt, Human
augguuguauuauuuuuuaaaa

SEQ ID NO: 2160499 - RNA, 13 nt, Human
acuauaaaacuag

SEQ ID NO: 2160500 - RNA, 17 nt, Human
uacaaaugcauuucuaa

SEQ ID NO: 2160501 - RNA, 19 nt, Human
cccccucuggcuccagcug

SEQ ID NO: 2160502 - RNA, 20 nt, Human
cgcaggaccaucccggccgg

SEQ ID NO: 2160503 - RNA, 21 nt, Human
aggcauccaaaggcuccugag

SEQ ID NO: 2160504 - RNA, 15 nt, Human
uuacagagacagaaa

SEQ ID NO: 2160505 - RNA, 21 nt, Human
ugaaacgaggauugggaaaaa

SEQ ID NO: 2160506 - RNA, 16 nt, Human
uucucuaggaaauauu

SEQ ID NO: 2160507 - RNA, 19 nt, Human
gaaaauaacgauaaaagac

SEQ ID NO: 2160508 - RNA, 20 nt, Human
cugcacuccagccugagcga

SEQ ID NO: 2160509 - RNA, 12 nt, Human
aagaaaauaaca

SEQ ID NO: 2160510 - RNA, 16 nt, Human
cuguacgcgagcgcgc

SEQ ID NO: 2160511 - RNA, 19 nt, Human
aaugaauggcuaagcaaaa

SEQ ID NO: 2160512 - RNA, 21 nt, Human
ugaccauacuaauuauacccc

SEQ ID NO: 2160513 - RNA, 14 nt, Human
ucaaugcagccccc

SEQ ID NO: 2160514 - RNA, 14 nt, Human
auugucuagugaaa

SEQ ID NO: 2160515 - RNA, 14 nt, Human
cuaagucuuauaua

SEQ ID NO: 2160516 - RNA, 16 nt, Human
ccuaugcagaggucca

SEQ ID NO: 2160517 - RNA, 22 nt, Human
caugaguaacugauuuguaaca

SEQ ID NO: 2160518 - RNA, 23 nt, Human
agucccagaucaagccugccuca

SEQ ID NO: 2160519 - RNA, 23 nt, Human
gccgggaaagaagagccggagcc

SEQ ID NO: 2160520 - RNA, 14 nt, Human
cagucucccucccu

SEQ ID NO: 2160521 - RNA, 14 nt, Human
aauuguauuacaaa

SEQ ID NO: 2160522 - RNA, 10 nt, Human
auguuuucag

SEQ ID NO: 2160523 - RNA, 12 nt, Human
ucccaaccucuc

SEQ ID NO: 2160524 - RNA, 21 nt, Human
uuuucaggcuagauguaugua

SEQ ID NO: 2160525 - RNA, 20 nt, Human
auaauccuaaacauaugaau

SEQ ID NO: 2160526 - RNA, 21 nt, Human
aauuaaguuuuuuuuuaaaaa

SEQ ID NO: 2160527 - RNA, 14 nt, Human
agacaucaacagau

SEQ ID NO: 2160528 - RNA, 15 nt, Human
gaaaugaaagcaggg

SEQ ID NO: 2160529 - RNA, 15 nt, Human
guuuuucuuuucauu

SEQ ID NO: 2160530 - RNA, 18 nt, Human
gccuuggauacuccaugg

SEQ ID NO: 2160531 - RNA, 15 nt, Human
ggugcugcagccccu

SEQ ID NO: 2160532 - RNA, 20 nt, Human
uuauugaggcuuuaaaacuu

SEQ ID NO: 2160533 - RNA, 14 nt, Human
ccugagaccaaggc

SEQ ID NO: 2160534 - RNA, 14 nt, Human
ucuaucccaaccuc

SEQ ID NO: 2160535 - RNA, 16 nt, Human
acauuugcucauggaa

SEQ ID NO: 2160536 - RNA, 21 nt, Human
cuauguucuaagaagugaaaa

SEQ ID NO: 2160537 - RNA, 15 nt, Human
cuucaacucccugcc

SEQ ID NO: 2160538 - RNA, 19 nt, Human
cccacuggacucaccuccc

SEQ ID NO: 2160539 - RNA, 16 nt, Human
gccuaagugcagcccc

SEQ ID NO: 2160540 - RNA, 18 nt, Human
cugcugguggcgcuggcu

SEQ ID NO: 2160541 - RNA, 12 nt, Human
gggggucagcca

SEQ ID NO: 2160542 - RNA, 15 nt, Human
auaauccuaaacaua

SEQ ID NO: 2160543 - RNA, 23 nt, Human
agaaugauuaugaauuacauuug

SEQ ID NO: 2160544 - RNA, 20 nt, Human
caaacauccuacaagacaca

SEQ ID NO: 2160545 - RNA, 18 nt, Human
uuuugugaagcaaaauuu

SEQ ID NO: 2160546 - RNA, 18 nt, Human
ugcugcagccccugggac

SEQ ID NO: 2160547 - RNA, 21 nt, Human
ucuuaggguuaugauuaagua

SEQ ID NO: 2160548 - RNA, 14 nt, Human
gcgcgcuccgcgca

SEQ ID NO: 2160549 - RNA, 21 nt, Human
gcgcucggccugcucgcccac

SEQ ID NO: 2160550 - RNA, 21 nt, Human
gaaauguuuacagauccccaa

SEQ ID NO: 2160551 - RNA, 22 nt, Human
ggcagcuuuccucaaaacuuca

SEQ ID NO: 2160552 - RNA, 12 nt, Human
gguuuauauaag

SEQ ID NO: 2160553 - RNA, 19 nt, Human
uguaaagguccuggcaaag

SEQ ID NO: 2160554 - RNA, 18 nt, Human
cagucucccucccuuggg

SEQ ID NO: 2160555 - RNA, 15 nt, Human
ucaguauucauauuu

SEQ ID NO: 2160556 - RNA, 12 nt, Human
gcccccgggccg

SEQ ID NO: 2160557 - RNA, 23 nt, Human
gaaaaugucauuguucuugugaa

SEQ ID NO: 2160558 - RNA, 20 nt, Human
auaaauggcuuccuggcaau

SEQ ID NO: 2160559 - RNA, 15 nt, Human
uucacauuuaaauaa

SEQ ID NO: 2160560 - RNA, 22 nt, Human
cccaugauguuuagaaacacaa

SEQ ID NO: 2160561 - RNA, 17 nt, Human
uccugccccugagccca

SEQ ID NO: 2160562 - RNA, 12 nt, Human
gguauuuuaauc

SEQ ID NO: 2160563 - RNA, 20 nt, Human
ccagugagacagcucugcau

SEQ ID NO: 2160564 - RNA, 17 nt, Human
ugaccacugcagaagac

SEQ ID NO: 2160565 - RNA, 15 nt, Human
gcgagcgcgcgcgcc

SEQ ID NO: 2160566 - RNA, 19 nt, Human
aaaacuaggugcugcagcc

SEQ ID NO: 2160567 - RNA, 19 nt, Human
ggccugcucgcccacuucc

SEQ ID NO: 2160568 - RNA, 20 nt, Human
acaagacacagugaccauac

SEQ ID NO: 2160569 - RNA, 18 nt, Human
gagcgacagugagacucu

SEQ ID NO: 2160570 - RNA, 15 nt, Human
cccaaccucucccaa

SEQ ID NO: 2160571 - RNA, 19 nt, Human
gucaaauugugugaaaggu

SEQ ID NO: 2160572 - RNA, 14 nt, Human
uuuguauaaaauaa

SEQ ID NO: 2160573 - RNA, 23 nt, Human
cucagucucccucccuuggggcc

SEQ ID NO: 2160574 - RNA, 18 nt, Human
ccugucacgugugggcaa

SEQ ID NO: 2160575 - RNA, 21 nt, Human
cccacuggacucaccuccccc

SEQ ID NO: 2160576 - RNA, 17 nt, Human
gccgcgcugcgcgccgc

SEQ ID NO: 2160577 - RNA, 13 nt, Human
acaaggaaaaaau

SEQ ID NO: 2160578 - RNA, 15 nt, Human
accucccccaucucu

SEQ ID NO: 2160579 - RNA, 20 nt, Human
uauuuauuacuguaagaaaa

SEQ ID NO: 2160580 - RNA, 12 nt, Human
cccccagcccuc

SEQ ID NO: 2160581 - RNA, 20 nt, Human
cucuguucugcacacagcac

SEQ ID NO: 2160582 - RNA, 21 nt, Human
auauuuuuuuuuuuaaaaaaa

SEQ ID NO: 2160583 - RNA, 23 nt, Human
uacuuccagggcuacgcgcgcuc

SEQ ID NO: 2160584 - RNA, 23 nt, Human
acucuauguucuaagaagugaaa

SEQ ID NO: 2160585 - RNA, 17 nt, Human
ccagaucaagccugccu

SEQ ID NO: 2160586 - RNA, 14 nt, Human
uauuugaaauauug

SEQ ID NO: 2160587 - RNA, 21 nt, Human
cugcccugcugagucccaggc

SEQ ID NO: 2160588 - RNA, 15 nt, Human
ggccugagaccaagg

SEQ ID NO: 2160589 - RNA, 14 nt, Human
ugagcuaggggggu

SEQ ID NO: 2160590 - RNA, 16 nt, Human
uggggauagugaggca

SEQ ID NO: 2160591 - RNA, 17 nt, Human
gccuccuuuuaaaguaa

SEQ ID NO: 2160592 - RNA, 17 nt, Human
ccaugaugcugagcccg

SEQ ID NO: 2160593 - RNA, 15 nt, Human
ggggcuucugggcag

SEQ ID NO: 2160594 - RNA, 17 nt, Human
acucuggucaagaagca

SEQ ID NO: 2160595 - RNA, 22 nt, Human
auagccagguaccuucucaccu

SEQ ID NO: 2160596 - RNA, 15 nt, Human
uggacgagaaaacaa

SEQ ID NO: 2160597 - RNA, 13 nt, Human
gaaccuaggguga

SEQ ID NO: 2160598 - RNA, 15 nt, Human
agugacaagcucaca

SEQ ID NO: 2160599 - RNA, 15 nt, Human
uccuacaagacacag

SEQ ID NO: 2160600 - RNA, 23 nt, Human
ggaacaguuaccucugccucaga

SEQ ID NO: 2160601 - RNA, 20 nt, Human
aaucuuucacaggggacagg

SEQ ID NO: 2160602 - RNA, 14 nt, Human
uaugaauuacauuu

SEQ ID NO: 2160603 - RNA, 17 nt, Human
ccugccccccagcccuc

SEQ ID NO: 2160604 - RNA, 16 nt, Human
auacauguuacaacac

SEQ ID NO: 2160605 - RNA, 20 nt, Human
ggcuccggacgcugcugccg

SEQ ID NO: 2160606 - RNA, 23 nt, Human
cucagcccuggugggcagagagg

SEQ ID NO: 2160607 - RNA, 14 nt, Human
gagguaccagccuu

SEQ ID NO: 2160608 - RNA, 20 nt, Human
aguuuuuuuuuaaaaaagaa

SEQ ID NO: 2160609 - RNA, 16 nt, Human
uaggugcugcagcccc

SEQ ID NO: 2160610 - RNA, 22 nt, Human
gaauuucuucaacucccugccc

SEQ ID NO: 2160611 - RNA, 15 nt, Human
aauugacccacaaga

SEQ ID NO: 2160612 - RNA, 18 nt, Human
ugagaaggagcucccagg

SEQ ID NO: 2160613 - RNA, 20 nt, Human
uguuggugaacuugguuuua

SEQ ID NO: 2160614 - RNA, 17 nt, Human
auaucaauuuaaaaaaa

SEQ ID NO: 2160615 - RNA, 12 nt, Human
aauuuaaauaua

SEQ ID NO: 2160616 - RNA, 20 nt, Human
aaggagccaaacauccuaca

SEQ ID NO: 2160617 - RNA, 16 nt, Human
aaaauaauccucaguu

SEQ ID NO: 2160618 - RNA, 22 nt, Human
aauaugccccauucaacaucua

SEQ ID NO: 2160619 - RNA, 16 nt, Human
cucucccaacuauaaa

SEQ ID NO: 2160620 - RNA, 23 nt, Human
ucggccuccauccugaggcucca

SEQ ID NO: 2160621 - RNA, 21 nt, Human
ugaacaaauuuacagagacag

SEQ ID NO: 2160622 - RNA, 21 nt, Human
aagacucgggauuaguacaca

SEQ ID NO: 2160623 - RNA, 22 nt, Human
cccagcccuccuuaucaaagga

SEQ ID NO: 2160624 - RNA, 19 nt, Human
gaaaaugucauuguucuug

SEQ ID NO: 2160625 - RNA, 17 nt, Human
ccuauccuacuuccccu

SEQ ID NO: 2160626 - RNA, 14 nt, Human
aucaguuauuuuua

SEQ ID NO: 2160627 - RNA, 22 nt, Human
acauccuacaagacacagugac

SEQ ID NO: 2160628 - RNA, 16 nt, Human
gacaagcucacagacc

SEQ ID NO: 2160629 - RNA, 18 nt, Human
uacauuuguauaaaauaa

SEQ ID NO: 2160630 - RNA, 19 nt, Human
aaauaugccccauucaaca

SEQ ID NO: 2160631 - RNA, 16 nt, Human
uggcgcuggcugcgcu

SEQ ID NO: 2160632 - RNA, 19 nt, Human
auuucuucaacucccugcc

SEQ ID NO: 2160633 - RNA, 20 nt, Human
uacaucccuuaccugggaaa

SEQ ID NO: 2160634 - RNA, 16 nt, Human
ccucaaaacuucagac

SEQ ID NO: 2160635 - RNA, 14 nt, Human
ggugcugcagcccc

SEQ ID NO: 2160636 - RNA, 21 nt, Human
gccugagaccaaggcccccgg

SEQ ID NO: 2160637 - RNA, 19 nt, Human
auucuuuacccccugggag

SEQ ID NO: 2160638 - RNA, 14 nt, Human
auuuucuauaauuu

SEQ ID NO: 2160639 - RNA, 19 nt, Human
auuguaguccuguaaugga

SEQ ID NO: 2160640 - RNA, 16 nt, Human
uaaaauccauacauuu

SEQ ID NO: 2160641 - RNA, 14 nt, Human
cccugccccccagc

SEQ ID NO: 2160642 - RNA, 16 nt, Human
ccucauuaucagucca

SEQ ID NO: 2160643 - RNA, 20 nt, Human
ccagcuggccgggagccuga

SEQ ID NO: 2160644 - RNA, 14 nt, Human
caggaggcauccaa

SEQ ID NO: 2160645 - RNA, 22 nt, Human
ggcuaagcuucacuguaaaaua

SEQ ID NO: 2160646 - RNA, 21 nt, Human
auguuuaauucugaaagcaac

SEQ ID NO: 2160647 - RNA, 19 nt, Human
gguuuaauaauuuuuaauu

SEQ ID NO: 2160648 - RNA, 16 nt, Human
ccugagcgacagugag

SEQ ID NO: 2160649 - RNA, 23 nt, Human
gccugaguguugccuaauuuguu

SEQ ID NO: 2160650 - RNA, 22 nt, Human
caagcacuaaacaaagagugaa

SEQ ID NO: 2160651 - RNA, 21 nt, Human
ugccugagcggaccuucccag

SEQ ID NO: 2160652 - RNA, 17 nt, Human
ccaaaagguauuuuaau

SEQ ID NO: 2160653 - RNA, 23 nt, Human
cacaagaaaugaaagcagggacu

SEQ ID NO: 2160654 - RNA, 21 nt, Human
cagccccugggaccaggcacc

SEQ ID NO: 2160655 - RNA, 18 nt, Human
cucuauguucuaagaagu

SEQ ID NO: 2160656 - RNA, 16 nt, Human
cccaaccucucccaac

SEQ ID NO: 2160657 - RNA, 14 nt, Human
cuaaacauaugaau

SEQ ID NO: 2160658 - RNA, 22 nt, Human
uucccagcuagaauucacucca

SEQ ID NO: 2160659 - RNA, 21 nt, Human
gaaaacaauaacgauaaaaga

SEQ ID NO: 2160660 - RNA, 17 nt, Human
auuuucuauaauuuaaa

SEQ ID NO: 2160661 - RNA, 21 nt, Human
uaaaagacagugaaagaaaau

SEQ ID NO: 2160662 - RNA, 18 nt, Human
ucuucuggguuccuuccu

SEQ ID NO: 2160663 - RNA, 22 nt, Human
aucucuucuggguuccuuccuc

SEQ ID NO: 2160664 - RNA, 18 nt, Human
cuuucacauuuaaauaaa

SEQ ID NO: 2160665 - RNA, 22 nt, Human
ugguuguauuauuuuuuaaaaa

SEQ ID NO: 2160666 - RNA, 13 nt, Human
gggcggggagcga

SEQ ID NO: 2160667 - RNA, 21 nt, Human
caauuuuguuauguauauuuu

SEQ ID NO: 2160668 - RNA, 23 nt, Human
cuuaagaagacugcauuauauuu

SEQ ID NO: 2160669 - RNA, 12 nt, Human
acucccugcccc

SEQ ID NO: 2160670 - RNA, 14 nt, Human
uaacuaauuuuaac

SEQ ID NO: 2160671 - RNA, 17 nt, Human
uuccaagugauugaaac

SEQ ID NO: 2160672 - RNA, 13 nt, Human
aggaaaaaauaac

SEQ ID NO: 2160673 - RNA, 16 nt, Human
gucuaucuuugagcgc

SEQ ID NO: 2160674 - RNA, 16 nt, Human
cauagaaguaaaaaca

SEQ ID NO: 2160675 - RNA, 17 nt, Human
cugggaccaggcacccc

SEQ ID NO: 2160676 - RNA, 13 nt, Human
auuuuaaaagaau

SEQ ID NO: 2160677 - RNA, 20 nt, Human
caagccuccuuuuaaaguaa

SEQ ID NO: 2160678 - RNA, 21 nt, Human
augcuacaggauuugaaauug

SEQ ID NO: 2160679 - RNA, 19 nt, Human
auguuuacagauccccaag

SEQ ID NO: 2160680 - RNA, 17 nt, Human
cauuaaaguucuaguga

SEQ ID NO: 2160681 - RNA, 15 nt, Human
gcuguauuuuaaaag

SEQ ID NO: 2160682 - RNA, 21 nt, Human
cuauaaaacuaggugcugcag

SEQ ID NO: 2160683 - RNA, 23 nt, Human
agggaagggggaacaugagccuu

SEQ ID NO: 2160684 - RNA, 23 nt, Human
cauuguggucacaggaaguagag

SEQ ID NO: 2160685 - RNA, 14 nt, Human
cuaucaauccaaga

SEQ ID NO: 2160686 - RNA, 14 nt, Human
cggagccuccagcu

SEQ ID NO: 2160687 - RNA, 19 nt, Human
ggaauuucuucaacucccu

SEQ ID NO: 2160688 - RNA, 15 nt, Human
aaugauuaugaauua

SEQ ID NO: 2160689 - RNA, 21 nt, Human
aaagcugaaauggacuuuugu

SEQ ID NO: 2160690 - RNA, 18 nt, Human
uuauuacuguaagaaaau

SEQ ID NO: 2160691 - RNA, 16 nt, Human
uauugggguugggggg

SEQ ID NO: 2160692 - RNA, 22 nt, Human
gaagugaaaaucuacacuccag

SEQ ID NO: 2160693 - RNA, 13 nt, Human
auauuuuauuaua

SEQ ID NO: 2160694 - RNA, 12 nt, Human
cuccauuuuuag

SEQ ID NO: 2160695 - RNA, 13 nt, Human
agcgacagugaga

SEQ ID NO: 2160696 - RNA, 17 nt, Human
uccagcuggccgggagc

SEQ ID NO: 2160697 - RNA, 21 nt, Human
cccuauccuacuuccccuucc

SEQ ID NO: 2160698 - RNA, 22 nt, Human
uuguucuugugaacccaaagug

SEQ ID NO: 2160699 - RNA, 23 nt, Human
cuugauaaauggcuuccuggcaa

SEQ ID NO: 2160700 - RNA, 13 nt, Human
caccaaggagcca

SEQ ID NO: 2160701 - RNA, 21 nt, Human
auuuuuucucuaggaaauauu

SEQ ID NO: 2160702 - RNA, 20 nt, Human
auuuugugauugauuauaug

SEQ ID NO: 2160703 - RNA, 22 nt, Human
auauaugcuaagucuuauauau

SEQ ID NO: 2160704 - RNA, 13 nt, Human
gagacagcucugc

SEQ ID NO: 2160705 - RNA, 22 nt, Human
uguucugauauuggacaguaaa

SEQ ID NO: 2160706 - RNA, 22 nt, Human
gcuaaaacaagcacuaaacaaa

SEQ ID NO: 2160707 - RNA, 13 nt, Human
cccggccgcgcug

SEQ ID NO: 2160708 - RNA, 19 nt, Human
cagcuacuugggaggcuga

SEQ ID NO: 2160709 - RNA, 21 nt, Human
cgcccacuuccucccggccgc

SEQ ID NO: 2160710 - RNA, 17 nt, Human
caagacccaaaaggcag

SEQ ID NO: 2160711 - RNA, 14 nt, Human
gaaaacaauaacga

SEQ ID NO: 2160712 - RNA, 20 nt, Human
cugcucgcccacuuccuccc

SEQ ID NO: 2160713 - RNA, 18 nt, Human
ucucuaggaaauauuuau

SEQ ID NO: 2160714 - RNA, 23 nt, Human
cucuacuaaaaauacaaaaaaaa

SEQ ID NO: 2160715 - RNA, 19 nt, Human
uggaaauguuuacagaucc

SEQ ID NO: 2160716 - RNA, 21 nt, Human
cggcuccggacgcugcugccg

SEQ ID NO: 2160717 - RNA, 14 nt, Human
auauuugaaauauu

SEQ ID NO: 2160718 - RNA, 14 nt, Human
auuuaaauauaugc

SEQ ID NO: 2160719 - RNA, 12 nt, Human
ggaggggcuucu

SEQ ID NO: 2160720 - RNA, 20 nt, Human
uccuccaugaauaucaguua

SEQ ID NO: 2160721 - RNA, 15 nt, Human
accaaggcugauuaa

SEQ ID NO: 2160722 - RNA, 12 nt, Human
gaugcugagccc

SEQ ID NO: 2160723 - RNA, 15 nt, Human
ggauacuccaugggg

SEQ ID NO: 2160724 - RNA, 21 nt, Human
ccccugcaaagcccagcuuga

SEQ ID NO: 2160725 - RNA, 14 nt, Human
ccuugaugaagaag

SEQ ID NO: 2160726 - RNA, 19 nt, Human
auaaaagacaaggaaaaaa

SEQ ID NO: 2160727 - RNA, 20 nt, Human
acggacgaaccuugaaaacu

SEQ ID NO: 2160728 - RNA, 19 nt, Human
aaaaucuuauaauuuaaaa

SEQ ID NO: 2160729 - RNA, 22 nt, Human
agccaaacauccuacaagacac

SEQ ID NO: 2160730 - RNA, 16 nt, Human
uuuauauuugaaauau

SEQ ID NO: 2160731 - RNA, 11 nt, Human
ugcagugagcc

SEQ ID NO: 2160732 - RNA, 16 nt, Human
auuccaccuacaugag

SEQ ID NO: 2160733 - RNA, 19 nt, Human
agaugcuagaacucccuuu

SEQ ID NO: 2160734 - RNA, 21 nt, Human
gcacuguggguagacacacau

SEQ ID NO: 2160735 - RNA, 15 nt, Human
aaacauaugaauuau

SEQ ID NO: 2160736 - RNA, 12 nt, Human
ucuacacuccag

SEQ ID NO: 2160737 - RNA, 21 nt, Human
cuccccagcucuaucccaacc

SEQ ID NO: 2160738 - RNA, 22 nt, Human
uggcgcuggcugcgcucggccu

SEQ ID NO: 2160739 - RNA, 20 nt, Human
aaggaugccccgucccccuc

SEQ ID NO: 2160740 - RNA, 23 nt, Human
cccagcccuccuuaucaaaggac

SEQ ID NO: 2160741 - RNA, 17 nt, Human
cacuuggacaugggccc

SEQ ID NO: 2160742 - RNA, 21 nt, Human
ccauccugccccugagcccau

SEQ ID NO: 2160743 - RNA, 15 nt, Human
cagugaaagaaaaua

SEQ ID NO: 2160744 - RNA, 23 nt, Human
gccccugcacuccagccugagcg

SEQ ID NO: 2160745 - RNA, 22 nt, Human
uaaaauaauuuuuauauuugaa

SEQ ID NO: 2160746 - RNA, 13 nt, Human
auccugaggcucc

SEQ ID NO: 2160747 - RNA, 15 nt, Human
uccauccugaggcuc

SEQ ID NO: 2160748 - RNA, 21 nt, Human
auccugugggaccugggccau

SEQ ID NO: 2160749 - RNA, 13 nt, Human
gggggaggugagg

SEQ ID NO: 2160750 - RNA, 14 nt, Human
gccgcgcuccucgg

SEQ ID NO: 2160751 - RNA, 17 nt, Human
uaaaagacaaggaaaaa

SEQ ID NO: 2160752 - RNA, 12 nt, Human
ccccuugccaua

SEQ ID NO: 2160753 - RNA, 21 nt, Human
augucauuugcuggagcucug

SEQ ID NO: 2160754 - RNA, 17 nt, Human
ccauagucauucugccu

SEQ ID NO: 2160755 - RNA, 12 nt, Human
uuuuuuuuaaaa

SEQ ID NO: 2160756 - RNA, 23 nt, Human
gauagauaggucagugcaaauac

SEQ ID NO: 2160757 - RNA, 16 nt, Human
ggcgggagggcgcggg

SEQ ID NO: 2160758 - RNA, 18 nt, Human
caguuguugcccacagcu

SEQ ID NO: 2160759 - RNA, 15 nt, Human
uugacccacaagaaa

SEQ ID NO: 2160760 - RNA, 23 nt, Human
cccacuggacucaccucccccau

SEQ ID NO: 2160761 - RNA, 16 nt, Human
caauccaagaacuuau

SEQ ID NO: 2160762 - RNA, 16 nt, Human
ccuccuuaucaaagga

SEQ ID NO: 2160763 - RNA, 19 nt, Human
cauccaaaggcuccugaga

SEQ ID NO: 2160764 - RNA, 21 nt, Human
auacauaaaguaugugcauau

SEQ ID NO: 2160765 - RNA, 20 nt, Human
ugagucccaggcugagccuc

SEQ ID NO: 2160766 - RNA, 21 nt, Human
aauaauguuucaaacauauau

SEQ ID NO: 2160767 - RNA, 18 nt, Human
uauagcuacuaauuuuaa

SEQ ID NO: 2160768 - RNA, 15 nt, Human
ugcaauuccacuuau

SEQ ID NO: 2160769 - RNA, 13 nt, Human
aaauccuugaaga

SEQ ID NO: 2160770 - RNA, 21 nt, Human
aagaagagccggagccuccag

SEQ ID NO: 2160771 - RNA, 16 nt, Human
accuguucgcgcgccu

SEQ ID NO: 2160772 - RNA, 20 nt, Human
ggccaugggacagggaggac

SEQ ID NO: 2160773 - RNA, 16 nt, Human
uauaucaauuuaaaaa

SEQ ID NO: 2160774 - RNA, 22 nt, Human
caaggaugccccgucccccucu

SEQ ID NO: 2160775 - RNA, 18 nt, Human
auucuugccaaauauaaa

SEQ ID NO: 2160776 - RNA, 19 nt, Human
uauacugugugcuaaaaca

SEQ ID NO: 2160777 - RNA, 14 nt, Human
uauguauauuuuau

SEQ ID NO: 2160778 - RNA, 16 nt, Human
cuuuaugcuaagugaa

SEQ ID NO: 2160779 - RNA, 18 nt, Human
cagguaccuucucaccug

SEQ ID NO: 2160780 - RNA, 14 nt, Human
cuggccgggagccu

SEQ ID NO: 2160781 - RNA, 16 nt, Human
gggucagccagcccuc

SEQ ID NO: 2160782 - RNA, 16 nt, Human
cgcgcgcuccgcgcag

SEQ ID NO: 2160783 - RNA, 19 nt, Human
aauuuuuauauuugaaaua

SEQ ID NO: 2160784 - RNA, 17 nt, Human
cggcccugugcggccug

SEQ ID NO: 2160785 - RNA, 14 nt, Human
acuaauuuuaaaau

SEQ ID NO: 2160786 - RNA, 19 nt, Human
cuuccagauccuggaaauc

SEQ ID NO: 2160787 - RNA, 13 nt, Human
ucagccagcccuc

SEQ ID NO: 2160788 - RNA, 21 nt, Human
aauuuacagagacagaaagca

SEQ ID NO: 2160789 - RNA, 13 nt, Human
caauccaagaacu

SEQ ID NO: 2160790 - RNA, 13 nt, Human
aaguucuagugac

SEQ ID NO: 2160791 - RNA, 20 nt, Human
acggcuccggacgcugcugc

SEQ ID NO: 2160792 - RNA, 21 nt, Human
cuaccaaaaaucucaauauuu

SEQ ID NO: 2160793 - RNA, 19 nt, Human
guuguauuauuuuuuaaaa

SEQ ID NO: 2160794 - RNA, 15 nt, Human
uguauuuuaaaagaa

SEQ ID NO: 2160795 - RNA, 21 nt, Human
gccucagggugcacacaggau

SEQ ID NO: 2160796 - RNA, 21 nt, Human
gaaaaaaagcuuuuuuugaau

SEQ ID NO: 2160797 - RNA, 19 nt, Human
cacaggaaccacaagacug

SEQ ID NO: 2160798 - RNA, 16 nt, Human
cagaagcaacccaaau

SEQ ID NO: 2160799 - RNA, 12 nt, Human
cucuaucauuaa

SEQ ID NO: 2160800 - RNA, 19 nt, Human
cucaccucccccaucucuu

SEQ ID NO: 2160801 - RNA, 16 nt, Human
ugcucgcccacuuccu

SEQ ID NO: 2160802 - RNA, 16 nt, Human
agggagggaaggggga

SEQ ID NO: 2160803 - RNA, 16 nt, Human
aaaugggaaacaaaag

SEQ ID NO: 2160804 - RNA, 19 nt, Human
ucucuaucauuaaaguucu

SEQ ID NO: 2160805 - RNA, 14 nt, Human
auucugccugcccu

SEQ ID NO: 2160806 - RNA, 18 nt, Human
ucuucaacucccugcccc

SEQ ID NO: 2160807 - RNA, 13 nt, Human
ccugccccccagc

SEQ ID NO: 2160808 - RNA, 20 nt, Human
acaagacccaaaaggcagaa

SEQ ID NO: 2160809 - RNA, 13 nt, Human
aucaaugaaugaa

SEQ ID NO: 2160810 - RNA, 20 nt, Human
aagucuuucacauuuaaaua

SEQ ID NO: 2160811 - RNA, 17 nt, Human
ugcagcgaguacuuccc

SEQ ID NO: 2160812 - RNA, 18 nt, Human
agcugcucaauaaaguac

SEQ ID NO: 2160813 - RNA, 22 nt, Human
agaauuuuaugcggcauuuucu

SEQ ID NO: 2160814 - RNA, 14 nt, Human
acacugaagaagca

SEQ ID NO: 2160815 - RNA, 16 nt, Human
uuuuagugaaauauua

SEQ ID NO: 2160816 - RNA, 22 nt, Human
aauuuaaaaaaaaaccugagcc

SEQ ID NO: 2160817 - RNA, 17 nt, Human
cugugcggccuggucua

SEQ ID NO: 2160818 - RNA, 18 nt, Human
gaugcaguucugaagaag

SEQ ID NO: 2160819 - RNA, 14 nt, Human
ggaaacuccacauc

SEQ ID NO: 2160820 - RNA, 13 nt, Human
aucauuaaaguuc

SEQ ID NO: 2160821 - RNA, 22 nt, Human
uggacgagaaaacaauaacgau

SEQ ID NO: 2160822 - RNA, 14 nt, Human
auggaaguaaaugu

SEQ ID NO: 2160823 - RNA, 15 nt, Human
aaaaaagaaacauuu

SEQ ID NO: 2160824 - RNA, 14 nt, Human
ugcuagaacucccu

SEQ ID NO: 2160825 - RNA, 23 nt, Human
cauuuuuuuuuucaauaaaacuu

SEQ ID NO: 2160826 - RNA, 16 nt, Human
cuagaaccaccugccu

SEQ ID NO: 2160827 - RNA, 15 nt, Human
ucauaauaaguugca

SEQ ID NO: 2160828 - RNA, 14 nt, Human
cguguccccuaucc

SEQ ID NO: 2160829 - RNA, 21 nt, Human
aacuuauccuccaugaauauc

SEQ ID NO: 2160830 - RNA, 13 nt, Human
aucaggcuggcca

SEQ ID NO: 2160831 - RNA, 20 nt, Human
aguuguuucuacuacaugga

SEQ ID NO: 2160832 - RNA, 22 nt, Human
uuugaugcuacaggauuugaaa

SEQ ID NO: 2160833 - RNA, 14 nt, Human
ccagcuggccggga

SEQ ID NO: 2160834 - RNA, 19 nt, Human
auucccagccagcacagcc

SEQ ID NO: 2160835 - RNA, 13 nt, Human
ggcuccugagaca

SEQ ID NO: 2160836 - RNA, 22 nt, Human
gucucuacuaaaaauacaaaaa

SEQ ID NO: 2160837 - RNA, 16 nt, Human
guucugcacacagcac

SEQ ID NO: 2160838 - RNA, 21 nt, Human
accaaggagccaaacauccua

SEQ ID NO: 2160839 - RNA, 17 nt, Human
uuaaauggucaauuuug

SEQ ID NO: 2160840 - RNA, 13 nt, Human
uuuuaaaaaagaa

SEQ ID NO: 2160841 - RNA, 15 nt, Human
ccgugggccugagac

SEQ ID NO: 2160842 - RNA, 16 nt, Human
cugcucucaguucacu

SEQ ID NO: 2160843 - RNA, 16 nt, Human
uaaugaauacuuuaua

SEQ ID NO: 2160844 - RNA, 18 nt, Human
agcuagaauucacuccac

SEQ ID NO: 2160845 - RNA, 12 nt, Human
aagaaaauaacg

SEQ ID NO: 2160846 - RNA, 13 nt, Human
cgcccucuggcug

SEQ ID NO: 2160847 - RNA, 16 nt, Human
cagcuuuccucaaaac

SEQ ID NO: 2160848 - RNA, 17 nt, Human
cucguggaacaguuacc

SEQ ID NO: 2160849 - RNA, 15 nt, Human
cagaauucauucacu

SEQ ID NO: 2160850 - RNA, 14 nt, Human
acuuggucugugag

SEQ ID NO: 2160851 - RNA, 12 nt, Human
agaucaagccug

SEQ ID NO: 2160852 - RNA, 16 nt, Human
aauuacauuuguauaa

SEQ ID NO: 2160853 - RNA, 14 nt, Human
uggcuugaguuuaa

SEQ ID NO: 2160854 - RNA, 13 nt, Human
uuuaaaaaagaaa

SEQ ID NO: 2160855 - RNA, 17 nt, Human
agguccacaacacacag

SEQ ID NO: 2160856 - RNA, 22 nt, Human
auauaaauaaaaauaauccuca

SEQ ID NO: 2160857 - RNA, 15 nt, Human
aauauaaauaaaaau

SEQ ID NO: 2160858 - RNA, 15 nt, Human
uauaaauaaaaauaa

SEQ ID NO: 2160859 - RNA, 17 nt, Human
cgcgccuccgcuacuuc

SEQ ID NO: 2160860 - RNA, 16 nt, Human
gccaaggaugccccgu

SEQ ID NO: 2160861 - RNA, 15 nt, Human
agucucuaucauuaa

SEQ ID NO: 2160862 - RNA, 13 nt, Human
acuguaaaauaau

SEQ ID NO: 2160863 - RNA, 23 nt, Human
aaaaacagaccgggguucccgug

SEQ ID NO: 2160864 - RNA, 22 nt, Human
cagcucuaucccaaccucuccc

SEQ ID NO: 2160865 - RNA, 13 nt, Human
uuaaaaaagaaac

SEQ ID NO: 2160866 - RNA, 16 nt, Human
acaugaacuuguaaag

SEQ ID NO: 2160867 - RNA, 13 nt, Human
ugcauuucuaaag

SEQ ID NO: 2160868 - RNA, 15 nt, Human
ccaacuauaaaacua

SEQ ID NO: 2160869 - RNA, 13 nt, Human
cugagagugaaca

SEQ ID NO: 2160870 - RNA, 17 nt, Human
agccuuggauacuccau

SEQ ID NO: 2160871 - RNA, 17 nt, Human
ggccaugggacagggag

SEQ ID NO: 2160872 - RNA, 13 nt, Human
auaacuggaaacu

SEQ ID NO: 2160873 - RNA, 13 nt, Human
guggcgcuggcug

SEQ ID NO: 2160874 - RNA, 18 nt, Human
cacuccagugagacagcu

SEQ ID NO: 2160875 - RNA, 14 nt, Human
ccucggacggcucc

SEQ ID NO: 2160876 - RNA, 15 nt, Human
cacuuccucccggcc

SEQ ID NO: 2160877 - RNA, 22 nt, Human
cauaaauguugacaugggacau

SEQ ID NO: 2160878 - RNA, 15 nt, Human
acaagacccaaaagg

SEQ ID NO: 2160879 - RNA, 21 nt, Human
auuuuccugaaaacccuugcc

SEQ ID NO: 2160880 - RNA, 14 nt, Human
uuaugauuaaguaa

SEQ ID NO: 2160881 - RNA, 16 nt, Human
aauauaaauaaaaaua

SEQ ID NO: 2160882 - RNA, 15 nt, Human
cuagaauucacucca

SEQ ID NO: 2160883 - RNA, 23 nt, Human
agcccuccuuaucaaaggacacc

SEQ ID NO: 2160884 - RNA, 13 nt, Human
accuggccgcagu

SEQ ID NO: 2160885 - RNA, 18 nt, Human
cagaaagcagaacaguga

SEQ ID NO: 2160886 - RNA, 18 nt, Human
uaauuuuaacucuauaau

SEQ ID NO: 2160887 - RNA, 15 nt, Human
uggacucaccucccc

SEQ ID NO: 2160888 - RNA, 17 nt, Human
cugccucagaaaacaag

SEQ ID NO: 2160889 - RNA, 15 nt, Human
ccgugugccugagcg

SEQ ID NO: 2160890 - RNA, 18 nt, Human
cauggaauuggagcucgu

SEQ ID NO: 2160891 - RNA, 15 nt, Human
ccucauguccacugg

SEQ ID NO: 2160892 - RNA, 18 nt, Human
ugaaaaaguucugcagau

SEQ ID NO: 2160893 - RNA, 19 nt, Human
ucccagaucaagccugccu

SEQ ID NO: 2160894 - RNA, 19 nt, Human
augaauuacauuuguauaa

SEQ ID NO: 2160895 - RNA, 18 nt, Human
gccuuggggcugaugcag

SEQ ID NO: 2160896 - RNA, 15 nt, Human
gccuaauuuguuuuc

SEQ ID NO: 2160897 - RNA, 17 nt, Human
agagacagaaagcagaa

SEQ ID NO: 2160898 - RNA, 16 nt, Human
ccacuuccucccggcc

SEQ ID NO: 2160899 - RNA, 13 nt, Human
aacucuauaaugu

SEQ ID NO: 2160900 - RNA, 12 nt, Human
uuuuauauuuga

SEQ ID NO: 2160901 - RNA, 16 nt, Human
accagccuuggauacu

SEQ ID NO: 2160902 - RNA, 23 nt, Human
ucugacacuaaaacaccucagcu

SEQ ID NO: 2160903 - RNA, 23 nt, Human
ccucagcugccuccccagcucua

SEQ ID NO: 2160904 - RNA, 20 nt, Human
caccucagcugccuccccag

SEQ ID NO: 2160905 - RNA, 23 nt, Human
uacaaaugggaaacaaaaggaua

SEQ ID NO: 2160906 - RNA, 15 nt, Human
cuggacucaccuccc

SEQ ID NO: 2160907 - RNA, 19 nt, Human
auccugugggaccugggcc

SEQ ID NO: 2160908 - RNA, 11 nt, Human
ggguugggggg

SEQ ID NO: 2160909 - RNA, 18 nt, Human
aacaaugcuguauuuuaa

SEQ ID NO: 2160910 - RNA, 19 nt, Human
gcuguuccucgccacgcuc

SEQ ID NO: 2160911 - RNA, 21 nt, Human
cagcucuaucccaaccucucc

SEQ ID NO: 2160912 - RNA, 14 nt, Human
uucccgcuguuccu

SEQ ID NO: 2160913 - RNA, 14 nt, Human
aaaauacaaaaaaa

SEQ ID NO: 2160914 - RNA, 18 nt, Human
cuucacuguaaaauaaua

SEQ ID NO: 2160915 - RNA, 15 nt, Human
uaucaguccaaaggg

SEQ ID NO: 2160916 - RNA, 15 nt, Human
ugcuguauuuuaaaa

SEQ ID NO: 2160917 - RNA, 17 nt, Human
cccccugcaaagcccag

SEQ ID NO: 2160918 - RNA, 16 nt, Human
aaagacaaggaaaaaa

SEQ ID NO: 2160919 - RNA, 16 nt, Human
ugcuguauuuuaaaag

SEQ ID NO: 2160920 - RNA, 20 nt, Human
agaugcaguucugaagaaga

SEQ ID NO: 2160921 - RNA, 13 nt, Human
aguuaccucugcc

SEQ ID NO: 2160922 - RNA, 17 nt, Human
cgcgcugcgcgccgcgc

SEQ ID NO: 2160923 - RNA, 15 nt, Human
gcaacccaaauguuc

SEQ ID NO: 2160924 - RNA, 16 nt, Human
cccacuggacucaccu

SEQ ID NO: 2160925 - RNA, 21 nt, Human
ccugaucaccugcccugcuga

SEQ ID NO: 2160926 - RNA, 20 nt, Human
uccaagccucauguccacug

SEQ ID NO: 2160927 - RNA, 18 nt, Human
uagugaaauauuauuuua

SEQ ID NO: 2160928 - RNA, 19 nt, Human
gcuccgcgcagcucaggcu

SEQ ID NO: 2160929 - RNA, 14 nt, Human
cgcgcugcgcgccg

SEQ ID NO: 2160930 - RNA, 19 nt, Human
ccccucuggcuccagcugg

SEQ ID NO: 2160931 - RNA, 22 nt, Human
ccacuuggacaugggccccaga

SEQ ID NO: 2160932 - RNA, 17 nt, Human
cuacacuccagugagac

SEQ ID NO: 2160933 - RNA, 12 nt, Human
cauagaaguaaa

SEQ ID NO: 2160934 - RNA, 16 nt, Human
cagcucuaucccaacc

SEQ ID NO: 2160935 - RNA, 17 nt, Human
cgauaaaagacagugaa

SEQ ID NO: 2160936 - RNA, 14 nt, Human
cugggucgccggca

SEQ ID NO: 2160937 - RNA, 20 nt, Human
aaaacuuauccuccaugaau

SEQ ID NO: 2160938 - RNA, 16 nt, Human
accucugccucagaaa

SEQ ID NO: 2160939 - RNA, 23 nt, Human
auaauguguucauucuggaauaa

SEQ ID NO: 2160940 - RNA, 21 nt, Human
cugggaccaggcacccccaga

SEQ ID NO: 2160941 - RNA, 22 nt, Human
cuuccuaauuccacagcugcuc

SEQ ID NO: 2160942 - RNA, 16 nt, Human
uaacaauaaaagacaa

SEQ ID NO: 2160943 - RNA, 20 nt, Human
uguaauaggcguaacuaauu

SEQ ID NO: 2160944 - RNA, 16 nt, Human
ugagcucagcccuggu

SEQ ID NO: 2160945 - RNA, 23 nt, Human
uuguaacaagccuccuuuuaaag

SEQ ID NO: 2160946 - RNA, 18 nt, Human
uaauaauguuucaaacau

SEQ ID NO: 2160947 - RNA, 23 nt, Human
cgcaggaccaucccggccggcgc

SEQ ID NO: 2160948 - RNA, 15 nt, Human
ccugaaagucccaga

SEQ ID NO: 2160949 - RNA, 20 nt, Human
aauaagccagacaucaacag

SEQ ID NO: 2160950 - RNA, 13 nt, Human
ugagcggaccuuc

SEQ ID NO: 2160951 - RNA, 21 nt, Human
auaauuuuuauauuugaaaua

SEQ ID NO: 2160952 - RNA, 14 nt, Human
gucccaggcugagc

SEQ ID NO: 2160953 - RNA, 18 nt, Human
uguaaaggaauuuaaaaa

SEQ ID NO: 2160954 - RNA, 13 nt, Human
ugccuaauuuguu

SEQ ID NO: 2160955 - RNA, 19 nt, Human
auuauuuuuuaaaaaaauu

SEQ ID NO: 2160956 - RNA, 12 nt, Human
cuacaagacaca

SEQ ID NO: 2160957 - RNA, 16 nt, Human
aaauaacaaugaaagu

SEQ ID NO: 2160958 - RNA, 18 nt, Human
acagagacagaaagcaga

SEQ ID NO: 2160959 - RNA, 15 nt, Human
cuuuucccaacucca

SEQ ID NO: 2160960 - RNA, 22 nt, Human
aaagggcauggguuuuauuaua

SEQ ID NO: 2160961 - RNA, 15 nt, Human
gcugguggcgcuggc

SEQ ID NO: 2160962 - RNA, 18 nt, Human
aaaaucuuauaauuuaaa

SEQ ID NO: 2160963 - RNA, 20 nt, Human
uuuccaaugacauuuuguug

SEQ ID NO: 2160964 - RNA, 15 nt, Human
gagcgcgcgcgcccu

SEQ ID NO: 2160965 - RNA, 12 nt, Human
auauaaauaaaa

SEQ ID NO: 2160966 - RNA, 24 nt, Human
gcuucugggcagacucuggucaag

SEQ ID NO: 2160967 - RNA, 16 nt, Human
auaucaauuuaaaaaa

SEQ ID NO: 2160968 - RNA, 23 nt, Human
aaguauccuucagccugaaagag

SEQ ID NO: 2160969 - RNA, 15 nt, Human
auaaaguguuugaaa

SEQ ID NO: 2160970 - RNA, 20 nt, Human
acuccacuuggacaugggcc

SEQ ID NO: 2160971 - RNA, 17 nt, Human
gccugagcgacagugag

SEQ ID NO: 2160972 - RNA, 20 nt, Human
accucauggaauuggagcuc

SEQ ID NO: 2160973 - RNA, 13 nt, Human
cucgccacgcucu

SEQ ID NO: 2160974 - RNA, 14 nt, Human
caacuauaaaacua

SEQ ID NO: 2160975 - RNA, 22 nt, Human
agaaagugacaagcucacagac

SEQ ID NO: 2160976 - RNA, 15 nt, Human
ugaaacccugucucu

SEQ ID NO: 2160977 - RNA, 15 nt, Human
uugccuaauuuguuu

SEQ ID NO: 2160978 - RNA, 22 nt, Human
caccucccccaucucuucuggg

SEQ ID NO: 2160979 - RNA, 22 nt, Human
auaaaguaugugcauauuuuau

SEQ ID NO: 2160980 - RNA, 11 nt, Human
auuuaaaaauc

SEQ ID NO: 2160981 - RNA, 15 nt, Human
aaauaauuuuuauau

SEQ ID NO: 2160982 - RNA, 21 nt, Human
ccaggaggggcuucugggcag

SEQ ID NO: 2160983 - RNA, 18 nt, Human
acauuuauauuuuuguga

SEQ ID NO: 2160984 - RNA, 20 nt, Human
agcuacuaauuuuaaaaugu

SEQ ID NO: 2160985 - RNA, 13 nt, Human
ccaccugccuaua

SEQ ID NO: 2160986 - RNA, 16 nt, Human
acuaguuucccuugca

SEQ ID NO: 2160987 - RNA, 22 nt, Human
cggagccgggaaagaagagccg

SEQ ID NO: 2160988 - RNA, 11 nt, Human
ccugagcccca

SEQ ID NO: 2160989 - RNA, 20 nt, Human
ucaauaaaauccauacauuu

SEQ ID NO: 2160990 - RNA, 23 nt, Human
gccggcgcgcucaucccacccgc

SEQ ID NO: 2160991 - RNA, 23 nt, Human
caauccaagaacuuauuuguaca

SEQ ID NO: 2160992 - RNA, 11 nt, Human
ucaccugcccu

SEQ ID NO: 2160993 - RNA, 22 nt, Human
cuuuccacagaagcuccaggua

SEQ ID NO: 2160994 - RNA, 14 nt, Human
cacaagaaaugaaa

SEQ ID NO: 2160995 - RNA, 12 nt, Human
cagaacagugau

SEQ ID NO: 2160996 - RNA, 21 nt, Human
agucacuaguuguaauuuuuu

SEQ ID NO: 2160997 - RNA, 16 nt, Human
auuuuaauaauguuuc

SEQ ID NO: 2160998 - RNA, 19 nt, Human
ugaaaccaaaccagagccu

SEQ ID NO: 2160999 - RNA, 17 nt, Human
aaucuuucacaggggac

SEQ ID NO: 2161000 - RNA, 18 nt, Human
ggcgcuggcugcgcucgg

SEQ ID NO: 2161001 - RNA, 13 nt, Human
guaacuaauuuua

SEQ ID NO: 2161002 - RNA, 20 nt, Human
aaaaucuuauaauuuaaaau

SEQ ID NO: 2161003 - RNA, 11 nt, Human
augggacaggg

SEQ ID NO: 2161004 - RNA, 22 nt, Human
gcuugcagagaugaggccgcca

SEQ ID NO: 2161005 - RNA, 14 nt, Human
auggcaggaggcau

SEQ ID NO: 2161006 - RNA, 23 nt, Human
caucaacagauaaauaguuuaug

SEQ ID NO: 2161007 - RNA, 20 nt, Human
auuuauugaggcuuuaaaac

SEQ ID NO: 2161008 - RNA, 19 nt, Human
uuaaauggaaguaaauguu

SEQ ID NO: 2161009 - RNA, 19 nt, Human
gagguacugagagugaaca

SEQ ID NO: 2161010 - RNA, 17 nt, Human
cuaucucauuuccaagc

SEQ ID NO: 2161011 - RNA, 17 nt, Human
ugaucaccugcccugcu

SEQ ID NO: 2161012 - RNA, 13 nt, Human
gccuccccagcuc

SEQ ID NO: 2161013 - RNA, 18 nt, Human
gccggagccuccagcugc

SEQ ID NO: 2161014 - RNA, 15 nt, Human
augauaacuggaaac

SEQ ID NO: 2161015 - RNA, 15 nt, Human
ggccuucggccucca

SEQ ID NO: 2161016 - RNA, 21 nt, Human
gcaggaccaucccggccggcg

SEQ ID NO: 2161017 - RNA, 15 nt, Human
gcucgcuuccgcauc

SEQ ID NO: 2161018 - RNA, 18 nt, Human
aaggagcucccaggaggg

SEQ ID NO: 2161019 - RNA, 15 nt, Human
uuuuuaguucuucaa

SEQ ID NO: 2161020 - RNA, 18 nt, Human
acuggacucaccuccccc

SEQ ID NO: 2161021 - RNA, 16 nt, Human
ggagccuccagcugcc

SEQ ID NO: 2161022 - RNA, 21 nt, Human
uucccgcuguuccucgccacg

SEQ ID NO: 2161023 - RNA, 19 nt, Human
gaaggagcucccaggaggg

SEQ ID NO: 2161024 - RNA, 16 nt, Human
caaaaggauaaugaau

SEQ ID NO: 2161025 - RNA, 17 nt, Human
gccuaagugcagccccg

SEQ ID NO: 2161026 - RNA, 14 nt, Human
auuauuuuuuaaaa

SEQ ID NO: 2161027 - RNA, 14 nt, Human
uauaauuuaaaaua

SEQ ID NO: 2161028 - RNA, 23 nt, Human
auuucugagcauuuaauauggau

SEQ ID NO: 2161029 - RNA, 17 nt, Human
ucauauuuauagccagg

SEQ ID NO: 2161030 - RNA, 23 nt, Human
uggaaauguuuacagauccccaa

SEQ ID NO: 2161031 - RNA, 12 nt, Human
ucaagaagcauc

SEQ ID NO: 2161032 - RNA, 14 nt, Human
uugacccacaagaa

SEQ ID NO: 2161033 - RNA, 19 nt, Human
gcacacagcacgggggcca

SEQ ID NO: 2161034 - RNA, 24 nt, Human
ccagguaccuucucaccugugaga

SEQ ID NO: 2161035 - RNA, 18 nt, Human
acaaauccaaugaaauga

SEQ ID NO: 2161036 - RNA, 12 nt, Human
accccugagcuu

SEQ ID NO: 2161037 - RNA, 17 nt, Human
ucccagaucaagccugc

SEQ ID NO: 2161038 - RNA, 13 nt, Human
auauauauuuuuu

SEQ ID NO: 2161039 - RNA, 14 nt, Human
caugggccccagau

SEQ ID NO: 2161040 - RNA, 22 nt, Human
uggaaaguuuaugguuguauua

SEQ ID NO: 2161041 - RNA, 13 nt, Human
gagccuccagcug

SEQ ID NO: 2161042 - RNA, 15 nt, Human
cuucucuucacaguc

SEQ ID NO: 2161043 - RNA, 16 nt, Human
ccugcaaagcccagcu

SEQ ID NO: 2161044 - RNA, 14 nt, Human
agagacagaaagca

SEQ ID NO: 2161045 - RNA, 22 nt, Human
ccucccuuggggccuaugcaga

SEQ ID NO: 2161046 - RNA, 22 nt, Human
cucagcccuggugggcagagag

SEQ ID NO: 2161047 - RNA, 11 nt, Human
ucaccuccccc

SEQ ID NO: 2161048 - RNA, 19 nt, Human
guaguccuguaauggaagc

SEQ ID NO: 2161049 - RNA, 14 nt, Human
uaaaggaauuuaaa

SEQ ID NO: 2161050 - RNA, 23 nt, Human
ccagguaccuucucaccugugag

SEQ ID NO: 2161051 - RNA, 15 nt, Human
gccagcccucuucug

SEQ ID NO: 2161052 - RNA, 17 nt, Human
aaagcuccauuuuuagu

SEQ ID NO: 2161053 - RNA, 21 nt, Human
gugccugagcggaccuuccca

SEQ ID NO: 2161054 - RNA, 16 nt, Human
ccugaucaccugcccu

SEQ ID NO: 2161055 - RNA, 11 nt, Human
aauuuaaauau

SEQ ID NO: 2161056 - RNA, 13 nt, Human
aaaugaaagcagg

SEQ ID NO: 2161057 - RNA, 13 nt, Human
gggaggggcgcuc

SEQ ID NO: 2161058 - RNA, 24 nt, Human
aacuauaaaacuaggugcugcagc

SEQ ID NO: 2161059 - RNA, 12 nt, Human
aauacuuuauaa

SEQ ID NO: 2161060 - RNA, 13 nt, Human
ccagcacagccuc

SEQ ID NO: 2161061 - RNA, 17 nt, Human
ugugcauauuuuauuau

SEQ ID NO: 2161062 - RNA, 14 nt, Human
cauuaaaguucuag

SEQ ID NO: 2161063 - RNA, 20 nt, Human
cugagccucagucucccucc

SEQ ID NO: 2161064 - RNA, 16 nt, Human
agugaaauauuauuuu

SEQ ID NO: 2161065 - RNA, 17 nt, Human
ucgggauuaguacacac

SEQ ID NO: 2161066 - RNA, 15 nt, Human
uaaaagacaaggaaa

SEQ ID NO: 2161067 - RNA, 22 nt, Human
guggcgcuggcugcgcucggcc

SEQ ID NO: 2161068 - RNA, 13 nt, Human
auuuuuuaaaaaa

SEQ ID NO: 2161069 - RNA, 17 nt, Human
agcugccccggggaggg

SEQ ID NO: 2161070 - RNA, 14 nt, Human
cggggaggggcgcu

SEQ ID NO: 2161071 - RNA, 21 nt, Human
ccugagcggaccuucccagcu

SEQ ID NO: 2161072 - RNA, 11 nt, Human
ccggccgcgcu

SEQ ID NO: 2161073 - RNA, 11 nt, Human
ggucacaggaa

SEQ ID NO: 2161074 - RNA, 19 nt, Human
uauuuuaauaauguuucaa

SEQ ID NO: 2161075 - RNA, 16 nt, Human
caugguuuagaaagcu

SEQ ID NO: 2161076 - RNA, 20 nt, Human
uaaaacaagcacuaaacaaa

SEQ ID NO: 2161077 - RNA, 13 nt, Human
uuuagugaaauau

SEQ ID NO: 2161078 - RNA, 19 nt, Human
aauauuauguuaaaacugg

SEQ ID NO: 2161079 - RNA, 16 nt, Human
ucuugagguaaaagca

SEQ ID NO: 2161080 - RNA, 14 nt, Human
auccuugaagauuu

SEQ ID NO: 2161081 - RNA, 12 nt, Human
uucagccugaaa

SEQ ID NO: 2161082 - RNA, 16 nt, Human
ugcaaauugucacagg

SEQ ID NO: 2161083 - RNA, 21 nt, Human
gaccaggcacccccagaauga

SEQ ID NO: 2161084 - RNA, 15 nt, Human
ugagcucagcccugg

SEQ ID NO: 2161085 - RNA, 14 nt, Human
uaaaauccauacau

SEQ ID NO: 2161086 - RNA, 12 nt, Human
agaaaacaauaa

SEQ ID NO: 2161087 - RNA, 14 nt, Human
cucccggccgcgcu

SEQ ID NO: 2161088 - RNA, 23 nt, Human
aucaccaaggcugauuaaaccaa

SEQ ID NO: 2161089 - RNA, 11 nt, Human
caucuagugag

SEQ ID NO: 2161090 - RNA, 14 nt, Human
ccugccccugagcc

SEQ ID NO: 2161091 - RNA, 13 nt, Human
cccugcacuccag

SEQ ID NO: 2161092 - RNA, 12 nt, Human
uaauuccacagc

SEQ ID NO: 2161093 - RNA, 16 nt, Human
uguaguccuguaaugg

SEQ ID NO: 2161094 - RNA, 16 nt, Human
agguugcagugagccg

SEQ ID NO: 2161095 - RNA, 17 nt, Human
ccucagucucccucccu

SEQ ID NO: 2161096 - RNA, 20 nt, Human
gaaacgaggauugggaaaaa

SEQ ID NO: 2161097 - RNA, 22 nt, Human
agcuuguauuccuuuuucucuc

SEQ ID NO: 2161098 - RNA, 21 nt, Human
ccaaggaugccccgucccccu

SEQ ID NO: 2161099 - RNA, 13 nt, Human
ggcacccccagaa

SEQ ID NO: 2161100 - RNA, 17 nt, Human
augccccgucccccucu

SEQ ID NO: 2161101 - RNA, 13 nt, Human
augauuccaccua

SEQ ID NO: 2161102 - RNA, 20 nt, Human
aaacuuuaugcuaagugaaa

SEQ ID NO: 2161103 - RNA, 15 nt, Human
cgcgccgcgcuccuc

SEQ ID NO: 2161104 - RNA, 23 nt, Human
gaaaaaguucugcagauaaacag

SEQ ID NO: 2161105 - RNA, 20 nt, Human
cacuagacccacuggacuca

SEQ ID NO: 2161106 - RNA, 21 nt, Human
ggcaccgcuguacgcgagcgc

SEQ ID NO: 2161107 - RNA, 20 nt, Human
aaugaauacuuuauaaagga

SEQ ID NO: 2161108 - RNA, 21 nt, Human
ucuucaacucccugcccccca

SEQ ID NO: 2161109 - RNA, 11 nt, Human
auaauuuaaau

SEQ ID NO: 2161110 - RNA, 23 nt, Human
uguagguagaucuggucuuuaga

SEQ ID NO: 2161111 - RNA, 17 nt, Human
aaaaauccuacuuucau

SEQ ID NO: 2161112 - RNA, 20 nt, Human
cgcauccuagucucuaucau

SEQ ID NO: 2161113 - RNA, 16 nt, Human
cagccagcccucuucu

SEQ ID NO: 2161114 - RNA, 13 nt, Human
aauuuuuauauuu

SEQ ID NO: 2161115 - RNA, 19 nt, Human
aaacaaaaggauaaugaau

SEQ ID NO: 2161116 - RNA, 19 nt, Human
ggagggcgcggggcgggga

SEQ ID NO: 2161117 - RNA, 19 nt, Human
ggacucaccucccccaucu

SEQ ID NO: 2161118 - RNA, 15 nt, Human
ccuggugggcagaga

SEQ ID NO: 2161119 - RNA, 16 nt, Human
auaacuggaaacuuca

SEQ ID NO: 2161120 - RNA, 22 nt, Human
cucuggucaagaagcaucgugu

SEQ ID NO: 2161121 - RNA, 19 nt, Human
ucaccaaggcugauuaaac

SEQ ID NO: 2161122 - RNA, 21 nt, Human
acaguuaccucugccucagaa

SEQ ID NO: 2161123 - RNA, 15 nt, Human
auauuuuuuguuaaa

SEQ ID NO: 2161124 - RNA, 21 nt, Human
ggcgcuggcugcgcucggccu

SEQ ID NO: 2161125 - RNA, 15 nt, Human
ccagaaugaccuggc

SEQ ID NO: 2161126 - RNA, 17 nt, Human
cuucacuguaaaauaau

SEQ ID NO: 2161127 - RNA, 16 nt, Human
cauggguuuuauuaua

SEQ ID NO: 2161128 - RNA, 22 nt, Human
aguauguuagugcaaauuguca

SEQ ID NO: 2161129 - RNA, 18 nt, Human
ccucuggcuccagcuggc

SEQ ID NO: 2161130 - RNA, 17 nt, Human
augaucaguaugaaaau

SEQ ID NO: 2161131 - RNA, 18 nt, Human
gccuccagcugccccggg

SEQ ID NO: 2161132 - RNA, 18 nt, Human
ugcucgcccacuuccucc

SEQ ID NO: 2161133 - RNA, 14 nt, Human
uuuuuguuuuguuu

SEQ ID NO: 2161134 - RNA, 18 nt, Human
cagugaaagaaaauaaca

SEQ ID NO: 2161135 - RNA, 19 nt, Human
uguauacugugugcuaaaa

SEQ ID NO: 2161136 - RNA, 16 nt, Human
gaccaaggcccccggg

SEQ ID NO: 2161137 - RNA, 19 nt, Human
ccucucuuccucccuggaa

SEQ ID NO: 2161138 - RNA, 21 nt, Human
uauaaaauaauuuuuauauuu

SEQ ID NO: 2161139 - RNA, 16 nt, Human
aucaauuuaaaaaaaa

SEQ ID NO: 2161140 - RNA, 13 nt, Human
aguuguaauuuuu

SEQ ID NO: 2161141 - RNA, 16 nt, Human
acaaauccaaugaaau

SEQ ID NO: 2161142 - RNA, 16 nt, Human
ugacuuaaugccacua

SEQ ID NO: 2161143 - RNA, 18 nt, Human
uuuguuaaaugauuucau

SEQ ID NO: 2161144 - RNA, 22 nt, Human
cuccugccuaagugcagccccg

SEQ ID NO: 2161145 - RNA, 19 nt, Human
ccuucccagcuagaauuca

SEQ ID NO: 2161146 - RNA, 18 nt, Human
uaaauguuguuuuaggaa

SEQ ID NO: 2161147 - RNA, 13 nt, Human
ccaaaagguauuu

SEQ ID NO: 2161148 - RNA, 16 nt, Human
gcagcucaggcuggca

SEQ ID NO: 2161149 - RNA, 19 nt, Human
accccugagcuugcagaga

SEQ ID NO: 2161150 - RNA, 18 nt, Human
agguccacaacacacaga

SEQ ID NO: 2161151 - RNA, 18 nt, Human
cugagucccaggcugagc

SEQ ID NO: 2161152 - RNA, 14 nt, Human
agguugcagugagc

SEQ ID NO: 2161153 - RNA, 14 nt, Human
uugugauugauuau

SEQ ID NO: 2161154 - RNA, 14 nt, Human
ugcagccccuggga

SEQ ID NO: 2161155 - RNA, 21 nt, Human
ccuuuuuuugaaaaaaagcuu

SEQ ID NO: 2161156 - RNA, 22 nt, Human
ugccugagcggaccuucccagc

SEQ ID NO: 2161157 - RNA, 21 nt, Human
cacaugaacuuguaaaggaau

SEQ ID NO: 2161158 - RNA, 16 nt, Human
gccgcgcugcgcgccg

SEQ ID NO: 2161159 - RNA, 17 nt, Human
ccugagcggaccuuccc

SEQ ID NO: 2161160 - RNA, 23 nt, Human
cagagguugcagugagccgagau

SEQ ID NO: 2161161 - RNA, 22 nt, Human
accucagcugccuccccagcuc

SEQ ID NO: 2161162 - RNA, 18 nt, Human
aaagaaaaucaggcuggc

SEQ ID NO: 2161163 - RNA, 17 nt, Human
ugagcggaccuucccag

SEQ ID NO: 2161164 - RNA, 14 nt, Human
aauauuuauuuuaa

SEQ ID NO: 2161165 - RNA, 22 nt, Human
uauagccagguaccuucucacc

SEQ ID NO: 2161166 - RNA, 17 nt, Human
cucuggucaagaagcau

SEQ ID NO: 2161167 - RNA, 23 nt, Human
aucucuucuggguuccuuccucu

SEQ ID NO: 2161168 - RNA, 19 nt, Human
uuauggcacuaguauuucu

SEQ ID NO: 2161169 - RNA, 18 nt, Human
ccauccugccccugagcc

SEQ ID NO: 2161170 - RNA, 16 nt, Human
ccacuuauaggaauug

SEQ ID NO: 2161171 - RNA, 14 nt, Human
auuugaaauuguau

SEQ ID NO: 2161172 - RNA, 22 nt, Human
ccgggagccugaucaccugccc

SEQ ID NO: 2161173 - RNA, 20 nt, Human
ugccccccagcccuccuuau

SEQ ID NO: 2161174 - RNA, 13 nt, Human
cgcgcugcgcgcc

SEQ ID NO: 2161175 - RNA, 21 nt, Human
caaggaaaaaauaacaaugaa

SEQ ID NO: 2161176 - RNA, 17 nt, Human
auccugugggaccuggg

SEQ ID NO: 2161177 - RNA, 23 nt, Human
gaacaugagccuuuguugcuauc

SEQ ID NO: 2161178 - RNA, 15 nt, Human
acauccuacaagaca

SEQ ID NO: 2161179 - RNA, 19 nt, Human
acuucagcgguuuauauaa

SEQ ID NO: 2161180 - RNA, 22 nt, Human
cuuuuccaaugacauuuuguug

SEQ ID NO: 2161181 - RNA, 14 nt, Human
agcggaccuuccca

SEQ ID NO: 2161182 - RNA, 12 nt, Human
gggaaagaagag

SEQ ID NO: 2161183 - RNA, 18 nt, Human
agcaaaauuuuuucucua

SEQ ID NO: 2161184 - RNA, 15 nt, Human
gccuaagugcagccc

SEQ ID NO: 2161185 - RNA, 22 nt, Human
ccgggaggcagagguugcagug

SEQ ID NO: 2161186 - RNA, 22 nt, Human
cgcgcuccgcgcagcucaggcu

SEQ ID NO: 2161187 - RNA, 16 nt, Human
uccugcaauuccacuu

SEQ ID NO: 2161188 - RNA, 23 nt, Human
ugaaaugaguuuuucuuuucauu

SEQ ID NO: 2161189 - RNA, 20 nt, Human
caagagccuuuuuuugaaaa

SEQ ID NO: 2161190 - RNA, 17 nt, Human
aaagacaaggaaaaaau

SEQ ID NO: 2161191 - RNA, 18 nt, Human
aaagagugaaggauuuau

SEQ ID NO: 2161192 - RNA, 16 nt, Human
gcugcgcgccgcgcuc

SEQ ID NO: 2161193 - RNA, 16 nt, Human
auaaugaauacuuuau

SEQ ID NO: 2161194 - RNA, 15 nt, Human
aucuuauaauuuaaa

SEQ ID NO: 2161195 - RNA, 22 nt, Human
gagccucagucucccucccuug

SEQ ID NO: 2161196 - RNA, 19 nt, Human
gacagucaccucauggaau

SEQ ID NO: 2161197 - RNA, 16 nt, Human
uuacccccugggagcc

SEQ ID NO: 2161198 - RNA, 14 nt, Human
ucccuugaugaaga

SEQ ID NO: 2161199 - RNA, 23 nt, Human
aaagaugaucaguaugaaaaugu

SEQ ID NO: 2161200 - RNA, 20 nt, Human
aauucuugccaaauauaaau

SEQ ID NO: 2161201 - RNA, 16 nt, Human
uggggaugaacuuuuu

SEQ ID NO: 2161202 - RNA, 16 nt, Human
cuucuggguuccuucc

SEQ ID NO: 2161203 - RNA, 23 nt, Human
gggagccugaucaccugcccugc

SEQ ID NO: 2161204 - RNA, 23 nt, Human
cugaaaucauacuucuuaggguu

SEQ ID NO: 2161205 - RNA, 14 nt, Human
cuccugagacacau

SEQ ID NO: 2161206 - RNA, 13 nt, Human
cccuccuuaucaa

SEQ ID NO: 2161207 - RNA, 19 nt, Human
ggcugcugguggcgcuggc

SEQ ID NO: 2161208 - RNA, 17 nt, Human
uuacagagacagaaagc

SEQ ID NO: 2161209 - RNA, 22 nt, Human
uuaccucugccucagaaaacaa

SEQ ID NO: 2161210 - RNA, 14 nt, Human
ccggggaggggcgc

SEQ ID NO: 2161211 - RNA, 20 nt, Human
acggagccgggaaagaagag

SEQ ID NO: 2161212 - RNA, 18 nt, Human
auaauccuaaacauauga

SEQ ID NO: 2161213 - RNA, 13 nt, Human
gagccggagccuc

SEQ ID NO: 2161214 - RNA, 18 nt, Human
uaaaauccauacauuugu

SEQ ID NO: 2161215 - RNA, 14 nt, Human
aaaagaaacauuug

SEQ ID NO: 2161216 - RNA, 17 nt, Human
uugggguugggggggag

SEQ ID NO: 2161217 - RNA, 13 nt, Human
ccuucucaccugu

SEQ ID NO: 2161218 - RNA, 12 nt, Human
gaaagucccaga

SEQ ID NO: 2161219 - RNA, 21 nt, Human
cuggccuucggccuccauccu

SEQ ID NO: 2161220 - RNA, 18 nt, Human
gaagcaaaauuuuuucuc

SEQ ID NO: 2161221 - RNA, 13 nt, Human
gaagaacugaaau

SEQ ID NO: 2161222 - RNA, 19 nt, Human
auacuaauuauacccccug

SEQ ID NO: 2161223 - RNA, 22 nt, Human
cugggacaggggagaaccuagg

SEQ ID NO: 2161224 - RNA, 16 nt, Human
uugucaauaaaaucca

SEQ ID NO: 2161225 - RNA, 17 nt, Human
guuuaauaauuuuuaau

SEQ ID NO: 2161226 - RNA, 19 nt, Human
uccacauccugugggaccu

SEQ ID NO: 2161227 - RNA, 23 nt, Human
acugucuuguuggacgagaaaac

SEQ ID NO: 2161228 - RNA, 22 nt, Human
agaaaacaauaacgauaaaaga

SEQ ID NO: 2161229 - RNA, 20 nt, Human
accugauuucugagcauuua

SEQ ID NO: 2161230 - RNA, 15 nt, Human
auaaauaaaaauaau

SEQ ID NO: 2161231 - RNA, 15 nt, Human
uucugcacacagcac

SEQ ID NO: 2161232 - RNA, 14 nt, Human
cauagaaguaaaaa

SEQ ID NO: 2161233 - RNA, 12 nt, Human
acaagaaaugaa

SEQ ID NO: 2161234 - RNA, 22 nt, Human
cauuuaaauaaaguguuugaaa

SEQ ID NO: 2161235 - RNA, 19 nt, Human
cugcaaagcccagcuugaa

SEQ ID NO: 2161236 - RNA, 14 nt, Human
ccacccgcccaccg

SEQ ID NO: 2161237 - RNA, 13 nt, Human
agguaccagccuu

SEQ ID NO: 2161238 - RNA, 16 nt, Human
aacaauaaaagacaag

SEQ ID NO: 2161239 - RNA, 23 nt, Human
cuaguaauuggaaaggcagcucu

SEQ ID NO: 2161240 - RNA, 15 nt, Human
aucaauuuaaaaaaa

SEQ ID NO: 2161241 - RNA, 19 nt, Human
ugaaauggacuuuuguaca

SEQ ID NO: 2161242 - RNA, 11 nt, Human
uuauuuuuaaa

SEQ ID NO: 2161243 - RNA, 17 nt, Human
aucaaggguacacugcc

SEQ ID NO: 2161244 - RNA, 18 nt, Human
cgcgagcgcgcgcgcccu

SEQ ID NO: 2161245 - RNA, 13 nt, Human
uuggacgagaaaa

SEQ ID NO: 2161246 - RNA, 23 nt, Human
uuuguauaaaauaauuuuuauau

SEQ ID NO: 2161247 - RNA, 22 nt, Human
aaagagugaaggauuuauguuu

SEQ ID NO: 2161248 - RNA, 18 nt, Human
gcgcgcccucuggcugcu

SEQ ID NO: 2161249 - RNA, 18 nt, Human
ccugaaagaggaaugaag

SEQ ID NO: 2161250 - RNA, 19 nt, Human
ccugccuaagugcagcccc

SEQ ID NO: 2161251 - RNA, 14 nt, Human
cagaccgggguucc

SEQ ID NO: 2161252 - RNA, 18 nt, Human
acagaaagcagaacagug

SEQ ID NO: 2161253 - RNA, 17 nt, Human
uuauauuugaaauauug

SEQ ID NO: 2161254 - RNA, 16 nt, Human
agugaaagaaaauaac

SEQ ID NO: 2161255 - RNA, 19 nt, Human
augaguaacugauuuguaa

SEQ ID NO: 2161256 - RNA, 22 nt, Human
aggaugccccgucccccucugg

SEQ ID NO: 2161257 - RNA, 13 nt, Human
cggccgcgcugcg

SEQ ID NO: 2161258 - RNA, 16 nt, Human
cuuccucccuggaauc

SEQ ID NO: 2161259 - RNA, 21 nt, Human
agggugauauuaaccaggggc

SEQ ID NO: 2161260 - RNA, 17 nt, Human
gccccagauaccaugau

SEQ ID NO: 2161261 - RNA, 22 nt, Human
ugugccugagcggaccuuccca

SEQ ID NO: 2161262 - RNA, 18 nt, Human
caaggcugauuaaaccaa

SEQ ID NO: 2161263 - RNA, 12 nt, Human
auucugaaagca

SEQ ID NO: 2161264 - RNA, 23 nt, Human
augaauaucaguuauuuuuaaac

SEQ ID NO: 2161265 - RNA, 12 nt, Human
ucugcacacagc

SEQ ID NO: 2161266 - RNA, 13 nt, Human
auugauuauaugu

SEQ ID NO: 2161267 - RNA, 21 nt, Human
cucagugucaaugcagccccc

SEQ ID NO: 2161268 - RNA, 15 nt, Human
auuauagucacuagu

SEQ ID NO: 2161269 - RNA, 21 nt, Human
gcaucgugucuggcguugugg

SEQ ID NO: 2161270 - RNA, 16 nt, Human
ccagggcuacgcgcgc

SEQ ID NO: 2161271 - RNA, 21 nt, Human
gaaaaguauguuagugcaaau

SEQ ID NO: 2161272 - RNA, 21 nt, Human
gcgcucaucccacccgcccac

SEQ ID NO: 2161273 - RNA, 18 nt, Human
cuccgcgcagcucaggcu

SEQ ID NO: 2161274 - RNA, 18 nt, Human
agaagcaacccaaauguu

SEQ ID NO: 2161275 - RNA, 15 nt, Human
cuggguuccuuccuc

SEQ ID NO: 2161276 - RNA, 16 nt, Human
uuucuauaauuuaaau

SEQ ID NO: 2161277 - RNA, 21 nt, Human
gcaaaauuuuuucucuaggaa

SEQ ID NO: 2161278 - RNA, 18 nt, Human
ucuaugaaauauuauguu

SEQ ID NO: 2161279 - RNA, 18 nt, Human
ccuuccuaauuccacagc

SEQ ID NO: 2161280 - RNA, 18 nt, Human
aaaguaacccuacaaaac

SEQ ID NO: 2161281 - RNA, 14 nt, Human
agaaaauaacaaua

SEQ ID NO: 2161282 - RNA, 17 nt, Human
agacacacugaagaagc

SEQ ID NO: 2161283 - RNA, 17 nt, Human
caggaggggcuucuggg

SEQ ID NO: 2161284 - RNA, 16 nt, Human
cucaauaaaguacaag

SEQ ID NO: 2161285 - RNA, 14 nt, Human
uacuaauuuuaaaa

SEQ ID NO: 2161286 - RNA, 23 nt, Human
uaaguuuuuuuuuaaaaaagaaa

SEQ ID NO: 2161287 - RNA, 19 nt, Human
cugccccccagcccuccuu

SEQ ID NO: 2161288 - RNA, 21 nt, Human
aagcuccauuuuuagugaaau

SEQ ID NO: 2161289 - RNA, 18 nt, Human
ccggggaggggcgcucgc

SEQ ID NO: 2161290 - RNA, 16 nt, Human
caugggacagggagga

SEQ ID NO: 2161291 - RNA, 19 nt, Human
ugcacacagcacgggggcc

SEQ ID NO: 2161292 - RNA, 17 nt, Human
agaacucccuuucaaca

SEQ ID NO: 2161293 - RNA, 22 nt, Human
acaccuuguacuuuauuuucua

SEQ ID NO: 2161294 - RNA, 14 nt, Human
ugcuucuguuuuau

SEQ ID NO: 2161295 - RNA, 23 nt, Human
caugcugucuacacuaagagaga

SEQ ID NO: 2161296 - RNA, 22 nt, Human
cugccuccccagcucuauccca

SEQ ID NO: 2161297 - RNA, 20 nt, Human
auuuucaguuauuauauuua

SEQ ID NO: 2161298 - RNA, 22 nt, Human
agacucugucucaguccaugaa

SEQ ID NO: 2161299 - RNA, 22 nt, Human
augcugagcccggaaacuccac

SEQ ID NO: 2161300 - RNA, 18 nt, Human
ccgggccgacggagccgg

SEQ ID NO: 2161301 - RNA, 13 nt, Human
acaagagcuuaac

SEQ ID NO: 2161302 - RNA, 13 nt, Human
uggcuccagcugg

SEQ ID NO: 2161303 - RNA, 15 nt, Human
cuccacauccugugg

SEQ ID NO: 2161304 - RNA, 21 nt, Human
aagucuuucacauuuaaauaa

SEQ ID NO: 2161305 - RNA, 22 nt, Human
gucacaggaaguagaggaggcc

SEQ ID NO: 2161306 - RNA, 22 nt, Human
gaugguucccuugaugaagaag

SEQ ID NO: 2161307 - RNA, 18 nt, Human
auggcuugaguuuaaauu

SEQ ID NO: 2161308 - RNA, 15 nt, Human
cugacucuuaagaag

SEQ ID NO: 2161309 - RNA, 17 nt, Human
uuauuuguacauuuuuu

SEQ ID NO: 2161310 - RNA, 17 nt, Human
aauaacaauaaaagaca

SEQ ID NO: 2161311 - RNA, 21 nt, Human
gaggugagguaccagccuugg

SEQ ID NO: 2161312 - RNA, 16 nt, Human
uaaaagacaaggaaaa

SEQ ID NO: 2161313 - RNA, 18 nt, Human
cauagguuuaauaauuuu

SEQ ID NO: 2161314 - RNA, 16 nt, Human
uucuauaauuuaaaua

SEQ ID NO: 2161315 - RNA, 15 nt, Human
ccaugaugcugagcc

SEQ ID NO: 2161316 - RNA, 13 nt, Human
cgggaggcagagg

SEQ ID NO: 2161317 - RNA, 18 nt, Human
uccagcuggccgggagcc

SEQ ID NO: 2161318 - RNA, 23 nt, Human
ucuaccaaaaaucucaauauuuc

SEQ ID NO: 2161319 - RNA, 22 nt, Human
ugaccauacuaauuauaccccc

SEQ ID NO: 2161320 - RNA, 16 nt, Human
aaugaaagcagggacu

SEQ ID NO: 2161321 - RNA, 20 nt, Human
acaugagguacugagaguga

SEQ ID NO: 2161322 - RNA, 15 nt, Human
aauacuuuauaaagg

SEQ ID NO: 2161323 - RNA, 19 nt, Human
gugacuuaaugccacuaaa

SEQ ID NO: 2161324 - RNA, 15 nt, Human
ccggagccuccagcu

SEQ ID NO: 2161325 - RNA, 22 nt, Human
caaauuuacagagacagaaagc

SEQ ID NO: 2161326 - RNA, 16 nt, Human
ugcacaucaaaauaug

SEQ ID NO: 2161327 - RNA, 16 nt, Human
uggauacuccaugggg

SEQ ID NO: 2161328 - RNA, 19 nt, Human
uggcaagcucuaucaccaa

SEQ ID NO: 2161329 - RNA, 16 nt, Human
ugugcauauuuuauua

SEQ ID NO: 2161330 - RNA, 23 nt, Human
cucauguccacugguucuucuug

SEQ ID NO: 2161331 - RNA, 20 nt, Human
cuaggggggucagccagccc

SEQ ID NO: 2161332 - RNA, 20 nt, Human
agcccucuucugacacuaaa

SEQ ID NO: 2161333 - RNA, 14 nt, Human
auuucuaugaaaua

SEQ ID NO: 2161334 - RNA, 22 nt, Human
uuguaacaagccuccuuuuaaa

SEQ ID NO: 2161335 - RNA, 16 nt, Human
uaucaaaagaaagaaa

SEQ ID NO: 2161336 - RNA, 12 nt, Human
ucaauaaaacuu

SEQ ID NO: 2161337 - RNA, 22 nt, Human
ucuggguuccuuccucugagcc

SEQ ID NO: 2161338 - RNA, 20 nt, Human
agccuaguugaucagcuuau

SEQ ID NO: 2161339 - RNA, 22 nt, Human
cuaccuguucgcgcgccuccgc

SEQ ID NO: 2161340 - RNA, 22 nt, Human
gcggguccgggucgcaggacca

SEQ ID NO: 2161341 - RNA, 22 nt, Human
aggcuccugagacacaugggug

SEQ ID NO: 2161342 - RNA, 16 nt, Human
acaggauggcaggagg

SEQ ID NO: 2161343 - RNA, 18 nt, Human
ugccauaauuacuauguc

SEQ ID NO: 2161344 - RNA, 23 nt, Human
ccugggaccaggcacccccagaa

SEQ ID NO: 2161345 - RNA, 21 nt, Human
ccagggcuacgcgcgcuccgc

SEQ ID NO: 2161346 - RNA, 18 nt, Human
gcuccgcgcagcucaggc

SEQ ID NO: 2161347 - RNA, 16 nt, Human
aucaguuauuuuuaaa

SEQ ID NO: 2161348 - RNA, 14 nt, Human
guauuuuaaaagaa

SEQ ID NO: 2161349 - RNA, 19 nt, Human
ccugagcggaccuucccag

SEQ ID NO: 2161350 - RNA, 20 nt, Human
ugaaaaucuuauaauuuaaa

SEQ ID NO: 2161351 - RNA, 22 nt, Human
cagcccuggugggcagagaggu

SEQ ID NO: 2161352 - RNA, 18 nt, Human
ccuucggccuccauccug

SEQ ID NO: 2161353 - RNA, 21 nt, Human
gcuccgcgcagcucaggcugg

SEQ ID NO: 2161354 - RNA, 18 nt, Human
cuccauuuuuagugaaau

SEQ ID NO: 2161355 - RNA, 14 nt, Human
aagcaucacaugaa

SEQ ID NO: 2161356 - RNA, 16 nt, Human
cacuuaaaaaugguuu

SEQ ID NO: 2161357 - RNA, 19 nt, Human
uaguuuaugauuccaccua

SEQ ID NO: 2161358 - RNA, 16 nt, Human
aucaaaagaaagaaaa

SEQ ID NO: 2161359 - RNA, 17 nt, Human
cucaggcuggcaccgcu

SEQ ID NO: 2161360 - RNA, 13 nt, Human
agggggaacauga

SEQ ID NO: 2161361 - RNA, 14 nt, Human
ucugggcagacucu

SEQ ID NO: 2161362 - RNA, 22 nt, Human
aucaccaaggcugauuaaacca

SEQ ID NO: 2161363 - RNA, 21 nt, Human
uuuuauggcacuaguauuucu

SEQ ID NO: 2161364 - RNA, 15 nt, Human
auagucauucugccu

SEQ ID NO: 2161365 - RNA, 15 nt, Human
ucacaggacagcccu

SEQ ID NO: 2161366 - RNA, 15 nt, Human
gacaguauggcagcu

SEQ ID NO: 2161367 - RNA, 17 nt, Human
cauuuguauaaaauaau

SEQ ID NO: 2161368 - RNA, 20 nt, Human
aacaagccuccuuuuaaagu

SEQ ID NO: 2161369 - RNA, 22 nt, Human
agcucuaucccaaccucuccca

SEQ ID NO: 2161370 - RNA, 14 nt, Human
gaaagcagaacagu

SEQ ID NO: 2161371 - RNA, 14 nt, Human
aauauaaauaaaaa

SEQ ID NO: 2161372 - RNA, 21 nt, Human
aauaauccucaguuuuuguga

SEQ ID NO: 2161373 - RNA, 23 nt, Human
cugggccauagucauucugccug

SEQ ID NO: 2161374 - RNA, 14 nt, Human
caaggcuagaacca

SEQ ID NO: 2161375 - RNA, 17 nt, Human
guugcugggggggauug

SEQ ID NO: 2161376 - RNA, 21 nt, Human
acaugagguacugagagugaa

SEQ ID NO: 2161377 - RNA, 20 nt, Human
uuaaugccacuaaauugaca

SEQ ID NO: 2161378 - RNA, 21 nt, Human
ugccuguaaucacagcuacuu

SEQ ID NO: 2161379 - RNA, 15 nt, Human
ugagcggaccuuccc

SEQ ID NO: 2161380 - RNA, 15 nt, Human
aaggcuccugagaca

SEQ ID NO: 2161381 - RNA, 22 nt, Human
cuaucaauccaagaacuuauuu

SEQ ID NO: 2161382 - RNA, 13 nt, Human
augcuagaacucc

SEQ ID NO: 2161383 - RNA, 18 nt, Human
uauuuucuauaauuuaaa

SEQ ID NO: 2161384 - RNA, 18 nt, Human
ggcccugugcggccuggu

SEQ ID NO: 2161385 - RNA, 15 nt, Human
cugcacuccagccug

SEQ ID NO: 2161386 - RNA, 23 nt, Human
uuuccaucaaggguacacugccu

SEQ ID NO: 2161387 - RNA, 17 nt, Human
ucuuauaauuuaaaaua

SEQ ID NO: 2161388 - RNA, 17 nt, Human
aauaugcucuaaacaug

SEQ ID NO: 2161389 - RNA, 16 nt, Human
uauuuuugugauuuug

SEQ ID NO: 2161390 - RNA, 21 nt, Human
aaaagguauuuuaaucaccaa

SEQ ID NO: 2161391 - RNA, 17 nt, Human
uuccaagccucaugucc

SEQ ID NO: 2161392 - RNA, 19 nt, Human
cugagccucagucucccuc

SEQ ID NO: 2161393 - RNA, 13 nt, Human
cacuguaaaauaa

SEQ ID NO: 2161394 - RNA, 17 nt, Human
uuaauaauuuuuaauua

SEQ ID NO: 2161395 - RNA, 14 nt, Human
ucugccugcccuga

SEQ ID NO: 2161396 - RNA, 16 nt, Human
auaauccuaaacauau

SEQ ID NO: 2161397 - RNA, 22 nt, Human
acagauuugagcucagcccugg

SEQ ID NO: 2161398 - RNA, 15 nt, Human
gaccacugcagaaga

SEQ ID NO: 2161399 - RNA, 13 nt, Human
cugccuucucaac

SEQ ID NO: 2161400 - RNA, 12 nt, Human
cgcgccuccgcu

SEQ ID NO: 2161401 - RNA, 17 nt, Human
cucgugggacagucacc

SEQ ID NO: 2161402 - RNA, 23 nt, Human
augucaauucuugccaaauauaa

SEQ ID NO: 2161403 - RNA, 19 nt, Human
acggagccgggaaagaaga

SEQ ID NO: 2161404 - RNA, 19 nt, Human
agccuccagcugccccggg

SEQ ID NO: 2161405 - RNA, 22 nt, Human
uucaauaucuuuuuuuuaauaa

SEQ ID NO: 2161406 - RNA, 21 nt, Human
gauaaaagacagugaaagaaa

SEQ ID NO: 2161407 - RNA, 15 nt, Human
gauccugcaauucca

SEQ ID NO: 2161408 - RNA, 18 nt, Human
uuuugugggaaauccaca

SEQ ID NO: 2161409 - RNA, 24 nt, Human
cauaugaaaaggcuaagcuucacu

SEQ ID NO: 2161410 - RNA, 14 nt, Human
cacuuggacauggg

SEQ ID NO: 2161411 - RNA, 15 nt, Human
aagugaaaaucuaca

SEQ ID NO: 2161412 - RNA, 15 nt, Human
aguucugaagaagau

SEQ ID NO: 2161413 - RNA, 14 nt, Human
ugaucaccugcccu

SEQ ID NO: 2161414 - RNA, 12 nt, Human
gauaaaagacag

SEQ ID NO: 2161415 - RNA, 17 nt, Human
aagacaaggaaaaaaua

SEQ ID NO: 2161416 - RNA, 13 nt, Human
uuuucuuuucauu

SEQ ID NO: 2161417 - RNA, 18 nt, Human
guuaguauuguccagguc

SEQ ID NO: 2161418 - RNA, 16 nt, Human
ccauuuuuagugaaau

SEQ ID NO: 2161419 - RNA, 13 nt, Human
cacauccuguggg

SEQ ID NO: 2161420 - RNA, 17 nt, Human
cucccuggaaucuugua

SEQ ID NO: 2161421 - RNA, 12 nt, Human
aaggaugccccg

SEQ ID NO: 2161422 - RNA, 11 nt, Human
gccuccagcug

SEQ ID NO: 2161423 - RNA, 12 nt, Human
aauaauuuuuaa

SEQ ID NO: 2161424 - RNA, 21 nt, Human
caagacugcacaucaaaauau

SEQ ID NO: 2161425 - RNA, 20 nt, Human
cccugcacuccagccugagc

SEQ ID NO: 2161426 - RNA, 14 nt, Human
cgcucgcuuccgca

SEQ ID NO: 2161427 - RNA, 16 nt, Human
ugcuaagucuuauaua

SEQ ID NO: 2161428 - RNA, 23 nt, Human
acuaguuguaauuuuuuuguggg

SEQ ID NO: 2161429 - RNA, 19 nt, Human
gcuguacgcgagcgcgcgc

SEQ ID NO: 2161430 - RNA, 15 nt, Human
gagccuccagcugcc

SEQ ID NO: 2161431 - RNA, 19 nt, Human
gucaaucagccuaguugau

SEQ ID NO: 2161432 - RNA, 14 nt, Human
ccuuaucaaaggac

SEQ ID NO: 2161433 - RNA, 18 nt, Human
acucuuaagaagacugca

SEQ ID NO: 2161434 - RNA, 23 nt, Human
aaauuuacagagacagaaagcag

SEQ ID NO: 2161435 - RNA, 15 nt, Human
acaggguuuauguuu

SEQ ID NO: 2161436 - RNA, 20 nt, Human
cgcgcucaucccacccgccc

SEQ ID NO: 2161437 - RNA, 17 nt, Human
uugugaagcaaaauuuu

SEQ ID NO: 2161438 - RNA, 18 nt, Human
cuggaaacuucagcgguu

SEQ ID NO: 2161439 - RNA, 20 nt, Human
ucaaaacuucagacauagaa

SEQ ID NO: 2161440 - RNA, 23 nt, Human
uaauuuguaguguuggagaagaa

SEQ ID NO: 2161441 - RNA, 16 nt, Human
cuucacuguaaaauaa

SEQ ID NO: 2161442 - RNA, 15 nt, Human
ugauuucauucaaua

SEQ ID NO: 2161443 - RNA, 18 nt, Human
ugugcauauuuuauuaua

SEQ ID NO: 2161444 - RNA, 15 nt, Human
ccuugccaugugcua

SEQ ID NO: 2161445 - RNA, 19 nt, Human
cgcccacuagacccacugg

SEQ ID NO: 2161446 - RNA, 16 nt, Human
ugcauagguuuaauaa

SEQ ID NO: 2161447 - RNA, 20 nt, Human
uccagccugagcgacaguga

SEQ ID NO: 2161448 - RNA, 17 nt, Human
gacagucaccucaugga

SEQ ID NO: 2161449 - RNA, 15 nt, Human
gacucaccuccccca

SEQ ID NO: 2161450 - RNA, 18 nt, Human
cuuuccacagaagcucca

SEQ ID NO: 2161451 - RNA, 13 nt, Human
aacucccugcccc

SEQ ID NO: 2161452 - RNA, 14 nt, Human
ggaaguagaggagg

SEQ ID NO: 2161453 - RNA, 15 nt, Human
gcaagcucuaucacc

SEQ ID NO: 2161454 - RNA, 16 nt, Human
cugcgcgccgcgcucc

SEQ ID NO: 2161455 - RNA, 12 nt, Human
ccuucagccuga

SEQ ID NO: 2161456 - RNA, 21 nt, Human
gagcuaggggggucagccagc

SEQ ID NO: 2161457 - RNA, 14 nt, Human
ucaagccugccuca

SEQ ID NO: 2161458 - RNA, 17 nt, Human
aauaaaguguuugaaag

SEQ ID NO: 2161459 - RNA, 14 nt, Human
uaguuucccuugca

SEQ ID NO: 2161460 - RNA, 18 nt, Human
aaauauaaauaaaaauaa

SEQ ID NO: 2161461 - RNA, 22 nt, Human
uaaaacaagcacuaaacaaaga

SEQ ID NO: 2161462 - RNA, 17 nt, Human
gcaaauugucacaggac

SEQ ID NO: 2161463 - RNA, 22 nt, Human
gaaauaagccagacaucaacag

SEQ ID NO: 2161464 - RNA, 23 nt, Human
ugaaaaucuuauaauuuaaaaua

SEQ ID NO: 2161465 - RNA, 18 nt, Human
ccugcccugaaaguccca

SEQ ID NO: 2161466 - RNA, 22 nt, Human
ccauacuaauuauacccccugc

SEQ ID NO: 2161467 - RNA, 12 nt, Human
aguguuugaaag

SEQ ID NO: 2161468 - RNA, 23 nt, Human
ucuuagaugcaguucugaagaag

SEQ ID NO: 2161469 - RNA, 20 nt, Human
gcgcggggcggggagcgagc

SEQ ID NO: 2161470 - RNA, 14 nt, Human
aucaccaaggcuga

SEQ ID NO: 2161471 - RNA, 15 nt, Human
cuacuaauuuuaaaa

SEQ ID NO: 2161472 - RNA, 19 nt, Human
ugaaauuguauuacaaauc

SEQ ID NO: 2161473 - RNA, 16 nt, Human
auaucaguuauuuuua

SEQ ID NO: 2161474 - RNA, 13 nt, Human
aaagaagagccgg

SEQ ID NO: 2161475 - RNA, 14 nt, Human
uucagccugaaaga

SEQ ID NO: 2161476 - RNA, 14 nt, Human
ucccacccgcccac

SEQ ID NO: 2161477 - RNA, 14 nt, Human
cugcugagucccag

SEQ ID NO: 2161478 - RNA, 15 nt, Human
caguuauuuuuaaac

SEQ ID NO: 2161479 - RNA, 14 nt, Human
gagccgggaaagaa

SEQ ID NO: 2161480 - RNA, 15 nt, Human
ugggacagggaggac

SEQ ID NO: 2161481 - RNA, 21 nt, Human
aaauaauuuuuauauuugaaa

SEQ ID NO: 2161482 - RNA, 13 nt, Human
cuucuuucaugaa

SEQ ID NO: 2161483 - RNA, 16 nt, Human
agugucaaugcagccc

SEQ ID NO: 2161484 - RNA, 20 nt, Human
auaagccagacaucaacaga

SEQ ID NO: 2161485 - RNA, 17 nt, Human
cugagcggaccuuccca

SEQ ID NO: 2161486 - RNA, 20 nt, Human
ugauuauaugucacuuugcu

SEQ ID NO: 2161487 - RNA, 19 nt, Human
ugcuauugggguugggggg

SEQ ID NO: 2161488 - RNA, 22 nt, Human
uaaacuguaaagcuuugugcag

SEQ ID NO: 2161489 - RNA, 16 nt, Human
agucucuaucauuaaa

SEQ ID NO: 2161490 - RNA, 21 nt, Human
uuacaaugcauucugagguaa

SEQ ID NO: 2161491 - RNA, 12 nt, Human
ggugcugcagcc

SEQ ID NO: 2161492 - RNA, 13 nt, Human
gcuggagcucugc

SEQ ID NO: 2161493 - RNA, 13 nt, Human
cuaugaaauauua

SEQ ID NO: 2161494 - RNA, 14 nt, Human
aauggcuaagcaaa

SEQ ID NO: 2161495 - RNA, 11 nt, Human
gggaaagaaga

SEQ ID NO: 2161496 - RNA, 16 nt, Human
cauagucauucugccu

SEQ ID NO: 2161497 - RNA, 21 nt, Human
gacagugaaagaaaauaacaa

SEQ ID NO: 2161498 - RNA, 23 nt, Human
caacggggugaaacccugucucu

SEQ ID NO: 2161499 - RNA, 13 nt, Human
cggccggcgcgcu

SEQ ID NO: 2161500 - RNA, 17 nt, Human
guucgcgcgccuccgcu

SEQ ID NO: 2161501 - RNA, 20 nt, Human
gagccugaucaccugcccug

SEQ ID NO: 2161502 - RNA, 19 nt, Human
ccgcagggugaacugcagc

SEQ ID NO: 2161503 - RNA, 17 nt, Human
gacucaccucccccauc

SEQ ID NO: 2161504 - RNA, 21 nt, Human
uccuucagccugaaagaggaa

SEQ ID NO: 2161505 - RNA, 23 nt, Human
ucccgcuguuccucgccacgcuc

SEQ ID NO: 2161506 - RNA, 17 nt, Human
agcucuaucccaaccuc

SEQ ID NO: 2161507 - RNA, 21 nt, Human
cgacagugagacucugucuca

SEQ ID NO: 2161508 - RNA, 20 nt, Human
uauaugcuaagucuuauaua

SEQ ID NO: 2161509 - RNA, 17 nt, Human
aaagaaacauuugguaa

SEQ ID NO: 2161510 - RNA, 15 nt, Human
aaaaaauaacaauga

SEQ ID NO: 2161511 - RNA, 20 nt, Human
agcuuauugucuagugaaac

SEQ ID NO: 2161512 - RNA, 21 nt, Human
cauuuucuucucacauuuaua

SEQ ID NO: 2161513 - RNA, 13 nt, Human
ucuauaauuuaaa

SEQ ID NO: 2161514 - RNA, 17 nt, Human
auaaaguacaagagcuu

SEQ ID NO: 2161515 - RNA, 21 nt, Human
gaagugaaaaucuacacucca

SEQ ID NO: 2161516 - RNA, 16 nt, Human
aaaagcaucacaugaa

SEQ ID NO: 2161517 - RNA, 14 nt, Human
uacccccugggagc

SEQ ID NO: 2161518 - RNA, 14 nt, Human
uauauauauauuuu

SEQ ID NO: 2161519 - RNA, 14 nt, Human
cucugccucagaaa

SEQ ID NO: 2161520 - RNA, 20 nt, Human
guaucaaaagaaagaaaauc

SEQ ID NO: 2161521 - RNA, 16 nt, Human
aauugacccacaagaa

SEQ ID NO: 2161522 - RNA, 18 nt, Human
ugaacuugguuuuaauua

SEQ ID NO: 2161523 - RNA, 15 nt, Human
ggcaagcucuaucac

SEQ ID NO: 2161524 - RNA, 15 nt, Human
aaaagacaaggaaaa

SEQ ID NO: 2161525 - RNA, 22 nt, Human
cuggguuccuuccucugagccu

SEQ ID NO: 2161526 - RNA, 13 nt, Human
aagugcagccccg

SEQ ID NO: 2161527 - RNA, 23 nt, Human
aagagccuuuuuuugaaaaaaag

SEQ ID NO: 2161528 - RNA, 18 nt, Human
uuuuauaucaauuuaaaa

SEQ ID NO: 2161529 - RNA, 21 nt, Human
uacaugagguacugagaguga

SEQ ID NO: 2161530 - RNA, 19 nt, Human
ugaacaaauuuacagagac

SEQ ID NO: 2161531 - RNA, 19 nt, Human
cugcgcgccgcgcuccucg

SEQ ID NO: 2161532 - RNA, 19 nt, Human
accucagcugccuccccag

SEQ ID NO: 2161533 - RNA, 15 nt, Human
uucacuguaaaauaa

SEQ ID NO: 2161534 - RNA, 22 nt, Human
ucuuccuuuuuuaguucuucaa

SEQ ID NO: 2161535 - RNA, 14 nt, Human
cugcaaagcccagc

SEQ ID NO: 2161536 - RNA, 20 nt, Human
gcggggcggggagcgagccc

SEQ ID NO: 2161537 - RNA, 17 nt, Human
gcaugguuuagaaagcu

SEQ ID NO: 2161538 - RNA, 17 nt, Human
gacacaugggugcuauu

SEQ ID NO: 2161539 - RNA, 21 nt, Human
cuccacuuggacaugggcccc

SEQ ID NO: 2161540 - RNA, 18 nt, Human
aggaaaaaauaacaauga

SEQ ID NO: 2161541 - RNA, 18 nt, Human
uuguaaaggaauuuaaaa

SEQ ID NO: 2161542 - RNA, 14 nt, Human
gaaaaaauaacaau

SEQ ID NO: 2161543 - RNA, 19 nt, Human
cagauucuuuacccccugg

SEQ ID NO: 2161544 - RNA, 17 nt, Human
ucucuggccuucggccu

SEQ ID NO: 2161545 - RNA, 20 nt, Human
cagcugccccggggaggggc

SEQ ID NO: 2161546 - RNA, 15 nt, Human
ccacaggaaccacaa

SEQ ID NO: 2161547 - RNA, 20 nt, Human
agagccggagccuccagcug

SEQ ID NO: 2161548 - RNA, 23 nt, Human
caccucauggaauuggagcucgu

SEQ ID NO: 2161549 - RNA, 15 nt, Human
gacaugggccccaga

SEQ ID NO: 2161550 - RNA, 21 nt, Human
cauuucuugagguaaaagcau

SEQ ID NO: 2161551 - RNA, 14 nt, Human
uccacaacacacag

SEQ ID NO: 2161552 - RNA, 12 nt, Human
aggggcgcucgc

SEQ ID NO: 2161553 - RNA, 19 nt, Human
aggggggucagccagcccu

SEQ ID NO: 2161554 - RNA, 18 nt, Human
acaccucagcugccuccc

SEQ ID NO: 2161555 - RNA, 17 nt, Human
cguaaucguguccccua

SEQ ID NO: 2161556 - RNA, 14 nt, Human
accugugagaccaa

SEQ ID NO: 2161557 - RNA, 14 nt, Human
aaagagaacuucca

SEQ ID NO: 2161558 - RNA, 17 nt, Human
accugagccccaaaagg

SEQ ID NO: 2161559 - RNA, 15 nt, Human
cuaucuuugagcgcc

SEQ ID NO: 2161560 - RNA, 13 nt, Human
ucuaagaagugaa

SEQ ID NO: 2161561 - RNA, 14 nt, Human
aaauauaaauaaaa

SEQ ID NO: 2161562 - RNA, 14 nt, Human
auaaauaaaaauaa

SEQ ID NO: 2161563 - RNA, 15 nt, Human
uuagugaaauauuau

SEQ ID NO: 2161564 - RNA, 19 nt, Human
ugaucaccugcccugcuga

SEQ ID NO: 2161565 - RNA, 15 nt, Human
ccugccccccagccc

SEQ ID NO: 2161566 - RNA, 21 nt, Human
aaugaauggcuaagcaaaaug

SEQ ID NO: 2161567 - RNA, 16 nt, Human
gaaucacuugaacccg

SEQ ID NO: 2161568 - RNA, 19 nt, Human
agugaggagcuuugaaacg

SEQ ID NO: 2161569 - RNA, 14 nt, Human
ugacacuuaaaaau

SEQ ID NO: 2161570 - RNA, 15 nt, Human
ccucccggccgcgcu

SEQ ID NO: 2161571 - RNA, 22 nt, Human
ccaaaggcuccugagacacaug

SEQ ID NO: 2161572 - RNA, 16 nt, Human
gaaagaagagccggag

SEQ ID NO: 2161573 - RNA, 12 nt, Human
cggcccugugcg

SEQ ID NO: 2161574 - RNA, 20 nt, Human
cucgcccacuuccucccggc

SEQ ID NO: 2161575 - RNA, 15 nt, Human
auuauuuuuuaaaaa

SEQ ID NO: 2161576 - RNA, 15 nt, Human
agccgggaaagaaga

SEQ ID NO: 2161577 - RNA, 12 nt, Human
gaaaauaacaau

SEQ ID NO: 2161578 - RNA, 16 nt, Human
aaauauuauguuaaaa

SEQ ID NO: 2161579 - RNA, 17 nt, Human
gccaugggacagggagg

SEQ ID NO: 2161580 - RNA, 17 nt, Human
gggagcgagccccaggc

SEQ ID NO: 2161581 - RNA, 21 nt, Human
gccaaauauaaauaaaaauaa

SEQ ID NO: 2161582 - RNA, 19 nt, Human
auagucauucugccugccc

SEQ ID NO: 2161583 - RNA, 21 nt, Human
cgaaguauccuucagccugaa

SEQ ID NO: 2161584 - RNA, 21 nt, Human
acuuuuccaaugacauuuugu

SEQ ID NO: 2161585 - RNA, 14 nt, Human
cucccugcccccca

SEQ ID NO: 2161586 - RNA, 12 nt, Human
guagacacacau

SEQ ID NO: 2161587 - RNA, 18 nt, Human
aaaucuuauaauuuaaaa

SEQ ID NO: 2161588 - RNA, 21 nt, Human
cuaguaucaaaagaaagaaaa

SEQ ID NO: 2161589 - RNA, 18 nt, Human
auggaaguaaauguuguu

SEQ ID NO: 2161590 - RNA, 15 nt, Human
uauauauauauauuu

SEQ ID NO: 2161591 - RNA, 23 nt, Human
acguaaucguguccccuauccua

SEQ ID NO: 2161592 - RNA, 20 nt, Human
uggaauaauccuaaacauau

SEQ ID NO: 2161593 - RNA, 13 nt, Human
agcucugcccauc

SEQ ID NO: 2161594 - RNA, 17 nt, Human
aggcuagaaccaccugc

SEQ ID NO: 2161595 - RNA, 18 nt, Human
gccugagcgacagugaga

SEQ ID NO: 2161596 - RNA, 19 nt, Human
auuggagcucgugggacag

SEQ ID NO: 2161597 - RNA, 11 nt, Human
uuuuuuuucaa

SEQ ID NO: 2161598 - RNA, 21 nt, Human
gaagagccggagccuccagcu

SEQ ID NO: 2161599 - RNA, 15 nt, Human
ccccugagcuugcag

SEQ ID NO: 2161600 - RNA, 20 nt, Human
gcucgcccacuuccucccgg

SEQ ID NO: 2161601 - RNA, 21 nt, Human
ccuggugccucaccccuugcc

SEQ ID NO: 2161602 - RNA, 22 nt, Human
ccauagucauucugccugcccu

SEQ ID NO: 2161603 - RNA, 13 nt, Human
ucacuguaaaaua

SEQ ID NO: 2161604 - RNA, 21 nt, Human
uauuacuguaagaaaauauca

SEQ ID NO: 2161605 - RNA, 19 nt, Human
cucauggaauuggagcucg

SEQ ID NO: 2161606 - RNA, 21 nt, Human
uccuacaagacacagugacca

SEQ ID NO: 2161607 - RNA, 19 nt, Human
guccaggucuaccaaaaau

SEQ ID NO: 2161608 - RNA, 22 nt, Human
cacuuggacaugggccccagau

SEQ ID NO: 2161609 - RNA, 19 nt, Human
ucagugucaaugcagcccc

SEQ ID NO: 2161610 - RNA, 10 nt, Human
aauaaaacuu

SEQ ID NO: 2161611 - RNA, 19 nt, Human
gagccucagucucccuccc

SEQ ID NO: 2161612 - RNA, 15 nt, Human
caaauccaaugaaau

SEQ ID NO: 2161613 - RNA, 19 nt, Human
cuuggggccuaugcagagg

SEQ ID NO: 2161614 - RNA, 14 nt, Human
uaaaagacaaggaa

SEQ ID NO: 2161615 - RNA, 18 nt, Human
uaaguuuuuuuuuaaaaa

SEQ ID NO: 2161616 - RNA, 12 nt, Human
gcugaugcaguu

SEQ ID NO: 2161617 - RNA, 20 nt, Human
aaagagugaaggauuuaugu

SEQ ID NO: 2161618 - RNA, 16 nt, Human
aaauccacacugagcu

SEQ ID NO: 2161619 - RNA, 18 nt, Human
accaccugccuauauuuu

SEQ ID NO: 2161620 - RNA, 16 nt, Human
gacauuugcucaugga

SEQ ID NO: 2161621 - RNA, 21 nt, Human
aggacagcccuucuuuccaca

SEQ ID NO: 2161622 - RNA, 23 nt, Human
ccucuucugacacuaaaacaccu

SEQ ID NO: 2161623 - RNA, 17 nt, Human
gccggagccuccagcug

SEQ ID NO: 2161624 - RNA, 20 nt, Human
aucccggccggcgcgcucau

SEQ ID NO: 2161625 - RNA, 15 nt, Human
guuucuuccuuuuuu

SEQ ID NO: 2161626 - RNA, 20 nt, Human
gggaggcagagguugcagug

SEQ ID NO: 2161627 - RNA, 15 nt, Human
aacgauaaaagacag

SEQ ID NO: 2161628 - RNA, 17 nt, Human
uaauuuuuauauuugaa

SEQ ID NO: 2161629 - RNA, 15 nt, Human
ugcagauaaacagua

SEQ ID NO: 2161630 - RNA, 14 nt, Human
aauauuauuuuaua

SEQ ID NO: 2161631 - RNA, 22 nt, Human
ucuagcaugucgucaaagcuga

SEQ ID NO: 2161632 - RNA, 23 nt, Human
gggaaagaagagccggagccucc

SEQ ID NO: 2161633 - RNA, 17 nt, Human
ggaaauauuuauuuuaa

SEQ ID NO: 2161634 - RNA, 14 nt, Human
uggacucaccuccc

SEQ ID NO: 2161635 - RNA, 22 nt, Human
gucaagaagcaucgugucuggc

SEQ ID NO: 2161636 - RNA, 18 nt, Human
ccugcucgcccacuuccu

SEQ ID NO: 2161637 - RNA, 20 nt, Human
caccgcagggugaacugcag

SEQ ID NO: 2161638 - RNA, 24 nt, Human
cauucuggaauaauccuaaacaua

SEQ ID NO: 2161639 - RNA, 16 nt, Human
gccucagucucccucc

SEQ ID NO: 2161640 - RNA, 22 nt, Human
ugucucuacuaaaaauacaaaa

SEQ ID NO: 2161641 - RNA, 20 nt, Human
aagcuucacuguaaaauaau

SEQ ID NO: 2161642 - RNA, 16 nt, Human
ccucagucucccuccc

SEQ ID NO: 2161643 - RNA, 19 nt, Human
cuagaguuuagcuggaaaa

SEQ ID NO: 2161644 - RNA, 14 nt, Human
cagagguugcagug

SEQ ID NO: 2161645 - RNA, 14 nt, Human
cucaggcuggcacc

SEQ ID NO: 2161646 - RNA, 16 nt, Human
agauagggagggaagg

SEQ ID NO: 2161647 - RNA, 20 nt, Human
gauugagaaggagcucccag

SEQ ID NO: 2161648 - RNA, 21 nt, Human
aaaaacguauugcauuuaauu

SEQ ID NO: 2161649 - RNA, 22 nt, Human
uagacacacaugaaguccaagc

SEQ ID NO: 2161650 - RNA, 17 nt, Human
cugagaugggagaauca

SEQ ID NO: 2161651 - RNA, 20 nt, Human
cagguaccuucucaccugug

SEQ ID NO: 2161652 - RNA, 18 nt, Human
guuucaaacauauauaac

SEQ ID NO: 2161653 - RNA, 14 nt, Human
ugaggcuuuaaaac

SEQ ID NO: 2161654 - RNA, 15 nt, Human
auccuagucucuauc

SEQ ID NO: 2161655 - RNA, 23 nt, Human
auaaaguaugugcauauuuuauu

SEQ ID NO: 2161656 - RNA, 17 nt, Human
cuuauuuguacauuuuu

SEQ ID NO: 2161657 - RNA, 20 nt, Human
ccgcagggugaacugcagcg

SEQ ID NO: 2161658 - RNA, 17 nt, Human
uauauuguagauaauac

SEQ ID NO: 2161659 - RNA, 13 nt, Human
ccccagcccuccu

SEQ ID NO: 2161660 - RNA, 17 nt, Human
ggcuccggacgcugcug

SEQ ID NO: 2161661 - RNA, 15 nt, Human
aaauauuuauuuuaa

SEQ ID NO: 2161662 - RNA, 22 nt, Human
aaugggcacaggguuuauguuu

SEQ ID NO: 2161663 - RNA, 18 nt, Human
uguacuuuauuuucuaua

SEQ ID NO: 2161664 - RNA, 14 nt, Human
gaaugauuaugaau

SEQ ID NO: 2161665 - RNA, 19 nt, Human
aaguugcauagguuuaaua

SEQ ID NO: 2161666 - RNA, 14 nt, Human
cgucccccucuggc

SEQ ID NO: 2161667 - RNA, 17 nt, Human
gaagaccucauuuugaa

SEQ ID NO: 2161668 - RNA, 23 nt, Human
ggaggcagagguugcagugagcc

SEQ ID NO: 2161669 - RNA, 19 nt, Human
caacucccugccccccagc

SEQ ID NO: 2161670 - RNA, 18 nt, Human
uguauuauuuuuuaaaaa

SEQ ID NO: 2161671 - RNA, 15 nt, Human
agacagcucugcaua

SEQ ID NO: 2161672 - RNA, 18 nt, Human
uuuauguuuaauucugaa

SEQ ID NO: 2161673 - RNA, 22 nt, Human
agaagagccggagccuccagcu

SEQ ID NO: 2161674 - RNA, 20 nt, Human
ggaggcauccaaaggcuccu

SEQ ID NO: 2161675 - RNA, 21 nt, Human
cuccagcuggccgggagccug

SEQ ID NO: 2161676 - RNA, 21 nt, Human
uuuauauaagcuuguauuccu

SEQ ID NO: 2161677 - RNA, 12 nt, Human
agacagugaaag

SEQ ID NO: 2161678 - RNA, 19 nt, Human
ucugagcauuuaauaugga

SEQ ID NO: 2161679 - RNA, 15 nt, Human
acuuuauaaaggauu

SEQ ID NO: 2161680 - RNA, 16 nt, Human
aaaauccauacauuug

SEQ ID NO: 2161681 - RNA, 19 nt, Human
uccccuauccuacuucccc

SEQ ID NO: 2161682 - RNA, 13 nt, Human
ccucuggcuccag

SEQ ID NO: 2161683 - RNA, 21 nt, Human
uuauagcuacuaauuuuaaaa

SEQ ID NO: 2161684 - RNA, 22 nt, Human
gaugcaguucugaagaagaugg

SEQ ID NO: 2161685 - RNA, 16 nt, Human
cugagccucagucucc

SEQ ID NO: 2161686 - RNA, 13 nt, Human
ccacaacacacag

SEQ ID NO: 2161687 - RNA, 14 nt, Human
cucccucccuuggg

SEQ ID NO: 2161688 - RNA, 22 nt, Human
cccaggcggguccgggucgcag

SEQ ID NO: 2161689 - RNA, 19 nt, Human
aaacaccucagcugccucc

SEQ ID NO: 2161690 - RNA, 14 nt, Human
aaaagaaagaaaau

SEQ ID NO: 2161691 - RNA, 18 nt, Human
uaucccaaccucucccaa

SEQ ID NO: 2161692 - RNA, 19 nt, Human
agauuugagcucagcccug

SEQ ID NO: 2161693 - RNA, 16 nt, Human
cggggagcgagcccca

SEQ ID NO: 2161694 - RNA, 15 nt, Human
cuaggugcugcagcc

SEQ ID NO: 2161695 - RNA, 22 nt, Human
cuccagccugagcgacagugag

SEQ ID NO: 2161696 - RNA, 18 nt, Human
uauauuuuuuuuuuuaaa

SEQ ID NO: 2161697 - RNA, 18 nt, Human
uuauuauagucacuaguu

SEQ ID NO: 2161698 - RNA, 13 nt, Human
uaauuuuuauauu

SEQ ID NO: 2161699 - RNA, 13 nt, Human
guuauuuuuaaac

SEQ ID NO: 2161700 - RNA, 22 nt, Human
agaagcaccaaucaugaauuag

SEQ ID NO: 2161701 - RNA, 16 nt, Human
gcccugaaagucccag

SEQ ID NO: 2161702 - RNA, 22 nt, Human
cggagccuccagcugccccggg

SEQ ID NO: 2161703 - RNA, 17 nt, Human
gcucggccugcucgccc

SEQ ID NO: 2161704 - RNA, 18 nt, Human
cggagccuccagcugccc

SEQ ID NO: 2161705 - RNA, 17 nt, Human
auauuugaaauauugac

SEQ ID NO: 2161706 - RNA, 18 nt, Human
ucaaggguacacugccuu

SEQ ID NO: 2161707 - RNA, 19 nt, Human
ccccugcaaagcccagcuu

SEQ ID NO: 2161708 - RNA, 17 nt, Human
gcaagcucuaucaccaa

SEQ ID NO: 2161709 - RNA, 19 nt, Human
cuuggacaugggccccaga

SEQ ID NO: 2161710 - RNA, 15 nt, Human
gacagggaggacgcu

SEQ ID NO: 2161711 - RNA, 16 nt, Human
guuuuuuuuuaaaaaa

SEQ ID NO: 2161712 - RNA, 15 nt, Human
ucuuauaauuuaaaa

SEQ ID NO: 2161713 - RNA, 18 nt, Human
ccaaccuggaguugaaaa

SEQ ID NO: 2161714 - RNA, 15 nt, Human
cacuuggucugugag

SEQ ID NO: 2161715 - RNA, 13 nt, Human
ccagcccuccuua

SEQ ID NO: 2161716 - RNA, 23 nt, Human
uuuuauagcuacuaauuuuaaaa

SEQ ID NO: 2161717 - RNA, 18 nt, Human
uaucaaaagaaagaaaau

SEQ ID NO: 2161718 - RNA, 14 nt, Human
agaaaugaaagcag

SEQ ID NO: 2161719 - RNA, 14 nt, Human
gcaaagcccagcuu

SEQ ID NO: 2161720 - RNA, 17 nt, Human
auguugacaugggacau

SEQ ID NO: 2161721 - RNA, 17 nt, Human
agggcauagaaguaaaa

SEQ ID NO: 2161722 - RNA, 21 nt, Human
cuucucaccugugagaccaaa

SEQ ID NO: 2161723 - RNA, 17 nt, Human
cuuccuaauuccacagc

SEQ ID NO: 2161724 - RNA, 15 nt, Human
acaaggaaaaaauaa

SEQ ID NO: 2161725 - RNA, 20 nt, Human
auauuuuauaucaauuuaaa

SEQ ID NO: 2161726 - RNA, 18 nt, Human
caaucaguauucauauuu

SEQ ID NO: 2161727 - RNA, 22 nt, Human
uuuuauagcuacuaauuuuaaa

SEQ ID NO: 2161728 - RNA, 14 nt, Human
cagauccccaagcc

SEQ ID NO: 2161729 - RNA, 22 nt, Human
caccagucugacuguuuccauc

SEQ ID NO: 2161730 - RNA, 21 nt, Human
aauuuuuauauuugaaauauu

SEQ ID NO: 2161731 - RNA, 19 nt, Human
gugaacuugguuuuaauua

SEQ ID NO: 2161732 - RNA, 23 nt, Human
gcccuggugccucaccccuugcc

SEQ ID NO: 2161733 - RNA, 14 nt, Human
acaaauccaaugaa

SEQ ID NO: 2161734 - RNA, 21 nt, Human
auaguuguaccgcaaugugac

SEQ ID NO: 2161735 - RNA, 14 nt, Human
guaacuaauuuuaa

SEQ ID NO: 2161736 - RNA, 14 nt, Human
cauccugugggacc

SEQ ID NO: 2161737 - RNA, 16 nt, Human
ccuccuuuuaaaguaa

SEQ ID NO: 2161738 - RNA, 17 nt, Human
caauucgauccccuguc

SEQ ID NO: 2161739 - RNA, 16 nt, Human
agugaaggauuuaugu

SEQ ID NO: 2161740 - RNA, 13 nt, Human
gcuacgcgcgcuc

SEQ ID NO: 2161741 - RNA, 13 nt, Human
cuucucaacucca

SEQ ID NO: 2161742 - RNA, 13 nt, Human
uccccagcucuau

SEQ ID NO: 2161743 - RNA, 16 nt, Human
ugacacuuaaaaaugg

SEQ ID NO: 2161744 - RNA, 19 nt, Human
cacauccugugggaccugg

SEQ ID NO: 2161745 - RNA, 17 nt, Human
guauuauuuuuuaaaaa

SEQ ID NO: 2161746 - RNA, 23 nt, Human
auguuaaaacugggacaggggag

SEQ ID NO: 2161747 - RNA, 20 nt, Human
ccagggcuacgcgcgcuccg

SEQ ID NO: 2161748 - RNA, 19 nt, Human
aaaagacagugaaagaaaa

SEQ ID NO: 2161749 - RNA, 14 nt, Human
ggccgggagccuga

SEQ ID NO: 2161750 - RNA, 16 nt, Human
agugagacagcucugc

SEQ ID NO: 2161751 - RNA, 23 nt, Human
ggccugcucgcccacuuccuccc

SEQ ID NO: 2161752 - RNA, 12 nt, Human
gcauccuagucu

SEQ ID NO: 2161753 - RNA, 18 nt, Human
auaaaguguuugaaagcu

SEQ ID NO: 2161754 - RNA, 12 nt, Human
gcucagcccugg

SEQ ID NO: 2161755 - RNA, 24 nt, Human
gucgcaggaccaucccggccggcg

SEQ ID NO: 2161756 - RNA, 18 nt, Human
cagaucaagccugccuca

SEQ ID NO: 2161757 - RNA, 16 nt, Human
uccuagucucuaucau

SEQ ID NO: 2161758 - RNA, 22 nt, Human
ugagacucugucucaguccaug

SEQ ID NO: 2161759 - RNA, 18 nt, Human
gaaaugaaagcagggacu

SEQ ID NO: 2161760 - RNA, 23 nt, Human
agcucugcccauccugccccuga

SEQ ID NO: 2161761 - RNA, 11 nt, Human
cuguuuuauaa

SEQ ID NO: 2161762 - RNA, 11 nt, Human
gcaugguuuag

SEQ ID NO: 2161763 - RNA, 17 nt, Human
acuaggugcugcagccc

SEQ ID NO: 2161764 - RNA, 15 nt, Human
cuaagugcagccccg

SEQ ID NO: 2161765 - RNA, 13 nt, Human
cugcacuccagcc

SEQ ID NO: 2161766 - RNA, 18 nt, Human
acauuugcucauggaauu

SEQ ID NO: 2161767 - RNA, 16 nt, Human
aaauaguuuaugauuc

SEQ ID NO: 2161768 - RNA, 15 nt, Human
cccccagcccuccuu

SEQ ID NO: 2161769 - RNA, 15 nt, Human
acaucaacagauaaa

SEQ ID NO: 2161770 - RNA, 20 nt, Human
augguuuagaaagcuugccc

SEQ ID NO: 2161771 - RNA, 17 nt, Human
auguuuacagaucccca

SEQ ID NO: 2161772 - RNA, 14 nt, Human
ugugaaaagcucca

SEQ ID NO: 2161773 - RNA, 15 nt, Human
cuugaaaacuuuaug

SEQ ID NO: 2161774 - RNA, 17 nt, Human
auaauuuaaauauaugc

SEQ ID NO: 2161775 - RNA, 15 nt, Human
acgagauacagaauu

SEQ ID NO: 2161776 - RNA, 21 nt, Human
ugcccauccugccccugagcc

SEQ ID NO: 2161777 - RNA, 13 nt, Human
aacacaacuauau

SEQ ID NO: 2161778 - RNA, 19 nt, Human
aagguccuggcaaagauga

SEQ ID NO: 2161779 - RNA, 17 nt, Human
agaugggagaaucacuu

SEQ ID NO: 2161780 - RNA, 20 nt, Human
ucauucacucaacaaacaua

SEQ ID NO: 2161781 - RNA, 15 nt, Human
uccgcauccuagucu

SEQ ID NO: 2161782 - RNA, 16 nt, Human
aaauauaaauaaaaau

SEQ ID NO: 2161783 - RNA, 12 nt, Human
uccaaagggcau

SEQ ID NO: 2161784 - RNA, 15 nt, Human
uuuaugguuguauua

SEQ ID NO: 2161785 - RNA, 12 nt, Human
ccaggcugagcc

SEQ ID NO: 2161786 - RNA, 15 nt, Human
gcagcucaggcuggc

SEQ ID NO: 2161787 - RNA, 16 nt, Human
gacauagaauuaacac

SEQ ID NO: 2161788 - RNA, 20 nt, Human
uagucucuaucauuaaaguu

SEQ ID NO: 2161789 - RNA, 15 nt, Human
uacaggauuugaaau

SEQ ID NO: 2161790 - RNA, 12 nt, Human
ucccccucuggc

SEQ ID NO: 2161791 - RNA, 15 nt, Human
ggcaauagucaaauu

SEQ ID NO: 2161792 - RNA, 16 nt, Human
cuucggccuccauccu

SEQ ID NO: 2161793 - RNA, 22 nt, Human
uggguuccuuccucugagccuu

SEQ ID NO: 2161794 - RNA, 14 nt, Human
cuggagcucugccc

SEQ ID NO: 2161795 - RNA, 19 nt, Human
cuccucggacggcuccgga

SEQ ID NO: 2161796 - RNA, 17 nt, Human
gaaugagagacacacug

SEQ ID NO: 2161797 - RNA, 17 nt, Human
ucuauaauuuaaauaua

SEQ ID NO: 2161798 - RNA, 17 nt, Human
cuccuuaucaaaggaca

SEQ ID NO: 2161799 - RNA, 21 nt, Human
ugagcucagcccuggugggca

SEQ ID NO: 2161800 - RNA, 18 nt, Human
gaagagccggagccucca

SEQ ID NO: 2161801 - RNA, 18 nt, Human
aaaagacaaggaaaaaau

SEQ ID NO: 2161802 - RNA, 22 nt, Human
aauugacccacaagaaaugaaa

SEQ ID NO: 2161803 - RNA, 18 nt, Human
auuuuaacucuauaaugu

SEQ ID NO: 2161804 - RNA, 21 nt, Human
acagugaaagaaaauaacaau

SEQ ID NO: 2161805 - RNA, 18 nt, Human
accauuuuugaaaccaaa

SEQ ID NO: 2161806 - RNA, 22 nt, Human
cccagaaugaccuggccgcagu

SEQ ID NO: 2161807 - RNA, 14 nt, Human
ccggagccuccagc

SEQ ID NO: 2161808 - RNA, 18 nt, Human
auuuauuacuguaagaaa

SEQ ID NO: 2161809 - RNA, 20 nt, Human
gauaccaugaugcugagccc

SEQ ID NO: 2161810 - RNA, 16 nt, Human
aauaaaguguuugaaa

SEQ ID NO: 2161811 - RNA, 15 nt, Human
augggacagggagga

SEQ ID NO: 2161812 - RNA, 20 nt, Human
cagcuggccgggagccugau

SEQ ID NO: 2161813 - RNA, 20 nt, Human
agaagaacugaaaucauacu

SEQ ID NO: 2161814 - RNA, 16 nt, Human
cuggcugcgcucggcc

SEQ ID NO: 2161815 - RNA, 20 nt, Human
ugaggcuccacuuggucugu

SEQ ID NO: 2161816 - RNA, 19 nt, Human
cauggaauuggagcucgug

SEQ ID NO: 2161817 - RNA, 15 nt, Human
uucccgugugccuga

SEQ ID NO: 2161818 - RNA, 15 nt, Human
caggaaguagaggag

SEQ ID NO: 2161819 - RNA, 20 nt, Human
aaaagacagugaaagaaaau

SEQ ID NO: 2161820 - RNA, 21 nt, Human
caccucagcugccuccccagc

SEQ ID NO: 2161821 - RNA, 20 nt, Human
gaauucauucacucaacaaa

SEQ ID NO: 2161822 - RNA, 19 nt, Human
ggagccuccagcugccccg

SEQ ID NO: 2161823 - RNA, 20 nt, Human
accuucccagcuagaauuca

SEQ ID NO: 2161824 - RNA, 11 nt, Human
caauaaaagac

SEQ ID NO: 2161825 - RNA, 19 nt, Human
aggucuaccaaaaaucuca

SEQ ID NO: 2161826 - RNA, 16 nt, Human
aggguguguaaguaga

SEQ ID NO: 2161827 - RNA, 22 nt, Human
cacuaguauuucuaugaaauau

SEQ ID NO: 2161828 - RNA, 16 nt, Human
auuuuuagugaaauau

SEQ ID NO: 2161829 - RNA, 19 nt, Human
gcccacuuccucccggccg

SEQ ID NO: 2161830 - RNA, 21 nt, Human
aggcucuuuugggauuuuuga

SEQ ID NO: 2161831 - RNA, 19 nt, Human
ucuugugaacccaaagugu

SEQ ID NO: 2161832 - RNA, 14 nt, Human
ugaagauguagagg

SEQ ID NO: 2161833 - RNA, 17 nt, Human
cgcgagcgcgcgcgccc

SEQ ID NO: 2161834 - RNA, 15 nt, Human
gucccaggcugagcc

SEQ ID NO: 2161835 - RNA, 17 nt, Human
gcuauugggguuggggg

SEQ ID NO: 2161836 - RNA, 16 nt, Human
cugagcuugcagagau

SEQ ID NO: 2161837 - RNA, 19 nt, Human
cagagaugaggccgccaug

SEQ ID NO: 2161838 - RNA, 12 nt, Human
uuaauaaaccau

SEQ ID NO: 2161839 - RNA, 15 nt, Human
uaaaacuuuuccaau

SEQ ID NO: 2161840 - RNA, 16 nt, Human
cugcacuccagccuga

SEQ ID NO: 2161841 - RNA, 13 nt, Human
acaagaaaugaaa

SEQ ID NO: 2161842 - RNA, 20 nt, Human
gccgggcgugguggugagug

SEQ ID NO: 2161843 - RNA, 15 nt, Human
gccuugggaccccug

SEQ ID NO: 2161844 - RNA, 17 nt, Human
aggguguguaaguagau

SEQ ID NO: 2161845 - RNA, 11 nt, Human
uuuuuuuaaaa

SEQ ID NO: 2161846 - RNA, 13 nt, Human
aggauuugaaauu

SEQ ID NO: 2161847 - RNA, 12 nt, Human
gaaucuuguaaa

SEQ ID NO: 2161848 - RNA, 19 nt, Human
agucaaauugugugaaagg

SEQ ID NO: 2161849 - RNA, 23 nt, Human
aauaauccucaguuuuugugaaa

SEQ ID NO: 2161850 - RNA, 15 nt, Human
ccugcaaagcccagc

SEQ ID NO: 2161851 - RNA, 17 nt, Human
uugccaaauauaaauaa

SEQ ID NO: 2161852 - RNA, 14 nt, Human
cgcugcgcgccgcg

SEQ ID NO: 2161853 - RNA, 19 nt, Human
agacucgggauuaguacac

SEQ ID NO: 2161854 - RNA, 13 nt, Human
gauggcaggaggc

SEQ ID NO: 2161855 - RNA, 20 nt, Human
uuugcaagccagauuuuccu

SEQ ID NO: 2161856 - RNA, 17 nt, Human
gaaaaucaggcuggcca

SEQ ID NO: 2161857 - RNA, 19 nt, Human
cuggacucaccucccccau

SEQ ID NO: 2161858 - RNA, 22 nt, Human
aaacauguuuaucguauuugau

SEQ ID NO: 2161859 - RNA, 15 nt, Human
guucugcagauaaac

SEQ ID NO: 2161860 - RNA, 16 nt, Human
cucgccacgcucuggg

SEQ ID NO: 2161861 - RNA, 22 nt, Human
gaggcggauugagaaggagcuc

SEQ ID NO: 2161862 - RNA, 13 nt, Human
aguaugaaaaugu

SEQ ID NO: 2161863 - RNA, 23 nt, Human
ccccugggaccaggcacccccag

SEQ ID NO: 2161864 - RNA, 18 nt, Human
cccucuucugacacuaaa

SEQ ID NO: 2161865 - RNA, 20 nt, Human
auauauuuuuuuuuuuaaaa

SEQ ID NO: 2161866 - RNA, 15 nt, Human
aggauggcaggaggc

SEQ ID NO: 2161867 - RNA, 18 nt, Human
gaaaauaacaauaaaaga

SEQ ID NO: 2161868 - RNA, 20 nt, Human
aaaaaccugagccccaaaag

SEQ ID NO: 2161869 - RNA, 14 nt, Human
gggaccugggccau

SEQ ID NO: 2161870 - RNA, 13 nt, Human
cgagccccaggcg

SEQ ID NO: 2161871 - RNA, 23 nt, Human
gucucccucccuuggggccuaug

SEQ ID NO: 2161872 - RNA, 22 nt, Human
guguccccuauccuacuucccc

SEQ ID NO: 2161873 - RNA, 23 nt, Human
ccagaucaagccugccucaauca

SEQ ID NO: 2161874 - RNA, 11 nt, Human
gggaccugggc

SEQ ID NO: 2161875 - RNA, 14 nt, Human
accugggccauagu

SEQ ID NO: 2161876 - RNA, 18 nt, Human
gcuccauuuuuagugaaa

SEQ ID NO: 2161877 - RNA, 17 nt, Human
ccugcucgcccacuucc

SEQ ID NO: 2161878 - RNA, 21 nt, Human
ccuaauuuguuuucccuucuu

SEQ ID NO: 2161879 - RNA, 15 nt, Human
cgcucggccugcucg

SEQ ID NO: 2161880 - RNA, 23 nt, Human
gcuuuggucuaucuuugagcgcc

SEQ ID NO: 2161881 - RNA, 15 nt, Human
auuugguaaggggaa

SEQ ID NO: 2161882 - RNA, 15 nt, Human
uauuuauuuuaauaa

SEQ ID NO: 2161883 - RNA, 13 nt, Human
ccaaggaugcccc

SEQ ID NO: 2161884 - RNA, 23 nt, Human
aguacucauacauguuacaacac

SEQ ID NO: 2161885 - RNA, 12 nt, Human
gaagaccucauu

SEQ ID NO: 2161886 - RNA, 18 nt, Human
cagagacagaaagcagaa

SEQ ID NO: 2161887 - RNA, 18 nt, Human
cccacuggacucaccucc

SEQ ID NO: 2161888 - RNA, 13 nt, Human
auccuagucucua

SEQ ID NO: 2161889 - RNA, 14 nt, Human
aauauuauguuaaa

SEQ ID NO: 2161890 - RNA, 17 nt, Human
aaauguucaucaaugaa

SEQ ID NO: 2161891 - RNA, 15 nt, Human
uagauaggccauggg

SEQ ID NO: 2161892 - RNA, 14 nt, Human
auuuguauaaaaua

SEQ ID NO: 2161893 - RNA, 17 nt, Human
augaauaucaguuauuu

SEQ ID NO: 2161894 - RNA, 16 nt, Human
auagucauucugccug

SEQ ID NO: 2161895 - RNA, 20 nt, Human
cugucacgugugggcaaugu

SEQ ID NO: 2161896 - RNA, 19 nt, Human
acuucccgcuguuccucgc

SEQ ID NO: 2161897 - RNA, 23 nt, Human
aacuuguaaaggaauuuaaaaau

SEQ ID NO: 2161898 - RNA, 14 nt, Human
ggcuccagcuggcc

SEQ ID NO: 2161899 - RNA, 12 nt, Human
auaacuggaaac

SEQ ID NO: 2161900 - RNA, 18 nt, Human
ccuugggaccccugagcu

SEQ ID NO: 2161901 - RNA, 22 nt, Human
cucugagccuugggaccccuga

SEQ ID NO: 2161902 - RNA, 14 nt, Human
ugagacucugucuc

SEQ ID NO: 2161903 - RNA, 20 nt, Human
accucugccucagaaaacaa

SEQ ID NO: 2161904 - RNA, 22 nt, Human
cucuggccuucggccuccaucc

SEQ ID NO: 2161905 - RNA, 22 nt, Human
gacucaccucccccaucucuuc

SEQ ID NO: 2161906 - RNA, 21 nt, Human
auccccaagccuggcaaggga

SEQ ID NO: 2161907 - RNA, 20 nt, Human
ucuucuggguuccuuccucu

SEQ ID NO: 2161908 - RNA, 20 nt, Human
cugauauuggacaguaaaau

SEQ ID NO: 2161909 - RNA, 16 nt, Human
gcgcagcucaggcugg

SEQ ID NO: 2161910 - RNA, 16 nt, Human
cggagccuccagcugc

SEQ ID NO: 2161911 - RNA, 17 nt, Human
ucuuucacauuuaaaua

SEQ ID NO: 2161912 - RNA, 21 nt, Human
aacuuguaaaggaauuuaaaa

SEQ ID NO: 2161913 - RNA, 12 nt, Human
aagagcuuaaca

SEQ ID NO: 2161914 - RNA, 22 nt, Human
aaccuacacgagauacagaauu

SEQ ID NO: 2161915 - RNA, 22 nt, Human
ggacaguaaaauccacagacca

SEQ ID NO: 2161916 - RNA, 19 nt, Human
uagugagcagucaggaaag

SEQ ID NO: 2161917 - RNA, 21 nt, Human
aggguuaugauuaaguaauga

SEQ ID NO: 2161918 - RNA, 19 nt, Human
accauuuuggcaagcucua

SEQ ID NO: 2161919 - RNA, 17 nt, Human
aggccaugggacaggga

SEQ ID NO: 2161920 - RNA, 16 nt, Human
ucuucaacucccugcc

SEQ ID NO: 2161921 - RNA, 23 nt, Human
uccaaacugacucuuaagaagac

SEQ ID NO: 2161922 - RNA, 14 nt, Human
ggagccuccagcug

SEQ ID NO: 2161923 - RNA, 20 nt, Human
uaaaagacagugaaagaaaa

SEQ ID NO: 2161924 - RNA, 20 nt, Human
uguaaaggaauuuaaaaauc

SEQ ID NO: 2161925 - RNA, 19 nt, Human
aagugugacucauuaaaug

SEQ ID NO: 2161926 - RNA, 13 nt, Human
agccgggaaagaa

SEQ ID NO: 2161927 - RNA, 22 nt, Human
accccugagcuugcagagauga

SEQ ID NO: 2161928 - RNA, 17 nt, Human
ucuauaauguguucauu

SEQ ID NO: 2161929 - RNA, 17 nt, Human
cccggccggcgcgcuca

SEQ ID NO: 2161930 - RNA, 17 nt, Human
acaaaugggaaacaaaa

SEQ ID NO: 2161931 - RNA, 16 nt, Human
uuguaaaggaauuuaa

SEQ ID NO: 2161932 - RNA, 20 nt, Human
gccugagcggaccuucccag

SEQ ID NO: 2161933 - RNA, 19 nt, Human
cuaagcuucacuguaaaau

SEQ ID NO: 2161934 - RNA, 17 nt, Human
caaacauauauaacaau

SEQ ID NO: 2161935 - RNA, 19 nt, Human
aagcuuguauuccuuuuuc

SEQ ID NO: 2161936 - RNA, 12 nt, Human
gaaggggcggcg

SEQ ID NO: 2161937 - RNA, 16 nt, Human
aaaaugugauauguac

SEQ ID NO: 2161938 - RNA, 20 nt, Human
cugcacacagcacgggggcc

SEQ ID NO: 2161939 - RNA, 21 nt, Human
uacauaaaguaugugcauauu

SEQ ID NO: 2161940 - RNA, 22 nt, Human
auucugagguaaccucauuauc

SEQ ID NO: 2161941 - RNA, 14 nt, Human
uccagauccuggaa

SEQ ID NO: 2161942 - RNA, 15 nt, Human
aucaaaggacaccau

SEQ ID NO: 2161943 - RNA, 14 nt, Human
agcucguggaacag

SEQ ID NO: 2161944 - RNA, 23 nt, Human
ccgcagggugaacugcagcgagu

SEQ ID NO: 2161945 - RNA, 16 nt, Human
cagauccccaagccug

SEQ ID NO: 2161946 - RNA, 20 nt, Human
acuccagugagacagcucug

SEQ ID NO: 2161947 - RNA, 17 nt, Human
acucaccucccccaucu

SEQ ID NO: 2161948 - RNA, 16 nt, Human
uacaaaugggaaacaa

SEQ ID NO: 2161949 - RNA, 23 nt, Human
ucaauaucuuuuuuuuaauaaac

SEQ ID NO: 2161950 - RNA, 15 nt, Human
gaagauguagaggag

SEQ ID NO: 2161951 - RNA, 20 nt, Human
aaagacagugaaagaaaaua

SEQ ID NO: 2161952 - RNA, 18 nt, Human
aaauggaaguaaauguug

SEQ ID NO: 2161953 - RNA, 13 nt, Human
gcggccuggucua

SEQ ID NO: 2161954 - RNA, 20 nt, Human
cugacacuaaaacaccucag

SEQ ID NO: 2161955 - RNA, 22 nt, Human
cacagauuugagcucagcccug

SEQ ID NO: 2161956 - RNA, 12 nt, Human
aacuuauuugua

SEQ ID NO: 2161957 - RNA, 20 nt, Human
auaacaaugcuguauuuuaa

SEQ ID NO: 2161958 - RNA, 15 nt, Human
ggagccuccagcugc

SEQ ID NO: 2161959 - RNA, 20 nt, Human
cuggccuucggccuccaucc

SEQ ID NO: 2161960 - RNA, 20 nt, Human
cuacuuccccuuccuaauuc

SEQ ID NO: 2161961 - RNA, 20 nt, Human
aaauccuugaagauuuacca

SEQ ID NO: 2161962 - RNA, 17 nt, Human
uaacugauuuguaacaa

SEQ ID NO: 2161963 - RNA, 22 nt, Human
cgcgcgccuccgcuacuuccag

SEQ ID NO: 2161964 - RNA, 17 nt, Human
cgcucaucccacccgcc

SEQ ID NO: 2161965 - RNA, 14 nt, Human
cgcgcccucuggcu

SEQ ID NO: 2161966 - RNA, 17 nt, Human
ucauacuucuuaggguu

SEQ ID NO: 2161967 - RNA, 15 nt, Human
ccaaggagccaaaca

SEQ ID NO: 2161968 - RNA, 15 nt, Human
gagccggagccucca

SEQ ID NO: 2161969 - RNA, 16 nt, Human
uguccccuauccuacu

SEQ ID NO: 2161970 - RNA, 13 nt, Human
uuuauuauauaua

SEQ ID NO: 2161971 - RNA, 16 nt, Human
aagguccuggcaaaga

SEQ ID NO: 2161972 - RNA, 16 nt, Human
uccuguaauggaagca

SEQ ID NO: 2161973 - RNA, 19 nt, Human
agcucugcccauccugccc

SEQ ID NO: 2161974 - RNA, 17 nt, Human
ugaaaaucuuauaauuu

SEQ ID NO: 2161975 - RNA, 23 nt, Human
gagguaccagccuuggauacucc

SEQ ID NO: 2161976 - RNA, 19 nt, Human
caucaaggguacacugccu

SEQ ID NO: 2161977 - RNA, 18 nt, Human
auucacuccacuuggaca

SEQ ID NO: 2161978 - RNA, 16 nt, Human
cuucugggcagacucu

SEQ ID NO: 2161979 - RNA, 21 nt, Human
aggauggcaggaggcauccaa

SEQ ID NO: 2161980 - RNA, 18 nt, Human
auuugcuggagcucugcc

SEQ ID NO: 2161981 - RNA, 10 nt, Human
acuuccuccc

SEQ ID NO: 2161982 - RNA, 18 nt, Human
uaagcuucacuguaaaau

SEQ ID NO: 2161983 - RNA, 22 nt, Human
agcccuccuuaucaaaggacac

SEQ ID NO: 2161984 - RNA, 14 nt, Human
cgagcgcgcgcgcc

SEQ ID NO: 2161985 - RNA, 15 nt, Human
acugaagaagcacca

SEQ ID NO: 2161986 - RNA, 15 nt, Human
aguaugugcauauuu

SEQ ID NO: 2161987 - RNA, 23 nt, Human
aauauuuauuuuaauaauguuuc

SEQ ID NO: 2161988 - RNA, 18 nt, Human
cagcuuauugucuaguga

SEQ ID NO: 2161989 - RNA, 15 nt, Human
cagccccugggacca

SEQ ID NO: 2161990 - RNA, 20 nt, Human
ccugccuaagugcagccccg

SEQ ID NO: 2161991 - RNA, 15 nt, Human
aguaaauguuguuuu

SEQ ID NO: 2161992 - RNA, 12 nt, Human
aaaagaaagaaa

SEQ ID NO: 2161993 - RNA, 17 nt, Human
ucaauccaagaacuuau

SEQ ID NO: 2161994 - RNA, 17 nt, Human
uccuacaagacacagug

SEQ ID NO: 2161995 - RNA, 19 nt, Human
ggaaaaaauaacaaugaaa

SEQ ID NO: 2161996 - RNA, 22 nt, Human
agacccacuggacucaccuccc

SEQ ID NO: 2161997 - RNA, 13 nt, Human
caugggccccaga

SEQ ID NO: 2161998 - RNA, 18 nt, Human
auccuucagccugaaaga

SEQ ID NO: 2161999 - RNA, 23 nt, Human
agcaugucgucaaagcugaaaug

SEQ ID NO: 2162000 - RNA, 23 nt, Human
caccaaggagccaaacauccuac

SEQ ID NO: 2162001 - RNA, 23 nt, Human
ggacggcuccggacgcugcugcc

SEQ ID NO: 2162002 - RNA, 13 nt, Human
ccucccccaucuc

SEQ ID NO: 2162003 - RNA, 11 nt, Human
ggggaggggcg

SEQ ID NO: 2162004 - RNA, 23 nt, Human
ggcuaagcuucacuguaaaauaa

SEQ ID NO: 2162005 - RNA, 14 nt, Human
uauuuauuuuaaua

SEQ ID NO: 2162006 - RNA, 14 nt, Human
gucauucugccugc

SEQ ID NO: 2162007 - RNA, 17 nt, Human
acuuccagauccuggaa

SEQ ID NO: 2162008 - RNA, 21 nt, Human
auguuuacagauccccaagcc

SEQ ID NO: 2162009 - RNA, 17 nt, Human
aaauauaaauaaaaaua

SEQ ID NO: 2162010 - RNA, 12 nt, Human
auccugugggac

SEQ ID NO: 2162011 - RNA, 23 nt, Human
uuguaaagguccuggcaaagaug

SEQ ID NO: 2162012 - RNA, 15 nt, Human
accuucccagcuaga

SEQ ID NO: 2162013 - RNA, 12 nt, Human
acccccugggag

SEQ ID NO: 2162014 - RNA, 15 nt, Human
ccagcacagccucuu

SEQ ID NO: 2162015 - RNA, 22 nt, Human
auaucuuuuuuuuaauaaacca

SEQ ID NO: 2162016 - RNA, 13 nt, Human
ugugcggccuggu

SEQ ID NO: 2162017 - RNA, 17 nt, Human
caagaaaugaaagcagg

SEQ ID NO: 2162018 - RNA, 12 nt, Human
uauuauuuuuua

SEQ ID NO: 2162019 - RNA, 15 nt, Human
uugacacuuaaaaau

SEQ ID NO: 2162020 - RNA, 19 nt, Human
aaaacguauugcauuuaau

SEQ ID NO: 2162021 - RNA, 21 nt, Human
accaccugccuauauuuuuug

SEQ ID NO: 2162022 - RNA, 15 nt, Human
aggagcucccaggag

SEQ ID NO: 2162023 - RNA, 22 nt, Human
aaacaccucagcugccucccca

SEQ ID NO: 2162024 - RNA, 17 nt, Human
uuauuacuguaagaaaa

SEQ ID NO: 2162025 - RNA, 14 nt, Human
uuauuauauuuaca

SEQ ID NO: 2162026 - RNA, 22 nt, Human
uuuauugaggcuuuaaaacuua

SEQ ID NO: 2162027 - RNA, 17 nt, Human
uccauccugaggcucca

SEQ ID NO: 2162028 - RNA, 16 nt, Human
uucaauaaaacuuuuc

SEQ ID NO: 2162029 - RNA, 18 nt, Human
gagccucagucucccucc

SEQ ID NO: 2162030 - RNA, 18 nt, Human
uggagggaagccuugggg

SEQ ID NO: 2162031 - RNA, 13 nt, Human
uuuaaaaaaaaac

SEQ ID NO: 2162032 - RNA, 16 nt, Human
cuguucgcgcgccucc

SEQ ID NO: 2162033 - RNA, 15 nt, Human
ccaggcggguccggg

SEQ ID NO: 2162034 - RNA, 14 nt, Human
accacaagacugca

SEQ ID NO: 2162035 - RNA, 18 nt, Human
aguucuccacuagcuaug

SEQ ID NO: 2162036 - RNA, 23 nt, Human
ucuccauguacuggcaagaccug

SEQ ID NO: 2162037 - RNA, 15 nt, Human
gccccauucaacauc

SEQ ID NO: 2162038 - RNA, 18 nt, Human
ccaggaggggcuucuggg

SEQ ID NO: 2162039 - RNA, 18 nt, Human
caugaagauguagaggag

SEQ ID NO: 2162040 - RNA, 15 nt, Human
uacaaaugcauuucu

SEQ ID NO: 2162041 - RNA, 16 nt, Human
augaauacuuuauaaa

SEQ ID NO: 2162042 - RNA, 20 nt, Human
cuugccauaauuacuauguc

SEQ ID NO: 2162043 - RNA, 14 nt, Human
gacggagccgggaa

SEQ ID NO: 2162044 - RNA, 15 nt, Human
ccagauccuggaaau

SEQ ID NO: 2162045 - RNA, 16 nt, Human
ccccaucucuucuggg

SEQ ID NO: 2162046 - RNA, 17 nt, Human
guguccccuauccuacu

SEQ ID NO: 2162047 - RNA, 17 nt, Human
aaacaccucagcugccu

SEQ ID NO: 2162048 - RNA, 19 nt, Human
ggagccugaucaccugccc

SEQ ID NO: 2162049 - RNA, 23 nt, Human
gcagacucuggucaagaagcauc

SEQ ID NO: 2162050 - RNA, 19 nt, Human
cuguacgcgagcgcgcgcg

SEQ ID NO: 2162051 - RNA, 18 nt, Human
gcgcuggcugcgcucggc

SEQ ID NO: 2162052 - RNA, 14 nt, Human
cgcuccgcgcagcu

SEQ ID NO: 2162053 - RNA, 15 nt, Human
gcccugugcggccug

SEQ ID NO: 2162054 - RNA, 21 nt, Human
accagagccugaguguugccu

SEQ ID NO: 2162055 - RNA, 14 nt, Human
gauaaaagacagug

SEQ ID NO: 2162056 - RNA, 19 nt, Human
gcucauggaauuggagcuc

SEQ ID NO: 2162057 - RNA, 19 nt, Human
ucaguccaugaagauguag

SEQ ID NO: 2162058 - RNA, 16 nt, Human
cagggcuacgcgcgcu

SEQ ID NO: 2162059 - RNA, 21 nt, Human
cucccaggaggggcuucuggg

SEQ ID NO: 2162060 - RNA, 15 nt, Human
uagggugauauuaac

SEQ ID NO: 2162061 - RNA, 15 nt, Human
aaggaaaaaauaaca

SEQ ID NO: 2162062 - RNA, 20 nt, Human
cucccugccccccagcccuc

SEQ ID NO: 2162063 - RNA, 23 nt, Human
ggucucagugucaaugcagcccc

SEQ ID NO: 2162064 - RNA, 22 nt, Human
ugggccccagauaccaugaugc

SEQ ID NO: 2162065 - RNA, 17 nt, Human
ucuggcguuguggggau

SEQ ID NO: 2162066 - RNA, 14 nt, Human
agucugacuguuuc

SEQ ID NO: 2162067 - RNA, 19 nt, Human
acaaauuuacagagacaga

SEQ ID NO: 2162068 - RNA, 17 nt, Human
auggcuaguaucaaaag

SEQ ID NO: 2162069 - RNA, 21 nt, Human
uuuauagccagguaccuucuc

SEQ ID NO: 2162070 - RNA, 17 nt, Human
gcgcgcuccgcgcagcu

SEQ ID NO: 2162071 - RNA, 15 nt, Human
auaauuuugugaagc

SEQ ID NO: 2162072 - RNA, 21 nt, Human
guggggaugaacuuuuuguuu

SEQ ID NO: 2162073 - RNA, 23 nt, Human
cuggccgggagccugaucaccug

SEQ ID NO: 2162074 - RNA, 21 nt, Human
ggguucccgugugccugagcg

SEQ ID NO: 2162075 - RNA, 19 nt, Human
uaggggggucagccagccc

SEQ ID NO: 2162076 - RNA, 16 nt, Human
agagguccacaacaca

SEQ ID NO: 2162077 - RNA, 14 nt, Human
cugaaagucccaga

SEQ ID NO: 2162078 - RNA, 15 nt, Human
cauucugccugcccu

SEQ ID NO: 2162079 - RNA, 14 nt, Human
cucagcugccuccc

SEQ ID NO: 2162080 - RNA, 16 nt, Human
gagcucgugggacagu

SEQ ID NO: 2162081 - RNA, 13 nt, Human
aagacaaggaaaa

SEQ ID NO: 2162082 - RNA, 16 nt, Human
ccgcauccuagucucu

SEQ ID NO: 2162083 - RNA, 13 nt, Human
gguccacaacaca

SEQ ID NO: 2162084 - RNA, 22 nt, Human
gccauagucauucugccugccc

SEQ ID NO: 2162085 - RNA, 22 nt, Human
agacucgggauuaguacacacu

SEQ ID NO: 2162086 - RNA, 21 nt, Human
caagacccaaaaggcagaagc

SEQ ID NO: 2162087 - RNA, 22 nt, Human
agaugaucaguaugaaaauguc

SEQ ID NO: 2162088 - RNA, 21 nt, Human
ccgacggagccgggaaagaag

SEQ ID NO: 2162089 - RNA, 19 nt, Human
gcugcugguggcgcuggcu

SEQ ID NO: 2162090 - RNA, 18 nt, Human
ugugaccacugcagaaga

SEQ ID NO: 2162091 - RNA, 22 nt, Human
uguugcccacagcuguaugauu

SEQ ID NO: 2162092 - RNA, 14 nt, Human
cggggagcgagccc

SEQ ID NO: 2162093 - RNA, 22 nt, Human
gugugaccacugcagaagacag

SEQ ID NO: 2162094 - RNA, 14 nt, Human
cgagccccaggcgg

SEQ ID NO: 2162095 - RNA, 12 nt, Human
cauaaaguaugu

SEQ ID NO: 2162096 - RNA, 16 nt, Human
gcuucacuguaaaaua

SEQ ID NO: 2162097 - RNA, 20 nt, Human
aggcugagaugggagaauca

SEQ ID NO: 2162098 - RNA, 16 nt, Human
cacgggggccaaggau

SEQ ID NO: 2162099 - RNA, 13 nt, Human
ugggaggcugaga

SEQ ID NO: 2162100 - RNA, 14 nt, Human
agaugcuagaacuc

SEQ ID NO: 2162101 - RNA, 21 nt, Human
ucaagucuuucacauuuaaau

SEQ ID NO: 2162102 - RNA, 15 nt, Human
uuaauucugaaagca

SEQ ID NO: 2162103 - RNA, 16 nt, Human
aaacuuuuccaaugac

SEQ ID NO: 2162104 - RNA, 15 nt, Human
ccuguucgcgcgccu

SEQ ID NO: 2162105 - RNA, 14 nt, Human
ucucuaucauuaaa

SEQ ID NO: 2162106 - RNA, 18 nt, Human
acaaaugcauuucuaaag

SEQ ID NO: 2162107 - RNA, 18 nt, Human
ugggcacaggguuuaugu

SEQ ID NO: 2162108 - RNA, 21 nt, Human
guauacugugugcuaaaacaa

SEQ ID NO: 2162109 - RNA, 20 nt, Human
uagaugcaguucugaagaag

SEQ ID NO: 2162110 - RNA, 16 nt, Human
cuccauccugaggcuc

SEQ ID NO: 2162111 - RNA, 22 nt, Human
gaaaacaauaacgauaaaagac

SEQ ID NO: 2162112 - RNA, 22 nt, Human
auggaaauguuuacagaucccc

SEQ ID NO: 2162113 - RNA, 18 nt, Human
agccggagccuccagcug

SEQ ID NO: 2162114 - RNA, 12 nt, Human
gcgagccccagg

SEQ ID NO: 2162115 - RNA, 15 nt, Human
ucaguuuuugugaaa

SEQ ID NO: 2162116 - RNA, 17 nt, Human
gcuguacgcgagcgcgc

SEQ ID NO: 2162117 - RNA, 21 nt, Human
aaaugucuugcuugauuguau

SEQ ID NO: 2162118 - RNA, 18 nt, Human
acugccuucucaacucca

SEQ ID NO: 2162119 - RNA, 22 nt, Human
uuuauagcuacuaauuuuaaaa

SEQ ID NO: 2162120 - RNA, 19 nt, Human
aauuuuguuauguauauuu

SEQ ID NO: 2162121 - RNA, 18 nt, Human
gaaacaaaaggauaauga

SEQ ID NO: 2162122 - RNA, 21 nt, Human
acaugggugcuauugggguug

SEQ ID NO: 2162123 - RNA, 22 nt, Human
uauuucuaugaaauauuauguu

SEQ ID NO: 2162124 - RNA, 22 nt, Human
ccccuuccuaauuccacagcug

SEQ ID NO: 2162125 - RNA, 17 nt, Human
cucagucucccucccuu

SEQ ID NO: 2162126 - RNA, 16 nt, Human
guuccuuccucugagc

SEQ ID NO: 2162127 - RNA, 20 nt, Human
gaaacauuugguaaggggaa

SEQ ID NO: 2162128 - RNA, 15 nt, Human
aaagaaagaaaauca

SEQ ID NO: 2162129 - RNA, 23 nt, Human
gcugccccggggaggggcgcucg

SEQ ID NO: 2162130 - RNA, 20 nt, Human
agccuuuuuuugaaaaaaag

SEQ ID NO: 2162131 - RNA, 13 nt, Human
cauuuguauaaaa

SEQ ID NO: 2162132 - RNA, 19 nt, Human
acaauaacgauaaaagaca

SEQ ID NO: 2162133 - RNA, 20 nt, Human
cccggccgcgcugcgcgccg

SEQ ID NO: 2162134 - RNA, 20 nt, Human
uaagugaaauaagccagaca

SEQ ID NO: 2162135 - RNA, 17 nt, Human
cucuuuugggauuuuug

SEQ ID NO: 2162136 - RNA, 12 nt, Human
cuaagaagugaa

SEQ ID NO: 2162137 - RNA, 22 nt, Human
aagacccaaaaggcagaagcaa

SEQ ID NO: 2162138 - RNA, 22 nt, Human
gccccggggaggggcgcucgcu

SEQ ID NO: 2162139 - RNA, 18 nt, Human
aucuacacuccagugaga

SEQ ID NO: 2162140 - RNA, 18 nt, Human
guuuaugguuguauuauu

SEQ ID NO: 2162141 - RNA, 13 nt, Human
gagcuaggggggu

SEQ ID NO: 2162142 - RNA, 12 nt, Human
cuggcuccagcu

SEQ ID NO: 2162143 - RNA, 17 nt, Human
cauauuuauagccaggu

SEQ ID NO: 2162144 - RNA, 18 nt, Human
auagggagggaaggggga

SEQ ID NO: 2162145 - RNA, 15 nt, Human
uuaauuuguaguguu

SEQ ID NO: 2162146 - RNA, 19 nt, Human
auaucaguuauuuuuaaac

SEQ ID NO: 2162147 - RNA, 12 nt, Human
agugcagccccg

SEQ ID NO: 2162148 - RNA, 21 nt, Human
gggagccugaucaccugcccu

SEQ ID NO: 2162149 - RNA, 21 nt, Human
cccccucuggcuccagcuggc

SEQ ID NO: 2162150 - RNA, 13 nt, Human
cugagacacaugg

SEQ ID NO: 2162151 - RNA, 15 nt, Human
cuaagcaaaauguga

SEQ ID NO: 2162152 - RNA, 22 nt, Human
gcggggagcgagccccaggcgg

SEQ ID NO: 2162153 - RNA, 23 nt, Human
cacuggacucaccucccccaucu

SEQ ID NO: 2162154 - RNA, 13 nt, Human
guggaaaaacaga

SEQ ID NO: 2162155 - RNA, 15 nt, Human
auuucauucaauauc

SEQ ID NO: 2162156 - RNA, 17 nt, Human
aaagcagggacuugaac

SEQ ID NO: 2162157 - RNA, 20 nt, Human
gcccauccugccccugagcc

SEQ ID NO: 2162158 - RNA, 19 nt, Human
gaggcagagguugcaguga

SEQ ID NO: 2162159 - RNA, 20 nt, Human
ccuccugccuaagugcagcc

SEQ ID NO: 2162160 - RNA, 23 nt, Human
ggaugguucccuugaugaagaag

SEQ ID NO: 2162161 - RNA, 18 nt, Human
acaggauggcaggaggca

SEQ ID NO: 2162162 - RNA, 18 nt, Human
auagcuacuaauuuuaaa

SEQ ID NO: 2162163 - RNA, 17 nt, Human
aaaguacaagagcuuaa

SEQ ID NO: 2162164 - RNA, 17 nt, Human
aauaacgauaaaagaca

SEQ ID NO: 2162165 - RNA, 23 nt, Human
ccccucuggcuccagcuggccgg

SEQ ID NO: 2162166 - RNA, 18 nt, Human
acugugugcuaaaacaag

SEQ ID NO: 2162167 - RNA, 12 nt, Human
gaauuggagcuc

SEQ ID NO: 2162168 - RNA, 15 nt, Human
aguucuucaaagaua

SEQ ID NO: 2162169 - RNA, 14 nt, Human
gacaugggccccag

SEQ ID NO: 2162170 - RNA, 14 nt, Human
uaauccuaaacaua

SEQ ID NO: 2162171 - RNA, 16 nt, Human
uuccgcauccuagucu

SEQ ID NO: 2162172 - RNA, 22 nt, Human
aggcccccgggccgacggagcc

SEQ ID NO: 2162173 - RNA, 15 nt, Human
ugccccgucccccuc

SEQ ID NO: 2162174 - RNA, 16 nt, Human
aaaaauuccaagugau

SEQ ID NO: 2162175 - RNA, 14 nt, Human
ugagcucagcccug

SEQ ID NO: 2162176 - RNA, 17 nt, Human
ccuacuuccccuuccua

SEQ ID NO: 2162177 - RNA, 16 nt, Human
cccccagcccuccuua

SEQ ID NO: 2162178 - RNA, 13 nt, Human
gauuguaaaaugg

SEQ ID NO: 2162179 - RNA, 15 nt, Human
caaggaaaaaauaac

SEQ ID NO: 2162180 - RNA, 20 nt, Human
aaauaauuuuuauauuugaa

SEQ ID NO: 2162181 - RNA, 19 nt, Human
uggugaacuugguuuuaau

SEQ ID NO: 2162182 - RNA, 21 nt, Human
ccucuguucugcacacagcac

SEQ ID NO: 2162183 - RNA, 18 nt, Human
gccccugcacuccagccu

SEQ ID NO: 2162184 - RNA, 13 nt, Human
cccaaaaggcaga

SEQ ID NO: 2162185 - RNA, 19 nt, Human
gguuccuuccucugagccu

SEQ ID NO: 2162186 - RNA, 20 nt, Human
cuuauucacaagacccaaaa

SEQ ID NO: 2162187 - RNA, 22 nt, Human
agaaugagagacacacugaaga

SEQ ID NO: 2162188 - RNA, 19 nt, Human
uggaacaguuaccucugcc

SEQ ID NO: 2162189 - RNA, 16 nt, Human
cgcuuccgcauccuag

SEQ ID NO: 2162190 - RNA, 15 nt, Human
uaacgauaaaagaca

SEQ ID NO: 2162191 - RNA, 21 nt, Human
ucccaggaggggcuucugggc

SEQ ID NO: 2162192 - RNA, 21 nt, Human
auuuacaaaugggaaacaaaa

SEQ ID NO: 2162193 - RNA, 14 nt, Human
cuguaaucacagcu

SEQ ID NO: 2162194 - RNA, 20 nt, Human
gaaaauaacgauaaaagaca

SEQ ID NO: 2162195 - RNA, 14 nt, Human
aaugauuaugaauu

SEQ ID NO: 2162196 - RNA, 20 nt, Human
auagucauucugccugcccu

SEQ ID NO: 2162197 - RNA, 16 nt, Human
ccccugcacuccagcc

SEQ ID NO: 2162198 - RNA, 18 nt, Human
aagggaauuucuucaacu

SEQ ID NO: 2162199 - RNA, 14 nt, Human
aaaagacagugaaa

SEQ ID NO: 2162200 - RNA, 13 nt, Human
gugcugcagcccc

SEQ ID NO: 2162201 - RNA, 16 nt, Human
guuuuguuucuuccuu

SEQ ID NO: 2162202 - RNA, 20 nt, Human
gccagcccucuucugacacu

SEQ ID NO: 2162203 - RNA, 14 nt, Human
ugcucauggaauug

SEQ ID NO: 2162204 - RNA, 19 nt, Human
uauauuuuugugauuuugu

SEQ ID NO: 2162205 - RNA, 22 nt, Human
uauuucagauaaucacaauaca

SEQ ID NO: 2162206 - RNA, 17 nt, Human
aaauaacgauaaaagac

SEQ ID NO: 2162207 - RNA, 15 nt, Human
cccucuucugacacu

SEQ ID NO: 2162208 - RNA, 17 nt, Human
ccccaguuguuucuacu

SEQ ID NO: 2162209 - RNA, 13 nt, Human
uaugaaauauuau

SEQ ID NO: 2162210 - RNA, 18 nt, Human
gcugagcccggaaacucc

SEQ ID NO: 2162211 - RNA, 17 nt, Human
aaccuagggugauauua

SEQ ID NO: 2162212 - RNA, 23 nt, Human
gcgcuggcugcgcucggccugcu

SEQ ID NO: 2162213 - RNA, 20 nt, Human
cacccccagaaugaccuggc

SEQ ID NO: 2162214 - RNA, 23 nt, Human
cuucaacucccugccccccagcc

SEQ ID NO: 2162215 - RNA, 17 nt, Human
ccaaaaaucucaauauu

SEQ ID NO: 2162216 - RNA, 18 nt, Human
caaggcuagaaccaccug

SEQ ID NO: 2162217 - RNA, 15 nt, Human
acucaacaaacauaa

SEQ ID NO: 2162218 - RNA, 17 nt, Human
ugaaauauuauuuuaua

SEQ ID NO: 2162219 - RNA, 18 nt, Human
ggagccgggaaagaagag

SEQ ID NO: 2162220 - RNA, 20 nt, Human
ugagcgcccacuagacccac

SEQ ID NO: 2162221 - RNA, 21 nt, Human
ugcucaauaaaguacaagagc

SEQ ID NO: 2162222 - RNA, 12 nt, Human
cggccggcgcgc

SEQ ID NO: 2162223 - RNA, 22 nt, Human
gugccucaccccuugccauaau

SEQ ID NO: 2162224 - RNA, 12 nt, Human
aauuuuaaaaug

SEQ ID NO: 2162225 - RNA, 13 nt, Human
uguauauuuuaua

SEQ ID NO: 2162226 - RNA, 21 nt, Human
ccaaagugugacucauuaaau

SEQ ID NO: 2162227 - RNA, 18 nt, Human
aaauauuuauuuuaauaa

SEQ ID NO: 2162228 - RNA, 11 nt, Human
cgauaaaagac

SEQ ID NO: 2162229 - RNA, 17 nt, Human
caaauccaaugaaauga

SEQ ID NO: 2162230 - RNA, 13 nt, Human
auaacgauaaaag

SEQ ID NO: 2162231 - RNA, 22 nt, Human
uugaaaaucuuauaauuuaaaa

SEQ ID NO: 2162232 - RNA, 20 nt, Human
uuacaaauccaaugaaauga

SEQ ID NO: 2162233 - RNA, 21 nt, Human
acgcucucuggccuucggccu

SEQ ID NO: 2162234 - RNA, 14 nt, Human
acagaauuuuaugc

SEQ ID NO: 2162235 - RNA, 14 nt, Human
uugaaauuguauua

SEQ ID NO: 2162236 - RNA, 20 nt, Human
agccuuggggcugaugcagu

SEQ ID NO: 2162237 - RNA, 15 nt, Human
ugagcgcccacuaga

SEQ ID NO: 2162238 - RNA, 19 nt, Human
cagaaagcagaacagugau

SEQ ID NO: 2162239 - RNA, 19 nt, Human
uuggcaagcucuaucacca

SEQ ID NO: 2162240 - RNA, 17 nt, Human
ccugugggaccugggcc

SEQ ID NO: 2162241 - RNA, 20 nt, Human
uuaaguuuuuuuuuaaaaaa

SEQ ID NO: 2162242 - RNA, 16 nt, Human
uagcuacuaauuuuaa

SEQ ID NO: 2162243 - RNA, 20 nt, Human
agaggagaaacuggaacucu

SEQ ID NO: 2162244 - RNA, 18 nt, Human
ccacuuggucugugagau

SEQ ID NO: 2162245 - RNA, 14 nt, Human
ccugccccccagcc

SEQ ID NO: 2162246 - RNA, 18 nt, Human
uuuuagugaaauauuauu

SEQ ID NO: 2162247 - RNA, 15 nt, Human
ucuggcuccagcugg

SEQ ID NO: 2162248 - RNA, 13 nt, Human
agaaaugaaagca

SEQ ID NO: 2162249 - RNA, 15 nt, Human
auaucaauuuaaaaa

SEQ ID NO: 2162250 - RNA, 15 nt, Human
uaucaauuuaaaaaa

SEQ ID NO: 2162251 - RNA, 19 nt, Human
caaggaugccccguccccc

SEQ ID NO: 2162252 - RNA, 19 nt, Human
acuggacucaccuccccca

SEQ ID NO: 2162253 - RNA, 23 nt, Human
uccagguagaggguguguaagua

SEQ ID NO: 2162254 - RNA, 13 nt, Human
caacucccugccc

SEQ ID NO: 2162255 - RNA, 22 nt, Human
cggccugcucgcccacuuccuc

SEQ ID NO: 2162256 - RNA, 13 nt, Human
ugaaaaucuuaua

SEQ ID NO: 2162257 - RNA, 22 nt, Human
auauauaacaaugcuguauuuu

SEQ ID NO: 2162258 - RNA, 23 nt, Human
uguugcccacagcuguaugauuc

SEQ ID NO: 2162259 - RNA, 23 nt, Human
ugcauagguuuaauaauuuuuaa

SEQ ID NO: 2162260 - RNA, 18 nt, Human
cuaucccaaccucuccca

SEQ ID NO: 2162261 - RNA, 13 nt, Human
cgcgcccucuggc

SEQ ID NO: 2162262 - RNA, 22 nt, Human
ccugggaccaggcacccccaga

SEQ ID NO: 2162263 - RNA, 16 nt, Human
gggccgacggagccgg

SEQ ID NO: 2162264 - RNA, 17 nt, Human
gacaaggaaaaaauaac

SEQ ID NO: 2162265 - RNA, 16 nt, Human
aucaagccugccucaa

SEQ ID NO: 2162266 - RNA, 19 nt, Human
gcagggugaacugcagcga

SEQ ID NO: 2162267 - RNA, 13 nt, Human
uuaugcuaaguga

SEQ ID NO: 2162268 - RNA, 17 nt, Human
aauguuguuuuaggaau

SEQ ID NO: 2162269 - RNA, 17 nt, Human
caaauauaaauaaaaau

SEQ ID NO: 2162270 - RNA, 22 nt, Human
cagcuagaauucacuccacuug

SEQ ID NO: 2162271 - RNA, 23 nt, Human
aggcacccccagaaugaccuggc

SEQ ID NO: 2162272 - RNA, 18 nt, Human
gcacuccagccugagcga

SEQ ID NO: 2162273 - RNA, 20 nt, Human
acagcccuucuuuccacaga

SEQ ID NO: 2162274 - RNA, 16 nt, Human
uucacauuuaaauaaa

SEQ ID NO: 2162275 - RNA, 21 nt, Human
cugcgcucggccugcucgccc

SEQ ID NO: 2162276 - RNA, 18 nt, Human
aaguugauaugccuuuuc

SEQ ID NO: 2162277 - RNA, 12 nt, Human
ccccugggacca

SEQ ID NO: 2162278 - RNA, 20 nt, Human
aagggcuguuauaaucuuuc

SEQ ID NO: 2162279 - RNA, 19 nt, Human
cagauccccaagccuggca

SEQ ID NO: 2162280 - RNA, 17 nt, Human
auuuuaauaauguuuca

SEQ ID NO: 2162281 - RNA, 18 nt, Human
gaaguaaauguuguuuua

SEQ ID NO: 2162282 - RNA, 20 nt, Human
agagacacacugaagaagca

SEQ ID NO: 2162283 - RNA, 20 nt, Human
uaacgauaaaagacagugaa

SEQ ID NO: 2162284 - RNA, 14 nt, Human
aaauauuauuuuau

SEQ ID NO: 2162285 - RNA, 14 nt, Human
agucucccucccuu

SEQ ID NO: 2162286 - RNA, 14 nt, Human
uaguaucaaaagaa

SEQ ID NO: 2162287 - RNA, 12 nt, Human
acugaaaucaua

SEQ ID NO: 2162288 - RNA, 16 nt, Human
cuuauaauuuaaaaua

SEQ ID NO: 2162289 - RNA, 10 nt, Human
caacucccug

SEQ ID NO: 2162290 - RNA, 17 nt, Human
ccugagcuugcagagau

SEQ ID NO: 2162291 - RNA, 18 nt, Human
cuuccucugagccuuggg

SEQ ID NO: 2162292 - RNA, 15 nt, Human
cacaggacagcccuu

SEQ ID NO: 2162293 - RNA, 17 nt, Human
cagugaaagaaaauaac

SEQ ID NO: 2162294 - RNA, 16 nt, Human
ccuggugggcagagag

SEQ ID NO: 2162295 - RNA, 18 nt, Human
acggcuccggacgcugcu

SEQ ID NO: 2162296 - RNA, 16 nt, Human
cacgugugggcaaugu

SEQ ID NO: 2162297 - RNA, 18 nt, Human
cugagggcauagaaguaa

SEQ ID NO: 2162298 - RNA, 15 nt, Human
agaauaccacaggaa

SEQ ID NO: 2162299 - RNA, 19 nt, Human
cucugcauacucauuagga

SEQ ID NO: 2162300 - RNA, 15 nt, Human
cuaguaauuggaaag

SEQ ID NO: 2162301 - RNA, 14 nt, Human
agaucaagccugcc

SEQ ID NO: 2162302 - RNA, 15 nt, Human
caccucagcugccuc

SEQ ID NO: 2162303 - RNA, 18 nt, Human
agagaaugagagacacac

SEQ ID NO: 2162304 - RNA, 20 nt, Human
aauuuugugaagcaaaauuu

SEQ ID NO: 2162305 - RNA, 18 nt, Human
uacuuuauuuucuauaau

SEQ ID NO: 2162306 - RNA, 23 nt, Human
gaggcauccaaaggcuccugaga

SEQ ID NO: 2162307 - RNA, 12 nt, Human
cuucaacucccu

SEQ ID NO: 2162308 - RNA, 21 nt, Human
gccugaucaccugcccugcug

SEQ ID NO: 2162309 - RNA, 17 nt, Human
aaacauccuacaagaca

SEQ ID NO: 2162310 - RNA, 11 nt, Human
uucacagggga

SEQ ID NO: 2162311 - RNA, 18 nt, Human
gaccccugagcuugcaga

SEQ ID NO: 2162312 - RNA, 20 nt, Human
agcugccccggggaggggcg

SEQ ID NO: 2162313 - RNA, 16 nt, Human
uuuucucuaggaaaua

SEQ ID NO: 2162314 - RNA, 14 nt, Human
gagagugaacaaau

SEQ ID NO: 2162315 - RNA, 16 nt, Human
uauccuacuuccccuu

SEQ ID NO: 2162316 - RNA, 22 nt, Human
agaccaaauugagcuagggggg

SEQ ID NO: 2162317 - RNA, 16 nt, Human
gcauccuagucucuau

SEQ ID NO: 2162318 - RNA, 17 nt, Human
gccgggaaagaagagcc

SEQ ID NO: 2162319 - RNA, 17 nt, Human
ugguucccuugaugaag

SEQ ID NO: 2162320 - RNA, 16 nt, Human
caauaacgauaaaaga

SEQ ID NO: 2162321 - RNA, 13 nt, Human
cugugcggccugg

SEQ ID NO: 2162322 - RNA, 19 nt, Human
acauuuguauaaaauaauu

SEQ ID NO: 2162323 - RNA, 16 nt, Human
agaucaagccugccuc

SEQ ID NO: 2162324 - RNA, 17 nt, Human
auauuuuuuuuuuuaaa

SEQ ID NO: 2162325 - RNA, 17 nt, Human
aagcuuuuuuugaauca

SEQ ID NO: 2162326 - RNA, 13 nt, Human
aagaaaauaacga

SEQ ID NO: 2162327 - RNA, 16 nt, Human
cuggccuucggccucc

SEQ ID NO: 2162328 - RNA, 21 nt, Human
acacuaaaacaccucagcugc

SEQ ID NO: 2162329 - RNA, 16 nt, Human
auccuugaagauuuac

SEQ ID NO: 2162330 - RNA, 17 nt, Human
ugaaggauuuauguuua

SEQ ID NO: 2162331 - RNA, 15 nt, Human
cucgcccacuuccuc

SEQ ID NO: 2162332 - RNA, 14 nt, Human
ugaaagucccagau

SEQ ID NO: 2162333 - RNA, 23 nt, Human
agccuugggaccccugagcuugc

SEQ ID NO: 2162334 - RNA, 16 nt, Human
uuauaauuuaaaauau

SEQ ID NO: 2162335 - RNA, 21 nt, Human
caucccacccgcccaccgcag

SEQ ID NO: 2162336 - RNA, 13 nt, Human
ccaaauugagcua

SEQ ID NO: 2162337 - RNA, 16 nt, Human
ccagaucaagccugcc

SEQ ID NO: 2162338 - RNA, 16 nt, Human
uaaaggaauuuaaaaa

SEQ ID NO: 2162339 - RNA, 20 nt, Human
gacggcuccggacgcugcug

SEQ ID NO: 2162340 - RNA, 15 nt, Human
uuauagcuacuaauu

SEQ ID NO: 2162341 - RNA, 19 nt, Human
uaucucauuuccaagcaag

SEQ ID NO: 2162342 - RNA, 14 nt, Human
auaccaugaugcug

SEQ ID NO: 2162343 - RNA, 18 nt, Human
gagccgggaaagaagagc

SEQ ID NO: 2162344 - RNA, 21 nt, Human
gcugagucccaggcugagccu

SEQ ID NO: 2162345 - RNA, 18 nt, Human
uauuuucaguuauuauau

SEQ ID NO: 2162346 - RNA, 15 nt, Human
cucgugggacaguca

SEQ ID NO: 2162347 - RNA, 16 nt, Human
aagcauuuagauguau

SEQ ID NO: 2162348 - RNA, 15 nt, Human
gcagagguugcagug

SEQ ID NO: 2162349 - RNA, 21 nt, Human
cuuuuccaaugacauuuuguu

SEQ ID NO: 2162350 - RNA, 15 nt, Human
ccucuucugacacua

SEQ ID NO: 2162351 - RNA, 23 nt, Human
ccacuuggacaugggccccagau

SEQ ID NO: 2162352 - RNA, 20 nt, Human
guauuauuuuuuaaaaaaau

SEQ ID NO: 2162353 - RNA, 23 nt, Human
uagauaggucagugcaaauacuc

SEQ ID NO: 2162354 - RNA, 15 nt, Human
gccucagucucccuc

SEQ ID NO: 2162355 - RNA, 12 nt, Human
aaugcagccccc

SEQ ID NO: 2162356 - RNA, 14 nt, Human
gugagcuacaaaug

SEQ ID NO: 2162357 - RNA, 13 nt, Human
aaaauaacaauga

SEQ ID NO: 2162358 - RNA, 14 nt, Human
acauagugaggagc

SEQ ID NO: 2162359 - RNA, 19 nt, Human
uuuauaucaauuuaaaaaa

SEQ ID NO: 2162360 - RNA, 22 nt, Human
aggacaccauuuuggcaagcuc

SEQ ID NO: 2162361 - RNA, 22 nt, Human
uaauaggcguaacuaauuuuaa

SEQ ID NO: 2162362 - RNA, 15 nt, Human
augguuguauuauuu

SEQ ID NO: 2162363 - RNA, 22 nt, Human
caauaaaagacaaggaaaaaau

SEQ ID NO: 2162364 - RNA, 14 nt, Human
cggccggcgcgcuc

SEQ ID NO: 2162365 - RNA, 17 nt, Human
gcgccuccgcuacuucc

SEQ ID NO: 2162366 - RNA, 19 nt, Human
aaaauaacaauaaaagaca

SEQ ID NO: 2162367 - RNA, 15 nt, Human
gggaaagaagagccg

SEQ ID NO: 2162368 - RNA, 13 nt, Human
ccuccuuuuaaag

SEQ ID NO: 2162369 - RNA, 15 nt, Human
uccgcuacuuccagg

SEQ ID NO: 2162370 - RNA, 21 nt, Human
uagggugauauuaaccagggg

SEQ ID NO: 2162371 - RNA, 18 nt, Human
ccuguucgcgcgccuccg

SEQ ID NO: 2162372 - RNA, 18 nt, Human
agcuuugugcagauucuu

SEQ ID NO: 2162373 - RNA, 10 nt, Human
ggggaggggc

SEQ ID NO: 2162374 - RNA, 14 nt, Human
ucccaacuauaaaa

SEQ ID NO: 2162375 - RNA, 16 nt, Human
agcuugaaaccuucac

SEQ ID NO: 2162376 - RNA, 16 nt, Human
cugcugagucccaggc

SEQ ID NO: 2162377 - RNA, 18 nt, Human
ugccuaauuuguuuuccc

SEQ ID NO: 2162378 - RNA, 23 nt, Human
gcugccuccccagcucuauccca

SEQ ID NO: 2162379 - RNA, 14 nt, Human
aagcaacccaaaug

SEQ ID NO: 2162380 - RNA, 15 nt, Human
ucagucucccucccu

SEQ ID NO: 2162381 - RNA, 14 nt, Human
caggaggggcuucu

SEQ ID NO: 2162382 - RNA, 20 nt, Human
gcagagaugaggccgccaug

SEQ ID NO: 2162383 - RNA, 19 nt, Human
gaaagaaaauaacaauaaa

SEQ ID NO: 2162384 - RNA, 22 nt, Human
accuaacgaaguauccuucagc

SEQ ID NO: 2162385 - RNA, 22 nt, Human
cccuauccuacuuccccuuccu

SEQ ID NO: 2162386 - RNA, 21 nt, Human
gagccggagccuccagcugcc

SEQ ID NO: 2162387 - RNA, 18 nt, Human
ccugagcggaccuuccca

SEQ ID NO: 2162388 - RNA, 19 nt, Human
agagccggagccuccagcu

SEQ ID NO: 2162389 - RNA, 23 nt, Human
auauaacaaugcuguauuuuaaa

SEQ ID NO: 2162390 - RNA, 15 nt, Human
cugaaagaggaauga

SEQ ID NO: 2162391 - RNA, 22 nt, Human
caagcucuaucaccaaggagcc

SEQ ID NO: 2162392 - RNA, 23 nt, Human
gaaaaucuuauaauuuaaaauau

SEQ ID NO: 2162393 - RNA, 21 nt, Human
cucaguccaugaagauguaga

SEQ ID NO: 2162394 - RNA, 14 nt, Human
ucagucucccuccc

SEQ ID NO: 2162395 - RNA, 15 nt, Human
aagaaaauaacaaua

SEQ ID NO: 2162396 - RNA, 22 nt, Human
gcgcggcgggagggcgcggggc

SEQ ID NO: 2162397 - RNA, 22 nt, Human
ugaauggcuaagcaaaauguga

SEQ ID NO: 2162398 - RNA, 13 nt, Human
cgcgagcgcgcgc

SEQ ID NO: 2162399 - RNA, 19 nt, Human
cuucuggguuccuuccucu

SEQ ID NO: 2162400 - RNA, 23 nt, Human
guaauuccguagguuauuuucag

SEQ ID NO: 2162401 - RNA, 17 nt, Human
ucugugagaugcuagaa

SEQ ID NO: 2162402 - RNA, 23 nt, Human
uuuauaugcuucuguuuuauaau

SEQ ID NO: 2162403 - RNA, 16 nt, Human
augcuaagugaaauaa

SEQ ID NO: 2162404 - RNA, 20 nt, Human
auuacuguaagaaaauauca

SEQ ID NO: 2162405 - RNA, 18 nt, Human
aagaccucauuuugaagg

SEQ ID NO: 2162406 - RNA, 22 nt, Human
aaauguugacaugggacauuug

SEQ ID NO: 2162407 - RNA, 20 nt, Human
ccuucucaccugugagacca

SEQ ID NO: 2162408 - RNA, 14 nt, Human
ugguauguuuucag

SEQ ID NO: 2162409 - RNA, 20 nt, Human
agcccuggugggcagagagg

SEQ ID NO: 2162410 - RNA, 24 nt, Human
gccugcccugaaagucccagauca

SEQ ID NO: 2162411 - RNA, 15 nt, Human
gccucuuagaugcag

SEQ ID NO: 2162412 - RNA, 14 nt, Human
cuuggucugugaga

SEQ ID NO: 2162413 - RNA, 11 nt, Human
ccgugugccug

SEQ ID NO: 2162414 - RNA, 19 nt, Human
auugaggacacugauaugg

SEQ ID NO: 2162415 - RNA, 19 nt, Human
aaacaauaacgauaaaaga

SEQ ID NO: 2162416 - RNA, 13 nt, Human
aaauaaaaauaau

SEQ ID NO: 2162417 - RNA, 19 nt, Human
gccgcgcugcgcgccgcgc

SEQ ID NO: 2162418 - RNA, 20 nt, Human
uaauaaguugcauagguuua

SEQ ID NO: 2162419 - RNA, 19 nt, Human
uuccucccuucucuucaca

SEQ ID NO: 2162420 - RNA, 20 nt, Human
agaagagccggagccuccag

SEQ ID NO: 2162421 - RNA, 13 nt, Human
ugauuauauguca

SEQ ID NO: 2162422 - RNA, 22 nt, Human
ccgcgcagcucaggcuggcacc

SEQ ID NO: 2162423 - RNA, 22 nt, Human
gcucuaucccaaccucucccaa

SEQ ID NO: 2162424 - RNA, 16 nt, Human
auccaaugaaaugagu

SEQ ID NO: 2162425 - RNA, 19 nt, Human
auaaaagacagugaaagaa

SEQ ID NO: 2162426 - RNA, 15 nt, Human
auauugacuuuuuau

SEQ ID NO: 2162427 - RNA, 22 nt, Human
cugaggcuccacuuggucugug

SEQ ID NO: 2162428 - RNA, 17 nt, Human
guuuuaggaauacauaa

SEQ ID NO: 2162429 - RNA, 13 nt, Human
aacuauaaaacua

SEQ ID NO: 2162430 - RNA, 22 nt, Human
acaugagguacugagagugaac

SEQ ID NO: 2162431 - RNA, 13 nt, Human
aggggcgcucgcu

SEQ ID NO: 2162432 - RNA, 15 nt, Human
cccugccccccagcc

SEQ ID NO: 2162433 - RNA, 11 nt, Human
acugggacagg

SEQ ID NO: 2162434 - RNA, 23 nt, Human
cagcugccccggggaggggcgcu

SEQ ID NO: 2162435 - RNA, 17 nt, Human
aaaacaccucagcugcc

SEQ ID NO: 2162436 - RNA, 18 nt, Human
gaaaauaacgauaaaaga

SEQ ID NO: 2162437 - RNA, 20 nt, Human
accgcuguacgcgagcgcgc

SEQ ID NO: 2162438 - RNA, 15 nt, Human
aaggaauuuaaaaau

SEQ ID NO: 2162439 - RNA, 21 nt, Human
gaaaugaguuuuucuuuucau

SEQ ID NO: 2162440 - RNA, 23 nt, Human
ucuagcaugucgucaaagcugaa

SEQ ID NO: 2162441 - RNA, 17 nt, Human
ucagacauagaauuaac

SEQ ID NO: 2162442 - RNA, 21 nt, Human
auauauuuuuuuuuuuaaaaa

SEQ ID NO: 2162443 - RNA, 14 nt, Human
uucuaugaaauauu

SEQ ID NO: 2162444 - RNA, 17 nt, Human
uaucaauuuaaaaaaaa

SEQ ID NO: 2162445 - RNA, 18 nt, Human
uaguaucaaaagaaagaa

SEQ ID NO: 2162446 - RNA, 14 nt, Human
cucagucucccucc

SEQ ID NO: 2162447 - RNA, 21 nt, Human
auuccuuuuucucuccucucc

SEQ ID NO: 2162448 - RNA, 13 nt, Human
ccagaucaagccu

SEQ ID NO: 2162449 - RNA, 18 nt, Human
uuuauggcacuaguauuu

SEQ ID NO: 2162450 - RNA, 13 nt, Human
ggaaguagaggag

SEQ ID NO: 2162451 - RNA, 21 nt, Human
aauuuguuuucccuucuuaca

SEQ ID NO: 2162452 - RNA, 17 nt, Human
acccacuggacucaccu

SEQ ID NO: 2162453 - RNA, 20 nt, Human
cggcccugugcggccugguc

SEQ ID NO: 2162454 - RNA, 19 nt, Human
uggaaguaaauguuguuuu

SEQ ID NO: 2162455 - RNA, 21 nt, Human
gccuuuucccaacuccagaaa

SEQ ID NO: 2162456 - RNA, 23 nt, Human
aagagccggagccuccagcugcc

SEQ ID NO: 2162457 - RNA, 16 nt, Human
cugagcauuuaauaug

SEQ ID NO: 2162458 - RNA, 12 nt, Human
gagcucccagga

SEQ ID NO: 2162459 - RNA, 21 nt, Human
uacuucccgcuguuccucgcc

SEQ ID NO: 2162460 - RNA, 22 nt, Human
aaaucaggguuaguauugucca

SEQ ID NO: 2162461 - RNA, 15 nt, Human
aaaaauaacaaugaa

SEQ ID NO: 2162462 - RNA, 17 nt, Human
caaggcccccgggccga

SEQ ID NO: 2162463 - RNA, 15 nt, Human
cggagccuccagcug

SEQ ID NO: 2162464 - RNA, 17 nt, Human
agaaaugaaagcaggga

SEQ ID NO: 2162465 - RNA, 19 nt, Human
ccuccauccugaggcucca

SEQ ID NO: 2162466 - RNA, 15 nt, Human
uuuagugaaauauua

SEQ ID NO: 2162467 - RNA, 14 nt, Human
ggccgcagugaggc

SEQ ID NO: 2162468 - RNA, 20 nt, Human
ccaaccucucccaacuauaa

SEQ ID NO: 2162469 - RNA, 16 nt, Human
ugagaugcuagaacuc

SEQ ID NO: 2162470 - RNA, 23 nt, Human
cuagacccacuggacucaccucc

SEQ ID NO: 2162471 - RNA, 14 nt, Human
augaacuuuuuguu

SEQ ID NO: 2162472 - RNA, 16 nt, Human
gaagauguagaggaga

SEQ ID NO: 2162473 - RNA, 19 nt, Human
uaucacuugucaauaaaau

SEQ ID NO: 2162474 - RNA, 22 nt, Human
aauuuuuucucuaggaaauauu

SEQ ID NO: 2162475 - RNA, 15 nt, Human
aagcacuaaacaaag

SEQ ID NO: 2162476 - RNA, 12 nt, Human
cagauuuuccug

SEQ ID NO: 2162477 - RNA, 23 nt, Human
gggaaacaaaaggauaaugaaua

SEQ ID NO: 2162478 - RNA, 19 nt, Human
auuaaguuuuuuuuuaaaa

SEQ ID NO: 2162479 - RNA, 15 nt, Human
agggcucacagaauu

SEQ ID NO: 2162480 - RNA, 16 nt, Human
caggaggcauccaaag

SEQ ID NO: 2162481 - RNA, 22 nt, Human
cagcacgggggccaaggaugcc

SEQ ID NO: 2162482 - RNA, 20 nt, Human
aagacagugaaagaaaauaa

SEQ ID NO: 2162483 - RNA, 14 nt, Human
cugucucaguccau

SEQ ID NO: 2162484 - RNA, 12 nt, Human
caggacagcccu

SEQ ID NO: 2162485 - RNA, 14 nt, Human
uauaauuuaaauau

SEQ ID NO: 2162486 - RNA, 18 nt, Human
aaggaugccccguccccc

SEQ ID NO: 2162487 - RNA, 13 nt, Human
acuaauuuuaaaa

SEQ ID NO: 2162488 - RNA, 16 nt, Human
cugaucaccugcccug

SEQ ID NO: 2162489 - RNA, 21 nt, Human
aaguuuaugguuguauuauuu

SEQ ID NO: 2162490 - RNA, 23 nt, Human
ugcagagguccacaacacacaga

SEQ ID NO: 2162491 - RNA, 20 nt, Human
augggccccagauaccauga

SEQ ID NO: 2162492 - RNA, 20 nt, Human
ugggccccagauaccaugau

SEQ ID NO: 2162493 - RNA, 22 nt, Human
cgcccacuuccucccggccgcg

SEQ ID NO: 2162494 - RNA, 14 nt, Human
ugagaugcuagaac

SEQ ID NO: 2162495 - RNA, 22 nt, Human
cuagucucuaucauuaaaguuc

SEQ ID NO: 2162496 - RNA, 17 nt, Human
uaacgauaaaagacagu

SEQ ID NO: 2162497 - RNA, 20 nt, Human
cugguggcgcuggcugcgcu

SEQ ID NO: 2162498 - RNA, 13 nt, Human
gcucucuggccuu

SEQ ID NO: 2162499 - RNA, 22 nt, Human
gcuccgcgcagcucaggcuggc

SEQ ID NO: 2162500 - RNA, 23 nt, Human
agaguuuagcuggaaaaguaugu

SEQ ID NO: 2162501 - RNA, 18 nt, Human
cuuuucccaacuccagaa

SEQ ID NO: 2162502 - RNA, 14 nt, Human
ugcugcagccccug

SEQ ID NO: 2162503 - RNA, 20 nt, Human
aaaacaagcacuaaacaaag

SEQ ID NO: 2162504 - RNA, 21 nt, Human
uccauccugaggcuccacuug

SEQ ID NO: 2162505 - RNA, 16 nt, Human
aaaguguuugaaagcu

SEQ ID NO: 2162506 - RNA, 12 nt, Human
gccggcgcgcuc

SEQ ID NO: 2162507 - RNA, 18 nt, Human
acuguaaagcuuugugca

SEQ ID NO: 2162508 - RNA, 17 nt, Human
cuggagggaagccuugg

SEQ ID NO: 2162509 - RNA, 13 nt, Human
ugagcgacaguga

SEQ ID NO: 2162510 - RNA, 21 nt, Human
cugagcccggaaacuccacau

SEQ ID NO: 2162511 - RNA, 15 nt, Human
augaauuaaguuuuu

SEQ ID NO: 2162512 - RNA, 16 nt, Human
ggggcuucugggcaga

SEQ ID NO: 2162513 - RNA, 22 nt, Human
gauaaaagacagugaaagaaaa

SEQ ID NO: 2162514 - RNA, 23 nt, Human
aucacagcuacuugggaggcuga

SEQ ID NO: 2162515 - RNA, 18 nt, Human
acaugaacuuguaaagga

SEQ ID NO: 2162516 - RNA, 14 nt, Human
auauuuauuuuaau

SEQ ID NO: 2162517 - RNA, 18 nt, Human
auccugugggaccugggc

SEQ ID NO: 2162518 - RNA, 22 nt, Human
ggccauagucauucugccugcc

SEQ ID NO: 2162519 - RNA, 14 nt, Human
gauugagaaggagc

SEQ ID NO: 2162520 - RNA, 20 nt, Human
aauuuuuucucuaggaaaua

SEQ ID NO: 2162521 - RNA, 18 nt, Human
gggggucagccagcccuc

SEQ ID NO: 2162522 - RNA, 21 nt, Human
ucagccagcccucuucugaca

SEQ ID NO: 2162523 - RNA, 16 nt, Human
gucccagaucaagccu

SEQ ID NO: 2162524 - RNA, 21 nt, Human
uuuguauaaaauaauuuuuau

SEQ ID NO: 2162525 - RNA, 17 nt, Human
uccucugagccuuggga

SEQ ID NO: 2162526 - RNA, 22 nt, Human
caucucuucuggguuccuuccu

SEQ ID NO: 2162527 - RNA, 17 nt, Human
agcuucacuguaaaaua

SEQ ID NO: 2162528 - RNA, 20 nt, Human
cuaaaugucaaucagccuag

SEQ ID NO: 2162529 - RNA, 19 nt, Human
agccugaucaccugcccug

SEQ ID NO: 2162530 - RNA, 21 nt, Human
uuccuaauuccacagcugcuc

SEQ ID NO: 2162531 - RNA, 18 nt, Human
aaaaguucugcagauaaa

SEQ ID NO: 2162532 - RNA, 18 nt, Human
uccuaauuccacagcugc

SEQ ID NO: 2162533 - RNA, 12 nt, Human
uucucuaggaaa

SEQ ID NO: 2162534 - RNA, 19 nt, Human
ugcccugaaagucccagau

SEQ ID NO: 2162535 - RNA, 18 nt, Human
cuuugagcgcccacuaga

SEQ ID NO: 2162536 - RNA, 11 nt, Human
caacucccugc

SEQ ID NO: 2162537 - RNA, 13 nt, Human
ugaaauuguauua

SEQ ID NO: 2162538 - RNA, 15 nt, Human
acuuuuccaaugaca

SEQ ID NO: 2162539 - RNA, 21 nt, Human
acagugauuaccagggacuga

SEQ ID NO: 2162540 - RNA, 18 nt, Human
gaaggagcucccaggagg

SEQ ID NO: 2162541 - RNA, 14 nt, Human
ccucuccucucuuc

SEQ ID NO: 2162542 - RNA, 20 nt, Human
gauugugccccugcacucca

SEQ ID NO: 2162543 - RNA, 14 nt, Human
uuccgcauccuagu

SEQ ID NO: 2162544 - RNA, 16 nt, Human
cucagcccuggugggc

SEQ ID NO: 2162545 - RNA, 18 nt, Human
cccucuggcuccagcugg

SEQ ID NO: 2162546 - RNA, 17 nt, Human
aaauccuacuuucauaa

SEQ ID NO: 2162547 - RNA, 15 nt, Human
uguuaaaugauuuca

SEQ ID NO: 2162548 - RNA, 18 nt, Human
agccgggaaagaagagcc

SEQ ID NO: 2162549 - RNA, 16 nt, Human
ccaggcugagccucag

SEQ ID NO: 2162550 - RNA, 18 nt, Human
ccggagccuccagcugcc

SEQ ID NO: 2162551 - RNA, 12 nt, Human
uguuugaaagcu

SEQ ID NO: 2162552 - RNA, 14 nt, Human
ccaucccggccggc

SEQ ID NO: 2162553 - RNA, 15 nt, Human
ucuaugaaauauuau

SEQ ID NO: 2162554 - RNA, 12 nt, Human
caagccugccuc

SEQ ID NO: 2162555 - RNA, 22 nt, Human
aagagccuuuuuuugaaaaaaa

SEQ ID NO: 2162556 - RNA, 18 nt, Human
ccgcuacuuccagggcua

SEQ ID NO: 2162557 - RNA, 12 nt, Human
gucauuguucuu

SEQ ID NO: 2162558 - RNA, 17 nt, Human
ccacuggacucaccucc

SEQ ID NO: 2162559 - RNA, 23 nt, Human
gccugagcggaccuucccagcua

SEQ ID NO: 2162560 - RNA, 17 nt, Human
auaaaguaugugcauau

SEQ ID NO: 2162561 - RNA, 20 nt, Human
ugauuucugagcauuuaaua

SEQ ID NO: 2162562 - RNA, 18 nt, Human
auguuaaaacugggacag

SEQ ID NO: 2162563 - RNA, 18 nt, Human
uuacaaaugggaaacaaa

SEQ ID NO: 2162564 - RNA, 16 nt, Human
ucuuauaauuuaaaau

SEQ ID NO: 2162565 - RNA, 22 nt, Human
uuaaaaaaaaaacguauugcau

SEQ ID NO: 2162566 - RNA, 19 nt, Human
ccgggcgugguggugagug

SEQ ID NO: 2162567 - RNA, 14 nt, Human
aucaaaagaaagaa

SEQ ID NO: 2162568 - RNA, 19 nt, Human
uguaguguuggagaagaac

SEQ ID NO: 2162569 - RNA, 16 nt, Human
aagacugcacaucaaa

SEQ ID NO: 2162570 - RNA, 14 nt, Human
cagauuugagcuca

SEQ ID NO: 2162571 - RNA, 14 nt, Human
aauaguuuaugauu

SEQ ID NO: 2162572 - RNA, 23 nt, Human
gccagguaccuucucaccuguga

SEQ ID NO: 2162573 - RNA, 14 nt, Human
acuggacucaccuc

SEQ ID NO: 2162574 - RNA, 13 nt, Human
uuauucacaagac

SEQ ID NO: 2162575 - RNA, 17 nt, Human
gacgagaaaacaauaac

SEQ ID NO: 2162576 - RNA, 20 nt, Human
ccagcuugaaaccuucacuu

SEQ ID NO: 2162577 - RNA, 23 nt, Human
auuuuauagcuacuaauuuuaaa

SEQ ID NO: 2162578 - RNA, 16 nt, Human
ugugagaugcuagaac

SEQ ID NO: 2162579 - RNA, 16 nt, Human
auugucuagugaaacu

SEQ ID NO: 2162580 - RNA, 16 nt, Human
cagaucaagccugccu

SEQ ID NO: 2162581 - RNA, 13 nt, Human
aucuacacuccag

SEQ ID NO: 2162582 - RNA, 18 nt, Human
gaaaauaucacuugucaa

SEQ ID NO: 2162583 - RNA, 16 nt, Human
ucaucaaugaaugaau

SEQ ID NO: 2162584 - RNA, 20 nt, Human
cccugccccccagcccuccu

SEQ ID NO: 2162585 - RNA, 14 nt, Human
acccgggaggcaga

SEQ ID NO: 2162586 - RNA, 14 nt, Human
cucaacaaacauaa

SEQ ID NO: 2162587 - RNA, 21 nt, Human
cccccauuguggucacaggaa

SEQ ID NO: 2162588 - RNA, 22 nt, Human
gaaaaucuuauaauuuaaaaua

SEQ ID NO: 2162589 - RNA, 16 nt, Human
uauaugucacuuugcu

SEQ ID NO: 2162590 - RNA, 16 nt, Human
ucuucugacacuaaaa

SEQ ID NO: 2162591 - RNA, 19 nt, Human
ucaguuauuauauuuacaa

SEQ ID NO: 2162592 - RNA, 15 nt, Human
aaugaauggcuaagc

SEQ ID NO: 2162593 - RNA, 13 nt, Human
cacauuuaaauaa

SEQ ID NO: 2162594 - RNA, 17 nt, Human
augauuaaguaaugaua

SEQ ID NO: 2162595 - RNA, 19 nt, Human
auauauuuuuuuuuuuaaa

SEQ ID NO: 2162596 - RNA, 19 nt, Human
uugugccccugcacuccag

SEQ ID NO: 2162597 - RNA, 13 nt, Human
uuuugaaucauca

SEQ ID NO: 2162598 - RNA, 14 nt, Human
gauuaguacacacu

SEQ ID NO: 2162599 - RNA, 15 nt, Human
agcucuaucaccaag

SEQ ID NO: 2162600 - RNA, 12 nt, Human
ucuuaagaagac

SEQ ID NO: 2162601 - RNA, 13 nt, Human
ucauucugccugc

SEQ ID NO: 2162602 - RNA, 17 nt, Human
agaagagccggagccuc

SEQ ID NO: 2162603 - RNA, 20 nt, Human
uugaacccgggaggcagagg

SEQ ID NO: 2162604 - RNA, 12 nt, Human
gacagugaaaga

SEQ ID NO: 2162605 - RNA, 19 nt, Human
cccugccccccagcccucc

SEQ ID NO: 2162606 - RNA, 14 nt, Human
agccuccagcugcc

SEQ ID NO: 2162607 - RNA, 14 nt, Human
auuuauuuuaauaa

SEQ ID NO: 2162608 - RNA, 23 nt, Human
gauauuaaccaggggccaugaau

SEQ ID NO: 2162609 - RNA, 16 nt, Human
auccuacaagacacag

SEQ ID NO: 2162610 - RNA, 22 nt, Human
auauauauuuuuuuuuuuaaaa

SEQ ID NO: 2162611 - RNA, 20 nt, Human
aagaugguaccaccagucug

SEQ ID NO: 2162612 - RNA, 18 nt, Human
gcuaucaauccaagaacu

SEQ ID NO: 2162613 - RNA, 19 nt, Human
uuugccaaguucuccacua

SEQ ID NO: 2162614 - RNA, 12 nt, Human
gugggaccuggg

SEQ ID NO: 2162615 - RNA, 14 nt, Human
caaaugcauuucua

SEQ ID NO: 2162616 - RNA, 15 nt, Human
aaaauaacaaugaaa

SEQ ID NO: 2162617 - RNA, 18 nt, Human
agugucaaugcagccccc

SEQ ID NO: 2162618 - RNA, 22 nt, Human
uacaugagguacugagagugaa

SEQ ID NO: 2162619 - RNA, 17 nt, Human
aguauuucuaugaaaua

SEQ ID NO: 2162620 - RNA, 12 nt, Human
auuuuaaaagaa

SEQ ID NO: 2162621 - RNA, 16 nt, Human
ucaguuuuugugaaaa

SEQ ID NO: 2162622 - RNA, 17 nt, Human
gcgcccucuggcugcug

SEQ ID NO: 2162623 - RNA, 20 nt, Human
ccuguucgcgcgccuccgcu

SEQ ID NO: 2162624 - RNA, 12 nt, Human
cuugguuuuaau

SEQ ID NO: 2162625 - RNA, 23 nt, Human
uagucauucugccugcccugaaa

SEQ ID NO: 2162626 - RNA, 20 nt, Human
augucgucaaagcugaaaug

SEQ ID NO: 2162627 - RNA, 13 nt, Human
cagcucaggcugg

SEQ ID NO: 2162628 - RNA, 16 nt, Human
uuaauaauuuuuaauu

SEQ ID NO: 2162629 - RNA, 22 nt, Human
aaauaacaaugaaaguugauaa

SEQ ID NO: 2162630 - RNA, 18 nt, Human
cagggaggacgcucucug

SEQ ID NO: 2162631 - RNA, 22 nt, Human
cuucagccugaaagaggaauga

SEQ ID NO: 2162632 - RNA, 10 nt, Human
accugagccc

SEQ ID NO: 2162633 - RNA, 16 nt, Human
auuugaugcuacagga

SEQ ID NO: 2162634 - RNA, 23 nt, Human
auucugagguaaccucauuauca

SEQ ID NO: 2162635 - RNA, 20 nt, Human
uaaaagacaaggaaaaaaua

SEQ ID NO: 2162636 - RNA, 18 nt, Human
cagccucuuagaugcagu

SEQ ID NO: 2162637 - RNA, 14 nt, Human
ccucagcugccucc

SEQ ID NO: 2162638 - RNA, 19 nt, Human
gucuuucacauuuaaauaa

SEQ ID NO: 2162639 - RNA, 22 nt, Human
aaagcuuugugcagauucuuua

SEQ ID NO: 2162640 - RNA, 13 nt, Human
uucuauaauuuaa

SEQ ID NO: 2162641 - RNA, 16 nt, Human
ucuuggucucaguguc

SEQ ID NO: 2162642 - RNA, 16 nt, Human
cauuucuaaagccauu

SEQ ID NO: 2162643 - RNA, 13 nt, Human
acggggugaaacc

SEQ ID NO: 2162644 - RNA, 15 nt, Human
gccccugcacuccag

SEQ ID NO: 2162645 - RNA, 19 nt, Human
cuccgcuacuuccagggcu

SEQ ID NO: 2162646 - RNA, 17 nt, Human
agugauuaccagggacu

SEQ ID NO: 2162647 - RNA, 16 nt, Human
agggaggacgcucucu

SEQ ID NO: 2162648 - RNA, 12 nt, Human
ugagagacacac

SEQ ID NO: 2162649 - RNA, 14 nt, Human
auacaaaaaaaaaa

SEQ ID NO: 2162650 - RNA, 12 nt, Human
cauuauauuuau

SEQ ID NO: 2162651 - RNA, 13 nt, Human
ugaaagaaaauaa

SEQ ID NO: 2162652 - RNA, 22 nt, Human
ugaagcaaaauuuuuucucuag

SEQ ID NO: 2162653 - RNA, 16 nt, Human
aagcuucacuguaaaa

SEQ ID NO: 2162654 - RNA, 18 nt, Human
agauccccaagccuggca

SEQ ID NO: 2162655 - RNA, 16 nt, Human
uucucaccugugagac

SEQ ID NO: 2162656 - RNA, 18 nt, Human
cucccuuggggccuaugc

SEQ ID NO: 2162657 - RNA, 21 nt, Human
agcccuucuuuccacagaagc

SEQ ID NO: 2162658 - RNA, 18 nt, Human
cuccauccugaggcucca

SEQ ID NO: 2162659 - RNA, 18 nt, Human
caugaauuaguuuuauau

SEQ ID NO: 2162660 - RNA, 19 nt, Human
ugagcgcccacuagaccca

SEQ ID NO: 2162661 - RNA, 21 nt, Human
uuguaauuuuuuugugggaaa

SEQ ID NO: 2162662 - RNA, 14 nt, Human
agcgcgcgcgcccu

SEQ ID NO: 2162663 - RNA, 20 nt, Human
uaggaauugacccacaagaa

SEQ ID NO: 2162664 - RNA, 15 nt, Human
cauuccaagccucau

SEQ ID NO: 2162665 - RNA, 13 nt, Human
aacaauaaaagac

SEQ ID NO: 2162666 - RNA, 17 nt, Human
cuaguuguaauuuuuuu

SEQ ID NO: 2162667 - RNA, 16 nt, Human
aagaaaauaacaauaa

SEQ ID NO: 2162668 - RNA, 20 nt, Human
uuucuucaacucccugcccc

SEQ ID NO: 2162669 - RNA, 17 nt, Human
ccacugcagaagacagu

SEQ ID NO: 2162670 - RNA, 14 nt, Human
uaaauaaaaauaau

SEQ ID NO: 2162671 - RNA, 17 nt, Human
gccccccagcccuccuu

SEQ ID NO: 2162672 - RNA, 14 nt, Human
cucaccccuugcca

SEQ ID NO: 2162673 - RNA, 21 nt, Human
aucuuuuuuuuaauaaaccau

SEQ ID NO: 2162674 - RNA, 16 nt, Human
cauuuguauaaaauaa

SEQ ID NO: 2162675 - RNA, 14 nt, Streptococcus pneumoniae R6
uuuuucugauuuca

SEQ ID NO: 2162676 - RNA, 20 nt, Streptococcus pneumoniae R6
uuuuugccucaauaucuucu

SEQ ID NO: 2162677 - RNA, 13 nt, Streptococcus pneumoniae R6
uuuuugaguuucu

SEQ ID NO: 2162678 - RNA, 14 nt, Streptococcus pneumoniae R6
uuuuugauaagaua

SEQ ID NO: 2162679 - RNA, 13 nt, Streptococcus pneumoniae R6
uuuuuugauuuca

SEQ ID NO: 2162680 - RNA, 21 nt, Streptococcus pneumoniae R6
uuuucacgauucaucaagaga

SEQ ID NO: 2162681 - RNA, 18 nt, Streptococcus pneumoniae R6
uuucaacuauagccaucu

SEQ ID NO: 2162682 - RNA, 20 nt, Streptococcus pneumoniae R6
uuucauugaguauuauuuca

SEQ ID NO: 2162683 - RNA, 19 nt, Streptococcus pneumoniae R6
uuuauaauuuuaaagacuu

SEQ ID NO: 2162684 - RNA, 16 nt, Streptococcus pneumoniae R6
uuuauuuaaucauuua

SEQ ID NO: 2162685 - RNA, 18 nt, Streptococcus pneumoniae R6
uuuauauggaaaaaugga

SEQ ID NO: 2162686 - RNA, 14 nt, Streptococcus pneumoniae R6
uuuaacuugaacuu

SEQ ID NO: 2162687 - RNA, 13 nt, Streptococcus pneumoniae R6
uuuaagcugacuu

SEQ ID NO: 2162688 - RNA, 22 nt, Streptococcus pneumoniae R6
uugguaguuuggcacaccacga

SEQ ID NO: 2162689 - RNA, 15 nt, Streptococcus pneumoniae R6
uugucaauuuccauu

SEQ ID NO: 2162690 - RNA, 15 nt, Streptococcus pneumoniae R6
uuguuucgcuuagac

SEQ ID NO: 2162691 - RNA, 18 nt, Streptococcus pneumoniae R6
uuguggauagaacugacg

SEQ ID NO: 2162692 - RNA, 18 nt, Streptococcus pneumoniae R6
uuguggaugaaacugacg

SEQ ID NO: 2162693 - RNA, 18 nt, Streptococcus pneumoniae R6
uuguggauggaacugacg

SEQ ID NO: 2162694 - RNA, 23 nt, Streptococcus pneumoniae R6
uugauuuccauuucuuuucugac

SEQ ID NO: 2162695 - RNA, 14 nt, Streptococcus pneumoniae R6
uugauuuuacugau

SEQ ID NO: 2162696 - RNA, 21 nt, Streptococcus pneumoniae R6
uugauuccgucauguucauuu

SEQ ID NO: 2162697 - RNA, 16 nt, Streptococcus pneumoniae R6
uugaguugggauaaac

SEQ ID NO: 2162698 - RNA, 20 nt, Streptococcus pneumoniae R6
uugauccuggcucaggacga

SEQ ID NO: 2162699 - RNA, 23 nt, Streptococcus pneumoniae R6
uugaucccuugacguugcaaguu

SEQ ID NO: 2162700 - RNA, 13 nt, Streptococcus pneumoniae R6
uugccagguuucg

SEQ ID NO: 2162701 - RNA, 16 nt, Streptococcus pneumoniae R6
uugagaagagcuucuu

SEQ ID NO: 2162702 - RNA, 15 nt, Streptococcus pneumoniae R6
uugagaucucuuaga

SEQ ID NO: 2162703 - RNA, 19 nt, Streptococcus pneumoniae R6
uugagcuacguucugucaa

SEQ ID NO: 2162704 - RNA, 19 nt, Streptococcus pneumoniae R6
uugagguuuuagauaagac

SEQ ID NO: 2162705 - RNA, 22 nt, Streptococcus pneumoniae R6
uugaguaaccugcggcuaacuu

SEQ ID NO: 2162706 - RNA, 22 nt, Streptococcus pneumoniae R6
uugagaaaauaugggcuuacau

SEQ ID NO: 2162707 - RNA, 18 nt, Streptococcus pneumoniae R6
uuccgucaagagaugguu

SEQ ID NO: 2162708 - RNA, 23 nt, Streptococcus pneumoniae R6
uuccuagccuauuuuuuauuuca

SEQ ID NO: 2162709 - RNA, 18 nt, Streptococcus pneumoniae R6
uugaaguugauucaugac

SEQ ID NO: 2162710 - RNA, 13 nt, Streptococcus pneumoniae R6
uugaaugcuuacu

SEQ ID NO: 2162711 - RNA, 22 nt, Streptococcus pneumoniae R6
uggagcaucugguuucguagca

SEQ ID NO: 2162712 - RNA, 17 nt, Streptococcus pneumoniae R6
uggaguuuucaaugaua

SEQ ID NO: 2162713 - RNA, 20 nt, Streptococcus pneumoniae R6
uggcaaaaauaucauuaagu

SEQ ID NO: 2162714 - RNA, 19 nt, Streptococcus pneumoniae R6
ugugcagggcgcuacaaca

SEQ ID NO: 2162715 - RNA, 15 nt, Streptococcus pneumoniae R6
uguuaaugauagcuu

SEQ ID NO: 2162716 - RNA, 19 nt, Streptococcus pneumoniae R6
uguuaagugguugauaaau

SEQ ID NO: 2162717 - RNA, 23 nt, Streptococcus pneumoniae R6
ugguuuccuaguuugcucuauga

SEQ ID NO: 2162718 - RNA, 18 nt, Streptococcus pneumoniae R6
ugguaauaccuuuuauga

SEQ ID NO: 2162719 - RNA, 15 nt, Streptococcus pneumoniae R6
ugguaaagaggaaau

SEQ ID NO: 2162720 - RNA, 16 nt, Streptococcus pneumoniae R6
ugucacauugagaaag

SEQ ID NO: 2162721 - RNA, 21 nt, Streptococcus pneumoniae R6
uuagaagcagagguguacuau

SEQ ID NO: 2162722 - RNA, 21 nt, Streptococcus pneumoniae R6
uuagaaguagagguguacuau

SEQ ID NO: 2162723 - RNA, 18 nt, Streptococcus pneumoniae R6
uuaucaaaucgaucuguu

SEQ ID NO: 2162724 - RNA, 16 nt, Streptococcus pneumoniae R6
uuaucaaucaaacgcu

SEQ ID NO: 2162725 - RNA, 21 nt, Streptococcus pneumoniae R6
uuaaccucuugaaguucauuu

SEQ ID NO: 2162726 - RNA, 16 nt, Streptococcus pneumoniae R6
uuacaaucauagacuu

SEQ ID NO: 2162727 - RNA, 14 nt, Streptococcus pneumoniae R6
uuaaucauguaccu

SEQ ID NO: 2162728 - RNA, 19 nt, Streptococcus pneumoniae R6
uucauagcugcguucacuu

SEQ ID NO: 2162729 - RNA, 21 nt, Streptococcus pneumoniae R6
uucauccagcaggagaaaguu

SEQ ID NO: 2162730 - RNA, 17 nt, Streptococcus pneumoniae R6
uuccaagacuuucaauu

SEQ ID NO: 2162731 - RNA, 19 nt, Streptococcus pneumoniae R6
uuccaagagaccuuucaua

SEQ ID NO: 2162732 - RNA, 23 nt, Streptococcus pneumoniae R6
uucacuaguauucaucuuaucaa

SEQ ID NO: 2162733 - RNA, 16 nt, Streptococcus pneumoniae R6
uuauguucuaagaacu

SEQ ID NO: 2162734 - RNA, 17 nt, Streptococcus pneumoniae R6
ucgucacuaacaaagcu

SEQ ID NO: 2162735 - RNA, 15 nt, Streptococcus pneumoniae R6
ucuagucaucagaaa

SEQ ID NO: 2162736 - RNA, 18 nt, Streptococcus pneumoniae R6
ucuaucaacucaagaauu

SEQ ID NO: 2162737 - RNA, 16 nt, Streptococcus pneumoniae R6
ucuaucauuauacucu

SEQ ID NO: 2162738 - RNA, 17 nt, Streptococcus pneumoniae R6
ucuaacuucaauagacu

SEQ ID NO: 2162739 - RNA, 14 nt, Streptococcus pneumoniae R6
ucguccuugauuua

SEQ ID NO: 2162740 - RNA, 14 nt, Streptococcus pneumoniae R6
ucgauuacaaucau

SEQ ID NO: 2162741 - RNA, 16 nt, Streptococcus pneumoniae R6
ucgagccaauacugcu

SEQ ID NO: 2162742 - RNA, 13 nt, Streptococcus pneumoniae R6
ucgccguuuacgu

SEQ ID NO: 2162743 - RNA, 20 nt, Streptococcus pneumoniae R6
ucgccaauucuuucaagcgc

SEQ ID NO: 2162744 - RNA, 19 nt, Streptococcus pneumoniae R6
ugcccauaagcugaucaau

SEQ ID NO: 2162745 - RNA, 19 nt, Streptococcus pneumoniae R6
ugccugaacgcuagcuacu

SEQ ID NO: 2162746 - RNA, 16 nt, Streptococcus pneumoniae R6
ugcaaucaaguaacuu

SEQ ID NO: 2162747 - RNA, 14 nt, Streptococcus pneumoniae R6
ugacugucaauaua

SEQ ID NO: 2162748 - RNA, 23 nt, Streptococcus pneumoniae R6
ugacgagugaagaauugaaaguc

SEQ ID NO: 2162749 - RNA, 14 nt, Streptococcus pneumoniae R6
ugaccguugacuuc

SEQ ID NO: 2162750 - RNA, 15 nt, Streptococcus pneumoniae R6
ugaaacuagaauagg

SEQ ID NO: 2162751 - RNA, 21 nt, Streptococcus pneumoniae R6
ugaauauagauggucaaaaua

SEQ ID NO: 2162752 - RNA, 16 nt, Streptococcus pneumoniae R6
ugaauucccuuacucu

SEQ ID NO: 2162753 - RNA, 22 nt, Streptococcus pneumoniae R6
uauuagggaaacaaaagucuuc

SEQ ID NO: 2162754 - RNA, 11 nt, Streptococcus pneumoniae R6
uauuaucuuuc

SEQ ID NO: 2162755 - RNA, 17 nt, Streptococcus pneumoniae R6
uauuuuugcaagugcuc

SEQ ID NO: 2162756 - RNA, 13 nt, Streptococcus pneumoniae R6
ucaaaaacauaau

SEQ ID NO: 2162757 - RNA, 21 nt, Streptococcus pneumoniae R6
uauuuccuugaccaaguccuc

SEQ ID NO: 2162758 - RNA, 20 nt, Streptococcus pneumoniae R6
ucaacaagcuguagucagcu

SEQ ID NO: 2162759 - RNA, 23 nt, Streptococcus pneumoniae R6
ucaacaaaaucgggagauugagu

SEQ ID NO: 2162760 - RNA, 21 nt, Streptococcus pneumoniae R6
ucaaauuauuggucgcuucaa

SEQ ID NO: 2162761 - RNA, 15 nt, Streptococcus pneumoniae R6
ucaaauuguuuacga

SEQ ID NO: 2162762 - RNA, 22 nt, Streptococcus pneumoniae R6
ucaaaauucugucuuagacuuu

SEQ ID NO: 2162763 - RNA, 22 nt, Streptococcus pneumoniae R6
ucaaaccguguucugucaugcg

SEQ ID NO: 2162764 - RNA, 18 nt, Streptococcus pneumoniae R6
ucaaagggcaaaucuuug

SEQ ID NO: 2162765 - RNA, 19 nt, Streptococcus pneumoniae R6
ucaagguuuuucuguacug

SEQ ID NO: 2162766 - RNA, 12 nt, Streptococcus pneumoniae R6
ucaauaucuuua

SEQ ID NO: 2162767 - RNA, 15 nt, Streptococcus pneumoniae R6
ucaauccacuuguaa

SEQ ID NO: 2162768 - RNA, 16 nt, Streptococcus pneumoniae R6
ucaaucgcagcaucga

SEQ ID NO: 2162769 - RNA, 13 nt, Streptococcus pneumoniae R6
ucaaucuuaucaa

SEQ ID NO: 2162770 - RNA, 22 nt, Streptococcus pneumoniae R6
ucaagaacugcuaccaauucag

SEQ ID NO: 2162771 - RNA, 18 nt, Streptococcus pneumoniae R6
ucacaacucuuauacuuu

SEQ ID NO: 2162772 - RNA, 21 nt, Streptococcus pneumoniae R6
ucauggcgaucacguccaauu

SEQ ID NO: 2162773 - RNA, 15 nt, Streptococcus pneumoniae R6
uccagacccugcaca

SEQ ID NO: 2162774 - RNA, 18 nt, Streptococcus pneumoniae R6
uccccucgcuugacugua

SEQ ID NO: 2162775 - RNA, 23 nt, Streptococcus pneumoniae R6
guuguggaugaaacugacgaagu

SEQ ID NO: 2162776 - RNA, 15 nt, Streptococcus pneumoniae R6
guucgaagauaucuc

SEQ ID NO: 2162777 - RNA, 20 nt, Streptococcus pneumoniae R6
guucgcaucuuauuucaauc

SEQ ID NO: 2162778 - RNA, 17 nt, Streptococcus pneumoniae R6
guuccauccacaaccuu

SEQ ID NO: 2162779 - RNA, 19 nt, Streptococcus pneumoniae R6
guucuuuaaagguaucaac

SEQ ID NO: 2162780 - RNA, 21 nt, Streptococcus pneumoniae R6
guucuuuuacaauguugucaa

SEQ ID NO: 2162781 - RNA, 18 nt, Streptococcus pneumoniae R6
guuccagcgguaucaauc

SEQ ID NO: 2162782 - RNA, 16 nt, Streptococcus pneumoniae R6
guuauugcuuucaauu

SEQ ID NO: 2162783 - RNA, 13 nt, Streptococcus pneumoniae R6
guuagucuuagua

SEQ ID NO: 2162784 - RNA, 23 nt, Streptococcus pneumoniae R6
uacccaaaacacaaaaaguccuc

SEQ ID NO: 2162785 - RNA, 13 nt, Streptococcus pneumoniae R6
uaccagaccaagu

SEQ ID NO: 2162786 - RNA, 22 nt, Streptococcus pneumoniae R6
uaccgauggacuuuaucaccuc

SEQ ID NO: 2162787 - RNA, 12 nt, Streptococcus pneumoniae R6
uacuuuccaauu

SEQ ID NO: 2162788 - RNA, 15 nt, Streptococcus pneumoniae R6
uagaauaguacacuu

SEQ ID NO: 2162789 - RNA, 20 nt, Streptococcus pneumoniae R6
uagaguagucugggugcuga

SEQ ID NO: 2162790 - RNA, 17 nt, Streptococcus pneumoniae R6
uagauaacuuuucugcu

SEQ ID NO: 2162791 - RNA, 12 nt, Streptococcus pneumoniae R6
uagcaccauauu

SEQ ID NO: 2162792 - RNA, 23 nt, Streptococcus pneumoniae R6
uagcaucuuguguuuuuugagca

SEQ ID NO: 2162793 - RNA, 14 nt, Streptococcus pneumoniae R6
uaauaguaagagca

SEQ ID NO: 2162794 - RNA, 13 nt, Streptococcus pneumoniae R6
uaaucaucucauc

SEQ ID NO: 2162795 - RNA, 14 nt, Streptococcus pneumoniae R6
uaacugcgauacga

SEQ ID NO: 2162796 - RNA, 13 nt, Streptococcus pneumoniae R6
uaacgaagagcug

SEQ ID NO: 2162797 - RNA, 14 nt, Streptococcus pneumoniae R6
uaacaaaagagcua

SEQ ID NO: 2162798 - RNA, 22 nt, Streptococcus pneumoniae R6
uaaauccuuuuuucuuuacucu

SEQ ID NO: 2162799 - RNA, 14 nt, Streptococcus pneumoniae R6
uaaaaagaguagaa

SEQ ID NO: 2162800 - RNA, 14 nt, Streptococcus pneumoniae R6
guuucaaucguuuc

SEQ ID NO: 2162801 - RNA, 13 nt, Streptococcus pneumoniae R6
uaaaauaucugua

SEQ ID NO: 2162802 - RNA, 12 nt, Streptococcus pneumoniae R6
uaaacucugcac

SEQ ID NO: 2162803 - RNA, 18 nt, Streptococcus pneumoniae R6
ggauuaggguagcguguc

SEQ ID NO: 2162804 - RNA, 15 nt, Streptococcus pneumoniae R6
guaccgccaaaccuu

SEQ ID NO: 2162805 - RNA, 14 nt, Streptococcus pneumoniae R6
gucacauucccauu

SEQ ID NO: 2162806 - RNA, 18 nt, Streptococcus pneumoniae R6
guaucaauguaguaauca

SEQ ID NO: 2162807 - RNA, 19 nt, Streptococcus pneumoniae R6
ggugugauuuuccugaaua

SEQ ID NO: 2162808 - RNA, 14 nt, Streptococcus pneumoniae R6
ggugucauauaauc

SEQ ID NO: 2162809 - RNA, 21 nt, Streptococcus pneumoniae R6
guaaauugcccuugucauccu

SEQ ID NO: 2162810 - RNA, 15 nt, Streptococcus pneumoniae R6
guaacuggaccaagu

SEQ ID NO: 2162811 - RNA, 13 nt, Streptococcus pneumoniae R6
gucuggauugacc

SEQ ID NO: 2162812 - RNA, 15 nt, Streptococcus pneumoniae R6
gucgucauaccaguu

SEQ ID NO: 2162813 - RNA, 15 nt, Streptococcus pneumoniae R6
gugauuaaaacugcc

SEQ ID NO: 2162814 - RNA, 16 nt, Streptococcus pneumoniae R6
gucgaagcuuccaaua

SEQ ID NO: 2162815 - RNA, 15 nt, Streptococcus pneumoniae R6
gucgaagguuauacc

SEQ ID NO: 2162816 - RNA, 19 nt, Streptococcus pneumoniae R6
gucgaaccuuccugauacc

SEQ ID NO: 2162817 - RNA, 18 nt, Streptococcus pneumoniae R6
gcgaaaagcuacaaucug

SEQ ID NO: 2162818 - RNA, 13 nt, Streptococcus pneumoniae R6
gcuuguuccaauu

SEQ ID NO: 2162819 - RNA, 17 nt, Streptococcus pneumoniae R6
ggaagcacacaaaucuu

SEQ ID NO: 2162820 - RNA, 19 nt, Streptococcus pneumoniae R6
gcuuauuucacauuuucaa

SEQ ID NO: 2162821 - RNA, 18 nt, Streptococcus pneumoniae R6
gcuaaagcaccugaauca

SEQ ID NO: 2162822 - RNA, 20 nt, Streptococcus pneumoniae R6
uguaaguuucuucuuuagca

SEQ ID NO: 2162823 - RNA, 23 nt, Streptococcus pneumoniae R6
uguacuauucuaguuucaauaua

SEQ ID NO: 2162824 - RNA, 19 nt, Streptococcus pneumoniae R6
aaucaccguuugauucaca

SEQ ID NO: 2162825 - RNA, 16 nt, Streptococcus pneumoniae R6
uguacuguuauagauu

SEQ ID NO: 2162826 - RNA, 20 nt, Streptococcus pneumoniae R6
aauauuagucggaaucuuua

SEQ ID NO: 2162827 - RNA, 22 nt, Streptococcus pneumoniae R6
uggcuaaagaguugggugauga

SEQ ID NO: 2162828 - RNA, 15 nt, Streptococcus pneumoniae R6
ugggguuucaucccu

SEQ ID NO: 2162829 - RNA, 17 nt, Streptococcus pneumoniae R6
ugcuugggaaugaugac

SEQ ID NO: 2162830 - RNA, 16 nt, Streptococcus pneumoniae R6
ugcuucuguugucaaa

SEQ ID NO: 2162831 - RNA, 17 nt, Streptococcus pneumoniae R6
ugugaauauucuuggca

SEQ ID NO: 2162832 - RNA, 15 nt, Streptococcus pneumoniae R6
uguucgcaagauaga

SEQ ID NO: 2162833 - RNA, 15 nt, Streptococcus pneumoniae R6
uguggcuaucuguca

SEQ ID NO: 2162834 - RNA, 15 nt, Streptococcus pneumoniae R6
uguggaauuggugca

SEQ ID NO: 2162835 - RNA, 16 nt, Streptococcus pneumoniae R6
uuagcuuuucuucaac

SEQ ID NO: 2162836 - RNA, 18 nt, Streptococcus pneumoniae R6
uuauaaaagcucauuucc

SEQ ID NO: 2162837 - RNA, 22 nt, Streptococcus pneumoniae R6
uuaaucauguuuuuaagcuacu

SEQ ID NO: 2162838 - RNA, 17 nt, Streptococcus pneumoniae R6
uuacaucaagcucaucu

SEQ ID NO: 2162839 - RNA, 17 nt, Streptococcus pneumoniae R6
uguucugucuguucucu

SEQ ID NO: 2162840 - RNA, 14 nt, Streptococcus pneumoniae R6
uucuaaauucaauu

SEQ ID NO: 2162841 - RNA, 12 nt, Streptococcus pneumoniae R6
uucuagcuaucu

SEQ ID NO: 2162842 - RNA, 23 nt, Streptococcus pneumoniae R6
uucuagaguccaagauucaacau

SEQ ID NO: 2162843 - RNA, 17 nt, Streptococcus pneumoniae R6
aaucagaacacuuccaa

SEQ ID NO: 2162844 - RNA, 14 nt, Streptococcus pneumoniae R6
uucuccuguuucaa

SEQ ID NO: 2162845 - RNA, 20 nt, Streptococcus pneumoniae R6
uucucccuuuugcucggcau

SEQ ID NO: 2162846 - RNA, 18 nt, Streptococcus pneumoniae R6
uuccaagaccuuaaacuu

SEQ ID NO: 2162847 - RNA, 22 nt, Streptococcus pneumoniae R6
uuccacucgcugacacuggcau

SEQ ID NO: 2162848 - RNA, 15 nt, Streptococcus pneumoniae R6
uuccagcgguaucaa

SEQ ID NO: 2162849 - RNA, 13 nt, Streptococcus pneumoniae R6
uuccauucaaauu

SEQ ID NO: 2162850 - RNA, 18 nt, Streptococcus pneumoniae R6
uuccaucugcagccucaa

SEQ ID NO: 2162851 - RNA, 16 nt, Streptococcus pneumoniae R6
uucauggaucauuucu

SEQ ID NO: 2162852 - RNA, 17 nt, Streptococcus pneumoniae R6
uucaugaaauuauuuca

SEQ ID NO: 2162853 - RNA, 23 nt, Streptococcus pneumoniae R6
uuuggaauguugcugaaauggug

SEQ ID NO: 2162854 - RNA, 20 nt, Streptococcus pneumoniae R6
uuugcugacuugccuucaac

SEQ ID NO: 2162855 - RNA, 14 nt, Streptococcus pneumoniae R6
uuuggucaauccga

SEQ ID NO: 2162856 - RNA, 19 nt, Streptococcus pneumoniae R6
uuugcgcuugauaaccuua

SEQ ID NO: 2162857 - RNA, 23 nt, Streptococcus pneumoniae R6
uuugcacuuuucuuguacaacuu

SEQ ID NO: 2162858 - RNA, 18 nt, Streptococcus pneumoniae R6
uuugaguuucucuuacuu

SEQ ID NO: 2162859 - RNA, 13 nt, Streptococcus pneumoniae R6
uuugagaugagac

SEQ ID NO: 2162860 - RNA, 20 nt, Streptococcus pneumoniae R6
uuugauauagaguucuuggu

SEQ ID NO: 2162861 - RNA, 21 nt, Streptococcus pneumoniae R6
uuuaauucuuuuucaaaugua

SEQ ID NO: 2162862 - RNA, 14 nt, Streptococcus pneumoniae R6
uuuaccauucaauu

SEQ ID NO: 2162863 - RNA, 20 nt, Streptococcus pneumoniae R6
uuucuuuugcaaucauuuca

SEQ ID NO: 2162864 - RNA, 16 nt, Streptococcus pneumoniae R6
uuucuuggucauuuga

SEQ ID NO: 2162865 - RNA, 20 nt, Streptococcus pneumoniae R6
uuucuucuagcuucauauca

SEQ ID NO: 2162866 - RNA, 18 nt, Streptococcus pneumoniae R6
uuucuggcagauagagac

SEQ ID NO: 2162867 - RNA, 15 nt, Streptococcus pneumoniae R6
uuucuguggauacuu

SEQ ID NO: 2162868 - RNA, 17 nt, Streptococcus pneumoniae R6
uuucuguuuaauagcuu

SEQ ID NO: 2162869 - RNA, 23 nt, Streptococcus pneumoniae R6
aauggguuaaaauuuuaucuuug

SEQ ID NO: 2162870 - RNA, 15 nt, Streptococcus pneumoniae R6
uuuuuagaagcuucu

SEQ ID NO: 2162871 - RNA, 16 nt, Streptococcus pneumoniae R6
uuuuucaaagacuucu

SEQ ID NO: 2162872 - RNA, 23 nt, Streptococcus pneumoniae R6
uuuuuguuagauuuauaauuuca

SEQ ID NO: 2162873 - RNA, 12 nt, Streptococcus pneumoniae R6
aaucuuugccac

SEQ ID NO: 2162874 - RNA, 14 nt, Streptococcus pneumoniae R6
uuuuugauacaagu

SEQ ID NO: 2162875 - RNA, 23 nt, Streptococcus pneumoniae R6
uuuuugauacaaguucaucuuca

SEQ ID NO: 2162876 - RNA, 17 nt, Streptococcus pneumoniae R6
uuuuugauuucaagcua

SEQ ID NO: 2162877 - RNA, 22 nt, Streptococcus pneumoniae R6
uuuuugaagaguauaagucuuu

SEQ ID NO: 2162878 - RNA, 20 nt, Streptococcus pneumoniae R6
aaugaaguucucucaaaagu

SEQ ID NO: 2162879 - RNA, 14 nt, Streptococcus pneumoniae R6
aaucguugucaagu

SEQ ID NO: 2162880 - RNA, 13 nt, Streptococcus pneumoniae R6
aaucguuuaaaac

SEQ ID NO: 2162881 - RNA, 14 nt, Streptococcus pneumoniae R6
uugauuaagugacu

SEQ ID NO: 2162882 - RNA, 12 nt, Streptococcus pneumoniae R6
uugauuuccauu

SEQ ID NO: 2162883 - RNA, 18 nt, Streptococcus pneumoniae R6
uugcaagugcuccaugac

SEQ ID NO: 2162884 - RNA, 18 nt, Streptococcus pneumoniae R6
uugcagauagaacugacg

SEQ ID NO: 2162885 - RNA, 21 nt, Streptococcus pneumoniae R6
aaucaguucuuuaaagguauc

SEQ ID NO: 2162886 - RNA, 20 nt, Streptococcus pneumoniae R6
aaucauuauagaaggcaauu

SEQ ID NO: 2162887 - RNA, 20 nt, Streptococcus pneumoniae R6
aaucauacaccucuucugau

SEQ ID NO: 2162888 - RNA, 19 nt, Streptococcus pneumoniae R6
aaucauagcauagaugaca

SEQ ID NO: 2162889 - RNA, 13 nt, Streptococcus pneumoniae R6
uugugcaacuucc

SEQ ID NO: 2162890 - RNA, 16 nt, Streptococcus pneumoniae R6
uugugcuugauaaguu

SEQ ID NO: 2162891 - RNA, 12 nt, Streptococcus pneumoniae R6
uugucugaaguu

SEQ ID NO: 2162892 - RNA, 16 nt, Streptococcus pneumoniae R6
uuguauucgcuuacau

SEQ ID NO: 2162893 - RNA, 23 nt, Streptococcus pneumoniae R6
aauccagucccuuuuaagaguua

SEQ ID NO: 2162894 - RNA, 14 nt, Streptococcus pneumoniae R6
acgguaaucaagug

SEQ ID NO: 2162895 - RNA, 16 nt, Streptococcus pneumoniae R6
acggcacguuccauac

SEQ ID NO: 2162896 - RNA, 21 nt, Streptococcus pneumoniae R6
acguaguuuuuuuuguaaucu

SEQ ID NO: 2162897 - RNA, 20 nt, Streptococcus pneumoniae R6
acguuuaaagacaguugcau

SEQ ID NO: 2162898 - RNA, 23 nt, Streptococcus pneumoniae R6
acuaaaauucuauaucuaaugac

SEQ ID NO: 2162899 - RNA, 18 nt, Streptococcus pneumoniae R6
acugaaucuagacuagca

SEQ ID NO: 2162900 - RNA, 20 nt, Streptococcus pneumoniae R6
acuccuuaguguacagcaaa

SEQ ID NO: 2162901 - RNA, 13 nt, Streptococcus pneumoniae R6
acgagcaguucca

SEQ ID NO: 2162902 - RNA, 18 nt, Streptococcus pneumoniae R6
accuuuaaauccugcaaa

SEQ ID NO: 2162903 - RNA, 17 nt, Streptococcus pneumoniae R6
accuacccaaauggaua

SEQ ID NO: 2162904 - RNA, 23 nt, Streptococcus pneumoniae R6
acaaagagccggaaauugucuga

SEQ ID NO: 2162905 - RNA, 17 nt, Streptococcus pneumoniae R6
acaaccacauagucaga

SEQ ID NO: 2162906 - RNA, 16 nt, Streptococcus pneumoniae R6
acaaccugaaguagau

SEQ ID NO: 2162907 - RNA, 19 nt, Streptococcus pneumoniae R6
aauguuuugaucugacuuc

SEQ ID NO: 2162908 - RNA, 14 nt, Streptococcus pneumoniae R6
acaagccuagucuu

SEQ ID NO: 2162909 - RNA, 23 nt, Streptococcus pneumoniae R6
acaagacuaccgcuccuaaucuc

SEQ ID NO: 2162910 - RNA, 15 nt, Streptococcus pneumoniae R6
acaucuguuuuaaac

SEQ ID NO: 2162911 - RNA, 21 nt, Streptococcus pneumoniae R6
acaugaaguaaauauuucuau

SEQ ID NO: 2162912 - RNA, 20 nt, Streptococcus pneumoniae R6
accaagaucuugucugcaug

SEQ ID NO: 2162913 - RNA, 22 nt, Streptococcus pneumoniae R6
acaguuuugagguuguggauag

SEQ ID NO: 2162914 - RNA, 20 nt, Streptococcus pneumoniae R6
accaaucucaaauccuugaa

SEQ ID NO: 2162915 - RNA, 17 nt, Streptococcus pneumoniae R6
ucgcuugguaggguucu

SEQ ID NO: 2162916 - RNA, 18 nt, Streptococcus pneumoniae R6
aauacgccaaaaccucua

SEQ ID NO: 2162917 - RNA, 16 nt, Streptococcus pneumoniae R6
ucggcaugcugacaaa

SEQ ID NO: 2162918 - RNA, 23 nt, Streptococcus pneumoniae R6
ucccgucucaugaaaggauuucu

SEQ ID NO: 2162919 - RNA, 19 nt, Streptococcus pneumoniae R6
ucccaugacaaucauuuca

SEQ ID NO: 2162920 - RNA, 21 nt, Streptococcus pneumoniae R6
uccuuuuugauaacgugcuaa

SEQ ID NO: 2162921 - RNA, 19 nt, Streptococcus pneumoniae R6
uccguaccaacacauucaa

SEQ ID NO: 2162922 - RNA, 16 nt, Streptococcus pneumoniae R6
uccguaaucuuguuaa

SEQ ID NO: 2162923 - RNA, 22 nt, Streptococcus pneumoniae R6
ucgauaacgauagauccuucaa

SEQ ID NO: 2162924 - RNA, 22 nt, Streptococcus pneumoniae R6
ucguccuuucuuuuuugaaguu

SEQ ID NO: 2162925 - RNA, 13 nt, Streptococcus pneumoniae R6
ugaaauaagaaau

SEQ ID NO: 2162926 - RNA, 17 nt, Streptococcus pneumoniae R6
ucuuauccagaaauuga

SEQ ID NO: 2162927 - RNA, 16 nt, Streptococcus pneumoniae R6
ucuuacugauauacuu

SEQ ID NO: 2162928 - RNA, 13 nt, Streptococcus pneumoniae R6
ucuucauggacuu

SEQ ID NO: 2162929 - RNA, 20 nt, Streptococcus pneumoniae R6
ucuucuccuaaaauugacuu

SEQ ID NO: 2162930 - RNA, 20 nt, Streptococcus pneumoniae R6
ucucauggcgaucauuauca

SEQ ID NO: 2162931 - RNA, 22 nt, Streptococcus pneumoniae R6
ucuauuucuuuaaaaucaaagu

SEQ ID NO: 2162932 - RNA, 22 nt, Streptococcus pneumoniae R6
ucucuucaauccgcgucaacgu

SEQ ID NO: 2162933 - RNA, 23 nt, Streptococcus pneumoniae R6
ucugaaggaacuaacucaucaaa

SEQ ID NO: 2162934 - RNA, 15 nt, Streptococcus pneumoniae R6
ucugaguauuuagca

SEQ ID NO: 2162935 - RNA, 16 nt, Streptococcus pneumoniae R6
ucugaugcugacaagu

SEQ ID NO: 2162936 - RNA, 17 nt, Streptococcus pneumoniae R6
ucugcaaccucuacaau

SEQ ID NO: 2162937 - RNA, 22 nt, Streptococcus pneumoniae R6
ugcaucaagugccaagaagguu

SEQ ID NO: 2162938 - RNA, 18 nt, Streptococcus pneumoniae R6
ugaugaaccuucaucaaa

SEQ ID NO: 2162939 - RNA, 15 nt, Streptococcus pneumoniae R6
ugauaccuugaucaa

SEQ ID NO: 2162940 - RNA, 16 nt, Streptococcus pneumoniae R6
ucaacagcuccuucaa

SEQ ID NO: 2162941 - RNA, 14 nt, Streptococcus pneumoniae R6
uagugacuucagag

SEQ ID NO: 2162942 - RNA, 19 nt, Streptococcus pneumoniae R6
uaguucuugaaaugaaguu

SEQ ID NO: 2162943 - RNA, 14 nt, Streptococcus pneumoniae R6
uaguuggccaacuu

SEQ ID NO: 2162944 - RNA, 21 nt, Streptococcus pneumoniae R6
uagcuuccuaguuugcucuuu

SEQ ID NO: 2162945 - RNA, 13 nt, Streptococcus pneumoniae R6
uagcuuccuugau

SEQ ID NO: 2162946 - RNA, 18 nt, Streptococcus pneumoniae R6
uagcugcguucacuucau

SEQ ID NO: 2162947 - RNA, 13 nt, Streptococcus pneumoniae R6
uaguaaagagcug

SEQ ID NO: 2162948 - RNA, 16 nt, Streptococcus pneumoniae R6
uaguacacuucuacuu

SEQ ID NO: 2162949 - RNA, 20 nt, Streptococcus pneumoniae R6
uaucaagcaaaucaaagcua

SEQ ID NO: 2162950 - RNA, 17 nt, Streptococcus pneumoniae R6
uauaaaucaauuuuccu

SEQ ID NO: 2162951 - RNA, 19 nt, Streptococcus pneumoniae R6
uaguuugcauuggcuauuu

SEQ ID NO: 2162952 - RNA, 23 nt, Streptococcus pneumoniae R6
uauaaacuuuuucauaaauagau

SEQ ID NO: 2162953 - RNA, 15 nt, Streptococcus pneumoniae R6
uagaaguaguuuagg

SEQ ID NO: 2162954 - RNA, 19 nt, Streptococcus pneumoniae R6
uagauggaaguagugacuu

SEQ ID NO: 2162955 - RNA, 15 nt, Streptococcus pneumoniae R6
uagcauaaaagccuc

SEQ ID NO: 2162956 - RNA, 18 nt, Streptococcus pneumoniae R6
uccaaaagaccguuugaa

SEQ ID NO: 2162957 - RNA, 17 nt, Streptococcus pneumoniae R6
aauaauuucaaaaucuu

SEQ ID NO: 2162958 - RNA, 23 nt, Streptococcus pneumoniae R6
ucacuguauuggucguauuuuug

SEQ ID NO: 2162959 - RNA, 16 nt, Streptococcus pneumoniae R6
gugauguaauuucuga

SEQ ID NO: 2162960 - RNA, 16 nt, Streptococcus pneumoniae R6
gugcuaaguccuugau

SEQ ID NO: 2162961 - RNA, 20 nt, Streptococcus pneumoniae R6
aaguguuugauaucuaucaa

SEQ ID NO: 2162962 - RNA, 19 nt, Streptococcus pneumoniae R6
aaguuaauugaauuucaag

SEQ ID NO: 2162963 - RNA, 11 nt, Streptococcus pneumoniae R6
guuuaucaaua

SEQ ID NO: 2162964 - RNA, 18 nt, Streptococcus pneumoniae R6
guuguggauagaacugac

SEQ ID NO: 2162965 - RNA, 23 nt, Streptococcus pneumoniae R6
guuguggauagaacugacgaagu

SEQ ID NO: 2162966 - RNA, 23 nt, Streptococcus pneumoniae R6
guuguggauggaacugacgaagu

SEQ ID NO: 2162967 - RNA, 15 nt, Streptococcus pneumoniae R6
uaagaugaccuuauc

SEQ ID NO: 2162968 - RNA, 20 nt, Streptococcus pneumoniae R6
uaagacauaccuacgauauc

SEQ ID NO: 2162969 - RNA, 14 nt, Streptococcus pneumoniae R6
uaauaacucucauc

SEQ ID NO: 2162970 - RNA, 16 nt, Streptococcus pneumoniae R6
uaauacaagcucaucu

SEQ ID NO: 2162971 - RNA, 20 nt, Streptococcus pneumoniae R6
uaaggcagugacuaccaauc

SEQ ID NO: 2162972 - RNA, 15 nt, Streptococcus pneumoniae R6
uaauucggaaagcca

SEQ ID NO: 2162973 - RNA, 20 nt, Streptococcus pneumoniae R6
uaauuauauauaaaaagcua

SEQ ID NO: 2162974 - RNA, 21 nt, Streptococcus pneumoniae R6
uaaagaggagucuuauaguaa

SEQ ID NO: 2162975 - RNA, 22 nt, Streptococcus pneumoniae R6
uaaacugagcaaaaccaucauc

SEQ ID NO: 2162976 - RNA, 16 nt, Streptococcus pneumoniae R6
uaaaacuauugacuuu

SEQ ID NO: 2162977 - RNA, 17 nt, Streptococcus pneumoniae R6
uaaaagauaaucaucug

SEQ ID NO: 2162978 - RNA, 13 nt, Streptococcus pneumoniae R6
agcauagaaguuu

SEQ ID NO: 2162979 - RNA, 20 nt, Streptococcus pneumoniae R6
agacgacgggcuaauugaca

SEQ ID NO: 2162980 - RNA, 18 nt, Streptococcus pneumoniae R6
agacccuauauuucaaga

SEQ ID NO: 2162981 - RNA, 20 nt, Streptococcus pneumoniae R6
agacuuugguauuacuuacc

SEQ ID NO: 2162982 - RNA, 21 nt, Streptococcus pneumoniae R6
agacuucuuuuuuacuucguu

SEQ ID NO: 2162983 - RNA, 15 nt, Streptococcus pneumoniae R6
agagaaauuucugaa

SEQ ID NO: 2162984 - RNA, 18 nt, Streptococcus pneumoniae R6
agacugaaucugaaauag

SEQ ID NO: 2162985 - RNA, 17 nt, Streptococcus pneumoniae R6
agauagcugcagcugag

SEQ ID NO: 2162986 - RNA, 23 nt, Streptococcus pneumoniae R6
agauagguuuugcaugauugaga

SEQ ID NO: 2162987 - RNA, 20 nt, Streptococcus pneumoniae R6
agauaaggcaucuuaacauu

SEQ ID NO: 2162988 - RNA, 22 nt, Streptococcus pneumoniae R6
agauaaggucaucuuauagcga

SEQ ID NO: 2162989 - RNA, 13 nt, Streptococcus pneumoniae R6
agaguuuucugau

SEQ ID NO: 2162990 - RNA, 19 nt, Streptococcus pneumoniae R6
agaagugguuuaaagucua

SEQ ID NO: 2162991 - RNA, 18 nt, Streptococcus pneumoniae R6
agaaguccauagcgucaa

SEQ ID NO: 2162992 - RNA, 15 nt, Streptococcus pneumoniae R6
agaauacaguaucag

SEQ ID NO: 2162993 - RNA, 16 nt, Streptococcus pneumoniae R6
acugcugggucaaacg

SEQ ID NO: 2162994 - RNA, 14 nt, Streptococcus pneumoniae R6
agaagagggcuucu

SEQ ID NO: 2162995 - RNA, 22 nt, Streptococcus pneumoniae R6
agaacccuuuuuggauaaguuu

SEQ ID NO: 2162996 - RNA, 18 nt, Streptococcus pneumoniae R6
agugauguaauuucugaa

SEQ ID NO: 2162997 - RNA, 19 nt, Streptococcus pneumoniae R6
aguguuuuaagcugacuuc

SEQ ID NO: 2162998 - RNA, 16 nt, Streptococcus pneumoniae R6
aguuauuaacagcaaa

SEQ ID NO: 2162999 - RNA, 18 nt, Streptococcus pneumoniae R6
aguucacaaaugagauaa

SEQ ID NO: 2163000 - RNA, 14 nt, Streptococcus pneumoniae R6
agucuguucuaugc

SEQ ID NO: 2163001 - RNA, 17 nt, Streptococcus pneumoniae R6
agucugaaacagaggug

SEQ ID NO: 2163002 - RNA, 21 nt, Streptococcus pneumoniae R6
aguagugguuuuuaggcaaua

SEQ ID NO: 2163003 - RNA, 16 nt, Streptococcus pneumoniae R6
agucaaaucgauuucu

SEQ ID NO: 2163004 - RNA, 17 nt, Streptococcus pneumoniae R6
auaauagucucuugcga

SEQ ID NO: 2163005 - RNA, 16 nt, Streptococcus pneumoniae R6
auaccaaggauugucu

SEQ ID NO: 2163006 - RNA, 18 nt, Streptococcus pneumoniae R6
auaauacucaaugaaaau

SEQ ID NO: 2163007 - RNA, 16 nt, Streptococcus pneumoniae R6
auaagucucagcaguc

SEQ ID NO: 2163008 - RNA, 20 nt, Streptococcus pneumoniae R6
auaaguuuuaacuuucuggu

SEQ ID NO: 2163009 - RNA, 21 nt, Streptococcus pneumoniae R6
auaagaggauuuuaaaguaau

SEQ ID NO: 2163010 - RNA, 12 nt, Streptococcus pneumoniae R6
aguuugcucuuu

SEQ ID NO: 2163011 - RNA, 18 nt, Streptococcus pneumoniae R6
auaacgaauccaacucuu

SEQ ID NO: 2163012 - RNA, 12 nt, Streptococcus pneumoniae R6
auaacgcaauuc

SEQ ID NO: 2163013 - RNA, 23 nt, Streptococcus pneumoniae R6
auaacgauaauccuugucgucau

SEQ ID NO: 2163014 - RNA, 16 nt, Streptococcus pneumoniae R6
auagaaaaggaguaga

SEQ ID NO: 2163015 - RNA, 21 nt, Streptococcus pneumoniae R6
auagcuccaucuccaacugcu

SEQ ID NO: 2163016 - RNA, 18 nt, Streptococcus pneumoniae R6
auagugagauuuuuugau

SEQ ID NO: 2163017 - RNA, 16 nt, Streptococcus pneumoniae R6
auaggaaguugagcgg

SEQ ID NO: 2163018 - RNA, 21 nt, Streptococcus pneumoniae R6
auaucuuuuauuuuuauaaca

SEQ ID NO: 2163019 - RNA, 21 nt, Streptococcus pneumoniae R6
auaugaaaucuuuuugauaca

SEQ ID NO: 2163020 - RNA, 22 nt, Streptococcus pneumoniae R6
auauucaaucgcuauuaucguu

SEQ ID NO: 2163021 - RNA, 15 nt, Streptococcus pneumoniae R6
auauaauagauugaa

SEQ ID NO: 2163022 - RNA, 18 nt, Streptococcus pneumoniae R6
agcuuccccauucuaugg

SEQ ID NO: 2163023 - RNA, 19 nt, Streptococcus pneumoniae R6
aggaauaaauccagcugag

SEQ ID NO: 2163024 - RNA, 15 nt, Streptococcus pneumoniae R6
caccacgaaguccuu

SEQ ID NO: 2163025 - RNA, 21 nt, Streptococcus pneumoniae R6
cacaaaaagugucagauagga

SEQ ID NO: 2163026 - RNA, 14 nt, Streptococcus pneumoniae R6
caagguagagacag

SEQ ID NO: 2163027 - RNA, 14 nt, Streptococcus pneumoniae R6
cacccauguaugga

SEQ ID NO: 2163028 - RNA, 22 nt, Streptococcus pneumoniae R6
caaauaaaaagcuuuaagacag

SEQ ID NO: 2163029 - RNA, 13 nt, Streptococcus pneumoniae R6
caaaguagucauu

SEQ ID NO: 2163030 - RNA, 22 nt, Streptococcus pneumoniae R6
caacagaugagcgaauaguaua

SEQ ID NO: 2163031 - RNA, 16 nt, Streptococcus pneumoniae R6
caacaggaaaagucuu

SEQ ID NO: 2163032 - RNA, 17 nt, Streptococcus pneumoniae R6
caacgacacgguaugga

SEQ ID NO: 2163033 - RNA, 13 nt, Streptococcus pneumoniae R6
caacgguaucuug

SEQ ID NO: 2163034 - RNA, 14 nt, Streptococcus pneumoniae R6
caagaaacaacaau

SEQ ID NO: 2163035 - RNA, 14 nt, Streptococcus pneumoniae R6
caagaagagcuugg

SEQ ID NO: 2163036 - RNA, 15 nt, Streptococcus pneumoniae R6
caagaacuccucuca

SEQ ID NO: 2163037 - RNA, 16 nt, Streptococcus pneumoniae R6
caagacuuuuugagcc

SEQ ID NO: 2163038 - RNA, 19 nt, Streptococcus pneumoniae R6
caagaggguggaaagacug

SEQ ID NO: 2163039 - RNA, 19 nt, Streptococcus pneumoniae R6
caagauaguaaagagcugc

SEQ ID NO: 2163040 - RNA, 17 nt, Streptococcus pneumoniae R6
caagcuaucagagaugg

SEQ ID NO: 2163041 - RNA, 18 nt, Streptococcus pneumoniae R6
caaaacgcauaguaucaa

SEQ ID NO: 2163042 - RNA, 23 nt, Streptococcus pneumoniae R6
caaaaguuagaaauaaaacucug

SEQ ID NO: 2163043 - RNA, 22 nt, Streptococcus pneumoniae R6
caaaacugguccagagauagua

SEQ ID NO: 2163044 - RNA, 20 nt, Streptococcus pneumoniae R6
caaaaucagaaccuuugaga

SEQ ID NO: 2163045 - RNA, 18 nt, Streptococcus pneumoniae R6
caaaauccgcuugggaaa

SEQ ID NO: 2163046 - RNA, 15 nt, Streptococcus pneumoniae R6
caaagcacugauuug

SEQ ID NO: 2163047 - RNA, 20 nt, Streptococcus pneumoniae R6
caaacaguuagacaauuaau

SEQ ID NO: 2163048 - RNA, 22 nt, Streptococcus pneumoniae R6
auuuuucugagucugugauuga

SEQ ID NO: 2163049 - RNA, 19 nt, Streptococcus pneumoniae R6
auuuuucgguucuuuguca

SEQ ID NO: 2163050 - RNA, 19 nt, Streptococcus pneumoniae R6
caaaaaacgcauaguauca

SEQ ID NO: 2163051 - RNA, 20 nt, Streptococcus pneumoniae R6
caaaaaacgcauaguaucaa

SEQ ID NO: 2163052 - RNA, 18 nt, Streptococcus pneumoniae R6
caaaaacgcauaguauca

SEQ ID NO: 2163053 - RNA, 19 nt, Streptococcus pneumoniae R6
caaaaaguggaaagagcag

SEQ ID NO: 2163054 - RNA, 17 nt, Streptococcus pneumoniae R6
auuuugauucagauuca

SEQ ID NO: 2163055 - RNA, 22 nt, Streptococcus pneumoniae R6
auuuuguuuuugagucaagaua

SEQ ID NO: 2163056 - RNA, 12 nt, Streptococcus pneumoniae R6
auuuuuaguuga

SEQ ID NO: 2163057 - RNA, 19 nt, Streptococcus pneumoniae R6
auuuuccggcucuuuguca

SEQ ID NO: 2163058 - RNA, 17 nt, Streptococcus pneumoniae R6
auuuuccuuaauccacu

SEQ ID NO: 2163059 - RNA, 20 nt, Streptococcus pneumoniae R6
auuuuaugcguuuuucugau

SEQ ID NO: 2163060 - RNA, 22 nt, Streptococcus pneumoniae R6
auuugaugcugcauuucuggau

SEQ ID NO: 2163061 - RNA, 19 nt, Streptococcus pneumoniae R6
auuuuaaaauauuagcaaa

SEQ ID NO: 2163062 - RNA, 20 nt, Streptococcus pneumoniae R6
auuucguaagaaauuuugga

SEQ ID NO: 2163063 - RNA, 22 nt, Streptococcus pneumoniae R6
auuuauuacuucaauuucuaau

SEQ ID NO: 2163064 - RNA, 15 nt, Streptococcus pneumoniae R6
auuuccacuaaaggu

SEQ ID NO: 2163065 - RNA, 19 nt, Streptococcus pneumoniae R6
auuuccggcucuuugucaa

SEQ ID NO: 2163066 - RNA, 20 nt, Streptococcus pneumoniae R6
auuuaauacucugugaaaau

SEQ ID NO: 2163067 - RNA, 15 nt, Streptococcus pneumoniae R6
auuuauaguuuugau

SEQ ID NO: 2163068 - RNA, 13 nt, Streptococcus pneumoniae R6
auccaucacaguu

SEQ ID NO: 2163069 - RNA, 23 nt, Streptococcus pneumoniae R6
aucccaagcccugcaaacuggag

SEQ ID NO: 2163070 - RNA, 20 nt, Streptococcus pneumoniae R6
auccguauucuuauuucaaa

SEQ ID NO: 2163071 - RNA, 17 nt, Streptococcus pneumoniae R6
aucaucugcaucaagaa

SEQ ID NO: 2163072 - RNA, 15 nt, Streptococcus pneumoniae R6
aucucuccuuaucaa

SEQ ID NO: 2163073 - RNA, 14 nt, Streptococcus pneumoniae R6
aucuccaacugcaa

SEQ ID NO: 2163074 - RNA, 15 nt, Streptococcus pneumoniae R6
augcucugaaacacu

SEQ ID NO: 2163075 - RNA, 19 nt, Streptococcus pneumoniae R6
auguccuaaaacuagugaa

SEQ ID NO: 2163076 - RNA, 18 nt, Streptococcus pneumoniae R6
auuauuucuuuuguacaa

SEQ ID NO: 2163077 - RNA, 14 nt, Streptococcus pneumoniae R6
auuacuaucaagaa

SEQ ID NO: 2163078 - RNA, 18 nt, Streptococcus pneumoniae R6
auuaaaaagaguagaaau

SEQ ID NO: 2163079 - RNA, 22 nt, Streptococcus pneumoniae R6
auguuuagcaaacuaaauaccu

SEQ ID NO: 2163080 - RNA, 21 nt, Streptococcus pneumoniae R6
auguuucaacaugucagcuga

SEQ ID NO: 2163081 - RNA, 14 nt, Streptococcus pneumoniae R6
auuaaucaccuagu

SEQ ID NO: 2163082 - RNA, 18 nt, Streptococcus pneumoniae R6
auuaauucgauuucugcu

SEQ ID NO: 2163083 - RNA, 16 nt, Streptococcus pneumoniae R6
auuaauuuauagaaau

SEQ ID NO: 2163084 - RNA, 17 nt, Streptococcus pneumoniae R6
augauuugagugaauag

SEQ ID NO: 2163085 - RNA, 16 nt, Streptococcus pneumoniae R6
aucugcagaauacucu

SEQ ID NO: 2163086 - RNA, 17 nt, Streptococcus pneumoniae R6
aucugauuggaaacuuu

SEQ ID NO: 2163087 - RNA, 23 nt, Streptococcus pneumoniae R6
augagacuugcaagaaaguagag

SEQ ID NO: 2163088 - RNA, 15 nt, Streptococcus pneumoniae R6
ccgaacccuguuuua

SEQ ID NO: 2163089 - RNA, 14 nt, Streptococcus pneumoniae R6
ccaguacuuucaac

SEQ ID NO: 2163090 - RNA, 23 nt, Streptococcus pneumoniae R6
ccaguaaaggacuuuaaagcggu

SEQ ID NO: 2163091 - RNA, 20 nt, Streptococcus pneumoniae R6
cccacuacacuugacaaaga

SEQ ID NO: 2163092 - RNA, 18 nt, Streptococcus pneumoniae R6
ccacuauuuuaucuuacu

SEQ ID NO: 2163093 - RNA, 14 nt, Streptococcus pneumoniae R6
caucugcaucaaga

SEQ ID NO: 2163094 - RNA, 16 nt, Streptococcus pneumoniae R6
caugacaaucauuuca

SEQ ID NO: 2163095 - RNA, 20 nt, Streptococcus pneumoniae R6
caugaauacguacgauagca

SEQ ID NO: 2163096 - RNA, 17 nt, Streptococcus pneumoniae R6
caugaauauuccuauga

SEQ ID NO: 2163097 - RNA, 17 nt, Streptococcus pneumoniae R6
caucuuuguaaguuucu

SEQ ID NO: 2163098 - RNA, 19 nt, Streptococcus pneumoniae R6
caugagcaugaucauuugc

SEQ ID NO: 2163099 - RNA, 20 nt, Streptococcus pneumoniae R6
caugagcaugaucauuugca

SEQ ID NO: 2163100 - RNA, 15 nt, Streptococcus pneumoniae R6
ccaaacuagauagca

SEQ ID NO: 2163101 - RNA, 21 nt, Streptococcus pneumoniae R6
cauuuucaaugugaccaguga

SEQ ID NO: 2163102 - RNA, 21 nt, Streptococcus pneumoniae R6
cauauagucuuucaaagccug

SEQ ID NO: 2163103 - RNA, 16 nt, Streptococcus pneumoniae R6
cauaucuuauuucaau

SEQ ID NO: 2163104 - RNA, 21 nt, Streptococcus pneumoniae R6
cauauucuaacuuauuuuaac

SEQ ID NO: 2163105 - RNA, 16 nt, Streptococcus pneumoniae R6
cauaacgauaauccuu

SEQ ID NO: 2163106 - RNA, 20 nt, Streptococcus pneumoniae R6
cauacugccaagauagagag

SEQ ID NO: 2163107 - RNA, 22 nt, Streptococcus pneumoniae R6
caguagacuugaccgcagauuu

SEQ ID NO: 2163108 - RNA, 16 nt, Streptococcus pneumoniae R6
caguagaaaaagucug

SEQ ID NO: 2163109 - RNA, 22 nt, Streptococcus pneumoniae R6
cagcuuaucucguacuucccga

SEQ ID NO: 2163110 - RNA, 15 nt, Streptococcus pneumoniae R6
cagcuuccaucugca

SEQ ID NO: 2163111 - RNA, 18 nt, Streptococcus pneumoniae R6
cacuugguaggauaaagu

SEQ ID NO: 2163112 - RNA, 18 nt, Streptococcus pneumoniae R6
cacuugguguugagaaag

SEQ ID NO: 2163113 - RNA, 22 nt, Streptococcus pneumoniae R6
cacggauaguuccuaaucugga

SEQ ID NO: 2163114 - RNA, 20 nt, Streptococcus pneumoniae R6
cagauaagcaccuaguacaa

SEQ ID NO: 2163115 - RNA, 15 nt, Streptococcus pneumoniae R6
cagcaccagacauuu

SEQ ID NO: 2163116 - RNA, 14 nt, Streptococcus pneumoniae R6
cagcauuuuucaaa

SEQ ID NO: 2163117 - RNA, 19 nt, Streptococcus pneumoniae R6
cagcauggcccgcuucgcu

SEQ ID NO: 2163118 - RNA, 20 nt, Streptococcus pneumoniae R6
cagccacuguacguccaacu

SEQ ID NO: 2163119 - RNA, 16 nt, Streptococcus pneumoniae R6
cgauauucuuuucaaa

SEQ ID NO: 2163120 - RNA, 10 nt, Streptococcus pneumoniae R6
cgaguucaug

SEQ ID NO: 2163121 - RNA, 22 nt, Streptococcus pneumoniae R6
cgaguguauuguacuuuccaau

SEQ ID NO: 2163122 - RNA, 23 nt, Streptococcus pneumoniae R6
cgagguauuucuuguuuucuaaa

SEQ ID NO: 2163123 - RNA, 16 nt, Streptococcus pneumoniae R6
ccuucaccaaucaaau

SEQ ID NO: 2163124 - RNA, 22 nt, Streptococcus pneumoniae R6
ccuuuaaccugaugaauaguga

SEQ ID NO: 2163125 - RNA, 13 nt, Streptococcus pneumoniae R6
cgaaaaguauuaa

SEQ ID NO: 2163126 - RNA, 22 nt, Streptococcus pneumoniae R6
cgacugcgguugcguagcugag

SEQ ID NO: 2163127 - RNA, 11 nt, Streptococcus pneumoniae R6
ccuagucuucu

SEQ ID NO: 2163128 - RNA, 22 nt, Streptococcus pneumoniae R6
ccuagccuucuggucugauuuu

SEQ ID NO: 2163129 - RNA, 17 nt, Streptococcus pneumoniae R6
ccuacgaacaagacuac

SEQ ID NO: 2163130 - RNA, 16 nt, Streptococcus pneumoniae R6
ccucuucauucaaaga

SEQ ID NO: 2163131 - RNA, 21 nt, Streptococcus pneumoniae R6
ccucuucacugugacuagcaa

SEQ ID NO: 2163132 - RNA, 12 nt, Streptococcus pneumoniae R6
ccugaucaaagg

SEQ ID NO: 2163133 - RNA, 14 nt, Streptococcus pneumoniae R6
cggguucuuccaaa

SEQ ID NO: 2163134 - RNA, 17 nt, Streptococcus pneumoniae R6
cgcccuuguucuccaaa

SEQ ID NO: 2163135 - RNA, 13 nt, Streptococcus pneumoniae R6
gauaaucaucugg

SEQ ID NO: 2163136 - RNA, 21 nt, Streptococcus pneumoniae R6
gauaauauauagguuuugcua

SEQ ID NO: 2163137 - RNA, 12 nt, Streptococcus pneumoniae R6
gauaagaugaca

SEQ ID NO: 2163138 - RNA, 14 nt, Streptococcus pneumoniae R6
gauagcuuuugcag

SEQ ID NO: 2163139 - RNA, 21 nt, Streptococcus pneumoniae R6
gaguacgaacaaguugugcag

SEQ ID NO: 2163140 - RNA, 20 nt, Streptococcus pneumoniae R6
gagcuuccaguagcgcuuga

SEQ ID NO: 2163141 - RNA, 12 nt, Streptococcus pneumoniae R6
gagcuggcucau

SEQ ID NO: 2163142 - RNA, 15 nt, Streptococcus pneumoniae R6
gagcauuuuucgaaa

SEQ ID NO: 2163143 - RNA, 22 nt, Streptococcus pneumoniae R6
gagcgaauaccaccaaucauuu

SEQ ID NO: 2163144 - RNA, 20 nt, Streptococcus pneumoniae R6
gaugucguaaguguuacuau

SEQ ID NO: 2163145 - RNA, 14 nt, Streptococcus pneumoniae R6
gcagcgguuccauu

SEQ ID NO: 2163146 - RNA, 18 nt, Streptococcus pneumoniae R6
gcaguacauucaacaccu

SEQ ID NO: 2163147 - RNA, 14 nt, Streptococcus pneumoniae R6
gcacaccugauauu

SEQ ID NO: 2163148 - RNA, 16 nt, Streptococcus pneumoniae R6
gaccuguauucauuga

SEQ ID NO: 2163149 - RNA, 21 nt, Streptococcus pneumoniae R6
gaccuuaaacuuguaagucaa

SEQ ID NO: 2163150 - RNA, 17 nt, Streptococcus pneumoniae R6
gaaacgacggucaugcg

SEQ ID NO: 2163151 - RNA, 14 nt, Streptococcus pneumoniae R6
gacauuaccucuuu

SEQ ID NO: 2163152 - RNA, 15 nt, Streptococcus pneumoniae R6
gacauaaucaagaug

SEQ ID NO: 2163153 - RNA, 15 nt, Streptococcus pneumoniae R6
gaauaaagaaacuug

SEQ ID NO: 2163154 - RNA, 19 nt, Streptococcus pneumoniae R6
gaauuaggcucuuugucaa

SEQ ID NO: 2163155 - RNA, 23 nt, Streptococcus pneumoniae R6
gaaugaugacaccugaaacauug

SEQ ID NO: 2163156 - RNA, 15 nt, Streptococcus pneumoniae R6
gaagucuagcaauuc

SEQ ID NO: 2163157 - RNA, 20 nt, Streptococcus pneumoniae R6
cugcuagacuaacuucuuau

SEQ ID NO: 2163158 - RNA, 12 nt, Streptococcus pneumoniae R6
cuugaucuucca

SEQ ID NO: 2163159 - RNA, 12 nt, Streptococcus pneumoniae R6
cuugcauuaucc

SEQ ID NO: 2163160 - RNA, 19 nt, Streptococcus pneumoniae R6
cuugacuccccauuuacca

SEQ ID NO: 2163161 - RNA, 14 nt, Streptococcus pneumoniae R6
cuuuccaagaaucc

SEQ ID NO: 2163162 - RNA, 13 nt, Streptococcus pneumoniae R6
cuuugcauuucau

SEQ ID NO: 2163163 - RNA, 13 nt, Streptococcus pneumoniae R6
cuuugccaguucu

SEQ ID NO: 2163164 - RNA, 14 nt, Streptococcus pneumoniae R6
gaaaaucucuucaa

SEQ ID NO: 2163165 - RNA, 15 nt, Streptococcus pneumoniae R6
cuucuuugauggagu

SEQ ID NO: 2163166 - RNA, 17 nt, Streptococcus pneumoniae R6
cuucuuuguaggcuucu

SEQ ID NO: 2163167 - RNA, 19 nt, Streptococcus pneumoniae R6
cuucuuuacugagauggau

SEQ ID NO: 2163168 - RNA, 21 nt, Streptococcus pneumoniae R6
cuugaaaauaccaaguucauu

SEQ ID NO: 2163169 - RNA, 14 nt, Streptococcus pneumoniae R6
cuucuuuuuugaga

SEQ ID NO: 2163170 - RNA, 15 nt, Streptococcus pneumoniae R6
cuucauuuaucuucu

SEQ ID NO: 2163171 - RNA, 21 nt, Streptococcus pneumoniae R6
cuuccaagucguaagucuucg

SEQ ID NO: 2163172 - RNA, 20 nt, Streptococcus pneumoniae R6
cuuauuucaauuugaugauu

SEQ ID NO: 2163173 - RNA, 21 nt, Streptococcus pneumoniae R6
cuucaacucuauuuuugagca

SEQ ID NO: 2163174 - RNA, 14 nt, Streptococcus pneumoniae R6
cugugacuagcaau

SEQ ID NO: 2163175 - RNA, 13 nt, Streptococcus pneumoniae R6
cugugaguucauu

SEQ ID NO: 2163176 - RNA, 18 nt, Streptococcus pneumoniae R6
cuguaucgaccucuacca

SEQ ID NO: 2163177 - RNA, 21 nt, Streptococcus pneumoniae R6
cgucuuuagagagaugaauag

SEQ ID NO: 2163178 - RNA, 22 nt, Streptococcus pneumoniae R6
cgucaguuccaucuacaaccuu

SEQ ID NO: 2163179 - RNA, 19 nt, Streptococcus pneumoniae R6
cuaaaacauucuuagaaau

SEQ ID NO: 2163180 - RNA, 14 nt, Streptococcus pneumoniae R6
cuaaacuuugagcc

SEQ ID NO: 2163181 - RNA, 21 nt, Streptococcus pneumoniae R6
cuaaaaacucuucuuuuggca

SEQ ID NO: 2163182 - RNA, 21 nt, Streptococcus pneumoniae R6
cuaaucaaaacgcaguuucag

SEQ ID NO: 2163183 - RNA, 17 nt, Streptococcus pneumoniae R6
cuacaaauguuuuagca

SEQ ID NO: 2163184 - RNA, 14 nt, Streptococcus pneumoniae R6
cuaauuauuucaau

SEQ ID NO: 2163185 - RNA, 22 nt, Streptococcus pneumoniae R6
cuauuauuuaaguguuaugaau

SEQ ID NO: 2163186 - RNA, 21 nt, Streptococcus pneumoniae R6
cuagugaauggauuuaucagu

SEQ ID NO: 2163187 - RNA, 20 nt, Streptococcus pneumoniae R6
cuauaaaagaggagguaaau

SEQ ID NO: 2163188 - RNA, 13 nt, Streptococcus pneumoniae R6
cucauauagacca

SEQ ID NO: 2163189 - RNA, 14 nt, Streptococcus pneumoniae R6
cuauugaguucaca

SEQ ID NO: 2163190 - RNA, 21 nt, Streptococcus pneumoniae R6
cucaaaacaguguuuugagca

SEQ ID NO: 2163191 - RNA, 21 nt, Streptococcus pneumoniae R6
cucaaaaccauguuuugagcu

SEQ ID NO: 2163192 - RNA, 21 nt, Streptococcus pneumoniae R6
cucaaaacgguguuuugagcu

SEQ ID NO: 2163193 - RNA, 13 nt, Streptococcus pneumoniae R6
cucagcacuuggc

SEQ ID NO: 2163194 - RNA, 20 nt, Streptococcus pneumoniae R6
cucauaaaagguauugcaac

SEQ ID NO: 2163195 - RNA, 22 nt, Streptococcus pneumoniae R6
cugaguuagugucgcauaugca

SEQ ID NO: 2163196 - RNA, 23 nt, Streptococcus pneumoniae R6
cugauaagucaggcauaccgccu

SEQ ID NO: 2163197 - RNA, 13 nt, Streptococcus pneumoniae R6
cucuggcaauuua

SEQ ID NO: 2163198 - RNA, 18 nt, Streptococcus pneumoniae R6
cuacccacuacacuugac

SEQ ID NO: 2163199 - RNA, 12 nt, Streptococcus pneumoniae R6
cuaacugcugga

SEQ ID NO: 2163200 - RNA, 20 nt, Streptococcus pneumoniae R6
cuaagauuacugucauauca

SEQ ID NO: 2163201 - RNA, 18 nt, Streptococcus pneumoniae R6
cuacugucaagucuugcu

SEQ ID NO: 2163202 - RNA, 21 nt, Streptococcus pneumoniae R6
cuaguaaauaucauuuccaac

SEQ ID NO: 2163203 - RNA, 19 nt, Streptococcus pneumoniae R6
cuaaaacauuuauagaaau

SEQ ID NO: 2163204 - RNA, 18 nt, Streptococcus pneumoniae R6
cuaaaacgcauccuauca

SEQ ID NO: 2163205 - RNA, 14 nt, Streptococcus pneumoniae R6
cuaacacuugcuag

SEQ ID NO: 2163206 - RNA, 15 nt, Streptococcus pneumoniae R6
cuaaauuccaaauua

SEQ ID NO: 2163207 - RNA, 18 nt, Streptococcus pneumoniae R6
cguaguugguuaccucau

SEQ ID NO: 2163208 - RNA, 22 nt, Streptococcus pneumoniae R6
cgucaguuccauccacaaccuu

SEQ ID NO: 2163209 - RNA, 21 nt, Streptococcus pneumoniae R6
cguccgacauagaugaugguu

SEQ ID NO: 2163210 - RNA, 15 nt, Streptococcus pneumoniae R6
cgucucaaacagugc

SEQ ID NO: 2163211 - RNA, 20 nt, Streptococcus pneumoniae R6
cuuaauuuaaugcaguaaau

SEQ ID NO: 2163212 - RNA, 14 nt, Streptococcus pneumoniae R6
cuuaguaaugacuu

SEQ ID NO: 2163213 - RNA, 20 nt, Streptococcus pneumoniae R6
cuucuuuauguucaucuucu

SEQ ID NO: 2163214 - RNA, 16 nt, Streptococcus pneumoniae R6
cuugauauucuuauca

SEQ ID NO: 2163215 - RNA, 17 nt, Streptococcus pneumoniae R6
cugcuuccauuuccaca

SEQ ID NO: 2163216 - RNA, 16 nt, Streptococcus pneumoniae R6
gaauuacaugaaacug

SEQ ID NO: 2163217 - RNA, 19 nt, Streptococcus pneumoniae R6
gaauuaggauagauaccuu

SEQ ID NO: 2163218 - RNA, 19 nt, Streptococcus pneumoniae R6
gaccaagagacgauuccaa

SEQ ID NO: 2163219 - RNA, 17 nt, Streptococcus pneumoniae R6
gacauugacuuugucac

SEQ ID NO: 2163220 - RNA, 14 nt, Streptococcus pneumoniae R6
gacaguugcauugu

SEQ ID NO: 2163221 - RNA, 20 nt, Streptococcus pneumoniae R6
gaacuugaccuaaaucacuu

SEQ ID NO: 2163222 - RNA, 18 nt, Streptococcus pneumoniae R6
gaaaugaccugcauacgu

SEQ ID NO: 2163223 - RNA, 17 nt, Streptococcus pneumoniae R6
gaauacuuuguuuagac

SEQ ID NO: 2163224 - RNA, 20 nt, Streptococcus pneumoniae R6
gaaucuugcugguuugugaa

SEQ ID NO: 2163225 - RNA, 23 nt, Streptococcus pneumoniae R6
gaaguccauaaugucuucugcuc

SEQ ID NO: 2163226 - RNA, 18 nt, Streptococcus pneumoniae R6
gaaggauuuaguucugua

SEQ ID NO: 2163227 - RNA, 17 nt, Streptococcus pneumoniae R6
gcauaaaaucugaauca

SEQ ID NO: 2163228 - RNA, 15 nt, Streptococcus pneumoniae R6
gcauacguucaaauu

SEQ ID NO: 2163229 - RNA, 18 nt, Streptococcus pneumoniae R6
aagacuuauacucuucaa

SEQ ID NO: 2163230 - RNA, 16 nt, Streptococcus pneumoniae R6
aagagguugggcaauc

SEQ ID NO: 2163231 - RNA, 14 nt, Streptococcus pneumoniae R6
aagagucaagacaa

SEQ ID NO: 2163232 - RNA, 20 nt, Streptococcus pneumoniae R6
aagagccuuuuuaaagauau

SEQ ID NO: 2163233 - RNA, 15 nt, Streptococcus pneumoniae R6
aagaugauaucaaga

SEQ ID NO: 2163234 - RNA, 16 nt, Streptococcus pneumoniae R6
gagauucauucugcua

SEQ ID NO: 2163235 - RNA, 12 nt, Streptococcus pneumoniae R6
gagaauuucugg

SEQ ID NO: 2163236 - RNA, 16 nt, Streptococcus pneumoniae R6
gacucuuauuucucaa

SEQ ID NO: 2163237 - RNA, 13 nt, Streptococcus pneumoniae R6
gacuggaaacuuu

SEQ ID NO: 2163238 - RNA, 23 nt, Streptococcus pneumoniae R6
aacuauguucugugauaaacuug

SEQ ID NO: 2163239 - RNA, 24 nt, Streptococcus pneumoniae R6
gacuguuugagaugauuugcucaa

SEQ ID NO: 2163240 - RNA, 22 nt, Streptococcus pneumoniae R6
gacuucgucaguucuauccaca

SEQ ID NO: 2163241 - RNA, 13 nt, Streptococcus pneumoniae R6
gauaggauugaca

SEQ ID NO: 2163242 - RNA, 22 nt, Streptococcus pneumoniae R6
gaucaaccgauuuaagauaagu

SEQ ID NO: 2163243 - RNA, 17 nt, Streptococcus pneumoniae R6
gaucaagaugagacuug

SEQ ID NO: 2163244 - RNA, 22 nt, Streptococcus pneumoniae R6
gagucaaaaaaggaguaacuau

SEQ ID NO: 2163245 - RNA, 15 nt, Streptococcus pneumoniae R6
gagguguucuaucac

SEQ ID NO: 2163246 - RNA, 19 nt, Streptococcus pneumoniae R6
aagaaaaaaaguaaaucuu

SEQ ID NO: 2163247 - RNA, 16 nt, Streptococcus pneumoniae R6
gauuauuuuuucucaa

SEQ ID NO: 2163248 - RNA, 16 nt, Streptococcus pneumoniae R6
gauucuacuuuuucaa

SEQ ID NO: 2163249 - RNA, 14 nt, Streptococcus pneumoniae R6
gauuucuuuaucaa

SEQ ID NO: 2163250 - RNA, 16 nt, Streptococcus pneumoniae R6
gauuucggccaauucu

SEQ ID NO: 2163251 - RNA, 14 nt, Streptococcus pneumoniae R6
ggacaugaguccug

SEQ ID NO: 2163252 - RNA, 16 nt, Streptococcus pneumoniae R6
ggagccaauggguuga

SEQ ID NO: 2163253 - RNA, 23 nt, Streptococcus pneumoniae R6
aagggaagguguuaaagauuccu

SEQ ID NO: 2163254 - RNA, 15 nt, Streptococcus pneumoniae R6
aaguaaguacaugca

SEQ ID NO: 2163255 - RNA, 13 nt, Streptococcus pneumoniae R6
gggcaccaaacuu

SEQ ID NO: 2163256 - RNA, 14 nt, Streptococcus pneumoniae R6
gggaucgguuagac

SEQ ID NO: 2163257 - RNA, 17 nt, Streptococcus pneumoniae R6
ggucaagauauucuuga

SEQ ID NO: 2163258 - RNA, 18 nt, Streptococcus pneumoniae R6
ggugauuuuuucauagca

SEQ ID NO: 2163259 - RNA, 21 nt, Streptococcus pneumoniae R6
aagucguucggcuucaucugg

SEQ ID NO: 2163260 - RNA, 15 nt, Streptococcus pneumoniae R6
guagauggaacugac

SEQ ID NO: 2163261 - RNA, 15 nt, Streptococcus pneumoniae R6
guagaugaaacugac

SEQ ID NO: 2163262 - RNA, 16 nt, Streptococcus pneumoniae R6
guagcacuuuuccauu

SEQ ID NO: 2163263 - RNA, 19 nt, Streptococcus pneumoniae R6
guaccgaauguggauacug

SEQ ID NO: 2163264 - RNA, 14 nt, Streptococcus pneumoniae R6
gucagcuaagcucg

SEQ ID NO: 2163265 - RNA, 14 nt, Streptococcus pneumoniae R6
gucgaagcuuccaa

SEQ ID NO: 2163266 - RNA, 18 nt, Streptococcus pneumoniae R6
guccugaaaaucaucugc

SEQ ID NO: 2163267 - RNA, 16 nt, Streptococcus pneumoniae R6
guccucaauuugaacc

SEQ ID NO: 2163268 - RNA, 13 nt, Streptococcus pneumoniae R6
gcuaauaguggug

SEQ ID NO: 2163269 - RNA, 14 nt, Streptococcus pneumoniae R6
gcguugacaaucuu

SEQ ID NO: 2163270 - RNA, 20 nt, Streptococcus pneumoniae R6
gcuaauagagcugaggaaau

SEQ ID NO: 2163271 - RNA, 18 nt, Streptococcus pneumoniae R6
gcucaaucaaguaagcca

SEQ ID NO: 2163272 - RNA, 13 nt, Streptococcus pneumoniae R6
gcugacugauuua

SEQ ID NO: 2163273 - RNA, 20 nt, Streptococcus pneumoniae R6
aagcauagaaaaaaggaauc

SEQ ID NO: 2163274 - RNA, 14 nt, Streptococcus pneumoniae R6
aagcagaggcaaug

SEQ ID NO: 2163275 - RNA, 17 nt, Streptococcus pneumoniae R6
gcgaucuggcaggcuga

SEQ ID NO: 2163276 - RNA, 16 nt, Streptococcus pneumoniae R6
aacaucuuugaagaua

SEQ ID NO: 2163277 - RNA, 21 nt, Streptococcus pneumoniae R6
aacauguuuugagcugacuuc

SEQ ID NO: 2163278 - RNA, 18 nt, Streptococcus pneumoniae R6
aacaauauuuuagaagca

SEQ ID NO: 2163279 - RNA, 20 nt, Streptococcus pneumoniae R6
cgagacauaccauuuuccaa

SEQ ID NO: 2163280 - RNA, 14 nt, Streptococcus pneumoniae R6
ccuuaaaacagugu

SEQ ID NO: 2163281 - RNA, 20 nt, Streptococcus pneumoniae R6
ccuuauccacaucaucaaau

SEQ ID NO: 2163282 - RNA, 15 nt, Streptococcus pneumoniae R6
ccuucuuuuacuucu

SEQ ID NO: 2163283 - RNA, 19 nt, Streptococcus pneumoniae R6
ccuucuaauagaacagaga

SEQ ID NO: 2163284 - RNA, 13 nt, Streptococcus pneumoniae R6
ccuuguuuccaag

SEQ ID NO: 2163285 - RNA, 19 nt, Streptococcus pneumoniae R6
ccuuguuuccaaggaaagu

SEQ ID NO: 2163286 - RNA, 13 nt, Streptococcus pneumoniae R6
ccuaaucucuggc

SEQ ID NO: 2163287 - RNA, 16 nt, Streptococcus pneumoniae R6
ccuaaaacaguuacau

SEQ ID NO: 2163288 - RNA, 15 nt, Streptococcus pneumoniae R6
ccuacuguacuuaca

SEQ ID NO: 2163289 - RNA, 20 nt, Streptococcus pneumoniae R6
ccggugaacccaauagcgau

SEQ ID NO: 2163290 - RNA, 20 nt, Streptococcus pneumoniae R6
aaauuaugaugcauaguuga

SEQ ID NO: 2163291 - RNA, 18 nt, Streptococcus pneumoniae R6
aaauucacaaaauccuuu

SEQ ID NO: 2163292 - RNA, 14 nt, Streptococcus pneumoniae R6
cacucgcugacacu

SEQ ID NO: 2163293 - RNA, 15 nt, Streptococcus pneumoniae R6
aaagaauccaauuca

SEQ ID NO: 2163294 - RNA, 20 nt, Streptococcus pneumoniae R6
cagagcgauaaaaauccuuu

SEQ ID NO: 2163295 - RNA, 21 nt, Streptococcus pneumoniae R6
aaagaaauuggcugcaauaau

SEQ ID NO: 2163296 - RNA, 16 nt, Streptococcus pneumoniae R6
cacuuuuuauccguca

SEQ ID NO: 2163297 - RNA, 19 nt, Streptococcus pneumoniae R6
cagaaaacgcauaguauca

SEQ ID NO: 2163298 - RNA, 22 nt, Streptococcus pneumoniae R6
aaacuguccacaaagauaucac

SEQ ID NO: 2163299 - RNA, 12 nt, Streptococcus pneumoniae R6
aaacugugauau

SEQ ID NO: 2163300 - RNA, 17 nt, Streptococcus pneumoniae R6
cacggaguuucuuggcc

SEQ ID NO: 2163301 - RNA, 12 nt, Streptococcus pneumoniae R6
cagccaagacac

SEQ ID NO: 2163302 - RNA, 22 nt, Streptococcus pneumoniae R6
caucauuccugauaaaagauag

SEQ ID NO: 2163303 - RNA, 20 nt, Streptococcus pneumoniae R6
cauaaaaaaguuuccaauca

SEQ ID NO: 2163304 - RNA, 12 nt, Streptococcus pneumoniae R6
caguuucucuac

SEQ ID NO: 2163305 - RNA, 15 nt, Streptococcus pneumoniae R6
caguuuggcguugga

SEQ ID NO: 2163306 - RNA, 22 nt, Streptococcus pneumoniae R6
caguuuguguuucuuuuuggcc

SEQ ID NO: 2163307 - RNA, 12 nt, Streptococcus pneumoniae R6
cauaauacugug

SEQ ID NO: 2163308 - RNA, 14 nt, Streptococcus pneumoniae R6
cauaauagucucuu

SEQ ID NO: 2163309 - RNA, 16 nt, Streptococcus pneumoniae R6
cauaagucauaacauu

SEQ ID NO: 2163310 - RNA, 15 nt, Streptococcus pneumoniae R6
aaagccagucgucac

SEQ ID NO: 2163311 - RNA, 21 nt, Streptococcus pneumoniae R6
aaagcccuucauaagcuaguc

SEQ ID NO: 2163312 - RNA, 12 nt, Streptococcus pneumoniae R6
cauguagauuga

SEQ ID NO: 2163313 - RNA, 17 nt, Streptococcus pneumoniae R6
cauuauuagcucgauug

SEQ ID NO: 2163314 - RNA, 18 nt, Streptococcus pneumoniae R6
cauuauuagcucgauuga

SEQ ID NO: 2163315 - RNA, 19 nt, Streptococcus pneumoniae R6
cauuccucccauauuuggc

SEQ ID NO: 2163316 - RNA, 15 nt, Streptococcus pneumoniae R6
cauucuugguaaaga

SEQ ID NO: 2163317 - RNA, 17 nt, Streptococcus pneumoniae R6
cauugauaugguaaugu

SEQ ID NO: 2163318 - RNA, 18 nt, Streptococcus pneumoniae R6
cauuucaauagcuccuug

SEQ ID NO: 2163319 - RNA, 14 nt, Streptococcus pneumoniae R6
cauuuuuagauuga

SEQ ID NO: 2163320 - RNA, 13 nt, Streptococcus pneumoniae R6
ccaauuaaauaag

SEQ ID NO: 2163321 - RNA, 14 nt, Streptococcus pneumoniae R6
ccaaggauugucug

SEQ ID NO: 2163322 - RNA, 15 nt, Streptococcus pneumoniae R6
ccacaccaccugcca

SEQ ID NO: 2163323 - RNA, 16 nt, Streptococcus pneumoniae R6
aaaguggcugugauau

SEQ ID NO: 2163324 - RNA, 21 nt, Streptococcus pneumoniae R6
aaauagauuggauaaaaucuu

SEQ ID NO: 2163325 - RNA, 17 nt, Streptococcus pneumoniae R6
aaauacuuguagcaauc

SEQ ID NO: 2163326 - RNA, 23 nt, Streptococcus pneumoniae R6
ccauccuccaccuguaauuuggu

SEQ ID NO: 2163327 - RNA, 16 nt, Streptococcus pneumoniae R6
ccaucuucauuuuggu

SEQ ID NO: 2163328 - RNA, 20 nt, Streptococcus pneumoniae R6
cccacuacaguugacaaaga

SEQ ID NO: 2163329 - RNA, 15 nt, Streptococcus pneumoniae R6
ccaugguaucaaagg

SEQ ID NO: 2163330 - RNA, 17 nt, Streptococcus pneumoniae R6
caacugccugguaaaga

SEQ ID NO: 2163331 - RNA, 21 nt, Streptococcus pneumoniae R6
caacuaacaauuaugcuuaaa

SEQ ID NO: 2163332 - RNA, 16 nt, Streptococcus pneumoniae R6
caagauccaauccuuu

SEQ ID NO: 2163333 - RNA, 18 nt, Streptococcus pneumoniae R6
caagagggcuucaaucuc

SEQ ID NO: 2163334 - RNA, 19 nt, Streptococcus pneumoniae R6
caagcgaagggcuucuuug

SEQ ID NO: 2163335 - RNA, 14 nt, Streptococcus pneumoniae R6
caagcucagcauuu

SEQ ID NO: 2163336 - RNA, 15 nt, Streptococcus pneumoniae R6
caauguucaagacau

SEQ ID NO: 2163337 - RNA, 22 nt, Streptococcus pneumoniae R6
caauguuuacucaguauuugga

SEQ ID NO: 2163338 - RNA, 17 nt, Streptococcus pneumoniae R6
caauguuuugaucugac

SEQ ID NO: 2163339 - RNA, 22 nt, Streptococcus pneumoniae R6
caaugauaucugguauauuuug

SEQ ID NO: 2163340 - RNA, 16 nt, Streptococcus pneumoniae R6
caagucaacaccuguc

SEQ ID NO: 2163341 - RNA, 18 nt, Streptococcus pneumoniae R6
caaccuuguggaauuggu

SEQ ID NO: 2163342 - RNA, 14 nt, Streptococcus pneumoniae R6
caacgccgucuucu

SEQ ID NO: 2163343 - RNA, 17 nt, Streptococcus pneumoniae R6
caaccacuucgucuugu

SEQ ID NO: 2163344 - RNA, 14 nt, Streptococcus pneumoniae R6
caaagugcaaacua

SEQ ID NO: 2163345 - RNA, 15 nt, Streptococcus pneumoniae R6
auuuacgaaucucuu

SEQ ID NO: 2163346 - RNA, 20 nt, Streptococcus pneumoniae R6
cacaguuuacaauuagccuu

SEQ ID NO: 2163347 - RNA, 21 nt, Streptococcus pneumoniae R6
aucuuuuuuugaugacauuca

SEQ ID NO: 2163348 - RNA, 21 nt, Streptococcus pneumoniae R6
aucuuugaaauaaucaaaaua

SEQ ID NO: 2163349 - RNA, 14 nt, Streptococcus pneumoniae R6
augaauuucuacaa

SEQ ID NO: 2163350 - RNA, 23 nt, Streptococcus pneumoniae R6
aucuuuagccgcuugacugacua

SEQ ID NO: 2163351 - RNA, 16 nt, Streptococcus pneumoniae R6
aucuucauuuugguaa

SEQ ID NO: 2163352 - RNA, 17 nt, Streptococcus pneumoniae R6
aucuuccuuacuagcaa

SEQ ID NO: 2163353 - RNA, 22 nt, Streptococcus pneumoniae R6
aucuuaguuaaaauaaguuaga

SEQ ID NO: 2163354 - RNA, 15 nt, Streptococcus pneumoniae R6
auugauuuuucugag

SEQ ID NO: 2163355 - RNA, 21 nt, Streptococcus pneumoniae R6
auugaucuagcucucucugau

SEQ ID NO: 2163356 - RNA, 16 nt, Streptococcus pneumoniae R6
auugguacauuuugau

SEQ ID NO: 2163357 - RNA, 23 nt, Streptococcus pneumoniae R6
auugaggguaguaauuuucgaua

SEQ ID NO: 2163358 - RNA, 17 nt, Streptococcus pneumoniae R6
auugacuauauuucuau

SEQ ID NO: 2163359 - RNA, 16 nt, Streptococcus pneumoniae R6
auucuggcauuuguaa

SEQ ID NO: 2163360 - RNA, 15 nt, Streptococcus pneumoniae R6
auucuuauuuggcaa

SEQ ID NO: 2163361 - RNA, 19 nt, Streptococcus pneumoniae R6
auuauagucgcuagacuga

SEQ ID NO: 2163362 - RNA, 22 nt, Streptococcus pneumoniae R6
auuauuuccuugaccaaguccu

SEQ ID NO: 2163363 - RNA, 13 nt, Streptococcus pneumoniae R6
auucauaucccca

SEQ ID NO: 2163364 - RNA, 20 nt, Streptococcus pneumoniae R6
auuagggaaacaaaagucuu

SEQ ID NO: 2163365 - RNA, 19 nt, Streptococcus pneumoniae R6
auguuagaaaaaguucaau

SEQ ID NO: 2163366 - RNA, 14 nt, Streptococcus pneumoniae R6
auguuuccugcaaa

SEQ ID NO: 2163367 - RNA, 18 nt, Streptococcus pneumoniae R6
auuaaagagaugagagau

SEQ ID NO: 2163368 - RNA, 18 nt, Streptococcus pneumoniae R6
auguuuugagcugacuuc

SEQ ID NO: 2163369 - RNA, 19 nt, Streptococcus pneumoniae R6
auggacaacaaugagaaau

SEQ ID NO: 2163370 - RNA, 12 nt, Streptococcus pneumoniae R6
augcuuuccauu

SEQ ID NO: 2163371 - RNA, 16 nt, Streptococcus pneumoniae R6
augcuuggugagaaag

SEQ ID NO: 2163372 - RNA, 17 nt, Streptococcus pneumoniae R6
augcuuuuuucuaugau

SEQ ID NO: 2163373 - RNA, 22 nt, Streptococcus pneumoniae R6
augcguuuuuucugauuucaaa

SEQ ID NO: 2163374 - RNA, 19 nt, Streptococcus pneumoniae R6
aguaaaacgcauaauauca

SEQ ID NO: 2163375 - RNA, 16 nt, Streptococcus pneumoniae R6
aguacuuuuucuauga

SEQ ID NO: 2163376 - RNA, 14 nt, Streptococcus pneumoniae R6
aggcaucaucugaa

SEQ ID NO: 2163377 - RNA, 23 nt, Streptococcus pneumoniae R6
aguugaagggcguugacaaucuu

SEQ ID NO: 2163378 - RNA, 12 nt, Streptococcus pneumoniae R6
aguucuucagaa

SEQ ID NO: 2163379 - RNA, 19 nt, Streptococcus pneumoniae R6
aguucuugaaaugaaguua

SEQ ID NO: 2163380 - RNA, 14 nt, Streptococcus pneumoniae R6
aguucuaucugcaa

SEQ ID NO: 2163381 - RNA, 22 nt, Streptococcus pneumoniae R6
agucuuuaucgauucuugcaaa

SEQ ID NO: 2163382 - RNA, 16 nt, Streptococcus pneumoniae R6
agugagaagcccagua

SEQ ID NO: 2163383 - RNA, 18 nt, Streptococcus pneumoniae R6
agucaauuucucuacaaa

SEQ ID NO: 2163384 - RNA, 19 nt, Streptococcus pneumoniae R6
agugcggacggucuuugga

SEQ ID NO: 2163385 - RNA, 16 nt, Streptococcus pneumoniae R6
auaagaccaaaagucg

SEQ ID NO: 2163386 - RNA, 15 nt, Streptococcus pneumoniae R6
aguuuccgaauaccu

SEQ ID NO: 2163387 - RNA, 16 nt, Streptococcus pneumoniae R6
auacauuuuuucugaa

SEQ ID NO: 2163388 - RNA, 13 nt, Streptococcus pneumoniae R6
auacaucuaugau

SEQ ID NO: 2163389 - RNA, 18 nt, Streptococcus pneumoniae R6
auagcaguugguuguuca

SEQ ID NO: 2163390 - RNA, 18 nt, Streptococcus pneumoniae R6
auagaaggaguugagccu

SEQ ID NO: 2163391 - RNA, 20 nt, Streptococcus pneumoniae R6
auacucuucaaaaaucucuu

SEQ ID NO: 2163392 - RNA, 13 nt, Streptococcus pneumoniae R6
auauagaaguagu

SEQ ID NO: 2163393 - RNA, 20 nt, Streptococcus pneumoniae R6
auaggaugccuuuuuaugau

SEQ ID NO: 2163394 - RNA, 22 nt, Streptococcus pneumoniae R6
auaggcaauuucgauaauaccu

SEQ ID NO: 2163395 - RNA, 14 nt, Streptococcus pneumoniae R6
aucaaacuagcaag

SEQ ID NO: 2163396 - RNA, 19 nt, Streptococcus pneumoniae R6
aucaagacagauuugacgu

SEQ ID NO: 2163397 - RNA, 19 nt, Streptococcus pneumoniae R6
aucaccaagcauuuucaua

SEQ ID NO: 2163398 - RNA, 20 nt, Streptococcus pneumoniae R6
aucacccaaaacuucugcaa

SEQ ID NO: 2163399 - RNA, 14 nt, Streptococcus pneumoniae R6
agcucuucagcaaa

SEQ ID NO: 2163400 - RNA, 18 nt, Streptococcus pneumoniae R6
aaaccuugauaggaugcc

SEQ ID NO: 2163401 - RNA, 13 nt, Streptococcus pneumoniae R6
aaaccguucaaga

SEQ ID NO: 2163402 - RNA, 17 nt, Streptococcus pneumoniae R6
agcaaaagaacaaguaa

SEQ ID NO: 2163403 - RNA, 17 nt, Streptococcus pneumoniae R6
agcaaccauuuucucaa

SEQ ID NO: 2163404 - RNA, 20 nt, Streptococcus pneumoniae R6
acugcuaaaagauuucuaua

SEQ ID NO: 2163405 - RNA, 16 nt, Streptococcus pneumoniae R6
acucuucuuuuggcaa

SEQ ID NO: 2163406 - RNA, 16 nt, Streptococcus pneumoniae R6
acucuaacuucugcua

SEQ ID NO: 2163407 - RNA, 22 nt, Streptococcus pneumoniae R6
acuucugaaucugccucaagaa

SEQ ID NO: 2163408 - RNA, 16 nt, Streptococcus pneumoniae R6
acuucgucaguuucau

SEQ ID NO: 2163409 - RNA, 13 nt, Streptococcus pneumoniae R6
acuugaccuguuu

SEQ ID NO: 2163410 - RNA, 22 nt, Streptococcus pneumoniae R6
acggggcuguuuuguugacuug

SEQ ID NO: 2163411 - RNA, 18 nt, Streptococcus pneumoniae R6
acgucuuuugccuuagca

SEQ ID NO: 2163412 - RNA, 16 nt, Streptococcus pneumoniae R6
acguauucagucaucu

SEQ ID NO: 2163413 - RNA, 20 nt, Streptococcus pneumoniae R6
accuguugaugcaucaagug

SEQ ID NO: 2163414 - RNA, 19 nt, Streptococcus pneumoniae R6
acgcaucauaucaagguuu

SEQ ID NO: 2163415 - RNA, 16 nt, Streptococcus pneumoniae R6
aaacauuggucgcauc

SEQ ID NO: 2163416 - RNA, 18 nt, Streptococcus pneumoniae R6
acagcuagucuagucugg

SEQ ID NO: 2163417 - RNA, 13 nt, Streptococcus pneumoniae R6
acaucagaugaca

SEQ ID NO: 2163418 - RNA, 19 nt, Streptococcus pneumoniae R6
acauaccuacgauaucuga

SEQ ID NO: 2163419 - RNA, 13 nt, Streptococcus pneumoniae R6
acaguaccgaaug

SEQ ID NO: 2163420 - RNA, 21 nt, Streptococcus pneumoniae R6
acagucaaaucgauuucuaac

SEQ ID NO: 2163421 - RNA, 14 nt, Streptococcus pneumoniae R6
accaagucugcaug

SEQ ID NO: 2163422 - RNA, 16 nt, Streptococcus pneumoniae R6
acaucuggcucauauc

SEQ ID NO: 2163423 - RNA, 17 nt, Streptococcus pneumoniae R6
accacaccgauaucuga

SEQ ID NO: 2163424 - RNA, 16 nt, Streptococcus pneumoniae R6
accagaaagaacuggg

SEQ ID NO: 2163425 - RNA, 13 nt, Streptococcus pneumoniae R6
aagauuucuauaa

SEQ ID NO: 2163426 - RNA, 13 nt, Streptococcus pneumoniae R6
aagcaacuuacuc

SEQ ID NO: 2163427 - RNA, 18 nt, Streptococcus pneumoniae R6
aagcaaaagccgauaccu

SEQ ID NO: 2163428 - RNA, 14 nt, Streptococcus pneumoniae R6
aagagcaucugccg

SEQ ID NO: 2163429 - RNA, 20 nt, Streptococcus pneumoniae R6
aagagccucauaaaagguau

SEQ ID NO: 2163430 - RNA, 15 nt, Streptococcus pneumoniae R6
aagaggagugauaau

SEQ ID NO: 2163431 - RNA, 16 nt, Streptococcus pneumoniae R6
aaguaaucucuaacaa

SEQ ID NO: 2163432 - RNA, 17 nt, Streptococcus pneumoniae R6
aagcuuccaauaauaga

SEQ ID NO: 2163433 - RNA, 17 nt, Streptococcus pneumoniae R6
aauacaugcaaguagaa

SEQ ID NO: 2163434 - RNA, 16 nt, Streptococcus pneumoniae R6
aaguccucauuucaau

SEQ ID NO: 2163435 - RNA, 19 nt, Streptococcus pneumoniae R6
aauaacucuguaaucucua

SEQ ID NO: 2163436 - RNA, 21 nt, Streptococcus pneumoniae R6
aauggccagauaauucucuaa

SEQ ID NO: 2163437 - RNA, 12 nt, Streptococcus pneumoniae R6
aauggcaaccgu

SEQ ID NO: 2163438 - RNA, 18 nt, Streptococcus pneumoniae R6
aaucugaaauauaauaga

SEQ ID NO: 2163439 - RNA, 22 nt, Streptococcus pneumoniae R6
aauuaucauaguacaauaccuu

SEQ ID NO: 2163440 - RNA, 14 nt, Streptococcus pneumoniae R6
aauucucuaaguga

SEQ ID NO: 2163441 - RNA, 19 nt, Streptococcus pneumoniae R6
aaucgcuggcauuucccau

SEQ ID NO: 2163442 - RNA, 15 nt, Streptococcus pneumoniae R6
aauccacuugggaaa

SEQ ID NO: 2163443 - RNA, 22 nt, Streptococcus pneumoniae R6
aauccacguuuacgaaucucuu

SEQ ID NO: 2163444 - RNA, 21 nt, Streptococcus pneumoniae R6
aaccaaaaaguggaaagagca

SEQ ID NO: 2163445 - RNA, 15 nt, Streptococcus pneumoniae R6
aaccaacauagcuaa

SEQ ID NO: 2163446 - RNA, 15 nt, Streptococcus pneumoniae R6
aaccaagucugcaug

SEQ ID NO: 2163447 - RNA, 13 nt, Streptococcus pneumoniae R6
aaaaaaggaguaa

SEQ ID NO: 2163448 - RNA, 20 nt, Streptococcus pneumoniae R6
aaaaacacauuuugaaaugu

SEQ ID NO: 2163449 - RNA, 19 nt, Streptococcus pneumoniae R6
aaagauuauaggcgauaau

SEQ ID NO: 2163450 - RNA, 17 nt, Streptococcus pneumoniae R6
aaagcaacacaccuugu

SEQ ID NO: 2163451 - RNA, 17 nt, Streptococcus pneumoniae R6
aaacuucuggcuuaaca

SEQ ID NO: 2163452 - RNA, 18 nt, Streptococcus pneumoniae R6
aaagauaaaauugauaau

SEQ ID NO: 2163453 - RNA, 14 nt, Streptococcus pneumoniae R6
aaacuggugauaag

SEQ ID NO: 2163454 - RNA, 20 nt, Streptococcus pneumoniae R6
aaacucaguuaaaaucaguu

SEQ ID NO: 2163455 - RNA, 13 nt, Streptococcus pneumoniae R6
aaaaauucugcca

SEQ ID NO: 2163456 - RNA, 14 nt, Streptococcus pneumoniae R6
aaagcugaauucua

SEQ ID NO: 2163457 - RNA, 19 nt, Streptococcus pneumoniae R6
aaaaauuaaggcgauugcu

SEQ ID NO: 2163458 - RNA, 16 nt, Streptococcus pneumoniae R6
aaaaauagaaggagau

SEQ ID NO: 2163459 - RNA, 20 nt, Streptococcus pneumoniae R6
aaaaaucguguuucauaugu

SEQ ID NO: 2163460 - RNA, 22 nt, Streptococcus pneumoniae R6
aaaaaucguguuucauauguaa

SEQ ID NO: 2163461 - RNA, 18 nt, Streptococcus pneumoniae R6
aaauugcgauuuugccaa

SEQ ID NO: 2163462 - RNA, 22 nt, Streptococcus pneumoniae R6
aaauuauucuuaucuuuggcaa

SEQ ID NO: 2163463 - RNA, 23 nt, Streptococcus pneumoniae R6
uuuucgcuuggauuuucaaggua

SEQ ID NO: 2163464 - RNA, 20 nt, Streptococcus pneumoniae R6
uuuguuuauaucuuauuuca

SEQ ID NO: 2163465 - RNA, 20 nt, Streptococcus pneumoniae R6
uuuguuccgauuuuauuuca

SEQ ID NO: 2163466 - RNA, 20 nt, Streptococcus pneumoniae R6
uuuguucauaucuuauuuca

SEQ ID NO: 2163467 - RNA, 20 nt, Streptococcus pneumoniae R6
uuugcucgcuggagagacuu

SEQ ID NO: 2163468 - RNA, 20 nt, Streptococcus pneumoniae R6
uuugagguugcagauaagac

SEQ ID NO: 2163469 - RNA, 13 nt, Streptococcus pneumoniae R6
uuugagcugacuu

SEQ ID NO: 2163470 - RNA, 17 nt, Streptococcus pneumoniae R6
uuugacaaguaaguagc

SEQ ID NO: 2163471 - RNA, 12 nt, Streptococcus pneumoniae R6
uuucuucuuuca

SEQ ID NO: 2163472 - RNA, 15 nt, Streptococcus pneumoniae R6
uuucuaauuauuuca

SEQ ID NO: 2163473 - RNA, 16 nt, Streptococcus pneumoniae R6
uuucuauuaagcuggc

SEQ ID NO: 2163474 - RNA, 19 nt, Streptococcus pneumoniae R6
uuucuauaaauucauuuga

SEQ ID NO: 2163475 - RNA, 18 nt, Streptococcus pneumoniae R6
uuucuaucaacucaagaa

SEQ ID NO: 2163476 - RNA, 14 nt, Streptococcus pneumoniae R6
uuucuccauagauu

SEQ ID NO: 2163477 - RNA, 16 nt, Streptococcus pneumoniae R6
uuuaucgaaaagacuu

SEQ ID NO: 2163478 - RNA, 14 nt, Streptococcus pneumoniae R6
uuuagaagcuucuu

SEQ ID NO: 2163479 - RNA, 18 nt, Streptococcus pneumoniae R6
uuucacaauuucauuucu

SEQ ID NO: 2163480 - RNA, 18 nt, Streptococcus pneumoniae R6
uuguagauagaacugacg

SEQ ID NO: 2163481 - RNA, 18 nt, Streptococcus pneumoniae R6
uuguagauggaacugacg

SEQ ID NO: 2163482 - RNA, 17 nt, Streptococcus pneumoniae R6
uucuuuauguucaucuu

SEQ ID NO: 2163483 - RNA, 14 nt, Streptococcus pneumoniae R6
uucuuuuuguucaa

SEQ ID NO: 2163484 - RNA, 15 nt, Streptococcus pneumoniae R6
uucuuuuuuuccaug

SEQ ID NO: 2163485 - RNA, 15 nt, Streptococcus pneumoniae R6
uggcugguauuaaga

SEQ ID NO: 2163486 - RNA, 13 nt, Streptococcus pneumoniae R6
ugggcagaaguuu

SEQ ID NO: 2163487 - RNA, 18 nt, Streptococcus pneumoniae R6
uggucagaggggugcuga

SEQ ID NO: 2163488 - RNA, 24 nt, Streptococcus pneumoniae R6
ugguccagcuucaaaucccaugua

SEQ ID NO: 2163489 - RNA, 11 nt, Streptococcus pneumoniae R6
uguaggcuagc

SEQ ID NO: 2163490 - RNA, 21 nt, Streptococcus pneumoniae R6
uguccguaaaacgauaaauuc

SEQ ID NO: 2163491 - RNA, 18 nt, Streptococcus pneumoniae R6
ugucuucaaaggucaaau

SEQ ID NO: 2163492 - RNA, 14 nt, Streptococcus pneumoniae R6
ugucuuuucaaagu

SEQ ID NO: 2163493 - RNA, 20 nt, Streptococcus pneumoniae R6
uucauuuuugagugguuucu

SEQ ID NO: 2163494 - RNA, 14 nt, Streptococcus pneumoniae R6
uucaaaguuaacuu

SEQ ID NO: 2163495 - RNA, 11 nt, Streptococcus pneumoniae R6
uucaagagcuu

SEQ ID NO: 2163496 - RNA, 21 nt, Streptococcus pneumoniae R6
uuaagugcguugauaaucuua

SEQ ID NO: 2163497 - RNA, 21 nt, Streptococcus pneumoniae R6
uuacugacuucgucaguuuca

SEQ ID NO: 2163498 - RNA, 13 nt, Streptococcus pneumoniae R6
uuagccauacguu

SEQ ID NO: 2163499 - RNA, 19 nt, Streptococcus pneumoniae R6
uuauacucuucgaaaaucu

SEQ ID NO: 2163500 - RNA, 18 nt, Streptococcus pneumoniae R6
uuaauuaggaaagaaugu

SEQ ID NO: 2163501 - RNA, 13 nt, Streptococcus pneumoniae R6
uuacggucaaagu

SEQ ID NO: 2163502 - RNA, 22 nt, Streptococcus pneumoniae R6
uucucaaagcguuuauauagua

SEQ ID NO: 2163503 - RNA, 21 nt, Streptococcus pneumoniae R6
uucuccuuugagguuaaucaa

SEQ ID NO: 2163504 - RNA, 21 nt, Streptococcus pneumoniae R6
uucucuacaguuggagcaucu

SEQ ID NO: 2163505 - RNA, 12 nt, Streptococcus pneumoniae R6
uucugaaauuga

SEQ ID NO: 2163506 - RNA, 16 nt, Streptococcus pneumoniae R6
uucuuauuucauuuua

SEQ ID NO: 2163507 - RNA, 21 nt, Streptococcus pneumoniae R6
uucuuauuuggcaauucaauu

SEQ ID NO: 2163508 - RNA, 13 nt, Streptococcus pneumoniae R6
uucuucaagagcu

SEQ ID NO: 2163509 - RNA, 16 nt, Streptococcus pneumoniae R6
uucuuauucuuggcgu

SEQ ID NO: 2163510 - RNA, 15 nt, Streptococcus pneumoniae R6
uucuucccacgacgg

SEQ ID NO: 2163511 - RNA, 14 nt, Streptococcus pneumoniae R6
uucuucuggaaguu

SEQ ID NO: 2163512 - RNA, 22 nt, Streptococcus pneumoniae R6
uucuugaccaacuuuaagagcu

SEQ ID NO: 2163513 - RNA, 22 nt, Streptococcus pneumoniae R6
uucuugagaagagcuucuuuca

SEQ ID NO: 2163514 - RNA, 20 nt, Streptococcus pneumoniae R6
uucuuacacguuuuugucua

SEQ ID NO: 2163515 - RNA, 15 nt, Streptococcus pneumoniae R6
uucuuaaaagcuucu

SEQ ID NO: 2163516 - RNA, 17 nt, Streptococcus pneumoniae R6
uucuaauuauuucaauu

SEQ ID NO: 2163517 - RNA, 19 nt, Streptococcus pneumoniae R6
uucuaauacaagcucaucu

SEQ ID NO: 2163518 - RNA, 20 nt, Streptococcus pneumoniae R6
uuccgcaagauucgaugguu

SEQ ID NO: 2163519 - RNA, 16 nt, Streptococcus pneumoniae R6
uuccugucuuauuuca

SEQ ID NO: 2163520 - RNA, 17 nt, Streptococcus pneumoniae R6
uucgccacguucaacau

SEQ ID NO: 2163521 - RNA, 15 nt, Streptococcus pneumoniae R6
ucguucugucugcug

SEQ ID NO: 2163522 - RNA, 20 nt, Streptococcus pneumoniae R6
ucuaucuucuugauacugau

SEQ ID NO: 2163523 - RNA, 19 nt, Streptococcus pneumoniae R6
ucucugucccaucauuucu

SEQ ID NO: 2163524 - RNA, 14 nt, Streptococcus pneumoniae R6
ucucuccuuaucaa

SEQ ID NO: 2163525 - RNA, 22 nt, Streptococcus pneumoniae R6
ucucaaaaucaaagacuuauac

SEQ ID NO: 2163526 - RNA, 16 nt, Streptococcus pneumoniae R6
ucuccuguuucaaagu

SEQ ID NO: 2163527 - RNA, 22 nt, Streptococcus pneumoniae R6
ucucuuuuuugauguucaaagu

SEQ ID NO: 2163528 - RNA, 15 nt, Streptococcus pneumoniae R6
ucugaugcugacaag

SEQ ID NO: 2163529 - RNA, 16 nt, Streptococcus pneumoniae R6
ucugucaccuuaucac

SEQ ID NO: 2163530 - RNA, 15 nt, Streptococcus pneumoniae R6
ucugcuugcaucaaa

SEQ ID NO: 2163531 - RNA, 18 nt, Streptococcus pneumoniae R6
ucuggaugccauuggaca

SEQ ID NO: 2163532 - RNA, 19 nt, Streptococcus pneumoniae R6
ucuucaacauucuccagua

SEQ ID NO: 2163533 - RNA, 18 nt, Streptococcus pneumoniae R6
ucuuccaguuuauaacuu

SEQ ID NO: 2163534 - RNA, 14 nt, Streptococcus pneumoniae R6
ucuucgauaucuug

SEQ ID NO: 2163535 - RNA, 15 nt, Streptococcus pneumoniae R6
ucuuuuucauaacuu

SEQ ID NO: 2163536 - RNA, 16 nt, Streptococcus pneumoniae R6
ugaaaaaauggacuuu

SEQ ID NO: 2163537 - RNA, 12 nt, Streptococcus pneumoniae R6
ucuuuucaaagu

SEQ ID NO: 2163538 - RNA, 13 nt, Streptococcus pneumoniae R6
ucuuuauaggcuu

SEQ ID NO: 2163539 - RNA, 12 nt, Streptococcus pneumoniae R6
ucuugucaaaga

SEQ ID NO: 2163540 - RNA, 22 nt, Streptococcus pneumoniae R6
ugaugcaagauauucauuaagu

SEQ ID NO: 2163541 - RNA, 15 nt, Streptococcus pneumoniae R6
ugauuucggccaauu

SEQ ID NO: 2163542 - RNA, 19 nt, Streptococcus pneumoniae R6
ugauaagaauaucaagaua

SEQ ID NO: 2163543 - RNA, 16 nt, Streptococcus pneumoniae R6
ugauaauugauuaaga

SEQ ID NO: 2163544 - RNA, 13 nt, Streptococcus pneumoniae R6
ugauaucaccauc

SEQ ID NO: 2163545 - RNA, 14 nt, Streptococcus pneumoniae R6
ugagaaauuucaac

SEQ ID NO: 2163546 - RNA, 20 nt, Streptococcus pneumoniae R6
ugaagcaucaaauccuucag

SEQ ID NO: 2163547 - RNA, 13 nt, Streptococcus pneumoniae R6
ugccaaagguaau

SEQ ID NO: 2163548 - RNA, 23 nt, Streptococcus pneumoniae R6
ugccaacaaacauggcgccauuu

SEQ ID NO: 2163549 - RNA, 17 nt, Streptococcus pneumoniae R6
ugcuugugaucaauuca

SEQ ID NO: 2163550 - RNA, 13 nt, Streptococcus pneumoniae R6
ugcggucccaguu

SEQ ID NO: 2163551 - RNA, 21 nt, Streptococcus pneumoniae R6
ugcuacaaggacauugacuuu

SEQ ID NO: 2163552 - RNA, 13 nt, Streptococcus pneumoniae R6
ugcucaaaacacu

SEQ ID NO: 2163553 - RNA, 16 nt, Streptococcus pneumoniae R6
ugcucaaucuuaucaa

SEQ ID NO: 2163554 - RNA, 15 nt, Streptococcus pneumoniae R6
ugccuaauacaugca

SEQ ID NO: 2163555 - RNA, 23 nt, Streptococcus pneumoniae R6
uccacguccgucaagaagagcuu

SEQ ID NO: 2163556 - RNA, 16 nt, Streptococcus pneumoniae R6
uccacagaccugucca

SEQ ID NO: 2163557 - RNA, 15 nt, Streptococcus pneumoniae R6
uccaccacuugcuua

SEQ ID NO: 2163558 - RNA, 16 nt, Streptococcus pneumoniae R6
uccauccucaccagua

SEQ ID NO: 2163559 - RNA, 22 nt, Streptococcus pneumoniae R6
uccagcuauuaaguccuuccca

SEQ ID NO: 2163560 - RNA, 24 nt, Streptococcus pneumoniae R6
uccaaacgauuaucuaacaauaag

SEQ ID NO: 2163561 - RNA, 17 nt, Streptococcus pneumoniae R6
ucauucacuacuuugac

SEQ ID NO: 2163562 - RNA, 13 nt, Streptococcus pneumoniae R6
ucauaaaaauaag

SEQ ID NO: 2163563 - RNA, 14 nt, Streptococcus pneumoniae R6
ucauaaagccaguc

SEQ ID NO: 2163564 - RNA, 18 nt, Streptococcus pneumoniae R6
ucauaaauauccugcccc

SEQ ID NO: 2163565 - RNA, 22 nt, Streptococcus pneumoniae R6
ucauaaucaggccagaugacuu

SEQ ID NO: 2163566 - RNA, 16 nt, Streptococcus pneumoniae R6
uccuauucuugauuua

SEQ ID NO: 2163567 - RNA, 22 nt, Streptococcus pneumoniae R6
uccucaaaauucugucuuagac

SEQ ID NO: 2163568 - RNA, 18 nt, Streptococcus pneumoniae R6
uccuaauaaacuugauua

SEQ ID NO: 2163569 - RNA, 18 nt, Streptococcus pneumoniae R6
ucccguaucuuugauaca

SEQ ID NO: 2163570 - RNA, 17 nt, Streptococcus pneumoniae R6
uccucuguaucaagaua

SEQ ID NO: 2163571 - RNA, 16 nt, Streptococcus pneumoniae R6
uccuuuuugauaacgu

SEQ ID NO: 2163572 - RNA, 22 nt, Streptococcus pneumoniae R6
ucgaaaucacgcuuuucuugac

SEQ ID NO: 2163573 - RNA, 16 nt, Streptococcus pneumoniae R6
uccuuacggucaaagu

SEQ ID NO: 2163574 - RNA, 14 nt, Streptococcus pneumoniae R6
uagaaaauuaacuu

SEQ ID NO: 2163575 - RNA, 15 nt, Streptococcus pneumoniae R6
uagaacuaguaaauu

SEQ ID NO: 2163576 - RNA, 17 nt, Streptococcus pneumoniae R6
uagaaauagggauuaau

SEQ ID NO: 2163577 - RNA, 15 nt, Streptococcus pneumoniae R6
uagaaauaucugcac

SEQ ID NO: 2163578 - RNA, 18 nt, Streptococcus pneumoniae R6
uagaaauugaaguaauaa

SEQ ID NO: 2163579 - RNA, 17 nt, Streptococcus pneumoniae R6
uaggcuaaugagucuau

SEQ ID NO: 2163580 - RNA, 14 nt, Streptococcus pneumoniae R6
uaggcuggauacga

SEQ ID NO: 2163581 - RNA, 21 nt, Streptococcus pneumoniae R6
uagccuguaugaugggcucuu

SEQ ID NO: 2163582 - RNA, 19 nt, Streptococcus pneumoniae R6
uagauucaccaguagacuu

SEQ ID NO: 2163583 - RNA, 15 nt, Streptococcus pneumoniae R6
uauucaucuuaucaa

SEQ ID NO: 2163584 - RNA, 12 nt, Streptococcus pneumoniae R6
uauuaagaaucu

SEQ ID NO: 2163585 - RNA, 18 nt, Streptococcus pneumoniae R6
uaucacucaguuucugac

SEQ ID NO: 2163586 - RNA, 14 nt, Streptococcus pneumoniae R6
uauccgaagggcua

SEQ ID NO: 2163587 - RNA, 19 nt, Streptococcus pneumoniae R6
uauagguuccuucugcauc

SEQ ID NO: 2163588 - RNA, 18 nt, Streptococcus pneumoniae R6
uauacauuuagaaaggua

SEQ ID NO: 2163589 - RNA, 16 nt, Streptococcus pneumoniae R6
uaguucauaagagcua

SEQ ID NO: 2163590 - RNA, 20 nt, Streptococcus pneumoniae R6
uagucccugguaaaagagca

SEQ ID NO: 2163591 - RNA, 14 nt, Streptococcus pneumoniae R6
uaguauuaguaauu

SEQ ID NO: 2163592 - RNA, 21 nt, Streptococcus pneumoniae R6
uagucaauugaaacaagagca

SEQ ID NO: 2163593 - RNA, 18 nt, Streptococcus pneumoniae R6
guugcagauagaacugac

SEQ ID NO: 2163594 - RNA, 21 nt, Streptococcus pneumoniae R6
guuucuuaaucuguuuggcaa

SEQ ID NO: 2163595 - RNA, 23 nt, Streptococcus pneumoniae R6
guuuuccuugccuaauuuuucaa

SEQ ID NO: 2163596 - RNA, 15 nt, Streptococcus pneumoniae R6
guuuaccccaaauuc

SEQ ID NO: 2163597 - RNA, 17 nt, Streptococcus pneumoniae R6
guuucgaaguuucaauc

SEQ ID NO: 2163598 - RNA, 23 nt, Streptococcus pneumoniae R6
guuguagaugaaacugacgaagu

SEQ ID NO: 2163599 - RNA, 23 nt, Streptococcus pneumoniae R6
guuguagauggaacugacgaagu

SEQ ID NO: 2163600 - RNA, 14 nt, Streptococcus pneumoniae R6
guuggccaacuucu

SEQ ID NO: 2163601 - RNA, 21 nt, Streptococcus pneumoniae R6
uacaagacagguuuugaagca

SEQ ID NO: 2163602 - RNA, 23 nt, Streptococcus pneumoniae R6
uaauggucuggauguucugucug

SEQ ID NO: 2163603 - RNA, 17 nt, Streptococcus pneumoniae R6
uaaauccacguuuacga

SEQ ID NO: 2163604 - RNA, 19 nt, Streptococcus pneumoniae R6
uaagaaaucuccagauuag

SEQ ID NO: 2163605 - RNA, 13 nt, Streptococcus pneumoniae R6
uaaaauuugaaca

SEQ ID NO: 2163606 - RNA, 18 nt, Streptococcus pneumoniae R6
uaaaaccuugauacugua

SEQ ID NO: 2163607 - RNA, 18 nt, Streptococcus pneumoniae R6
guuuuuugaaguuuucaa

SEQ ID NO: 2163608 - RNA, 15 nt, Streptococcus pneumoniae R6
guuuuugaauaaccu

SEQ ID NO: 2163609 - RNA, 14 nt, Streptococcus pneumoniae R6
gucuuggaaaaugg

SEQ ID NO: 2163610 - RNA, 20 nt, Streptococcus pneumoniae R6
gucgcugaguaaagacuaga

SEQ ID NO: 2163611 - RNA, 15 nt, Streptococcus pneumoniae R6
guggaugaaacugac

SEQ ID NO: 2163612 - RNA, 18 nt, Streptococcus pneumoniae R6
guccaauuuugucucuga

SEQ ID NO: 2163613 - RNA, 15 nt, Streptococcus pneumoniae R6
gucccaucauuucuu

SEQ ID NO: 2163614 - RNA, 19 nt, Streptococcus pneumoniae R6
guaucugaugcugacaagu

SEQ ID NO: 2163615 - RNA, 20 nt, Streptococcus pneumoniae R6
guauucaucuuaucaacgcu

SEQ ID NO: 2163616 - RNA, 18 nt, Streptococcus pneumoniae R6
guauuuaugugcuuaaca

SEQ ID NO: 2163617 - RNA, 15 nt, Streptococcus pneumoniae R6
guagauagaacugac

SEQ ID NO: 2163618 - RNA, 18 nt, Streptococcus pneumoniae R6
guaaaaucaggaagguca

SEQ ID NO: 2163619 - RNA, 15 nt, Streptococcus pneumoniae R6
ggucagcuucuugca

SEQ ID NO: 2163620 - RNA, 21 nt, Streptococcus pneumoniae R6
ggcgauuuuuuugauuucugg

SEQ ID NO: 2163621 - RNA, 17 nt, Streptococcus pneumoniae R6
ggcagauuucaaaccug

SEQ ID NO: 2163622 - RNA, 20 nt, Streptococcus pneumoniae R6
gcgauuuacaucuucucugg

SEQ ID NO: 2163623 - RNA, 17 nt, Streptococcus pneumoniae R6
gcucaaucuuaucaauc

SEQ ID NO: 2163624 - RNA, 14 nt, Streptococcus pneumoniae R6
gcucuuugucaagu

SEQ ID NO: 2163625 - RNA, 17 nt, Streptococcus pneumoniae R6
gcugacgugguuugcag

SEQ ID NO: 2163626 - RNA, 18 nt, Streptococcus pneumoniae R6
ggacacgguaaugauuga

SEQ ID NO: 2163627 - RNA, 18 nt, Streptococcus pneumoniae R6
gcuugauaguagccaauu

SEQ ID NO: 2163628 - RNA, 23 nt, Streptococcus pneumoniae R6
gcuuuuuccucauaccuagcgaa

SEQ ID NO: 2163629 - RNA, 22 nt, Streptococcus pneumoniae R6
gcuuucaacugcuuuuucaauc

SEQ ID NO: 2163630 - RNA, 19 nt, Streptococcus pneumoniae R6
ugaccaacuuuaagagcuu

SEQ ID NO: 2163631 - RNA, 14 nt, Streptococcus pneumoniae R6
ucuuuucaagaacu

SEQ ID NO: 2163632 - RNA, 14 nt, Streptococcus pneumoniae R6
ugaaaaugugaaau

SEQ ID NO: 2163633 - RNA, 18 nt, Streptococcus pneumoniae R6
ucuugcaaacuuuccaau

SEQ ID NO: 2163634 - RNA, 18 nt, Streptococcus pneumoniae R6
aauacggucaaucaacuu

SEQ ID NO: 2163635 - RNA, 14 nt, Streptococcus pneumoniae R6
ucuaaagaguauaa

SEQ ID NO: 2163636 - RNA, 19 nt, Streptococcus pneumoniae R6
ucuaacuguauugaccaaa

SEQ ID NO: 2163637 - RNA, 17 nt, Streptococcus pneumoniae R6
ucuacaucauugucaaa

SEQ ID NO: 2163638 - RNA, 13 nt, Streptococcus pneumoniae R6
ucuauaaacaaag

SEQ ID NO: 2163639 - RNA, 21 nt, Streptococcus pneumoniae R6
ucuauaguagauugaaauaag

SEQ ID NO: 2163640 - RNA, 15 nt, Streptococcus pneumoniae R6
ucuauugaaaaaucu

SEQ ID NO: 2163641 - RNA, 20 nt, Streptococcus pneumoniae R6
ucgguacuuaaacgugcuau

SEQ ID NO: 2163642 - RNA, 22 nt, Streptococcus pneumoniae R6
ucggcuguucgcaagauagaac

SEQ ID NO: 2163643 - RNA, 16 nt, Streptococcus pneumoniae R6
ugauaggagcuaugua

SEQ ID NO: 2163644 - RNA, 19 nt, Streptococcus pneumoniae R6
ugaguauuuuauaguaauu

SEQ ID NO: 2163645 - RNA, 14 nt, Streptococcus pneumoniae R6
ugagcaucaggaaa

SEQ ID NO: 2163646 - RNA, 23 nt, Streptococcus pneumoniae R6
ugauccaagcuucuacagaugcu

SEQ ID NO: 2163647 - RNA, 16 nt, Streptococcus pneumoniae R6
ucgauaucuugguaca

SEQ ID NO: 2163648 - RNA, 19 nt, Streptococcus pneumoniae R6
aauaaaacgcauaguauca

SEQ ID NO: 2163649 - RNA, 19 nt, Streptococcus pneumoniae R6
aauaaaaagcauaguauca

SEQ ID NO: 2163650 - RNA, 17 nt, Streptococcus pneumoniae R6
uaggacaauuucucgga

SEQ ID NO: 2163651 - RNA, 22 nt, Streptococcus pneumoniae R6
uaggauuuggcguuaguuacuu

SEQ ID NO: 2163652 - RNA, 12 nt, Streptococcus pneumoniae R6
uagcaagaguuu

SEQ ID NO: 2163653 - RNA, 13 nt, Streptococcus pneumoniae R6
uagaaaaaguagu

SEQ ID NO: 2163654 - RNA, 16 nt, Streptococcus pneumoniae R6
uagaaauauuuuagca

SEQ ID NO: 2163655 - RNA, 14 nt, Streptococcus pneumoniae R6
uagauuuuuucugu

SEQ ID NO: 2163656 - RNA, 22 nt, Streptococcus pneumoniae R6
uacuaaauauaagauuuaacuu

SEQ ID NO: 2163657 - RNA, 18 nt, Streptococcus pneumoniae R6
uacuauaguagccuugac

SEQ ID NO: 2163658 - RNA, 16 nt, Streptococcus pneumoniae R6
ucaaagcaguacuuug

SEQ ID NO: 2163659 - RNA, 22 nt, Streptococcus pneumoniae R6
ucaaacuuuuucucucugaaua

SEQ ID NO: 2163660 - RNA, 21 nt, Streptococcus pneumoniae R6
ucaaagaguuuuuuaucuuug

SEQ ID NO: 2163661 - RNA, 19 nt, Streptococcus pneumoniae R6
ucaaaggucucuucuucug

SEQ ID NO: 2163662 - RNA, 19 nt, Streptococcus pneumoniae R6
ucaaacacgguauuugaga

SEQ ID NO: 2163663 - RNA, 20 nt, Streptococcus pneumoniae R6
uauuggaacuaaaguuccua

SEQ ID NO: 2163664 - RNA, 13 nt, Streptococcus pneumoniae R6
ucaaguaacuuug

SEQ ID NO: 2163665 - RNA, 24 nt, Streptococcus pneumoniae R6
ucaagucuguauagaccugaucaa

SEQ ID NO: 2163666 - RNA, 15 nt, Streptococcus pneumoniae R6
ucaaguuuaccauuc

SEQ ID NO: 2163667 - RNA, 22 nt, Streptococcus pneumoniae R6
ucaauccaucuccaaccaucaa

SEQ ID NO: 2163668 - RNA, 17 nt, Streptococcus pneumoniae R6
uagggauuugauaagaa

SEQ ID NO: 2163669 - RNA, 22 nt, Streptococcus pneumoniae R6
uauguuguaggugcuuauuuca

SEQ ID NO: 2163670 - RNA, 18 nt, Streptococcus pneumoniae R6
uaugaggugcuuuuugau

SEQ ID NO: 2163671 - RNA, 23 nt, Streptococcus pneumoniae R6
ucacaaucucacuaugauuaggu

SEQ ID NO: 2163672 - RNA, 20 nt, Streptococcus pneumoniae R6
aauaauauccgauagcauca

SEQ ID NO: 2163673 - RNA, 17 nt, Streptococcus pneumoniae R6
ucagaacacuuccaaua

SEQ ID NO: 2163674 - RNA, 21 nt, Streptococcus pneumoniae R6
ucagaaaacccaccaauucag

SEQ ID NO: 2163675 - RNA, 15 nt, Streptococcus pneumoniae R6
ucagauucugacaau

SEQ ID NO: 2163676 - RNA, 17 nt, Streptococcus pneumoniae R6
ucagcauauuucccauu

SEQ ID NO: 2163677 - RNA, 15 nt, Streptococcus pneumoniae R6
uccaauugauuaagu

SEQ ID NO: 2163678 - RNA, 15 nt, Streptococcus pneumoniae R6
uccagaaccguucaa

SEQ ID NO: 2163679 - RNA, 16 nt, Streptococcus pneumoniae R6
uccauagcgucaaaga

SEQ ID NO: 2163680 - RNA, 13 nt, Streptococcus pneumoniae R6
uccauaccauaag

SEQ ID NO: 2163681 - RNA, 13 nt, Streptococcus pneumoniae R6
ucauaacugcuaa

SEQ ID NO: 2163682 - RNA, 21 nt, Streptococcus pneumoniae R6
ucauacgauugaaaggaaucu

SEQ ID NO: 2163683 - RNA, 14 nt, Streptococcus pneumoniae R6
ucaucuccugucaa

SEQ ID NO: 2163684 - RNA, 15 nt, Streptococcus pneumoniae R6
ucauucacuacuuug

SEQ ID NO: 2163685 - RNA, 17 nt, Streptococcus pneumoniae R6
ucauuuccaaugaugag

SEQ ID NO: 2163686 - RNA, 13 nt, Streptococcus pneumoniae R6
ucauuucuucaac

SEQ ID NO: 2163687 - RNA, 22 nt, Streptococcus pneumoniae R6
uccaauccuuuucuuuuacucu

SEQ ID NO: 2163688 - RNA, 18 nt, Streptococcus pneumoniae R6
uccaaucucuugaacaua

SEQ ID NO: 2163689 - RNA, 22 nt, Streptococcus pneumoniae R6
uaacgauggacuuuaucaccuc

SEQ ID NO: 2163690 - RNA, 16 nt, Streptococcus pneumoniae R6
uaaggccugauaagau

SEQ ID NO: 2163691 - RNA, 12 nt, Streptococcus pneumoniae R6
uaaguugauacu

SEQ ID NO: 2163692 - RNA, 21 nt, Streptococcus pneumoniae R6
uaaucaaacuagcaagugcua

SEQ ID NO: 2163693 - RNA, 22 nt, Streptococcus pneumoniae R6
uaaucaaaauauguuuucuuug

SEQ ID NO: 2163694 - RNA, 21 nt, Streptococcus pneumoniae R6
uaauagccuuuggauauuuug

SEQ ID NO: 2163695 - RNA, 19 nt, Streptococcus pneumoniae R6
uacaauaacacccuuguaa

SEQ ID NO: 2163696 - RNA, 22 nt, Streptococcus pneumoniae R6
uaaaaaaucuuuuucauaacuu

SEQ ID NO: 2163697 - RNA, 17 nt, Streptococcus pneumoniae R6
uaaaaauaacuucagau

SEQ ID NO: 2163698 - RNA, 21 nt, Streptococcus pneumoniae R6
uaaaaucaagguuuuugaaca

SEQ ID NO: 2163699 - RNA, 15 nt, Streptococcus pneumoniae R6
uaaaaucuuugaaca

SEQ ID NO: 2163700 - RNA, 19 nt, Streptococcus pneumoniae R6
uaaaacaguguuuugagca

SEQ ID NO: 2163701 - RNA, 19 nt, Streptococcus pneumoniae R6
uaaaacaguguuuugagcu

SEQ ID NO: 2163702 - RNA, 16 nt, Streptococcus pneumoniae R6
guuuuugcgauaagcu

SEQ ID NO: 2163703 - RNA, 19 nt, Streptococcus pneumoniae R6
guuuugagauuacugauaa

SEQ ID NO: 2163704 - RNA, 19 nt, Streptococcus pneumoniae R6
guuuucuucuccgaagacu

SEQ ID NO: 2163705 - RNA, 14 nt, Streptococcus pneumoniae R6
guuuuguuugucag

SEQ ID NO: 2163706 - RNA, 20 nt, Streptococcus pneumoniae R6
guuuuuacuacuuuugucag

SEQ ID NO: 2163707 - RNA, 16 nt, Streptococcus pneumoniae R6
guuguaagcuagcaac

SEQ ID NO: 2163708 - RNA, 23 nt, Streptococcus pneumoniae R6
guuguagauagaacugacgaagu

SEQ ID NO: 2163709 - RNA, 18 nt, Streptococcus pneumoniae R6
guuugaaaaggcuguaua

SEQ ID NO: 2163710 - RNA, 18 nt, Streptococcus pneumoniae R6
guuucugugcuuuuucaa

SEQ ID NO: 2163711 - RNA, 11 nt, Streptococcus pneumoniae R6
guugaaauugg

SEQ ID NO: 2163712 - RNA, 15 nt, Streptococcus pneumoniae R6
guggauggaacugac

SEQ ID NO: 2163713 - RNA, 19 nt, Streptococcus pneumoniae R6
guucauggcauggaaagca

SEQ ID NO: 2163714 - RNA, 17 nt, Streptococcus pneumoniae R6
guuccaucuacaaccuu

SEQ ID NO: 2163715 - RNA, 21 nt, Streptococcus pneumoniae R6
uggcuaguaaauaucauuucc

SEQ ID NO: 2163716 - RNA, 19 nt, Streptococcus pneumoniae R6
uggcuauuccaaguuccuc

SEQ ID NO: 2163717 - RNA, 15 nt, Streptococcus pneumoniae R6
uggcucaucugcaau

SEQ ID NO: 2163718 - RNA, 18 nt, Streptococcus pneumoniae R6
ugguuagaaaaucaagua

SEQ ID NO: 2163719 - RNA, 13 nt, Streptococcus pneumoniae R6
uggucaggcuagg

SEQ ID NO: 2163720 - RNA, 17 nt, Streptococcus pneumoniae R6
ugguuuuuaaggacuga

SEQ ID NO: 2163721 - RNA, 16 nt, Streptococcus pneumoniae R6
aaucaauuuuuaacaa

SEQ ID NO: 2163722 - RNA, 12 nt, Streptococcus pneumoniae R6
uguaucaagaua

SEQ ID NO: 2163723 - RNA, 11 nt, Streptococcus pneumoniae R6
ugccugacaau

SEQ ID NO: 2163724 - RNA, 19 nt, Streptococcus pneumoniae R6
ugcgcgcuugaaugauaaa

SEQ ID NO: 2163725 - RNA, 21 nt, Streptococcus pneumoniae R6
uggcaccgaauuuuucaagua

SEQ ID NO: 2163726 - RNA, 20 nt, Streptococcus pneumoniae R6
uggauuauauaugugacuga

SEQ ID NO: 2163727 - RNA, 21 nt, Streptococcus pneumoniae R6
uggcaaauuugaccauuucaa

SEQ ID NO: 2163728 - RNA, 22 nt, Streptococcus pneumoniae R6
uggagaaacuccuuggcuacuu

SEQ ID NO: 2163729 - RNA, 23 nt, Streptococcus pneumoniae R6
uggacuguuauagauucaauaua

SEQ ID NO: 2163730 - RNA, 15 nt, Streptococcus pneumoniae R6
ugcucacugaugaaa

SEQ ID NO: 2163731 - RNA, 20 nt, Streptococcus pneumoniae R6
uuuuauaggcucuuugucaa

SEQ ID NO: 2163732 - RNA, 21 nt, Streptococcus pneumoniae R6
uuucuaccgaucucaucuuca

SEQ ID NO: 2163733 - RNA, 21 nt, Streptococcus pneumoniae R6
uuucguauggcaagaucaagu

SEQ ID NO: 2163734 - RNA, 20 nt, Streptococcus pneumoniae R6
uuuguucguauccuauuuca

SEQ ID NO: 2163735 - RNA, 14 nt, Streptococcus pneumoniae R6
uuuugaaagucaua

SEQ ID NO: 2163736 - RNA, 12 nt, Streptococcus pneumoniae R6
uuuucugaaguu

SEQ ID NO: 2163737 - RNA, 14 nt, Streptococcus pneumoniae R6
uuuucuggcucuuu

SEQ ID NO: 2163738 - RNA, 11 nt, Streptococcus pneumoniae R6
uuuugccucaa

SEQ ID NO: 2163739 - RNA, 21 nt, Streptococcus pneumoniae R6
uuuucaaucaaugucaacaua

SEQ ID NO: 2163740 - RNA, 20 nt, Streptococcus pneumoniae R6
uuuucaauuugauuaaaguu

SEQ ID NO: 2163741 - RNA, 16 nt, Streptococcus pneumoniae R6
uuuuccgaccucagac

SEQ ID NO: 2163742 - RNA, 14 nt, Streptococcus pneumoniae R6
aaucuuccuuacua

SEQ ID NO: 2163743 - RNA, 16 nt, Streptococcus pneumoniae R6
aaucuucaaaaucuca

SEQ ID NO: 2163744 - RNA, 21 nt, Streptococcus pneumoniae R6
uuuugguugcaccaagucaua

SEQ ID NO: 2163745 - RNA, 20 nt, Streptococcus pneumoniae R6
uuuuguucaaaauuaagaua

SEQ ID NO: 2163746 - RNA, 19 nt, Streptococcus pneumoniae R6
aauuaaaucauccauauaa

SEQ ID NO: 2163747 - RNA, 20 nt, Streptococcus pneumoniae R6
aauuauaggacguuuucaga

SEQ ID NO: 2163748 - RNA, 23 nt, Streptococcus pneumoniae R6
aauuuaucuagugcuauaguaga

SEQ ID NO: 2163749 - RNA, 18 nt, Streptococcus pneumoniae R6
aauucggugguauuuaga

SEQ ID NO: 2163750 - RNA, 14 nt, Streptococcus pneumoniae R6
aauugcucuucuga

SEQ ID NO: 2163751 - RNA, 13 nt, Streptococcus pneumoniae R6
uugcucaacuucu

SEQ ID NO: 2163752 - RNA, 19 nt, Streptococcus pneumoniae R6
uugggcacgaaguugguca

SEQ ID NO: 2163753 - RNA, 18 nt, Streptococcus pneumoniae R6
uuguagaugaaacugacg

SEQ ID NO: 2163754 - RNA, 19 nt, Streptococcus pneumoniae R6
uuucauauaauaaauugua

SEQ ID NO: 2163755 - RNA, 15 nt, Streptococcus pneumoniae R6
uuucgaagcuugcuu

SEQ ID NO: 2163756 - RNA, 18 nt, Streptococcus pneumoniae R6
uuuccuucgcgaaaugga

SEQ ID NO: 2163757 - RNA, 12 nt, Streptococcus pneumoniae R6
uuuccaaucaga

SEQ ID NO: 2163758 - RNA, 13 nt, Streptococcus pneumoniae R6
uuuauuaaguaga

SEQ ID NO: 2163759 - RNA, 17 nt, Streptococcus pneumoniae R6
uuuauaugauuucaauu

SEQ ID NO: 2163760 - RNA, 17 nt, Streptococcus pneumoniae R6
uucgaugaaucauuucc

SEQ ID NO: 2163761 - RNA, 19 nt, Streptococcus pneumoniae R6
uucauaucuuauuucaauu

SEQ ID NO: 2163762 - RNA, 21 nt, Streptococcus pneumoniae R6
uuccucauuuugaagauuguu

SEQ ID NO: 2163763 - RNA, 15 nt, Streptococcus pneumoniae R6
uucuuuauuagucaa

SEQ ID NO: 2163764 - RNA, 18 nt, Streptococcus pneumoniae R6
uucuuuagcuuucaaguu

SEQ ID NO: 2163765 - RNA, 19 nt, Streptococcus pneumoniae R6
uucugauggauuuauagua

SEQ ID NO: 2163766 - RNA, 20 nt, Streptococcus pneumoniae R6
uucugcaucugcguuaacuu

SEQ ID NO: 2163767 - RNA, 13 nt, Streptococcus pneumoniae R6
uucuucugaaauu

SEQ ID NO: 2163768 - RNA, 14 nt, Streptococcus pneumoniae R6
uucuucuuucacuu

SEQ ID NO: 2163769 - RNA, 20 nt, Streptococcus pneumoniae R6
uugaaaacugaacaagacga

SEQ ID NO: 2163770 - RNA, 20 nt, Streptococcus pneumoniae R6
uucuuuuuugaaguuuucaa

SEQ ID NO: 2163771 - RNA, 16 nt, Streptococcus pneumoniae R6
uucuuuuuugguuucu

SEQ ID NO: 2163772 - RNA, 22 nt, Streptococcus pneumoniae R6
uucuuugguugcuacaucuucu

SEQ ID NO: 2163773 - RNA, 19 nt, Streptococcus pneumoniae R6
uugacuugcaaaaagacuu

SEQ ID NO: 2163774 - RNA, 13 nt, Streptococcus pneumoniae R6
uugagaagagcuu

SEQ ID NO: 2163775 - RNA, 14 nt, Streptococcus pneumoniae R6
uugaacuucuugac

SEQ ID NO: 2163776 - RNA, 21 nt, Streptococcus pneumoniae R6
uuauugauuccgucauguuca

SEQ ID NO: 2163777 - RNA, 11 nt, Streptococcus pneumoniae R6
uucacaaauuc

SEQ ID NO: 2163778 - RNA, 21 nt, Streptococcus pneumoniae R6
uucaccaauuuuaccuuucaa

SEQ ID NO: 2163779 - RNA, 20 nt, Streptococcus pneumoniae R6
uuaugcauaaucuuggucaa

SEQ ID NO: 2163780 - RNA, 17 nt, Streptococcus pneumoniae R6
uuauagaaaauuaacuu

SEQ ID NO: 2163781 - RNA, 22 nt, Streptococcus pneumoniae R6
uuacugucacccuaggcaagcu

SEQ ID NO: 2163782 - RNA, 14 nt, Streptococcus pneumoniae R6
uuauaauuucaacu

SEQ ID NO: 2163783 - RNA, 12 nt, Streptococcus pneumoniae R6
uuaaaacagugu

SEQ ID NO: 2163784 - RNA, 20 nt, Streptococcus pneumoniae R6
uuaaaacaguguuuugagcu

SEQ ID NO: 2163785 - RNA, 13 nt, Streptococcus pneumoniae R6
uguuugucaaaca

SEQ ID NO: 2163786 - RNA, 14 nt, Streptococcus pneumoniae R6
uguuucuggaaguu

SEQ ID NO: 2163787 - RNA, 13 nt, Streptococcus pneumoniae R6
uuaagaguaguau

SEQ ID NO: 2163788 - RNA, 16 nt, Streptococcus pneumoniae R6
acgaccaaugagaaac

SEQ ID NO: 2163789 - RNA, 23 nt, Streptococcus pneumoniae R6
acgaagcugacaugaugugaaga

SEQ ID NO: 2163790 - RNA, 13 nt, Streptococcus pneumoniae R6
acgaaggacaucu

SEQ ID NO: 2163791 - RNA, 16 nt, Streptococcus pneumoniae R6
acgauugguucugcuc

SEQ ID NO: 2163792 - RNA, 23 nt, Streptococcus pneumoniae R6
acggucauuuucuucgucaccga

SEQ ID NO: 2163793 - RNA, 16 nt, Streptococcus pneumoniae R6
acguucuuuucaagaa

SEQ ID NO: 2163794 - RNA, 18 nt, Streptococcus pneumoniae R6
acuauuagcaucuuauca

SEQ ID NO: 2163795 - RNA, 21 nt, Streptococcus pneumoniae R6
acuaucuccuuugauucagau

SEQ ID NO: 2163796 - RNA, 18 nt, Streptococcus pneumoniae R6
acuacaauaauugguaca

SEQ ID NO: 2163797 - RNA, 21 nt, Streptococcus pneumoniae R6
acgucaagaacuuuaguuuga

SEQ ID NO: 2163798 - RNA, 22 nt, Streptococcus pneumoniae R6
acucguuuuaguauaguaaacu

SEQ ID NO: 2163799 - RNA, 16 nt, Streptococcus pneumoniae R6
acucacuaaaauucua

SEQ ID NO: 2163800 - RNA, 15 nt, Streptococcus pneumoniae R6
acugugacuagcaau

SEQ ID NO: 2163801 - RNA, 15 nt, Streptococcus pneumoniae R6
acuucaaccuuacca

SEQ ID NO: 2163802 - RNA, 17 nt, Streptococcus pneumoniae R6
acuuagacgguuuacca

SEQ ID NO: 2163803 - RNA, 15 nt, Streptococcus pneumoniae R6
acuucgucaguucca

SEQ ID NO: 2163804 - RNA, 16 nt, Streptococcus pneumoniae R6
acuucgucaguuccau

SEQ ID NO: 2163805 - RNA, 14 nt, Streptococcus pneumoniae R6
acuucgucaguucu

SEQ ID NO: 2163806 - RNA, 22 nt, Streptococcus pneumoniae R6
acuugagcaaacugaauccgca

SEQ ID NO: 2163807 - RNA, 14 nt, Streptococcus pneumoniae R6
acuugacuagcaau

SEQ ID NO: 2163808 - RNA, 17 nt, Streptococcus pneumoniae R6
acuucuuuuuugagaug

SEQ ID NO: 2163809 - RNA, 21 nt, Streptococcus pneumoniae R6
acuugaaaauaccaaguucau

SEQ ID NO: 2163810 - RNA, 14 nt, Streptococcus pneumoniae R6
acuuugagcaaccu

SEQ ID NO: 2163811 - RNA, 21 nt, Streptococcus pneumoniae R6
acuuucuucgaaauuccauac

SEQ ID NO: 2163812 - RNA, 14 nt, Streptococcus pneumoniae R6
acuuuaguuccaau

SEQ ID NO: 2163813 - RNA, 20 nt, Streptococcus pneumoniae R6
acuuuuggggggcaguucag

SEQ ID NO: 2163814 - RNA, 13 nt, Streptococcus pneumoniae R6
agaaaaaguucaa

SEQ ID NO: 2163815 - RNA, 12 nt, Streptococcus pneumoniae R6
agaaaacaacuu

SEQ ID NO: 2163816 - RNA, 18 nt, Streptococcus pneumoniae R6
acacuagcuggugagaag

SEQ ID NO: 2163817 - RNA, 18 nt, Streptococcus pneumoniae R6
aauuuuauacucaucugu

SEQ ID NO: 2163818 - RNA, 14 nt, Streptococcus pneumoniae R6
aauuuugugauaaa

SEQ ID NO: 2163819 - RNA, 17 nt, Streptococcus pneumoniae R6
accaugucagcccuauc

SEQ ID NO: 2163820 - RNA, 16 nt, Streptococcus pneumoniae R6
accauuuuccaagacu

SEQ ID NO: 2163821 - RNA, 21 nt, Streptococcus pneumoniae R6
accguucuaaauuacgauuca

SEQ ID NO: 2163822 - RNA, 14 nt, Streptococcus pneumoniae R6
accggcaucggaua

SEQ ID NO: 2163823 - RNA, 21 nt, Streptococcus pneumoniae R6
accgaauuuuucaaguagguc

SEQ ID NO: 2163824 - RNA, 13 nt, Streptococcus pneumoniae R6
caaucuaucuuuu

SEQ ID NO: 2163825 - RNA, 21 nt, Streptococcus pneumoniae R6
caauccuuguaugacaucuug

SEQ ID NO: 2163826 - RNA, 19 nt, Streptococcus pneumoniae R6
caaucauaccugcauuguc

SEQ ID NO: 2163827 - RNA, 15 nt, Streptococcus pneumoniae R6
caauauuuuugagcc

SEQ ID NO: 2163828 - RNA, 19 nt, Streptococcus pneumoniae R6
caauaaaacgcauaguaca

SEQ ID NO: 2163829 - RNA, 20 nt, Streptococcus pneumoniae R6
caauaaaaagcauaguauca

SEQ ID NO: 2163830 - RNA, 15 nt, Streptococcus pneumoniae R6
caauaaaaucaaaca

SEQ ID NO: 2163831 - RNA, 13 nt, Streptococcus pneumoniae R6
caagguuuccaaa

SEQ ID NO: 2163832 - RNA, 23 nt, Streptococcus pneumoniae R6
caaccucaaaacacugcuuugag

SEQ ID NO: 2163833 - RNA, 21 nt, Streptococcus pneumoniae R6
caacacgaccuucaauuccuu

SEQ ID NO: 2163834 - RNA, 22 nt, Streptococcus pneumoniae R6
caaccaauuucuuaauagcuga

SEQ ID NO: 2163835 - RNA, 11 nt, Streptococcus pneumoniae R6
caacaaaucuu

SEQ ID NO: 2163836 - RNA, 19 nt, Streptococcus pneumoniae R6
caaaucaaauuuauucaga

SEQ ID NO: 2163837 - RNA, 17 nt, Streptococcus pneumoniae R6
auuguguccucaauaua

SEQ ID NO: 2163838 - RNA, 16 nt, Streptococcus pneumoniae R6
caaaauuaagauagcc

SEQ ID NO: 2163839 - RNA, 22 nt, Streptococcus pneumoniae R6
caaaggauuuaguucuguacug

SEQ ID NO: 2163840 - RNA, 15 nt, Streptococcus pneumoniae R6
caaagggcaaaucuu

SEQ ID NO: 2163841 - RNA, 18 nt, Streptococcus pneumoniae R6
caccaggcauuauuucac

SEQ ID NO: 2163842 - RNA, 23 nt, Streptococcus pneumoniae R6
caccaggcauuauuucacuugua

SEQ ID NO: 2163843 - RNA, 14 nt, Streptococcus pneumoniae R6
auguuacugacuuc

SEQ ID NO: 2163844 - RNA, 16 nt, Streptococcus pneumoniae R6
auggccauaaucucug

SEQ ID NO: 2163845 - RNA, 19 nt, Streptococcus pneumoniae R6
auggauuugucauucagau

SEQ ID NO: 2163846 - RNA, 16 nt, Streptococcus pneumoniae R6
auggcaagaucaaguu

SEQ ID NO: 2163847 - RNA, 23 nt, Streptococcus pneumoniae R6
auucgaaugauuucucuugcaau

SEQ ID NO: 2163848 - RNA, 23 nt, Streptococcus pneumoniae R6
auuccuugcgcgugguccagaua

SEQ ID NO: 2163849 - RNA, 18 nt, Streptococcus pneumoniae R6
auucuacaucauugucaa

SEQ ID NO: 2163850 - RNA, 20 nt, Streptococcus pneumoniae R6
auucuaauguacagaagacu

SEQ ID NO: 2163851 - RNA, 17 nt, Streptococcus pneumoniae R6
auucuaguuucaauaua

SEQ ID NO: 2163852 - RNA, 23 nt, Streptococcus pneumoniae R6
auucucuaaauaagguuuagcaa

SEQ ID NO: 2163853 - RNA, 23 nt, Streptococcus pneumoniae R6
auucuccauaauugcuugagcaa

SEQ ID NO: 2163854 - RNA, 18 nt, Streptococcus pneumoniae R6
auucaugggauuucggau

SEQ ID NO: 2163855 - RNA, 16 nt, Streptococcus pneumoniae R6
auucaugauuggucaa

SEQ ID NO: 2163856 - RNA, 16 nt, Streptococcus pneumoniae R6
auuaaaaugcaagaca

SEQ ID NO: 2163857 - RNA, 15 nt, Streptococcus pneumoniae R6
auuauuaccuugaac

SEQ ID NO: 2163858 - RNA, 15 nt, Streptococcus pneumoniae R6
auuggauuuucugaa

SEQ ID NO: 2163859 - RNA, 23 nt, Streptococcus pneumoniae R6
auuguaggacuuccuuuucuuau

SEQ ID NO: 2163860 - RNA, 20 nt, Streptococcus pneumoniae R6
auugagaaaucguuucuaau

SEQ ID NO: 2163861 - RNA, 22 nt, Streptococcus pneumoniae R6
auugaggguaguaauuuucgau

SEQ ID NO: 2163862 - RNA, 15 nt, Streptococcus pneumoniae R6
auugacuuuucuuau

SEQ ID NO: 2163863 - RNA, 12 nt, Streptococcus pneumoniae R6
auugacugucaa

SEQ ID NO: 2163864 - RNA, 16 nt, Streptococcus pneumoniae R6
auugacugucaauaua

SEQ ID NO: 2163865 - RNA, 18 nt, Streptococcus pneumoniae R6
auugaaacagcuaaagac

SEQ ID NO: 2163866 - RNA, 17 nt, Streptococcus pneumoniae R6
auugaaaggaaucugcg

SEQ ID NO: 2163867 - RNA, 14 nt, Streptococcus pneumoniae R6
auugauuuccugau

SEQ ID NO: 2163868 - RNA, 22 nt, Streptococcus pneumoniae R6
augaaacugacgaagucaguaa

SEQ ID NO: 2163869 - RNA, 14 nt, Streptococcus pneumoniae R6
augaaaugagaaau

SEQ ID NO: 2163870 - RNA, 23 nt, Streptococcus pneumoniae R6
augaaauuauucucuaucuuuua

SEQ ID NO: 2163871 - RNA, 14 nt, Streptococcus pneumoniae R6
augaacuugaaaau

SEQ ID NO: 2163872 - RNA, 24 nt, Streptococcus pneumoniae R6
aucuuugcgaaguauucaagagua

SEQ ID NO: 2163873 - RNA, 19 nt, Streptococcus pneumoniae R6
augauauacacacuuaaau

SEQ ID NO: 2163874 - RNA, 22 nt, Streptococcus pneumoniae R6
augauuaaucaaaugagcauag

SEQ ID NO: 2163875 - RNA, 22 nt, Streptococcus pneumoniae R6
aucuccucuaccugccuuccaa

SEQ ID NO: 2163876 - RNA, 16 nt, Streptococcus pneumoniae R6
aucuugacgauaggug

SEQ ID NO: 2163877 - RNA, 23 nt, Streptococcus pneumoniae R6
aucuuccuacauauguaagaaga

SEQ ID NO: 2163878 - RNA, 14 nt, Streptococcus pneumoniae R6
aucgaaaaguggag

SEQ ID NO: 2163879 - RNA, 14 nt, Streptococcus pneumoniae R6
auccuuucaguaga

SEQ ID NO: 2163880 - RNA, 21 nt, Streptococcus pneumoniae R6
aucgcuauuaucguuuuccua

SEQ ID NO: 2163881 - RNA, 19 nt, Streptococcus pneumoniae R6
agcuaauuuuuugagcaau

SEQ ID NO: 2163882 - RNA, 15 nt, Streptococcus pneumoniae R6
agcuauuacaucguu

SEQ ID NO: 2163883 - RNA, 13 nt, Streptococcus pneumoniae R6
agcucaaaacacu

SEQ ID NO: 2163884 - RNA, 19 nt, Streptococcus pneumoniae R6
agcguuuucuacagcugua

SEQ ID NO: 2163885 - RNA, 13 nt, Streptococcus pneumoniae R6
agccuuuccuuaa

SEQ ID NO: 2163886 - RNA, 19 nt, Streptococcus pneumoniae R6
agcaguaugcaaggcaaug

SEQ ID NO: 2163887 - RNA, 21 nt, Streptococcus pneumoniae R6
agcaucccauggaacuaagau

SEQ ID NO: 2163888 - RNA, 17 nt, Streptococcus pneumoniae R6
agaaagaggaguaggag

SEQ ID NO: 2163889 - RNA, 17 nt, Streptococcus pneumoniae R6
agaaacuccuuggcuac

SEQ ID NO: 2163890 - RNA, 16 nt, Streptococcus pneumoniae R6
agagauuauaguggug

SEQ ID NO: 2163891 - RNA, 16 nt, Streptococcus pneumoniae R6
agcaacuaucugaaua

SEQ ID NO: 2163892 - RNA, 22 nt, Streptococcus pneumoniae R6
agauuacaaaaaaaacuacguu

SEQ ID NO: 2163893 - RNA, 22 nt, Streptococcus pneumoniae R6
agcaccauauuuguugcucuua

SEQ ID NO: 2163894 - RNA, 17 nt, Streptococcus pneumoniae R6
aggaugccuuuuuauga

SEQ ID NO: 2163895 - RNA, 21 nt, Streptococcus pneumoniae R6
aguaacuaacgccaaauccua

SEQ ID NO: 2163896 - RNA, 20 nt, Streptococcus pneumoniae R6
aguaccagcucguucuaugg

SEQ ID NO: 2163897 - RNA, 17 nt, Streptococcus pneumoniae R6
aguaucagguguugaau

SEQ ID NO: 2163898 - RNA, 20 nt, Streptococcus pneumoniae R6
aguaaaacuguaugagaaac

SEQ ID NO: 2163899 - RNA, 23 nt, Streptococcus pneumoniae R6
agguugcucaaagcacugauuug

SEQ ID NO: 2163900 - RNA, 13 nt, Streptococcus pneumoniae R6
aggugauuuacca

SEQ ID NO: 2163901 - RNA, 15 nt, Streptococcus pneumoniae R6
aguucuaucugcaac

SEQ ID NO: 2163902 - RNA, 20 nt, Streptococcus pneumoniae R6
aguucuaucuugagcaaguc

SEQ ID NO: 2163903 - RNA, 13 nt, Streptococcus pneumoniae R6
aguucguaguaaa

SEQ ID NO: 2163904 - RNA, 18 nt, Streptococcus pneumoniae R6
auaaacuuguaggcuucu

SEQ ID NO: 2163905 - RNA, 15 nt, Streptococcus pneumoniae R6
auaaaauaacggaga

SEQ ID NO: 2163906 - RNA, 13 nt, Streptococcus pneumoniae R6
auaaaaucaaauu

SEQ ID NO: 2163907 - RNA, 19 nt, Streptococcus pneumoniae R6
auaaaauuuaaaaauagau

SEQ ID NO: 2163908 - RNA, 22 nt, Streptococcus pneumoniae R6
auaaagagcacugcuagcauca

SEQ ID NO: 2163909 - RNA, 18 nt, Streptococcus pneumoniae R6
aguuguaaucuuagcaaa

SEQ ID NO: 2163910 - RNA, 22 nt, Streptococcus pneumoniae R6
aguuucagcgauuuccuugagc

SEQ ID NO: 2163911 - RNA, 14 nt, Streptococcus pneumoniae R6
aguuuucuaaagaa

SEQ ID NO: 2163912 - RNA, 20 nt, Streptococcus pneumoniae R6
aguuuuuuauuuucccagua

SEQ ID NO: 2163913 - RNA, 18 nt, Streptococcus pneumoniae R6
auaaaaggcauccuauca

SEQ ID NO: 2163914 - RNA, 18 nt, Streptococcus pneumoniae R6
auaagcuuguuaccugau

SEQ ID NO: 2163915 - RNA, 12 nt, Streptococcus pneumoniae R6
auaaucaagaug

SEQ ID NO: 2163916 - RNA, 23 nt, Streptococcus pneumoniae R6
auaaggacuuccgccaucuuguu

SEQ ID NO: 2163917 - RNA, 11 nt, Streptococcus pneumoniae R6
auaauuucaac

SEQ ID NO: 2163918 - RNA, 19 nt, Streptococcus pneumoniae R6
auaaucuguuaucuucgca

SEQ ID NO: 2163919 - RNA, 18 nt, Streptococcus pneumoniae R6
auacuaauacauuuugua

SEQ ID NO: 2163920 - RNA, 19 nt, Streptococcus pneumoniae R6
auacuaugcguuuucuaau

SEQ ID NO: 2163921 - RNA, 20 nt, Streptococcus pneumoniae R6
auacucuucgaaaaucucuu

SEQ ID NO: 2163922 - RNA, 20 nt, Streptococcus pneumoniae R6
aucaaaguuggucauauuaa

SEQ ID NO: 2163923 - RNA, 14 nt, Streptococcus pneumoniae R6
aucaagacccaagu

SEQ ID NO: 2163924 - RNA, 13 nt, Streptococcus pneumoniae R6
auaucaaucucug

SEQ ID NO: 2163925 - RNA, 22 nt, Streptococcus pneumoniae R6
auaucauuaaguaaucucugau

SEQ ID NO: 2163926 - RNA, 23 nt, Streptococcus pneumoniae R6
auaugcaacuuguuuuuccugau

SEQ ID NO: 2163927 - RNA, 13 nt, Streptococcus pneumoniae R6
auaugauuucaau

SEQ ID NO: 2163928 - RNA, 19 nt, Streptococcus pneumoniae R6
auauggugcguuuuuugau

SEQ ID NO: 2163929 - RNA, 21 nt, Streptococcus pneumoniae R6
auauuaugcguuuuuucugau

SEQ ID NO: 2163930 - RNA, 19 nt, Streptococcus pneumoniae R6
aucagaaccuuugagaaaa

SEQ ID NO: 2163931 - RNA, 18 nt, Streptococcus pneumoniae R6
aucagauaagcaccuagu

SEQ ID NO: 2163932 - RNA, 16 nt, Streptococcus pneumoniae R6
aucacguacaacagcu

SEQ ID NO: 2163933 - RNA, 13 nt, Streptococcus pneumoniae R6
ccauacguuucau

SEQ ID NO: 2163934 - RNA, 11 nt, Streptococcus pneumoniae R6
cccauccgccc

SEQ ID NO: 2163935 - RNA, 15 nt, Streptococcus pneumoniae R6
cauuaguaauuugca

SEQ ID NO: 2163936 - RNA, 22 nt, Streptococcus pneumoniae R6
cauuauaguuuaaguaguaacc

SEQ ID NO: 2163937 - RNA, 13 nt, Streptococcus pneumoniae R6
cauuucaucccca

SEQ ID NO: 2163938 - RNA, 18 nt, Streptococcus pneumoniae R6
ccaaucacuugaccaaag

SEQ ID NO: 2163939 - RNA, 22 nt, Streptococcus pneumoniae R6
ccaaucaaucguccuugauuua

SEQ ID NO: 2163940 - RNA, 11 nt, Streptococcus pneumoniae R6
ccaaucaaacu

SEQ ID NO: 2163941 - RNA, 12 nt, Streptococcus pneumoniae R6
ccaaucaaacua

SEQ ID NO: 2163942 - RNA, 14 nt, Streptococcus pneumoniae R6
ccacacuuccaagu

SEQ ID NO: 2163943 - RNA, 22 nt, Streptococcus pneumoniae R6
ccaccgauauggccugcuaggc

SEQ ID NO: 2163944 - RNA, 14 nt, Streptococcus pneumoniae R6
caggacaaaucgau

SEQ ID NO: 2163945 - RNA, 18 nt, Streptococcus pneumoniae R6
caggacagucaaaucgau

SEQ ID NO: 2163946 - RNA, 20 nt, Streptococcus pneumoniae R6
cauaaucuaaggucauuuga

SEQ ID NO: 2163947 - RNA, 21 nt, Streptococcus pneumoniae R6
cauaaugucuucugcucgcug

SEQ ID NO: 2163948 - RNA, 19 nt, Streptococcus pneumoniae R6
cauaaaauacccucuauca

SEQ ID NO: 2163949 - RNA, 22 nt, Streptococcus pneumoniae R6
cagguuuugaagcacuuauaga

SEQ ID NO: 2163950 - RNA, 21 nt, Streptococcus pneumoniae R6
caguccuuguaugacaucuug

SEQ ID NO: 2163951 - RNA, 15 nt, Streptococcus pneumoniae R6
caucacgaucaaagu

SEQ ID NO: 2163952 - RNA, 22 nt, Streptococcus pneumoniae R6
cauagcuaaaaucaggucuuau

SEQ ID NO: 2163953 - RNA, 21 nt, Streptococcus pneumoniae R6
cauccagcaggagaaaguuug

SEQ ID NO: 2163954 - RNA, 18 nt, Streptococcus pneumoniae R6
cacuauguggcuuggcag

SEQ ID NO: 2163955 - RNA, 21 nt, Streptococcus pneumoniae R6
cacucaaaucaaaauauagca

SEQ ID NO: 2163956 - RNA, 14 nt, Streptococcus pneumoniae R6
cagcaaagguacau

SEQ ID NO: 2163957 - RNA, 15 nt, Streptococcus pneumoniae R6
cagaugacaaaucua

SEQ ID NO: 2163958 - RNA, 22 nt, Streptococcus pneumoniae R6
gaugaagucuagcaauucuugg

SEQ ID NO: 2163959 - RNA, 21 nt, Streptococcus pneumoniae R6
gaugaagggcuuuucuaucac

SEQ ID NO: 2163960 - RNA, 16 nt, Streptococcus pneumoniae R6
gauacgaugaccaaga

SEQ ID NO: 2163961 - RNA, 12 nt, Streptococcus pneumoniae R6
gauuaucguguu

SEQ ID NO: 2163962 - RNA, 15 nt, Streptococcus pneumoniae R6
gauuccuuuuugcag

SEQ ID NO: 2163963 - RNA, 23 nt, Streptococcus pneumoniae R6
gauuggugcuaauucuuugacaa

SEQ ID NO: 2163964 - RNA, 19 nt, Streptococcus pneumoniae R6
gauucuucugguuuggcaa

SEQ ID NO: 2163965 - RNA, 12 nt, Streptococcus pneumoniae R6
gauucuuuucaa

SEQ ID NO: 2163966 - RNA, 18 nt, Streptococcus pneumoniae R6
gcaaauuuaaucgcuugg

SEQ ID NO: 2163967 - RNA, 17 nt, Streptococcus pneumoniae R6
gcaaucauaccugcauu

SEQ ID NO: 2163968 - RNA, 19 nt, Streptococcus pneumoniae R6
gcaagacgaagcugacaug

SEQ ID NO: 2163969 - RNA, 15 nt, Streptococcus pneumoniae R6
gcagauuugcuuaca

SEQ ID NO: 2163970 - RNA, 13 nt, Streptococcus pneumoniae R6
gcccaauucuuga

SEQ ID NO: 2163971 - RNA, 15 nt, Streptococcus pneumoniae R6
gcccaauauucucua

SEQ ID NO: 2163972 - RNA, 18 nt, Streptococcus pneumoniae R6
cguucggcuucaucugga

SEQ ID NO: 2163973 - RNA, 18 nt, Streptococcus pneumoniae R6
cguaagaggguaauccuu

SEQ ID NO: 2163974 - RNA, 22 nt, Streptococcus pneumoniae R6
cugaaucauaggcauaguacca

SEQ ID NO: 2163975 - RNA, 12 nt, Streptococcus pneumoniae R6
cucuuuaagaga

SEQ ID NO: 2163976 - RNA, 15 nt, Streptococcus pneumoniae R6
cucuugaaguucauu

SEQ ID NO: 2163977 - RNA, 22 nt, Streptococcus pneumoniae R6
cuauacauuuagaaagguaaaa

SEQ ID NO: 2163978 - RNA, 22 nt, Streptococcus pneumoniae R6
cuauagaaaaggaguagaaaau

SEQ ID NO: 2163979 - RNA, 15 nt, Streptococcus pneumoniae R6
cuaugaucagcauuu

SEQ ID NO: 2163980 - RNA, 21 nt, Streptococcus pneumoniae R6
cucaaagcaguacuuugagca

SEQ ID NO: 2163981 - RNA, 13 nt, Streptococcus pneumoniae R6
cucaaagcagugc

SEQ ID NO: 2163982 - RNA, 13 nt, Streptococcus pneumoniae R6
cucaaagcugugc

SEQ ID NO: 2163983 - RNA, 21 nt, Streptococcus pneumoniae R6
cucaaagcugugcuuugagca

SEQ ID NO: 2163984 - RNA, 19 nt, Streptococcus pneumoniae R6
cguugaaaaagugagauau

SEQ ID NO: 2163985 - RNA, 21 nt, Streptococcus pneumoniae R6
cuagagagcuuucuaaacaau

SEQ ID NO: 2163986 - RNA, 18 nt, Streptococcus pneumoniae R6
cuagaauccuaguucaug

SEQ ID NO: 2163987 - RNA, 20 nt, Streptococcus pneumoniae R6
cuacuaggcaggaaggaaau

SEQ ID NO: 2163988 - RNA, 16 nt, Streptococcus pneumoniae R6
gaaucgugaguuccug

SEQ ID NO: 2163989 - RNA, 15 nt, Streptococcus pneumoniae R6
gaauggauuugucau

SEQ ID NO: 2163990 - RNA, 14 nt, Streptococcus pneumoniae R6
gagacuaucugcua

SEQ ID NO: 2163991 - RNA, 22 nt, Streptococcus pneumoniae R6
gacuauagcguuuugaaacuag

SEQ ID NO: 2163992 - RNA, 16 nt, Streptococcus pneumoniae R6
gagaaaggacaaauuu

SEQ ID NO: 2163993 - RNA, 23 nt, Streptococcus pneumoniae R6
cuuagucucaaaaucaaagacuu

SEQ ID NO: 2163994 - RNA, 20 nt, Streptococcus pneumoniae R6
cuguacccaaguaaucugca

SEQ ID NO: 2163995 - RNA, 20 nt, Streptococcus pneumoniae R6
cuuccauguuguagucugcu

SEQ ID NO: 2163996 - RNA, 20 nt, Streptococcus pneumoniae R6
cugguaagaaguaaccaguu

SEQ ID NO: 2163997 - RNA, 19 nt, Streptococcus pneumoniae R6
cuggaucuagauaguacca

SEQ ID NO: 2163998 - RNA, 22 nt, Streptococcus pneumoniae R6
gaaauuuugaaauaaucucuga

SEQ ID NO: 2163999 - RNA, 22 nt, Streptococcus pneumoniae R6
gaaauuuaucaaccacuuaaca

SEQ ID NO: 2164000 - RNA, 16 nt, Streptococcus pneumoniae R6
cuuguuucaauugacu

SEQ ID NO: 2164001 - RNA, 18 nt, Streptococcus pneumoniae R6
cuuguuccaagaugaguu

SEQ ID NO: 2164002 - RNA, 23 nt, Streptococcus pneumoniae R6
cuuuagacccuucuggcaauuua

SEQ ID NO: 2164003 - RNA, 19 nt, Streptococcus pneumoniae R6
cuuuaguaccagcucguuc

SEQ ID NO: 2164004 - RNA, 17 nt, Streptococcus pneumoniae R6
cuucguaacgaguuucu

SEQ ID NO: 2164005 - RNA, 19 nt, Streptococcus pneumoniae R6
cuugcuagucauaacugcu

SEQ ID NO: 2164006 - RNA, 22 nt, Streptococcus pneumoniae R6
gaaauaaaaguaacaccucuuc

SEQ ID NO: 2164007 - RNA, 16 nt, Streptococcus pneumoniae R6
cuuuuuguuagauuua

SEQ ID NO: 2164008 - RNA, 21 nt, Streptococcus pneumoniae R6
cuuuaucaagcaaaucaaagc

SEQ ID NO: 2164009 - RNA, 19 nt, Streptococcus pneumoniae R6
cuuuucauuauaggucaua

SEQ ID NO: 2164010 - RNA, 24 nt, Streptococcus pneumoniae R6
ccuugucauccuuacggucaaagu

SEQ ID NO: 2164011 - RNA, 22 nt, Streptococcus pneumoniae R6
ccuuaccacuagugaauuuggu

SEQ ID NO: 2164012 - RNA, 17 nt, Streptococcus pneumoniae R6
cgaacccccaugacuuc

SEQ ID NO: 2164013 - RNA, 20 nt, Streptococcus pneumoniae R6
cgaaucucuuuccacacuug

SEQ ID NO: 2164014 - RNA, 14 nt, Streptococcus pneumoniae R6
ccucaaaacagugu

SEQ ID NO: 2164015 - RNA, 18 nt, Streptococcus pneumoniae R6
ccuauucggacuuuggcu

SEQ ID NO: 2164016 - RNA, 14 nt, Streptococcus pneumoniae R6
cgcuaccauuaucu

SEQ ID NO: 2164017 - RNA, 19 nt, Streptococcus pneumoniae R6
aaaauaacucuguaaucuc

SEQ ID NO: 2164018 - RNA, 16 nt, Streptococcus pneumoniae R6
aaaaucacaucugcua

SEQ ID NO: 2164019 - RNA, 14 nt, Streptococcus pneumoniae R6
aaaaucaggaaauc

SEQ ID NO: 2164020 - RNA, 13 nt, Streptococcus pneumoniae R6
aaaaucaucgcca

SEQ ID NO: 2164021 - RNA, 16 nt, Streptococcus pneumoniae R6
aaaauaaaucuaucag

SEQ ID NO: 2164022 - RNA, 17 nt, Streptococcus pneumoniae R6
aaaaugugauuucugua

SEQ ID NO: 2164023 - RNA, 18 nt, Streptococcus pneumoniae R6
aaaaugacuugcaaucuc

SEQ ID NO: 2164024 - RNA, 13 nt, Streptococcus pneumoniae R6
aaaaacacaauuu

SEQ ID NO: 2164025 - RNA, 20 nt, Streptococcus pneumoniae R6
aaaacgcauaaaaucaaggu

SEQ ID NO: 2164026 - RNA, 20 nt, Streptococcus pneumoniae R6
aaaacgcauaauaucaaggu

SEQ ID NO: 2164027 - RNA, 19 nt, Streptococcus pneumoniae R6
aaaacgcauaauaucaagu

SEQ ID NO: 2164028 - RNA, 20 nt, Streptococcus pneumoniae R6
aaaacgcauaauaucaaguu

SEQ ID NO: 2164029 - RNA, 20 nt, Streptococcus pneumoniae R6
aaaacgcauaguaucaaggu

SEQ ID NO: 2164030 - RNA, 20 nt, Streptococcus pneumoniae R6
aaaacgcauaguaucaaguu

SEQ ID NO: 2164031 - RNA, 20 nt, Streptococcus pneumoniae R6
aaaacgcauauuaccaaguu

SEQ ID NO: 2164032 - RNA, 20 nt, Streptococcus pneumoniae R6
aaaacgcaucauaucaaggu

SEQ ID NO: 2164033 - RNA, 20 nt, Streptococcus pneumoniae R6
aaaacgcauccuaucaaguu

SEQ ID NO: 2164034 - RNA, 14 nt, Streptococcus pneumoniae R6
aaaacucaauuuga

SEQ ID NO: 2164035 - RNA, 15 nt, Streptococcus pneumoniae R6
aaaacucuuaucuaa

SEQ ID NO: 2164036 - RNA, 20 nt, Streptococcus pneumoniae R6
aaaacguacaguaucaaggu

SEQ ID NO: 2164037 - RNA, 14 nt, Streptococcus pneumoniae R6
aaaaagagcugcca

SEQ ID NO: 2164038 - RNA, 18 nt, Streptococcus pneumoniae R6
aaaaagggauaaguugau

SEQ ID NO: 2164039 - RNA, 22 nt, Streptococcus pneumoniae R6
aaaaaguguuugauaucuauca

SEQ ID NO: 2164040 - RNA, 12 nt, Streptococcus pneumoniae R6
aaagaacuccug

SEQ ID NO: 2164041 - RNA, 16 nt, Streptococcus pneumoniae R6
aaagacuucuugagcu

SEQ ID NO: 2164042 - RNA, 17 nt, Streptococcus pneumoniae R6
aaacuuuauauccuugu

SEQ ID NO: 2164043 - RNA, 21 nt, Streptococcus pneumoniae R6
aaagcgaacaaccgacaaguc

SEQ ID NO: 2164044 - RNA, 20 nt, Streptococcus pneumoniae R6
aaauuagaaaaaguaguuga

SEQ ID NO: 2164045 - RNA, 15 nt, Streptococcus pneumoniae R6
aaaacuagaauccua

SEQ ID NO: 2164046 - RNA, 19 nt, Streptococcus pneumoniae R6
aaaacgcauaguaucaagu

SEQ ID NO: 2164047 - RNA, 19 nt, Streptococcus pneumoniae R6
aaaacgcauccuaucaagu

SEQ ID NO: 2164048 - RNA, 17 nt, Streptococcus pneumoniae R6
aaaacgucguaaucuua

SEQ ID NO: 2164049 - RNA, 18 nt, Streptococcus pneumoniae R6
aacaaauccaaucuucua

SEQ ID NO: 2164050 - RNA, 23 nt, Streptococcus pneumoniae R6
aacaaauaaaucauugauaguaa

SEQ ID NO: 2164051 - RNA, 17 nt, Streptococcus pneumoniae R6
aacaaccaauuucuuaa

SEQ ID NO: 2164052 - RNA, 20 nt, Streptococcus pneumoniae R6
aaaacauuguuagaauucga

SEQ ID NO: 2164053 - RNA, 14 nt, Streptococcus pneumoniae R6
aaaaccaaucaauu

SEQ ID NO: 2164054 - RNA, 20 nt, Streptococcus pneumoniae R6
aaauccaaacgauuaucuaa

SEQ ID NO: 2164055 - RNA, 22 nt, Streptococcus pneumoniae R6
acaacauaaguuguaguacuga

SEQ ID NO: 2164056 - RNA, 13 nt, Streptococcus pneumoniae R6
acaaaaaagguca

SEQ ID NO: 2164057 - RNA, 19 nt, Streptococcus pneumoniae R6
aauuucucuaaaucuucua

SEQ ID NO: 2164058 - RNA, 21 nt, Streptococcus pneumoniae R6
acaaaucuucuguagacaggc

SEQ ID NO: 2164059 - RNA, 17 nt, Streptococcus pneumoniae R6
acaauaauugguacauu

SEQ ID NO: 2164060 - RNA, 16 nt, Streptococcus pneumoniae R6
acaauacccacugcga

SEQ ID NO: 2164061 - RNA, 18 nt, Streptococcus pneumoniae R6
acaauagcuuguuccaau

SEQ ID NO: 2164062 - RNA, 22 nt, Streptococcus pneumoniae R6
acaaucguaaccaauuucucaa

SEQ ID NO: 2164063 - RNA, 14 nt, Streptococcus pneumoniae R6
aaugacuuucuaau

SEQ ID NO: 2164064 - RNA, 21 nt, Streptococcus pneumoniae R6
aaucuuuuacuucugaaguua

SEQ ID NO: 2164065 - RNA, 17 nt, Streptococcus pneumoniae R6
aaucaccuaaaguagag

SEQ ID NO: 2164066 - RNA, 17 nt, Streptococcus pneumoniae R6
aaugaaauuuuucugcu

SEQ ID NO: 2164067 - RNA, 14 nt, Streptococcus pneumoniae R6
aaugacuaauucua

SEQ ID NO: 2164068 - RNA, 13 nt, Streptococcus pneumoniae R6
aauguuuucucau

SEQ ID NO: 2164069 - RNA, 21 nt, Streptococcus pneumoniae R6
aauuggaucucugugagauag

SEQ ID NO: 2164070 - RNA, 15 nt, Streptococcus pneumoniae R6
aauugucugaaguug

SEQ ID NO: 2164071 - RNA, 17 nt, Streptococcus pneumoniae R6
aaaauacccucuaucaa

SEQ ID NO: 2164072 - RNA, 21 nt, Streptococcus pneumoniae R6
acagagaggucaauaguauca

SEQ ID NO: 2164073 - RNA, 14 nt, Streptococcus pneumoniae R6
acagauuuuucugu

SEQ ID NO: 2164074 - RNA, 23 nt, Streptococcus pneumoniae R6
aauaacgaagucuauugaaaaau

SEQ ID NO: 2164075 - RNA, 12 nt, Streptococcus pneumoniae R6
aaucaaagagca

SEQ ID NO: 2164076 - RNA, 20 nt, Streptococcus pneumoniae R6
aagagaccuuucauaaaguu

SEQ ID NO: 2164077 - RNA, 16 nt, Streptococcus pneumoniae R6
aagacugacgaaguca

SEQ ID NO: 2164078 - RNA, 21 nt, Streptococcus pneumoniae R6
aagcgauuaggggggcuauuc

SEQ ID NO: 2164079 - RNA, 13 nt, Streptococcus pneumoniae R6
aaggcuguauaau

SEQ ID NO: 2164080 - RNA, 17 nt, Streptococcus pneumoniae R6
aaggcgaagcugacgug

SEQ ID NO: 2164081 - RNA, 15 nt, Streptococcus pneumoniae R6
aaccucuugaaguuc

SEQ ID NO: 2164082 - RNA, 17 nt, Streptococcus pneumoniae R6
aacucugcacguguaau

SEQ ID NO: 2164083 - RNA, 19 nt, Streptococcus pneumoniae R6
aacucuuguccuaaauaga

SEQ ID NO: 2164084 - RNA, 12 nt, Streptococcus pneumoniae R6
aacuucuaucac

SEQ ID NO: 2164085 - RNA, 21 nt, Streptococcus pneumoniae R6
aacugguccagagauaguaga

SEQ ID NO: 2164086 - RNA, 18 nt, Streptococcus pneumoniae R6
acgauuccguuugagaag

SEQ ID NO: 2164087 - RNA, 19 nt, Streptococcus pneumoniae R6
aaacaaauccaaucuucua

SEQ ID NO: 2164088 - RNA, 19 nt, Streptococcus pneumoniae R6
aaaauuucauuucgacuga

SEQ ID NO: 2164089 - RNA, 22 nt, Streptococcus pneumoniae R6
acgacggauaacagucaguuca

SEQ ID NO: 2164090 - RNA, 12 nt, Streptococcus pneumoniae R6
acgacgauuccg

SEQ ID NO: 2164091 - RNA, 19 nt, Streptococcus pneumoniae R6
accuagaacaagcuaggug

SEQ ID NO: 2164092 - RNA, 22 nt, Streptococcus pneumoniae R6
accuccucgagcaguuccauca

SEQ ID NO: 2164093 - RNA, 18 nt, Streptococcus pneumoniae R6
accguauuuuuguuacca

SEQ ID NO: 2164094 - RNA, 14 nt, Streptococcus pneumoniae R6
aaaaucaaagugca

SEQ ID NO: 2164095 - RNA, 16 nt, Streptococcus pneumoniae R6
aaaaugagucuaucaa

SEQ ID NO: 2164096 - RNA, 18 nt, Streptococcus pneumoniae R6
accaucaaaauaguguga

SEQ ID NO: 2164097 - RNA, 21 nt, Streptococcus pneumoniae R6
acgguguuuugagcugacuuc

SEQ ID NO: 2164098 - RNA, 18 nt, Streptococcus pneumoniae R6
acgugauaaaguuucugu

SEQ ID NO: 2164099 - RNA, 18 nt, Streptococcus pneumoniae R6
acgugaguagucauacca

SEQ ID NO: 2164100 - RNA, 14 nt, Streptococcus pneumoniae R6
acuagaauaguaca

SEQ ID NO: 2164101 - RNA, 21 nt, Streptococcus pneumoniae R6
acuacuggaauggcaaccguu

SEQ ID NO: 2164102 - RNA, 14 nt, Streptococcus pneumoniae R6
acuaggcgucuucu

SEQ ID NO: 2164103 - RNA, 22 nt, Streptococcus pneumoniae R6
acuaaguucacuugagcaaacu

SEQ ID NO: 2164104 - RNA, 17 nt, Streptococcus pneumoniae R6
acguuuuuacuuuggca

SEQ ID NO: 2164105 - RNA, 18 nt, Streptococcus pneumoniae R6
acgcuuuaaaaauccacu

SEQ ID NO: 2164106 - RNA, 22 nt, Streptococcus pneumoniae R6
acggacguugauuuguccaucu

SEQ ID NO: 2164107 - RNA, 18 nt, Streptococcus pneumoniae R6
aaacagcugcgauaagga

SEQ ID NO: 2164108 - RNA, 18 nt, Streptococcus pneumoniae R6
agaccuuucauaaaguuu

SEQ ID NO: 2164109 - RNA, 22 nt, Streptococcus pneumoniae R6
agauagcugcagcugaggaaau

SEQ ID NO: 2164110 - RNA, 23 nt, Streptococcus pneumoniae R6
agauaaaagcgccugacauucuu

SEQ ID NO: 2164111 - RNA, 21 nt, Streptococcus pneumoniae R6
agaugguauugacugcccaga

SEQ ID NO: 2164112 - RNA, 14 nt, Streptococcus pneumoniae R6
agauggaaguagug

SEQ ID NO: 2164113 - RNA, 22 nt, Streptococcus pneumoniae R6
agaugaguguaaaaagaaaguc

SEQ ID NO: 2164114 - RNA, 13 nt, Streptococcus pneumoniae R6
agaugaagcaauc

SEQ ID NO: 2164115 - RNA, 20 nt, Streptococcus pneumoniae R6
acuuuuggggggcaguucau

SEQ ID NO: 2164116 - RNA, 14 nt, Streptococcus pneumoniae R6
agaaaacgaugaca

SEQ ID NO: 2164117 - RNA, 21 nt, Streptococcus pneumoniae R6
agaaaagcccuucauaagcua

SEQ ID NO: 2164118 - RNA, 23 nt, Streptococcus pneumoniae R6
acuuucuuuuuauacucaucugc

SEQ ID NO: 2164119 - RNA, 17 nt, Streptococcus pneumoniae R6
acuuccugcucaaaaua

SEQ ID NO: 2164120 - RNA, 20 nt, Streptococcus pneumoniae R6
acuuccauguuguagucugc

SEQ ID NO: 2164121 - RNA, 16 nt, Streptococcus pneumoniae R6
agaaaucacaauuccu

SEQ ID NO: 2164122 - RNA, 21 nt, Streptococcus pneumoniae R6
agaaaagugcaaauaagaaau

SEQ ID NO: 2164123 - RNA, 13 nt, Streptococcus pneumoniae R6
agaauaguacacu

SEQ ID NO: 2164124 - RNA, 17 nt, Streptococcus pneumoniae R6
agaagugacagucgcaa

SEQ ID NO: 2164125 - RNA, 20 nt, Streptococcus pneumoniae R6
agaaggcugguugaaaaccu

SEQ ID NO: 2164126 - RNA, 23 nt, Streptococcus pneumoniae R6
agaagcaccaguugcagucgcau

SEQ ID NO: 2164127 - RNA, 16 nt, Streptococcus pneumoniae R6
agaacugacgaaguca

SEQ ID NO: 2164128 - RNA, 22 nt, Streptococcus pneumoniae R6
acugauuugagguuguagauag

SEQ ID NO: 2164129 - RNA, 13 nt, Streptococcus pneumoniae R6
acucuuuaagaga

SEQ ID NO: 2164130 - RNA, 22 nt, Streptococcus pneumoniae R6
acuuauaguacuaaucuuugcc

SEQ ID NO: 2164131 - RNA, 17 nt, Streptococcus pneumoniae R6
acuuagcucugugcaau

SEQ ID NO: 2164132 - RNA, 19 nt, Streptococcus pneumoniae R6
acuuagauugcuuugcaau

SEQ ID NO: 2164133 - RNA, 23 nt, Streptococcus pneumoniae R6
aagacagguuucacaucaaucuu

SEQ ID NO: 2164134 - RNA, 19 nt, Streptococcus pneumoniae R6
aagcaaaauggcgaguccu

SEQ ID NO: 2164135 - RNA, 15 nt, Streptococcus pneumoniae R6
aagauugauaaaggc

SEQ ID NO: 2164136 - RNA, 21 nt, Streptococcus pneumoniae R6
aagauuaauuucagaaaucuu

SEQ ID NO: 2164137 - RNA, 21 nt, Streptococcus pneumoniae R6
aagauccaguacuuuuucuau

SEQ ID NO: 2164138 - RNA, 11 nt, Streptococcus pneumoniae R6
aagaucaaguu

SEQ ID NO: 2164139 - RNA, 20 nt, Streptococcus pneumoniae R6
aagauaacugcuagaaaugc

SEQ ID NO: 2164140 - RNA, 20 nt, Streptococcus pneumoniae R6
gcaccaacucgggcugaaua

SEQ ID NO: 2164141 - RNA, 21 nt, Streptococcus pneumoniae R6
gcagauagggcuaggcuaaca

SEQ ID NO: 2164142 - RNA, 19 nt, Streptococcus pneumoniae R6
gcagcuuguucuucugcug

SEQ ID NO: 2164143 - RNA, 18 nt, Streptococcus pneumoniae R6
aagaacaggacaaaucga

SEQ ID NO: 2164144 - RNA, 14 nt, Streptococcus pneumoniae R6
aagaacaucuacaa

SEQ ID NO: 2164145 - RNA, 14 nt, Streptococcus pneumoniae R6
aagaaguaaaucuu

SEQ ID NO: 2164146 - RNA, 17 nt, Streptococcus pneumoniae R6
aagaaagaccauagcaa

SEQ ID NO: 2164147 - RNA, 19 nt, Streptococcus pneumoniae R6
aagaaaguaagaaucugca

SEQ ID NO: 2164148 - RNA, 13 nt, Streptococcus pneumoniae R6
gauaacauugaca

SEQ ID NO: 2164149 - RNA, 24 nt, Streptococcus pneumoniae R6
gcaaauagcaguaacuucugucua

SEQ ID NO: 2164150 - RNA, 21 nt, Streptococcus pneumoniae R6
gcaaacuaugucggcuucaca

SEQ ID NO: 2164151 - RNA, 18 nt, Streptococcus pneumoniae R6
gauuuugugaauuuucaa

SEQ ID NO: 2164152 - RNA, 22 nt, Streptococcus pneumoniae R6
gauuuuucuggcucuuugucaa

SEQ ID NO: 2164153 - RNA, 16 nt, Streptococcus pneumoniae R6
gauucgcucuucaauc

SEQ ID NO: 2164154 - RNA, 23 nt, Streptococcus pneumoniae R6
aacugccuuucucucgugauuau

SEQ ID NO: 2164155 - RNA, 14 nt, Streptococcus pneumoniae R6
gaugaagauugaua

SEQ ID NO: 2164156 - RNA, 22 nt, Streptococcus pneumoniae R6
gaugacccaagcuuuaugcuug

SEQ ID NO: 2164157 - RNA, 16 nt, Streptococcus pneumoniae R6
cguacuguuauagauu

SEQ ID NO: 2164158 - RNA, 14 nt, Streptococcus pneumoniae R6
cguccagccuuguc

SEQ ID NO: 2164159 - RNA, 17 nt, Streptococcus pneumoniae R6
cugcaaaauuuugagca

SEQ ID NO: 2164160 - RNA, 18 nt, Streptococcus pneumoniae R6
cugcaauuaguaugagca

SEQ ID NO: 2164161 - RNA, 22 nt, Streptococcus pneumoniae R6
cugaucaaaaaauuucauuucg

SEQ ID NO: 2164162 - RNA, 17 nt, Streptococcus pneumoniae R6
cugaucccuccauuuca

SEQ ID NO: 2164163 - RNA, 13 nt, Streptococcus pneumoniae R6
cucuuugucaacu

SEQ ID NO: 2164164 - RNA, 17 nt, Streptococcus pneumoniae R6
cucuaucaggaaaguca

SEQ ID NO: 2164165 - RNA, 17 nt, Streptococcus pneumoniae R6
cucucagcacuuggcau

SEQ ID NO: 2164166 - RNA, 16 nt, Streptococcus pneumoniae R6
cucaaugauuugaaca

SEQ ID NO: 2164167 - RNA, 16 nt, Streptococcus pneumoniae R6
cuccaaaguagcuugc

SEQ ID NO: 2164168 - RNA, 15 nt, Streptococcus pneumoniae R6
cuccaaccaucaaaa

SEQ ID NO: 2164169 - RNA, 21 nt, Streptococcus pneumoniae R6
cucaaggcaguacuuugagca

SEQ ID NO: 2164170 - RNA, 20 nt, Streptococcus pneumoniae R6
cuauucuaaauucaauucac

SEQ ID NO: 2164171 - RNA, 19 nt, Streptococcus pneumoniae R6
cuauuuuuacucaaggacu

SEQ ID NO: 2164172 - RNA, 20 nt, Streptococcus pneumoniae R6
cucaaaacacuguuuugaga

SEQ ID NO: 2164173 - RNA, 21 nt, Streptococcus pneumoniae R6
cucaaaacacuguuuugagcu

SEQ ID NO: 2164174 - RNA, 21 nt, Streptococcus pneumoniae R6
cucaaaacaguguuuugagcu

SEQ ID NO: 2164175 - RNA, 21 nt, Streptococcus pneumoniae R6
cucaaagcagugcuuugagca

SEQ ID NO: 2164176 - RNA, 19 nt, Streptococcus pneumoniae R6
cucaaacagugcuagaaau

SEQ ID NO: 2164177 - RNA, 18 nt, Streptococcus pneumoniae R6
cuauccuggcguaguaaa

SEQ ID NO: 2164178 - RNA, 23 nt, Streptococcus pneumoniae R6
cuauuauuaauguuuagcaaacu

SEQ ID NO: 2164179 - RNA, 12 nt, Streptococcus pneumoniae R6
cuauguugcaaa

SEQ ID NO: 2164180 - RNA, 17 nt, Streptococcus pneumoniae R6
cuauaguuugcaaauua

SEQ ID NO: 2164181 - RNA, 21 nt, Streptococcus pneumoniae R6
cuauaauaauuuauaaaacca

SEQ ID NO: 2164182 - RNA, 21 nt, Streptococcus pneumoniae R6
cuauagauaaggucaucuuau

SEQ ID NO: 2164183 - RNA, 16 nt, Streptococcus pneumoniae R6
cucccauauuuggcau

SEQ ID NO: 2164184 - RNA, 17 nt, Streptococcus pneumoniae R6
cucgagguuaacuccuu

SEQ ID NO: 2164185 - RNA, 19 nt, Streptococcus pneumoniae R6
gacaaccaaacuguccaca

SEQ ID NO: 2164186 - RNA, 18 nt, Streptococcus pneumoniae R6
gaauuuuuugagcaaguu

SEQ ID NO: 2164187 - RNA, 19 nt, Streptococcus pneumoniae R6
gacaaagcgcuggaacuug

SEQ ID NO: 2164188 - RNA, 14 nt, Streptococcus pneumoniae R6
gaaugcuuuccaac

SEQ ID NO: 2164189 - RNA, 13 nt, Streptococcus pneumoniae R6
gaauaguaucuga

SEQ ID NO: 2164190 - RNA, 11 nt, Streptococcus pneumoniae R6
gaaucaauaga

SEQ ID NO: 2164191 - RNA, 13 nt, Streptococcus pneumoniae R6
cuucaaucuuguc

SEQ ID NO: 2164192 - RNA, 18 nt, Streptococcus pneumoniae R6
cuucgcuuccaaucucac

SEQ ID NO: 2164193 - RNA, 13 nt, Streptococcus pneumoniae R6
cuuaucuuuggca

SEQ ID NO: 2164194 - RNA, 16 nt, Streptococcus pneumoniae R6
cuuaucuucaguuccc

SEQ ID NO: 2164195 - RNA, 14 nt, Streptococcus pneumoniae R6
cuuaucuauagcuu

SEQ ID NO: 2164196 - RNA, 16 nt, Streptococcus pneumoniae R6
cuuaacaaucuuacca

SEQ ID NO: 2164197 - RNA, 21 nt, Streptococcus pneumoniae R6
cuguuuuugguugcaccaagu

SEQ ID NO: 2164198 - RNA, 23 nt, Streptococcus pneumoniae R6
cuuaaguaaguacaugcaaagua

SEQ ID NO: 2164199 - RNA, 21 nt, Streptococcus pneumoniae R6
cuggcuacagaugcugcauuu

SEQ ID NO: 2164200 - RNA, 18 nt, Streptococcus pneumoniae R6
cuggcucauaucuggcau

SEQ ID NO: 2164201 - RNA, 14 nt, Streptococcus pneumoniae R6
cuuucaaaccgcca

SEQ ID NO: 2164202 - RNA, 15 nt, Streptococcus pneumoniae R6
cuucgucagucuuau

SEQ ID NO: 2164203 - RNA, 20 nt, Streptococcus pneumoniae R6
cuucgucaguuccaucuaca

SEQ ID NO: 2164204 - RNA, 17 nt, Streptococcus pneumoniae R6
cuucguaagauucuucu

SEQ ID NO: 2164205 - RNA, 15 nt, Streptococcus pneumoniae R6
cuuuguccauuauga

SEQ ID NO: 2164206 - RNA, 15 nt, Streptococcus pneumoniae R6
cuuuuuauacucaau

SEQ ID NO: 2164207 - RNA, 20 nt, Streptococcus pneumoniae R6
cuuuuggggggcaguucaga

SEQ ID NO: 2164208 - RNA, 20 nt, Streptococcus pneumoniae R6
cuuuuggggggcaguucaua

SEQ ID NO: 2164209 - RNA, 19 nt, Streptococcus pneumoniae R6
cuuuuguauuccacuugug

SEQ ID NO: 2164210 - RNA, 14 nt, Streptococcus pneumoniae R6
cuuuucugaggauu

SEQ ID NO: 2164211 - RNA, 14 nt, Streptococcus pneumoniae R6
cuuuucuacugaaa

SEQ ID NO: 2164212 - RNA, 17 nt, Streptococcus pneumoniae R6
cuuuugcaaucauuuca

SEQ ID NO: 2164213 - RNA, 20 nt, Streptococcus pneumoniae R6
gaaaaguuuuagcuucugua

SEQ ID NO: 2164214 - RNA, 16 nt, Streptococcus pneumoniae R6
gaaaagucaucuauaa

SEQ ID NO: 2164215 - RNA, 18 nt, Streptococcus pneumoniae R6
gaaaaggcagauucucua

SEQ ID NO: 2164216 - RNA, 15 nt, Streptococcus pneumoniae R6
gaaaagcuaagcucg

SEQ ID NO: 2164217 - RNA, 14 nt, Streptococcus pneumoniae R6
aaccuucuaauaga

SEQ ID NO: 2164218 - RNA, 16 nt, Streptococcus pneumoniae R6
gaacguguucaauagc

SEQ ID NO: 2164219 - RNA, 17 nt, Streptococcus pneumoniae R6
gcgaagggcuucuuuga

SEQ ID NO: 2164220 - RNA, 17 nt, Streptococcus pneumoniae R6
gcucaucaucugaauga

SEQ ID NO: 2164221 - RNA, 15 nt, Streptococcus pneumoniae R6
gcucuuugucaacug

SEQ ID NO: 2164222 - RNA, 23 nt, Streptococcus pneumoniae R6
gcugacuucgucaguucuaucca

SEQ ID NO: 2164223 - RNA, 21 nt, Streptococcus pneumoniae R6
gcuuucuauagaaaacaacuu

SEQ ID NO: 2164224 - RNA, 19 nt, Streptococcus pneumoniae R6
gcuucuuuuggauuuucaa

SEQ ID NO: 2164225 - RNA, 22 nt, Streptococcus pneumoniae R6
gcuuaagugcguugauaaucuu

SEQ ID NO: 2164226 - RNA, 19 nt, Streptococcus pneumoniae R6
ggcucaucuggcuuucugu

SEQ ID NO: 2164227 - RNA, 20 nt, Streptococcus pneumoniae R6
ggcugugauauacuaauaua

SEQ ID NO: 2164228 - RNA, 12 nt, Streptococcus pneumoniae R6
ggcuuuuccaag

SEQ ID NO: 2164229 - RNA, 19 nt, Streptococcus pneumoniae R6
guauaauccgcauacuugg

SEQ ID NO: 2164230 - RNA, 19 nt, Streptococcus pneumoniae R6
aagucucagugggcuauuc

SEQ ID NO: 2164231 - RNA, 20 nt, Streptococcus pneumoniae R6
guacagaaaaaccuugauac

SEQ ID NO: 2164232 - RNA, 16 nt, Streptococcus pneumoniae R6
ggucgcuugaaccuuu

SEQ ID NO: 2164233 - RNA, 14 nt, Streptococcus pneumoniae R6
gucaguucuaucca

SEQ ID NO: 2164234 - RNA, 15 nt, Streptococcus pneumoniae R6
gucauuuuucugcua

SEQ ID NO: 2164235 - RNA, 15 nt, Streptococcus pneumoniae R6
guccaacuguaaaga

SEQ ID NO: 2164236 - RNA, 13 nt, Streptococcus pneumoniae R6
guccuuguaaaga

SEQ ID NO: 2164237 - RNA, 15 nt, Streptococcus pneumoniae R6
gucuuucauuucugu

SEQ ID NO: 2164238 - RNA, 15 nt, Streptococcus pneumoniae R6
gucuuggucugucaa

SEQ ID NO: 2164239 - RNA, 18 nt, Streptococcus pneumoniae R6
gucuuacguucauccaua

SEQ ID NO: 2164240 - RNA, 14 nt, Streptococcus pneumoniae R6
gucuucgauaucuu

SEQ ID NO: 2164241 - RNA, 14 nt, Streptococcus pneumoniae R6
gugaauauucuugg

SEQ ID NO: 2164242 - RNA, 21 nt, Streptococcus pneumoniae R6
aaccaagaucuugucugcaug

SEQ ID NO: 2164243 - RNA, 22 nt, Streptococcus pneumoniae R6
aaccaucuguaccgaccuuguc

SEQ ID NO: 2164244 - RNA, 18 nt, Streptococcus pneumoniae R6
aacccaauagcgauuccc

SEQ ID NO: 2164245 - RNA, 22 nt, Streptococcus pneumoniae R6
aacaucuacaauugaaacucua

SEQ ID NO: 2164246 - RNA, 20 nt, Streptococcus pneumoniae R6
ccguauauauguuacugacu

SEQ ID NO: 2164247 - RNA, 18 nt, Streptococcus pneumoniae R6
ccucugaguauuuagcaa

SEQ ID NO: 2164248 - RNA, 17 nt, Streptococcus pneumoniae R6
ccugcaaaucuacuggc

SEQ ID NO: 2164249 - RNA, 23 nt, Streptococcus pneumoniae R6
ccucgauggcuccguagauagcu

SEQ ID NO: 2164250 - RNA, 15 nt, Streptococcus pneumoniae R6
aacaaauccaaucuu

SEQ ID NO: 2164251 - RNA, 15 nt, Streptococcus pneumoniae R6
aaaucaggaaaucuu

SEQ ID NO: 2164252 - RNA, 14 nt, Streptococcus pneumoniae R6
ccaaccaucaaaau

SEQ ID NO: 2164253 - RNA, 16 nt, Streptococcus pneumoniae R6
aaaggcuuagccaguc

SEQ ID NO: 2164254 - RNA, 14 nt, Streptococcus pneumoniae R6
aaagguaacuccuu

SEQ ID NO: 2164255 - RNA, 12 nt, Streptococcus pneumoniae R6
aaagucaaauua

SEQ ID NO: 2164256 - RNA, 22 nt, Streptococcus pneumoniae R6
aaaguuagauuuuuucugucua

SEQ ID NO: 2164257 - RNA, 16 nt, Streptococcus pneumoniae R6
ccauuccucccauauu

SEQ ID NO: 2164258 - RNA, 17 nt, Streptococcus pneumoniae R6
ccauucuuuuacuuacg

SEQ ID NO: 2164259 - RNA, 13 nt, Streptococcus pneumoniae R6
caucgacuuguuu

SEQ ID NO: 2164260 - RNA, 19 nt, Streptococcus pneumoniae R6
caucacgaaaauauuugga

SEQ ID NO: 2164261 - RNA, 16 nt, Streptococcus pneumoniae R6
caucaaucaagauaca

SEQ ID NO: 2164262 - RNA, 16 nt, Streptococcus pneumoniae R6
cauaacagcauuucca

SEQ ID NO: 2164263 - RNA, 14 nt, Streptococcus pneumoniae R6
caucuuauuucaau

SEQ ID NO: 2164264 - RNA, 17 nt, Streptococcus pneumoniae R6
caucuuccgcaauccac

SEQ ID NO: 2164265 - RNA, 17 nt, Streptococcus pneumoniae R6
cagcaagaaugaacauc

SEQ ID NO: 2164266 - RNA, 18 nt, Streptococcus pneumoniae R6
cagaaauggaaguuucaa

SEQ ID NO: 2164267 - RNA, 17 nt, Streptococcus pneumoniae R6
cagauauaccaagacau

SEQ ID NO: 2164268 - RNA, 13 nt, Streptococcus pneumoniae R6
cagaugaaagcug

SEQ ID NO: 2164269 - RNA, 18 nt, Streptococcus pneumoniae R6
caccaccgauagagugcc

SEQ ID NO: 2164270 - RNA, 14 nt, Streptococcus pneumoniae R6
caccacaugacauu

SEQ ID NO: 2164271 - RNA, 15 nt, Streptococcus pneumoniae R6
caccacuugcuuagu

SEQ ID NO: 2164272 - RNA, 17 nt, Streptococcus pneumoniae R6
caccagauagaauagca

SEQ ID NO: 2164273 - RNA, 18 nt, Streptococcus pneumoniae R6
caauacgaaucaauacag

SEQ ID NO: 2164274 - RNA, 12 nt, Streptococcus pneumoniae R6
caauuuaucagu

SEQ ID NO: 2164275 - RNA, 19 nt, Streptococcus pneumoniae R6
caagauggacuguuauaga

SEQ ID NO: 2164276 - RNA, 16 nt, Streptococcus pneumoniae R6
caagcauaacagcauu

SEQ ID NO: 2164277 - RNA, 16 nt, Streptococcus pneumoniae R6
caacuguuuuuucaac

SEQ ID NO: 2164278 - RNA, 21 nt, Streptococcus pneumoniae R6
caacugucuuauccaaacuag

SEQ ID NO: 2164279 - RNA, 12 nt, Streptococcus pneumoniae R6
caauaagacuau

SEQ ID NO: 2164280 - RNA, 20 nt, Streptococcus pneumoniae R6
caauaaaacgcauaauauca

SEQ ID NO: 2164281 - RNA, 20 nt, Streptococcus pneumoniae R6
caauaaaacgcauaguauca

SEQ ID NO: 2164282 - RNA, 19 nt, Streptococcus pneumoniae R6
caagguguacuguuauaga

SEQ ID NO: 2164283 - RNA, 21 nt, Streptococcus pneumoniae R6
cacgaaguccuuguuugagcu

SEQ ID NO: 2164284 - RNA, 15 nt, Streptococcus pneumoniae R6
augguuacugacuuc

SEQ ID NO: 2164285 - RNA, 23 nt, Streptococcus pneumoniae R6
auggguucuuugccaguucuuca

SEQ ID NO: 2164286 - RNA, 20 nt, Streptococcus pneumoniae R6
auggcaaaaaauugagaaag

SEQ ID NO: 2164287 - RNA, 15 nt, Streptococcus pneumoniae R6
auggcgccauuuggc

SEQ ID NO: 2164288 - RNA, 16 nt, Streptococcus pneumoniae R6
aucucuacuacuugaa

SEQ ID NO: 2164289 - RNA, 12 nt, Streptococcus pneumoniae R6
augcaucaagug

SEQ ID NO: 2164290 - RNA, 17 nt, Streptococcus pneumoniae R6
augcauaauuuccauac

SEQ ID NO: 2164291 - RNA, 15 nt, Streptococcus pneumoniae R6
augcacauauacacu

SEQ ID NO: 2164292 - RNA, 19 nt, Streptococcus pneumoniae R6
aucugguacucacuuacau

SEQ ID NO: 2164293 - RNA, 20 nt, Streptococcus pneumoniae R6
augaagggcuuuucuaucac

SEQ ID NO: 2164294 - RNA, 22 nt, Streptococcus pneumoniae R6
augaaggcuggaaaaaagucuu

SEQ ID NO: 2164295 - RNA, 20 nt, Streptococcus pneumoniae R6
augacaaaguacuugagaau

SEQ ID NO: 2164296 - RNA, 19 nt, Streptococcus pneumoniae R6
augacaacgggguuuccaa

SEQ ID NO: 2164297 - RNA, 22 nt, Streptococcus pneumoniae R6
caaaccaccgacaaucguugca

SEQ ID NO: 2164298 - RNA, 20 nt, Streptococcus pneumoniae R6
caaagguuugauuaguccau

SEQ ID NO: 2164299 - RNA, 21 nt, Streptococcus pneumoniae R6
caaagggagguaaagauagcc

SEQ ID NO: 2164300 - RNA, 13 nt, Streptococcus pneumoniae R6
caaaucaaauuua

SEQ ID NO: 2164301 - RNA, 21 nt, Streptococcus pneumoniae R6
caaauccugccucaauccuuu

SEQ ID NO: 2164302 - RNA, 14 nt, Streptococcus pneumoniae R6
caaauccauaguaa

SEQ ID NO: 2164303 - RNA, 16 nt, Streptococcus pneumoniae R6
caaagauagaauccau

SEQ ID NO: 2164304 - RNA, 16 nt, Streptococcus pneumoniae R6
caaauuaauuuauaga

SEQ ID NO: 2164305 - RNA, 15 nt, Streptococcus pneumoniae R6
caaauuauuuacaga

SEQ ID NO: 2164306 - RNA, 21 nt, Streptococcus pneumoniae R6
caacaccgacuugguaguuga

SEQ ID NO: 2164307 - RNA, 23 nt, Streptococcus pneumoniae R6
auuuuugagaugggacuaaagau

SEQ ID NO: 2164308 - RNA, 22 nt, Streptococcus pneumoniae R6
auuuuuaggaagguuauuugga

SEQ ID NO: 2164309 - RNA, 18 nt, Streptococcus pneumoniae R6
auuuuuaaauuuuaucaa

SEQ ID NO: 2164310 - RNA, 18 nt, Streptococcus pneumoniae R6
caaaaacaaagagauugc

SEQ ID NO: 2164311 - RNA, 14 nt, Streptococcus pneumoniae R6
caaaaauuugauca

SEQ ID NO: 2164312 - RNA, 22 nt, Streptococcus pneumoniae R6
caaaacaguguuuugaucugac

SEQ ID NO: 2164313 - RNA, 15 nt, Streptococcus pneumoniae R6
caaaacacuguuuua

SEQ ID NO: 2164314 - RNA, 23 nt, Streptococcus pneumoniae R6
caaaacacuguuuugagguugca

SEQ ID NO: 2164315 - RNA, 18 nt, Streptococcus pneumoniae R6
auuugggucaaucuuguc

SEQ ID NO: 2164316 - RNA, 22 nt, Streptococcus pneumoniae R6
auuugauaagaauaucaagaua

SEQ ID NO: 2164317 - RNA, 15 nt, Streptococcus pneumoniae R6
auuucuccuaaagaa

SEQ ID NO: 2164318 - RNA, 17 nt, Streptococcus pneumoniae R6
auuucuggauuuccauu

SEQ ID NO: 2164319 - RNA, 15 nt, Streptococcus pneumoniae R6
auuuucuuagauaga

SEQ ID NO: 2164320 - RNA, 18 nt, Streptococcus pneumoniae R6
auuuucuuuuugaaguug

SEQ ID NO: 2164321 - RNA, 18 nt, Streptococcus pneumoniae R6
auuuuagcagucaagaug

SEQ ID NO: 2164322 - RNA, 17 nt, Streptococcus pneumoniae R6
auugucauuuuucugcu

SEQ ID NO: 2164323 - RNA, 23 nt, Streptococcus pneumoniae R6
auucucccgcccuuuuuucucaa

SEQ ID NO: 2164324 - RNA, 14 nt, Streptococcus pneumoniae R6
auugcgcacuuguu

SEQ ID NO: 2164325 - RNA, 17 nt, Streptococcus pneumoniae R6
auuucauauuuucagau

SEQ ID NO: 2164326 - RNA, 14 nt, Streptococcus pneumoniae R6
auuucgucaguucu

SEQ ID NO: 2164327 - RNA, 22 nt, Streptococcus pneumoniae R6
auuccauauucaauuauccaua

SEQ ID NO: 2164328 - RNA, 22 nt, Streptococcus pneumoniae R6
aaacuagaauaauacacuucua

SEQ ID NO: 2164329 - RNA, 18 nt, Streptococcus pneumoniae R6
auucauuugauuuuccua

SEQ ID NO: 2164330 - RNA, 15 nt, Streptococcus pneumoniae R6
aaacugacgaaguca

SEQ ID NO: 2164331 - RNA, 20 nt, Streptococcus pneumoniae R6
auuaauuuuacuuuccugau

SEQ ID NO: 2164332 - RNA, 13 nt, Streptococcus pneumoniae R6
auuaaucaaauga

SEQ ID NO: 2164333 - RNA, 19 nt, Streptococcus pneumoniae R6
agguaaaucccaaguaaau

SEQ ID NO: 2164334 - RNA, 22 nt, Streptococcus pneumoniae R6
aguaaucauuauccaacagaga

SEQ ID NO: 2164335 - RNA, 21 nt, Streptococcus pneumoniae R6
agucauuaccaguggcaauca

SEQ ID NO: 2164336 - RNA, 22 nt, Streptococcus pneumoniae R6
aguagccuuugucguuccaagu

SEQ ID NO: 2164337 - RNA, 19 nt, Streptococcus pneumoniae R6
aguguuuugagcugacuuc

SEQ ID NO: 2164338 - RNA, 19 nt, Streptococcus pneumoniae R6
aguguuuugaucugacuuc

SEQ ID NO: 2164339 - RNA, 16 nt, Streptococcus pneumoniae R6
auaaaauauaguagau

SEQ ID NO: 2164340 - RNA, 23 nt, Streptococcus pneumoniae R6
auaaaaucugaaucaaaggagau

SEQ ID NO: 2164341 - RNA, 19 nt, Streptococcus pneumoniae R6
auaaaacgcauaguaucag

SEQ ID NO: 2164342 - RNA, 15 nt, Streptococcus pneumoniae R6
auaaaacgcaucaua

SEQ ID NO: 2164343 - RNA, 12 nt, Streptococcus pneumoniae R6
auaaaagauaga

SEQ ID NO: 2164344 - RNA, 13 nt, Streptococcus pneumoniae R6
aguuaucugcaaa

SEQ ID NO: 2164345 - RNA, 18 nt, Streptococcus pneumoniae R6
auaacaagguuagucuua

SEQ ID NO: 2164346 - RNA, 12 nt, Streptococcus pneumoniae R6
auaaucgccaua

SEQ ID NO: 2164347 - RNA, 19 nt, Streptococcus pneumoniae R6
auaagguaccuccuaaucc

SEQ ID NO: 2164348 - RNA, 22 nt, Streptococcus pneumoniae R6
auaaugguaucacauucaaugu

SEQ ID NO: 2164349 - RNA, 23 nt, Streptococcus pneumoniae R6
auacaaggacuggagaaggagau

SEQ ID NO: 2164350 - RNA, 15 nt, Streptococcus pneumoniae R6
auauauauaauagau

SEQ ID NO: 2164351 - RNA, 13 nt, Streptococcus pneumoniae R6
auauaugagaagu

SEQ ID NO: 2164352 - RNA, 17 nt, Streptococcus pneumoniae R6
auauaggcauaucugau

SEQ ID NO: 2164353 - RNA, 12 nt, Streptococcus pneumoniae R6
auagguugcaaa

SEQ ID NO: 2164354 - RNA, 14 nt, Streptococcus pneumoniae R6
auaguaucaaauga

SEQ ID NO: 2164355 - RNA, 21 nt, Streptococcus pneumoniae R6
auaguaucaagguuuuucugu

SEQ ID NO: 2164356 - RNA, 17 nt, Streptococcus pneumoniae R6
auaucaaguuuucacac

SEQ ID NO: 2164357 - RNA, 15 nt, Streptococcus pneumoniae R6
auaucauuaaguaau

SEQ ID NO: 2164358 - RNA, 18 nt, Streptococcus pneumoniae R6
auaugaaaucuuuuugau

SEQ ID NO: 2164359 - RNA, 17 nt, Streptococcus pneumoniae R6
auaugauucuuucuaau

SEQ ID NO: 2164360 - RNA, 13 nt, Streptococcus pneumoniae R6
auauuuucagaua

SEQ ID NO: 2164361 - RNA, 18 nt, Streptococcus pneumoniae R6
auauuggcugcuugcaau

SEQ ID NO: 2164362 - RNA, 13 nt, Streptococcus pneumoniae R6
auauuucuagaaa

SEQ ID NO: 2164363 - RNA, 18 nt, Streptococcus pneumoniae R6
aucaagcucaucuaaugu

SEQ ID NO: 2164364 - RNA, 21 nt, Streptococcus pneumoniae R6
aucauaaccacccgucaaacg

SEQ ID NO: 2164365 - RNA, 18 nt, Streptococcus pneumoniae R6
auccugaagaaugggaua

SEQ ID NO: 2164366 - RNA, 15 nt, Streptococcus pneumoniae R6
auccuuuauuuucaa

SEQ ID NO: 2164367 - RNA, 21 nt, Streptococcus pneumoniae R6
auccaccuauuauacaaaguu

SEQ ID NO: 2164368 - RNA, 19 nt, Streptococcus pneumoniae R6
agccacggcacguuccaua

SEQ ID NO: 2164369 - RNA, 14 nt, Streptococcus pneumoniae R6
agauucaauauacu

SEQ ID NO: 2164370 - RNA, 16 nt, Streptococcus pneumoniae R6
agauucuacucuguuu

SEQ ID NO: 2164371 - RNA, 12 nt, Streptococcus pneumoniae R6
agauugagaaac

SEQ ID NO: 2164372 - RNA, 15 nt, Streptococcus pneumoniae R6
agauuuccugagaug

SEQ ID NO: 2164373 - RNA, 15 nt, Streptococcus pneumoniae R6
agcauacugcccuga

SEQ ID NO: 2164374 - RNA, 22 nt, Streptococcus pneumoniae R6
aggauuguacucaggugaguag

SEQ ID NO: 2164375 - RNA, 22 nt, Streptococcus pneumoniae R6
aggauuugcaucccuugaauag

SEQ ID NO: 2164376 - RNA, 17 nt, Streptococcus pneumoniae R6
aggaguuugagacaauc

SEQ ID NO: 2164377 - RNA, 14 nt, Streptococcus pneumoniae R6
aggagccagcugaa

SEQ ID NO: 2164378 - RNA, 12 nt, Streptococcus pneumoniae R6
aggaagauguaa

SEQ ID NO: 2164379 - RNA, 17 nt, Streptococcus pneumoniae R6
aggacaaaagauaagau

SEQ ID NO: 2164380 - RNA, 12 nt, Streptococcus pneumoniae R6
agcgugucaaga

SEQ ID NO: 2164381 - RNA, 22 nt, Streptococcus pneumoniae R6
agcguccaucucgacuggcaaa

SEQ ID NO: 2164382 - RNA, 21 nt, Streptococcus pneumoniae R6
agcucgagaaaggggcucuuu

SEQ ID NO: 2164383 - RNA, 10 nt, Streptococcus pneumoniae R6
uuuuuuguuu

SEQ ID NO: 2164384 - RNA, 12 nt, Streptococcus pneumoniae R6
uuuuuuuacauc

SEQ ID NO: 2164385 - RNA, 22 nt, Streptococcus pneumoniae R6
uuuuucagguccaguuacuacu

SEQ ID NO: 2164386 - RNA, 12 nt, Streptococcus pneumoniae R6
uuuuuucucaau

SEQ ID NO: 2164387 - RNA, 22 nt, Streptococcus pneumoniae R6
uuuuuugauuggcuuugacuua

SEQ ID NO: 2164388 - RNA, 11 nt, Streptococcus pneumoniae R6
uuuuuucuugg

SEQ ID NO: 2164389 - RNA, 13 nt, Streptococcus pneumoniae R6
uuuuguagggcug

SEQ ID NO: 2164390 - RNA, 22 nt, Streptococcus pneumoniae R6
uuuuguauuauuagggaaacaa

SEQ ID NO: 2164391 - RNA, 15 nt, Streptococcus pneumoniae R6
uuuuguauuuugaau

SEQ ID NO: 2164392 - RNA, 20 nt, Streptococcus pneumoniae R6
uuuuguauuuugaauauacc

SEQ ID NO: 2164393 - RNA, 19 nt, Streptococcus pneumoniae R6
uuuugugaccacaucugcc

SEQ ID NO: 2164394 - RNA, 14 nt, Streptococcus pneumoniae R6
uuuugugauuuuaa

SEQ ID NO: 2164395 - RNA, 16 nt, Streptococcus pneumoniae R6
uuuugugauuuuaaga

SEQ ID NO: 2164396 - RNA, 16 nt, Streptococcus pneumoniae R6
uuuuguucaucauuaa

SEQ ID NO: 2164397 - RNA, 21 nt, Streptococcus pneumoniae R6
uuuuguugacuuguacucaau

SEQ ID NO: 2164398 - RNA, 10 nt, Streptococcus pneumoniae R6
uuuuuaaaaa

SEQ ID NO: 2164399 - RNA, 23 nt, Streptococcus pneumoniae R6
uuuuguaaaggguucuacaaauc

SEQ ID NO: 2164400 - RNA, 19 nt, Streptococcus pneumoniae R6
uuuuguaaucuaggaaaac

SEQ ID NO: 2164401 - RNA, 20 nt, Streptococcus pneumoniae R6
uuuugcuuaaauaaaauuuu

SEQ ID NO: 2164402 - RNA, 18 nt, Streptococcus pneumoniae R6
uuuuggcuaguucccuau

SEQ ID NO: 2164403 - RNA, 18 nt, Streptococcus pneumoniae R6
uuuuggcaauuuuugaaa

SEQ ID NO: 2164404 - RNA, 21 nt, Streptococcus pneumoniae R6
uuuugccgugcucuaaaauca

SEQ ID NO: 2164405 - RNA, 21 nt, Streptococcus pneumoniae R6
uuuugcccucuaaauacaaaa

SEQ ID NO: 2164406 - RNA, 14 nt, Streptococcus pneumoniae R6
uuuugcuaaucaaa

SEQ ID NO: 2164407 - RNA, 15 nt, Streptococcus pneumoniae R6
uuuugcuaaucaaaa

SEQ ID NO: 2164408 - RNA, 23 nt, Streptococcus pneumoniae R6
uuuugcucggcauugugaugaag

SEQ ID NO: 2164409 - RNA, 23 nt, Streptococcus pneumoniae R6
uuuugcuguccucaaaaugaaaa

SEQ ID NO: 2164410 - RNA, 10 nt, Streptococcus pneumoniae R6
uuuuuaaagg

SEQ ID NO: 2164411 - RNA, 13 nt, Streptococcus pneumoniae R6
uuuuuaacaaaaa

SEQ ID NO: 2164412 - RNA, 16 nt, Streptococcus pneumoniae R6
uuuuuagaaggauaaa

SEQ ID NO: 2164413 - RNA, 19 nt, Streptococcus pneumoniae R6
uuuuucaaaguuugacuua

SEQ ID NO: 2164414 - RNA, 15 nt, Streptococcus pneumoniae R6
uuuuucaagcauuuu

SEQ ID NO: 2164415 - RNA, 14 nt, Streptococcus pneumoniae R6
uuuuucaaucaaug

SEQ ID NO: 2164416 - RNA, 20 nt, Streptococcus pneumoniae R6
uuuuucagcuggcuccuucu

SEQ ID NO: 2164417 - RNA, 17 nt, Streptococcus pneumoniae R6
uuuuuauaacaguauac

SEQ ID NO: 2164418 - RNA, 22 nt, Streptococcus pneumoniae R6
uuuuuauacucaaugaaaauca

SEQ ID NO: 2164419 - RNA, 15 nt, Streptococcus pneumoniae R6
uuuuuaguugaguua

SEQ ID NO: 2164420 - RNA, 14 nt, Streptococcus pneumoniae R6
uuuuuagcuucuuu

SEQ ID NO: 2164421 - RNA, 23 nt, Streptococcus pneumoniae R6
uuuuuaucuagcucccuuaguuc

SEQ ID NO: 2164422 - RNA, 11 nt, Streptococcus pneumoniae R6
uuuuuaugaua

SEQ ID NO: 2164423 - RNA, 23 nt, Streptococcus pneumoniae R6
uuuuuaugauucgcuauucuucu

SEQ ID NO: 2164424 - RNA, 19 nt, Streptococcus pneumoniae R6
uuuucuuguacaacuuuag

SEQ ID NO: 2164425 - RNA, 14 nt, Streptococcus pneumoniae R6
uuuucuuuacuucu

SEQ ID NO: 2164426 - RNA, 17 nt, Streptococcus pneumoniae R6
uuuucuuugauuuuaau

SEQ ID NO: 2164427 - RNA, 13 nt, Streptococcus pneumoniae R6
uuuucuuugcagu

SEQ ID NO: 2164428 - RNA, 19 nt, Streptococcus pneumoniae R6
uuuucuuugccucccacua

SEQ ID NO: 2164429 - RNA, 18 nt, Streptococcus pneumoniae R6
uuuucuuggguuucuucu

SEQ ID NO: 2164430 - RNA, 18 nt, Streptococcus pneumoniae R6
uuuucugaguuaaacucu

SEQ ID NO: 2164431 - RNA, 17 nt, Streptococcus pneumoniae R6
uuuucugauaagaugcu

SEQ ID NO: 2164432 - RNA, 16 nt, Streptococcus pneumoniae R6
uuuucgagccaauacu

SEQ ID NO: 2164433 - RNA, 21 nt, Streptococcus pneumoniae R6
uuuucucuuuguccuuuagaa

SEQ ID NO: 2164434 - RNA, 13 nt, Streptococcus pneumoniae R6
uuuucucuagcuu

SEQ ID NO: 2164435 - RNA, 20 nt, Streptococcus pneumoniae R6
uuuugcacaccugauauuau

SEQ ID NO: 2164436 - RNA, 16 nt, Streptococcus pneumoniae R6
uuuugcccauucuuua

SEQ ID NO: 2164437 - RNA, 21 nt, Streptococcus pneumoniae R6
uuuugacguaucuuagcgauu

SEQ ID NO: 2164438 - RNA, 20 nt, Streptococcus pneumoniae R6
uuuugacguucuucugcagu

SEQ ID NO: 2164439 - RNA, 14 nt, Streptococcus pneumoniae R6
uuuucuuuuucaga

SEQ ID NO: 2164440 - RNA, 17 nt, Streptococcus pneumoniae R6
uuuucuuuuucagaacu

SEQ ID NO: 2164441 - RNA, 15 nt, Streptococcus pneumoniae R6
uuuugagcaauaaua

SEQ ID NO: 2164442 - RNA, 16 nt, Streptococcus pneumoniae R6
uuuugagcaauacuuu

SEQ ID NO: 2164443 - RNA, 20 nt, Streptococcus pneumoniae R6
uuuugagcuaauuuugccag

SEQ ID NO: 2164444 - RNA, 16 nt, Streptococcus pneumoniae R6
uuuugagucaagauaa

SEQ ID NO: 2164445 - RNA, 19 nt, Streptococcus pneumoniae R6
uuuucacauuuucaaaaac

SEQ ID NO: 2164446 - RNA, 17 nt, Streptococcus pneumoniae R6
uuuucaccagaaaguac

SEQ ID NO: 2164447 - RNA, 24 nt, Streptococcus pneumoniae R6
uuuucaaaguccucccaccaaacu

SEQ ID NO: 2164448 - RNA, 17 nt, Streptococcus pneumoniae R6
uuuucaaaguuccgaaa

SEQ ID NO: 2164449 - RNA, 13 nt, Streptococcus pneumoniae R6
uuuucaaaguuuc

SEQ ID NO: 2164450 - RNA, 22 nt, Streptococcus pneumoniae R6
uuuucaaauguauuugaaaggg

SEQ ID NO: 2164451 - RNA, 16 nt, Streptococcus pneumoniae R6
uuuucaaauucuuuag

SEQ ID NO: 2164452 - RNA, 22 nt, Streptococcus pneumoniae R6
uuuucaaauucuuuagaaaacu

SEQ ID NO: 2164453 - RNA, 15 nt, Streptococcus pneumoniae R6
uuuucagaacuuuua

SEQ ID NO: 2164454 - RNA, 20 nt, Streptococcus pneumoniae R6
uuuucaaaacugguccagag

SEQ ID NO: 2164455 - RNA, 22 nt, Streptococcus pneumoniae R6
uuuucaaaacugguccagagau

SEQ ID NO: 2164456 - RNA, 22 nt, Streptococcus pneumoniae R6
uuuucaaaaucagaaaaacgca

SEQ ID NO: 2164457 - RNA, 15 nt, Streptococcus pneumoniae R6
uuuucaaagacuucu

SEQ ID NO: 2164458 - RNA, 12 nt, Streptococcus pneumoniae R6
uuuucaaaauga

SEQ ID NO: 2164459 - RNA, 20 nt, Streptococcus pneumoniae R6
uuuucaaaaugacaauuuuu

SEQ ID NO: 2164460 - RNA, 15 nt, Streptococcus pneumoniae R6
uuuucaaacaauuga

SEQ ID NO: 2164461 - RNA, 21 nt, Streptococcus pneumoniae R6
uuuaccuuaauucguuuguug

SEQ ID NO: 2164462 - RNA, 17 nt, Streptococcus pneumoniae R6
uuuaccuuaauucucuu

SEQ ID NO: 2164463 - RNA, 21 nt, Streptococcus pneumoniae R6
uuuaccuuaauucucuuguug

SEQ ID NO: 2164464 - RNA, 14 nt, Streptococcus pneumoniae R6
uuuaccuucaaguu

SEQ ID NO: 2164465 - RNA, 16 nt, Streptococcus pneumoniae R6
uuuaccugcuacugca

SEQ ID NO: 2164466 - RNA, 23 nt, Streptococcus pneumoniae R6
uuuucauaagccguaaucaugug

SEQ ID NO: 2164467 - RNA, 16 nt, Streptococcus pneumoniae R6
uuuucauaauuuuuuu

SEQ ID NO: 2164468 - RNA, 18 nt, Streptococcus pneumoniae R6
uuuucaguuuuauuuuug

SEQ ID NO: 2164469 - RNA, 22 nt, Streptococcus pneumoniae R6
uuuucaucuaguugaacuuuag

SEQ ID NO: 2164470 - RNA, 13 nt, Streptococcus pneumoniae R6
uuuucauuccaaa

SEQ ID NO: 2164471 - RNA, 13 nt, Streptococcus pneumoniae R6
uuuucauucuacu

SEQ ID NO: 2164472 - RNA, 19 nt, Streptococcus pneumoniae R6
uuuucagcuggcuccuucu

SEQ ID NO: 2164473 - RNA, 14 nt, Streptococcus pneumoniae R6
uuuucagcagaguu

SEQ ID NO: 2164474 - RNA, 18 nt, Streptococcus pneumoniae R6
uuuucgaagaguauaaaa

SEQ ID NO: 2164475 - RNA, 20 nt, Streptococcus pneumoniae R6
uuuucgaagaguauaaaauc

SEQ ID NO: 2164476 - RNA, 12 nt, Streptococcus pneumoniae R6
uuuuccuugacc

SEQ ID NO: 2164477 - RNA, 15 nt, Streptococcus pneumoniae R6
uuuuccuugaccuua

SEQ ID NO: 2164478 - RNA, 20 nt, Streptococcus pneumoniae R6
uuuuccuugaccuuaucagu

SEQ ID NO: 2164479 - RNA, 11 nt, Streptococcus pneumoniae R6
uuuuccuugcu

SEQ ID NO: 2164480 - RNA, 15 nt, Streptococcus pneumoniae R6
uuuuccuucauuucc

SEQ ID NO: 2164481 - RNA, 20 nt, Streptococcus pneumoniae R6
uuuuccuaaucaauuuguuc

SEQ ID NO: 2164482 - RNA, 15 nt, Streptococcus pneumoniae R6
uuuuccuaauucuuu

SEQ ID NO: 2164483 - RNA, 13 nt, Streptococcus pneumoniae R6
uuuuccuagaaua

SEQ ID NO: 2164484 - RNA, 18 nt, Streptococcus pneumoniae R6
uuuuccuagauuacaaaa

SEQ ID NO: 2164485 - RNA, 21 nt, Streptococcus pneumoniae R6
uuuuccgauaaugcuuugaac

SEQ ID NO: 2164486 - RNA, 20 nt, Streptococcus pneumoniae R6
ucugaugaaccuucaucaaa

SEQ ID NO: 2164487 - RNA, 20 nt, Streptococcus pneumoniae R6
ucugaugcacuauuuuccaa

SEQ ID NO: 2164488 - RNA, 23 nt, Streptococcus pneumoniae R6
ucugauuuugaaaauuuuuccca

SEQ ID NO: 2164489 - RNA, 12 nt, Streptococcus pneumoniae R6
ucugcaaaccac

SEQ ID NO: 2164490 - RNA, 15 nt, Streptococcus pneumoniae R6
ucugcaaccucaaaa

SEQ ID NO: 2164491 - RNA, 22 nt, Streptococcus pneumoniae R6
ucugcaaccuuaaaacaguguu

SEQ ID NO: 2164492 - RNA, 15 nt, Streptococcus pneumoniae R6
ucugacuucgucagu

SEQ ID NO: 2164493 - RNA, 19 nt, Streptococcus pneumoniae R6
ucugacuucgucaguucua

SEQ ID NO: 2164494 - RNA, 20 nt, Streptococcus pneumoniae R6
ucugacuaucuuguugaaug

SEQ ID NO: 2164495 - RNA, 15 nt, Streptococcus pneumoniae R6
ucugauauuauacgu

SEQ ID NO: 2164496 - RNA, 12 nt, Streptococcus pneumoniae R6
ucucuuucuaaa

SEQ ID NO: 2164497 - RNA, 21 nt, Streptococcus pneumoniae R6
ucucuuuccacacuuguucaa

SEQ ID NO: 2164498 - RNA, 14 nt, Streptococcus pneumoniae R6
ucucuuuucuuauc

SEQ ID NO: 2164499 - RNA, 16 nt, Streptococcus pneumoniae R6
ucucuuuucuuaucug

SEQ ID NO: 2164500 - RNA, 19 nt, Streptococcus pneumoniae R6
ucugaagacaaaucauuuu

SEQ ID NO: 2164501 - RNA, 23 nt, Streptococcus pneumoniae R6
ucugaagacaaaucauuuugacc

SEQ ID NO: 2164502 - RNA, 16 nt, Streptococcus pneumoniae R6
ucucuuuuuucuccaa

SEQ ID NO: 2164503 - RNA, 20 nt, Streptococcus pneumoniae R6
ucucuuuuuugauguucaaa

SEQ ID NO: 2164504 - RNA, 15 nt, Streptococcus pneumoniae R6
ucugaagacuggagu

SEQ ID NO: 2164505 - RNA, 22 nt, Streptococcus pneumoniae R6
ucugaaucugccucaagaagug

SEQ ID NO: 2164506 - RNA, 15 nt, Streptococcus pneumoniae R6
ucugacgagaaauag

SEQ ID NO: 2164507 - RNA, 16 nt, Streptococcus pneumoniae R6
ucugaagucacuacuu

SEQ ID NO: 2164508 - RNA, 22 nt, Streptococcus pneumoniae R6
ucucugaaaacaaguucuuuuc

SEQ ID NO: 2164509 - RNA, 12 nt, Streptococcus pneumoniae R6
ucucucgugauu

SEQ ID NO: 2164510 - RNA, 15 nt, Streptococcus pneumoniae R6
ucucugguuccuuau

SEQ ID NO: 2164511 - RNA, 16 nt, Streptococcus pneumoniae R6
ucucugguuccuuauu

SEQ ID NO: 2164512 - RNA, 20 nt, Streptococcus pneumoniae R6
ucucugguuccuuauucugg

SEQ ID NO: 2164513 - RNA, 15 nt, Streptococcus pneumoniae R6
ucucugcuauuucua

SEQ ID NO: 2164514 - RNA, 17 nt, Streptococcus pneumoniae R6
ucucugcaauuucuaau

SEQ ID NO: 2164515 - RNA, 16 nt, Streptococcus pneumoniae R6
ucucuccuuaucaaaa

SEQ ID NO: 2164516 - RNA, 23 nt, Streptococcus pneumoniae R6
ucucugagaccuuuauuggcugc

SEQ ID NO: 2164517 - RNA, 19 nt, Streptococcus pneumoniae R6
ucucuuaauaucagccaga

SEQ ID NO: 2164518 - RNA, 23 nt, Streptococcus pneumoniae R6
ucucuucaaaccacgucagcuuu

SEQ ID NO: 2164519 - RNA, 22 nt, Streptococcus pneumoniae R6
ucucuucaaaccgcgucagcuu

SEQ ID NO: 2164520 - RNA, 15 nt, Streptococcus pneumoniae R6
ucucuuguuguugua

SEQ ID NO: 2164521 - RNA, 17 nt, Streptococcus pneumoniae R6
ucucuuguuuaagagca

SEQ ID NO: 2164522 - RNA, 13 nt, Streptococcus pneumoniae R6
ucucuuguauucg

SEQ ID NO: 2164523 - RNA, 20 nt, Streptococcus pneumoniae R6
ucucuaucucuuaaaaaagu

SEQ ID NO: 2164524 - RNA, 21 nt, Streptococcus pneumoniae R6
ucucuauaauaacuccgaacu

SEQ ID NO: 2164525 - RNA, 13 nt, Streptococcus pneumoniae R6
ucucuaaauaaau

SEQ ID NO: 2164526 - RNA, 17 nt, Streptococcus pneumoniae R6
ucucuaaaaauaaaaaa

SEQ ID NO: 2164527 - RNA, 16 nt, Streptococcus pneumoniae R6
ucucggacuuuuucca

SEQ ID NO: 2164528 - RNA, 19 nt, Streptococcus pneumoniae R6
ucucggacuuuuuccaaau

SEQ ID NO: 2164529 - RNA, 14 nt, Streptococcus pneumoniae R6
ucuccgaagucaag

SEQ ID NO: 2164530 - RNA, 19 nt, Streptococcus pneumoniae R6
ucuccgaagucaagccucc

SEQ ID NO: 2164531 - RNA, 19 nt, Streptococcus pneumoniae R6
ucucccgcccuuuuuucuc

SEQ ID NO: 2164532 - RNA, 15 nt, Streptococcus pneumoniae R6
ucuccucuaccugcc

SEQ ID NO: 2164533 - RNA, 18 nt, Streptococcus pneumoniae R6
ucuccgcuuuuaucaaag

SEQ ID NO: 2164534 - RNA, 20 nt, Streptococcus pneumoniae R6
ucuccgcuuuuaucaaagac

SEQ ID NO: 2164535 - RNA, 21 nt, Streptococcus pneumoniae R6
ucuccauaggccaagucuuuu

SEQ ID NO: 2164536 - RNA, 20 nt, Streptococcus pneumoniae R6
ucuccaguaacuuuaccaaa

SEQ ID NO: 2164537 - RNA, 20 nt, Streptococcus pneumoniae R6
ucucaucuucacucuucaaa

SEQ ID NO: 2164538 - RNA, 17 nt, Streptococcus pneumoniae R6
ucuacauucccaaacaa

SEQ ID NO: 2164539 - RNA, 16 nt, Streptococcus pneumoniae R6
ucucauucaucaccac

SEQ ID NO: 2164540 - RNA, 20 nt, Streptococcus pneumoniae R6
ucucaugaaaggauuucucu

SEQ ID NO: 2164541 - RNA, 23 nt, Streptococcus pneumoniae R6
ucuggagaagcaccaguugcagu

SEQ ID NO: 2164542 - RNA, 22 nt, Streptococcus pneumoniae R6
ucuggauaagcuugugaaagcu

SEQ ID NO: 2164543 - RNA, 15 nt, Streptococcus pneumoniae R6
ucuggaguagcaucc

SEQ ID NO: 2164544 - RNA, 18 nt, Streptococcus pneumoniae R6
ucuggaggcuuuuucuca

SEQ ID NO: 2164545 - RNA, 15 nt, Streptococcus pneumoniae R6
ucuggagauuucuua

SEQ ID NO: 2164546 - RNA, 16 nt, Streptococcus pneumoniae R6
ucuggagauuuuucaa

SEQ ID NO: 2164547 - RNA, 15 nt, Streptococcus pneumoniae R6
ucugggaaaaauuuu

SEQ ID NO: 2164548 - RNA, 14 nt, Streptococcus pneumoniae R6
ucuguaagcaaagu

SEQ ID NO: 2164549 - RNA, 18 nt, Streptococcus pneumoniae R6
ucuguaagucauuuucuu

SEQ ID NO: 2164550 - RNA, 21 nt, Streptococcus pneumoniae R6
ucuguaaaaucaggaagguca

SEQ ID NO: 2164551 - RNA, 12 nt, Streptococcus pneumoniae R6
ucuguaaucuua

SEQ ID NO: 2164552 - RNA, 15 nt, Streptococcus pneumoniae R6
ucuguaauaugaaca

SEQ ID NO: 2164553 - RNA, 13 nt, Streptococcus pneumoniae R6
ucugucaaaccau

SEQ ID NO: 2164554 - RNA, 18 nt, Streptococcus pneumoniae R6
ucuguaccgaccuugucu

SEQ ID NO: 2164555 - RNA, 16 nt, Streptococcus pneumoniae R6
ucuguguguuuaugcu

SEQ ID NO: 2164556 - RNA, 15 nt, Streptococcus pneumoniae R6
ucugucuaacuuuug

SEQ ID NO: 2164557 - RNA, 22 nt, Streptococcus pneumoniae R6
ucugucgcaaggaugccagccu

SEQ ID NO: 2164558 - RNA, 23 nt, Streptococcus pneumoniae R6
ucugucacuugaccuguuuucac

SEQ ID NO: 2164559 - RNA, 14 nt, Streptococcus pneumoniae R6
ucugucaugcgaua

SEQ ID NO: 2164560 - RNA, 15 nt, Streptococcus pneumoniae R6
ucuggaagugaaaaa

SEQ ID NO: 2164561 - RNA, 16 nt, Streptococcus pneumoniae R6
ucugcugcgucugucu

SEQ ID NO: 2164562 - RNA, 14 nt, Streptococcus pneumoniae R6
ucugcucuccaucu

SEQ ID NO: 2164563 - RNA, 16 nt, Streptococcus pneumoniae R6
ucugcucuccaucuug

SEQ ID NO: 2164564 - RNA, 18 nt, Streptococcus pneumoniae R6
ucugcuagacuaacuucu

SEQ ID NO: 2164565 - RNA, 22 nt, Streptococcus pneumoniae R6
ucugcuagacuaacuucuuauu

SEQ ID NO: 2164566 - RNA, 14 nt, Streptococcus pneumoniae R6
ucugcuaauuuuau

SEQ ID NO: 2164567 - RNA, 12 nt, Streptococcus pneumoniae R6
ucugcuccuccg

SEQ ID NO: 2164568 - RNA, 18 nt, Streptococcus pneumoniae R6
ucugcucgcuggagauag

SEQ ID NO: 2164569 - RNA, 18 nt, Streptococcus pneumoniae R6
ucugcuccauaggcagcu

SEQ ID NO: 2164570 - RNA, 18 nt, Streptococcus pneumoniae R6
ucugcuauagucaauuga

SEQ ID NO: 2164571 - RNA, 12 nt, Streptococcus pneumoniae R6
ucuguuaaaaaa

SEQ ID NO: 2164572 - RNA, 21 nt, Streptococcus pneumoniae R6
ucuguuaaaaaauaaucaaaa

SEQ ID NO: 2164573 - RNA, 23 nt, Streptococcus pneumoniae R6
ucuguuaccacaggagcuggauc

SEQ ID NO: 2164574 - RNA, 20 nt, Streptococcus pneumoniae R6
ucuuaccaaccucagaaucc

SEQ ID NO: 2164575 - RNA, 13 nt, Streptococcus pneumoniae R6
ucuuaccacaaac

SEQ ID NO: 2164576 - RNA, 14 nt, Streptococcus pneumoniae R6
ucuuagacuuucuc

SEQ ID NO: 2164577 - RNA, 17 nt, Streptococcus pneumoniae R6
ucuuacuuccuuuuuaa

SEQ ID NO: 2164578 - RNA, 18 nt, Streptococcus pneumoniae R6
ucuuacuuccuuuuuaaa

SEQ ID NO: 2164579 - RNA, 20 nt, Streptococcus pneumoniae R6
ucuuagaaaaucucuucaaa

SEQ ID NO: 2164580 - RNA, 13 nt, Streptococcus pneumoniae R6
ucuuacuuuuaau

SEQ ID NO: 2164581 - RNA, 15 nt, Streptococcus pneumoniae R6
ucuuaucaaaucccu

SEQ ID NO: 2164582 - RNA, 22 nt, Streptococcus pneumoniae R6
ucuuaucaaaucccuagcucau

SEQ ID NO: 2164583 - RNA, 15 nt, Streptococcus pneumoniae R6
ucuuaucaaucaaac

SEQ ID NO: 2164584 - RNA, 16 nt, Streptococcus pneumoniae R6
ucuuaucacccaaaac

SEQ ID NO: 2164585 - RNA, 15 nt, Streptococcus pneumoniae R6
ucuuagcaauucuaa

SEQ ID NO: 2164586 - RNA, 21 nt, Streptococcus pneumoniae R6
ucuuagugaguuuuacaaugu

SEQ ID NO: 2164587 - RNA, 14 nt, Streptococcus pneumoniae R6
ucuuaucuuuggca

SEQ ID NO: 2164588 - RNA, 13 nt, Streptococcus pneumoniae R6
ucuuauuauucuc

SEQ ID NO: 2164589 - RNA, 17 nt, Streptococcus pneumoniae R6
ucuuauccuugucaugc

SEQ ID NO: 2164590 - RNA, 13 nt, Streptococcus pneumoniae R6
ucuuaucuaaaac

SEQ ID NO: 2164591 - RNA, 18 nt, Streptococcus pneumoniae R6
ucuucaagagcuuuaaua

SEQ ID NO: 2164592 - RNA, 18 nt, Streptococcus pneumoniae R6
ucuucaauaccaaagaag

SEQ ID NO: 2164593 - RNA, 21 nt, Streptococcus pneumoniae R6
ucuucaauaccaaagaaguca

SEQ ID NO: 2164594 - RNA, 14 nt, Streptococcus pneumoniae R6
ucuucaacccacua

SEQ ID NO: 2164595 - RNA, 23 nt, Streptococcus pneumoniae R6
ucuucaacccacuacaguugaca

SEQ ID NO: 2164596 - RNA, 13 nt, Streptococcus pneumoniae R6
ucuucaaauuuuu

SEQ ID NO: 2164597 - RNA, 15 nt, Streptococcus pneumoniae R6
ucuucaaauuuuuca

SEQ ID NO: 2164598 - RNA, 16 nt, Streptococcus pneumoniae R6
ucuucaaauuuuucau

SEQ ID NO: 2164599 - RNA, 22 nt, Streptococcus pneumoniae R6
ucuucaaauuuuucauaauuuu

SEQ ID NO: 2164600 - RNA, 20 nt, Streptococcus pneumoniae R6
ucuucaaacuacgucagcuu

SEQ ID NO: 2164601 - RNA, 12 nt, Streptococcus pneumoniae R6
ucuuauuucauu

SEQ ID NO: 2164602 - RNA, 19 nt, Streptococcus pneumoniae R6
ucuuauuucauuuuaauau

SEQ ID NO: 2164603 - RNA, 18 nt, Streptococcus pneumoniae R6
ucuuauuucauuuuacua

SEQ ID NO: 2164604 - RNA, 14 nt, Streptococcus pneumoniae R6
ucuuauuucaauuu

SEQ ID NO: 2164605 - RNA, 14 nt, Streptococcus pneumoniae R6
ucuuauugauuuuu

SEQ ID NO: 2164606 - RNA, 23 nt, Streptococcus pneumoniae R6
ucuucagauucagcuaaaauguu

SEQ ID NO: 2164607 - RNA, 13 nt, Streptococcus pneumoniae R6
ucuucacucuuca

SEQ ID NO: 2164608 - RNA, 17 nt, Streptococcus pneumoniae R6
ucuucagaaauuuucuu

SEQ ID NO: 2164609 - RNA, 19 nt, Streptococcus pneumoniae R6
ucuucaugcuggcagaaac

SEQ ID NO: 2164610 - RNA, 18 nt, Streptococcus pneumoniae R6
ucuucauggacuuuuuug

SEQ ID NO: 2164611 - RNA, 18 nt, Streptococcus pneumoniae R6
ucuucaugauuagaaaua

SEQ ID NO: 2164612 - RNA, 18 nt, Streptococcus pneumoniae R6
ucuucaucuugucuucaa

SEQ ID NO: 2164613 - RNA, 13 nt, Streptococcus pneumoniae R6
ugaaacuaaauuc

SEQ ID NO: 2164614 - RNA, 21 nt, Streptococcus pneumoniae R6
ugaaacuaagcuucaaaaaag

SEQ ID NO: 2164615 - RNA, 21 nt, Streptococcus pneumoniae R6
ugaaacuaauagguacaaaaa

SEQ ID NO: 2164616 - RNA, 22 nt, Streptococcus pneumoniae R6
ugaaacuagaauaggacaucau

SEQ ID NO: 2164617 - RNA, 23 nt, Streptococcus pneumoniae R6
ugaaacuagaauaguacacuucu

SEQ ID NO: 2164618 - RNA, 17 nt, Streptococcus pneumoniae R6
ugaaacugacgaaguca

SEQ ID NO: 2164619 - RNA, 19 nt, Streptococcus pneumoniae R6
ugaaacugacgaagucagc

SEQ ID NO: 2164620 - RNA, 22 nt, Streptococcus pneumoniae R6
ugaaacugacgaagucagcuca

SEQ ID NO: 2164621 - RNA, 20 nt, Streptococcus pneumoniae R6
ugaaacugacgaagucagua

SEQ ID NO: 2164622 - RNA, 18 nt, Streptococcus pneumoniae R6
ugaaacuggaauaguaca

SEQ ID NO: 2164623 - RNA, 23 nt, Streptococcus pneumoniae R6
ugaaacuguggaaaauagaaaaa

SEQ ID NO: 2164624 - RNA, 22 nt, Streptococcus pneumoniae R6
ugaaacccuugauuuuuuccua

SEQ ID NO: 2164625 - RNA, 12 nt, Streptococcus pneumoniae R6
ugaaaccccaag

SEQ ID NO: 2164626 - RNA, 22 nt, Streptococcus pneumoniae R6
ugaaaccaguuccuuugucuuu

SEQ ID NO: 2164627 - RNA, 21 nt, Streptococcus pneumoniae R6
ugaaagucuuggaaaauggua

SEQ ID NO: 2164628 - RNA, 17 nt, Streptococcus pneumoniae R6
ugaaagugaaaaaguaa

SEQ ID NO: 2164629 - RNA, 19 nt, Streptococcus pneumoniae R6
ugaaagugaaaaaguaaga

SEQ ID NO: 2164630 - RNA, 19 nt, Streptococcus pneumoniae R6
ugaaauaacucauaauagu

SEQ ID NO: 2164631 - RNA, 16 nt, Streptococcus pneumoniae R6
ugaaauaaaauuugaa

SEQ ID NO: 2164632 - RNA, 16 nt, Streptococcus pneumoniae R6
ugaaaguuuaucucuu

SEQ ID NO: 2164633 - RNA, 19 nt, Streptococcus pneumoniae R6
ugaaagugggcugauuuug

SEQ ID NO: 2164634 - RNA, 21 nt, Streptococcus pneumoniae R6
ugaaagugggcugauuuugaa

SEQ ID NO: 2164635 - RNA, 23 nt, Streptococcus pneumoniae R6
ugaaagugggcugauuuugaaaa

SEQ ID NO: 2164636 - RNA, 21 nt, Streptococcus pneumoniae R6
ugaaaggaaagcauaggggcu

SEQ ID NO: 2164637 - RNA, 22 nt, Streptococcus pneumoniae R6
ugaaaggauuggauccugcauu

SEQ ID NO: 2164638 - RNA, 16 nt, Streptococcus pneumoniae R6
ugaaaggauuucucua

SEQ ID NO: 2164639 - RNA, 14 nt, Streptococcus pneumoniae R6
ugaaacaaauaaau

SEQ ID NO: 2164640 - RNA, 17 nt, Streptococcus pneumoniae R6
ugaaacaaauaaaucau

SEQ ID NO: 2164641 - RNA, 10 nt, Streptococcus pneumoniae R6
ugaaaauuug

SEQ ID NO: 2164642 - RNA, 15 nt, Streptococcus pneumoniae R6
ugaaaauuuuuccca

SEQ ID NO: 2164643 - RNA, 19 nt, Streptococcus pneumoniae R6
ugaaacaaaaacaggacaa

SEQ ID NO: 2164644 - RNA, 19 nt, Streptococcus pneumoniae R6
ugaaaauucacaaaauccu

SEQ ID NO: 2164645 - RNA, 18 nt, Streptococcus pneumoniae R6
ugaaacacugauuucaag

SEQ ID NO: 2164646 - RNA, 24 nt, Streptococcus pneumoniae R6
ugaaaaucaaagagcaaacuagaa

SEQ ID NO: 2164647 - RNA, 17 nt, Streptococcus pneumoniae R6
ugaaaaucaaagaguaa

SEQ ID NO: 2164648 - RNA, 23 nt, Streptococcus pneumoniae R6
ugaaaaucaucugcaucaagaac

SEQ ID NO: 2164649 - RNA, 22 nt, Streptococcus pneumoniae R6
ugaaaaucgcaaguuuuuccca

SEQ ID NO: 2164650 - RNA, 23 nt, Streptococcus pneumoniae R6
ugaaaaugaauuugaaacaauga

SEQ ID NO: 2164651 - RNA, 17 nt, Streptococcus pneumoniae R6
ugaaaauaccaaguuca

SEQ ID NO: 2164652 - RNA, 18 nt, Streptococcus pneumoniae R6
ugaaaauaccaaguucau

SEQ ID NO: 2164653 - RNA, 19 nt, Streptococcus pneumoniae R6
ugaaaauaccaaguucauu

SEQ ID NO: 2164654 - RNA, 16 nt, Streptococcus pneumoniae R6
ugaaaaauauacaaaa

SEQ ID NO: 2164655 - RNA, 19 nt, Streptococcus pneumoniae R6
ugaaaaauauacaaaaaag

SEQ ID NO: 2164656 - RNA, 23 nt, Streptococcus pneumoniae R6
ugaaaacaauauuuuugagccuu

SEQ ID NO: 2164657 - RNA, 11 nt, Streptococcus pneumoniae R6
ugaaaaccaag

SEQ ID NO: 2164658 - RNA, 15 nt, Streptococcus pneumoniae R6
ugaaaaaccaauagc

SEQ ID NO: 2164659 - RNA, 13 nt, Streptococcus pneumoniae R6
ugaaaaagugaga

SEQ ID NO: 2164660 - RNA, 21 nt, Streptococcus pneumoniae R6
ugaaaaagugagauauauuga

SEQ ID NO: 2164661 - RNA, 20 nt, Streptococcus pneumoniae R6
ugaaaaaguuuauauuauaa

SEQ ID NO: 2164662 - RNA, 13 nt, Streptococcus pneumoniae R6
ugaaaaaguaaga

SEQ ID NO: 2164663 - RNA, 16 nt, Streptococcus pneumoniae R6
ugaaaagccacguuca

SEQ ID NO: 2164664 - RNA, 21 nt, Streptococcus pneumoniae R6
ugaaaagaacuccagugaaaa

SEQ ID NO: 2164665 - RNA, 22 nt, Streptococcus pneumoniae R6
ugaaaagaacuccagugaaaac

SEQ ID NO: 2164666 - RNA, 19 nt, Streptococcus pneumoniae R6
ugaaaagacguauucaguc

SEQ ID NO: 2164667 - RNA, 16 nt, Streptococcus pneumoniae R6
ugaaaacugaacaaga

SEQ ID NO: 2164668 - RNA, 20 nt, Streptococcus pneumoniae R6
ugaaaacugaacaagacgaa

SEQ ID NO: 2164669 - RNA, 21 nt, Streptococcus pneumoniae R6
ugaaaacgguaacaaaacuaa

SEQ ID NO: 2164670 - RNA, 23 nt, Streptococcus pneumoniae R6
ugaacgacaugcguuaaaaguua

SEQ ID NO: 2164671 - RNA, 21 nt, Streptococcus pneumoniae R6
ugaaccucuucauucaaagaa

SEQ ID NO: 2164672 - RNA, 16 nt, Streptococcus pneumoniae R6
ugaacaaugaaaaaaa

SEQ ID NO: 2164673 - RNA, 15 nt, Streptococcus pneumoniae R6
ugaacaaauugauaa

SEQ ID NO: 2164674 - RNA, 14 nt, Streptococcus pneumoniae R6
ugaacacaguguac

SEQ ID NO: 2164675 - RNA, 19 nt, Streptococcus pneumoniae R6
ugaacaucucuaucaggaa

SEQ ID NO: 2164676 - RNA, 23 nt, Streptococcus pneumoniae R6
ugaacaucuuuuggacucacuaa

SEQ ID NO: 2164677 - RNA, 12 nt, Streptococcus pneumoniae R6
ugaacaaaauua

SEQ ID NO: 2164678 - RNA, 22 nt, Streptococcus pneumoniae R6
ugaacaaaauuaucaacugaga

SEQ ID NO: 2164679 - RNA, 20 nt, Streptococcus pneumoniae R6
ugaaauugagucuuuuucca

SEQ ID NO: 2164680 - RNA, 20 nt, Streptococcus pneumoniae R6
ugaaauuguucacgauuggg

SEQ ID NO: 2164681 - RNA, 14 nt, Streptococcus pneumoniae R6
ugaaauuuaaaaag

SEQ ID NO: 2164682 - RNA, 17 nt, Streptococcus pneumoniae R6
ugaaauuuaaaaagaaa

SEQ ID NO: 2164683 - RNA, 17 nt, Streptococcus pneumoniae R6
ugaaauuuaucaaccac

SEQ ID NO: 2164684 - RNA, 17 nt, Streptococcus pneumoniae R6
ugaaaugucuauuuucu

SEQ ID NO: 2164685 - RNA, 21 nt, Streptococcus pneumoniae R6
ugaaaucugcucaaucuuauc

SEQ ID NO: 2164686 - RNA, 17 nt, Streptococcus pneumoniae R6
ugaaaucccauaguagu

SEQ ID NO: 2164687 - RNA, 21 nt, Streptococcus pneumoniae R6
ugaaauaauacucaaugaaaa

SEQ ID NO: 2164688 - RNA, 17 nt, Streptococcus pneumoniae R6
ugaaauaagggcaaaga

SEQ ID NO: 2164689 - RNA, 21 nt, Streptococcus pneumoniae R6
ugaaauaagggcaaagaaaag

SEQ ID NO: 2164690 - RNA, 17 nt, Streptococcus pneumoniae R6
ugaaauaauaacaggac

SEQ ID NO: 2164691 - RNA, 19 nt, Streptococcus pneumoniae R6
ugaaauaauaacaggacaa

SEQ ID NO: 2164692 - RNA, 16 nt, Streptococcus pneumoniae R6
ugaaauacuaaaaaaa

SEQ ID NO: 2164693 - RNA, 15 nt, Streptococcus pneumoniae R6
ugaaaucagaaaaaa

SEQ ID NO: 2164694 - RNA, 17 nt, Streptococcus pneumoniae R6
ugaaaucagaaaaaacg

SEQ ID NO: 2164695 - RNA, 18 nt, Streptococcus pneumoniae R6
ugaaauauaauagauuga

SEQ ID NO: 2164696 - RNA, 19 nt, Streptococcus pneumoniae R6
ugaaauaguacgaaacaau

SEQ ID NO: 2164697 - RNA, 12 nt, Streptococcus pneumoniae R6
ucuuguuucucg

SEQ ID NO: 2164698 - RNA, 16 nt, Streptococcus pneumoniae R6
ucuuuaacuacuugau

SEQ ID NO: 2164699 - RNA, 14 nt, Streptococcus pneumoniae R6
ucuuuaaaaaauuu

SEQ ID NO: 2164700 - RNA, 18 nt, Streptococcus pneumoniae R6
ucuugugcugacauugaa

SEQ ID NO: 2164701 - RNA, 21 nt, Streptococcus pneumoniae R6
ucuugugcugacauugaagag

SEQ ID NO: 2164702 - RNA, 16 nt, Streptococcus pneumoniae R6
ucuuguucuuguuuca

SEQ ID NO: 2164703 - RNA, 23 nt, Streptococcus pneumoniae R6
ucuuguugaaugagcuuccagua

SEQ ID NO: 2164704 - RNA, 22 nt, Streptococcus pneumoniae R6
ucuuguggagacagcaccaacu

SEQ ID NO: 2164705 - RNA, 16 nt, Streptococcus pneumoniae R6
ucuuggucuagcaaga

SEQ ID NO: 2164706 - RNA, 17 nt, Streptococcus pneumoniae R6
ucuuggcgaauauagac

SEQ ID NO: 2164707 - RNA, 13 nt, Streptococcus pneumoniae R6
ucuugcuugcuac

SEQ ID NO: 2164708 - RNA, 15 nt, Streptococcus pneumoniae R6
ucuugcuugcuacaa

SEQ ID NO: 2164709 - RNA, 21 nt, Streptococcus pneumoniae R6
ucuuggauuuuugauucagua

SEQ ID NO: 2164710 - RNA, 15 nt, Streptococcus pneumoniae R6
ucuuggcaaaguuuu

SEQ ID NO: 2164711 - RNA, 21 nt, Streptococcus pneumoniae R6
ucuuggcaaaguuuuugguaa

SEQ ID NO: 2164712 - RNA, 22 nt, Streptococcus pneumoniae R6
ucuugcuuuuuuauauggaaaa

SEQ ID NO: 2164713 - RNA, 18 nt, Streptococcus pneumoniae R6
ucuugcugguuugugaag

SEQ ID NO: 2164714 - RNA, 15 nt, Streptococcus pneumoniae R6
ucuuccauuucuuug

SEQ ID NO: 2164715 - RNA, 13 nt, Streptococcus pneumoniae R6
ucuuccaucuucu

SEQ ID NO: 2164716 - RNA, 15 nt, Streptococcus pneumoniae R6
ucuucccacaauaaa

SEQ ID NO: 2164717 - RNA, 12 nt, Streptococcus pneumoniae R6
ucuuuccuuuua

SEQ ID NO: 2164718 - RNA, 20 nt, Streptococcus pneumoniae R6
ucuuuccuuagauagcgcau

SEQ ID NO: 2164719 - RNA, 14 nt, Streptococcus pneumoniae R6
ucuuuauuagcaua

SEQ ID NO: 2164720 - RNA, 23 nt, Streptococcus pneumoniae R6
ucuuuaucuuugaggaagguuuu

SEQ ID NO: 2164721 - RNA, 17 nt, Streptococcus pneumoniae R6
ucuuucacuucacgaau

SEQ ID NO: 2164722 - RNA, 13 nt, Streptococcus pneumoniae R6
ucuuuaaugucua

SEQ ID NO: 2164723 - RNA, 21 nt, Streptococcus pneumoniae R6
ucuuugacaccgauaauauuu

SEQ ID NO: 2164724 - RNA, 15 nt, Streptococcus pneumoniae R6
ucuuucuuucucacu

SEQ ID NO: 2164725 - RNA, 21 nt, Streptococcus pneumoniae R6
ucuuucuugucguugaaaaag

SEQ ID NO: 2164726 - RNA, 18 nt, Streptococcus pneumoniae R6
ucuuugaaauaaucaaaa

SEQ ID NO: 2164727 - RNA, 19 nt, Streptococcus pneumoniae R6
ucuuugaaauaaucaaaau

SEQ ID NO: 2164728 - RNA, 13 nt, Streptococcus pneumoniae R6
ucuuugaaaucag

SEQ ID NO: 2164729 - RNA, 18 nt, Streptococcus pneumoniae R6
ucuuugaaaucuuguuga

SEQ ID NO: 2164730 - RNA, 21 nt, Streptococcus pneumoniae R6
ucuuugguugcuacaucuucu

SEQ ID NO: 2164731 - RNA, 23 nt, Streptococcus pneumoniae R6
ucuuuggcaccuuuguauggaaa

SEQ ID NO: 2164732 - RNA, 21 nt, Streptococcus pneumoniae R6
ucuuuggacauagccaauaaa

SEQ ID NO: 2164733 - RNA, 17 nt, Streptococcus pneumoniae R6
ucuuugccaguucuuca

SEQ ID NO: 2164734 - RNA, 20 nt, Streptococcus pneumoniae R6
ucuuugcauuucaucuucua

SEQ ID NO: 2164735 - RNA, 15 nt, Streptococcus pneumoniae R6
ucuuugauuuucauu

SEQ ID NO: 2164736 - RNA, 17 nt, Streptococcus pneumoniae R6
ucuuugauuuucauuga

SEQ ID NO: 2164737 - RNA, 19 nt, Streptococcus pneumoniae R6
ucuuuguaaguuucuucuu

SEQ ID NO: 2164738 - RNA, 16 nt, Streptococcus pneumoniae R6
ucuuugucaacuguag

SEQ ID NO: 2164739 - RNA, 20 nt, Streptococcus pneumoniae R6
ucuuuguuaaaugaauauau

SEQ ID NO: 2164740 - RNA, 21 nt, Streptococcus pneumoniae R6
ucuuuguuaaaugaauauauu

SEQ ID NO: 2164741 - RNA, 19 nt, Streptococcus pneumoniae R6
ucuuuguuaagaauaucca

SEQ ID NO: 2164742 - RNA, 22 nt, Streptococcus pneumoniae R6
ucuuuguccuuuagaaagguuu

SEQ ID NO: 2164743 - RNA, 18 nt, Streptococcus pneumoniae R6
ucuuuuacuuacgugagu

SEQ ID NO: 2164744 - RNA, 12 nt, Streptococcus pneumoniae R6
ucuuuuacuucu

SEQ ID NO: 2164745 - RNA, 20 nt, Streptococcus pneumoniae R6
ucuuuuacuucuuugguugc

SEQ ID NO: 2164746 - RNA, 15 nt, Streptococcus pneumoniae R6
ucuuuuacacucaau

SEQ ID NO: 2164747 - RNA, 16 nt, Streptococcus pneumoniae R6
ucuuuucauaaagaga

SEQ ID NO: 2164748 - RNA, 14 nt, Streptococcus pneumoniae R6
ucuuuucaucucuu

SEQ ID NO: 2164749 - RNA, 15 nt, Streptococcus pneumoniae R6
ucuuuucauuccaaa

SEQ ID NO: 2164750 - RNA, 21 nt, Streptococcus pneumoniae R6
ucuuuucauuccaaacgucug

SEQ ID NO: 2164751 - RNA, 19 nt, Streptococcus pneumoniae R6
ucuuuuuuauccucaaaau

SEQ ID NO: 2164752 - RNA, 23 nt, Streptococcus pneumoniae R6
ucuuuuuuauccucaaaauucug

SEQ ID NO: 2164753 - RNA, 19 nt, Streptococcus pneumoniae R6
ucuuuuuugaaguuuucaa

SEQ ID NO: 2164754 - RNA, 14 nt, Streptococcus pneumoniae R6
ucuuuuuugauguu

SEQ ID NO: 2164755 - RNA, 21 nt, Streptococcus pneumoniae R6
ucuuuuuuccgaauaaauaga

SEQ ID NO: 2164756 - RNA, 14 nt, Streptococcus pneumoniae R6
ucuuuuuuagcucu

SEQ ID NO: 2164757 - RNA, 16 nt, Streptococcus pneumoniae R6
ugaaaaaaacugguuc

SEQ ID NO: 2164758 - RNA, 19 nt, Streptococcus pneumoniae R6
ugaaaaaaauuagaaaaag

SEQ ID NO: 2164759 - RNA, 23 nt, Streptococcus pneumoniae R6
ugaaaaaaauuagaaaaaguagu

SEQ ID NO: 2164760 - RNA, 12 nt, Streptococcus pneumoniae R6
ucuuuuuccuaa

SEQ ID NO: 2164761 - RNA, 17 nt, Streptococcus pneumoniae R6
ucuuuuuccuaauaguu

SEQ ID NO: 2164762 - RNA, 23 nt, Streptococcus pneumoniae R6
ucuuuuuccaagaucuuuuuaua

SEQ ID NO: 2164763 - RNA, 15 nt, Streptococcus pneumoniae R6
ucuuuuucaaaggug

SEQ ID NO: 2164764 - RNA, 13 nt, Streptococcus pneumoniae R6
ucuuuuucagaac

SEQ ID NO: 2164765 - RNA, 17 nt, Streptococcus pneumoniae R6
ucuuuuucagaacuuuu

SEQ ID NO: 2164766 - RNA, 15 nt, Streptococcus pneumoniae R6
ucuuuuucaucuuuu

SEQ ID NO: 2164767 - RNA, 17 nt, Streptococcus pneumoniae R6
ucuuuuuauauauaaaa

SEQ ID NO: 2164768 - RNA, 14 nt, Streptococcus pneumoniae R6
ucuuuuuacauaga

SEQ ID NO: 2164769 - RNA, 12 nt, Streptococcus pneumoniae R6
ucuuuuuacuua

SEQ ID NO: 2164770 - RNA, 16 nt, Streptococcus pneumoniae R6
ucuuuuuacuuauaau

SEQ ID NO: 2164771 - RNA, 20 nt, Streptococcus pneumoniae R6
ucuuuuuacuuauaauuaaa

SEQ ID NO: 2164772 - RNA, 17 nt, Streptococcus pneumoniae R6
ucuuuuuaaauaaaucu

SEQ ID NO: 2164773 - RNA, 22 nt, Streptococcus pneumoniae R6
ucuuuuuacaauuguaaaaaga

SEQ ID NO: 2164774 - RNA, 22 nt, Streptococcus pneumoniae R6
ucuuuuuaauuauuuucaaaau

SEQ ID NO: 2164775 - RNA, 16 nt, Streptococcus pneumoniae R6
ucuuuuccaaacauac

SEQ ID NO: 2164776 - RNA, 22 nt, Streptococcus pneumoniae R6
ucuuuucgauaaaaaauaaaca

SEQ ID NO: 2164777 - RNA, 12 nt, Streptococcus pneumoniae R6
ucuuuucuuauc

SEQ ID NO: 2164778 - RNA, 16 nt, Streptococcus pneumoniae R6
ucuuuucuuuuaguga

SEQ ID NO: 2164779 - RNA, 22 nt, Streptococcus pneumoniae R6
ucuuuucucuagcuuuuauaaa

SEQ ID NO: 2164780 - RNA, 17 nt, Streptococcus pneumoniae R6
ucggauggaaauaaucu

SEQ ID NO: 2164781 - RNA, 18 nt, Streptococcus pneumoniae R6
ucgcuggaagucuauuau

SEQ ID NO: 2164782 - RNA, 11 nt, Streptococcus pneumoniae R6
ucgcuggagag

SEQ ID NO: 2164783 - RNA, 20 nt, Streptococcus pneumoniae R6
ucgcuggagagacuugcuca

SEQ ID NO: 2164784 - RNA, 24 nt, Streptococcus pneumoniae R6
ucgcuggagauaggucacagcccc

SEQ ID NO: 2164785 - RNA, 22 nt, Streptococcus pneumoniae R6
ucgcuguuaaagccaucuaaaa

SEQ ID NO: 2164786 - RNA, 18 nt, Streptococcus pneumoniae R6
ucgcuuggaaguuuuccu

SEQ ID NO: 2164787 - RNA, 18 nt, Streptococcus pneumoniae R6
ucgcuuuuuuaaaugcug

SEQ ID NO: 2164788 - RNA, 18 nt, Streptococcus pneumoniae R6
ucgcuuuuuuaguuugca

SEQ ID NO: 2164789 - RNA, 21 nt, Streptococcus pneumoniae R6
ucggagauggguucccuaucu

SEQ ID NO: 2164790 - RNA, 20 nt, Streptococcus pneumoniae R6
ucggcuuuuuuaucuuuccu

SEQ ID NO: 2164791 - RNA, 23 nt, Streptococcus pneumoniae R6
ucgggcaguuccgauguguuggg

SEQ ID NO: 2164792 - RNA, 15 nt, Streptococcus pneumoniae R6
ucgggugucaaauca

SEQ ID NO: 2164793 - RNA, 15 nt, Streptococcus pneumoniae R6
ucggcuguucuuuuu

SEQ ID NO: 2164794 - RNA, 14 nt, Streptococcus pneumoniae R6
ucggcuucaucugg

SEQ ID NO: 2164795 - RNA, 15 nt, Streptococcus pneumoniae R6
ucguaaauaauauua

SEQ ID NO: 2164796 - RNA, 13 nt, Streptococcus pneumoniae R6
ucguaaccuucuu

SEQ ID NO: 2164797 - RNA, 16 nt, Streptococcus pneumoniae R6
ucggucauggauuuua

SEQ ID NO: 2164798 - RNA, 16 nt, Streptococcus pneumoniae R6
ucggucuuguuuuuau

SEQ ID NO: 2164799 - RNA, 14 nt, Streptococcus pneumoniae R6
ucguagucuuucac

SEQ ID NO: 2164800 - RNA, 13 nt, Streptococcus pneumoniae R6
ucguauaccauaa

SEQ ID NO: 2164801 - RNA, 15 nt, Streptococcus pneumoniae R6
ucguauugaaugcuu

SEQ ID NO: 2164802 - RNA, 16 nt, Streptococcus pneumoniae R6
ucguauccuauuucac

SEQ ID NO: 2164803 - RNA, 23 nt, Streptococcus pneumoniae R6
ucguccgaauccguauucuuauu

SEQ ID NO: 2164804 - RNA, 15 nt, Streptococcus pneumoniae R6
ucuaaaaaaaugaua

SEQ ID NO: 2164805 - RNA, 15 nt, Streptococcus pneumoniae R6
ucuaaaaaggcguuc

SEQ ID NO: 2164806 - RNA, 19 nt, Streptococcus pneumoniae R6
ucuaaaaauuuaaaagaua

SEQ ID NO: 2164807 - RNA, 17 nt, Streptococcus pneumoniae R6
ucuaaauaauacuugga

SEQ ID NO: 2164808 - RNA, 14 nt, Streptococcus pneumoniae R6
ucuaaauacaaaaa

SEQ ID NO: 2164809 - RNA, 15 nt, Streptococcus pneumoniae R6
ucuaaauacaaaaau

SEQ ID NO: 2164810 - RNA, 14 nt, Streptococcus pneumoniae R6
ucuaacuuaucagc

SEQ ID NO: 2164811 - RNA, 16 nt, Streptococcus pneumoniae R6
ucuaacuucugcuaau

SEQ ID NO: 2164812 - RNA, 21 nt, Streptococcus pneumoniae R6
ucuaacuguuugggggcagua

SEQ ID NO: 2164813 - RNA, 13 nt, Streptococcus pneumoniae R6
ucuaacugaagcu

SEQ ID NO: 2164814 - RNA, 19 nt, Streptococcus pneumoniae R6
ucuaacuggaaagauaacu

SEQ ID NO: 2164815 - RNA, 15 nt, Streptococcus pneumoniae R6
ucuaagaucugguua

SEQ ID NO: 2164816 - RNA, 14 nt, Streptococcus pneumoniae R6
ucuaacucagcuuc

SEQ ID NO: 2164817 - RNA, 16 nt, Streptococcus pneumoniae R6
ucuaaaucuugcccuu

SEQ ID NO: 2164818 - RNA, 22 nt, Streptococcus pneumoniae R6
ucuaauaauuuuucauuuaaua

SEQ ID NO: 2164819 - RNA, 14 nt, Streptococcus pneumoniae R6
ucuaagucaaauaa

SEQ ID NO: 2164820 - RNA, 15 nt, Streptococcus pneumoniae R6
ucuaagguuucaaaa

SEQ ID NO: 2164821 - RNA, 13 nt, Streptococcus pneumoniae R6
ucuaaguaacuaa

SEQ ID NO: 2164822 - RNA, 17 nt, Streptococcus pneumoniae R6
ucuaagguauauucaaa

SEQ ID NO: 2164823 - RNA, 23 nt, Streptococcus pneumoniae R6
ucuacauacccaugcuuuucuau

SEQ ID NO: 2164824 - RNA, 15 nt, Streptococcus pneumoniae R6
ucuacaaauaagaaa

SEQ ID NO: 2164825 - RNA, 13 nt, Streptococcus pneumoniae R6
ucuacaaauguuu

SEQ ID NO: 2164826 - RNA, 19 nt, Streptococcus pneumoniae R6
ucuacaaccuuaaaacagu

SEQ ID NO: 2164827 - RNA, 13 nt, Streptococcus pneumoniae R6
ucguuaucacugg

SEQ ID NO: 2164828 - RNA, 15 nt, Streptococcus pneumoniae R6
ucgugaguuccuguu

SEQ ID NO: 2164829 - RNA, 17 nt, Streptococcus pneumoniae R6
ucguuaaaagcaaaaac

SEQ ID NO: 2164830 - RNA, 19 nt, Streptococcus pneumoniae R6
ucgugauguuaaaaugagu

SEQ ID NO: 2164831 - RNA, 18 nt, Streptococcus pneumoniae R6
ucguuccaguuuggcaaa

SEQ ID NO: 2164832 - RNA, 15 nt, Streptococcus pneumoniae R6
ucguucaggacaguc

SEQ ID NO: 2164833 - RNA, 16 nt, Streptococcus pneumoniae R6
ucguucaggacaguca

SEQ ID NO: 2164834 - RNA, 19 nt, Streptococcus pneumoniae R6
ucguucaggacagucaaau

SEQ ID NO: 2164835 - RNA, 13 nt, Streptococcus pneumoniae R6
ucguucacccuug

SEQ ID NO: 2164836 - RNA, 22 nt, Streptococcus pneumoniae R6
ucguucacccuugcuuuuucuu

SEQ ID NO: 2164837 - RNA, 11 nt, Streptococcus pneumoniae R6
ucguuccuuua

SEQ ID NO: 2164838 - RNA, 23 nt, Streptococcus pneumoniae R6
ucguuuacaagugaaguaacgau

SEQ ID NO: 2164839 - RNA, 12 nt, Streptococcus pneumoniae R6
ucguuucaagug

SEQ ID NO: 2164840 - RNA, 19 nt, Streptococcus pneumoniae R6
uccuuacuagcaaauuuaa

SEQ ID NO: 2164841 - RNA, 19 nt, Streptococcus pneumoniae R6
uccuuacucaaauaaaaga

SEQ ID NO: 2164842 - RNA, 13 nt, Streptococcus pneumoniae R6
uccuuaccuguuu

SEQ ID NO: 2164843 - RNA, 22 nt, Streptococcus pneumoniae R6
uccuuaugacgaaugauaauca

SEQ ID NO: 2164844 - RNA, 15 nt, Streptococcus pneumoniae R6
uccuuauucugaaag

SEQ ID NO: 2164845 - RNA, 17 nt, Streptococcus pneumoniae R6
uccuuauucugaaagug

SEQ ID NO: 2164846 - RNA, 23 nt, Streptococcus pneumoniae R6
uccuuauucuggaagugaaaaag

SEQ ID NO: 2164847 - RNA, 23 nt, Streptococcus pneumoniae R6
uccuuauugaugauguuuaaaau

SEQ ID NO: 2164848 - RNA, 17 nt, Streptococcus pneumoniae R6
uccuucaugaaauuauu

SEQ ID NO: 2164849 - RNA, 13 nt, Streptococcus pneumoniae R6
uccuucauuucca

SEQ ID NO: 2164850 - RNA, 19 nt, Streptococcus pneumoniae R6
uccuugauaaguucuuuuu

SEQ ID NO: 2164851 - RNA, 19 nt, Streptococcus pneumoniae R6
uccuugaccuuaucaguua

SEQ ID NO: 2164852 - RNA, 14 nt, Streptococcus pneumoniae R6
uccugcucaaaaua

SEQ ID NO: 2164853 - RNA, 21 nt, Streptococcus pneumoniae R6
uccugcauuacacaagaucca

SEQ ID NO: 2164854 - RNA, 13 nt, Streptococcus pneumoniae R6
uccuuaagucugu

SEQ ID NO: 2164855 - RNA, 16 nt, Streptococcus pneumoniae R6
uccugucuauacacga

SEQ ID NO: 2164856 - RNA, 14 nt, Streptococcus pneumoniae R6
uccugucuuauuuc

SEQ ID NO: 2164857 - RNA, 19 nt, Streptococcus pneumoniae R6
uccuguaagaacuuuuuaa

SEQ ID NO: 2164858 - RNA, 15 nt, Streptococcus pneumoniae R6
uccugucauggcuga

SEQ ID NO: 2164859 - RNA, 17 nt, Streptococcus pneumoniae R6
uccuguacccaaguaau

SEQ ID NO: 2164860 - RNA, 14 nt, Streptococcus pneumoniae R6
ucgaaguuucaauc

SEQ ID NO: 2164861 - RNA, 15 nt, Streptococcus pneumoniae R6
ucgaaguuucaaucg

SEQ ID NO: 2164862 - RNA, 22 nt, Streptococcus pneumoniae R6
ucgaccuacauugacucugcug

SEQ ID NO: 2164863 - RNA, 12 nt, Streptococcus pneumoniae R6
ucgacccuggau

SEQ ID NO: 2164864 - RNA, 12 nt, Streptococcus pneumoniae R6
ucgaaaaucucu

SEQ ID NO: 2164865 - RNA, 17 nt, Streptococcus pneumoniae R6
ucgaaaaucucuucaaa

SEQ ID NO: 2164866 - RNA, 17 nt, Streptococcus pneumoniae R6
uccuuuuaguuuuaccu

SEQ ID NO: 2164867 - RNA, 14 nt, Streptococcus pneumoniae R6
uccuuuuauuaucu

SEQ ID NO: 2164868 - RNA, 19 nt, Streptococcus pneumoniae R6
uccuuuuauuaucuuucca

SEQ ID NO: 2164869 - RNA, 17 nt, Streptococcus pneumoniae R6
uccuuuucuacugaaau

SEQ ID NO: 2164870 - RNA, 23 nt, Streptococcus pneumoniae R6
ucgaaaagaauuaggaaaacaug

SEQ ID NO: 2164871 - RNA, 16 nt, Streptococcus pneumoniae R6
ucgaaaaccaaaggca

SEQ ID NO: 2164872 - RNA, 14 nt, Streptococcus pneumoniae R6
uccuuuuuugacuc

SEQ ID NO: 2164873 - RNA, 19 nt, Streptococcus pneumoniae R6
uccuuggucgaucaauugu

SEQ ID NO: 2164874 - RNA, 14 nt, Streptococcus pneumoniae R6
uccuuguaaagacu

SEQ ID NO: 2164875 - RNA, 14 nt, Streptococcus pneumoniae R6
uccuuuacuuguuu

SEQ ID NO: 2164876 - RNA, 21 nt, Streptococcus pneumoniae R6
uccuuuagugauaucuugaag

SEQ ID NO: 2164877 - RNA, 14 nt, Streptococcus pneumoniae R6
uccuuuauuuucaa

SEQ ID NO: 2164878 - RNA, 13 nt, Streptococcus pneumoniae R6
uccuuucaaaaua

SEQ ID NO: 2164879 - RNA, 12 nt, Streptococcus pneumoniae R6
uccuuucuuuuu

SEQ ID NO: 2164880 - RNA, 13 nt, Streptococcus pneumoniae R6
uccuuucuuuuuu

SEQ ID NO: 2164881 - RNA, 15 nt, Streptococcus pneumoniae R6
uccuuugauucagau

SEQ ID NO: 2164882 - RNA, 19 nt, Streptococcus pneumoniae R6
uccuuugcguacaaaacuu

SEQ ID NO: 2164883 - RNA, 22 nt, Streptococcus pneumoniae R6
uccuuuuacaguacccauguuc

SEQ ID NO: 2164884 - RNA, 15 nt, Streptococcus pneumoniae R6
ucgacgcuuucuaag

SEQ ID NO: 2164885 - RNA, 21 nt, Streptococcus pneumoniae R6
ucgagguagaaaggagcagau

SEQ ID NO: 2164886 - RNA, 14 nt, Streptococcus pneumoniae R6
ucgaggaaaucccu

SEQ ID NO: 2164887 - RNA, 13 nt, Streptococcus pneumoniae R6
ucgauaaagaaga

SEQ ID NO: 2164888 - RNA, 14 nt, Streptococcus pneumoniae R6
ucgauaaagaagag

SEQ ID NO: 2164889 - RNA, 21 nt, Streptococcus pneumoniae R6
ucgaguuauuaacaaaagagc

SEQ ID NO: 2164890 - RNA, 18 nt, Streptococcus pneumoniae R6
ucgauaucguuauuagca

SEQ ID NO: 2164891 - RNA, 12 nt, Streptococcus pneumoniae R6
ucgauaaaguag

SEQ ID NO: 2164892 - RNA, 15 nt, Streptococcus pneumoniae R6
ucgauuuaaugauau

SEQ ID NO: 2164893 - RNA, 22 nt, Streptococcus pneumoniae R6
ucgaugaccaugucguuuccuu

SEQ ID NO: 2164894 - RNA, 19 nt, Streptococcus pneumoniae R6
ucgauuuguucauaucuua

SEQ ID NO: 2164895 - RNA, 13 nt, Streptococcus pneumoniae R6
ucgcaagauagaa

SEQ ID NO: 2164896 - RNA, 22 nt, Streptococcus pneumoniae R6
ucgcaacggacguugauuuguc

SEQ ID NO: 2164897 - RNA, 23 nt, Streptococcus pneumoniae R6
ucgcaacugucuuauccaaacua

SEQ ID NO: 2164898 - RNA, 14 nt, Streptococcus pneumoniae R6
ucgcaccucuuuuu

SEQ ID NO: 2164899 - RNA, 19 nt, Streptococcus pneumoniae R6
ucgcagguugcucaaagua

SEQ ID NO: 2164900 - RNA, 17 nt, Streptococcus pneumoniae R6
ucgcauauaagcggcua

SEQ ID NO: 2164901 - RNA, 19 nt, Streptococcus pneumoniae R6
ucgcauaggcaauuucgau

SEQ ID NO: 2164902 - RNA, 15 nt, Streptococcus pneumoniae R6
ucgccaauucuuuca

SEQ ID NO: 2164903 - RNA, 19 nt, Streptococcus pneumoniae R6
ucgccuggagcuucaucag

SEQ ID NO: 2164904 - RNA, 21 nt, Streptococcus pneumoniae R6
ucgccuggagcuucaucaguu

SEQ ID NO: 2164905 - RNA, 18 nt, Streptococcus pneumoniae R6
ugauaagaauaucaagau

SEQ ID NO: 2164906 - RNA, 18 nt, Streptococcus pneumoniae R6
ugauaagauuuuuggaaa

SEQ ID NO: 2164907 - RNA, 23 nt, Streptococcus pneumoniae R6
ugauaagauuuuuggaaaaaaua

SEQ ID NO: 2164908 - RNA, 19 nt, Streptococcus pneumoniae R6
ugauaagaggauuuuaaag

SEQ ID NO: 2164909 - RNA, 20 nt, Streptococcus pneumoniae R6
ugauaagauaaggcaucuua

SEQ ID NO: 2164910 - RNA, 23 nt, Streptococcus pneumoniae R6
ugauaacagcugcgauuuuagca

SEQ ID NO: 2164911 - RNA, 20 nt, Streptococcus pneumoniae R6
ugauaacauugacaucugug

SEQ ID NO: 2164912 - RNA, 15 nt, Streptococcus pneumoniae R6
ugauaaguaaagcuu

SEQ ID NO: 2164913 - RNA, 20 nt, Streptococcus pneumoniae R6
ugauaauacgaccaaucuuu

SEQ ID NO: 2164914 - RNA, 15 nt, Streptococcus pneumoniae R6
ugauaaguucuuuuu

SEQ ID NO: 2164915 - RNA, 21 nt, Streptococcus pneumoniae R6
ugauaaugcguuuagcaucuu

SEQ ID NO: 2164916 - RNA, 17 nt, Streptococcus pneumoniae R6
ugauaccaucuaacuca

SEQ ID NO: 2164917 - RNA, 14 nt, Streptococcus pneumoniae R6
ugauaccuucuuua

SEQ ID NO: 2164918 - RNA, 17 nt, Streptococcus pneumoniae R6
ugauaccuucuuuauca

SEQ ID NO: 2164919 - RNA, 15 nt, Streptococcus pneumoniae R6
ugauacgaaaucaua

SEQ ID NO: 2164920 - RNA, 12 nt, Streptococcus pneumoniae R6
ugagcauacugc

SEQ ID NO: 2164921 - RNA, 19 nt, Streptococcus pneumoniae R6
ugaguauuuuauaguaauu

SEQ ID NO: 2164922 - RNA, 22 nt, Streptococcus pneumoniae R6
ugaguccauaggcugcuagugu

SEQ ID NO: 2164923 - RNA, 18 nt, Streptococcus pneumoniae R6
ugagucagggaaaaaacu

SEQ ID NO: 2164924 - RNA, 15 nt, Streptococcus pneumoniae R6
ugagucuauucccug

SEQ ID NO: 2164925 - RNA, 20 nt, Streptococcus pneumoniae R6
ugaguccgaaaaauuucuca

SEQ ID NO: 2164926 - RNA, 19 nt, Streptococcus pneumoniae R6
ugaguuaccuaaauuauga

SEQ ID NO: 2164927 - RNA, 21 nt, Streptococcus pneumoniae R6
ugaguucaucuggaguagcau

SEQ ID NO: 2164928 - RNA, 18 nt, Streptococcus pneumoniae R6
ugaguucauuaugauuug

SEQ ID NO: 2164929 - RNA, 21 nt, Streptococcus pneumoniae R6
ugaguucucguuuguuuuuuc

SEQ ID NO: 2164930 - RNA, 17 nt, Streptococcus pneumoniae R6
ugaguucuucaacaaug

SEQ ID NO: 2164931 - RNA, 22 nt, Streptococcus pneumoniae R6
ugaguuguuuugucgcuuuuca

SEQ ID NO: 2164932 - RNA, 19 nt, Streptococcus pneumoniae R6
ugauaaaggcagauuucaa

SEQ ID NO: 2164933 - RNA, 21 nt, Streptococcus pneumoniae R6
ugauaaaaggcuuagccaguc

SEQ ID NO: 2164934 - RNA, 17 nt, Streptococcus pneumoniae R6
ugaguuuuuugacuuca

SEQ ID NO: 2164935 - RNA, 14 nt, Streptococcus pneumoniae R6
ugauaaaacauacu

SEQ ID NO: 2164936 - RNA, 13 nt, Streptococcus pneumoniae R6
ugaguuuuuccca

SEQ ID NO: 2164937 - RNA, 15 nt, Streptococcus pneumoniae R6
ugaucaaaaaauuuc

SEQ ID NO: 2164938 - RNA, 20 nt, Streptococcus pneumoniae R6
ugauaugguauuuaaaaccu

SEQ ID NO: 2164939 - RNA, 16 nt, Streptococcus pneumoniae R6
ugauaugggauuuuca

SEQ ID NO: 2164940 - RNA, 20 nt, Streptococcus pneumoniae R6
ugauaugggauuuucauaua

SEQ ID NO: 2164941 - RNA, 17 nt, Streptococcus pneumoniae R6
ugaucaagcguuuuucu

SEQ ID NO: 2164942 - RNA, 18 nt, Streptococcus pneumoniae R6
ugauaggaugcguuuuua

SEQ ID NO: 2164943 - RNA, 19 nt, Streptococcus pneumoniae R6
ugauagugauguuucaagu

SEQ ID NO: 2164944 - RNA, 19 nt, Streptococcus pneumoniae R6
ugauagugguguuucaagu

SEQ ID NO: 2164945 - RNA, 19 nt, Streptococcus pneumoniae R6
ugauacuaugcguuuuauu

SEQ ID NO: 2164946 - RNA, 20 nt, Streptococcus pneumoniae R6
ugauacuaugcguuuuauug

SEQ ID NO: 2164947 - RNA, 16 nt, Streptococcus pneumoniae R6
ugauacugaucaaaaa

SEQ ID NO: 2164948 - RNA, 11 nt, Streptococcus pneumoniae R6
ugauagaguua

SEQ ID NO: 2164949 - RNA, 14 nt, Streptococcus pneumoniae R6
ugauagaguuagag

SEQ ID NO: 2164950 - RNA, 20 nt, Streptococcus pneumoniae R6
ugauagcguucguucauaua

SEQ ID NO: 2164951 - RNA, 17 nt, Streptococcus pneumoniae R6
ugaugaagauugauaaa

SEQ ID NO: 2164952 - RNA, 20 nt, Streptococcus pneumoniae R6
ugaugaacugcuugagcugc

SEQ ID NO: 2164953 - RNA, 12 nt, Streptococcus pneumoniae R6
ugaugaaaaaaa

SEQ ID NO: 2164954 - RNA, 21 nt, Streptococcus pneumoniae R6
ugaugaaaaaaaguuuaaaaa

SEQ ID NO: 2164955 - RNA, 11 nt, Streptococcus pneumoniae R6
ugaucuuccau

SEQ ID NO: 2164956 - RNA, 19 nt, Streptococcus pneumoniae R6
ugaucuuccauuucuuuug

SEQ ID NO: 2164957 - RNA, 21 nt, Streptococcus pneumoniae R6
ugaugagggcgauuuucccuu

SEQ ID NO: 2164958 - RNA, 20 nt, Streptococcus pneumoniae R6
ugaugagguuucgcauuuga

SEQ ID NO: 2164959 - RNA, 13 nt, Streptococcus pneumoniae R6
ugaugauguuuaa

SEQ ID NO: 2164960 - RNA, 18 nt, Streptococcus pneumoniae R6
ugaucuuaaauuuucgag

SEQ ID NO: 2164961 - RNA, 20 nt, Streptococcus pneumoniae R6
ugcaaaacuagaauccuagu

SEQ ID NO: 2164962 - RNA, 16 nt, Streptococcus pneumoniae R6
ugcaaaucucauuuga

SEQ ID NO: 2164963 - RNA, 18 nt, Streptococcus pneumoniae R6
ugauuuuguaaaaauaga

SEQ ID NO: 2164964 - RNA, 23 nt, Streptococcus pneumoniae R6
ugauuuugugcucuuaaacaaga

SEQ ID NO: 2164965 - RNA, 18 nt, Streptococcus pneumoniae R6
ugauuuugagacuaagga

SEQ ID NO: 2164966 - RNA, 17 nt, Streptococcus pneumoniae R6
ugauuuucuuuaaaaaa

SEQ ID NO: 2164967 - RNA, 14 nt, Streptococcus pneumoniae R6
ugauuuauuuguuu

SEQ ID NO: 2164968 - RNA, 23 nt, Streptococcus pneumoniae R6
ugauuucaauuuuaaauuuuucu

SEQ ID NO: 2164969 - RNA, 13 nt, Streptococcus pneumoniae R6
ugauuucaaagaa

SEQ ID NO: 2164970 - RNA, 22 nt, Streptococcus pneumoniae R6
ugauuuucauugaguaugaaau

SEQ ID NO: 2164971 - RNA, 21 nt, Streptococcus pneumoniae R6
ugauuuucauugaguuuuaau

SEQ ID NO: 2164972 - RNA, 15 nt, Streptococcus pneumoniae R6
ugauuuuccugaaua

SEQ ID NO: 2164973 - RNA, 13 nt, Streptococcus pneumoniae R6
ugauuuucaucau

SEQ ID NO: 2164974 - RNA, 15 nt, Streptococcus pneumoniae R6
ugauuuucaucauca

SEQ ID NO: 2164975 - RNA, 16 nt, Streptococcus pneumoniae R6
ugauuuucaucaucac

SEQ ID NO: 2164976 - RNA, 12 nt, Streptococcus pneumoniae R6
ugauuuauagaa

SEQ ID NO: 2164977 - RNA, 22 nt, Streptococcus pneumoniae R6
ugauuuaccauuuucguccaag

SEQ ID NO: 2164978 - RNA, 20 nt, Streptococcus pneumoniae R6
ugauuuagaaccaagaucuu

SEQ ID NO: 2164979 - RNA, 19 nt, Streptococcus pneumoniae R6
ugauuggagauacuuuuuu

SEQ ID NO: 2164980 - RNA, 16 nt, Streptococcus pneumoniae R6
ugauuggugauauugu

SEQ ID NO: 2164981 - RNA, 15 nt, Streptococcus pneumoniae R6
ugauucuuucuaaug

SEQ ID NO: 2164982 - RNA, 19 nt, Streptococcus pneumoniae R6
ugauugacaccacuuuugg

SEQ ID NO: 2164983 - RNA, 23 nt, Streptococcus pneumoniae R6
ugauucaguaacguuagcaaaga

SEQ ID NO: 2164984 - RNA, 13 nt, Streptococcus pneumoniae R6
ugauucaucucca

SEQ ID NO: 2164985 - RNA, 13 nt, Streptococcus pneumoniae R6
ugauucaugacau

SEQ ID NO: 2164986 - RNA, 15 nt, Streptococcus pneumoniae R6
ugauucaugacaucu

SEQ ID NO: 2164987 - RNA, 20 nt, Streptococcus pneumoniae R6
ugauucaugacaucuuccaa

SEQ ID NO: 2164988 - RNA, 23 nt, Streptococcus pneumoniae R6
ugauuacaugaugugaagaacau

SEQ ID NO: 2164989 - RNA, 16 nt, Streptococcus pneumoniae R6
ugauuacauaaauugg

SEQ ID NO: 2164990 - RNA, 20 nt, Streptococcus pneumoniae R6
ugauuaggaaauucaaauga

SEQ ID NO: 2164991 - RNA, 22 nt, Streptococcus pneumoniae R6
ugauuaggaaauucaaaugaau

SEQ ID NO: 2164992 - RNA, 19 nt, Streptococcus pneumoniae R6
ugauuaggagauucuuaua

SEQ ID NO: 2164993 - RNA, 16 nt, Streptococcus pneumoniae R6
ugauuaggauuuuuua

SEQ ID NO: 2164994 - RNA, 23 nt, Streptococcus pneumoniae R6
ugauuagaaauagggauuaauaa

SEQ ID NO: 2164995 - RNA, 23 nt, Streptococcus pneumoniae R6
ugauuaagaagucaucuaucaaa

SEQ ID NO: 2164996 - RNA, 18 nt, Streptococcus pneumoniae R6
ugauuaagugauuuaaau

SEQ ID NO: 2164997 - RNA, 21 nt, Streptococcus pneumoniae R6
ugauuaagugauuuaaauguu

SEQ ID NO: 2164998 - RNA, 20 nt, Streptococcus pneumoniae R6
ugcaccuaaaauucccuuau

SEQ ID NO: 2164999 - RNA, 11 nt, Streptococcus pneumoniae R6
ugcacuaagga

SEQ ID NO: 2165000 - RNA, 22 nt, Streptococcus pneumoniae R6
ugcaauucuuuagcagaugcuu

SEQ ID NO: 2165001 - RNA, 15 nt, Streptococcus pneumoniae R6
ugcaauuuaucaguu

SEQ ID NO: 2165002 - RNA, 20 nt, Streptococcus pneumoniae R6
ugcaauuuaucaguuaucuu

SEQ ID NO: 2165003 - RNA, 18 nt, Streptococcus pneumoniae R6
ugcaauuucuuuauauaa

SEQ ID NO: 2165004 - RNA, 22 nt, Streptococcus pneumoniae R6
ugcaauuucuuuauauaaaaag

SEQ ID NO: 2165005 - RNA, 23 nt, Streptococcus pneumoniae R6
ugcaccaccgauauggccugcua

SEQ ID NO: 2165006 - RNA, 18 nt, Streptococcus pneumoniae R6
ugcaacuuguuuuuccug

SEQ ID NO: 2165007 - RNA, 15 nt, Streptococcus pneumoniae R6
ugcaagaaaguagag

SEQ ID NO: 2165008 - RNA, 18 nt, Streptococcus pneumoniae R6
ugcaagaaaguagagucc

SEQ ID NO: 2165009 - RNA, 17 nt, Streptococcus pneumoniae R6
ugcaauauagugaaauu

SEQ ID NO: 2165010 - RNA, 13 nt, Streptococcus pneumoniae R6
ugcaaucauugca

SEQ ID NO: 2165011 - RNA, 15 nt, Streptococcus pneumoniae R6
ugcaaccucaaaaca

SEQ ID NO: 2165012 - RNA, 19 nt, Streptococcus pneumoniae R6
ugcaaccucaaaacagugu

SEQ ID NO: 2165013 - RNA, 19 nt, Streptococcus pneumoniae R6
ugcaaccucuacaauaaca

SEQ ID NO: 2165014 - RNA, 15 nt, Streptococcus pneumoniae R6
ugcaaccuuaaaaca

SEQ ID NO: 2165015 - RNA, 19 nt, Streptococcus pneumoniae R6
ugcaaccuuaaaacagugu

SEQ ID NO: 2165016 - RNA, 16 nt, Streptococcus pneumoniae R6
ugcaaauuauuuacag

SEQ ID NO: 2165017 - RNA, 18 nt, Streptococcus pneumoniae R6
ugcaaauuuauaaaucuu

SEQ ID NO: 2165018 - RNA, 16 nt, Streptococcus pneumoniae R6
ugcaacaacagcuguc

SEQ ID NO: 2165019 - RNA, 22 nt, Streptococcus pneumoniae R6
ugcaacaacagcugucgcaccu

SEQ ID NO: 2165020 - RNA, 21 nt, Streptococcus pneumoniae R6
ugacuaaaaacucuucuuuug

SEQ ID NO: 2165021 - RNA, 22 nt, Streptococcus pneumoniae R6
ugacucuccuuagucucaaaau

SEQ ID NO: 2165022 - RNA, 20 nt, Streptococcus pneumoniae R6
ugacugacuaaaacuuguga

SEQ ID NO: 2165023 - RNA, 20 nt, Streptococcus pneumoniae R6
ugacuguugucacauagacu

SEQ ID NO: 2165024 - RNA, 20 nt, Streptococcus pneumoniae R6
ugacuguguuugagacuggc

SEQ ID NO: 2165025 - RNA, 17 nt, Streptococcus pneumoniae R6
ugacugauggaaguaau

SEQ ID NO: 2165026 - RNA, 16 nt, Streptococcus pneumoniae R6
ugacuagcaaucaaaa

SEQ ID NO: 2165027 - RNA, 20 nt, Streptococcus pneumoniae R6
ugacuauauuucuauacuuu

SEQ ID NO: 2165028 - RNA, 14 nt, Streptococcus pneumoniae R6
ugacuauauuucuu

SEQ ID NO: 2165029 - RNA, 21 nt, Streptococcus pneumoniae R6
ugacuacauuuuuugaaauaa

SEQ ID NO: 2165030 - RNA, 21 nt, Streptococcus pneumoniae R6
ugagaaacagcuccugaaaua

SEQ ID NO: 2165031 - RNA, 22 nt, Streptococcus pneumoniae R6
ugagaaacagcuccugaaauaa

SEQ ID NO: 2165032 - RNA, 23 nt, Streptococcus pneumoniae R6
ugagaaacagcuccugaaauaag

SEQ ID NO: 2165033 - RNA, 18 nt, Streptococcus pneumoniae R6
ugacuucuguaagucauu

SEQ ID NO: 2165034 - RNA, 21 nt, Streptococcus pneumoniae R6
ugacuucuguaagucauuuuc

SEQ ID NO: 2165035 - RNA, 22 nt, Streptococcus pneumoniae R6
ugacuucuguaagucauuuucu

SEQ ID NO: 2165036 - RNA, 20 nt, Streptococcus pneumoniae R6
ugacuucaacccacuacagu

SEQ ID NO: 2165037 - RNA, 17 nt, Streptococcus pneumoniae R6
ugacuucgucaguucca

SEQ ID NO: 2165038 - RNA, 17 nt, Streptococcus pneumoniae R6
ugacuucgucaguucua

SEQ ID NO: 2165039 - RNA, 18 nt, Streptococcus pneumoniae R6
ugacuucgucaguucuau

SEQ ID NO: 2165040 - RNA, 21 nt, Streptococcus pneumoniae R6
ugacuucgucaguucuaucca

SEQ ID NO: 2165041 - RNA, 20 nt, Streptococcus pneumoniae R6
ugacuucgucaguuucaucc

SEQ ID NO: 2165042 - RNA, 19 nt, Streptococcus pneumoniae R6
ugacuuagccauguuuuuc

SEQ ID NO: 2165043 - RNA, 13 nt, Streptococcus pneumoniae R6
ugacuucagcucc

SEQ ID NO: 2165044 - RNA, 17 nt, Streptococcus pneumoniae R6
ugagaaaguuaaaaaaa

SEQ ID NO: 2165045 - RNA, 15 nt, Streptococcus pneumoniae R6
ugagaaccucuguau

SEQ ID NO: 2165046 - RNA, 22 nt, Streptococcus pneumoniae R6
ugagaccuuuauuggcugccac

SEQ ID NO: 2165047 - RNA, 19 nt, Streptococcus pneumoniae R6
ugagacagcauagaaguuu

SEQ ID NO: 2165048 - RNA, 23 nt, Streptococcus pneumoniae R6
ugagagcauuuuucgaaauuuau

SEQ ID NO: 2165049 - RNA, 20 nt, Streptococcus pneumoniae R6
ugagauaaaacguugguaaa

SEQ ID NO: 2165050 - RNA, 15 nt, Streptococcus pneumoniae R6
ugagacuugcaagaa

SEQ ID NO: 2165051 - RNA, 19 nt, Streptococcus pneumoniae R6
ugagcaaguucaagacuug

SEQ ID NO: 2165052 - RNA, 16 nt, Streptococcus pneumoniae R6
ugagcaauuugacgaa

SEQ ID NO: 2165053 - RNA, 17 nt, Streptococcus pneumoniae R6
ugagcaaccugcggcua

SEQ ID NO: 2165054 - RNA, 16 nt, Streptococcus pneumoniae R6
ugagauaaucugcaaa

SEQ ID NO: 2165055 - RNA, 15 nt, Streptococcus pneumoniae R6
ugaccaaagcaucaa

SEQ ID NO: 2165056 - RNA, 19 nt, Streptococcus pneumoniae R6
ugacauggaaauuauaaaa

SEQ ID NO: 2165057 - RNA, 23 nt, Streptococcus pneumoniae R6
ugacaugaugugaagagauuuuc

SEQ ID NO: 2165058 - RNA, 17 nt, Streptococcus pneumoniae R6
ugacaugcuccucugua

SEQ ID NO: 2165059 - RNA, 18 nt, Streptococcus pneumoniae R6
ugacaugcuccucuguau

SEQ ID NO: 2165060 - RNA, 22 nt, Streptococcus pneumoniae R6
ugacauuauuuucuuagcaauu

SEQ ID NO: 2165061 - RNA, 15 nt, Streptococcus pneumoniae R6
ugacauucuuuagcu

SEQ ID NO: 2165062 - RNA, 21 nt, Streptococcus pneumoniae R6
ugacaauuuaaccaaaccaac

SEQ ID NO: 2165063 - RNA, 21 nt, Streptococcus pneumoniae R6
ugacaauuaagguuuuaccuu

SEQ ID NO: 2165064 - RNA, 17 nt, Streptococcus pneumoniae R6
ugacaaucuuuucuuua

SEQ ID NO: 2165065 - RNA, 19 nt, Streptococcus pneumoniae R6
ugacaaucuuuucuuuauc

SEQ ID NO: 2165066 - RNA, 14 nt, Streptococcus pneumoniae R6
ugacaaucuuuuua

SEQ ID NO: 2165067 - RNA, 15 nt, Streptococcus pneumoniae R6
ugacaauguaccugc

SEQ ID NO: 2165068 - RNA, 15 nt, Streptococcus pneumoniae R6
ugaccuguuuucaca

SEQ ID NO: 2165069 - RNA, 17 nt, Streptococcus pneumoniae R6
ugaccuguuuucacauu

SEQ ID NO: 2165070 - RNA, 21 nt, Streptococcus pneumoniae R6
ugaccuguuuucacauuuuca

SEQ ID NO: 2165071 - RNA, 21 nt, Streptococcus pneumoniae R6
ugacgaaacgaagaaggaaga

SEQ ID NO: 2165072 - RNA, 20 nt, Streptococcus pneumoniae R6
ugacgaacggguucuuccaa

SEQ ID NO: 2165073 - RNA, 16 nt, Streptococcus pneumoniae R6
ugacgaagaaaccaag

SEQ ID NO: 2165074 - RNA, 17 nt, Streptococcus pneumoniae R6
ugacgaagaaaccaagc

SEQ ID NO: 2165075 - RNA, 17 nt, Streptococcus pneumoniae R6
ugacgggcaaauuucau

SEQ ID NO: 2165076 - RNA, 15 nt, Streptococcus pneumoniae R6
ugacgauuuucucuu

SEQ ID NO: 2165077 - RNA, 15 nt, Streptococcus pneumoniae R6
ugaacugcugccgca

SEQ ID NO: 2165078 - RNA, 16 nt, Streptococcus pneumoniae R6
ugaacugcauuuuuuc

SEQ ID NO: 2165079 - RNA, 15 nt, Streptococcus pneumoniae R6
ugaacuauuuuauuu

SEQ ID NO: 2165080 - RNA, 17 nt, Streptococcus pneumoniae R6
ugaacggagauaguacc

SEQ ID NO: 2165081 - RNA, 19 nt, Streptococcus pneumoniae R6
ugaacggagauaguaccau

SEQ ID NO: 2165082 - RNA, 23 nt, Streptococcus pneumoniae R6
ugaacuuuuucuaacaucuuuug

SEQ ID NO: 2165083 - RNA, 16 nt, Streptococcus pneumoniae R6
ugaagaaaagcuaagc

SEQ ID NO: 2165084 - RNA, 18 nt, Streptococcus pneumoniae R6
ugaagaaagcaauuuuaa

SEQ ID NO: 2165085 - RNA, 23 nt, Streptococcus pneumoniae R6
ugaagaaagcgaagaucuagaaa

SEQ ID NO: 2165086 - RNA, 19 nt, Streptococcus pneumoniae R6
ugaagacaucauauaaaua

SEQ ID NO: 2165087 - RNA, 23 nt, Streptococcus pneumoniae R6
ugaagaccacgaugaugauugga

SEQ ID NO: 2165088 - RNA, 16 nt, Streptococcus pneumoniae R6
ugaagaguauaagucu

SEQ ID NO: 2165089 - RNA, 14 nt, Streptococcus pneumoniae R6
ugaaggaggagcuu

SEQ ID NO: 2165090 - RNA, 17 nt, Streptococcus pneumoniae R6
ugaaggaacuaacucau

SEQ ID NO: 2165091 - RNA, 18 nt, Streptococcus pneumoniae R6
ugaagcuuuauugucucu

SEQ ID NO: 2165092 - RNA, 22 nt, Streptococcus pneumoniae R6
ugaaggaucauggauuuuucuu

SEQ ID NO: 2165093 - RNA, 15 nt, Streptococcus pneumoniae R6
ugaaggucuucuuga

SEQ ID NO: 2165094 - RNA, 17 nt, Streptococcus pneumoniae R6
ugaaggucuuuugucuu

SEQ ID NO: 2165095 - RNA, 14 nt, Streptococcus pneumoniae R6
ugaaguaaauauuu

SEQ ID NO: 2165096 - RNA, 19 nt, Streptococcus pneumoniae R6
ugaaguaacgauagcacca

SEQ ID NO: 2165097 - RNA, 21 nt, Streptococcus pneumoniae R6
ugaagccuucuccuaggauuu

SEQ ID NO: 2165098 - RNA, 15 nt, Streptococcus pneumoniae R6
ugaagauugauaaag

SEQ ID NO: 2165099 - RNA, 18 nt, Streptococcus pneumoniae R6
ugaagauugauaaaggca

SEQ ID NO: 2165100 - RNA, 23 nt, Streptococcus pneumoniae R6
ugaagauaguaaaggacaccagc

SEQ ID NO: 2165101 - RNA, 21 nt, Streptococcus pneumoniae R6
ugaagcaaaucaacuggcauc

SEQ ID NO: 2165102 - RNA, 21 nt, Streptococcus pneumoniae R6
ugaaugcucccuucuuuagcc

SEQ ID NO: 2165103 - RNA, 21 nt, Streptococcus pneumoniae R6
ugaaucauaggcauaguacca

SEQ ID NO: 2165104 - RNA, 14 nt, Streptococcus pneumoniae R6
ugaaucaaaauuau

SEQ ID NO: 2165105 - RNA, 13 nt, Streptococcus pneumoniae R6
ugaaucaauucuu

SEQ ID NO: 2165106 - RNA, 15 nt, Streptococcus pneumoniae R6
ugaaucauuuccuuc

SEQ ID NO: 2165107 - RNA, 13 nt, Streptococcus pneumoniae R6
ugaaucauuuugu

SEQ ID NO: 2165108 - RNA, 22 nt, Streptococcus pneumoniae R6
ugacaauccacggcucaugaga

SEQ ID NO: 2165109 - RNA, 18 nt, Streptococcus pneumoniae R6
ugaauuuucuaauugauu

SEQ ID NO: 2165110 - RNA, 13 nt, Streptococcus pneumoniae R6
ugaauuucuacaa

SEQ ID NO: 2165111 - RNA, 14 nt, Streptococcus pneumoniae R6
ugaauuugaaacaa

SEQ ID NO: 2165112 - RNA, 18 nt, Streptococcus pneumoniae R6
ugaauuugaaacaaugaa

SEQ ID NO: 2165113 - RNA, 20 nt, Streptococcus pneumoniae R6
ugaauuugaaacaaugaaaa

SEQ ID NO: 2165114 - RNA, 21 nt, Streptococcus pneumoniae R6
ugaauuagcaaucacucuaac

SEQ ID NO: 2165115 - RNA, 16 nt, Streptococcus pneumoniae R6
ugaauuacaugaaacu

SEQ ID NO: 2165116 - RNA, 12 nt, Streptococcus pneumoniae R6
ugaaguuuucaa

SEQ ID NO: 2165117 - RNA, 16 nt, Streptococcus pneumoniae R6
ugaaguuuucuagacg

SEQ ID NO: 2165118 - RNA, 15 nt, Streptococcus pneumoniae R6
ugaaguuuauuucgu

SEQ ID NO: 2165119 - RNA, 20 nt, Streptococcus pneumoniae R6
ugaaguuagguuuuguuucu

SEQ ID NO: 2165120 - RNA, 21 nt, Streptococcus pneumoniae R6
ugaaguuagguuuuguuucuu

SEQ ID NO: 2165121 - RNA, 18 nt, Streptococcus pneumoniae R6
ugaaguguuuuuucauag

SEQ ID NO: 2165122 - RNA, 23 nt, Streptococcus pneumoniae R6
ugaaguuaaguuuuuugacuucu

SEQ ID NO: 2165123 - RNA, 17 nt, Streptococcus pneumoniae R6
ugaaguugaaagauuau

SEQ ID NO: 2165124 - RNA, 18 nt, Streptococcus pneumoniae R6
ugaaguucacguaaauug

SEQ ID NO: 2165125 - RNA, 14 nt, Streptococcus pneumoniae R6
ugaaguucauuuuc

SEQ ID NO: 2165126 - RNA, 15 nt, Streptococcus pneumoniae R6
ugaagucagcuaagc

SEQ ID NO: 2165127 - RNA, 19 nt, Streptococcus pneumoniae R6
ugaagucuagcaauucuug

SEQ ID NO: 2165128 - RNA, 19 nt, Streptococcus pneumoniae R6
ugaagucgaguuuuuuccc

SEQ ID NO: 2165129 - RNA, 21 nt, Streptococcus pneumoniae R6
ugaagucguguuuuuucacau

SEQ ID NO: 2165130 - RNA, 14 nt, Streptococcus pneumoniae R6
ugaauauuuuucuu

SEQ ID NO: 2165131 - RNA, 16 nt, Streptococcus pneumoniae R6
ugaauagugaagauac

SEQ ID NO: 2165132 - RNA, 21 nt, Streptococcus pneumoniae R6
ugaauaggugguuggaaguag

SEQ ID NO: 2165133 - RNA, 13 nt, Streptococcus pneumoniae R6
ugaauaguaaguu

SEQ ID NO: 2165134 - RNA, 16 nt, Streptococcus pneumoniae R6
ugaauaguaaguuaaa

SEQ ID NO: 2165135 - RNA, 12 nt, Streptococcus pneumoniae R6
ugaauagcucaa

SEQ ID NO: 2165136 - RNA, 19 nt, Streptococcus pneumoniae R6
ugaauaggcauaauacugu

SEQ ID NO: 2165137 - RNA, 15 nt, Streptococcus pneumoniae R6
ugcucuuugauuuuc

SEQ ID NO: 2165138 - RNA, 17 nt, Streptococcus pneumoniae R6
ugcucuuugauuuucau

SEQ ID NO: 2165139 - RNA, 20 nt, Streptococcus pneumoniae R6
ugcugaaaugguguauuauc

SEQ ID NO: 2165140 - RNA, 19 nt, Streptococcus pneumoniae R6
ugcugacgugguuugaaga

SEQ ID NO: 2165141 - RNA, 15 nt, Streptococcus pneumoniae R6
ugcucgguaaaacau

SEQ ID NO: 2165142 - RNA, 13 nt, Streptococcus pneumoniae R6
ugcucgaccaagc

SEQ ID NO: 2165143 - RNA, 15 nt, Streptococcus pneumoniae R6
ugcuccaagucagca

SEQ ID NO: 2165144 - RNA, 16 nt, Streptococcus pneumoniae R6
ugcuccgcggugcaau

SEQ ID NO: 2165145 - RNA, 23 nt, Streptococcus pneumoniae R6
ugcuccgcggugcaauuuuuuau

SEQ ID NO: 2165146 - RNA, 13 nt, Streptococcus pneumoniae R6
ugcguuggaauaa

SEQ ID NO: 2165147 - RNA, 19 nt, Streptococcus pneumoniae R6
ugcguuucagcauauuucc

SEQ ID NO: 2165148 - RNA, 22 nt, Streptococcus pneumoniae R6
ugcguuucagcauauuucccau

SEQ ID NO: 2165149 - RNA, 18 nt, Streptococcus pneumoniae R6
ugcucaaucaauccaaag

SEQ ID NO: 2165150 - RNA, 14 nt, Streptococcus pneumoniae R6
ugcucaauaaccac

SEQ ID NO: 2165151 - RNA, 19 nt, Streptococcus pneumoniae R6
ugcucaaucuuaucaauca

SEQ ID NO: 2165152 - RNA, 20 nt, Streptococcus pneumoniae R6
ugcucacagaguagaaguug

SEQ ID NO: 2165153 - RNA, 22 nt, Streptococcus pneumoniae R6
ugcugguuugugaagcacggau

SEQ ID NO: 2165154 - RNA, 14 nt, Streptococcus pneumoniae R6
ugcuuagaaacucu

SEQ ID NO: 2165155 - RNA, 18 nt, Streptococcus pneumoniae R6
ugcuuagaaccgaaaauc

SEQ ID NO: 2165156 - RNA, 13 nt, Streptococcus pneumoniae R6
ugcuuacugcugc

SEQ ID NO: 2165157 - RNA, 15 nt, Streptococcus pneumoniae R6
ugcuucacuagucau

SEQ ID NO: 2165158 - RNA, 16 nt, Streptococcus pneumoniae R6
ugcuucaacucuauuu

SEQ ID NO: 2165159 - RNA, 12 nt, Streptococcus pneumoniae R6
ugcuuauaaaaa

SEQ ID NO: 2165160 - RNA, 19 nt, Streptococcus pneumoniae R6
ugcuuauuucacauuuuca

SEQ ID NO: 2165161 - RNA, 16 nt, Streptococcus pneumoniae R6
ugcuuugugucaucag

SEQ ID NO: 2165162 - RNA, 24 nt, Streptococcus pneumoniae R6
ugcuuuucguacauaguuucauaa

SEQ ID NO: 2165163 - RNA, 22 nt, Streptococcus pneumoniae R6
uggaaaaaagucuuuaaaaucu

SEQ ID NO: 2165164 - RNA, 17 nt, Streptococcus pneumoniae R6
uggaaaaaauaaaaaaa

SEQ ID NO: 2165165 - RNA, 14 nt, Streptococcus pneumoniae R6
uggaaaaaccuuca

SEQ ID NO: 2165166 - RNA, 21 nt, Streptococcus pneumoniae R6
uggaaaaacguggacugguuu

SEQ ID NO: 2165167 - RNA, 14 nt, Streptococcus pneumoniae R6
ugcuuuuagcuucu

SEQ ID NO: 2165168 - RNA, 20 nt, Streptococcus pneumoniae R6
ugcuuuacuaguucucaaau

SEQ ID NO: 2165169 - RNA, 17 nt, Streptococcus pneumoniae R6
ugcuuuagaaacuauga

SEQ ID NO: 2165170 - RNA, 22 nt, Streptococcus pneumoniae R6
ugcuuuaguaccagcucguucu

SEQ ID NO: 2165171 - RNA, 20 nt, Streptococcus pneumoniae R6
ugcuuucaauuguuuauaaa

SEQ ID NO: 2165172 - RNA, 19 nt, Streptococcus pneumoniae R6
ugccuuccuugucuaucca

SEQ ID NO: 2165173 - RNA, 19 nt, Streptococcus pneumoniae R6
ugccuugaccaaucaaucg

SEQ ID NO: 2165174 - RNA, 16 nt, Streptococcus pneumoniae R6
ugcgucugcuccuccg

SEQ ID NO: 2165175 - RNA, 14 nt, Streptococcus pneumoniae R6
ugcgucuucuacaa

SEQ ID NO: 2165176 - RNA, 16 nt, Streptococcus pneumoniae R6
ugcgucugucuugacu

SEQ ID NO: 2165177 - RNA, 16 nt, Streptococcus pneumoniae R6
ugcgcgugguccagau

SEQ ID NO: 2165178 - RNA, 15 nt, Streptococcus pneumoniae R6
ugcggaccaaauccc

SEQ ID NO: 2165179 - RNA, 15 nt, Streptococcus pneumoniae R6
ugcggauaaaagaga

SEQ ID NO: 2165180 - RNA, 12 nt, Streptococcus pneumoniae R6
ugcggauaaacc

SEQ ID NO: 2165181 - RNA, 22 nt, Streptococcus pneumoniae R6
ugcaucugcguuaacuucaaga

SEQ ID NO: 2165182 - RNA, 23 nt, Streptococcus pneumoniae R6
ugcaucugcguuaacuucaagaa

SEQ ID NO: 2165183 - RNA, 19 nt, Streptococcus pneumoniae R6
ugcauuauccauaauaaua

SEQ ID NO: 2165184 - RNA, 21 nt, Streptococcus pneumoniae R6
ugcauguaucacaguaaguac

SEQ ID NO: 2165185 - RNA, 22 nt, Streptococcus pneumoniae R6
ugcaucuuuguaaguuucuucu

SEQ ID NO: 2165186 - RNA, 23 nt, Streptococcus pneumoniae R6
ugcacuauuuuccaaaaaucucu

SEQ ID NO: 2165187 - RNA, 15 nt, Streptococcus pneumoniae R6
ugcagucuuuuugcu

SEQ ID NO: 2165188 - RNA, 22 nt, Streptococcus pneumoniae R6
ugcaguuucucuacuaacucaa

SEQ ID NO: 2165189 - RNA, 20 nt, Streptococcus pneumoniae R6
ugcaguuuucauucuacuau

SEQ ID NO: 2165190 - RNA, 14 nt, Streptococcus pneumoniae R6
ugcauaauuuccau

SEQ ID NO: 2165191 - RNA, 18 nt, Streptococcus pneumoniae R6
ugcauaauuuccauacca

SEQ ID NO: 2165192 - RNA, 12 nt, Streptococcus pneumoniae R6
ugcaucagaugg

SEQ ID NO: 2165193 - RNA, 23 nt, Streptococcus pneumoniae R6
ugcaucagaugggucaagauuuc

SEQ ID NO: 2165194 - RNA, 14 nt, Streptococcus pneumoniae R6
ugcaucaacuauuc

SEQ ID NO: 2165195 - RNA, 16 nt, Streptococcus pneumoniae R6
ugcaucaacuauucuu

SEQ ID NO: 2165196 - RNA, 12 nt, Streptococcus pneumoniae R6
ugcauuucugga

SEQ ID NO: 2165197 - RNA, 19 nt, Streptococcus pneumoniae R6
ugcauuuuaauuucaaugu

SEQ ID NO: 2165198 - RNA, 16 nt, Streptococcus pneumoniae R6
ugcauuuagauaguac

SEQ ID NO: 2165199 - RNA, 21 nt, Streptococcus pneumoniae R6
ugcauuuagauaguaccaagu

SEQ ID NO: 2165200 - RNA, 14 nt, Streptococcus pneumoniae R6
ugccaugcugacga

SEQ ID NO: 2165201 - RNA, 15 nt, Streptococcus pneumoniae R6
ugccaugcugacgau

SEQ ID NO: 2165202 - RNA, 19 nt, Streptococcus pneumoniae R6
ugccaugagcgucuuucuu

SEQ ID NO: 2165203 - RNA, 20 nt, Streptococcus pneumoniae R6
ugccaugagcgucuuucuua

SEQ ID NO: 2165204 - RNA, 22 nt, Streptococcus pneumoniae R6
ugccaugagcgucuuucuuauc

SEQ ID NO: 2165205 - RNA, 20 nt, Streptococcus pneumoniae R6
ugccaucuagacuaggguuu

SEQ ID NO: 2165206 - RNA, 15 nt, Streptococcus pneumoniae R6
ugccagauuccugaa

SEQ ID NO: 2165207 - RNA, 21 nt, Streptococcus pneumoniae R6
ugcccugaaaucccauaguag

SEQ ID NO: 2165208 - RNA, 14 nt, Streptococcus pneumoniae R6
ugccauugguguuu

SEQ ID NO: 2165209 - RNA, 18 nt, Streptococcus pneumoniae R6
ugccauugguguuugguu

SEQ ID NO: 2165210 - RNA, 16 nt, Streptococcus pneumoniae R6
ugccauuaauuccuga

SEQ ID NO: 2165211 - RNA, 17 nt, Streptococcus pneumoniae R6
ugccaugguuucaucuu

SEQ ID NO: 2165212 - RNA, 22 nt, Streptococcus pneumoniae R6
ugccccccaaaaguuagacaaa

SEQ ID NO: 2165213 - RNA, 14 nt, Streptococcus pneumoniae R6
ugccuaauuuuuca

SEQ ID NO: 2165214 - RNA, 14 nt, Streptococcus pneumoniae R6
uuacaucuguuuua

SEQ ID NO: 2165215 - RNA, 20 nt, Streptococcus pneumoniae R6
uuacaugcgcaaaauaauuu

SEQ ID NO: 2165216 - RNA, 17 nt, Streptococcus pneumoniae R6
uuacaugcguuucagca

SEQ ID NO: 2165217 - RNA, 20 nt, Streptococcus pneumoniae R6
uuaccaagguuguuuaacuu

SEQ ID NO: 2165218 - RNA, 19 nt, Streptococcus pneumoniae R6
uuaccaaguccaagccuua

SEQ ID NO: 2165219 - RNA, 16 nt, Streptococcus pneumoniae R6
uuaccaaguuaaacaa

SEQ ID NO: 2165220 - RNA, 20 nt, Streptococcus pneumoniae R6
uuacagaguacuaaauauaa

SEQ ID NO: 2165221 - RNA, 16 nt, Streptococcus pneumoniae R6
uuacauaauuuaaaau

SEQ ID NO: 2165222 - RNA, 13 nt, Streptococcus pneumoniae R6
uuacauagacuuc

SEQ ID NO: 2165223 - RNA, 20 nt, Streptococcus pneumoniae R6
uuacauagagagacagcagu

SEQ ID NO: 2165224 - RNA, 16 nt, Streptococcus pneumoniae R6
uuacauauucuaacuu

SEQ ID NO: 2165225 - RNA, 12 nt, Streptococcus pneumoniae R6
uuaauuuauuua

SEQ ID NO: 2165226 - RNA, 14 nt, Streptococcus pneumoniae R6
uuaauuuauuuaau

SEQ ID NO: 2165227 - RNA, 13 nt, Streptococcus pneumoniae R6
uuaauuuauagaa

SEQ ID NO: 2165228 - RNA, 16 nt, Streptococcus pneumoniae R6
uuaauuuauagaaaaa

SEQ ID NO: 2165229 - RNA, 14 nt, Streptococcus pneumoniae R6
uuaauuguagcuuu

SEQ ID NO: 2165230 - RNA, 22 nt, Streptococcus pneumoniae R6
uuaauuguagcuuuauuaagcc

SEQ ID NO: 2165231 - RNA, 15 nt, Streptococcus pneumoniae R6
uuaauuuaaugcagu

SEQ ID NO: 2165232 - RNA, 19 nt, Streptococcus pneumoniae R6
uuacaaguguuuucacuuc

SEQ ID NO: 2165233 - RNA, 13 nt, Streptococcus pneumoniae R6
uuacacguacuuu

SEQ ID NO: 2165234 - RNA, 18 nt, Streptococcus pneumoniae R6
uuacacguacuuuaaaau

SEQ ID NO: 2165235 - RNA, 16 nt, Streptococcus pneumoniae R6
uuaauggguguuuaua

SEQ ID NO: 2165236 - RNA, 18 nt, Streptococcus pneumoniae R6
uuaaugcuaauuuagaaa

SEQ ID NO: 2165237 - RNA, 18 nt, Streptococcus pneumoniae R6
uuaauuauacuauaaaac

SEQ ID NO: 2165238 - RNA, 12 nt, Streptococcus pneumoniae R6
uuaaucuucaaa

SEQ ID NO: 2165239 - RNA, 17 nt, Streptococcus pneumoniae R6
uuaaugaccagaauagc

SEQ ID NO: 2165240 - RNA, 21 nt, Streptococcus pneumoniae R6
uuaaucugaauguuucccuug

SEQ ID NO: 2165241 - RNA, 20 nt, Streptococcus pneumoniae R6
uuaaucucuccuuaucaaaa

SEQ ID NO: 2165242 - RNA, 12 nt, Streptococcus pneumoniae R6
uuaauacucaau

SEQ ID NO: 2165243 - RNA, 20 nt, Streptococcus pneumoniae R6
uuacuauauaucaugcuuua

SEQ ID NO: 2165244 - RNA, 23 nt, Streptococcus pneumoniae R6
uuacuaauuaauuaacugguuaa

SEQ ID NO: 2165245 - RNA, 15 nt, Streptococcus pneumoniae R6
uuacuauacuagcuu

SEQ ID NO: 2165246 - RNA, 16 nt, Streptococcus pneumoniae R6
uuacucaaauaaaaga

SEQ ID NO: 2165247 - RNA, 16 nt, Streptococcus pneumoniae R6
uuacugauaaaacuga

SEQ ID NO: 2165248 - RNA, 20 nt, Streptococcus pneumoniae R6
uuacugacuucgucaguucu

SEQ ID NO: 2165249 - RNA, 22 nt, Streptococcus pneumoniae R6
uuacucuccuccauaaaaagac

SEQ ID NO: 2165250 - RNA, 17 nt, Streptococcus pneumoniae R6
uuacucuuugauuuuca

SEQ ID NO: 2165251 - RNA, 18 nt, Streptococcus pneumoniae R6
uuacuguugcugugcuug

SEQ ID NO: 2165252 - RNA, 21 nt, Streptococcus pneumoniae R6
uuacuuuugcacgacccugcg

SEQ ID NO: 2165253 - RNA, 21 nt, Streptococcus pneumoniae R6
uuagaaaaagacuugaaauac

SEQ ID NO: 2165254 - RNA, 12 nt, Streptococcus pneumoniae R6
uuagaaaaaguu

SEQ ID NO: 2165255 - RNA, 16 nt, Streptococcus pneumoniae R6
uuagaaaauucaaauu

SEQ ID NO: 2165256 - RNA, 18 nt, Streptococcus pneumoniae R6
uuagaaaaucucuucaaa

SEQ ID NO: 2165257 - RNA, 17 nt, Streptococcus pneumoniae R6
uuagaauaaggaaaaca

SEQ ID NO: 2165258 - RNA, 19 nt, Streptococcus pneumoniae R6
uuagaauaaggaaaacauu

SEQ ID NO: 2165259 - RNA, 21 nt, Streptococcus pneumoniae R6
uuaccaagcucgauauucuuu

SEQ ID NO: 2165260 - RNA, 22 nt, Streptococcus pneumoniae R6
uuacgauucauaguuacuccuu

SEQ ID NO: 2165261 - RNA, 18 nt, Streptococcus pneumoniae R6
uuacguccuguugcuuca

SEQ ID NO: 2165262 - RNA, 14 nt, Streptococcus pneumoniae R6
uuacguccaccaca

SEQ ID NO: 2165263 - RNA, 22 nt, Streptococcus pneumoniae R6
uuacguccaccacaaaagagaa

SEQ ID NO: 2165264 - RNA, 19 nt, Streptococcus pneumoniae R6
uuacggggguaagagacuu

SEQ ID NO: 2165265 - RNA, 24 nt, Streptococcus pneumoniae R6
uuacuaaggcccaauuaaaaucaa

SEQ ID NO: 2165266 - RNA, 22 nt, Streptococcus pneumoniae R6
uuacuaaacaagggauuuuucu

SEQ ID NO: 2165267 - RNA, 15 nt, Streptococcus pneumoniae R6
uuaaaccuuccaaga

SEQ ID NO: 2165268 - RNA, 19 nt, Streptococcus pneumoniae R6
uuaaacaugucuauagaac

SEQ ID NO: 2165269 - RNA, 20 nt, Streptococcus pneumoniae R6
uuaaacaugucuauagaacu

SEQ ID NO: 2165270 - RNA, 21 nt, Streptococcus pneumoniae R6
uguugcuagauuugucaaauu

SEQ ID NO: 2165271 - RNA, 12 nt, Streptococcus pneumoniae R6
uuaaacaaccuu

SEQ ID NO: 2165272 - RNA, 14 nt, Streptococcus pneumoniae R6
uuaaacaaaaagaa

SEQ ID NO: 2165273 - RNA, 14 nt, Streptococcus pneumoniae R6
uuaaauaauagaaa

SEQ ID NO: 2165274 - RNA, 21 nt, Streptococcus pneumoniae R6
uuaaacgacuagauaaaagaa

SEQ ID NO: 2165275 - RNA, 17 nt, Streptococcus pneumoniae R6
uuaaagacuuuuuucca

SEQ ID NO: 2165276 - RNA, 21 nt, Streptococcus pneumoniae R6
uuaaagacagucugaaaaaga

SEQ ID NO: 2165277 - RNA, 21 nt, Streptococcus pneumoniae R6
uuaaagacagucugaaaaaua

SEQ ID NO: 2165278 - RNA, 14 nt, Streptococcus pneumoniae R6
uuaaagaaauagaa

SEQ ID NO: 2165279 - RNA, 15 nt, Streptococcus pneumoniae R6
uuaacaaaauuauua

SEQ ID NO: 2165280 - RNA, 18 nt, Streptococcus pneumoniae R6
uuaacaaagaaaacgccu

SEQ ID NO: 2165281 - RNA, 19 nt, Streptococcus pneumoniae R6
uuaaauuuuucugcaaaaa

SEQ ID NO: 2165282 - RNA, 23 nt, Streptococcus pneumoniae R6
uuaaauuuuucugcaaaaaauau

SEQ ID NO: 2165283 - RNA, 14 nt, Streptococcus pneumoniae R6
uuaaauuuuuguuu

SEQ ID NO: 2165284 - RNA, 13 nt, Streptococcus pneumoniae R6
uuaacaaaaagaa

SEQ ID NO: 2165285 - RNA, 21 nt, Streptococcus pneumoniae R6
uuaaauuauaaauuauuucuu

SEQ ID NO: 2165286 - RNA, 13 nt, Streptococcus pneumoniae R6
uuaaauucauuaa

SEQ ID NO: 2165287 - RNA, 14 nt, Streptococcus pneumoniae R6
uuaaauucauuaaa

SEQ ID NO: 2165288 - RNA, 21 nt, Streptococcus pneumoniae R6
uuaaauugguguuguuuauua

SEQ ID NO: 2165289 - RNA, 17 nt, Streptococcus pneumoniae R6
uuaaaugcugguuuuua

SEQ ID NO: 2165290 - RNA, 18 nt, Streptococcus pneumoniae R6
uuaaauaugaacaaauca

SEQ ID NO: 2165291 - RNA, 16 nt, Streptococcus pneumoniae R6
uuaaauaguucuucca

SEQ ID NO: 2165292 - RNA, 21 nt, Streptococcus pneumoniae R6
uuaaauagcguagucuuuuaa

SEQ ID NO: 2165293 - RNA, 15 nt, Streptococcus pneumoniae R6
uuaaauagaaaaaca

SEQ ID NO: 2165294 - RNA, 18 nt, Streptococcus pneumoniae R6
uuaagcugacuucgucag

SEQ ID NO: 2165295 - RNA, 23 nt, Streptococcus pneumoniae R6
uuaagcugacuucgucaguucua

SEQ ID NO: 2165296 - RNA, 23 nt, Streptococcus pneumoniae R6
uuaagcugacuucgucaguuuca

SEQ ID NO: 2165297 - RNA, 19 nt, Streptococcus pneumoniae R6
uuaaguuuuuugauuucuu

SEQ ID NO: 2165298 - RNA, 22 nt, Streptococcus pneumoniae R6
uuaauaacucgaucaacaaaca

SEQ ID NO: 2165299 - RNA, 14 nt, Streptococcus pneumoniae R6
uuaacuuucugguc

SEQ ID NO: 2165300 - RNA, 16 nt, Streptococcus pneumoniae R6
uuaacuuuuccaguaa

SEQ ID NO: 2165301 - RNA, 20 nt, Streptococcus pneumoniae R6
uuaacuucaagaacuuuaac

SEQ ID NO: 2165302 - RNA, 23 nt, Streptococcus pneumoniae R6
uuaacuucaggauuuuuacagua

SEQ ID NO: 2165303 - RNA, 16 nt, Streptococcus pneumoniae R6
uuaagcaaaaaaagcc

SEQ ID NO: 2165304 - RNA, 19 nt, Streptococcus pneumoniae R6
uuaagagguuuuacuaaau

SEQ ID NO: 2165305 - RNA, 13 nt, Streptococcus pneumoniae R6
uuaacccaaccac

SEQ ID NO: 2165306 - RNA, 18 nt, Streptococcus pneumoniae R6
uuaacuacuugauaaaag

SEQ ID NO: 2165307 - RNA, 14 nt, Streptococcus pneumoniae R6
uuaacuaaaucuuu

SEQ ID NO: 2165308 - RNA, 22 nt, Streptococcus pneumoniae R6
uuaacgaucaaucaauuuaauc

SEQ ID NO: 2165309 - RNA, 21 nt, Streptococcus pneumoniae R6
uuaacgccucccaauuaaaau

SEQ ID NO: 2165310 - RNA, 20 nt, Streptococcus pneumoniae R6
uuaacagauuuuucuguuuu

SEQ ID NO: 2165311 - RNA, 15 nt, Streptococcus pneumoniae R6
uuaacauuaacauca

SEQ ID NO: 2165312 - RNA, 13 nt, Streptococcus pneumoniae R6
uuaaccacaaaaa

SEQ ID NO: 2165313 - RNA, 19 nt, Streptococcus pneumoniae R6
uuauuuggauuaaucccca

SEQ ID NO: 2165314 - RNA, 12 nt, Streptococcus pneumoniae R6
uuauuucucaac

SEQ ID NO: 2165315 - RNA, 22 nt, Streptococcus pneumoniae R6
uuauuucacuuguauccuccuc

SEQ ID NO: 2165316 - RNA, 12 nt, Streptococcus pneumoniae R6
uuauuucauuuc

SEQ ID NO: 2165317 - RNA, 16 nt, Streptococcus pneumoniae R6
uuauuucauuuggcua

SEQ ID NO: 2165318 - RNA, 15 nt, Streptococcus pneumoniae R6
uuauuuauuuacuua

SEQ ID NO: 2165319 - RNA, 20 nt, Streptococcus pneumoniae R6
uuauuuguuuauaucuuauu

SEQ ID NO: 2165320 - RNA, 18 nt, Streptococcus pneumoniae R6
uuauugguggcuuccagu

SEQ ID NO: 2165321 - RNA, 18 nt, Streptococcus pneumoniae R6
uuauuggcugccacacca

SEQ ID NO: 2165322 - RNA, 15 nt, Streptococcus pneumoniae R6
uuauugcucuugacu

SEQ ID NO: 2165323 - RNA, 17 nt, Streptococcus pneumoniae R6
uuauuuacagaaagaac

SEQ ID NO: 2165324 - RNA, 12 nt, Streptococcus pneumoniae R6
uuauuuaacuaa

SEQ ID NO: 2165325 - RNA, 17 nt, Streptococcus pneumoniae R6
uuauuucacauuuucaa

SEQ ID NO: 2165326 - RNA, 15 nt, Streptococcus pneumoniae R6
uuauuaccuuucuug

SEQ ID NO: 2165327 - RNA, 19 nt, Streptococcus pneumoniae R6
uuauuaagauuacagauca

SEQ ID NO: 2165328 - RNA, 15 nt, Streptococcus pneumoniae R6
uuauuacaucuaucu

SEQ ID NO: 2165329 - RNA, 12 nt, Streptococcus pneumoniae R6
uuauuaacaaaa

SEQ ID NO: 2165330 - RNA, 23 nt, Streptococcus pneumoniae R6
uuauucuggaagugaaaaagcaa

SEQ ID NO: 2165331 - RNA, 10 nt, Streptococcus pneumoniae R6
uuauugaaac

SEQ ID NO: 2165332 - RNA, 21 nt, Streptococcus pneumoniae R6
uuauugaaacagcuaaagaca

SEQ ID NO: 2165333 - RNA, 19 nt, Streptococcus pneumoniae R6
uuauugagcgcaggaagaa

SEQ ID NO: 2165334 - RNA, 23 nt, Streptococcus pneumoniae R6
uuauugaguauuagagguuugcu

SEQ ID NO: 2165335 - RNA, 19 nt, Streptococcus pneumoniae R6
uuauucaaaaacauaauuu

SEQ ID NO: 2165336 - RNA, 20 nt, Streptococcus pneumoniae R6
uuauuuuuucuguaaaauca

SEQ ID NO: 2165337 - RNA, 12 nt, Streptococcus pneumoniae R6
uuauuuuuuaag

SEQ ID NO: 2165338 - RNA, 15 nt, Streptococcus pneumoniae R6
uuauuuuugaaagua

SEQ ID NO: 2165339 - RNA, 21 nt, Streptococcus pneumoniae R6
uucaaaaaaagcuguuaaaaa

SEQ ID NO: 2165340 - RNA, 19 nt, Streptococcus pneumoniae R6
uucaaagaguauuaaacaa

SEQ ID NO: 2165341 - RNA, 13 nt, Streptococcus pneumoniae R6
uucaaaccguguu

SEQ ID NO: 2165342 - RNA, 14 nt, Streptococcus pneumoniae R6
uucaaagaauuuug

SEQ ID NO: 2165343 - RNA, 19 nt, Streptococcus pneumoniae R6
uucaaagucauaaacaucu

SEQ ID NO: 2165344 - RNA, 17 nt, Streptococcus pneumoniae R6
uucaaagucaucaaaau

SEQ ID NO: 2165345 - RNA, 23 nt, Streptococcus pneumoniae R6
uucaaaggucaaaucagguagga

SEQ ID NO: 2165346 - RNA, 14 nt, Streptococcus pneumoniae R6
uucaaaguuaacuu

SEQ ID NO: 2165347 - RNA, 13 nt, Streptococcus pneumoniae R6
uucaaaguuccga

SEQ ID NO: 2165348 - RNA, 16 nt, Streptococcus pneumoniae R6
uucaaaguuccgaaau

SEQ ID NO: 2165349 - RNA, 20 nt, Streptococcus pneumoniae R6
uucaaaguaauuugaguaaa

SEQ ID NO: 2165350 - RNA, 21 nt, Streptococcus pneumoniae R6
uucaaaguuucgaaaaccaaa

SEQ ID NO: 2165351 - RNA, 12 nt, Streptococcus pneumoniae R6
uucaaagauauc

SEQ ID NO: 2165352 - RNA, 22 nt, Streptococcus pneumoniae R6
uucaaagcgggauuuaaaauaa

SEQ ID NO: 2165353 - RNA, 21 nt, Streptococcus pneumoniae R6
uucaaaccaauuucuaacaua

SEQ ID NO: 2165354 - RNA, 22 nt, Streptococcus pneumoniae R6
uucaaaccagcaccagacauuu

SEQ ID NO: 2165355 - RNA, 16 nt, Streptococcus pneumoniae R6
uucaaaccaugucagc

SEQ ID NO: 2165356 - RNA, 18 nt, Streptococcus pneumoniae R6
uucaaaauacaaaaguug

SEQ ID NO: 2165357 - RNA, 14 nt, Streptococcus pneumoniae R6
uucaaaaucagaaa

SEQ ID NO: 2165358 - RNA, 17 nt, Streptococcus pneumoniae R6
uucaaauuaauuucuag

SEQ ID NO: 2165359 - RNA, 18 nt, Streptococcus pneumoniae R6
uucaaauuuuucauaauu

SEQ ID NO: 2165360 - RNA, 16 nt, Streptococcus pneumoniae R6
uucaaaugaaauauuu

SEQ ID NO: 2165361 - RNA, 19 nt, Streptococcus pneumoniae R6
uucaaaugaauuucuacaa

SEQ ID NO: 2165362 - RNA, 15 nt, Streptococcus pneumoniae R6
uucaaaucccaugua

SEQ ID NO: 2165363 - RNA, 14 nt, Streptococcus pneumoniae R6
uucaaauccugcau

SEQ ID NO: 2165364 - RNA, 16 nt, Streptococcus pneumoniae R6
uucaaauccuuuauuu

SEQ ID NO: 2165365 - RNA, 18 nt, Streptococcus pneumoniae R6
uucaacaccgacuuggua

SEQ ID NO: 2165366 - RNA, 17 nt, Streptococcus pneumoniae R6
uucaacacguccauaau

SEQ ID NO: 2165367 - RNA, 15 nt, Streptococcus pneumoniae R6
uucaacagcuuuuuu

SEQ ID NO: 2165368 - RNA, 14 nt, Streptococcus pneumoniae R6
uucaacgaaaauaa

SEQ ID NO: 2165369 - RNA, 15 nt, Streptococcus pneumoniae R6
uucaacgaaaauaau

SEQ ID NO: 2165370 - RNA, 16 nt, Streptococcus pneumoniae R6
uucaacgaaaauaauu

SEQ ID NO: 2165371 - RNA, 15 nt, Streptococcus pneumoniae R6
uucaacucuauuuuu

SEQ ID NO: 2165372 - RNA, 17 nt, Streptococcus pneumoniae R6
uucaagaacuuuaacuu

SEQ ID NO: 2165373 - RNA, 12 nt, Streptococcus pneumoniae R6
uucaagagacuc

SEQ ID NO: 2165374 - RNA, 14 nt, Streptococcus pneumoniae R6
uucaagcauuuuuu

SEQ ID NO: 2165375 - RNA, 21 nt, Streptococcus pneumoniae R6
uuaucugaaaauuaaucagaa

SEQ ID NO: 2165376 - RNA, 21 nt, Streptococcus pneumoniae R6
uuaucuagucgaagcuuccaa

SEQ ID NO: 2165377 - RNA, 17 nt, Streptococcus pneumoniae R6
uuaucuaacaauaagau

SEQ ID NO: 2165378 - RNA, 14 nt, Streptococcus pneumoniae R6
uuaucuaagguuug

SEQ ID NO: 2165379 - RNA, 11 nt, Streptococcus pneumoniae R6
uuaucuagaau

SEQ ID NO: 2165380 - RNA, 16 nt, Streptococcus pneumoniae R6
uuaucuagaauuucuu

SEQ ID NO: 2165381 - RNA, 15 nt, Streptococcus pneumoniae R6
uuaucuagcucccuu

SEQ ID NO: 2165382 - RNA, 18 nt, Streptococcus pneumoniae R6
uuaucuggguuccagaug

SEQ ID NO: 2165383 - RNA, 16 nt, Streptococcus pneumoniae R6
uuaucuuaauucucuu

SEQ ID NO: 2165384 - RNA, 20 nt, Streptococcus pneumoniae R6
uuaucuuaucacccaaaacu

SEQ ID NO: 2165385 - RNA, 22 nt, Streptococcus pneumoniae R6
uuaucuugauauucuuaucaaa

SEQ ID NO: 2165386 - RNA, 17 nt, Streptococcus pneumoniae R6
uuaucuuuaaacuuuuc

SEQ ID NO: 2165387 - RNA, 19 nt, Streptococcus pneumoniae R6
uuaugggagcaagcuccua

SEQ ID NO: 2165388 - RNA, 15 nt, Streptococcus pneumoniae R6
uuauguuuuaaauaa

SEQ ID NO: 2165389 - RNA, 18 nt, Streptococcus pneumoniae R6
uuauuaaaaucccauauu

SEQ ID NO: 2165390 - RNA, 21 nt, Streptococcus pneumoniae R6
uuaugaaaaagauuuuuuaaa

SEQ ID NO: 2165391 - RNA, 20 nt, Streptococcus pneumoniae R6
uuaugaaaaaguuuauauua

SEQ ID NO: 2165392 - RNA, 15 nt, Streptococcus pneumoniae R6
uuaugcaacuuuuuu

SEQ ID NO: 2165393 - RNA, 13 nt, Streptococcus pneumoniae R6
uuaugauauauuu

SEQ ID NO: 2165394 - RNA, 16 nt, Streptococcus pneumoniae R6
uuaugaugcaaaaggu

SEQ ID NO: 2165395 - RNA, 22 nt, Streptococcus pneumoniae R6
uuaucauuaaagaccaaagaaa

SEQ ID NO: 2165396 - RNA, 17 nt, Streptococcus pneumoniae R6
uuauccaaacuagauag

SEQ ID NO: 2165397 - RNA, 18 nt, Streptococcus pneumoniae R6
uuauccauuuuucaaauc

SEQ ID NO: 2165398 - RNA, 18 nt, Streptococcus pneumoniae R6
uuauccaugaaaaaugca

SEQ ID NO: 2165399 - RNA, 20 nt, Streptococcus pneumoniae R6
uuauccgaagggcuauuuuu

SEQ ID NO: 2165400 - RNA, 16 nt, Streptococcus pneumoniae R6
uuaucccagagcuaua

SEQ ID NO: 2165401 - RNA, 21 nt, Streptococcus pneumoniae R6
uuaucauagaaauuuuuacuu

SEQ ID NO: 2165402 - RNA, 17 nt, Streptococcus pneumoniae R6
uuaucaauugauuugaa

SEQ ID NO: 2165403 - RNA, 16 nt, Streptococcus pneumoniae R6
uuaucaauaucaaaac

SEQ ID NO: 2165404 - RNA, 18 nt, Streptococcus pneumoniae R6
uuaucaagcaaaucaaag

SEQ ID NO: 2165405 - RNA, 15 nt, Streptococcus pneumoniae R6
uuaucaauaauagcg

SEQ ID NO: 2165406 - RNA, 18 nt, Streptococcus pneumoniae R6
uuauaggacguuuucaga

SEQ ID NO: 2165407 - RNA, 13 nt, Streptococcus pneumoniae R6
uuauauacccaaa

SEQ ID NO: 2165408 - RNA, 13 nt, Streptococcus pneumoniae R6
uuauauauaaaaa

SEQ ID NO: 2165409 - RNA, 17 nt, Streptococcus pneumoniae R6
uuaucaaaucccuagcu

SEQ ID NO: 2165410 - RNA, 15 nt, Streptococcus pneumoniae R6
uuauaucuaauaauu

SEQ ID NO: 2165411 - RNA, 15 nt, Streptococcus pneumoniae R6
uuauauccuaaaaaa

SEQ ID NO: 2165412 - RNA, 14 nt, Streptococcus pneumoniae R6
uuauagcauucuuc

SEQ ID NO: 2165413 - RNA, 15 nt, Streptococcus pneumoniae R6
uuauagauucaacga

SEQ ID NO: 2165414 - RNA, 16 nt, Streptococcus pneumoniae R6
uuauagauucaauaua

SEQ ID NO: 2165415 - RNA, 19 nt, Streptococcus pneumoniae R6
uuauagauucaauauacua

SEQ ID NO: 2165416 - RNA, 15 nt, Streptococcus pneumoniae R6
uuauacaucuuccca

SEQ ID NO: 2165417 - RNA, 14 nt, Streptococcus pneumoniae R6
uuauagaaguacua

SEQ ID NO: 2165418 - RNA, 19 nt, Streptococcus pneumoniae R6
uuauagaauauauuucuca

SEQ ID NO: 2165419 - RNA, 22 nt, Streptococcus pneumoniae R6
uuauagaaaauuaacuucagga

SEQ ID NO: 2165420 - RNA, 21 nt, Streptococcus pneumoniae R6
uuauagaaggcaauuaaaagg

SEQ ID NO: 2165421 - RNA, 23 nt, Streptococcus pneumoniae R6
uuauagaggagauuuaaaaaugu

SEQ ID NO: 2165422 - RNA, 17 nt, Streptococcus pneumoniae R6
uuauaaucguuuaaaac

SEQ ID NO: 2165423 - RNA, 13 nt, Streptococcus pneumoniae R6
uuauaauauguau

SEQ ID NO: 2165424 - RNA, 19 nt, Streptococcus pneumoniae R6
uuauaauauaaacuuuuuc

SEQ ID NO: 2165425 - RNA, 14 nt, Streptococcus pneumoniae R6
uuauacaaauuaau

SEQ ID NO: 2165426 - RNA, 13 nt, Streptococcus pneumoniae R6
uuauaaacuuuau

SEQ ID NO: 2165427 - RNA, 17 nt, Streptococcus pneumoniae R6
uuagagccgcugaguca

SEQ ID NO: 2165428 - RNA, 21 nt, Streptococcus pneumoniae R6
uuagagauuuucauaaacaag

SEQ ID NO: 2165429 - RNA, 19 nt, Streptococcus pneumoniae R6
uuagagucaagguucuuaa

SEQ ID NO: 2165430 - RNA, 19 nt, Streptococcus pneumoniae R6
uuagagggcaaaaaaggga

SEQ ID NO: 2165431 - RNA, 16 nt, Streptococcus pneumoniae R6
uuagaggcgagacauu

SEQ ID NO: 2165432 - RNA, 22 nt, Streptococcus pneumoniae R6
ugucaaguuuggacggguaaag

SEQ ID NO: 2165433 - RNA, 20 nt, Streptococcus pneumoniae R6
ugucaaaucaaaaucacgug

SEQ ID NO: 2165434 - RNA, 21 nt, Streptococcus pneumoniae R6
ugucaaaucauccgaagcaaa

SEQ ID NO: 2165435 - RNA, 13 nt, Streptococcus pneumoniae R6
ugucauaaucugu

SEQ ID NO: 2165436 - RNA, 21 nt, Streptococcus pneumoniae R6
ugucauaauugaguugggaua

SEQ ID NO: 2165437 - RNA, 12 nt, Streptococcus pneumoniae R6
ugucagugacag

SEQ ID NO: 2165438 - RNA, 23 nt, Streptococcus pneumoniae R6
ugucaguaaaaaaaacauauauu

SEQ ID NO: 2165439 - RNA, 18 nt, Streptococcus pneumoniae R6
ugucacaaaggauagaca

SEQ ID NO: 2165440 - RNA, 15 nt, Streptococcus pneumoniae R6
ugucagcugaaagca

SEQ ID NO: 2165441 - RNA, 19 nt, Streptococcus pneumoniae R6
uguaugacaucuugaaguu

SEQ ID NO: 2165442 - RNA, 20 nt, Streptococcus pneumoniae R6
uguauugguaacaaaaauac

SEQ ID NO: 2165443 - RNA, 19 nt, Streptococcus pneumoniae R6
uguacagaagacuaggcuu

SEQ ID NO: 2165444 - RNA, 18 nt, Streptococcus pneumoniae R6
uguacagcaaaaaauuau

SEQ ID NO: 2165445 - RNA, 14 nt, Streptococcus pneumoniae R6
uguaugaaaaguuu

SEQ ID NO: 2165446 - RNA, 14 nt, Streptococcus pneumoniae R6
uguccaacagacuc

SEQ ID NO: 2165447 - RNA, 16 nt, Streptococcus pneumoniae R6
ugucauguuagaaaaa

SEQ ID NO: 2165448 - RNA, 17 nt, Streptococcus pneumoniae R6
ugucauguuagaaaaau

SEQ ID NO: 2165449 - RNA, 22 nt, Streptococcus pneumoniae R6
ugucauguuagaaaaaugcaaa

SEQ ID NO: 2165450 - RNA, 18 nt, Streptococcus pneumoniae R6
ugucaucguuuuccuaga

SEQ ID NO: 2165451 - RNA, 21 nt, Streptococcus pneumoniae R6
ugucauccuuacggucaaagu

SEQ ID NO: 2165452 - RNA, 23 nt, Streptococcus pneumoniae R6
ugucauccuuacggucaaaguca

SEQ ID NO: 2165453 - RNA, 23 nt, Streptococcus pneumoniae R6
ugucaucaucuugcuaaaaaaag

SEQ ID NO: 2165454 - RNA, 19 nt, Streptococcus pneumoniae R6
uguccauaacgaguaaaag

SEQ ID NO: 2165455 - RNA, 17 nt, Streptococcus pneumoniae R6
uguccaucuguaauaug

SEQ ID NO: 2165456 - RNA, 22 nt, Streptococcus pneumoniae R6
uguccucaaugaguccgaaaaa

SEQ ID NO: 2165457 - RNA, 20 nt, Streptococcus pneumoniae R6
uguccugaucgauuuguucu

SEQ ID NO: 2165458 - RNA, 23 nt, Streptococcus pneumoniae R6
uguccugauuggugauauugucu

SEQ ID NO: 2165459 - RNA, 18 nt, Streptococcus pneumoniae R6
uguccugaaugauuucuu

SEQ ID NO: 2165460 - RNA, 19 nt, Streptococcus pneumoniae R6
uguccugaaugauuucuuc

SEQ ID NO: 2165461 - RNA, 18 nt, Streptococcus pneumoniae R6
uguccuggucuuauuuca

SEQ ID NO: 2165462 - RNA, 16 nt, Streptococcus pneumoniae R6
uguccuugauagcaga

SEQ ID NO: 2165463 - RNA, 15 nt, Streptococcus pneumoniae R6
uguccuggauagaca

SEQ ID NO: 2165464 - RNA, 15 nt, Streptococcus pneumoniae R6
uguccuucuuuuacu

SEQ ID NO: 2165465 - RNA, 18 nt, Streptococcus pneumoniae R6
uguccgaguguuuccuuc

SEQ ID NO: 2165466 - RNA, 19 nt, Streptococcus pneumoniae R6
uguccgcauagccaaauaa

SEQ ID NO: 2165467 - RNA, 21 nt, Streptococcus pneumoniae R6
uguccuuucucgagcuuagcu

SEQ ID NO: 2165468 - RNA, 15 nt, Streptococcus pneumoniae R6
ugucguagucuagga

SEQ ID NO: 2165469 - RNA, 14 nt, Streptococcus pneumoniae R6
ugucuccccaugag

SEQ ID NO: 2165470 - RNA, 18 nt, Streptococcus pneumoniae R6
ugucucuagguuaaaggu

SEQ ID NO: 2165471 - RNA, 22 nt, Streptococcus pneumoniae R6
ugucugaacugccccccaaaag

SEQ ID NO: 2165472 - RNA, 15 nt, Streptococcus pneumoniae R6
ugucugaagauguga

SEQ ID NO: 2165473 - RNA, 20 nt, Streptococcus pneumoniae R6
ugucugaauauauaauuaua

SEQ ID NO: 2165474 - RNA, 15 nt, Streptococcus pneumoniae R6
ugucuaaaaauuuaa

SEQ ID NO: 2165475 - RNA, 22 nt, Streptococcus pneumoniae R6
ugucguuuccuuccaugauaga

SEQ ID NO: 2165476 - RNA, 23 nt, Streptococcus pneumoniae R6
ugucuuacguucauccauaucuu

SEQ ID NO: 2165477 - RNA, 20 nt, Streptococcus pneumoniae R6
ugucuuacuugcguuucuuc

SEQ ID NO: 2165478 - RNA, 13 nt, Streptococcus pneumoniae R6
ugucuucagccuu

SEQ ID NO: 2165479 - RNA, 14 nt, Streptococcus pneumoniae R6
ugucuuugauuuac

SEQ ID NO: 2165480 - RNA, 11 nt, Streptococcus pneumoniae R6
ugugaaaaacu

SEQ ID NO: 2165481 - RNA, 16 nt, Streptococcus pneumoniae R6
ugucuugcauuuuaau

SEQ ID NO: 2165482 - RNA, 17 nt, Streptococcus pneumoniae R6
ugucuuggauuuuugau

SEQ ID NO: 2165483 - RNA, 13 nt, Streptococcus pneumoniae R6
ugucuuauuucau

SEQ ID NO: 2165484 - RNA, 17 nt, Streptococcus pneumoniae R6
ugugaauauucuuggca

SEQ ID NO: 2165485 - RNA, 14 nt, Streptococcus pneumoniae R6
ugugaaucaucacu

SEQ ID NO: 2165486 - RNA, 13 nt, Streptococcus pneumoniae R6
ugugacacuagcu

SEQ ID NO: 2165487 - RNA, 23 nt, Streptococcus pneumoniae R6
ugugacacuagcuggugagaaga

SEQ ID NO: 2165488 - RNA, 23 nt, Streptococcus pneumoniae R6
ugugaaaaucauagagcaaacua

SEQ ID NO: 2165489 - RNA, 23 nt, Streptococcus pneumoniae R6
ugugaacaacucuaucaggaaag

SEQ ID NO: 2165490 - RNA, 12 nt, Streptococcus pneumoniae R6
ugugauaauggu

SEQ ID NO: 2165491 - RNA, 20 nt, Streptococcus pneumoniae R6
ugugauaaaggccuuggccu

SEQ ID NO: 2165492 - RNA, 13 nt, Streptococcus pneumoniae R6
ugugauuuucuua

SEQ ID NO: 2165493 - RNA, 16 nt, Streptococcus pneumoniae R6
ugugauuuucuuauca

SEQ ID NO: 2165494 - RNA, 13 nt, Streptococcus pneumoniae R6
ugugauuuuaaau

SEQ ID NO: 2165495 - RNA, 17 nt, Streptococcus pneumoniae R6
ugugauuuuaaauuuac

SEQ ID NO: 2165496 - RNA, 17 nt, Streptococcus pneumoniae R6
ugugauuuuuuuuggua

SEQ ID NO: 2165497 - RNA, 13 nt, Streptococcus pneumoniae R6
ugugauuucuaaa

SEQ ID NO: 2165498 - RNA, 18 nt, Streptococcus pneumoniae R6
ugugauuuaguagcauca

SEQ ID NO: 2165499 - RNA, 16 nt, Streptococcus pneumoniae R6
ugugccacaauaccca

SEQ ID NO: 2165500 - RNA, 14 nt, Streptococcus pneumoniae R6
ugugccagccauaa

SEQ ID NO: 2165501 - RNA, 21 nt, Streptococcus pneumoniae R6
ugugccagccauaagcuacau

SEQ ID NO: 2165502 - RNA, 15 nt, Streptococcus pneumoniae R6
ugugcuugauaaguu

SEQ ID NO: 2165503 - RNA, 16 nt, Streptococcus pneumoniae R6
uguggaugaaacugac

SEQ ID NO: 2165504 - RNA, 15 nt, Streptococcus pneumoniae R6
uguguaaaaaaguaa

SEQ ID NO: 2165505 - RNA, 21 nt, Streptococcus pneumoniae R6
uguggucuugcuuuuuuauau

SEQ ID NO: 2165506 - RNA, 18 nt, Streptococcus pneumoniae R6
uguguuaccgguuacaua

SEQ ID NO: 2165507 - RNA, 23 nt, Streptococcus pneumoniae R6
uguguacuguucuaaauucagua

SEQ ID NO: 2165508 - RNA, 11 nt, Streptococcus pneumoniae R6
uguguaaguga

SEQ ID NO: 2165509 - RNA, 21 nt, Streptococcus pneumoniae R6
uguuacuuggcgaaggucuuu

SEQ ID NO: 2165510 - RNA, 14 nt, Streptococcus pneumoniae R6
uguuagaacaguca

SEQ ID NO: 2165511 - RNA, 14 nt, Streptococcus pneumoniae R6
uguuagaagacuuu

SEQ ID NO: 2165512 - RNA, 18 nt, Streptococcus pneumoniae R6
uguuacagacaaaacugg

SEQ ID NO: 2165513 - RNA, 16 nt, Streptococcus pneumoniae R6
uguuaccacaggagcu

SEQ ID NO: 2165514 - RNA, 21 nt, Streptococcus pneumoniae R6
uguuaccacuuccuaccuauu

SEQ ID NO: 2165515 - RNA, 17 nt, Streptococcus pneumoniae R6
uguuauagguaaaaucu

SEQ ID NO: 2165516 - RNA, 20 nt, Streptococcus pneumoniae R6
uguuauagauucaauauacu

SEQ ID NO: 2165517 - RNA, 22 nt, Streptococcus pneumoniae R6
uguuaguucuugaaaugaaguu

SEQ ID NO: 2165518 - RNA, 14 nt, Streptococcus pneumoniae R6
uguuagauuuauaa

SEQ ID NO: 2165519 - RNA, 16 nt, Streptococcus pneumoniae R6
uguucaaagugguguu

SEQ ID NO: 2165520 - RNA, 19 nt, Streptococcus pneumoniae R6
uguucaaaaaccuugauuu

SEQ ID NO: 2165521 - RNA, 13 nt, Streptococcus pneumoniae R6
uguuauuuuucuu

SEQ ID NO: 2165522 - RNA, 16 nt, Streptococcus pneumoniae R6
uguuauuuuucuuuuu

SEQ ID NO: 2165523 - RNA, 18 nt, Streptococcus pneumoniae R6
uguucagguguuucuggu

SEQ ID NO: 2165524 - RNA, 12 nt, Streptococcus pneumoniae R6
uguucaauggcu

SEQ ID NO: 2165525 - RNA, 16 nt, Streptococcus pneumoniae R6
uguucaauccacuugu

SEQ ID NO: 2165526 - RNA, 20 nt, Streptococcus pneumoniae R6
uguucuuauuucauuuuacu

SEQ ID NO: 2165527 - RNA, 17 nt, Streptococcus pneumoniae R6
uguucuucuaucuucuu

SEQ ID NO: 2165528 - RNA, 12 nt, Streptococcus pneumoniae R6
uguucuuggaga

SEQ ID NO: 2165529 - RNA, 20 nt, Streptococcus pneumoniae R6
uguucuuguuuugacauugu

SEQ ID NO: 2165530 - RNA, 14 nt, Streptococcus pneumoniae R6
uguucuuuagaaag

SEQ ID NO: 2165531 - RNA, 14 nt, Streptococcus pneumoniae R6
uguucuuuuucaaa

SEQ ID NO: 2165532 - RNA, 15 nt, Streptococcus pneumoniae R6
uguucuuuuucaaaa

SEQ ID NO: 2165533 - RNA, 16 nt, Streptococcus pneumoniae R6
uguucuuuuucaaaag

SEQ ID NO: 2165534 - RNA, 14 nt, Streptococcus pneumoniae R6
uguugaaugagcuu

SEQ ID NO: 2165535 - RNA, 17 nt, Streptococcus pneumoniae R6
uguugagcauacugccc

SEQ ID NO: 2165536 - RNA, 16 nt, Streptococcus pneumoniae R6
uguugacuuguacuca

SEQ ID NO: 2165537 - RNA, 17 nt, Streptococcus pneumoniae R6
uguugaccgacuauuuu

SEQ ID NO: 2165538 - RNA, 14 nt, Streptococcus pneumoniae R6
uguugauauuucca

SEQ ID NO: 2165539 - RNA, 16 nt, Streptococcus pneumoniae R6
uguugauauuuccauc

SEQ ID NO: 2165540 - RNA, 16 nt, Streptococcus pneumoniae R6
uguuccaauugauuaa

SEQ ID NO: 2165541 - RNA, 18 nt, Streptococcus pneumoniae R6
uguucaucuucuuucucc

SEQ ID NO: 2165542 - RNA, 13 nt, Streptococcus pneumoniae R6
uguucauaucuua

SEQ ID NO: 2165543 - RNA, 16 nt, Streptococcus pneumoniae R6
uguucugccuauuuuu

SEQ ID NO: 2165544 - RNA, 14 nt, Streptococcus pneumoniae R6
uguucuguaaugaa

SEQ ID NO: 2165545 - RNA, 20 nt, Streptococcus pneumoniae R6
uguucugucuguucucugag

SEQ ID NO: 2165546 - RNA, 15 nt, Streptococcus pneumoniae R6
uguucuguucuuauu

SEQ ID NO: 2165547 - RNA, 20 nt, Streptococcus pneumoniae R6
uguucuguucuuauuucauu

SEQ ID NO: 2165548 - RNA, 16 nt, Streptococcus pneumoniae R6
uggucuggauguucug

SEQ ID NO: 2165549 - RNA, 15 nt, Streptococcus pneumoniae R6
uggucuucaugcugg

SEQ ID NO: 2165550 - RNA, 21 nt, Streptococcus pneumoniae R6
uggucuuauuucauuucacua

SEQ ID NO: 2165551 - RNA, 12 nt, Streptococcus pneumoniae R6
uggucugauuga

SEQ ID NO: 2165552 - RNA, 20 nt, Streptococcus pneumoniae R6
uggucggcucguccagcacu

SEQ ID NO: 2165553 - RNA, 19 nt, Streptococcus pneumoniae R6
uggugcuauuuguuguaag

SEQ ID NO: 2165554 - RNA, 17 nt, Streptococcus pneumoniae R6
uggugcuagggcaagga

SEQ ID NO: 2165555 - RNA, 22 nt, Streptococcus pneumoniae R6
uggugggaccuguccuaggucu

SEQ ID NO: 2165556 - RNA, 15 nt, Streptococcus pneumoniae R6
uggugcuaauucuuu

SEQ ID NO: 2165557 - RNA, 15 nt, Streptococcus pneumoniae R6
uggugccgaaacuuc

SEQ ID NO: 2165558 - RNA, 22 nt, Streptococcus pneumoniae R6
ugguauuuaaaaccuccaaagu

SEQ ID NO: 2165559 - RNA, 21 nt, Streptococcus pneumoniae R6
uggucaauccgaguuuuucag

SEQ ID NO: 2165560 - RNA, 14 nt, Streptococcus pneumoniae R6
uggucacagaacca

SEQ ID NO: 2165561 - RNA, 16 nt, Streptococcus pneumoniae R6
uggucauggucugauu

SEQ ID NO: 2165562 - RNA, 23 nt, Streptococcus pneumoniae R6
ugguccaaguggaauucauuuuc

SEQ ID NO: 2165563 - RNA, 15 nt, Streptococcus pneumoniae R6
ugguaagaguugaaa

SEQ ID NO: 2165564 - RNA, 15 nt, Streptococcus pneumoniae R6
ugguaauguucuucg

SEQ ID NO: 2165565 - RNA, 15 nt, Streptococcus pneumoniae R6
uggggucagaaagaa

SEQ ID NO: 2165566 - RNA, 18 nt, Streptococcus pneumoniae R6
ugggguugagaaguggga

SEQ ID NO: 2165567 - RNA, 12 nt, Streptococcus pneumoniae R6
ugguaacagucu

SEQ ID NO: 2165568 - RNA, 12 nt, Streptococcus pneumoniae R6
uguaauggcugu

SEQ ID NO: 2165569 - RNA, 19 nt, Streptococcus pneumoniae R6
uguaaugacaauuauauaa

SEQ ID NO: 2165570 - RNA, 20 nt, Streptococcus pneumoniae R6
uguaaugacaauuauauaaa

SEQ ID NO: 2165571 - RNA, 11 nt, Streptococcus pneumoniae R6
uguaaaaagaa

SEQ ID NO: 2165572 - RNA, 18 nt, Streptococcus pneumoniae R6
ugguuuuuaggcaauaaa

SEQ ID NO: 2165573 - RNA, 23 nt, Streptococcus pneumoniae R6
ugguuuuuaggcaauaaaauaug

SEQ ID NO: 2165574 - RNA, 13 nt, Streptococcus pneumoniae R6
ugguuuuucuuca

SEQ ID NO: 2165575 - RNA, 12 nt, Streptococcus pneumoniae R6
ugguuuuuuaag

SEQ ID NO: 2165576 - RNA, 21 nt, Streptococcus pneumoniae R6
uguaagucaagucuucuuggu

SEQ ID NO: 2165577 - RNA, 13 nt, Streptococcus pneumoniae R6
uguaaggugcaaa

SEQ ID NO: 2165578 - RNA, 13 nt, Streptococcus pneumoniae R6
uguaagauagaga

SEQ ID NO: 2165579 - RNA, 20 nt, Streptococcus pneumoniae R6
uguaacaucgaaguuguguu

SEQ ID NO: 2165580 - RNA, 23 nt, Streptococcus pneumoniae R6
uguaacaacuucacgagccaaga

SEQ ID NO: 2165581 - RNA, 15 nt, Streptococcus pneumoniae R6
uguaaauuuauuggu

SEQ ID NO: 2165582 - RNA, 13 nt, Streptococcus pneumoniae R6
ugguuuccuuggu

SEQ ID NO: 2165583 - RNA, 22 nt, Streptococcus pneumoniae R6
ugguuucagucaauaccaggua

SEQ ID NO: 2165584 - RNA, 13 nt, Streptococcus pneumoniae R6
ugguuuaaaaaga

SEQ ID NO: 2165585 - RNA, 13 nt, Streptococcus pneumoniae R6
ugguugggaaaau

SEQ ID NO: 2165586 - RNA, 14 nt, Streptococcus pneumoniae R6
ugguugcuuccucc

SEQ ID NO: 2165587 - RNA, 17 nt, Streptococcus pneumoniae R6
ugguuguccauuugaaa

SEQ ID NO: 2165588 - RNA, 23 nt, Streptococcus pneumoniae R6
ugguugucaaaccacaacgggca

SEQ ID NO: 2165589 - RNA, 13 nt, Streptococcus pneumoniae R6
ugguugaaaacaa

SEQ ID NO: 2165590 - RNA, 18 nt, Streptococcus pneumoniae R6
ugguucccagcaugguca

SEQ ID NO: 2165591 - RNA, 13 nt, Streptococcus pneumoniae R6
ugguuaagugcau

SEQ ID NO: 2165592 - RNA, 12 nt, Streptococcus pneumoniae R6
ugguuaaaaguu

SEQ ID NO: 2165593 - RNA, 11 nt, Streptococcus pneumoniae R6
uggaaaacuaa

SEQ ID NO: 2165594 - RNA, 15 nt, Streptococcus pneumoniae R6
uggaaaauagaaaaa

SEQ ID NO: 2165595 - RNA, 16 nt, Streptococcus pneumoniae R6
uggaaaauagaaaaaa

SEQ ID NO: 2165596 - RNA, 11 nt, Streptococcus pneumoniae R6
uggaaaauaaa

SEQ ID NO: 2165597 - RNA, 14 nt, Streptococcus pneumoniae R6
uggaaaaaaugaaa

SEQ ID NO: 2165598 - RNA, 16 nt, Streptococcus pneumoniae R6
uggaaaacaauaucag

SEQ ID NO: 2165599 - RNA, 20 nt, Streptococcus pneumoniae R6
uggcgcuucuacuccaagca

SEQ ID NO: 2165600 - RNA, 19 nt, Streptococcus pneumoniae R6
uggcucguggcagaccaua

SEQ ID NO: 2165601 - RNA, 23 nt, Streptococcus pneumoniae R6
uggcucauaucuggcauuccugc

SEQ ID NO: 2165602 - RNA, 16 nt, Streptococcus pneumoniae R6
uggcuccagaaauaau

SEQ ID NO: 2165603 - RNA, 19 nt, Streptococcus pneumoniae R6
uggcuccagaaauaauauc

SEQ ID NO: 2165604 - RNA, 20 nt, Streptococcus pneumoniae R6
uggcuauaauuauucugcaa

SEQ ID NO: 2165605 - RNA, 15 nt, Streptococcus pneumoniae R6
uggcuaguaaauauc

SEQ ID NO: 2165606 - RNA, 18 nt, Streptococcus pneumoniae R6
uggcucaggacgaacgcu

SEQ ID NO: 2165607 - RNA, 23 nt, Streptococcus pneumoniae R6
uggcuauuaacgauugaaauaac

SEQ ID NO: 2165608 - RNA, 17 nt, Streptococcus pneumoniae R6
uggcgugggucaucaag

SEQ ID NO: 2165609 - RNA, 18 nt, Streptococcus pneumoniae R6
uggcgugggucaucaagc

SEQ ID NO: 2165610 - RNA, 19 nt, Streptococcus pneumoniae R6
uggcguguuugucaaacau

SEQ ID NO: 2165611 - RNA, 14 nt, Streptococcus pneumoniae R6
uggcguuggaauaa

SEQ ID NO: 2165612 - RNA, 15 nt, Streptococcus pneumoniae R6
uggcuaaaaagcuac

SEQ ID NO: 2165613 - RNA, 20 nt, Streptococcus pneumoniae R6
uggcuacaagaacagucucu

SEQ ID NO: 2165614 - RNA, 17 nt, Streptococcus pneumoniae R6
uggcuacagaugcugca

SEQ ID NO: 2165615 - RNA, 14 nt, Streptococcus pneumoniae R6
ugggcuucuguaau

SEQ ID NO: 2165616 - RNA, 17 nt, Streptococcus pneumoniae R6
ugggcuuucauccaaga

SEQ ID NO: 2165617 - RNA, 12 nt, Streptococcus pneumoniae R6
ugggaccugucc

SEQ ID NO: 2165618 - RNA, 19 nt, Streptococcus pneumoniae R6
ugggaccuguccuaggucu

SEQ ID NO: 2165619 - RNA, 18 nt, Streptococcus pneumoniae R6
ugggacagaaaugcccaa

SEQ ID NO: 2165620 - RNA, 19 nt, Streptococcus pneumoniae R6
ugggccagauuuauggucu

SEQ ID NO: 2165621 - RNA, 14 nt, Streptococcus pneumoniae R6
uggcuuccaguuug

SEQ ID NO: 2165622 - RNA, 23 nt, Streptococcus pneumoniae R6
uggcuugaggucccaugcuucca

SEQ ID NO: 2165623 - RNA, 15 nt, Streptococcus pneumoniae R6
uggcuugucuuuuuc

SEQ ID NO: 2165624 - RNA, 23 nt, Streptococcus pneumoniae R6
ugggaaauaucgcguucgugcca

SEQ ID NO: 2165625 - RNA, 17 nt, Streptococcus pneumoniae R6
ugggaaggaauagugga

SEQ ID NO: 2165626 - RNA, 18 nt, Streptococcus pneumoniae R6
ugggaagaguugcuuguc

SEQ ID NO: 2165627 - RNA, 15 nt, Streptococcus pneumoniae R6
ugggaagauguauaa

SEQ ID NO: 2165628 - RNA, 20 nt, Streptococcus pneumoniae R6
ugggaagauguauaauggau

SEQ ID NO: 2165629 - RNA, 21 nt, Streptococcus pneumoniae R6
ugggaagauuuacuuccuuuu

SEQ ID NO: 2165630 - RNA, 19 nt, Streptococcus pneumoniae R6
ugggaagauuuacuucuuu

SEQ ID NO: 2165631 - RNA, 21 nt, Streptococcus pneumoniae R6
ugggaagauuuacuucuuuuu

SEQ ID NO: 2165632 - RNA, 23 nt, Streptococcus pneumoniae R6
ugggaagauuuacuucuuuuucu

SEQ ID NO: 2165633 - RNA, 15 nt, Streptococcus pneumoniae R6
ugggaauugguuuuu

SEQ ID NO: 2165634 - RNA, 21 nt, Streptococcus pneumoniae R6
uggcugccacaccaccugcca

SEQ ID NO: 2165635 - RNA, 15 nt, Streptococcus pneumoniae R6
uggcugcgaaaaaug

SEQ ID NO: 2165636 - RNA, 17 nt, Streptococcus pneumoniae R6
uggcugguauuaagaac

SEQ ID NO: 2165637 - RNA, 19 nt, Streptococcus pneumoniae R6
uucaguagauaauauaccc

SEQ ID NO: 2165638 - RNA, 17 nt, Streptococcus pneumoniae R6
uucaguagauuaaaggc

SEQ ID NO: 2165639 - RNA, 17 nt, Streptococcus pneumoniae R6
uucaguaauaucuccag

SEQ ID NO: 2165640 - RNA, 16 nt, Streptococcus pneumoniae R6
uucagguguuucuggu

SEQ ID NO: 2165641 - RNA, 17 nt, Streptococcus pneumoniae R6
uucagguggguuuucug

SEQ ID NO: 2165642 - RNA, 19 nt, Streptococcus pneumoniae R6
uucaggugcgagagcuuug

SEQ ID NO: 2165643 - RNA, 18 nt, Streptococcus pneumoniae R6
uucagcuacgacaccuga

SEQ ID NO: 2165644 - RNA, 17 nt, Streptococcus pneumoniae R6
uucagcuggcuccuucu

SEQ ID NO: 2165645 - RNA, 22 nt, Streptococcus pneumoniae R6
uucaggacagucaaaucgauuu

SEQ ID NO: 2165646 - RNA, 11 nt, Streptococcus pneumoniae R6
uucagcgauuu

SEQ ID NO: 2165647 - RNA, 19 nt, Streptococcus pneumoniae R6
uucauagcacuauuguauu

SEQ ID NO: 2165648 - RNA, 21 nt, Streptococcus pneumoniae R6
uucauacucaaucccauauuu

SEQ ID NO: 2165649 - RNA, 14 nt, Streptococcus pneumoniae R6
uucauagaaaucaa

SEQ ID NO: 2165650 - RNA, 20 nt, Streptococcus pneumoniae R6
uucauaguuacuccuuuuuu

SEQ ID NO: 2165651 - RNA, 14 nt, Streptococcus pneumoniae R6
uucauagguuuauu

SEQ ID NO: 2165652 - RNA, 13 nt, Streptococcus pneumoniae R6
uucauaguucuau

SEQ ID NO: 2165653 - RNA, 16 nt, Streptococcus pneumoniae R6
uucauacgauaaaaau

SEQ ID NO: 2165654 - RNA, 15 nt, Streptococcus pneumoniae R6
uucauacauuucgau

SEQ ID NO: 2165655 - RNA, 15 nt, Streptococcus pneumoniae R6
uucauaaucaggcca

SEQ ID NO: 2165656 - RNA, 18 nt, Streptococcus pneumoniae R6
uucaucaacccccauacc

SEQ ID NO: 2165657 - RNA, 20 nt, Streptococcus pneumoniae R6
uucaucaaagcuaguuguuu

SEQ ID NO: 2165658 - RNA, 18 nt, Streptococcus pneumoniae R6
uucauauaauaaauugua

SEQ ID NO: 2165659 - RNA, 21 nt, Streptococcus pneumoniae R6
uucauaucaugggguguuuuu

SEQ ID NO: 2165660 - RNA, 13 nt, Streptococcus pneumoniae R6
uucauauccccag

SEQ ID NO: 2165661 - RNA, 14 nt, Streptococcus pneumoniae R6
uucaguuucauaau

SEQ ID NO: 2165662 - RNA, 21 nt, Streptococcus pneumoniae R6
uucaguugccucagauucuga

SEQ ID NO: 2165663 - RNA, 14 nt, Streptococcus pneumoniae R6
uucaguugcauaaa

SEQ ID NO: 2165664 - RNA, 22 nt, Streptococcus pneumoniae R6
uucaguugcauaaaucgcuuuu

SEQ ID NO: 2165665 - RNA, 20 nt, Streptococcus pneumoniae R6
uucauaacuacaguauagca

SEQ ID NO: 2165666 - RNA, 21 nt, Streptococcus pneumoniae R6
uucauaaggaagucuguuauu

SEQ ID NO: 2165667 - RNA, 14 nt, Streptococcus pneumoniae R6
uucauaaaguuuuc

SEQ ID NO: 2165668 - RNA, 13 nt, Streptococcus pneumoniae R6
uucaguuuuauuu

SEQ ID NO: 2165669 - RNA, 16 nt, Streptococcus pneumoniae R6
uucaucauuuuauuca

SEQ ID NO: 2165670 - RNA, 18 nt, Streptococcus pneumoniae R6
uucauccacaaccucaaa

SEQ ID NO: 2165671 - RNA, 15 nt, Streptococcus pneumoniae R6
uucauccccauuugu

SEQ ID NO: 2165672 - RNA, 15 nt, Streptococcus pneumoniae R6
uucaucgagauggag

SEQ ID NO: 2165673 - RNA, 18 nt, Streptococcus pneumoniae R6
uucaucgccuacaugugu

SEQ ID NO: 2165674 - RNA, 17 nt, Streptococcus pneumoniae R6
uucaugacaucuuccaa

SEQ ID NO: 2165675 - RNA, 12 nt, Streptococcus pneumoniae R6
uucaugacagau

SEQ ID NO: 2165676 - RNA, 17 nt, Streptococcus pneumoniae R6
uucaugacagauucauc

SEQ ID NO: 2165677 - RNA, 14 nt, Streptococcus pneumoniae R6
uucaucuacaaccu

SEQ ID NO: 2165678 - RNA, 16 nt, Streptococcus pneumoniae R6
uucaucuacaaccuca

SEQ ID NO: 2165679 - RNA, 20 nt, Streptococcus pneumoniae R6
uucaucuccugucaauucca

SEQ ID NO: 2165680 - RNA, 19 nt, Streptococcus pneumoniae R6
uucauuauuaugaaaacca

SEQ ID NO: 2165681 - RNA, 19 nt, Streptococcus pneumoniae R6
uucauuccaucauaaaaau

SEQ ID NO: 2165682 - RNA, 13 nt, Streptococcus pneumoniae R6
uucauugagcuuu

SEQ ID NO: 2165683 - RNA, 17 nt, Streptococcus pneumoniae R6
uucauugagcuuuaaaa

SEQ ID NO: 2165684 - RNA, 14 nt, Streptococcus pneumoniae R6
uucauugaaaaaau

SEQ ID NO: 2165685 - RNA, 20 nt, Streptococcus pneumoniae R6
uucauugaaaaaauaucuuu

SEQ ID NO: 2165686 - RNA, 22 nt, Streptococcus pneumoniae R6
uucauucggucauggauuuuau

SEQ ID NO: 2165687 - RNA, 17 nt, Streptococcus pneumoniae R6
uucauuuggcuauaaaa

SEQ ID NO: 2165688 - RNA, 18 nt, Streptococcus pneumoniae R6
uucauuuggcuauaaaaa

SEQ ID NO: 2165689 - RNA, 14 nt, Streptococcus pneumoniae R6
uucauuuuacuaua

SEQ ID NO: 2165690 - RNA, 17 nt, Streptococcus pneumoniae R6
uucauuuuacuauaaaa

SEQ ID NO: 2165691 - RNA, 18 nt, Streptococcus pneumoniae R6
uucauuuugcacaauaua

SEQ ID NO: 2165692 - RNA, 14 nt, Streptococcus pneumoniae R6
uucauuuucuuaaa

SEQ ID NO: 2165693 - RNA, 13 nt, Streptococcus pneumoniae R6
uucauuaaaugga

SEQ ID NO: 2165694 - RNA, 20 nt, Streptococcus pneumoniae R6
uucauuaaauggaauaguau

SEQ ID NO: 2165695 - RNA, 16 nt, Streptococcus pneumoniae R6
uucauuacuuaaccca

SEQ ID NO: 2165696 - RNA, 15 nt, Streptococcus pneumoniae R6
uucaugauugauaau

SEQ ID NO: 2165697 - RNA, 16 nt, Streptococcus pneumoniae R6
uucauguauuccaaga

SEQ ID NO: 2165698 - RNA, 20 nt, Streptococcus pneumoniae R6
uucaugguucgggauaaaau

SEQ ID NO: 2165699 - RNA, 17 nt, Streptococcus pneumoniae R6
uucaaguaggucaaagc

SEQ ID NO: 2165700 - RNA, 20 nt, Streptococcus pneumoniae R6
uucaauaaauugagcauuau

SEQ ID NO: 2165701 - RNA, 22 nt, Streptococcus pneumoniae R6
uucaauaaauugagcauuaucg

SEQ ID NO: 2165702 - RNA, 24 nt, Streptococcus pneumoniae R6
uucaauacgaaucaauacagaaga

SEQ ID NO: 2165703 - RNA, 18 nt, Streptococcus pneumoniae R6
uucaauacggucaaucaa

SEQ ID NO: 2165704 - RNA, 13 nt, Streptococcus pneumoniae R6
uucaauaccaaag

SEQ ID NO: 2165705 - RNA, 14 nt, Streptococcus pneumoniae R6
uucaauaccaaaga

SEQ ID NO: 2165706 - RNA, 13 nt, Streptococcus pneumoniae R6
uucaaugauaaaa

SEQ ID NO: 2165707 - RNA, 13 nt, Streptococcus pneumoniae R6
uucaauguacuag

SEQ ID NO: 2165708 - RNA, 16 nt, Streptococcus pneumoniae R6
uucaauggaguaaaaa

SEQ ID NO: 2165709 - RNA, 19 nt, Streptococcus pneumoniae R6
uucaauggaguaaaaaaag

SEQ ID NO: 2165710 - RNA, 21 nt, Streptococcus pneumoniae R6
uucaaugcccuugauaauaaa

SEQ ID NO: 2165711 - RNA, 13 nt, Streptococcus pneumoniae R6
uucaauccaucuc

SEQ ID NO: 2165712 - RNA, 17 nt, Streptococcus pneumoniae R6
uucaaucagcuaaaaau

SEQ ID NO: 2165713 - RNA, 23 nt, Streptococcus pneumoniae R6
uucaauauauuauauaucugcag

SEQ ID NO: 2165714 - RNA, 16 nt, Streptococcus pneumoniae R6
uucaauuguuuauaaa

SEQ ID NO: 2165715 - RNA, 18 nt, Streptococcus pneumoniae R6
uucaauuguuuauaaaau

SEQ ID NO: 2165716 - RNA, 20 nt, Streptococcus pneumoniae R6
uucaauuguuuauaaaauaa

SEQ ID NO: 2165717 - RNA, 13 nt, Streptococcus pneumoniae R6
uucaauuucuaau

SEQ ID NO: 2165718 - RNA, 17 nt, Streptococcus pneumoniae R6
uucaauuugauauauaa

SEQ ID NO: 2165719 - RNA, 21 nt, Streptococcus pneumoniae R6
uucaauuugauauauaaauga

SEQ ID NO: 2165720 - RNA, 18 nt, Streptococcus pneumoniae R6
uucaaugugggaaacaga

SEQ ID NO: 2165721 - RNA, 22 nt, Streptococcus pneumoniae R6
uucaauugcaggagaaaaugaa

SEQ ID NO: 2165722 - RNA, 15 nt, Streptococcus pneumoniae R6
uucacaaucaaaaaa

SEQ ID NO: 2165723 - RNA, 20 nt, Streptococcus pneumoniae R6
uucacacaagaguucuagcu

SEQ ID NO: 2165724 - RNA, 21 nt, Streptococcus pneumoniae R6
uucacaacucuuauacuuuuc

SEQ ID NO: 2165725 - RNA, 21 nt, Streptococcus pneumoniae R6
uucaccaaaacuauauucucu

SEQ ID NO: 2165726 - RNA, 23 nt, Streptococcus pneumoniae R6
uucaccaguaaaguguucugucu

SEQ ID NO: 2165727 - RNA, 13 nt, Streptococcus pneumoniae R6
uucaccaauguuc

SEQ ID NO: 2165728 - RNA, 14 nt, Streptococcus pneumoniae R6
uucaccaaucaaau

SEQ ID NO: 2165729 - RNA, 18 nt, Streptococcus pneumoniae R6
uucaccaaucaaaucaau

SEQ ID NO: 2165730 - RNA, 16 nt, Streptococcus pneumoniae R6
uucaccagauagaaua

SEQ ID NO: 2165731 - RNA, 19 nt, Streptococcus pneumoniae R6
uucagauaaccaucucaca

SEQ ID NO: 2165732 - RNA, 19 nt, Streptococcus pneumoniae R6
uucagagggcuuuuucauu

SEQ ID NO: 2165733 - RNA, 22 nt, Streptococcus pneumoniae R6
uucagauuuuaaagacuuuuuu

SEQ ID NO: 2165734 - RNA, 16 nt, Streptococcus pneumoniae R6
uucagauucaucauuu

SEQ ID NO: 2165735 - RNA, 13 nt, Streptococcus pneumoniae R6
uucagccacuauu

SEQ ID NO: 2165736 - RNA, 15 nt, Streptococcus pneumoniae R6
uucagcauauuuccc

SEQ ID NO: 2165737 - RNA, 18 nt, Streptococcus pneumoniae R6
uucagcauauuucccauu

SEQ ID NO: 2165738 - RNA, 13 nt, Streptococcus pneumoniae R6
uucagaacuuuua

SEQ ID NO: 2165739 - RNA, 16 nt, Streptococcus pneumoniae R6
uucagaagaaaaaaag

SEQ ID NO: 2165740 - RNA, 13 nt, Streptococcus pneumoniae R6
uucacuugagcaa

SEQ ID NO: 2165741 - RNA, 14 nt, Streptococcus pneumoniae R6
uucagaauaagagg

SEQ ID NO: 2165742 - RNA, 15 nt, Streptococcus pneumoniae R6
uucagaaucccaaag

SEQ ID NO: 2165743 - RNA, 15 nt, Streptococcus pneumoniae R6
uucagaauuuucuua

SEQ ID NO: 2165744 - RNA, 23 nt, Streptococcus pneumoniae R6
uucagagcgauaaaaauccuuuu

SEQ ID NO: 2165745 - RNA, 16 nt, Streptococcus pneumoniae R6
uucaccuccucucacg

SEQ ID NO: 2165746 - RNA, 13 nt, Streptococcus pneumoniae R6
uucaccugcuuuu

SEQ ID NO: 2165747 - RNA, 20 nt, Streptococcus pneumoniae R6
uucacuagccccagcuagga

SEQ ID NO: 2165748 - RNA, 13 nt, Streptococcus pneumoniae R6
uucacuaguuuua

SEQ ID NO: 2165749 - RNA, 20 nt, Streptococcus pneumoniae R6
uucacuauauugcaagagaa

SEQ ID NO: 2165750 - RNA, 17 nt, Streptococcus pneumoniae R6
uucacguuguucaagcc

SEQ ID NO: 2165751 - RNA, 16 nt, Streptococcus pneumoniae R6
uucacggcuaauacca

SEQ ID NO: 2165752 - RNA, 23 nt, Streptococcus pneumoniae R6
uucacgggcuuggcguuuugagu

SEQ ID NO: 2165753 - RNA, 17 nt, Streptococcus pneumoniae R6
uucacguucgguauuuu

SEQ ID NO: 2165754 - RNA, 14 nt, Streptococcus pneumoniae R6
uucacguucuucca

SEQ ID NO: 2165755 - RNA, 18 nt, Streptococcus pneumoniae R6
uucacuccacuauaaaac

SEQ ID NO: 2165756 - RNA, 15 nt, Streptococcus pneumoniae R6
uucacucaaaccuga

SEQ ID NO: 2165757 - RNA, 17 nt, Streptococcus pneumoniae R6
uucacugagaucuucuu

SEQ ID NO: 2165758 - RNA, 17 nt, Streptococcus pneumoniae R6
uuccagaacuucaauaa

SEQ ID NO: 2165759 - RNA, 16 nt, Streptococcus pneumoniae R6
uuccaccauucuuucc

SEQ ID NO: 2165760 - RNA, 14 nt, Streptococcus pneumoniae R6
uuccacccagaaau

SEQ ID NO: 2165761 - RNA, 23 nt, Streptococcus pneumoniae R6
uuccaauuuuugcguuggaauaa

SEQ ID NO: 2165762 - RNA, 13 nt, Streptococcus pneumoniae R6
uuccaaucuucuc

SEQ ID NO: 2165763 - RNA, 16 nt, Streptococcus pneumoniae R6
uuccaaucuucuccag

SEQ ID NO: 2165764 - RNA, 22 nt, Streptococcus pneumoniae R6
uucauuuuuccuucccacuugu

SEQ ID NO: 2165765 - RNA, 22 nt, Streptococcus pneumoniae R6
uuccaaaaauucuuacuaccua

SEQ ID NO: 2165766 - RNA, 14 nt, Streptococcus pneumoniae R6
uuccaaaauuaaaa

SEQ ID NO: 2165767 - RNA, 17 nt, Streptococcus pneumoniae R6
uuccaaaauuaaaaugu

SEQ ID NO: 2165768 - RNA, 21 nt, Streptococcus pneumoniae R6
uuccaaacauacaauauaucc

SEQ ID NO: 2165769 - RNA, 18 nt, Streptococcus pneumoniae R6
uuccaaacguggaaacuc

SEQ ID NO: 2165770 - RNA, 18 nt, Streptococcus pneumoniae R6
uuccaaacaacaauacuu

SEQ ID NO: 2165771 - RNA, 21 nt, Streptococcus pneumoniae R6
uuccaaagccacuugcgaguu

SEQ ID NO: 2165772 - RNA, 17 nt, Streptococcus pneumoniae R6
uuccaaaguucgaaagg

SEQ ID NO: 2165773 - RNA, 15 nt, Streptococcus pneumoniae R6
uuccaaauuagaaaa

SEQ ID NO: 2165774 - RNA, 17 nt, Streptococcus pneumoniae R6
uuccaaauuagaaaaag

SEQ ID NO: 2165775 - RNA, 19 nt, Streptococcus pneumoniae R6
uuccaaauuagaaaaagac

SEQ ID NO: 2165776 - RNA, 19 nt, Streptococcus pneumoniae R6
uuccaaaucuuuggaggca

SEQ ID NO: 2165777 - RNA, 21 nt, Streptococcus pneumoniae R6
uuccaagcgaugauauccugu

SEQ ID NO: 2165778 - RNA, 18 nt, Streptococcus pneumoniae R6
uuccaagguagcaacagc

SEQ ID NO: 2165779 - RNA, 17 nt, Streptococcus pneumoniae R6
uuccaauaauagaaaac

SEQ ID NO: 2165780 - RNA, 13 nt, Streptococcus pneumoniae R6
uuccaauaauuca

SEQ ID NO: 2165781 - RNA, 20 nt, Streptococcus pneumoniae R6
uuccaagaccuuaaacuugu

SEQ ID NO: 2165782 - RNA, 21 nt, Streptococcus pneumoniae R6
uuccagauugugccccugaua

SEQ ID NO: 2165783 - RNA, 17 nt, Streptococcus pneumoniae R6
uuccagcguugcgauuu

SEQ ID NO: 2165784 - RNA, 19 nt, Streptococcus pneumoniae R6
uuccagugauuuggaagua

SEQ ID NO: 2165785 - RNA, 20 nt, Streptococcus pneumoniae R6
uuccauccacaaccuuaaaa

SEQ ID NO: 2165786 - RNA, 22 nt, Streptococcus pneumoniae R6
uuccauaugauucuuucuaaug

SEQ ID NO: 2165787 - RNA, 21 nt, Streptococcus pneumoniae R6
uuccauauccgacuugguaaa

SEQ ID NO: 2165788 - RNA, 21 nt, Streptococcus pneumoniae R6
uuccauuucagaagaaaauga

SEQ ID NO: 2165789 - RNA, 15 nt, Streptococcus pneumoniae R6
uuccauuuaacaaac

SEQ ID NO: 2165790 - RNA, 16 nt, Streptococcus pneumoniae R6
uuccauuuaacaaacc

SEQ ID NO: 2165791 - RNA, 19 nt, Streptococcus pneumoniae R6
uuccauuggaguaugcucg

SEQ ID NO: 2165792 - RNA, 12 nt, Streptococcus pneumoniae R6
uuccaucugcag

SEQ ID NO: 2165793 - RNA, 22 nt, Streptococcus pneumoniae R6
uuccaucugcagccucaaaaca

SEQ ID NO: 2165794 - RNA, 22 nt, Streptococcus pneumoniae R6
uuccaucuacaaccuuaaaaca

SEQ ID NO: 2165795 - RNA, 16 nt, Streptococcus pneumoniae R6
uuccaugucaauuuuu

SEQ ID NO: 2165796 - RNA, 15 nt, Streptococcus pneumoniae R6
uuccauuuuccauga

SEQ ID NO: 2165797 - RNA, 14 nt, Streptococcus pneumoniae R6
uuccauuuacagaa

SEQ ID NO: 2165798 - RNA, 14 nt, Streptococcus pneumoniae R6
uucccaaacaaaaa

SEQ ID NO: 2165799 - RNA, 12 nt, Streptococcus pneumoniae R6
uucccaacguga

SEQ ID NO: 2165800 - RNA, 18 nt, Streptococcus pneumoniae R6
uucccaccuuuucucaau

SEQ ID NO: 2165801 - RNA, 15 nt, Streptococcus pneumoniae R6
uucccacaauaaaac

SEQ ID NO: 2165802 - RNA, 19 nt, Streptococcus pneumoniae R6
uucccaucucgugaauaga

SEQ ID NO: 2165803 - RNA, 15 nt, Streptococcus pneumoniae R6
uucccagacuuuuuu

SEQ ID NO: 2165804 - RNA, 15 nt, Streptococcus pneumoniae R6
uucccguaucuuuga

SEQ ID NO: 2165805 - RNA, 17 nt, Streptococcus pneumoniae R6
uucccugccucauaucu

SEQ ID NO: 2165806 - RNA, 15 nt, Streptococcus pneumoniae R6
uucccuuugauagca

SEQ ID NO: 2165807 - RNA, 22 nt, Streptococcus pneumoniae R6
uuccgaaacuagcauccauccc

SEQ ID NO: 2165808 - RNA, 15 nt, Streptococcus pneumoniae R6
uucccuccuuuugug

SEQ ID NO: 2165809 - RNA, 13 nt, Streptococcus pneumoniae R6
uuccgcacucagg

SEQ ID NO: 2165810 - RNA, 16 nt, Streptococcus pneumoniae R6
uuccgccaucuuguuu

SEQ ID NO: 2165811 - RNA, 16 nt, Streptococcus pneumoniae R6
uuccgcuaacguuuuu

SEQ ID NO: 2165812 - RNA, 18 nt, Streptococcus pneumoniae R6
uucgcaucuuauuucaau

SEQ ID NO: 2165813 - RNA, 23 nt, Streptococcus pneumoniae R6
uucggagaagaaaacagaaaaau

SEQ ID NO: 2165814 - RNA, 16 nt, Streptococcus pneumoniae R6
uucgcuguuaaagcca

SEQ ID NO: 2165815 - RNA, 16 nt, Streptococcus pneumoniae R6
uucgcucuucaaucuu

SEQ ID NO: 2165816 - RNA, 18 nt, Streptococcus pneumoniae R6
uucgauuuaucuguuugu

SEQ ID NO: 2165817 - RNA, 19 nt, Streptococcus pneumoniae R6
uucgauugaaauucgcuuu

SEQ ID NO: 2165818 - RNA, 18 nt, Streptococcus pneumoniae R6
uucgauguuacagacaaa

SEQ ID NO: 2165819 - RNA, 18 nt, Streptococcus pneumoniae R6
uucgaugaaucauuuccu

SEQ ID NO: 2165820 - RNA, 18 nt, Streptococcus pneumoniae R6
uucgacuaauuuggaaau

SEQ ID NO: 2165821 - RNA, 21 nt, Streptococcus pneumoniae R6
uucgacuaauuuggaaauaag

SEQ ID NO: 2165822 - RNA, 21 nt, Streptococcus pneumoniae R6
uucgacugaaaauauuucgcu

SEQ ID NO: 2165823 - RNA, 22 nt, Streptococcus pneumoniae R6
uucgaagaguauaaaaacucuc

SEQ ID NO: 2165824 - RNA, 19 nt, Streptococcus pneumoniae R6
uuccugcucaaaauaacca

SEQ ID NO: 2165825 - RNA, 22 nt, Streptococcus pneumoniae R6
uuccuggaaucagaacacuucc

SEQ ID NO: 2165826 - RNA, 14 nt, Streptococcus pneumoniae R6
uuccugcaaaacua

SEQ ID NO: 2165827 - RNA, 16 nt, Streptococcus pneumoniae R6
uuccugauuaaaauca

SEQ ID NO: 2165828 - RNA, 15 nt, Streptococcus pneumoniae R6
uuccuuaugcauaau

SEQ ID NO: 2165829 - RNA, 15 nt, Streptococcus pneumoniae R6
uuccuuacuagcaaa

SEQ ID NO: 2165830 - RNA, 22 nt, Streptococcus pneumoniae R6
uuccuuaaacgacuagauaaaa

SEQ ID NO: 2165831 - RNA, 14 nt, Streptococcus pneumoniae R6
uuccuuaacaaucu

SEQ ID NO: 2165832 - RNA, 16 nt, Streptococcus pneumoniae R6
uuccuuaacaaucuua

SEQ ID NO: 2165833 - RNA, 18 nt, Streptococcus pneumoniae R6
uuccuguuguauuuauau

SEQ ID NO: 2165834 - RNA, 21 nt, Streptococcus pneumoniae R6
uuccuguguacuguucuaaau

SEQ ID NO: 2165835 - RNA, 13 nt, Streptococcus pneumoniae R6
uuccuuuccuaau

SEQ ID NO: 2165836 - RNA, 16 nt, Streptococcus pneumoniae R6
uuccuuucaaaauauc

SEQ ID NO: 2165837 - RNA, 17 nt, Streptococcus pneumoniae R6
uuccuuucaaaauaucu

SEQ ID NO: 2165838 - RNA, 21 nt, Streptococcus pneumoniae R6
uucgaaaaucucugcaaacca

SEQ ID NO: 2165839 - RNA, 19 nt, Streptococcus pneumoniae R6
uucgaaaagaauuaggaaa

SEQ ID NO: 2165840 - RNA, 14 nt, Streptococcus pneumoniae R6
uuccuuuuuucuau

SEQ ID NO: 2165841 - RNA, 17 nt, Streptococcus pneumoniae R6
uuccuuuuuuuacauca

SEQ ID NO: 2165842 - RNA, 15 nt, Streptococcus pneumoniae R6
uuccuucauuuccaa

SEQ ID NO: 2165843 - RNA, 16 nt, Streptococcus pneumoniae R6
uuccuuauucugaaag

SEQ ID NO: 2165844 - RNA, 13 nt, Streptococcus pneumoniae R6
uuccuuuaaaaac

SEQ ID NO: 2165845 - RNA, 14 nt, Streptococcus pneumoniae R6
uuccuuuaaaaaca

SEQ ID NO: 2165846 - RNA, 14 nt, Streptococcus pneumoniae R6
uuccuuuaaaauga

SEQ ID NO: 2165847 - RNA, 20 nt, Streptococcus pneumoniae R6
uuccuugguguacuugagac

SEQ ID NO: 2165848 - RNA, 22 nt, Streptococcus pneumoniae R6
uuccuaaucgauuuguucauau

SEQ ID NO: 2165849 - RNA, 16 nt, Streptococcus pneumoniae R6
uuccuaagauauuaag

SEQ ID NO: 2165850 - RNA, 22 nt, Streptococcus pneumoniae R6
uuccuaaaauaacacuccauuu

SEQ ID NO: 2165851 - RNA, 12 nt, Streptococcus pneumoniae R6
uuccuaaaacag

SEQ ID NO: 2165852 - RNA, 17 nt, Streptococcus pneumoniae R6
uuccucaacaaaauguu

SEQ ID NO: 2165853 - RNA, 13 nt, Streptococcus pneumoniae R6
uuccuaugauuaa

SEQ ID NO: 2165854 - RNA, 22 nt, Streptococcus pneumoniae R6
uuccucauuuugaagauuguuu

SEQ ID NO: 2165855 - RNA, 15 nt, Streptococcus pneumoniae R6
uuccucagcaggagc

SEQ ID NO: 2165856 - RNA, 13 nt, Streptococcus pneumoniae R6
uuccuacuucaaa

SEQ ID NO: 2165857 - RNA, 20 nt, Streptococcus pneumoniae R6
uuccuacauauguaagaaga

SEQ ID NO: 2165858 - RNA, 20 nt, Streptococcus pneumoniae R6
uuccucccugcgacaaaauu

SEQ ID NO: 2165859 - RNA, 23 nt, Streptococcus pneumoniae R6
uuccucuugauuuuuuuuaaaaa

SEQ ID NO: 2165860 - RNA, 17 nt, Streptococcus pneumoniae R6
uuccugaaauaaaaugc

SEQ ID NO: 2165861 - RNA, 22 nt, Streptococcus pneumoniae R6
uugcuaggcguucucugagacc

SEQ ID NO: 2165862 - RNA, 14 nt, Streptococcus pneumoniae R6
uugcucuauacaca

SEQ ID NO: 2165863 - RNA, 14 nt, Streptococcus pneumoniae R6
uugcucuucugaaa

SEQ ID NO: 2165864 - RNA, 16 nt, Streptococcus pneumoniae R6
uugcucuucugaaauc

SEQ ID NO: 2165865 - RNA, 14 nt, Streptococcus pneumoniae R6
uugcuccauucuuu

SEQ ID NO: 2165866 - RNA, 19 nt, Streptococcus pneumoniae R6
uugcuccauucuuuuacuu

SEQ ID NO: 2165867 - RNA, 15 nt, Streptococcus pneumoniae R6
uugcgauuuugccaa

SEQ ID NO: 2165868 - RNA, 12 nt, Streptococcus pneumoniae R6
uugcgaugauga

SEQ ID NO: 2165869 - RNA, 15 nt, Streptococcus pneumoniae R6
uugcgcagccuuuaa

SEQ ID NO: 2165870 - RNA, 17 nt, Streptococcus pneumoniae R6
uugccuuagcaacuguu

SEQ ID NO: 2165871 - RNA, 17 nt, Streptococcus pneumoniae R6
uugcggaauucaaacca

SEQ ID NO: 2165872 - RNA, 20 nt, Streptococcus pneumoniae R6
uugccucagauucugacaau

SEQ ID NO: 2165873 - RNA, 20 nt, Streptococcus pneumoniae R6
uugccucaauaucuucugcu

SEQ ID NO: 2165874 - RNA, 18 nt, Streptococcus pneumoniae R6
uugccuagcgauuuccau

SEQ ID NO: 2165875 - RNA, 20 nt, Streptococcus pneumoniae R6
uugccuagggugacaguaaa

SEQ ID NO: 2165876 - RNA, 14 nt, Streptococcus pneumoniae R6
uugcauaaaugucg

SEQ ID NO: 2165877 - RNA, 12 nt, Streptococcus pneumoniae R6
uugccaccuuuu

SEQ ID NO: 2165878 - RNA, 16 nt, Streptococcus pneumoniae R6
uugcauagacuucaac

SEQ ID NO: 2165879 - RNA, 23 nt, Streptococcus pneumoniae R6
uugcauagcgaagaacaauaauc

SEQ ID NO: 2165880 - RNA, 14 nt, Streptococcus pneumoniae R6
uuggaaguuuuccu

SEQ ID NO: 2165881 - RNA, 16 nt, Streptococcus pneumoniae R6
uuggaauaaggcagcu

SEQ ID NO: 2165882 - RNA, 20 nt, Streptococcus pneumoniae R6
uuggaauaguccucccuucu

SEQ ID NO: 2165883 - RNA, 14 nt, Streptococcus pneumoniae R6
uuggaauaguugaa

SEQ ID NO: 2165884 - RNA, 19 nt, Streptococcus pneumoniae R6
uuggaauaguugaaaucaa

SEQ ID NO: 2165885 - RNA, 16 nt, Streptococcus pneumoniae R6
uuggaagucaaaucaa

SEQ ID NO: 2165886 - RNA, 13 nt, Streptococcus pneumoniae R6
uuggauacaagga

SEQ ID NO: 2165887 - RNA, 17 nt, Streptococcus pneumoniae R6
uuggauaaguuuagaau

SEQ ID NO: 2165888 - RNA, 17 nt, Streptococcus pneumoniae R6
uuggauuaugaaaaauc

SEQ ID NO: 2165889 - RNA, 20 nt, Streptococcus pneumoniae R6
uuggauauaggaggguuggc

SEQ ID NO: 2165890 - RNA, 17 nt, Streptococcus pneumoniae R6
uuggauccaauuucuaa

SEQ ID NO: 2165891 - RNA, 13 nt, Streptococcus pneumoniae R6
uuggauuuaaaaa

SEQ ID NO: 2165892 - RNA, 14 nt, Streptococcus pneumoniae R6
uuggcaaaguuuuu

SEQ ID NO: 2165893 - RNA, 18 nt, Streptococcus pneumoniae R6
uuggcaaauugauaagga

SEQ ID NO: 2165894 - RNA, 14 nt, Streptococcus pneumoniae R6
uuggcaaccaaguc

SEQ ID NO: 2165895 - RNA, 22 nt, Streptococcus pneumoniae R6
uuggcacaccacgaaguccuug

SEQ ID NO: 2165896 - RNA, 14 nt, Streptococcus pneumoniae R6
uuggcaauucaauu

SEQ ID NO: 2165897 - RNA, 11 nt, Streptococcus pneumoniae R6
uuggcaagagc

SEQ ID NO: 2165898 - RNA, 18 nt, Streptococcus pneumoniae R6
uugcuugaccagcuacug

SEQ ID NO: 2165899 - RNA, 12 nt, Streptococcus pneumoniae R6
uugcuuguucca

SEQ ID NO: 2165900 - RNA, 14 nt, Streptococcus pneumoniae R6
uugcuuguuccaau

SEQ ID NO: 2165901 - RNA, 16 nt, Streptococcus pneumoniae R6
uuggaacguguucaau

SEQ ID NO: 2165902 - RNA, 14 nt, Streptococcus pneumoniae R6
uuggaacuaaaguu

SEQ ID NO: 2165903 - RNA, 13 nt, Streptococcus pneumoniae R6
uuggaagaaaucc

SEQ ID NO: 2165904 - RNA, 13 nt, Streptococcus pneumoniae R6
uuggaaacuuuuu

SEQ ID NO: 2165905 - RNA, 22 nt, Streptococcus pneumoniae R6
uuggaaauaacaaaccaagaau

SEQ ID NO: 2165906 - RNA, 12 nt, Streptococcus pneumoniae R6
uuggcuucagua

SEQ ID NO: 2165907 - RNA, 15 nt, Streptococcus pneumoniae R6
uugggaaauucuaau

SEQ ID NO: 2165908 - RNA, 16 nt, Streptococcus pneumoniae R6
uugggaaauucuaauu

SEQ ID NO: 2165909 - RNA, 17 nt, Streptococcus pneumoniae R6
uuggggggcaguucaua

SEQ ID NO: 2165910 - RNA, 23 nt, Streptococcus pneumoniae R6
uugggacagaaaugcccaauucu

SEQ ID NO: 2165911 - RNA, 18 nt, Streptococcus pneumoniae R6
uuggcccuaccugcucca

SEQ ID NO: 2165912 - RNA, 21 nt, Streptococcus pneumoniae R6
uugggucguaaaccuucaaga

SEQ ID NO: 2165913 - RNA, 14 nt, Streptococcus pneumoniae R6
uugggucuguuuuu

SEQ ID NO: 2165914 - RNA, 24 nt, Streptococcus pneumoniae R6
uuggucauuaaauuuuuuucucaa

SEQ ID NO: 2165915 - RNA, 19 nt, Streptococcus pneumoniae R6
uugguaauagaucucuacu

SEQ ID NO: 2165916 - RNA, 15 nt, Streptococcus pneumoniae R6
uuggucgcuuccaau

SEQ ID NO: 2165917 - RNA, 19 nt, Streptococcus pneumoniae R6
uuggucgcuuccaauuugg

SEQ ID NO: 2165918 - RNA, 16 nt, Streptococcus pneumoniae R6
uugguugauuuaccau

SEQ ID NO: 2165919 - RNA, 17 nt, Streptococcus pneumoniae R6
uugguugcuacaucuuc

SEQ ID NO: 2165920 - RNA, 22 nt, Streptococcus pneumoniae R6
uugguugcuacaucuucuccaa

SEQ ID NO: 2165921 - RNA, 17 nt, Streptococcus pneumoniae R6
uuggugaacguggucca

SEQ ID NO: 2165922 - RNA, 16 nt, Streptococcus pneumoniae R6
uugguuuuucuucagc

SEQ ID NO: 2165923 - RNA, 12 nt, Streptococcus pneumoniae R6
uuuaacaaacca

SEQ ID NO: 2165924 - RNA, 14 nt, Streptococcus pneumoniae R6
uuuaagaaaucaua

SEQ ID NO: 2165925 - RNA, 13 nt, Streptococcus pneumoniae R6
uuuaagcaaaaaa

SEQ ID NO: 2165926 - RNA, 15 nt, Streptococcus pneumoniae R6
uuuaagcaaaaaaag

SEQ ID NO: 2165927 - RNA, 15 nt, Streptococcus pneumoniae R6
uuuaaauucauuaaa

SEQ ID NO: 2165928 - RNA, 18 nt, Streptococcus pneumoniae R6
uuuaaauucauuuacucu

SEQ ID NO: 2165929 - RNA, 21 nt, Streptococcus pneumoniae R6
uuuaaauuuuucugcaaaaaa

SEQ ID NO: 2165930 - RNA, 13 nt, Streptococcus pneumoniae R6
uuuaaauuuacuu

SEQ ID NO: 2165931 - RNA, 17 nt, Streptococcus pneumoniae R6
uuuaaaggucaauuccu

SEQ ID NO: 2165932 - RNA, 15 nt, Streptococcus pneumoniae R6
uuuaaaguaaucucu

SEQ ID NO: 2165933 - RNA, 19 nt, Streptococcus pneumoniae R6
uuuaaagucucugucccau

SEQ ID NO: 2165934 - RNA, 20 nt, Streptococcus pneumoniae R6
uuuaaagacagucugaaaaa

SEQ ID NO: 2165935 - RNA, 23 nt, Streptococcus pneumoniae R6
uuuaaagacagucugaaaaagag

SEQ ID NO: 2165936 - RNA, 22 nt, Streptococcus pneumoniae R6
uuuaaagacagucugaaaaaua

SEQ ID NO: 2165937 - RNA, 19 nt, Streptococcus pneumoniae R6
uuuaaaaaaucuuuuucau

SEQ ID NO: 2165938 - RNA, 14 nt, Streptococcus pneumoniae R6
uuuaaaaacaauca

SEQ ID NO: 2165939 - RNA, 17 nt, Streptococcus pneumoniae R6
uuuaaaaagaaauauau

SEQ ID NO: 2165940 - RNA, 18 nt, Streptococcus pneumoniae R6
uuuaaaauguugggcaga

SEQ ID NO: 2165941 - RNA, 14 nt, Streptococcus pneumoniae R6
uuuaaaaucuggac

SEQ ID NO: 2165942 - RNA, 16 nt, Streptococcus pneumoniae R6
uuguuuguacuuguuc

SEQ ID NO: 2165943 - RNA, 12 nt, Streptococcus pneumoniae R6
uuuaaaaaaacu

SEQ ID NO: 2165944 - RNA, 12 nt, Streptococcus pneumoniae R6
uuuaaaaaagug

SEQ ID NO: 2165945 - RNA, 23 nt, Streptococcus pneumoniae R6
uuuaaacuaguuuucuaaagaau

SEQ ID NO: 2165946 - RNA, 18 nt, Streptococcus pneumoniae R6
uuuaaaccacgucaguuu

SEQ ID NO: 2165947 - RNA, 17 nt, Streptococcus pneumoniae R6
uuuaaaauuaaaaagag

SEQ ID NO: 2165948 - RNA, 14 nt, Streptococcus pneumoniae R6
uuuaaaauuacucc

SEQ ID NO: 2165949 - RNA, 23 nt, Streptococcus pneumoniae R6
uuuaagguuguagauggaacuga

SEQ ID NO: 2165950 - RNA, 21 nt, Streptococcus pneumoniae R6
uuuaagguuguggauggaacu

SEQ ID NO: 2165951 - RNA, 23 nt, Streptococcus pneumoniae R6
uuuaagguuguggauggaacuga

SEQ ID NO: 2165952 - RNA, 14 nt, Streptococcus pneumoniae R6
uuuaauauaagaau

SEQ ID NO: 2165953 - RNA, 15 nt, Streptococcus pneumoniae R6
uuuaauauauaaaaa

SEQ ID NO: 2165954 - RNA, 18 nt, Streptococcus pneumoniae R6
uuuaauauauaaaaaaua

SEQ ID NO: 2165955 - RNA, 17 nt, Streptococcus pneumoniae R6
uuuaaugaccagaauag

SEQ ID NO: 2165956 - RNA, 23 nt, Streptococcus pneumoniae R6
uuuaaucuugacuauauuucuua

SEQ ID NO: 2165957 - RNA, 15 nt, Streptococcus pneumoniae R6
uuuaaugcaguaaau

SEQ ID NO: 2165958 - RNA, 19 nt, Streptococcus pneumoniae R6
uuuaaugcaguaaaucaua

SEQ ID NO: 2165959 - RNA, 19 nt, Streptococcus pneumoniae R6
uuuaaugcuaauuuagaaa

SEQ ID NO: 2165960 - RNA, 15 nt, Streptococcus pneumoniae R6
uuuaauauuucccca

SEQ ID NO: 2165961 - RNA, 16 nt, Streptococcus pneumoniae R6
uuuaaucgauuauuuu

SEQ ID NO: 2165962 - RNA, 16 nt, Streptococcus pneumoniae R6
uuuaauccaaaguaaa

SEQ ID NO: 2165963 - RNA, 15 nt, Streptococcus pneumoniae R6
uuuacaauguuguca

SEQ ID NO: 2165964 - RNA, 16 nt, Streptococcus pneumoniae R6
uuuacaagugaaguaa

SEQ ID NO: 2165965 - RNA, 18 nt, Streptococcus pneumoniae R6
uuuacaauaucuccagaa

SEQ ID NO: 2165966 - RNA, 14 nt, Streptococcus pneumoniae R6
uuuaccauccugaa

SEQ ID NO: 2165967 - RNA, 17 nt, Streptococcus pneumoniae R6
uuuaccaauuuuuccuu

SEQ ID NO: 2165968 - RNA, 19 nt, Streptococcus pneumoniae R6
uuguaaaggguucuacaaa

SEQ ID NO: 2165969 - RNA, 23 nt, Streptococcus pneumoniae R6
uuguaaagcgaaaggagaaaaau

SEQ ID NO: 2165970 - RNA, 16 nt, Streptococcus pneumoniae R6
uuguaaacugugaugg

SEQ ID NO: 2165971 - RNA, 20 nt, Streptococcus pneumoniae R6
uuguaacuagcugccuaguu

SEQ ID NO: 2165972 - RNA, 16 nt, Streptococcus pneumoniae R6
uuguagaugaaacuga

SEQ ID NO: 2165973 - RNA, 14 nt, Streptococcus pneumoniae R6
uuguagauggaacu

SEQ ID NO: 2165974 - RNA, 14 nt, Streptococcus pneumoniae R6
uuguaaccuuuuug

SEQ ID NO: 2165975 - RNA, 21 nt, Streptococcus pneumoniae R6
uuguagcccuucauaaaggaa

SEQ ID NO: 2165976 - RNA, 20 nt, Streptococcus pneumoniae R6
uuguaggcuuucaacugcuu

SEQ ID NO: 2165977 - RNA, 13 nt, Streptococcus pneumoniae R6
uuguagucugcug

SEQ ID NO: 2165978 - RNA, 14 nt, Streptococcus pneumoniae R6
uuguagucugcugc

SEQ ID NO: 2165979 - RNA, 22 nt, Streptococcus pneumoniae R6
uuguaguucgugccaaucucaa

SEQ ID NO: 2165980 - RNA, 14 nt, Streptococcus pneumoniae R6
uuguaguucucaau

SEQ ID NO: 2165981 - RNA, 19 nt, Streptococcus pneumoniae R6
uuguccuuuagaaagguuu

SEQ ID NO: 2165982 - RNA, 20 nt, Streptococcus pneumoniae R6
uuguccuuuagaaagguuuu

SEQ ID NO: 2165983 - RNA, 13 nt, Streptococcus pneumoniae R6
uuguccuuucuuu

SEQ ID NO: 2165984 - RNA, 21 nt, Streptococcus pneumoniae R6
uuguccuguguaagugacaaa

SEQ ID NO: 2165985 - RNA, 14 nt, Streptococcus pneumoniae R6
uuguccugaaugau

SEQ ID NO: 2165986 - RNA, 16 nt, Streptococcus pneumoniae R6
uuguccuaaauagaag

SEQ ID NO: 2165987 - RNA, 11 nt, Streptococcus pneumoniae R6
uuguauuuaua

SEQ ID NO: 2165988 - RNA, 23 nt, Streptococcus pneumoniae R6
uugucaaacaagaccucaauaug

SEQ ID NO: 2165989 - RNA, 15 nt, Streptococcus pneumoniae R6
uugucaauuuccauu

SEQ ID NO: 2165990 - RNA, 17 nt, Streptococcus pneumoniae R6
uugucaauuuccauuua

SEQ ID NO: 2165991 - RNA, 15 nt, Streptococcus pneumoniae R6
uugucaaguuuggac

SEQ ID NO: 2165992 - RNA, 18 nt, Streptococcus pneumoniae R6
uugucuucaaaggucaaa

SEQ ID NO: 2165993 - RNA, 11 nt, Streptococcus pneumoniae R6
uugucuguaac

SEQ ID NO: 2165994 - RNA, 13 nt, Streptococcus pneumoniae R6
uuguguucuacuc

SEQ ID NO: 2165995 - RNA, 16 nt, Streptococcus pneumoniae R6
uugugguugaaaacaa

SEQ ID NO: 2165996 - RNA, 19 nt, Streptococcus pneumoniae R6
uuguggggccagaauaauu

SEQ ID NO: 2165997 - RNA, 22 nt, Streptococcus pneumoniae R6
uugugggaagauguauaaugga

SEQ ID NO: 2165998 - RNA, 22 nt, Streptococcus pneumoniae R6
uugugagaaauugguuugaauu

SEQ ID NO: 2165999 - RNA, 18 nt, Streptococcus pneumoniae R6
uugugaaagcucuucuaa

SEQ ID NO: 2166000 - RNA, 20 nt, Streptococcus pneumoniae R6
uugugaauuauaguagaguu

SEQ ID NO: 2166001 - RNA, 14 nt, Streptococcus pneumoniae R6
uuguuuauaaaaua

SEQ ID NO: 2166002 - RNA, 12 nt, Streptococcus pneumoniae R6
uuguuucuuauc

SEQ ID NO: 2166003 - RNA, 12 nt, Streptococcus pneumoniae R6
uuguuuccaugc

SEQ ID NO: 2166004 - RNA, 14 nt, Streptococcus pneumoniae R6
uuguuucguuucuu

SEQ ID NO: 2166005 - RNA, 14 nt, Streptococcus pneumoniae R6
uuguucacaucuua

SEQ ID NO: 2166006 - RNA, 22 nt, Streptococcus pneumoniae R6
uuguucuuguuucaauugacua

SEQ ID NO: 2166007 - RNA, 20 nt, Streptococcus pneumoniae R6
uuguucuuuagaaagguuuu

SEQ ID NO: 2166008 - RNA, 19 nt, Streptococcus pneumoniae R6
uugaaugcucccuucuuua

SEQ ID NO: 2166009 - RNA, 18 nt, Streptococcus pneumoniae R6
uugaaugcuuacuucacu

SEQ ID NO: 2166010 - RNA, 13 nt, Streptococcus pneumoniae R6
uugaauguacugc

SEQ ID NO: 2166011 - RNA, 22 nt, Streptococcus pneumoniae R6
uugaauguacugcccccaaaca

SEQ ID NO: 2166012 - RNA, 13 nt, Streptococcus pneumoniae R6
uugaauguccuug

SEQ ID NO: 2166013 - RNA, 14 nt, Streptococcus pneumoniae R6
uugaauguccuuga

SEQ ID NO: 2166014 - RNA, 14 nt, Streptococcus pneumoniae R6
uugaauguugaaac

SEQ ID NO: 2166015 - RNA, 18 nt, Streptococcus pneumoniae R6
uugaaugccaaaauucca

SEQ ID NO: 2166016 - RNA, 19 nt, Streptococcus pneumoniae R6
uugaaugccuguuccaaca

SEQ ID NO: 2166017 - RNA, 15 nt, Streptococcus pneumoniae R6
uugaagaaaagcuaa

SEQ ID NO: 2166018 - RNA, 18 nt, Streptococcus pneumoniae R6
uugaagaaaagcuaagcu

SEQ ID NO: 2166019 - RNA, 13 nt, Streptococcus pneumoniae R6
uugacaaaguuug

SEQ ID NO: 2166020 - RNA, 17 nt, Streptococcus pneumoniae R6
uugacaaaguuugaaaa

SEQ ID NO: 2166021 - RNA, 15 nt, Streptococcus pneumoniae R6
uugacaaagaaaaaa

SEQ ID NO: 2166022 - RNA, 18 nt, Streptococcus pneumoniae R6
uugacaaagaaaaaacaa

SEQ ID NO: 2166023 - RNA, 11 nt, Streptococcus pneumoniae R6
uugacaaagag

SEQ ID NO: 2166024 - RNA, 20 nt, Streptococcus pneumoniae R6
uugacaaagagccaaaaaag

SEQ ID NO: 2166025 - RNA, 22 nt, Streptococcus pneumoniae R6
uugacaaagagccaaaaaagaa

SEQ ID NO: 2166026 - RNA, 23 nt, Streptococcus pneumoniae R6
uugacaaagagccacucuuuauu

SEQ ID NO: 2166027 - RNA, 20 nt, Streptococcus pneumoniae R6
uugacaaagagccauaaaaa

SEQ ID NO: 2166028 - RNA, 20 nt, Streptococcus pneumoniae R6
uugacaaagagccuauaaaa

SEQ ID NO: 2166029 - RNA, 18 nt, Streptococcus pneumoniae R6
uugacuuccaaaauuaaa

SEQ ID NO: 2166030 - RNA, 18 nt, Streptococcus pneumoniae R6
uugagaacuuucuuuuuu

SEQ ID NO: 2166031 - RNA, 17 nt, Streptococcus pneumoniae R6
uugagaaagcacuugcu

SEQ ID NO: 2166032 - RNA, 19 nt, Streptococcus pneumoniae R6
uugagaaagcacuugcuuu

SEQ ID NO: 2166033 - RNA, 17 nt, Streptococcus pneumoniae R6
uugagaaaguuaaaaaa

SEQ ID NO: 2166034 - RNA, 19 nt, Streptococcus pneumoniae R6
uugagaaaguuaaaaaaac

SEQ ID NO: 2166035 - RNA, 21 nt, Streptococcus pneumoniae R6
uugagaaaguuaaaaaaacua

SEQ ID NO: 2166036 - RNA, 13 nt, Streptococcus pneumoniae R6
uugagaaaauaug

SEQ ID NO: 2166037 - RNA, 18 nt, Streptococcus pneumoniae R6
uugacgagugaagaauug

SEQ ID NO: 2166038 - RNA, 15 nt, Streptococcus pneumoniae R6
uugacgauauuucca

SEQ ID NO: 2166039 - RNA, 13 nt, Streptococcus pneumoniae R6
uugacgauuuucu

SEQ ID NO: 2166040 - RNA, 16 nt, Streptococcus pneumoniae R6
uugacgauuuucucuu

SEQ ID NO: 2166041 - RNA, 14 nt, Streptococcus pneumoniae R6
uugacgauuuuuuc

SEQ ID NO: 2166042 - RNA, 14 nt, Streptococcus pneumoniae R6
uugaaacuagaaca

SEQ ID NO: 2166043 - RNA, 18 nt, Streptococcus pneumoniae R6
uugaaacuggaauaguac

SEQ ID NO: 2166044 - RNA, 16 nt, Streptococcus pneumoniae R6
uugaaagucauauuuc

SEQ ID NO: 2166045 - RNA, 15 nt, Streptococcus pneumoniae R6
uugaaauaagaauac

SEQ ID NO: 2166046 - RNA, 19 nt, Streptococcus pneumoniae R6
uugaaauaagaugagaaca

SEQ ID NO: 2166047 - RNA, 14 nt, Streptococcus pneumoniae R6
uugaaauaauagac

SEQ ID NO: 2166048 - RNA, 22 nt, Streptococcus pneumoniae R6
uugaacauuacuacuaucccuu

SEQ ID NO: 2166049 - RNA, 15 nt, Streptococcus pneumoniae R6
uugaaacaaugaaaa

SEQ ID NO: 2166050 - RNA, 23 nt, Streptococcus pneumoniae R6
uugaaaccaguuccuuugucuuu

SEQ ID NO: 2166051 - RNA, 20 nt, Streptococcus pneumoniae R6
uugaaaaacuagaauagaaa

SEQ ID NO: 2166052 - RNA, 21 nt, Streptococcus pneumoniae R6
uucuuuuuuuacuaaaauaac

SEQ ID NO: 2166053 - RNA, 16 nt, Streptococcus pneumoniae R6
uugaaaaaauggacuu

SEQ ID NO: 2166054 - RNA, 16 nt, Streptococcus pneumoniae R6
uugaaaaaauaucuuu

SEQ ID NO: 2166055 - RNA, 21 nt, Streptococcus pneumoniae R6
uugaaaaaauaucuuuuauuu

SEQ ID NO: 2166056 - RNA, 15 nt, Streptococcus pneumoniae R6
uucuuuuuuauucaa

SEQ ID NO: 2166057 - RNA, 17 nt, Streptococcus pneumoniae R6
uucuuuuuuauucaaug

SEQ ID NO: 2166058 - RNA, 17 nt, Streptococcus pneumoniae R6
uucuuuuuugauguuca

SEQ ID NO: 2166059 - RNA, 19 nt, Streptococcus pneumoniae R6
uucuuuuuguauuucuucu

SEQ ID NO: 2166060 - RNA, 20 nt, Streptococcus pneumoniae R6
uucuuuuuuaauucuuuuuc

SEQ ID NO: 2166061 - RNA, 15 nt, Streptococcus pneumoniae R6
uucuuuuugauuuau

SEQ ID NO: 2166062 - RNA, 11 nt, Streptococcus pneumoniae R6
uucuuuuucag

SEQ ID NO: 2166063 - RNA, 15 nt, Streptococcus pneumoniae R6
uucuuuuucagaacu

SEQ ID NO: 2166064 - RNA, 15 nt, Streptococcus pneumoniae R6
uucuugauuuguucu

SEQ ID NO: 2166065 - RNA, 16 nt, Streptococcus pneumoniae R6
uucuuggaauucugga

SEQ ID NO: 2166066 - RNA, 16 nt, Streptococcus pneumoniae R6
uucuuggguuucuucu

SEQ ID NO: 2166067 - RNA, 18 nt, Streptococcus pneumoniae R6
uucuuggauaccuuuaga

SEQ ID NO: 2166068 - RNA, 12 nt, Streptococcus pneumoniae R6
uucuugguauug

SEQ ID NO: 2166069 - RNA, 16 nt, Streptococcus pneumoniae R6
uucuuggucauuugag

SEQ ID NO: 2166070 - RNA, 17 nt, Streptococcus pneumoniae R6
uucuugguugccuuuuu

SEQ ID NO: 2166071 - RNA, 18 nt, Streptococcus pneumoniae R6
uugauaugagcccauguu

SEQ ID NO: 2166072 - RNA, 23 nt, Streptococcus pneumoniae R6
uugauaugaugcguuuuauaauu

SEQ ID NO: 2166073 - RNA, 18 nt, Streptococcus pneumoniae R6
uugauaugguaauguucu

SEQ ID NO: 2166074 - RNA, 22 nt, Streptococcus pneumoniae R6
uugauaagauaaaguggucuuu

SEQ ID NO: 2166075 - RNA, 17 nt, Streptococcus pneumoniae R6
uugauaagauaauaaau

SEQ ID NO: 2166076 - RNA, 21 nt, Streptococcus pneumoniae R6
uugauaaccuuaaucaaauua

SEQ ID NO: 2166077 - RNA, 21 nt, Streptococcus pneumoniae R6
uugauaaaggcagauuucaaa

SEQ ID NO: 2166078 - RNA, 18 nt, Streptococcus pneumoniae R6
uugauaaaauuuaaaaau

SEQ ID NO: 2166079 - RNA, 17 nt, Streptococcus pneumoniae R6
uugaguuuuugaagaau

SEQ ID NO: 2166080 - RNA, 17 nt, Streptococcus pneumoniae R6
uugauauucuuaucaaa

SEQ ID NO: 2166081 - RNA, 17 nt, Streptococcus pneumoniae R6
uugauauuggcugcuug

SEQ ID NO: 2166082 - RNA, 20 nt, Streptococcus pneumoniae R6
uugauauuggcugcuugcaa

SEQ ID NO: 2166083 - RNA, 12 nt, Streptococcus pneumoniae R6
uugauauuucca

SEQ ID NO: 2166084 - RNA, 16 nt, Streptococcus pneumoniae R6
uugauauuuauagaaa

SEQ ID NO: 2166085 - RNA, 21 nt, Streptococcus pneumoniae R6
uugaucgaguuauuaacaaaa

SEQ ID NO: 2166086 - RNA, 16 nt, Streptococcus pneumoniae R6
uugagucuuuuuccaa

SEQ ID NO: 2166087 - RNA, 16 nt, Streptococcus pneumoniae R6
uugaguggauuuuuaa

SEQ ID NO: 2166088 - RNA, 22 nt, Streptococcus pneumoniae R6
uugagucaagauaacaguuuuu

SEQ ID NO: 2166089 - RNA, 12 nt, Streptococcus pneumoniae R6
uugaguucacaa

SEQ ID NO: 2166090 - RNA, 17 nt, Streptococcus pneumoniae R6
uugaguugggauaaacg

SEQ ID NO: 2166091 - RNA, 22 nt, Streptococcus pneumoniae R6
uugaguaugaguuaccuaaauu

SEQ ID NO: 2166092 - RNA, 13 nt, Streptococcus pneumoniae R6
uugaguaaguuua

SEQ ID NO: 2166093 - RNA, 22 nt, Streptococcus pneumoniae R6
uugaguaauucuccaauuaaug

SEQ ID NO: 2166094 - RNA, 23 nt, Streptococcus pneumoniae R6
uugagcugacuucgucagucuua

SEQ ID NO: 2166095 - RNA, 23 nt, Streptococcus pneumoniae R6
uugagcugacuucgucaguucca

SEQ ID NO: 2166096 - RNA, 13 nt, Streptococcus pneumoniae R6
uugagcuggcuca

SEQ ID NO: 2166097 - RNA, 11 nt, Streptococcus pneumoniae R6
uugagaagcca

SEQ ID NO: 2166098 - RNA, 18 nt, Streptococcus pneumoniae R6
uugagaagugggagaaaa

SEQ ID NO: 2166099 - RNA, 22 nt, Streptococcus pneumoniae R6
uugagcgcaggaagaaagagga

SEQ ID NO: 2166100 - RNA, 14 nt, Streptococcus pneumoniae R6
uugagcgaaaucaa

SEQ ID NO: 2166101 - RNA, 11 nt, Streptococcus pneumoniae R6
uugagcgaauc

SEQ ID NO: 2166102 - RNA, 19 nt, Streptococcus pneumoniae R6
uugagcuacguucugucaa

SEQ ID NO: 2166103 - RNA, 14 nt, Streptococcus pneumoniae R6
uugauugcuucauc

SEQ ID NO: 2166104 - RNA, 19 nt, Streptococcus pneumoniae R6
uugauucgcucuucaaucu

SEQ ID NO: 2166105 - RNA, 14 nt, Streptococcus pneumoniae R6
uugaugaaaaaaag

SEQ ID NO: 2166106 - RNA, 18 nt, Streptococcus pneumoniae R6
uugaugaaaaaaaguuua

SEQ ID NO: 2166107 - RNA, 18 nt, Streptococcus pneumoniae R6
uugaucugacuucgucag

SEQ ID NO: 2166108 - RNA, 18 nt, Streptococcus pneumoniae R6
uugaugaagaacuggcug

SEQ ID NO: 2166109 - RNA, 16 nt, Streptococcus pneumoniae R6
uugaugaaagauauuu

SEQ ID NO: 2166110 - RNA, 23 nt, Streptococcus pneumoniae R6
uugaucuuccauuucuuuugcaa

SEQ ID NO: 2166111 - RNA, 21 nt, Streptococcus pneumoniae R6
uugaugauauacguuuucuug

SEQ ID NO: 2166112 - RNA, 13 nt, Streptococcus pneumoniae R6
uugcaauucuuuu

SEQ ID NO: 2166113 - RNA, 16 nt, Streptococcus pneumoniae R6
uugcaaucauuucaaa

SEQ ID NO: 2166114 - RNA, 12 nt, Streptococcus pneumoniae R6
uugauuuuaugc

SEQ ID NO: 2166115 - RNA, 15 nt, Streptococcus pneumoniae R6
uugauuuuaaagaaa

SEQ ID NO: 2166116 - RNA, 15 nt, Streptococcus pneumoniae R6
uugauuuaugccaua

SEQ ID NO: 2166117 - RNA, 16 nt, Streptococcus pneumoniae R6
uugauuuaugccauau

SEQ ID NO: 2166118 - RNA, 19 nt, Streptococcus pneumoniae R6
uugauuuccugauuaccaa

SEQ ID NO: 2166119 - RNA, 15 nt, Streptococcus pneumoniae R6
uugauuugauuagga

SEQ ID NO: 2166120 - RNA, 17 nt, Streptococcus pneumoniae R6
uugauuuuguaaaaaua

SEQ ID NO: 2166121 - RNA, 18 nt, Streptococcus pneumoniae R6
uugauuuccaaaaaguag

SEQ ID NO: 2166122 - RNA, 13 nt, Streptococcus pneumoniae R6
uugauuuucauug

SEQ ID NO: 2166123 - RNA, 20 nt, Streptococcus pneumoniae R6
uugcaagcccuuauuuccau

SEQ ID NO: 2166124 - RNA, 19 nt, Streptococcus pneumoniae R6
uugcaaaaagacuuagcaa

SEQ ID NO: 2166125 - RNA, 15 nt, Streptococcus pneumoniae R6
uugcaagaaaguaga

SEQ ID NO: 2166126 - RNA, 20 nt, Streptococcus pneumoniae R6
uugcaagaaaguagagucca

SEQ ID NO: 2166127 - RNA, 22 nt, Streptococcus pneumoniae R6
uugcaagaaaguagaguccaaa

SEQ ID NO: 2166128 - RNA, 12 nt, Streptococcus pneumoniae R6
uugauuuuuucc

SEQ ID NO: 2166129 - RNA, 16 nt, Streptococcus pneumoniae R6
uugauuuuugccauau

SEQ ID NO: 2166130 - RNA, 15 nt, Streptococcus pneumoniae R6
uucugaugcacuauu

SEQ ID NO: 2166131 - RNA, 23 nt, Streptococcus pneumoniae R6
uucugagguuaaaaucuuuuacu

SEQ ID NO: 2166132 - RNA, 17 nt, Streptococcus pneumoniae R6
uucugcuucuaaaacau

SEQ ID NO: 2166133 - RNA, 18 nt, Streptococcus pneumoniae R6
uucugcuucuaaaacauu

SEQ ID NO: 2166134 - RNA, 18 nt, Streptococcus pneumoniae R6
uucuggaagugaaaaagc

SEQ ID NO: 2166135 - RNA, 16 nt, Streptococcus pneumoniae R6
uucuggaagugaaaca

SEQ ID NO: 2166136 - RNA, 20 nt, Streptococcus pneumoniae R6
uucuggaaguucuacgauuu

SEQ ID NO: 2166137 - RNA, 18 nt, Streptococcus pneumoniae R6
uucugggauggucacaga

SEQ ID NO: 2166138 - RNA, 22 nt, Streptococcus pneumoniae R6
uucugggcuuucauccaagaua

SEQ ID NO: 2166139 - RNA, 12 nt, Streptococcus pneumoniae R6
uucuggucuaca

SEQ ID NO: 2166140 - RNA, 20 nt, Streptococcus pneumoniae R6
uucuguaaaaauacaucuau

SEQ ID NO: 2166141 - RNA, 15 nt, Streptococcus pneumoniae R6
uucuggauuuccauu

SEQ ID NO: 2166142 - RNA, 13 nt, Streptococcus pneumoniae R6
uucucgcaaaauc

SEQ ID NO: 2166143 - RNA, 15 nt, Streptococcus pneumoniae R6
uucucguauauagug

SEQ ID NO: 2166144 - RNA, 17 nt, Streptococcus pneumoniae R6
uucucggucuuguuuuu

SEQ ID NO: 2166145 - RNA, 15 nt, Streptococcus pneumoniae R6
uucugaagacaaauc

SEQ ID NO: 2166146 - RNA, 13 nt, Streptococcus pneumoniae R6
uucucuacaaaua

SEQ ID NO: 2166147 - RNA, 22 nt, Streptococcus pneumoniae R6
uucugaaugcuuuccaacgauu

SEQ ID NO: 2166148 - RNA, 15 nt, Streptococcus pneumoniae R6
uucugaaguuaaguu

SEQ ID NO: 2166149 - RNA, 13 nt, Streptococcus pneumoniae R6
uucuucauacauu

SEQ ID NO: 2166150 - RNA, 22 nt, Streptococcus pneumoniae R6
uucuucauacucaaucccauau

SEQ ID NO: 2166151 - RNA, 19 nt, Streptococcus pneumoniae R6
uucuucaggauugauaaaa

SEQ ID NO: 2166152 - RNA, 22 nt, Streptococcus pneumoniae R6
uucuucauggaucauuucuucu

SEQ ID NO: 2166153 - RNA, 15 nt, Streptococcus pneumoniae R6
uucuuccaacucuuc

SEQ ID NO: 2166154 - RNA, 18 nt, Streptococcus pneumoniae R6
uucuugauuuccauuucu

SEQ ID NO: 2166155 - RNA, 23 nt, Streptococcus pneumoniae R6
uucuugaguaguuccagugauuu

SEQ ID NO: 2166156 - RNA, 21 nt, Streptococcus pneumoniae R6
uucuugauacugaucaaaaaa

SEQ ID NO: 2166157 - RNA, 21 nt, Streptococcus pneumoniae R6
uucuugaccagcgauagcucc

SEQ ID NO: 2166158 - RNA, 18 nt, Streptococcus pneumoniae R6
uucuucgacaguaaaaua

SEQ ID NO: 2166159 - RNA, 11 nt, Streptococcus pneumoniae R6
uucuuccuacu

SEQ ID NO: 2166160 - RNA, 16 nt, Streptococcus pneumoniae R6
uucuuauuucauuuua

SEQ ID NO: 2166161 - RNA, 13 nt, Streptococcus pneumoniae R6
uucuuauuuuccu

SEQ ID NO: 2166162 - RNA, 22 nt, Streptococcus pneumoniae R6
uucuucaacccacuacaguuga

SEQ ID NO: 2166163 - RNA, 17 nt, Streptococcus pneumoniae R6
uucuucacauccucuac

SEQ ID NO: 2166164 - RNA, 22 nt, Streptococcus pneumoniae R6
uucuucacgaauggcuagaacc

SEQ ID NO: 2166165 - RNA, 15 nt, Streptococcus pneumoniae R6
uucuuacuaccuacu

SEQ ID NO: 2166166 - RNA, 15 nt, Streptococcus pneumoniae R6
uucuguaaucuuacc

SEQ ID NO: 2166167 - RNA, 23 nt, Streptococcus pneumoniae R6
uucuguaauuucuacuguauacu

SEQ ID NO: 2166168 - RNA, 22 nt, Streptococcus pneumoniae R6
uucuuaauuguagcuuuauuaa

SEQ ID NO: 2166169 - RNA, 18 nt, Streptococcus pneumoniae R6
uucuguacugcacaggac

SEQ ID NO: 2166170 - RNA, 21 nt, Streptococcus pneumoniae R6
uucuguacugcacaggacuaa

SEQ ID NO: 2166171 - RNA, 14 nt, Streptococcus pneumoniae R6
uucuaguuugcucu

SEQ ID NO: 2166172 - RNA, 20 nt, Streptococcus pneumoniae R6
uucuaguuugcucuuugauu

SEQ ID NO: 2166173 - RNA, 15 nt, Streptococcus pneumoniae R6
uucuauaaauguuuu

SEQ ID NO: 2166174 - RNA, 18 nt, Streptococcus pneumoniae R6
uucucaucuuauuucaau

SEQ ID NO: 2166175 - RNA, 13 nt, Streptococcus pneumoniae R6
uucuauacuuuuu

SEQ ID NO: 2166176 - RNA, 18 nt, Streptococcus pneumoniae R6
uucucagggucuuuguuc

SEQ ID NO: 2166177 - RNA, 20 nt, Streptococcus pneumoniae R6
uucucagggucuuuguucug

SEQ ID NO: 2166178 - RNA, 23 nt, Streptococcus pneumoniae R6
uucuccaaagauagaauccauuu

SEQ ID NO: 2166179 - RNA, 17 nt, Streptococcus pneumoniae R6
uucuccaaagccuucuu

SEQ ID NO: 2166180 - RNA, 17 nt, Streptococcus pneumoniae R6
uucuccaaucaaauugu

SEQ ID NO: 2166181 - RNA, 14 nt, Streptococcus pneumoniae R6
uucuccaauccuug

SEQ ID NO: 2166182 - RNA, 12 nt, Streptococcus pneumoniae R6
uucuccacagac

SEQ ID NO: 2166183 - RNA, 19 nt, Streptococcus pneumoniae R6
uucuccuacuugcuuccca

SEQ ID NO: 2166184 - RNA, 22 nt, Streptococcus pneumoniae R6
uucuaguccaacuguaaagaca

SEQ ID NO: 2166185 - RNA, 13 nt, Streptococcus pneumoniae R6
uucuaguccaucu

SEQ ID NO: 2166186 - RNA, 19 nt, Streptococcus pneumoniae R6
uucuagggcacuaugggca

SEQ ID NO: 2166187 - RNA, 15 nt, Streptococcus pneumoniae R6
uucuaacucagcuuc

SEQ ID NO: 2166188 - RNA, 14 nt, Streptococcus pneumoniae R6
uucuaaggaaaaag

SEQ ID NO: 2166189 - RNA, 16 nt, Streptococcus pneumoniae R6
uucuaaugaguuguuu

SEQ ID NO: 2166190 - RNA, 21 nt, Streptococcus pneumoniae R6
uucuaaucgauuuguucauau

SEQ ID NO: 2166191 - RNA, 23 nt, Streptococcus pneumoniae R6
uucuaauuaaauaaaauaaaaac

SEQ ID NO: 2166192 - RNA, 14 nt, Streptococcus pneumoniae R6
uucuaauuaaauca

SEQ ID NO: 2166193 - RNA, 17 nt, Streptococcus pneumoniae R6
uucuaauuaaaucaucc

SEQ ID NO: 2166194 - RNA, 16 nt, Streptococcus pneumoniae R6
uucguaaccaaaucag

SEQ ID NO: 2166195 - RNA, 18 nt, Streptococcus pneumoniae R6
uucguaagaaauuuugga

SEQ ID NO: 2166196 - RNA, 15 nt, Streptococcus pneumoniae R6
uucguaaucauaagc

SEQ ID NO: 2166197 - RNA, 18 nt, Streptococcus pneumoniae R6
uucguacuauuucagauu

SEQ ID NO: 2166198 - RNA, 14 nt, Streptococcus pneumoniae R6
uucgucauuuguuu

SEQ ID NO: 2166199 - RNA, 22 nt, Streptococcus pneumoniae R6
uucggaugauggcuuguguucu

SEQ ID NO: 2166200 - RNA, 17 nt, Streptococcus pneumoniae R6
uucggaucauauuuucu

SEQ ID NO: 2166201 - RNA, 21 nt, Streptococcus pneumoniae R6
uucggcauacggcgguucaac

SEQ ID NO: 2166202 - RNA, 14 nt, Streptococcus pneumoniae R6
uucgucuuguaaug

SEQ ID NO: 2166203 - RNA, 18 nt, Streptococcus pneumoniae R6
uucgugagaggaggugaa

SEQ ID NO: 2166204 - RNA, 16 nt, Streptococcus pneumoniae R6
uucuaaauucaauuca

SEQ ID NO: 2166205 - RNA, 16 nt, Streptococcus pneumoniae R6
uucuaaauuuaacauu

SEQ ID NO: 2166206 - RNA, 17 nt, Streptococcus pneumoniae R6
uucguucacccuugcuu

SEQ ID NO: 2166207 - RNA, 21 nt, Streptococcus pneumoniae R6
gagucaauaauccuaacuuaa

SEQ ID NO: 2166208 - RNA, 13 nt, Streptococcus pneumoniae R6
gagucagcucuuu

SEQ ID NO: 2166209 - RNA, 15 nt, Streptococcus pneumoniae R6
gagucagcucuuuuu

SEQ ID NO: 2166210 - RNA, 14 nt, Streptococcus pneumoniae R6
gaguaugaaaagag

SEQ ID NO: 2166211 - RNA, 19 nt, Streptococcus pneumoniae R6
gaguaugaaauaagauaug

SEQ ID NO: 2166212 - RNA, 13 nt, Streptococcus pneumoniae R6
gaguauaaaaccu

SEQ ID NO: 2166213 - RNA, 13 nt, Streptococcus pneumoniae R6
gaauuugaaacaa

SEQ ID NO: 2166214 - RNA, 19 nt, Streptococcus pneumoniae R6
gaauuugaaacaaugaaaa

SEQ ID NO: 2166215 - RNA, 17 nt, Streptococcus pneumoniae R6
gagucauucaauccauc

SEQ ID NO: 2166216 - RNA, 22 nt, Streptococcus pneumoniae R6
gagucauaguuacucaggauaa

SEQ ID NO: 2166217 - RNA, 15 nt, Streptococcus pneumoniae R6
gaguccaaagaccau

SEQ ID NO: 2166218 - RNA, 22 nt, Streptococcus pneumoniae R6
gaguccaaagaccaugaggaaa

SEQ ID NO: 2166219 - RNA, 16 nt, Streptococcus pneumoniae R6
gagucuccucaaaaac

SEQ ID NO: 2166220 - RNA, 17 nt, Streptococcus pneumoniae R6
gaguuaacuauaccaga

SEQ ID NO: 2166221 - RNA, 14 nt, Streptococcus pneumoniae R6
gaguuaaaacaaag

SEQ ID NO: 2166222 - RNA, 17 nt, Streptococcus pneumoniae R6
gaguuaaaacaaagaaa

SEQ ID NO: 2166223 - RNA, 23 nt, Streptococcus pneumoniae R6
gaguuacaaacucucauuaaaac

SEQ ID NO: 2166224 - RNA, 18 nt, Streptococcus pneumoniae R6
gaguuaccuaaauuauga

SEQ ID NO: 2166225 - RNA, 16 nt, Streptococcus pneumoniae R6
gaguuaggagccaagu

SEQ ID NO: 2166226 - RNA, 15 nt, Streptococcus pneumoniae R6
gaguuccuguuucag

SEQ ID NO: 2166227 - RNA, 11 nt, Streptococcus pneumoniae R6
gaguugaaaau

SEQ ID NO: 2166228 - RNA, 23 nt, Streptococcus pneumoniae R6
gaguugaaugccuccaagaaaga

SEQ ID NO: 2166229 - RNA, 14 nt, Streptococcus pneumoniae R6
gauaaaaaacaacu

SEQ ID NO: 2166230 - RNA, 19 nt, Streptococcus pneumoniae R6
gauaaaagaaugcucagac

SEQ ID NO: 2166231 - RNA, 18 nt, Streptococcus pneumoniae R6
gauaaaaguuauagaagu

SEQ ID NO: 2166232 - RNA, 16 nt, Streptococcus pneumoniae R6
gauaaaagauagagaa

SEQ ID NO: 2166233 - RNA, 14 nt, Streptococcus pneumoniae R6
gauaaaaaucaagc

SEQ ID NO: 2166234 - RNA, 19 nt, Streptococcus pneumoniae R6
gauaaaaucguuuaucacu

SEQ ID NO: 2166235 - RNA, 15 nt, Streptococcus pneumoniae R6
gauaaagugucuccc

SEQ ID NO: 2166236 - RNA, 20 nt, Streptococcus pneumoniae R6
gauacgguauuuaccaaaaa

SEQ ID NO: 2166237 - RNA, 16 nt, Streptococcus pneumoniae R6
gauacgcucagcugau

SEQ ID NO: 2166238 - RNA, 21 nt, Streptococcus pneumoniae R6
gauagaugacuucuuaaucaa

SEQ ID NO: 2166239 - RNA, 16 nt, Streptococcus pneumoniae R6
gauagauuuauuuuug

SEQ ID NO: 2166240 - RNA, 20 nt, Streptococcus pneumoniae R6
gauagauccuucaaauccug

SEQ ID NO: 2166241 - RNA, 17 nt, Streptococcus pneumoniae R6
gauagaucugauagugg

SEQ ID NO: 2166242 - RNA, 22 nt, Streptococcus pneumoniae R6
gauagaaaagcccuucaucagu

SEQ ID NO: 2166243 - RNA, 22 nt, Streptococcus pneumoniae R6
gauacugguacuauuuaauguu

SEQ ID NO: 2166244 - RNA, 17 nt, Streptococcus pneumoniae R6
gauacuguaguuuuucc

SEQ ID NO: 2166245 - RNA, 15 nt, Streptococcus pneumoniae R6
gauaccaaccaguug

SEQ ID NO: 2166246 - RNA, 14 nt, Streptococcus pneumoniae R6
gauacgaucugaaa

SEQ ID NO: 2166247 - RNA, 23 nt, Streptococcus pneumoniae R6
gauacgauuaggaacaccucugu

SEQ ID NO: 2166248 - RNA, 21 nt, Streptococcus pneumoniae R6
gauacaccaucccuuaucauu

SEQ ID NO: 2166249 - RNA, 12 nt, Streptococcus pneumoniae R6
gauaauccagga

SEQ ID NO: 2166250 - RNA, 20 nt, Streptococcus pneumoniae R6
gauaaucgcaagguagagac

SEQ ID NO: 2166251 - RNA, 19 nt, Streptococcus pneumoniae R6
gauaaugcuuugaacaaau

SEQ ID NO: 2166252 - RNA, 13 nt, Streptococcus pneumoniae R6
gauaauuucuuua

SEQ ID NO: 2166253 - RNA, 20 nt, Streptococcus pneumoniae R6
gauaauuuucuguggauacu

SEQ ID NO: 2166254 - RNA, 23 nt, Streptococcus pneumoniae R6
gauaauuuaaaacucauuaauaa

SEQ ID NO: 2166255 - RNA, 18 nt, Streptococcus pneumoniae R6
gauaauauuacuucuaaa

SEQ ID NO: 2166256 - RNA, 12 nt, Streptococcus pneumoniae R6
gauaauaccagc

SEQ ID NO: 2166257 - RNA, 17 nt, Streptococcus pneumoniae R6
gauaauaccuaccagag

SEQ ID NO: 2166258 - RNA, 19 nt, Streptococcus pneumoniae R6
gauaaaguuaugaaaaaga

SEQ ID NO: 2166259 - RNA, 15 nt, Streptococcus pneumoniae R6
gauaacgaagagcug

SEQ ID NO: 2166260 - RNA, 20 nt, Streptococcus pneumoniae R6
gauauuguucuaguuuuuug

SEQ ID NO: 2166261 - RNA, 13 nt, Streptococcus pneumoniae R6
gaucauuucuucu

SEQ ID NO: 2166262 - RNA, 21 nt, Streptococcus pneumoniae R6
gaucagcguuuuuucuuuuug

SEQ ID NO: 2166263 - RNA, 15 nt, Streptococcus pneumoniae R6
gauagcacuugaauc

SEQ ID NO: 2166264 - RNA, 18 nt, Streptococcus pneumoniae R6
gauaucaccaucaaggac

SEQ ID NO: 2166265 - RNA, 15 nt, Streptococcus pneumoniae R6
gauaugaaacaugaa

SEQ ID NO: 2166266 - RNA, 12 nt, Streptococcus pneumoniae R6
gauaugaacaaa

SEQ ID NO: 2166267 - RNA, 14 nt, Streptococcus pneumoniae R6
gauaucucuuugaa

SEQ ID NO: 2166268 - RNA, 20 nt, Streptococcus pneumoniae R6
gauaucugaaaguuuaucuc

SEQ ID NO: 2166269 - RNA, 20 nt, Streptococcus pneumoniae R6
gauaucgguuuaucucccau

SEQ ID NO: 2166270 - RNA, 15 nt, Streptococcus pneumoniae R6
gauaucuaucaaaca

SEQ ID NO: 2166271 - RNA, 12 nt, Streptococcus pneumoniae R6
gauaucuugaag

SEQ ID NO: 2166272 - RNA, 18 nt, Streptococcus pneumoniae R6
gauauuaagaaucuuuuc

SEQ ID NO: 2166273 - RNA, 15 nt, Streptococcus pneumoniae R6
gauauugcaguauau

SEQ ID NO: 2166274 - RNA, 16 nt, Streptococcus pneumoniae R6
gaucgauuuguccugu

SEQ ID NO: 2166275 - RNA, 19 nt, Streptococcus pneumoniae R6
gaucgauuuguccuguucu

SEQ ID NO: 2166276 - RNA, 20 nt, Streptococcus pneumoniae R6
gaugacaaaucuaagucaaa

SEQ ID NO: 2166277 - RNA, 20 nt, Streptococcus pneumoniae R6
gaugacaauagcuaauagaa

SEQ ID NO: 2166278 - RNA, 20 nt, Streptococcus pneumoniae R6
gaugacuuuuaagaaaucau

SEQ ID NO: 2166279 - RNA, 14 nt, Streptococcus pneumoniae R6
gaugacuucagcuc

SEQ ID NO: 2166280 - RNA, 15 nt, Streptococcus pneumoniae R6
gaugacauucaggcu

SEQ ID NO: 2166281 - RNA, 19 nt, Streptococcus pneumoniae R6
gaugaaucugaaucaaaau

SEQ ID NO: 2166282 - RNA, 16 nt, Streptococcus pneumoniae R6
gaugagacgagcaguu

SEQ ID NO: 2166283 - RNA, 19 nt, Streptococcus pneumoniae R6
gaugagacuugcaagaaag

SEQ ID NO: 2166284 - RNA, 14 nt, Streptococcus pneumoniae R6
gaugagauuuugga

SEQ ID NO: 2166285 - RNA, 16 nt, Streptococcus pneumoniae R6
gaugaucgagcagauu

SEQ ID NO: 2166286 - RNA, 19 nt, Streptococcus pneumoniae R6
gaugcaugccauuaaucag

SEQ ID NO: 2166287 - RNA, 21 nt, Streptococcus pneumoniae R6
gauggacuguuauagauucaa

SEQ ID NO: 2166288 - RNA, 20 nt, Streptococcus pneumoniae R6
gauggacuuuaucaccuccu

SEQ ID NO: 2166289 - RNA, 13 nt, Streptococcus pneumoniae R6
gauggaacugacg

SEQ ID NO: 2166290 - RNA, 21 nt, Streptococcus pneumoniae R6
gauggacacgauaaucugggc

SEQ ID NO: 2166291 - RNA, 19 nt, Streptococcus pneumoniae R6
gaugccuuuuauaauagaa

SEQ ID NO: 2166292 - RNA, 21 nt, Streptococcus pneumoniae R6
gaugccuuuuauaauagaaag

SEQ ID NO: 2166293 - RNA, 18 nt, Streptococcus pneumoniae R6
gaugucaccaaacaaauc

SEQ ID NO: 2166294 - RNA, 19 nt, Streptococcus pneumoniae R6
gaugggcucuuuuuuuguc

SEQ ID NO: 2166295 - RNA, 14 nt, Streptococcus pneumoniae R6
gaugucauacaagg

SEQ ID NO: 2166296 - RNA, 12 nt, Streptococcus pneumoniae R6
gauuaaaacugc

SEQ ID NO: 2166297 - RNA, 19 nt, Streptococcus pneumoniae R6
gauuaaaacugccuuucuc

SEQ ID NO: 2166298 - RNA, 17 nt, Streptococcus pneumoniae R6
gauuaaauagagccuuc

SEQ ID NO: 2166299 - RNA, 15 nt, Streptococcus pneumoniae R6
gauuaaauaguucuu

SEQ ID NO: 2166300 - RNA, 21 nt, Streptococcus pneumoniae R6
gauuacuuauuugaacuugaa

SEQ ID NO: 2166301 - RNA, 12 nt, Streptococcus pneumoniae R6
gauucugaaaua

SEQ ID NO: 2166302 - RNA, 19 nt, Streptococcus pneumoniae R6
gauuauuacaacaauaaga

SEQ ID NO: 2166303 - RNA, 13 nt, Streptococcus pneumoniae R6
gauucuuauaaau

SEQ ID NO: 2166304 - RNA, 14 nt, Streptococcus pneumoniae R6
gauugaaacuggaa

SEQ ID NO: 2166305 - RNA, 12 nt, Streptococcus pneumoniae R6
gauugaaauaac

SEQ ID NO: 2166306 - RNA, 14 nt, Streptococcus pneumoniae R6
gauugaaauaagau

SEQ ID NO: 2166307 - RNA, 23 nt, Streptococcus pneumoniae R6
gauugaaauucgcuuuuuuaaau

SEQ ID NO: 2166308 - RNA, 12 nt, Streptococcus pneumoniae R6
gauugagaagcc

SEQ ID NO: 2166309 - RNA, 13 nt, Streptococcus pneumoniae R6
gauugagaagcca

SEQ ID NO: 2166310 - RNA, 14 nt, Streptococcus pneumoniae R6
gauugagaagccaa

SEQ ID NO: 2166311 - RNA, 19 nt, Streptococcus pneumoniae R6
gauuuaaucugaauguuuc

SEQ ID NO: 2166312 - RNA, 11 nt, Streptococcus pneumoniae R6
gauuuaaucau

SEQ ID NO: 2166313 - RNA, 12 nt, Streptococcus pneumoniae R6
gauuuaaaacug

SEQ ID NO: 2166314 - RNA, 21 nt, Streptococcus pneumoniae R6
gauuuaaaacugugauauaau

SEQ ID NO: 2166315 - RNA, 13 nt, Streptococcus pneumoniae R6
gauuuaacuuuuu

SEQ ID NO: 2166316 - RNA, 16 nt, Streptococcus pneumoniae R6
gauuuaagaauaaagc

SEQ ID NO: 2166317 - RNA, 16 nt, Streptococcus pneumoniae R6
gauuuaacaaucuauc

SEQ ID NO: 2166318 - RNA, 13 nt, Streptococcus pneumoniae R6
gauuguucagagg

SEQ ID NO: 2166319 - RNA, 14 nt, Streptococcus pneumoniae R6
gauuggauuugacu

SEQ ID NO: 2166320 - RNA, 17 nt, Streptococcus pneumoniae R6
gauugugauagcaguag

SEQ ID NO: 2166321 - RNA, 20 nt, Streptococcus pneumoniae R6
gauugagagcgacuuuuucu

SEQ ID NO: 2166322 - RNA, 13 nt, Streptococcus pneumoniae R6
gauugccuugcuc

SEQ ID NO: 2166323 - RNA, 14 nt, Streptococcus pneumoniae R6
gauugcuuuccaau

SEQ ID NO: 2166324 - RNA, 17 nt, Streptococcus pneumoniae R6
gauugcuuuccaauaau

SEQ ID NO: 2166325 - RNA, 20 nt, Streptococcus pneumoniae R6
gauugcuccgaucuuucaau

SEQ ID NO: 2166326 - RNA, 19 nt, Streptococcus pneumoniae R6
gauuggagauacuuuuuuc

SEQ ID NO: 2166327 - RNA, 16 nt, Streptococcus pneumoniae R6
gauuggagcuuaaaau

SEQ ID NO: 2166328 - RNA, 23 nt, Streptococcus pneumoniae R6
gauuugaaugccaaaauuccauc

SEQ ID NO: 2166329 - RNA, 13 nt, Streptococcus pneumoniae R6
gauuugaaaacug

SEQ ID NO: 2166330 - RNA, 21 nt, Streptococcus pneumoniae R6
gauuuuagauuuuuuaacaua

SEQ ID NO: 2166331 - RNA, 22 nt, Streptococcus pneumoniae R6
gauuuuaauaauuuuguuaaga

SEQ ID NO: 2166332 - RNA, 22 nt, Streptococcus pneumoniae R6
gauuuuaaauuuacuuaaaauu

SEQ ID NO: 2166333 - RNA, 17 nt, Streptococcus pneumoniae R6
gauuucagaaucccaaa

SEQ ID NO: 2166334 - RNA, 20 nt, Streptococcus pneumoniae R6
gauuucaagaccauuuccau

SEQ ID NO: 2166335 - RNA, 20 nt, Streptococcus pneumoniae R6
gauuucaauuuuaaauuuuu

SEQ ID NO: 2166336 - RNA, 13 nt, Streptococcus pneumoniae R6
gauuuauuuuucu

SEQ ID NO: 2166337 - RNA, 22 nt, Streptococcus pneumoniae R6
gauuuauuuuucuuuuucagaa

SEQ ID NO: 2166338 - RNA, 22 nt, Streptococcus pneumoniae R6
gauuuauuugcuuaauccucaa

SEQ ID NO: 2166339 - RNA, 15 nt, Streptococcus pneumoniae R6
gauuuauuuguuuca

SEQ ID NO: 2166340 - RNA, 14 nt, Streptococcus pneumoniae R6
gauuucagcguuuu

SEQ ID NO: 2166341 - RNA, 17 nt, Streptococcus pneumoniae R6
gauuuuucuguuuucuu

SEQ ID NO: 2166342 - RNA, 20 nt, Streptococcus pneumoniae R6
gcaaaaacacaauuuuagga

SEQ ID NO: 2166343 - RNA, 11 nt, Streptococcus pneumoniae R6
gauuuuaucca

SEQ ID NO: 2166344 - RNA, 23 nt, Streptococcus pneumoniae R6
gauuuucaaagaguauuaaacaa

SEQ ID NO: 2166345 - RNA, 18 nt, Streptococcus pneumoniae R6
gauuuuauugucuuuauu

SEQ ID NO: 2166346 - RNA, 13 nt, Streptococcus pneumoniae R6
gauuuuauuucau

SEQ ID NO: 2166347 - RNA, 19 nt, Streptococcus pneumoniae R6
gauuuuauuucauuccauc

SEQ ID NO: 2166348 - RNA, 17 nt, Streptococcus pneumoniae R6
gauuuucaaauuuucuu

SEQ ID NO: 2166349 - RNA, 23 nt, Streptococcus pneumoniae R6
gauuuuucaaggugaaguucacg

SEQ ID NO: 2166350 - RNA, 23 nt, Streptococcus pneumoniae R6
gauuuuucuaaauuuaacauuaa

SEQ ID NO: 2166351 - RNA, 17 nt, Streptococcus pneumoniae R6
gauuuuguauuuuaucu

SEQ ID NO: 2166352 - RNA, 15 nt, Streptococcus pneumoniae R6
gauuuuguucuuuuu

SEQ ID NO: 2166353 - RNA, 21 nt, Streptococcus pneumoniae R6
gauuuuggcagguaguauuua

SEQ ID NO: 2166354 - RNA, 13 nt, Streptococcus pneumoniae R6
gcaaaaucauaaa

SEQ ID NO: 2166355 - RNA, 21 nt, Streptococcus pneumoniae R6
gcaaaaucgcaauuuaauacu

SEQ ID NO: 2166356 - RNA, 19 nt, Streptococcus pneumoniae R6
gcaaacauucccacaauaa

SEQ ID NO: 2166357 - RNA, 20 nt, Streptococcus pneumoniae R6
gcaaacgaacgccuuaaaaa

SEQ ID NO: 2166358 - RNA, 14 nt, Streptococcus pneumoniae R6
gcaaagaaaaggaa

SEQ ID NO: 2166359 - RNA, 21 nt, Streptococcus pneumoniae R6
gcaaacuucuaaggaaaaagg

SEQ ID NO: 2166360 - RNA, 19 nt, Streptococcus pneumoniae R6
gcaaagauguucucaaccu

SEQ ID NO: 2166361 - RNA, 14 nt, Streptococcus pneumoniae R6
gcaaaucaaagcua

SEQ ID NO: 2166362 - RNA, 18 nt, Streptococcus pneumoniae R6
gcaaaucaaagcuagcaa

SEQ ID NO: 2166363 - RNA, 15 nt, Streptococcus pneumoniae R6
gcaaaucaacuggca

SEQ ID NO: 2166364 - RNA, 22 nt, Streptococcus pneumoniae R6
gcaaaucaacuggcauccccag

SEQ ID NO: 2166365 - RNA, 20 nt, Streptococcus pneumoniae R6
gcaaauagcccauaaagaga

SEQ ID NO: 2166366 - RNA, 21 nt, Streptococcus pneumoniae R6
gcaaauagcccauaaagagag

SEQ ID NO: 2166367 - RNA, 14 nt, Streptococcus pneumoniae R6
gcaaauuauuuaca

SEQ ID NO: 2166368 - RNA, 22 nt, Streptococcus pneumoniae R6
gcaaauuaaccuuauuucucaa

SEQ ID NO: 2166369 - RNA, 20 nt, Streptococcus pneumoniae R6
gcaaaguuuuugguaauuuu

SEQ ID NO: 2166370 - RNA, 15 nt, Streptococcus pneumoniae R6
gcaaaguccuuacuc

SEQ ID NO: 2166371 - RNA, 21 nt, Streptococcus pneumoniae R6
gcaaagcuaaauccuuuuuuc

SEQ ID NO: 2166372 - RNA, 18 nt, Streptococcus pneumoniae R6
gcagcgauugaaacagcu

SEQ ID NO: 2166373 - RNA, 15 nt, Streptococcus pneumoniae R6
gcagauugcucaaaa

SEQ ID NO: 2166374 - RNA, 17 nt, Streptococcus pneumoniae R6
gcaggauuuuugcuucu

SEQ ID NO: 2166375 - RNA, 13 nt, Streptococcus pneumoniae R6
gcaguuuuuucuu

SEQ ID NO: 2166376 - RNA, 16 nt, Streptococcus pneumoniae R6
gcauaagccggcuugu

SEQ ID NO: 2166377 - RNA, 20 nt, Streptococcus pneumoniae R6
gcauaagucauaacauucua

SEQ ID NO: 2166378 - RNA, 21 nt, Streptococcus pneumoniae R6
gcauaauaccaaggauugucu

SEQ ID NO: 2166379 - RNA, 12 nt, Streptococcus pneumoniae R6
gcauaucagaca

SEQ ID NO: 2166380 - RNA, 14 nt, Streptococcus pneumoniae R6
gcauauaaugguuu

SEQ ID NO: 2166381 - RNA, 15 nt, Streptococcus pneumoniae R6
gcauauaaugguuuc

SEQ ID NO: 2166382 - RNA, 16 nt, Streptococcus pneumoniae R6
gcauaguugcauuaaa

SEQ ID NO: 2166383 - RNA, 22 nt, Streptococcus pneumoniae R6
gcauaguauaucacuuuauagu

SEQ ID NO: 2166384 - RNA, 20 nt, Streptococcus pneumoniae R6
gcauaguaucaagguuuuuc

SEQ ID NO: 2166385 - RNA, 14 nt, Streptococcus pneumoniae R6
gcauagacuucaac

SEQ ID NO: 2166386 - RNA, 20 nt, Streptococcus pneumoniae R6
gcauaaucuuggucaacaua

SEQ ID NO: 2166387 - RNA, 20 nt, Streptococcus pneumoniae R6
gcauaaugauuucaagacca

SEQ ID NO: 2166388 - RNA, 17 nt, Streptococcus pneumoniae R6
gcauacguucaaauucg

SEQ ID NO: 2166389 - RNA, 17 nt, Streptococcus pneumoniae R6
gcauacugaauuuagaa

SEQ ID NO: 2166390 - RNA, 19 nt, Streptococcus pneumoniae R6
gcauacugcccugaaaucc

SEQ ID NO: 2166391 - RNA, 16 nt, Streptococcus pneumoniae R6
gcagguuuucaagccu

SEQ ID NO: 2166392 - RNA, 16 nt, Streptococcus pneumoniae R6
gcaguccaaggagaac

SEQ ID NO: 2166393 - RNA, 15 nt, Streptococcus pneumoniae R6
gcagguugcucaaag

SEQ ID NO: 2166394 - RNA, 21 nt, Streptococcus pneumoniae R6
gcaucaacuauucuuuuucua

SEQ ID NO: 2166395 - RNA, 20 nt, Streptococcus pneumoniae R6
gcauaugcaacuuguuuuuc

SEQ ID NO: 2166396 - RNA, 15 nt, Streptococcus pneumoniae R6
gcauauuucaugcuu

SEQ ID NO: 2166397 - RNA, 23 nt, Streptococcus pneumoniae R6
gcauccuaucaaguucacucaaa

SEQ ID NO: 2166398 - RNA, 16 nt, Streptococcus pneumoniae R6
gcauccaguaaaaacu

SEQ ID NO: 2166399 - RNA, 23 nt, Streptococcus pneumoniae R6
gcacaauauagccuaagacaacc

SEQ ID NO: 2166400 - RNA, 16 nt, Streptococcus pneumoniae R6
gcacacaaaucuucug

SEQ ID NO: 2166401 - RNA, 15 nt, Streptococcus pneumoniae R6
gcacaaaaggcucau

SEQ ID NO: 2166402 - RNA, 21 nt, Streptococcus pneumoniae R6
gcacaaaaggcucauaguuua

SEQ ID NO: 2166403 - RNA, 19 nt, Streptococcus pneumoniae R6
gcaauuuuacuucuucccc

SEQ ID NO: 2166404 - RNA, 22 nt, Streptococcus pneumoniae R6
gcaauuucuuuauauaaaaaga

SEQ ID NO: 2166405 - RNA, 16 nt, Streptococcus pneumoniae R6
gcaauuucuaauacaa

SEQ ID NO: 2166406 - RNA, 18 nt, Streptococcus pneumoniae R6
gcaauuuaucuccuacuu

SEQ ID NO: 2166407 - RNA, 13 nt, Streptococcus pneumoniae R6
gcaauucaauuau

SEQ ID NO: 2166408 - RNA, 15 nt, Streptococcus pneumoniae R6
gcaaggucaauaaca

SEQ ID NO: 2166409 - RNA, 16 nt, Streptococcus pneumoniae R6
gcaacuguuuuuucaa

SEQ ID NO: 2166410 - RNA, 18 nt, Streptococcus pneumoniae R6
gcaacuguuuuuucaaca

SEQ ID NO: 2166411 - RNA, 21 nt, Streptococcus pneumoniae R6
gcaacaaaaacgauaaaagcu

SEQ ID NO: 2166412 - RNA, 22 nt, Streptococcus pneumoniae R6
gcaaauuugaccauuucaaccu

SEQ ID NO: 2166413 - RNA, 16 nt, Streptococcus pneumoniae R6
gcaaauuuauaaaucu

SEQ ID NO: 2166414 - RNA, 21 nt, Streptococcus pneumoniae R6
gcaaauuuauaaaucuucuaa

SEQ ID NO: 2166415 - RNA, 22 nt, Streptococcus pneumoniae R6
gcaaauuuauaaaucuucuaaa

SEQ ID NO: 2166416 - RNA, 21 nt, Streptococcus pneumoniae R6
gcaacuuguuuuuccugauua

SEQ ID NO: 2166417 - RNA, 17 nt, Streptococcus pneumoniae R6
gcaacuugguaauaccu

SEQ ID NO: 2166418 - RNA, 14 nt, Streptococcus pneumoniae R6
gcaagauauucauu

SEQ ID NO: 2166419 - RNA, 16 nt, Streptococcus pneumoniae R6
gcaagucuagacugau

SEQ ID NO: 2166420 - RNA, 14 nt, Streptococcus pneumoniae R6
gcaagugcuaagau

SEQ ID NO: 2166421 - RNA, 17 nt, Streptococcus pneumoniae R6
gcaaguccuacccacug

SEQ ID NO: 2166422 - RNA, 15 nt, Streptococcus pneumoniae R6
gcaaguagaacgcug

SEQ ID NO: 2166423 - RNA, 17 nt, Streptococcus pneumoniae R6
gcaaucuuauccacaac

SEQ ID NO: 2166424 - RNA, 18 nt, Streptococcus pneumoniae R6
gcaaucucacguaacaua

SEQ ID NO: 2166425 - RNA, 22 nt, Streptococcus pneumoniae R6
gcaaucucuguuaagaaauaaa

SEQ ID NO: 2166426 - RNA, 21 nt, Streptococcus pneumoniae R6
gcaccugauuucuccgcuucc

SEQ ID NO: 2166427 - RNA, 21 nt, Streptococcus pneumoniae R6
gcaccuuuguauggaaacuca

SEQ ID NO: 2166428 - RNA, 20 nt, Streptococcus pneumoniae R6
gcacgagucaccccuccaug

SEQ ID NO: 2166429 - RNA, 17 nt, Streptococcus pneumoniae R6
gcacuaguaaucgguag

SEQ ID NO: 2166430 - RNA, 16 nt, Streptococcus pneumoniae R6
gcacguguaaugacag

SEQ ID NO: 2166431 - RNA, 17 nt, Streptococcus pneumoniae R6
gcacguguaauggcugu

SEQ ID NO: 2166432 - RNA, 16 nt, Streptococcus pneumoniae R6
gcacgugcucaaaaca

SEQ ID NO: 2166433 - RNA, 18 nt, Streptococcus pneumoniae R6
gcacugauuugagguugu

SEQ ID NO: 2166434 - RNA, 13 nt, Streptococcus pneumoniae R6
gcacggagaacaa

SEQ ID NO: 2166435 - RNA, 18 nt, Streptococcus pneumoniae R6
gcacggagaaucuucccg

SEQ ID NO: 2166436 - RNA, 23 nt, Streptococcus pneumoniae R6
gcacggacaccgcggucacggag

SEQ ID NO: 2166437 - RNA, 14 nt, Streptococcus pneumoniae R6
gcacggugauuuuu

SEQ ID NO: 2166438 - RNA, 20 nt, Streptococcus pneumoniae R6
gcacggugcuugggaaugau

SEQ ID NO: 2166439 - RNA, 16 nt, Streptococcus pneumoniae R6
gcccuauccgcaaccu

SEQ ID NO: 2166440 - RNA, 20 nt, Streptococcus pneumoniae R6
gcccugcaaucauugcaaag

SEQ ID NO: 2166441 - RNA, 21 nt, Streptococcus pneumoniae R6
gccccugauaguuaucgucac

SEQ ID NO: 2166442 - RNA, 17 nt, Streptococcus pneumoniae R6
gcccgauguuauugaaa

SEQ ID NO: 2166443 - RNA, 13 nt, Streptococcus pneumoniae R6
gcccuuuuuucuc

SEQ ID NO: 2166444 - RNA, 15 nt, Streptococcus pneumoniae R6
gcccuuuuuucucaa

SEQ ID NO: 2166445 - RNA, 15 nt, Streptococcus pneumoniae R6
gcccuucggauaaaa

SEQ ID NO: 2166446 - RNA, 13 nt, Streptococcus pneumoniae R6
gcaugauaucaaa

SEQ ID NO: 2166447 - RNA, 20 nt, Streptococcus pneumoniae R6
gcaucuuaucagaaaauaaa

SEQ ID NO: 2166448 - RNA, 21 nt, Streptococcus pneumoniae R6
gcaucuuaucagaaaauaaaa

SEQ ID NO: 2166449 - RNA, 16 nt, Streptococcus pneumoniae R6
gcaucuuaacauucuc

SEQ ID NO: 2166450 - RNA, 17 nt, Streptococcus pneumoniae R6
gcaucuuaguuaaaaua

SEQ ID NO: 2166451 - RNA, 14 nt, Streptococcus pneumoniae R6
gcaucuuguguuuu

SEQ ID NO: 2166452 - RNA, 20 nt, Streptococcus pneumoniae R6
gcaugacuccacucaacauu

SEQ ID NO: 2166453 - RNA, 14 nt, Streptococcus pneumoniae R6
gcaugaaggucuuu

SEQ ID NO: 2166454 - RNA, 17 nt, Streptococcus pneumoniae R6
gcauuaaucauucccug

SEQ ID NO: 2166455 - RNA, 15 nt, Streptococcus pneumoniae R6
gcaugguuauaggcu

SEQ ID NO: 2166456 - RNA, 17 nt, Streptococcus pneumoniae R6
gcauguaucacaguaag

SEQ ID NO: 2166457 - RNA, 17 nt, Streptococcus pneumoniae R6
gcauggaaagcaucucc

SEQ ID NO: 2166458 - RNA, 16 nt, Streptococcus pneumoniae R6
gcaugggccccagcuu

SEQ ID NO: 2166459 - RNA, 17 nt, Streptococcus pneumoniae R6
gcauuauccauaauaau

SEQ ID NO: 2166460 - RNA, 23 nt, Streptococcus pneumoniae R6
gcauucuucucuugaaaaugaaa

SEQ ID NO: 2166461 - RNA, 14 nt, Streptococcus pneumoniae R6
gcauugaggacaau

SEQ ID NO: 2166462 - RNA, 16 nt, Streptococcus pneumoniae R6
gcauucuaguccaucu

SEQ ID NO: 2166463 - RNA, 19 nt, Streptococcus pneumoniae R6
gcauugugcuugauaaguu

SEQ ID NO: 2166464 - RNA, 22 nt, Streptococcus pneumoniae R6
gcauuguccauaacgaguaaaa

SEQ ID NO: 2166465 - RNA, 19 nt, Streptococcus pneumoniae R6
gcauuguuggcaaccaagu

SEQ ID NO: 2166466 - RNA, 15 nt, Streptococcus pneumoniae R6
gcauuggauauaagg

SEQ ID NO: 2166467 - RNA, 19 nt, Streptococcus pneumoniae R6
gcauugcguuugauaaguu

SEQ ID NO: 2166468 - RNA, 23 nt, Streptococcus pneumoniae R6
gccaaauaucuucggauuuuucu

SEQ ID NO: 2166469 - RNA, 11 nt, Streptococcus pneumoniae R6
gccaaaucaau

SEQ ID NO: 2166470 - RNA, 14 nt, Streptococcus pneumoniae R6
gccaaaucaucaua

SEQ ID NO: 2166471 - RNA, 17 nt, Streptococcus pneumoniae R6
gccaaaucaucauaaaa

SEQ ID NO: 2166472 - RNA, 21 nt, Streptococcus pneumoniae R6
gccaaaucaucauaaaaauaa

SEQ ID NO: 2166473 - RNA, 16 nt, Streptococcus pneumoniae R6
gccaaacuugaaauga

SEQ ID NO: 2166474 - RNA, 12 nt, Streptococcus pneumoniae R6
gccaaaauccuu

SEQ ID NO: 2166475 - RNA, 18 nt, Streptococcus pneumoniae R6
gcauuuuucgaaauuuau

SEQ ID NO: 2166476 - RNA, 19 nt, Streptococcus pneumoniae R6
gccaaaaaagaaaggacga

SEQ ID NO: 2166477 - RNA, 21 nt, Streptococcus pneumoniae R6
gccaaaaaggaagcccuuuau

SEQ ID NO: 2166478 - RNA, 14 nt, Streptococcus pneumoniae R6
gcauuuuuucauug

SEQ ID NO: 2166479 - RNA, 13 nt, Streptococcus pneumoniae R6
gcauuuucuuuuu

SEQ ID NO: 2166480 - RNA, 19 nt, Streptococcus pneumoniae R6
gcauuugagcgaaaucaac

SEQ ID NO: 2166481 - RNA, 12 nt, Streptococcus pneumoniae R6
gcauuuuccuug

SEQ ID NO: 2166482 - RNA, 18 nt, Streptococcus pneumoniae R6
gcauuuucauaaggaagu

SEQ ID NO: 2166483 - RNA, 17 nt, Streptococcus pneumoniae R6
gccaacaacugauucua

SEQ ID NO: 2166484 - RNA, 19 nt, Streptococcus pneumoniae R6
gccaacaacugauucuacu

SEQ ID NO: 2166485 - RNA, 23 nt, Streptococcus pneumoniae R6
gccaacaacugauucuacuuuuu

SEQ ID NO: 2166486 - RNA, 14 nt, Streptococcus pneumoniae R6
gccaacuaaccaac

SEQ ID NO: 2166487 - RNA, 19 nt, Streptococcus pneumoniae R6
gccaacuuaucagcuagcu

SEQ ID NO: 2166488 - RNA, 18 nt, Streptococcus pneumoniae R6
gccaagauauugccgaua

SEQ ID NO: 2166489 - RNA, 19 nt, Streptococcus pneumoniae R6
gccaagaguagagagaaag

SEQ ID NO: 2166490 - RNA, 18 nt, Streptococcus pneumoniae R6
gccaaguuaaauucuucu

SEQ ID NO: 2166491 - RNA, 16 nt, Streptococcus pneumoniae R6
gccaaguccagaggac

SEQ ID NO: 2166492 - RNA, 15 nt, Streptococcus pneumoniae R6
gccaagguucauuuc

SEQ ID NO: 2166493 - RNA, 13 nt, Streptococcus pneumoniae R6
gccaauacagaua

SEQ ID NO: 2166494 - RNA, 21 nt, Streptococcus pneumoniae R6
gccaaucacuugaccaaagac

SEQ ID NO: 2166495 - RNA, 19 nt, Streptococcus pneumoniae R6
gccaauguauuaagaacuc

SEQ ID NO: 2166496 - RNA, 16 nt, Streptococcus pneumoniae R6
gccaauugcucaacuu

SEQ ID NO: 2166497 - RNA, 16 nt, Streptococcus pneumoniae R6
gccacaaaugcuucuu

SEQ ID NO: 2166498 - RNA, 15 nt, Streptococcus pneumoniae R6
gccagaaaaaucccu

SEQ ID NO: 2166499 - RNA, 10 nt, Streptococcus pneumoniae R6
gccagacugg

SEQ ID NO: 2166500 - RNA, 19 nt, Streptococcus pneumoniae R6
gccaucuuuugacagucuu

SEQ ID NO: 2166501 - RNA, 20 nt, Streptococcus pneumoniae R6
gccaugacaccguaagauag

SEQ ID NO: 2166502 - RNA, 13 nt, Streptococcus pneumoniae R6
gccaucuuguaac

SEQ ID NO: 2166503 - RNA, 17 nt, Streptococcus pneumoniae R6
gccauggccauaucugg

SEQ ID NO: 2166504 - RNA, 16 nt, Streptococcus pneumoniae R6
gccauugaaaauccug

SEQ ID NO: 2166505 - RNA, 23 nt, Streptococcus pneumoniae R6
gccagguuucguggcgacgccag

SEQ ID NO: 2166506 - RNA, 16 nt, Streptococcus pneumoniae R6
gccaucucuacuccuu

SEQ ID NO: 2166507 - RNA, 15 nt, Streptococcus pneumoniae R6
gcccaccugcuuaau

SEQ ID NO: 2166508 - RNA, 15 nt, Streptococcus pneumoniae R6
gcccaauauucucua

SEQ ID NO: 2166509 - RNA, 16 nt, Streptococcus pneumoniae R6
gccauuguauccugaa

SEQ ID NO: 2166510 - RNA, 22 nt, Streptococcus pneumoniae R6
gcccaaaaauuaccgagaaucu

SEQ ID NO: 2166511 - RNA, 12 nt, Streptococcus pneumoniae R6
gcccaaccagcu

SEQ ID NO: 2166512 - RNA, 20 nt, Streptococcus pneumoniae R6
gcuauaagaugaccuuaucu

SEQ ID NO: 2166513 - RNA, 15 nt, Streptococcus pneumoniae R6
gcuauaauaguaaga

SEQ ID NO: 2166514 - RNA, 17 nt, Streptococcus pneumoniae R6
gcuagcuguagaagacg

SEQ ID NO: 2166515 - RNA, 21 nt, Streptococcus pneumoniae R6
gcuauaauuauucugcaauca

SEQ ID NO: 2166516 - RNA, 21 nt, Streptococcus pneumoniae R6
gcuauacuguaguuaugaaac

SEQ ID NO: 2166517 - RNA, 17 nt, Streptococcus pneumoniae R6
gcuagaaauggcagcgu

SEQ ID NO: 2166518 - RNA, 14 nt, Streptococcus pneumoniae R6
gcuagauauuucca

SEQ ID NO: 2166519 - RNA, 21 nt, Streptococcus pneumoniae R6
gcuagcgucuaacaauuagga

SEQ ID NO: 2166520 - RNA, 23 nt, Streptococcus pneumoniae R6
gcuagccgcagguugcucaaaac

SEQ ID NO: 2166521 - RNA, 18 nt, Streptococcus pneumoniae R6
gcuauccagauagacauu

SEQ ID NO: 2166522 - RNA, 22 nt, Streptococcus pneumoniae R6
gcuauccuggcguaguaaauca

SEQ ID NO: 2166523 - RNA, 18 nt, Streptococcus pneumoniae R6
gcucaaaucagcucucug

SEQ ID NO: 2166524 - RNA, 15 nt, Streptococcus pneumoniae R6
gcucaaaacacuguu

SEQ ID NO: 2166525 - RNA, 19 nt, Streptococcus pneumoniae R6
gcucaaaacacuguuuuga

SEQ ID NO: 2166526 - RNA, 19 nt, Streptococcus pneumoniae R6
gcucaaaacaugguuuuga

SEQ ID NO: 2166527 - RNA, 15 nt, Streptococcus pneumoniae R6
gcucaaaagcuuguu

SEQ ID NO: 2166528 - RNA, 20 nt, Streptococcus pneumoniae R6
gcucaaaagcuuguuuaaaa

SEQ ID NO: 2166529 - RNA, 14 nt, Streptococcus pneumoniae R6
gcucaaaaguuuau

SEQ ID NO: 2166530 - RNA, 13 nt, Streptococcus pneumoniae R6
gcuauuccagcuu

SEQ ID NO: 2166531 - RNA, 19 nt, Streptococcus pneumoniae R6
gcuauugaaaggaaaauga

SEQ ID NO: 2166532 - RNA, 13 nt, Streptococcus pneumoniae R6
gcuauucuucucu

SEQ ID NO: 2166533 - RNA, 15 nt, Streptococcus pneumoniae R6
gcuauuagaccugcc

SEQ ID NO: 2166534 - RNA, 14 nt, Streptococcus pneumoniae R6
gcuauuagauggua

SEQ ID NO: 2166535 - RNA, 15 nt, Streptococcus pneumoniae R6
gcuauuauuaauguu

SEQ ID NO: 2166536 - RNA, 21 nt, Streptococcus pneumoniae R6
gcuauuaaaauucguuucauu

SEQ ID NO: 2166537 - RNA, 20 nt, Streptococcus pneumoniae R6
gcuauuaagaaaaaugauuc

SEQ ID NO: 2166538 - RNA, 21 nt, Streptococcus pneumoniae R6
gcuccuguacccaaguaaucu

SEQ ID NO: 2166539 - RNA, 14 nt, Streptococcus pneumoniae R6
gcucccauuuuugg

SEQ ID NO: 2166540 - RNA, 21 nt, Streptococcus pneumoniae R6
gcucccauuggaucccauggu

SEQ ID NO: 2166541 - RNA, 13 nt, Streptococcus pneumoniae R6
gcuccagaaauaa

SEQ ID NO: 2166542 - RNA, 19 nt, Streptococcus pneumoniae R6
gcucauggcaagcaagucu

SEQ ID NO: 2166543 - RNA, 13 nt, Streptococcus pneumoniae R6
gcugauagagauu

SEQ ID NO: 2166544 - RNA, 16 nt, Streptococcus pneumoniae R6
gcugagcuaaggaggc

SEQ ID NO: 2166545 - RNA, 18 nt, Streptococcus pneumoniae R6
gcugagucauucaaucca

SEQ ID NO: 2166546 - RNA, 22 nt, Streptococcus pneumoniae R6
gcugagucauucaauccaucuc

SEQ ID NO: 2166547 - RNA, 15 nt, Streptococcus pneumoniae R6
gcugagacuaucugc

SEQ ID NO: 2166548 - RNA, 15 nt, Streptococcus pneumoniae R6
gcugacuucgucagu

SEQ ID NO: 2166549 - RNA, 21 nt, Streptococcus pneumoniae R6
gcugacuucgucaguucuauc

SEQ ID NO: 2166550 - RNA, 22 nt, Streptococcus pneumoniae R6
gcugacuucgucaguucuaucu

SEQ ID NO: 2166551 - RNA, 20 nt, Streptococcus pneumoniae R6
gcugacuucgucaguuucau

SEQ ID NO: 2166552 - RNA, 18 nt, Streptococcus pneumoniae R6
gcugacaauaaagauaag

SEQ ID NO: 2166553 - RNA, 21 nt, Streptococcus pneumoniae R6
gcugaaggaaugccaaagaca

SEQ ID NO: 2166554 - RNA, 16 nt, Streptococcus pneumoniae R6
gcugacgauguugaug

SEQ ID NO: 2166555 - RNA, 19 nt, Streptococcus pneumoniae R6
gcugacgcgaucuggcagg

SEQ ID NO: 2166556 - RNA, 12 nt, Streptococcus pneumoniae R6
gcucuuaaacaa

SEQ ID NO: 2166557 - RNA, 15 nt, Streptococcus pneumoniae R6
gcucuuaaacaagag

SEQ ID NO: 2166558 - RNA, 13 nt, Streptococcus pneumoniae R6
gcucuuaucuguc

SEQ ID NO: 2166559 - RNA, 21 nt, Streptococcus pneumoniae R6
gcucugaauggccuccuucau

SEQ ID NO: 2166560 - RNA, 18 nt, Streptococcus pneumoniae R6
gcucuuuagucccagcuu

SEQ ID NO: 2166561 - RNA, 15 nt, Streptococcus pneumoniae R6
gcucuuugucaacug

SEQ ID NO: 2166562 - RNA, 16 nt, Streptococcus pneumoniae R6
gcucuuugucaacugu

SEQ ID NO: 2166563 - RNA, 13 nt, Streptococcus pneumoniae R6
gcucguucaaccg

SEQ ID NO: 2166564 - RNA, 21 nt, Streptococcus pneumoniae R6
gcucuaacugaagcuguuucc

SEQ ID NO: 2166565 - RNA, 24 nt, Streptococcus pneumoniae R6
gcucucaagaacaguuaugauauu

SEQ ID NO: 2166566 - RNA, 14 nt, Streptococcus pneumoniae R6
gcucuaugauuuuc

SEQ ID NO: 2166567 - RNA, 17 nt, Streptococcus pneumoniae R6
gcucuauacacauccag

SEQ ID NO: 2166568 - RNA, 22 nt, Streptococcus pneumoniae R6
gcucuacgaacaggaacgugau

SEQ ID NO: 2166569 - RNA, 13 nt, Streptococcus pneumoniae R6
gcguuaaauccua

SEQ ID NO: 2166570 - RNA, 20 nt, Streptococcus pneumoniae R6
gcguucagccaucuuguaac

SEQ ID NO: 2166571 - RNA, 15 nt, Streptococcus pneumoniae R6
gcguucaccaggagc

SEQ ID NO: 2166572 - RNA, 21 nt, Streptococcus pneumoniae R6
gcguucaccaggagccaagau

SEQ ID NO: 2166573 - RNA, 21 nt, Streptococcus pneumoniae R6
gcgugagauuugugaaucauc

SEQ ID NO: 2166574 - RNA, 21 nt, Streptococcus pneumoniae R6
gcguccagcagcuaagaccuu

SEQ ID NO: 2166575 - RNA, 19 nt, Streptococcus pneumoniae R6
gcguccucuaguaaagugu

SEQ ID NO: 2166576 - RNA, 21 nt, Streptococcus pneumoniae R6
gcguauuccauuggaaguucu

SEQ ID NO: 2166577 - RNA, 15 nt, Streptococcus pneumoniae R6
gcgucagcuuuaucu

SEQ ID NO: 2166578 - RNA, 21 nt, Streptococcus pneumoniae R6
gcgucaggagcacuugaugaa

SEQ ID NO: 2166579 - RNA, 21 nt, Streptococcus pneumoniae R6
gcgucaccguagguuggguga

SEQ ID NO: 2166580 - RNA, 18 nt, Streptococcus pneumoniae R6
gcggcuagcgucuaacaa

SEQ ID NO: 2166581 - RNA, 17 nt, Streptococcus pneumoniae R6
gcgcucgcuuuucaccu

SEQ ID NO: 2166582 - RNA, 19 nt, Streptococcus pneumoniae R6
gcgcuucuacuccaagcaa

SEQ ID NO: 2166583 - RNA, 16 nt, Streptococcus pneumoniae R6
gcgcuugaaacucauc

SEQ ID NO: 2166584 - RNA, 21 nt, Streptococcus pneumoniae R6
gcgcuugauaaccuuaaucaa

SEQ ID NO: 2166585 - RNA, 22 nt, Streptococcus pneumoniae R6
gcgcuugauaaccuuaaucaaa

SEQ ID NO: 2166586 - RNA, 20 nt, Streptococcus pneumoniae R6
gcggaaguuggucucccaag

SEQ ID NO: 2166587 - RNA, 13 nt, Streptococcus pneumoniae R6
gcggauaaaagag

SEQ ID NO: 2166588 - RNA, 15 nt, Streptococcus pneumoniae R6
gcgaacaucuccaac

SEQ ID NO: 2166589 - RNA, 18 nt, Streptococcus pneumoniae R6
gcgaacaucuccaacugc

SEQ ID NO: 2166590 - RNA, 22 nt, Streptococcus pneumoniae R6
gccuaaaauucaauguuuacuc

SEQ ID NO: 2166591 - RNA, 22 nt, Streptococcus pneumoniae R6
gcgacauugacugagucacguu

SEQ ID NO: 2166592 - RNA, 16 nt, Streptococcus pneumoniae R6
gcgaccaagagcaaaa

SEQ ID NO: 2166593 - RNA, 17 nt, Streptococcus pneumoniae R6
gcgaccaagagcaaaaa

SEQ ID NO: 2166594 - RNA, 15 nt, Streptococcus pneumoniae R6
gcgauaaaaauccuu

SEQ ID NO: 2166595 - RNA, 13 nt, Streptococcus pneumoniae R6
gcgauaugguagg

SEQ ID NO: 2166596 - RNA, 15 nt, Streptococcus pneumoniae R6
gcgacguuuucuccu

SEQ ID NO: 2166597 - RNA, 17 nt, Streptococcus pneumoniae R6
gcgcaucaacaugguau

SEQ ID NO: 2166598 - RNA, 15 nt, Streptococcus pneumoniae R6
gcugcucaaaacacu

SEQ ID NO: 2166599 - RNA, 18 nt, Streptococcus pneumoniae R6
gcugcgggcugcucaaaa

SEQ ID NO: 2166600 - RNA, 21 nt, Streptococcus pneumoniae R6
gcuggaaaaaagucuuuaaaa

SEQ ID NO: 2166601 - RNA, 19 nt, Streptococcus pneumoniae R6
gcuggauagaguagucugg

SEQ ID NO: 2166602 - RNA, 20 nt, Streptococcus pneumoniae R6
gcuggauagaguagucuggg

SEQ ID NO: 2166603 - RNA, 19 nt, Streptococcus pneumoniae R6
gcuggaucagcuuuuucag

SEQ ID NO: 2166604 - RNA, 20 nt, Streptococcus pneumoniae R6
gcuggagagacuugcucaag

SEQ ID NO: 2166605 - RNA, 13 nt, Streptococcus pneumoniae R6
gcuggagaaucau

SEQ ID NO: 2166606 - RNA, 13 nt, Streptococcus pneumoniae R6
gcugcaauaaucu

SEQ ID NO: 2166607 - RNA, 15 nt, Streptococcus pneumoniae R6
gcugcacggacuucu

SEQ ID NO: 2166608 - RNA, 13 nt, Streptococcus pneumoniae R6
gcugauuuuuuca

SEQ ID NO: 2166609 - RNA, 21 nt, Streptococcus pneumoniae R6
gcugccauuugacgaacaaaa

SEQ ID NO: 2166610 - RNA, 22 nt, Streptococcus pneumoniae R6
gcugccauuugacgaacaaaaa

SEQ ID NO: 2166611 - RNA, 13 nt, Streptococcus pneumoniae R6
gcugcgauaagga

SEQ ID NO: 2166612 - RNA, 15 nt, Streptococcus pneumoniae R6
gcugguauuuuuuca

SEQ ID NO: 2166613 - RNA, 11 nt, Streptococcus pneumoniae R6
gcuggcuacag

SEQ ID NO: 2166614 - RNA, 23 nt, Streptococcus pneumoniae R6
gcuggcuggaucagcuuuuucag

SEQ ID NO: 2166615 - RNA, 18 nt, Streptococcus pneumoniae R6
gcuguuccaccaccugca

SEQ ID NO: 2166616 - RNA, 16 nt, Streptococcus pneumoniae R6
gcuguucuuuuuuguu

SEQ ID NO: 2166617 - RNA, 21 nt, Streptococcus pneumoniae R6
gcuguggguggcuacaagaac

SEQ ID NO: 2166618 - RNA, 21 nt, Streptococcus pneumoniae R6
gcuguuaaagccaucuaaaac

SEQ ID NO: 2166619 - RNA, 17 nt, Streptococcus pneumoniae R6
gcuguguuccucuuuuu

SEQ ID NO: 2166620 - RNA, 16 nt, Streptococcus pneumoniae R6
gcugugcuuugagcaa

SEQ ID NO: 2166621 - RNA, 17 nt, Streptococcus pneumoniae R6
gcugucguagucuagga

SEQ ID NO: 2166622 - RNA, 16 nt, Streptococcus pneumoniae R6
gcuguccucaaaauga

SEQ ID NO: 2166623 - RNA, 22 nt, Streptococcus pneumoniae R6
gcuuagaaauaucugcacucuc

SEQ ID NO: 2166624 - RNA, 19 nt, Streptococcus pneumoniae R6
gcuuauauacccaaaacac

SEQ ID NO: 2166625 - RNA, 16 nt, Streptococcus pneumoniae R6
gcuuaauuucuaucag

SEQ ID NO: 2166626 - RNA, 19 nt, Streptococcus pneumoniae R6
gcuuacaucaaaaacaucu

SEQ ID NO: 2166627 - RNA, 20 nt, Streptococcus pneumoniae R6
gcuuacaucaaaaacaucuc

SEQ ID NO: 2166628 - RNA, 14 nt, Streptococcus pneumoniae R6
gcuuacaucauccc

SEQ ID NO: 2166629 - RNA, 10 nt, Streptococcus pneumoniae R6
gcuucaucaa

SEQ ID NO: 2166630 - RNA, 18 nt, Streptococcus pneumoniae R6
gcuucaguuagagcgagu

SEQ ID NO: 2166631 - RNA, 15 nt, Streptococcus pneumoniae R6
gcuucagcgauuucu

SEQ ID NO: 2166632 - RNA, 18 nt, Streptococcus pneumoniae R6
gcuucauuuaucuucuua

SEQ ID NO: 2166633 - RNA, 16 nt, Streptococcus pneumoniae R6
gcuucaucuccuguca

SEQ ID NO: 2166634 - RNA, 22 nt, Streptococcus pneumoniae R6
gcuuauuuuugcaagugcucca

SEQ ID NO: 2166635 - RNA, 18 nt, Streptococcus pneumoniae R6
gcuucuuacgaaugaguu

SEQ ID NO: 2166636 - RNA, 22 nt, Streptococcus pneumoniae R6
gcuucuuuauguucaucuucuu

SEQ ID NO: 2166637 - RNA, 21 nt, Streptococcus pneumoniae R6
gcuugaaugauaaaacauacu

SEQ ID NO: 2166638 - RNA, 16 nt, Streptococcus pneumoniae R6
gcuugaccugauaguu

SEQ ID NO: 2166639 - RNA, 19 nt, Streptococcus pneumoniae R6
gcuucuuuuuauauauaaa

SEQ ID NO: 2166640 - RNA, 18 nt, Streptococcus pneumoniae R6
gcuucuuuuuuuacuaaa

SEQ ID NO: 2166641 - RNA, 15 nt, Streptococcus pneumoniae R6
gcuugaaacaaauaa

SEQ ID NO: 2166642 - RNA, 14 nt, Streptococcus pneumoniae R6
gcuugaaacucauc

SEQ ID NO: 2166643 - RNA, 23 nt, Streptococcus pneumoniae R6
gcuugaaacucaucuuggucagg

SEQ ID NO: 2166644 - RNA, 14 nt, Streptococcus pneumoniae R6
gcuucuuuccuuag

SEQ ID NO: 2166645 - RNA, 10 nt, Streptococcus pneumoniae R6
gcuuccaguu

SEQ ID NO: 2166646 - RNA, 21 nt, Streptococcus pneumoniae R6
gcuuccccauucuauggaauc

SEQ ID NO: 2166647 - RNA, 20 nt, Streptococcus pneumoniae R6
gcuuccaucugcagccucaa

SEQ ID NO: 2166648 - RNA, 19 nt, Streptococcus pneumoniae R6
gcuugauaaccuuaaucaa

SEQ ID NO: 2166649 - RNA, 16 nt, Streptococcus pneumoniae R6
gcuugauaaguuugau

SEQ ID NO: 2166650 - RNA, 17 nt, Streptococcus pneumoniae R6
gcuugauaaguuugaug

SEQ ID NO: 2166651 - RNA, 20 nt, Streptococcus pneumoniae R6
gcuuggaaaucuucuguguu

SEQ ID NO: 2166652 - RNA, 21 nt, Streptococcus pneumoniae R6
gcuuggaaugauuugggcaag

SEQ ID NO: 2166653 - RNA, 14 nt, Streptococcus pneumoniae R6
gcuuggauuuaaaa

SEQ ID NO: 2166654 - RNA, 15 nt, Streptococcus pneumoniae R6
gcuuggugagaaagu

SEQ ID NO: 2166655 - RNA, 21 nt, Streptococcus pneumoniae R6
gcuuggucaguaagauacaga

SEQ ID NO: 2166656 - RNA, 14 nt, Streptococcus pneumoniae R6
gcuugguaauagau

SEQ ID NO: 2166657 - RNA, 13 nt, Streptococcus pneumoniae R6
gcuugggaaacca

SEQ ID NO: 2166658 - RNA, 16 nt, Streptococcus pneumoniae R6
gcuugugaaagcucuu

SEQ ID NO: 2166659 - RNA, 19 nt, Streptococcus pneumoniae R6
gcuugucuuugauuuacua

SEQ ID NO: 2166660 - RNA, 13 nt, Streptococcus pneumoniae R6
gcuuuaaaugcug

SEQ ID NO: 2166661 - RNA, 18 nt, Streptococcus pneumoniae R6
gcuuuaaaacuaaagcuu

SEQ ID NO: 2166662 - RNA, 20 nt, Streptococcus pneumoniae R6
gcuuguuuaaaaucucuuua

SEQ ID NO: 2166663 - RNA, 22 nt, Streptococcus pneumoniae R6
gcuuguuuaaaaucucuuuauu

SEQ ID NO: 2166664 - RNA, 18 nt, Streptococcus pneumoniae R6
gcuuuagcaaucuuaucc

SEQ ID NO: 2166665 - RNA, 15 nt, Streptococcus pneumoniae R6
gcuuuacuaguucuc

SEQ ID NO: 2166666 - RNA, 13 nt, Streptococcus pneumoniae R6
gcuuuaccauccu

SEQ ID NO: 2166667 - RNA, 14 nt, Streptococcus pneumoniae R6
gcuuuuugauauga

SEQ ID NO: 2166668 - RNA, 12 nt, Streptococcus pneumoniae R6
gcuuuuucuguu

SEQ ID NO: 2166669 - RNA, 13 nt, Streptococcus pneumoniae R6
gcuuuuucuuuuu

SEQ ID NO: 2166670 - RNA, 17 nt, Streptococcus pneumoniae R6
gcuuuugcagcaccagu

SEQ ID NO: 2166671 - RNA, 13 nt, Streptococcus pneumoniae R6
gcuuuugauuuga

SEQ ID NO: 2166672 - RNA, 20 nt, Streptococcus pneumoniae R6
gcuuuucuaucacuccaaaa

SEQ ID NO: 2166673 - RNA, 18 nt, Streptococcus pneumoniae R6
gcuuuuauucagccaagg

SEQ ID NO: 2166674 - RNA, 13 nt, Streptococcus pneumoniae R6
gcuuuuauuucuu

SEQ ID NO: 2166675 - RNA, 16 nt, Streptococcus pneumoniae R6
gcuuugguuucagcua

SEQ ID NO: 2166676 - RNA, 22 nt, Streptococcus pneumoniae R6
gcuuuauugucucuaaaaauaa

SEQ ID NO: 2166677 - RNA, 21 nt, Streptococcus pneumoniae R6
gcuuuaucugcaaccucaaaa

SEQ ID NO: 2166678 - RNA, 15 nt, Streptococcus pneumoniae R6
gcuuuauuaagcccu

SEQ ID NO: 2166679 - RNA, 19 nt, Streptococcus pneumoniae R6
gcuuuauucuuaaauccac

SEQ ID NO: 2166680 - RNA, 18 nt, Streptococcus pneumoniae R6
gcuuucacuauaguccaa

SEQ ID NO: 2166681 - RNA, 20 nt, Streptococcus pneumoniae R6
gcuuucacaaauuugaaaau

SEQ ID NO: 2166682 - RNA, 21 nt, Streptococcus pneumoniae R6
gcuuuccaauaauucaccuau

SEQ ID NO: 2166683 - RNA, 11 nt, Streptococcus pneumoniae R6
gcuuuccuuuc

SEQ ID NO: 2166684 - RNA, 17 nt, Streptococcus pneumoniae R6
gcuuugaaaauuccauu

SEQ ID NO: 2166685 - RNA, 13 nt, Streptococcus pneumoniae R6
gcuuugaacaaau

SEQ ID NO: 2166686 - RNA, 17 nt, Streptococcus pneumoniae R6
gcuuugaguaaccugcg

SEQ ID NO: 2166687 - RNA, 17 nt, Streptococcus pneumoniae R6
gcuuugagauauuucuu

SEQ ID NO: 2166688 - RNA, 22 nt, Streptococcus pneumoniae R6
gcuuugagaucuuuuucgcuug

SEQ ID NO: 2166689 - RNA, 14 nt, Streptococcus pneumoniae R6
gcuuugagcaaccu

SEQ ID NO: 2166690 - RNA, 22 nt, Streptococcus pneumoniae R6
ggaaagacuggugagauaaaac

SEQ ID NO: 2166691 - RNA, 22 nt, Streptococcus pneumoniae R6
ggaaacucucguaaacaaagag

SEQ ID NO: 2166692 - RNA, 15 nt, Streptococcus pneumoniae R6
ggaaacucuuacaaa

SEQ ID NO: 2166693 - RNA, 16 nt, Streptococcus pneumoniae R6
ggaaacucaaaagaag

SEQ ID NO: 2166694 - RNA, 14 nt, Streptococcus pneumoniae R6
ggaaagcaucucca

SEQ ID NO: 2166695 - RNA, 18 nt, Streptococcus pneumoniae R6
ggaaaauucucuuuucau

SEQ ID NO: 2166696 - RNA, 14 nt, Streptococcus pneumoniae R6
ggaaaccaagaagu

SEQ ID NO: 2166697 - RNA, 19 nt, Streptococcus pneumoniae R6
ggaaaccaaucucaaaucc

SEQ ID NO: 2166698 - RNA, 20 nt, Streptococcus pneumoniae R6
ggaaaccaaucucaaauccu

SEQ ID NO: 2166699 - RNA, 16 nt, Streptococcus pneumoniae R6
ggaaacauugauaaua

SEQ ID NO: 2166700 - RNA, 21 nt, Streptococcus pneumoniae R6
ggaaacuagccgcagauugcu

SEQ ID NO: 2166701 - RNA, 13 nt, Streptococcus pneumoniae R6
ggaaaagauagag

SEQ ID NO: 2166702 - RNA, 15 nt, Streptococcus pneumoniae R6
ggaaaagauagagac

SEQ ID NO: 2166703 - RNA, 15 nt, Streptococcus pneumoniae R6
ggaaaaccaguucau

SEQ ID NO: 2166704 - RNA, 14 nt, Streptococcus pneumoniae R6
gcuuuuuucuuuua

SEQ ID NO: 2166705 - RNA, 17 nt, Streptococcus pneumoniae R6
gcuuuuuuaucuuuccu

SEQ ID NO: 2166706 - RNA, 19 nt, Streptococcus pneumoniae R6
gcuuuuuuaucuuuccuuc

SEQ ID NO: 2166707 - RNA, 18 nt, Streptococcus pneumoniae R6
gcuuuuuuggcagauuua

SEQ ID NO: 2166708 - RNA, 15 nt, Streptococcus pneumoniae R6
ggaaaaaaugaagca

SEQ ID NO: 2166709 - RNA, 16 nt, Streptococcus pneumoniae R6
ggaaaaaagucuuuaa

SEQ ID NO: 2166710 - RNA, 17 nt, Streptococcus pneumoniae R6
ggaaaguaguaacuuuu

SEQ ID NO: 2166711 - RNA, 13 nt, Streptococcus pneumoniae R6
ggaaagucaaauu

SEQ ID NO: 2166712 - RNA, 11 nt, Streptococcus pneumoniae R6
ggaaauaagaa

SEQ ID NO: 2166713 - RNA, 22 nt, Streptococcus pneumoniae R6
ggaaauucaagaaugacacgua

SEQ ID NO: 2166714 - RNA, 21 nt, Streptococcus pneumoniae R6
ggaaccagguucuaaaaucug

SEQ ID NO: 2166715 - RNA, 22 nt, Streptococcus pneumoniae R6
ggaacgauguuugcagcaccag

SEQ ID NO: 2166716 - RNA, 18 nt, Streptococcus pneumoniae R6
ggaagccuucuuuuccac

SEQ ID NO: 2166717 - RNA, 23 nt, Streptococcus pneumoniae R6
ggaagacugaguauuuuauagua

SEQ ID NO: 2166718 - RNA, 17 nt, Streptococcus pneumoniae R6
ggaagagaagcugucuu

SEQ ID NO: 2166719 - RNA, 19 nt, Streptococcus pneumoniae R6
ggaagagucagacuuggaa

SEQ ID NO: 2166720 - RNA, 14 nt, Streptococcus pneumoniae R6
ggaagauuuauacu

SEQ ID NO: 2166721 - RNA, 14 nt, Streptococcus pneumoniae R6
ggaagaaagaggag

SEQ ID NO: 2166722 - RNA, 23 nt, Streptococcus pneumoniae R6
ggaacugacgaagucagcucaaa

SEQ ID NO: 2166723 - RNA, 15 nt, Streptococcus pneumoniae R6
ggaacuaagauuugu

SEQ ID NO: 2166724 - RNA, 22 nt, Streptococcus pneumoniae R6
ggaacucacuucccugagacuu

SEQ ID NO: 2166725 - RNA, 17 nt, Streptococcus pneumoniae R6
ggaacgcguugugcaga

SEQ ID NO: 2166726 - RNA, 16 nt, Streptococcus pneumoniae R6
ggaauauuuacuaauu

SEQ ID NO: 2166727 - RNA, 19 nt, Streptococcus pneumoniae R6
ggaauauugaguucuucac

SEQ ID NO: 2166728 - RNA, 21 nt, Streptococcus pneumoniae R6
ggaauaguaucugaugcugac

SEQ ID NO: 2166729 - RNA, 18 nt, Streptococcus pneumoniae R6
ggaauaguugaaaucaag

SEQ ID NO: 2166730 - RNA, 17 nt, Streptococcus pneumoniae R6
ggaagguauggccgaua

SEQ ID NO: 2166731 - RNA, 21 nt, Streptococcus pneumoniae R6
ggaagguauggccgauaacag

SEQ ID NO: 2166732 - RNA, 14 nt, Streptococcus pneumoniae R6
ggaaugccaaagac

SEQ ID NO: 2166733 - RNA, 15 nt, Streptococcus pneumoniae R6
ggaaugccaaagaca

SEQ ID NO: 2166734 - RNA, 14 nt, Streptococcus pneumoniae R6
ggaaucaaucuuca

SEQ ID NO: 2166735 - RNA, 17 nt, Streptococcus pneumoniae R6
ggaaugcuugcaaauca

SEQ ID NO: 2166736 - RNA, 16 nt, Streptococcus pneumoniae R6
ggaauuuguaaaguua

SEQ ID NO: 2166737 - RNA, 20 nt, Streptococcus pneumoniae R6
ggaauuagagaguuuuuaua

SEQ ID NO: 2166738 - RNA, 22 nt, Streptococcus pneumoniae R6
ggaauuagagaguuuuuauacu

SEQ ID NO: 2166739 - RNA, 19 nt, Streptococcus pneumoniae R6
ggaauuuuucgacugugau

SEQ ID NO: 2166740 - RNA, 18 nt, Streptococcus pneumoniae R6
ggacaccucuuucuuucu

SEQ ID NO: 2166741 - RNA, 20 nt, Streptococcus pneumoniae R6
ggacagucaaaucgauuucu

SEQ ID NO: 2166742 - RNA, 23 nt, Streptococcus pneumoniae R6
ggacuagaaugcuuuuugaaagc

SEQ ID NO: 2166743 - RNA, 22 nt, Streptococcus pneumoniae R6
ggagagcacccucguuaucauu

SEQ ID NO: 2166744 - RNA, 19 nt, Streptococcus pneumoniae R6
ggagaagauuucagaaaua

SEQ ID NO: 2166745 - RNA, 20 nt, Streptococcus pneumoniae R6
ggagcaguugauggagcugg

SEQ ID NO: 2166746 - RNA, 21 nt, Streptococcus pneumoniae R6
ggagccaaguuaaauucuucu

SEQ ID NO: 2166747 - RNA, 17 nt, Streptococcus pneumoniae R6
ggagcuggggcuacugg

SEQ ID NO: 2166748 - RNA, 17 nt, Streptococcus pneumoniae R6
ggauaacagucaguuca

SEQ ID NO: 2166749 - RNA, 14 nt, Streptococcus pneumoniae R6
ggauaaaaagucca

SEQ ID NO: 2166750 - RNA, 18 nt, Streptococcus pneumoniae R6
ggauaaaaccaaaaagug

SEQ ID NO: 2166751 - RNA, 17 nt, Streptococcus pneumoniae R6
ggagggucuuuuguccu

SEQ ID NO: 2166752 - RNA, 22 nt, Streptococcus pneumoniae R6
ggaggaauaaagguaaaaccaa

SEQ ID NO: 2166753 - RNA, 15 nt, Streptococcus pneumoniae R6
ggagcuuucagagcu

SEQ ID NO: 2166754 - RNA, 21 nt, Streptococcus pneumoniae R6
ggauccauugcuggagcuggg

SEQ ID NO: 2166755 - RNA, 20 nt, Streptococcus pneumoniae R6
ggauccucauauucuuuuac

SEQ ID NO: 2166756 - RNA, 15 nt, Streptococcus pneumoniae R6
ggauaagguaucugg

SEQ ID NO: 2166757 - RNA, 19 nt, Streptococcus pneumoniae R6
ggauaauugaauauggaau

SEQ ID NO: 2166758 - RNA, 14 nt, Streptococcus pneumoniae R6
ggauauaagaagca

SEQ ID NO: 2166759 - RNA, 13 nt, Streptococcus pneumoniae R6
ggauauugacaac

SEQ ID NO: 2166760 - RNA, 17 nt, Streptococcus pneumoniae R6
ggauguguauagagcaa

SEQ ID NO: 2166761 - RNA, 20 nt, Streptococcus pneumoniae R6
ggauugccaacaaacauggc

SEQ ID NO: 2166762 - RNA, 19 nt, Streptococcus pneumoniae R6
ggauuccuuuuugcagaag

SEQ ID NO: 2166763 - RNA, 21 nt, Streptococcus pneumoniae R6
ggaugacaauagcuaauagaa

SEQ ID NO: 2166764 - RNA, 12 nt, Streptococcus pneumoniae R6
ggaugacacgau

SEQ ID NO: 2166765 - RNA, 14 nt, Streptococcus pneumoniae R6
ggaugaaacugacg

SEQ ID NO: 2166766 - RNA, 18 nt, Streptococcus pneumoniae R6
ggaugcggucgccgaugg

SEQ ID NO: 2166767 - RNA, 16 nt, Streptococcus pneumoniae R6
ggcagcuuaagugcgu

SEQ ID NO: 2166768 - RNA, 23 nt, Streptococcus pneumoniae R6
ggcauaauacuguggaauauaga

SEQ ID NO: 2166769 - RNA, 16 nt, Streptococcus pneumoniae R6
ggcauaguaccaguua

SEQ ID NO: 2166770 - RNA, 23 nt, Streptococcus pneumoniae R6
ggcaguaaaucuuccuugaaaga

SEQ ID NO: 2166771 - RNA, 16 nt, Streptococcus pneumoniae R6
ggcagauuuugaagau

SEQ ID NO: 2166772 - RNA, 21 nt, Streptococcus pneumoniae R6
ggcacuagcuccaaacauaac

SEQ ID NO: 2166773 - RNA, 14 nt, Streptococcus pneumoniae R6
ggcagauagagaca

SEQ ID NO: 2166774 - RNA, 19 nt, Streptococcus pneumoniae R6
uaaugauaugguauuuaaa

SEQ ID NO: 2166775 - RNA, 21 nt, Streptococcus pneumoniae R6
uaaugacuuguguuuuuccuu

SEQ ID NO: 2166776 - RNA, 21 nt, Streptococcus pneumoniae R6
uaaugccaaagaaauuauucu

SEQ ID NO: 2166777 - RNA, 18 nt, Streptococcus pneumoniae R6
uaaugcaguaaaucauac

SEQ ID NO: 2166778 - RNA, 15 nt, Streptococcus pneumoniae R6
uaaugcccaagagac

SEQ ID NO: 2166779 - RNA, 23 nt, Streptococcus pneumoniae R6
uaaugcgauugguaucuuggcua

SEQ ID NO: 2166780 - RNA, 16 nt, Streptococcus pneumoniae R6
uaauggcuguguagau

SEQ ID NO: 2166781 - RNA, 19 nt, Streptococcus pneumoniae R6
uaauggcuucauuaugagu

SEQ ID NO: 2166782 - RNA, 16 nt, Streptococcus pneumoniae R6
uaauggcuuguuccaa

SEQ ID NO: 2166783 - RNA, 15 nt, Streptococcus pneumoniae R6
uaaugggccaaauca

SEQ ID NO: 2166784 - RNA, 20 nt, Streptococcus pneumoniae R6
uaaugggccaaaucaucaua

SEQ ID NO: 2166785 - RNA, 13 nt, Streptococcus pneumoniae R6
uaauuaaaaugug

SEQ ID NO: 2166786 - RNA, 19 nt, Streptococcus pneumoniae R6
uaauguuuucccuuugaua

SEQ ID NO: 2166787 - RNA, 21 nt, Streptococcus pneumoniae R6
uaauuaugaaauuuaaaaaga

SEQ ID NO: 2166788 - RNA, 23 nt, Streptococcus pneumoniae R6
uaauuaugaaauuuaaaaagaaa

SEQ ID NO: 2166789 - RNA, 16 nt, Streptococcus pneumoniae R6
uaauuauguacacauu

SEQ ID NO: 2166790 - RNA, 19 nt, Streptococcus pneumoniae R6
uaauucaauuaaguuuuac

SEQ ID NO: 2166791 - RNA, 16 nt, Streptococcus pneumoniae R6
uaauucaccuaaccaa

SEQ ID NO: 2166792 - RNA, 21 nt, Streptococcus pneumoniae R6
uaauucaccuaaccaaauaau

SEQ ID NO: 2166793 - RNA, 16 nt, Streptococcus pneumoniae R6
uaauucgauuucugcu

SEQ ID NO: 2166794 - RNA, 21 nt, Streptococcus pneumoniae R6
uaauucaccuauuaacaauaa

SEQ ID NO: 2166795 - RNA, 12 nt, Streptococcus pneumoniae R6
uaauauaaacuu

SEQ ID NO: 2166796 - RNA, 14 nt, Streptococcus pneumoniae R6
uaauauaauaucuc

SEQ ID NO: 2166797 - RNA, 14 nt, Streptococcus pneumoniae R6
uaauauauaaaauu

SEQ ID NO: 2166798 - RNA, 17 nt, Streptococcus pneumoniae R6
uaauauauaaaauuucu

SEQ ID NO: 2166799 - RNA, 16 nt, Streptococcus pneumoniae R6
uaauauagggcuuuuu

SEQ ID NO: 2166800 - RNA, 16 nt, Streptococcus pneumoniae R6
uaauauauaaaaaaua

SEQ ID NO: 2166801 - RNA, 20 nt, Streptococcus pneumoniae R6
uaauaucaggugugaaaacu

SEQ ID NO: 2166802 - RNA, 20 nt, Streptococcus pneumoniae R6
uaauaucagccagagcacca

SEQ ID NO: 2166803 - RNA, 22 nt, Streptococcus pneumoniae R6
uaauaucagccagagcaccaac

SEQ ID NO: 2166804 - RNA, 13 nt, Streptococcus pneumoniae R6
uaauaucaaggau

SEQ ID NO: 2166805 - RNA, 23 nt, Streptococcus pneumoniae R6
uaauaucagauauucuaaaaccu

SEQ ID NO: 2166806 - RNA, 15 nt, Streptococcus pneumoniae R6
uaauauccgauagca

SEQ ID NO: 2166807 - RNA, 20 nt, Streptococcus pneumoniae R6
uaauauccgauagcaucauu

SEQ ID NO: 2166808 - RNA, 19 nt, Streptococcus pneumoniae R6
uaauaucauaaugagcucc

SEQ ID NO: 2166809 - RNA, 19 nt, Streptococcus pneumoniae R6
uaauagcuugcaauucuuu

SEQ ID NO: 2166810 - RNA, 15 nt, Streptococcus pneumoniae R6
uaauagcugauuuuu

SEQ ID NO: 2166811 - RNA, 22 nt, Streptococcus pneumoniae R6
uaauaguggugugucugaagau

SEQ ID NO: 2166812 - RNA, 19 nt, Streptococcus pneumoniae R6
uaauagugggaauuuguaa

SEQ ID NO: 2166813 - RNA, 23 nt, Streptococcus pneumoniae R6
uaauagugggaauuuguaaaguu

SEQ ID NO: 2166814 - RNA, 14 nt, Streptococcus pneumoniae R6
uaauaguuauaaag

SEQ ID NO: 2166815 - RNA, 20 nt, Streptococcus pneumoniae R6
uaauaguuaucguaauuaaa

SEQ ID NO: 2166816 - RNA, 17 nt, Streptococcus pneumoniae R6
uaacguucuucaacauc

SEQ ID NO: 2166817 - RNA, 19 nt, Streptococcus pneumoniae R6
uaacguucuuuucaagaac

SEQ ID NO: 2166818 - RNA, 14 nt, Streptococcus pneumoniae R6
uaacgucuuuucgu

SEQ ID NO: 2166819 - RNA, 11 nt, Streptococcus pneumoniae R6
uaauauuuccc

SEQ ID NO: 2166820 - RNA, 15 nt, Streptococcus pneumoniae R6
uaauauugagugcuu

SEQ ID NO: 2166821 - RNA, 21 nt, Streptococcus pneumoniae R6
uaaucaccguccccaaaaaua

SEQ ID NO: 2166822 - RNA, 20 nt, Streptococcus pneumoniae R6
uaaucacguugcuuauacuc

SEQ ID NO: 2166823 - RNA, 15 nt, Streptococcus pneumoniae R6
uaaucacuuggaaaa

SEQ ID NO: 2166824 - RNA, 15 nt, Streptococcus pneumoniae R6
uaaucagauaaacaa

SEQ ID NO: 2166825 - RNA, 16 nt, Streptococcus pneumoniae R6
uaaucauuuaauaaug

SEQ ID NO: 2166826 - RNA, 11 nt, Streptococcus pneumoniae R6
uaaucaucugg

SEQ ID NO: 2166827 - RNA, 15 nt, Streptococcus pneumoniae R6
uaaucccucagagua

SEQ ID NO: 2166828 - RNA, 19 nt, Streptococcus pneumoniae R6
uaauccaaaguaaaauaca

SEQ ID NO: 2166829 - RNA, 22 nt, Streptococcus pneumoniae R6
uaauccaauugaggaaguacca

SEQ ID NO: 2166830 - RNA, 13 nt, Streptococcus pneumoniae R6
uacaacuuaaaaa

SEQ ID NO: 2166831 - RNA, 15 nt, Streptococcus pneumoniae R6
uacaacuuaaaaaga

SEQ ID NO: 2166832 - RNA, 20 nt, Streptococcus pneumoniae R6
uacaacuuuaaccaauuguu

SEQ ID NO: 2166833 - RNA, 17 nt, Streptococcus pneumoniae R6
uacaagaaaagugcaaa

SEQ ID NO: 2166834 - RNA, 19 nt, Streptococcus pneumoniae R6
uacaagaaaagugcaaaua

SEQ ID NO: 2166835 - RNA, 16 nt, Streptococcus pneumoniae R6
uacaagaacagucucu

SEQ ID NO: 2166836 - RNA, 21 nt, Streptococcus pneumoniae R6
uacaagaacagucucuguaua

SEQ ID NO: 2166837 - RNA, 15 nt, Streptococcus pneumoniae R6
uacaaagaauaaaau

SEQ ID NO: 2166838 - RNA, 22 nt, Streptococcus pneumoniae R6
uacaaagaauaaaauaguuagg

SEQ ID NO: 2166839 - RNA, 14 nt, Streptococcus pneumoniae R6
uacaaaccuuguac

SEQ ID NO: 2166840 - RNA, 22 nt, Streptococcus pneumoniae R6
uacaaagcccauacgcccucca

SEQ ID NO: 2166841 - RNA, 17 nt, Streptococcus pneumoniae R6
uacaaguguuuucacuu

SEQ ID NO: 2166842 - RNA, 21 nt, Streptococcus pneumoniae R6
uacaaguguuuucacuuccuu

SEQ ID NO: 2166843 - RNA, 23 nt, Streptococcus pneumoniae R6
uacaaguguuuucacuuccuuac

SEQ ID NO: 2166844 - RNA, 22 nt, Streptococcus pneumoniae R6
uacaaguaucuacuuugaaauu

SEQ ID NO: 2166845 - RNA, 18 nt, Streptococcus pneumoniae R6
uacaaggacauugacuuu

SEQ ID NO: 2166846 - RNA, 17 nt, Streptococcus pneumoniae R6
uacaaugucuaaaucuu

SEQ ID NO: 2166847 - RNA, 22 nt, Streptococcus pneumoniae R6
uacaauguugucaauuuccauu

SEQ ID NO: 2166848 - RNA, 18 nt, Streptococcus pneumoniae R6
uacacaggaauacuaaaa

SEQ ID NO: 2166849 - RNA, 21 nt, Streptococcus pneumoniae R6
uacaauucauaaagugcugua

SEQ ID NO: 2166850 - RNA, 20 nt, Streptococcus pneumoniae R6
uacaauugcucuucugaaau

SEQ ID NO: 2166851 - RNA, 18 nt, Streptococcus pneumoniae R6
uacaauuggaaauaacaa

SEQ ID NO: 2166852 - RNA, 18 nt, Streptococcus pneumoniae R6
uacacauuauguaaacaa

SEQ ID NO: 2166853 - RNA, 22 nt, Streptococcus pneumoniae R6
uacacauccaguguauggagcu

SEQ ID NO: 2166854 - RNA, 16 nt, Streptococcus pneumoniae R6
uacacaucuacuucua

SEQ ID NO: 2166855 - RNA, 16 nt, Streptococcus pneumoniae R6
uacacuuaaauucaua

SEQ ID NO: 2166856 - RNA, 23 nt, Streptococcus pneumoniae R6
uacacuucugcuucuaaaacauu

SEQ ID NO: 2166857 - RNA, 24 nt, Streptococcus pneumoniae R6
uacagcuagcuagaguuucaauug

SEQ ID NO: 2166858 - RNA, 21 nt, Streptococcus pneumoniae R6
uacaguugguccguguaaaac

SEQ ID NO: 2166859 - RNA, 22 nt, Streptococcus pneumoniae R6
uacaguuauuuuaguaaaaaaa

SEQ ID NO: 2166860 - RNA, 13 nt, Streptococcus pneumoniae R6
uacaguccucccu

SEQ ID NO: 2166861 - RNA, 16 nt, Streptococcus pneumoniae R6
uacagugaaggcuuua

SEQ ID NO: 2166862 - RNA, 20 nt, Streptococcus pneumoniae R6
uaauuuagagaaugaaauau

SEQ ID NO: 2166863 - RNA, 17 nt, Streptococcus pneumoniae R6
uaauuuaagaguaguau

SEQ ID NO: 2166864 - RNA, 15 nt, Streptococcus pneumoniae R6
uaauuucaaaaucuu

SEQ ID NO: 2166865 - RNA, 16 nt, Streptococcus pneumoniae R6
uaauuucaaaaucuuc

SEQ ID NO: 2166866 - RNA, 13 nt, Streptococcus pneumoniae R6
uaauuucaaaauc

SEQ ID NO: 2166867 - RNA, 12 nt, Streptococcus pneumoniae R6
uaauuuauagaa

SEQ ID NO: 2166868 - RNA, 21 nt, Streptococcus pneumoniae R6
uaauucucuuguuguuguaau

SEQ ID NO: 2166869 - RNA, 14 nt, Streptococcus pneumoniae R6
uaauucucuaaaua

SEQ ID NO: 2166870 - RNA, 15 nt, Streptococcus pneumoniae R6
uaauucucuaaauaa

SEQ ID NO: 2166871 - RNA, 21 nt, Streptococcus pneumoniae R6
uaauucggaaagccaaaucaa

SEQ ID NO: 2166872 - RNA, 16 nt, Streptococcus pneumoniae R6
uaauuucugaaaucaa

SEQ ID NO: 2166873 - RNA, 20 nt, Streptococcus pneumoniae R6
uaauuucuauaaauguuuua

SEQ ID NO: 2166874 - RNA, 21 nt, Streptococcus pneumoniae R6
uaauuucuauaaauguuuuag

SEQ ID NO: 2166875 - RNA, 22 nt, Streptococcus pneumoniae R6
uaauuucuuuuuguguuaaauc

SEQ ID NO: 2166876 - RNA, 23 nt, Streptococcus pneumoniae R6
uaauuucuuuuuguguuaaauca

SEQ ID NO: 2166877 - RNA, 19 nt, Streptococcus pneumoniae R6
uaauuucaagaaguugucu

SEQ ID NO: 2166878 - RNA, 14 nt, Streptococcus pneumoniae R6
uaauuucauuacua

SEQ ID NO: 2166879 - RNA, 14 nt, Streptococcus pneumoniae R6
uaauuucuagaaau

SEQ ID NO: 2166880 - RNA, 18 nt, Streptococcus pneumoniae R6
uaauuucuagaaauauuu

SEQ ID NO: 2166881 - RNA, 16 nt, Streptococcus pneumoniae R6
uaauuuccauaccaaa

SEQ ID NO: 2166882 - RNA, 16 nt, Streptococcus pneumoniae R6
uaauuuccauaucuuu

SEQ ID NO: 2166883 - RNA, 12 nt, Streptococcus pneumoniae R6
uacaaaaccaaa

SEQ ID NO: 2166884 - RNA, 12 nt, Streptococcus pneumoniae R6
uacaaaaauaua

SEQ ID NO: 2166885 - RNA, 22 nt, Streptococcus pneumoniae R6
uacaaaagcacucaauauuaug

SEQ ID NO: 2166886 - RNA, 13 nt, Streptococcus pneumoniae R6
uacaaaaaagcca

SEQ ID NO: 2166887 - RNA, 11 nt, Streptococcus pneumoniae R6
uacaaaaacaa

SEQ ID NO: 2166888 - RNA, 16 nt, Streptococcus pneumoniae R6
uacaaaaacaaagaga

SEQ ID NO: 2166889 - RNA, 14 nt, Streptococcus pneumoniae R6
uaauuuucuuuuug

SEQ ID NO: 2166890 - RNA, 21 nt, Streptococcus pneumoniae R6
uaauuuucuuuuugaguuuug

SEQ ID NO: 2166891 - RNA, 13 nt, Streptococcus pneumoniae R6
uaauuuuccuuaa

SEQ ID NO: 2166892 - RNA, 17 nt, Streptococcus pneumoniae R6
uaauuuucgauaaagua

SEQ ID NO: 2166893 - RNA, 21 nt, Streptococcus pneumoniae R6
uaauuuuucaauaucuuuauu

SEQ ID NO: 2166894 - RNA, 12 nt, Streptococcus pneumoniae R6
uaauuuuucauu

SEQ ID NO: 2166895 - RNA, 22 nt, Streptococcus pneumoniae R6
uaauuuucacaaacaaauccaa

SEQ ID NO: 2166896 - RNA, 20 nt, Streptococcus pneumoniae R6
uaauuuuacuuuccugauag

SEQ ID NO: 2166897 - RNA, 11 nt, Streptococcus pneumoniae R6
uaauuuuaaaa

SEQ ID NO: 2166898 - RNA, 19 nt, Streptococcus pneumoniae R6
uacgaaugaguucaaagcu

SEQ ID NO: 2166899 - RNA, 14 nt, Streptococcus pneumoniae R6
uaccuuuuccuuca

SEQ ID NO: 2166900 - RNA, 16 nt, Streptococcus pneumoniae R6
uaccuuucuuguaaua

SEQ ID NO: 2166901 - RNA, 15 nt, Streptococcus pneumoniae R6
uaccuuugaaaaaau

SEQ ID NO: 2166902 - RNA, 15 nt, Streptococcus pneumoniae R6
uaccuaccagaggau

SEQ ID NO: 2166903 - RNA, 15 nt, Streptococcus pneumoniae R6
uaccuaaucuuucug

SEQ ID NO: 2166904 - RNA, 13 nt, Streptococcus pneumoniae R6
uaccuaagauuag

SEQ ID NO: 2166905 - RNA, 18 nt, Streptococcus pneumoniae R6
uaccuucaggagauaaaa

SEQ ID NO: 2166906 - RNA, 17 nt, Streptococcus pneumoniae R6
uacgcauacuaauagca

SEQ ID NO: 2166907 - RNA, 20 nt, Streptococcus pneumoniae R6
uacguccaccacaaaagaga

SEQ ID NO: 2166908 - RNA, 13 nt, Streptococcus pneumoniae R6
uacgucugcacgg

SEQ ID NO: 2166909 - RNA, 22 nt, Streptococcus pneumoniae R6
uacgucggaacaucuuuuccau

SEQ ID NO: 2166910 - RNA, 20 nt, Streptococcus pneumoniae R6
uacgucggcuagcacuagua

SEQ ID NO: 2166911 - RNA, 17 nt, Streptococcus pneumoniae R6
uacggcaaggcaaagcu

SEQ ID NO: 2166912 - RNA, 17 nt, Streptococcus pneumoniae R6
uaccaccuuuaaauccu

SEQ ID NO: 2166913 - RNA, 15 nt, Streptococcus pneumoniae R6
uacauagaauaauuu

SEQ ID NO: 2166914 - RNA, 19 nt, Streptococcus pneumoniae R6
uacauagagagacagcagu

SEQ ID NO: 2166915 - RNA, 19 nt, Streptococcus pneumoniae R6
uaccacggcagacagagaa

SEQ ID NO: 2166916 - RNA, 20 nt, Streptococcus pneumoniae R6
uaccacuagugaauuugguu

SEQ ID NO: 2166917 - RNA, 21 nt, Streptococcus pneumoniae R6
uacauaauuuaaaauacgcaa

SEQ ID NO: 2166918 - RNA, 18 nt, Streptococcus pneumoniae R6
uacauacuuuaucuucua

SEQ ID NO: 2166919 - RNA, 19 nt, Streptococcus pneumoniae R6
uaccagcaaucaaauucau

SEQ ID NO: 2166920 - RNA, 20 nt, Streptococcus pneumoniae R6
uacccaaaacacaaaaaguc

SEQ ID NO: 2166921 - RNA, 16 nt, Streptococcus pneumoniae R6
uaccgaucucaucuuc

SEQ ID NO: 2166922 - RNA, 21 nt, Streptococcus pneumoniae R6
uaccgaugauguucauaacuu

SEQ ID NO: 2166923 - RNA, 21 nt, Streptococcus pneumoniae R6
uacccucggcuguuuuuucuu

SEQ ID NO: 2166924 - RNA, 18 nt, Streptococcus pneumoniae R6
uacccaaguaaucugcac

SEQ ID NO: 2166925 - RNA, 14 nt, Streptococcus pneumoniae R6
uacccacugugcuu

SEQ ID NO: 2166926 - RNA, 20 nt, Streptococcus pneumoniae R6
uaccgcacuuaugaagaaau

SEQ ID NO: 2166927 - RNA, 15 nt, Streptococcus pneumoniae R6
uacucaaugaaaauc

SEQ ID NO: 2166928 - RNA, 23 nt, Streptococcus pneumoniae R6
uacucaaugaaaaucaaagagca

SEQ ID NO: 2166929 - RNA, 15 nt, Streptococcus pneumoniae R6
uacucaaguccuuuu

SEQ ID NO: 2166930 - RNA, 14 nt, Streptococcus pneumoniae R6
uacucacuuacaua

SEQ ID NO: 2166931 - RNA, 16 nt, Streptococcus pneumoniae R6
uacuaaaccaauaaua

SEQ ID NO: 2166932 - RNA, 14 nt, Streptococcus pneumoniae R6
uacuauucuaguuu

SEQ ID NO: 2166933 - RNA, 15 nt, Streptococcus pneumoniae R6
uacucaacagaagaa

SEQ ID NO: 2166934 - RNA, 15 nt, Streptococcus pneumoniae R6
uacgugacucagcuu

SEQ ID NO: 2166935 - RNA, 17 nt, Streptococcus pneumoniae R6
uacgugaacaaguccau

SEQ ID NO: 2166936 - RNA, 16 nt, Streptococcus pneumoniae R6
uacuaaaauauuucua

SEQ ID NO: 2166937 - RNA, 20 nt, Streptococcus pneumoniae R6
uacuaaaauauuucuagaaa

SEQ ID NO: 2166938 - RNA, 13 nt, Streptococcus pneumoniae R6
uacuaaaacauuu

SEQ ID NO: 2166939 - RNA, 18 nt, Streptococcus pneumoniae R6
uacuaaaacauuucuaua

SEQ ID NO: 2166940 - RNA, 12 nt, Streptococcus pneumoniae R6
uacuaaaauaac

SEQ ID NO: 2166941 - RNA, 13 nt, Streptococcus pneumoniae R6
uacuaaaauaacu

SEQ ID NO: 2166942 - RNA, 19 nt, Streptococcus pneumoniae R6
uacucgugaagaaaucauc

SEQ ID NO: 2166943 - RNA, 17 nt, Streptococcus pneumoniae R6
uacuccuuuuuugacuc

SEQ ID NO: 2166944 - RNA, 15 nt, Streptococcus pneumoniae R6
uacucauaaagucuu

SEQ ID NO: 2166945 - RNA, 16 nt, Streptococcus pneumoniae R6
uacucaguauuuggau

SEQ ID NO: 2166946 - RNA, 12 nt, Streptococcus pneumoniae R6
uacucaugacag

SEQ ID NO: 2166947 - RNA, 19 nt, Streptococcus pneumoniae R6
uacugccgccaccuccgcc

SEQ ID NO: 2166948 - RNA, 19 nt, Streptococcus pneumoniae R6
uacugccccccaaaaaagu

SEQ ID NO: 2166949 - RNA, 21 nt, Streptococcus pneumoniae R6
uacugccuugagguuuuagau

SEQ ID NO: 2166950 - RNA, 19 nt, Streptococcus pneumoniae R6
uacugauguaacuguuuua

SEQ ID NO: 2166951 - RNA, 15 nt, Streptococcus pneumoniae R6
uacugauuucgucag

SEQ ID NO: 2166952 - RNA, 22 nt, Streptococcus pneumoniae R6
uacugacuucgucaguucuauc

SEQ ID NO: 2166953 - RNA, 22 nt, Streptococcus pneumoniae R6
uacugacuucgucaguuucauc

SEQ ID NO: 2166954 - RNA, 12 nt, Streptococcus pneumoniae R6
uacucuguuuuc

SEQ ID NO: 2166955 - RNA, 18 nt, Streptococcus pneumoniae R6
uacucuuagaaaaucucu

SEQ ID NO: 2166956 - RNA, 17 nt, Streptococcus pneumoniae R6
uacucuuauuauucucu

SEQ ID NO: 2166957 - RNA, 14 nt, Streptococcus pneumoniae R6
uacucuucgaaaau

SEQ ID NO: 2166958 - RNA, 13 nt, Streptococcus pneumoniae R6
uacucuuuacuuu

SEQ ID NO: 2166959 - RNA, 15 nt, Streptococcus pneumoniae R6
uacucuucaaaaauc

SEQ ID NO: 2166960 - RNA, 15 nt, Streptococcus pneumoniae R6
uacucuuugauuuuc

SEQ ID NO: 2166961 - RNA, 18 nt, Streptococcus pneumoniae R6
uacucuuugauuuucauu

SEQ ID NO: 2166962 - RNA, 14 nt, Streptococcus pneumoniae R6
uacucuuucaguuu

SEQ ID NO: 2166963 - RNA, 12 nt, Streptococcus pneumoniae R6
uacugaaacaac

SEQ ID NO: 2166964 - RNA, 16 nt, Streptococcus pneumoniae R6
uacugaaacaacaucu

SEQ ID NO: 2166965 - RNA, 18 nt, Streptococcus pneumoniae R6
uacugaaacaacaucuuu

SEQ ID NO: 2166966 - RNA, 22 nt, Streptococcus pneumoniae R6
uacugaaacaacaucuuuccag

SEQ ID NO: 2166967 - RNA, 21 nt, Streptococcus pneumoniae R6
uacugaacaaugaaaaaaaca

SEQ ID NO: 2166968 - RNA, 21 nt, Streptococcus pneumoniae R6
uacuugguugucccaagagua

SEQ ID NO: 2166969 - RNA, 16 nt, Streptococcus pneumoniae R6
uacuuuauaauucaua

SEQ ID NO: 2166970 - RNA, 14 nt, Streptococcus pneumoniae R6
uacuucuuuuucuc

SEQ ID NO: 2166971 - RNA, 23 nt, Streptococcus pneumoniae R6
uacuugauauaguuaaaaaagau

SEQ ID NO: 2166972 - RNA, 15 nt, Streptococcus pneumoniae R6
uacuugauaaaaguu

SEQ ID NO: 2166973 - RNA, 17 nt, Streptococcus pneumoniae R6
uacuugauugcaaagca

SEQ ID NO: 2166974 - RNA, 12 nt, Streptococcus pneumoniae R6
uacuugauuuuu

SEQ ID NO: 2166975 - RNA, 17 nt, Streptococcus pneumoniae R6
uacuuggagaaccuaga

SEQ ID NO: 2166976 - RNA, 14 nt, Streptococcus pneumoniae R6
uacuucuaaaacau

SEQ ID NO: 2166977 - RNA, 15 nt, Streptococcus pneumoniae R6
uacuucuaaaacauu

SEQ ID NO: 2166978 - RNA, 17 nt, Streptococcus pneumoniae R6
uacuucuaaaacauugu

SEQ ID NO: 2166979 - RNA, 16 nt, Streptococcus pneumoniae R6
uacuuuuaauauacuu

SEQ ID NO: 2166980 - RNA, 18 nt, Streptococcus pneumoniae R6
uacuuuuucguuugguaa

SEQ ID NO: 2166981 - RNA, 15 nt, Streptococcus pneumoniae R6
uacuuuuucuuccuu

SEQ ID NO: 2166982 - RNA, 20 nt, Streptococcus pneumoniae R6
uacuuuuuucuuaaguaagu

SEQ ID NO: 2166983 - RNA, 23 nt, Streptococcus pneumoniae R6
uagaaaaaagcuugaguggaaaa

SEQ ID NO: 2166984 - RNA, 16 nt, Streptococcus pneumoniae R6
uagaaaaaaggaauca

SEQ ID NO: 2166985 - RNA, 17 nt, Streptococcus pneumoniae R6
uagaaaaaaggaaucag

SEQ ID NO: 2166986 - RNA, 20 nt, Streptococcus pneumoniae R6
uagaaaaagacuugaaauac

SEQ ID NO: 2166987 - RNA, 17 nt, Streptococcus pneumoniae R6
uacuuugggugcaacuu

SEQ ID NO: 2166988 - RNA, 14 nt, Streptococcus pneumoniae R6
uacuuuguuuagac

SEQ ID NO: 2166989 - RNA, 17 nt, Streptococcus pneumoniae R6
uacuuucuaucuucauu

SEQ ID NO: 2166990 - RNA, 17 nt, Streptococcus pneumoniae R6
uacuuugacccugacuc

SEQ ID NO: 2166991 - RNA, 21 nt, Streptococcus pneumoniae R6
uacuuugacccugacucuccu

SEQ ID NO: 2166992 - RNA, 20 nt, Streptococcus pneumoniae R6
uacuucguucacccuugcuu

SEQ ID NO: 2166993 - RNA, 22 nt, Streptococcus pneumoniae R6
uacuuccguaaucuuguuaaga

SEQ ID NO: 2166994 - RNA, 14 nt, Streptococcus pneumoniae R6
uacuucauguuuuc

SEQ ID NO: 2166995 - RNA, 16 nt, Streptococcus pneumoniae R6
uacuucacuucuguaa

SEQ ID NO: 2166996 - RNA, 18 nt, Streptococcus pneumoniae R6
uacuucaaauccuuuauu

SEQ ID NO: 2166997 - RNA, 13 nt, Streptococcus pneumoniae R6
uacuuaauuuaau

SEQ ID NO: 2166998 - RNA, 21 nt, Streptococcus pneumoniae R6
uacuuaaacgugcuauaucaa

SEQ ID NO: 2166999 - RNA, 18 nt, Streptococcus pneumoniae R6
uacuuaaaauuguuucau

SEQ ID NO: 2167000 - RNA, 22 nt, Streptococcus pneumoniae R6
uacuuaaaauuguuucauguaa

SEQ ID NO: 2167001 - RNA, 13 nt, Streptococcus pneumoniae R6
uacuguuauagau

SEQ ID NO: 2167002 - RNA, 21 nt, Streptococcus pneumoniae R6
uacuuacuuaacccuuuuuau

SEQ ID NO: 2167003 - RNA, 15 nt, Streptococcus pneumoniae R6
uacuuagcuaauuuu

SEQ ID NO: 2167004 - RNA, 14 nt, Streptococcus pneumoniae R6
uacuuagauuuucu

SEQ ID NO: 2167005 - RNA, 19 nt, Streptococcus pneumoniae R6
uacuguauuuuuuuugguu

SEQ ID NO: 2167006 - RNA, 17 nt, Streptococcus pneumoniae R6
uacugucaagucuugcu

SEQ ID NO: 2167007 - RNA, 16 nt, Streptococcus pneumoniae R6
uacuguuaauaaaauu

SEQ ID NO: 2167008 - RNA, 17 nt, Streptococcus pneumoniae R6
uacuguucuaaauucag

SEQ ID NO: 2167009 - RNA, 21 nt, Streptococcus pneumoniae R6
uacugguacuauuuaauguuu

SEQ ID NO: 2167010 - RNA, 15 nt, Streptococcus pneumoniae R6
uaugauauacacacu

SEQ ID NO: 2167011 - RNA, 14 nt, Streptococcus pneumoniae R6
uaugaucuauuccu

SEQ ID NO: 2167012 - RNA, 18 nt, Streptococcus pneumoniae R6
uaugaugugcuauucuaa

SEQ ID NO: 2167013 - RNA, 23 nt, Streptococcus pneumoniae R6
uaugaugcguuuuauaauuuuaa

SEQ ID NO: 2167014 - RNA, 15 nt, Streptococcus pneumoniae R6
uaugauucuuucuaa

SEQ ID NO: 2167015 - RNA, 12 nt, Streptococcus pneumoniae R6
uaugauuucaau

SEQ ID NO: 2167016 - RNA, 17 nt, Streptococcus pneumoniae R6
uaugauuucaauuuuaa

SEQ ID NO: 2167017 - RNA, 22 nt, Streptococcus pneumoniae R6
uaugauuucaauuuuaaauuuu

SEQ ID NO: 2167018 - RNA, 15 nt, Streptococcus pneumoniae R6
uaugauuuaaacuag

SEQ ID NO: 2167019 - RNA, 20 nt, Streptococcus pneumoniae R6
uaugauuuaaacuaguuuuc

SEQ ID NO: 2167020 - RNA, 13 nt, Streptococcus pneumoniae R6
uaugauuuucauu

SEQ ID NO: 2167021 - RNA, 16 nt, Streptococcus pneumoniae R6
uaugcauaauuuccau

SEQ ID NO: 2167022 - RNA, 20 nt, Streptococcus pneumoniae R6
uaugcauaauuuccauacca

SEQ ID NO: 2167023 - RNA, 21 nt, Streptococcus pneumoniae R6
uaugauaaaacguacaguauc

SEQ ID NO: 2167024 - RNA, 18 nt, Streptococcus pneumoniae R6
uaugaguuaccuaaauua

SEQ ID NO: 2167025 - RNA, 15 nt, Streptococcus pneumoniae R6
uaucuucugcuugca

SEQ ID NO: 2167026 - RNA, 17 nt, Streptococcus pneumoniae R6
uaucuucggauuuuucu

SEQ ID NO: 2167027 - RNA, 14 nt, Streptococcus pneumoniae R6
uaucugcuaaaaca

SEQ ID NO: 2167028 - RNA, 21 nt, Streptococcus pneumoniae R6
uaucuugauuuucuuuaaaaa

SEQ ID NO: 2167029 - RNA, 15 nt, Streptococcus pneumoniae R6
uaucuugauauucuu

SEQ ID NO: 2167030 - RNA, 14 nt, Streptococcus pneumoniae R6
uaucuugaauauuu

SEQ ID NO: 2167031 - RNA, 22 nt, Streptococcus pneumoniae R6
uaucuuguccacucgaaacaag

SEQ ID NO: 2167032 - RNA, 19 nt, Streptococcus pneumoniae R6
uaucuuguaagucugcuuu

SEQ ID NO: 2167033 - RNA, 20 nt, Streptococcus pneumoniae R6
uaucuuuggacauagccaau

SEQ ID NO: 2167034 - RNA, 16 nt, Streptococcus pneumoniae R6
uaugaaauuuaaaaag

SEQ ID NO: 2167035 - RNA, 19 nt, Streptococcus pneumoniae R6
uaugaaauuuaaaaagaaa

SEQ ID NO: 2167036 - RNA, 17 nt, Streptococcus pneumoniae R6
uaugaaacuauguacga

SEQ ID NO: 2167037 - RNA, 16 nt, Streptococcus pneumoniae R6
uaucuuuuuucauuac

SEQ ID NO: 2167038 - RNA, 14 nt, Streptococcus pneumoniae R6
uaucuuuuuuugau

SEQ ID NO: 2167039 - RNA, 14 nt, Streptococcus pneumoniae R6
uaucuuuuaacuaa

SEQ ID NO: 2167040 - RNA, 21 nt, Streptococcus pneumoniae R6
uaucuuugggacgauuuucaa

SEQ ID NO: 2167041 - RNA, 21 nt, Streptococcus pneumoniae R6
uaugaaaaagauuuuuuaaaa

SEQ ID NO: 2167042 - RNA, 17 nt, Streptococcus pneumoniae R6
uaugaauaacuucaaua

SEQ ID NO: 2167043 - RNA, 22 nt, Streptococcus pneumoniae R6
uaugaauaacuucaauaucuuu

SEQ ID NO: 2167044 - RNA, 19 nt, Streptococcus pneumoniae R6
uaugucugaauauauaauu

SEQ ID NO: 2167045 - RNA, 15 nt, Streptococcus pneumoniae R6
uauggugcguuuuuu

SEQ ID NO: 2167046 - RNA, 14 nt, Streptococcus pneumoniae R6
uaugguauuuguaa

SEQ ID NO: 2167047 - RNA, 22 nt, Streptococcus pneumoniae R6
uaugguauucauuaagucaaca

SEQ ID NO: 2167048 - RNA, 20 nt, Streptococcus pneumoniae R6
uaugggcaucaacagcucca

SEQ ID NO: 2167049 - RNA, 22 nt, Streptococcus pneumoniae R6
uauguucugugauaaacuugua

SEQ ID NO: 2167050 - RNA, 13 nt, Streptococcus pneumoniae R6
uauguugcaaauu

SEQ ID NO: 2167051 - RNA, 20 nt, Streptococcus pneumoniae R6
uaugucggcuucacauugcc

SEQ ID NO: 2167052 - RNA, 19 nt, Streptococcus pneumoniae R6
uaugugcauaguauuuguu

SEQ ID NO: 2167053 - RNA, 18 nt, Streptococcus pneumoniae R6
uauguucaucuucuuucu

SEQ ID NO: 2167054 - RNA, 15 nt, Streptococcus pneumoniae R6
uauguuauccuauuc

SEQ ID NO: 2167055 - RNA, 13 nt, Streptococcus pneumoniae R6
uauggccugcuag

SEQ ID NO: 2167056 - RNA, 17 nt, Streptococcus pneumoniae R6
uauggccgauaacagcc

SEQ ID NO: 2167057 - RNA, 14 nt, Streptococcus pneumoniae R6
uauggaaucuugca

SEQ ID NO: 2167058 - RNA, 17 nt, Streptococcus pneumoniae R6
uauggaugauaccaucu

SEQ ID NO: 2167059 - RNA, 20 nt, Streptococcus pneumoniae R6
uaugcuagacucuuauuucu

SEQ ID NO: 2167060 - RNA, 16 nt, Streptococcus pneumoniae R6
uaugcuauugaaagga

SEQ ID NO: 2167061 - RNA, 16 nt, Streptococcus pneumoniae R6
uaugcuugccaaauau

SEQ ID NO: 2167062 - RNA, 19 nt, Streptococcus pneumoniae R6
uaugcuugccaaauauugu

SEQ ID NO: 2167063 - RNA, 22 nt, Streptococcus pneumoniae R6
uaugcuuuccuuucaaaauauc

SEQ ID NO: 2167064 - RNA, 14 nt, Streptococcus pneumoniae R6
uaugcguuuuaaug

SEQ ID NO: 2167065 - RNA, 14 nt, Streptococcus pneumoniae R6
uaugcguuuuacua

SEQ ID NO: 2167066 - RNA, 16 nt, Streptococcus pneumoniae R6
uaugcguuuuaucaua

SEQ ID NO: 2167067 - RNA, 21 nt, Streptococcus pneumoniae R6
uaugcguuuuuuugauuuuaa

SEQ ID NO: 2167068 - RNA, 16 nt, Streptococcus pneumoniae R6
uaugccguuucaacaa

SEQ ID NO: 2167069 - RNA, 18 nt, Streptococcus pneumoniae R6
uauaauaaaaugaaauaa

SEQ ID NO: 2167070 - RNA, 15 nt, Streptococcus pneumoniae R6
uauaaucauuaaaau

SEQ ID NO: 2167071 - RNA, 16 nt, Streptococcus pneumoniae R6
uauaaucauuaaaaua

SEQ ID NO: 2167072 - RNA, 17 nt, Streptococcus pneumoniae R6
uauaaucauuaaaauaa

SEQ ID NO: 2167073 - RNA, 21 nt, Streptococcus pneumoniae R6
uauaaucauuaaaauaacuca

SEQ ID NO: 2167074 - RNA, 13 nt, Streptococcus pneumoniae R6
uauaguaaacuga

SEQ ID NO: 2167075 - RNA, 18 nt, Streptococcus pneumoniae R6
uauaauggcuuauuccaa

SEQ ID NO: 2167076 - RNA, 18 nt, Streptococcus pneumoniae R6
uauaauggcuuguuccaa

SEQ ID NO: 2167077 - RNA, 22 nt, Streptococcus pneumoniae R6
uauaguagauugaaacuagaau

SEQ ID NO: 2167078 - RNA, 16 nt, Streptococcus pneumoniae R6
uauaguauaguagacu

SEQ ID NO: 2167079 - RNA, 13 nt, Streptococcus pneumoniae R6
uauaguauauuga

SEQ ID NO: 2167080 - RNA, 21 nt, Streptococcus pneumoniae R6
uauaguagacugaaucugaaa

SEQ ID NO: 2167081 - RNA, 15 nt, Streptococcus pneumoniae R6
uauaguuaaaaaaga

SEQ ID NO: 2167082 - RNA, 13 nt, Streptococcus pneumoniae R6
uauaguuaaauua

SEQ ID NO: 2167083 - RNA, 17 nt, Streptococcus pneumoniae R6
uauaguucguugaaucu

SEQ ID NO: 2167084 - RNA, 21 nt, Streptococcus pneumoniae R6
uauagugaaauuaacaaaaag

SEQ ID NO: 2167085 - RNA, 16 nt, Streptococcus pneumoniae R6
uauagugaauugaaau

SEQ ID NO: 2167086 - RNA, 16 nt, Streptococcus pneumoniae R6
uauagugguguuucaa

SEQ ID NO: 2167087 - RNA, 21 nt, Streptococcus pneumoniae R6
uauagugguguuucaagucuu

SEQ ID NO: 2167088 - RNA, 16 nt, Streptococcus pneumoniae R6
uauaucaugcuuuacu

SEQ ID NO: 2167089 - RNA, 17 nt, Streptococcus pneumoniae R6
uauauacccaaaacaca

SEQ ID NO: 2167090 - RNA, 18 nt, Streptococcus pneumoniae R6
uauauacccaaaacacaa

SEQ ID NO: 2167091 - RNA, 21 nt, Streptococcus pneumoniae R6
uauauacccaaaacacaaaaa

SEQ ID NO: 2167092 - RNA, 20 nt, Streptococcus pneumoniae R6
uauaucaaaaccaguccuug

SEQ ID NO: 2167093 - RNA, 17 nt, Streptococcus pneumoniae R6
uauaguuuugauuauuu

SEQ ID NO: 2167094 - RNA, 13 nt, Streptococcus pneumoniae R6
uauaguuuaauuu

SEQ ID NO: 2167095 - RNA, 18 nt, Streptococcus pneumoniae R6
uauauaauagauugaaau

SEQ ID NO: 2167096 - RNA, 12 nt, Streptococcus pneumoniae R6
uaucacugguca

SEQ ID NO: 2167097 - RNA, 20 nt, Streptococcus pneumoniae R6
uaucacuuuauaguuuucac

SEQ ID NO: 2167098 - RNA, 16 nt, Streptococcus pneumoniae R6
uaucagaaaauaaaau

SEQ ID NO: 2167099 - RNA, 17 nt, Streptococcus pneumoniae R6
uaucagaaaauaaaauu

SEQ ID NO: 2167100 - RNA, 16 nt, Streptococcus pneumoniae R6
uaucacgaacccagcc

SEQ ID NO: 2167101 - RNA, 23 nt, Streptococcus pneumoniae R6
uaucacgauacuguaguuuuucc

SEQ ID NO: 2167102 - RNA, 22 nt, Streptococcus pneumoniae R6
uaucacuaaauccaccuaauua

SEQ ID NO: 2167103 - RNA, 21 nt, Streptococcus pneumoniae R6
uaucacggcauuucugcauaa

SEQ ID NO: 2167104 - RNA, 19 nt, Streptococcus pneumoniae R6
uaucaacucaagaauuauu

SEQ ID NO: 2167105 - RNA, 15 nt, Streptococcus pneumoniae R6
uaucaacugccuggu

SEQ ID NO: 2167106 - RNA, 13 nt, Streptococcus pneumoniae R6
uaucaaaugacua

SEQ ID NO: 2167107 - RNA, 15 nt, Streptococcus pneumoniae R6
uaucaaacuuuuuag

SEQ ID NO: 2167108 - RNA, 14 nt, Streptococcus pneumoniae R6
uaucaaaaccaguc

SEQ ID NO: 2167109 - RNA, 21 nt, Streptococcus pneumoniae R6
uaucaaaaccaguccuugaaa

SEQ ID NO: 2167110 - RNA, 20 nt, Streptococcus pneumoniae R6
uaucaaaagauguuagaaaa

SEQ ID NO: 2167111 - RNA, 12 nt, Streptococcus pneumoniae R6
uauauuuauuau

SEQ ID NO: 2167112 - RNA, 20 nt, Streptococcus pneumoniae R6
uauaugcaauuucuuuauau

SEQ ID NO: 2167113 - RNA, 18 nt, Streptococcus pneumoniae R6
uauccgucacgauuucuu

SEQ ID NO: 2167114 - RNA, 16 nt, Streptococcus pneumoniae R6
uauccgucguuugguu

SEQ ID NO: 2167115 - RNA, 20 nt, Streptococcus pneumoniae R6
uauccgugaguucucuaguc

SEQ ID NO: 2167116 - RNA, 17 nt, Streptococcus pneumoniae R6
uauccuaaaaaagagcu

SEQ ID NO: 2167117 - RNA, 21 nt, Streptococcus pneumoniae R6
uaucccagagcuauaagccca

SEQ ID NO: 2167118 - RNA, 21 nt, Streptococcus pneumoniae R6
uauccauucacaacaucuucu

SEQ ID NO: 2167119 - RNA, 20 nt, Streptococcus pneumoniae R6
uauccauuagcuaaaucuaa

SEQ ID NO: 2167120 - RNA, 22 nt, Streptococcus pneumoniae R6
uauccauuuggguaggucuuuu

SEQ ID NO: 2167121 - RNA, 15 nt, Streptococcus pneumoniae R6
uauccacaucaucaa

SEQ ID NO: 2167122 - RNA, 21 nt, Streptococcus pneumoniae R6
uauccacaaccucaaaacagu

SEQ ID NO: 2167123 - RNA, 19 nt, Streptococcus pneumoniae R6
uauccacaaccuuaaaacg

SEQ ID NO: 2167124 - RNA, 20 nt, Streptococcus pneumoniae R6
uauccaaucuauuuaugaaa

SEQ ID NO: 2167125 - RNA, 23 nt, Streptococcus pneumoniae R6
uauccaaucuauuuaugaaaaag

SEQ ID NO: 2167126 - RNA, 14 nt, Streptococcus pneumoniae R6
uauccaacucagga

SEQ ID NO: 2167127 - RNA, 19 nt, Streptococcus pneumoniae R6
uauccaacucaggaaagau

SEQ ID NO: 2167128 - RNA, 15 nt, Streptococcus pneumoniae R6
uauccaaaacaacca

SEQ ID NO: 2167129 - RNA, 22 nt, Streptococcus pneumoniae R6
uauccaaaaccauucaaaauac

SEQ ID NO: 2167130 - RNA, 19 nt, Streptococcus pneumoniae R6
uaucauucuuauuuggcaa

SEQ ID NO: 2167131 - RNA, 20 nt, Streptococcus pneumoniae R6
uaucauuauggaccaugcaa

SEQ ID NO: 2167132 - RNA, 23 nt, Streptococcus pneumoniae R6
uaucagaaagucgugauuucuau

SEQ ID NO: 2167133 - RNA, 17 nt, Streptococcus pneumoniae R6
uaucagauauucuaaaa

SEQ ID NO: 2167134 - RNA, 14 nt, Streptococcus pneumoniae R6
uaucuccuuugauu

SEQ ID NO: 2167135 - RNA, 18 nt, Streptococcus pneumoniae R6
uaucuccagauagagcua

SEQ ID NO: 2167136 - RNA, 14 nt, Streptococcus pneumoniae R6
uaucucacacaaag

SEQ ID NO: 2167137 - RNA, 21 nt, Streptococcus pneumoniae R6
uaucguuuuacggacauguau

SEQ ID NO: 2167138 - RNA, 18 nt, Streptococcus pneumoniae R6
uaucuaaaaaaaugauaa

SEQ ID NO: 2167139 - RNA, 22 nt, Streptococcus pneumoniae R6
uaucguaacggcuuucaguuuc

SEQ ID NO: 2167140 - RNA, 14 nt, Streptococcus pneumoniae R6
uaucguuauuagca

SEQ ID NO: 2167141 - RNA, 14 nt, Streptococcus pneumoniae R6
uauccuauucuuga

SEQ ID NO: 2167142 - RNA, 12 nt, Streptococcus pneumoniae R6
uaguucuguacu

SEQ ID NO: 2167143 - RNA, 13 nt, Streptococcus pneumoniae R6
uaguugaaaucaa

SEQ ID NO: 2167144 - RNA, 22 nt, Streptococcus pneumoniae R6
uaguuccaauaacuuuaagauu

SEQ ID NO: 2167145 - RNA, 18 nt, Streptococcus pneumoniae R6
uaguucagaauuuucuua

SEQ ID NO: 2167146 - RNA, 18 nt, Streptococcus pneumoniae R6
uaguucucaaccacaaaa

SEQ ID NO: 2167147 - RNA, 15 nt, Streptococcus pneumoniae R6
uaguuggauuuccac

SEQ ID NO: 2167148 - RNA, 16 nt, Streptococcus pneumoniae R6
uaguuggauuuccacu

SEQ ID NO: 2167149 - RNA, 17 nt, Streptococcus pneumoniae R6
uaguuggauuuccacua

SEQ ID NO: 2167150 - RNA, 22 nt, Streptococcus pneumoniae R6
uaguugaagggcguugacaauc

SEQ ID NO: 2167151 - RNA, 18 nt, Streptococcus pneumoniae R6
uaguugaauuaucauagu

SEQ ID NO: 2167152 - RNA, 11 nt, Streptococcus pneumoniae R6
uaguugacaaa

SEQ ID NO: 2167153 - RNA, 19 nt, Streptococcus pneumoniae R6
uaguucuuccaauuucuuu

SEQ ID NO: 2167154 - RNA, 14 nt, Streptococcus pneumoniae R6
uaguucauaagagc

SEQ ID NO: 2167155 - RNA, 15 nt, Streptococcus pneumoniae R6
uaguuuaugaacacu

SEQ ID NO: 2167156 - RNA, 14 nt, Streptococcus pneumoniae R6
uauaaaaagaaaug

SEQ ID NO: 2167157 - RNA, 23 nt, Streptococcus pneumoniae R6
uauaaaaagaaaugucaucucga

SEQ ID NO: 2167158 - RNA, 23 nt, Streptococcus pneumoniae R6
uaguuggccaacuucuuuuugau

SEQ ID NO: 2167159 - RNA, 14 nt, Streptococcus pneumoniae R6
uaguugguuuccuu

SEQ ID NO: 2167160 - RNA, 20 nt, Streptococcus pneumoniae R6
uaguuuaaaucauaauccaa

SEQ ID NO: 2167161 - RNA, 16 nt, Streptococcus pneumoniae R6
uaguuuaaaagacuac

SEQ ID NO: 2167162 - RNA, 18 nt, Streptococcus pneumoniae R6
uauaaaagcucauuuccu

SEQ ID NO: 2167163 - RNA, 15 nt, Streptococcus pneumoniae R6
uauaaaaagcuauag

SEQ ID NO: 2167164 - RNA, 20 nt, Streptococcus pneumoniae R6
uauaaacuuugguuauaaaa

SEQ ID NO: 2167165 - RNA, 15 nt, Streptococcus pneumoniae R6
uauaagaagcauaga

SEQ ID NO: 2167166 - RNA, 19 nt, Streptococcus pneumoniae R6
uauaagcggcuagcgucua

SEQ ID NO: 2167167 - RNA, 13 nt, Streptococcus pneumoniae R6
uauaagcccaaau

SEQ ID NO: 2167168 - RNA, 16 nt, Streptococcus pneumoniae R6
uauaagcccaaaucau

SEQ ID NO: 2167169 - RNA, 18 nt, Streptococcus pneumoniae R6
uauaagauuuaacuuuuu

SEQ ID NO: 2167170 - RNA, 11 nt, Streptococcus pneumoniae R6
uauaagacuuu

SEQ ID NO: 2167171 - RNA, 14 nt, Streptococcus pneumoniae R6
uauaagauacaaau

SEQ ID NO: 2167172 - RNA, 15 nt, Streptococcus pneumoniae R6
uauaagauacaaauu

SEQ ID NO: 2167173 - RNA, 18 nt, Streptococcus pneumoniae R6
uauaagauauacuaaaag

SEQ ID NO: 2167174 - RNA, 18 nt, Streptococcus pneumoniae R6
uauaaggaccaaauauac

SEQ ID NO: 2167175 - RNA, 14 nt, Streptococcus pneumoniae R6
uauaagguuacuuu

SEQ ID NO: 2167176 - RNA, 20 nt, Streptococcus pneumoniae R6
uauaagguucauuagaacac

SEQ ID NO: 2167177 - RNA, 16 nt, Streptococcus pneumoniae R6
uauaagucuuugauuu

SEQ ID NO: 2167178 - RNA, 14 nt, Streptococcus pneumoniae R6
uaguagauugaaau

SEQ ID NO: 2167179 - RNA, 15 nt, Streptococcus pneumoniae R6
uaguagaccucagcu

SEQ ID NO: 2167180 - RNA, 20 nt, Streptococcus pneumoniae R6
uaguagaaaaugaaauacau

SEQ ID NO: 2167181 - RNA, 12 nt, Streptococcus pneumoniae R6
uaguacugaaca

SEQ ID NO: 2167182 - RNA, 17 nt, Streptococcus pneumoniae R6
uaguacugaacaaugaa

SEQ ID NO: 2167183 - RNA, 16 nt, Streptococcus pneumoniae R6
uaguaguuagauaacu

SEQ ID NO: 2167184 - RNA, 22 nt, Streptococcus pneumoniae R6
uaguaguuagauaacuuuucug

SEQ ID NO: 2167185 - RNA, 17 nt, Streptococcus pneumoniae R6
uaguaguuucagcgauu

SEQ ID NO: 2167186 - RNA, 16 nt, Streptococcus pneumoniae R6
uaguaucaaaugacua

SEQ ID NO: 2167187 - RNA, 17 nt, Streptococcus pneumoniae R6
uaguaucagguguugaa

SEQ ID NO: 2167188 - RNA, 22 nt, Streptococcus pneumoniae R6
uaguagugguuuuuaggcaaua

SEQ ID NO: 2167189 - RNA, 17 nt, Streptococcus pneumoniae R6
uaguagcggugaaucua

SEQ ID NO: 2167190 - RNA, 16 nt, Streptococcus pneumoniae R6
uaguagccaaaauccu

SEQ ID NO: 2167191 - RNA, 16 nt, Streptococcus pneumoniae R6
uaguagccaauugagg

SEQ ID NO: 2167192 - RNA, 18 nt, Streptococcus pneumoniae R6
uagucaauugaaacaaga

SEQ ID NO: 2167193 - RNA, 13 nt, Streptococcus pneumoniae R6
uaguauuuuaaaa

SEQ ID NO: 2167194 - RNA, 22 nt, Streptococcus pneumoniae R6
uagucaaagggaaaucugaaaa

SEQ ID NO: 2167195 - RNA, 17 nt, Streptococcus pneumoniae R6
uaguaucccauucuuca

SEQ ID NO: 2167196 - RNA, 18 nt, Streptococcus pneumoniae R6
uagucauuagauauagaa

SEQ ID NO: 2167197 - RNA, 14 nt, Streptococcus pneumoniae R6
uagucauuccaugg

SEQ ID NO: 2167198 - RNA, 19 nt, Streptococcus pneumoniae R6
uagucaugaccccuaaaua

SEQ ID NO: 2167199 - RNA, 22 nt, Streptococcus pneumoniae R6
uaguccacugcaauuucuaaaa

SEQ ID NO: 2167200 - RNA, 21 nt, Streptococcus pneumoniae R6
uaguccaaacguccagccuug

SEQ ID NO: 2167201 - RNA, 20 nt, Streptococcus pneumoniae R6
uaguccaacuguaaagacau

SEQ ID NO: 2167202 - RNA, 23 nt, Streptococcus pneumoniae R6
uaguccaagacguucaaagauau

SEQ ID NO: 2167203 - RNA, 16 nt, Streptococcus pneumoniae R6
uagucauaccaaguuc

SEQ ID NO: 2167204 - RNA, 18 nt, Streptococcus pneumoniae R6
uagucauaccaaguucuu

SEQ ID NO: 2167205 - RNA, 20 nt, Streptococcus pneumoniae R6
uagucaucagaaaaaaggca

SEQ ID NO: 2167206 - RNA, 21 nt, Streptococcus pneumoniae R6
uagucauaacugcuuugagau

SEQ ID NO: 2167207 - RNA, 18 nt, Streptococcus pneumoniae R6
uagucagaauagauaaca

SEQ ID NO: 2167208 - RNA, 19 nt, Streptococcus pneumoniae R6
uagucgaaggcuuguaauu

SEQ ID NO: 2167209 - RNA, 17 nt, Streptococcus pneumoniae R6
uaguccugaaaaucauc

SEQ ID NO: 2167210 - RNA, 17 nt, Streptococcus pneumoniae R6
uagucgcuacaggcaug

SEQ ID NO: 2167211 - RNA, 10 nt, Streptococcus pneumoniae R6
uagugagucc

SEQ ID NO: 2167212 - RNA, 23 nt, Streptococcus pneumoniae R6
uagguuucgcuaucucuaggaau

SEQ ID NO: 2167213 - RNA, 17 nt, Streptococcus pneumoniae R6
uagguuagucaaaaaga

SEQ ID NO: 2167214 - RNA, 22 nt, Streptococcus pneumoniae R6
uaggugcgagacaaaaaaaaca

SEQ ID NO: 2167215 - RNA, 22 nt, Streptococcus pneumoniae R6
uaggugagauuggauuuucuga

SEQ ID NO: 2167216 - RNA, 16 nt, Streptococcus pneumoniae R6
uaggugagcaucagga

SEQ ID NO: 2167217 - RNA, 19 nt, Streptococcus pneumoniae R6
uaggugagcaucaggaaag

SEQ ID NO: 2167218 - RNA, 22 nt, Streptococcus pneumoniae R6
uaggugaaaugucuauuuucuu

SEQ ID NO: 2167219 - RNA, 23 nt, Streptococcus pneumoniae R6
uaggugguuggaaguagugaaag

SEQ ID NO: 2167220 - RNA, 18 nt, Streptococcus pneumoniae R6
uagguguaaacuuuauau

SEQ ID NO: 2167221 - RNA, 17 nt, Streptococcus pneumoniae R6
uagguuaaagguuuuau

SEQ ID NO: 2167222 - RNA, 14 nt, Streptococcus pneumoniae R6
uaggcuuuauuuuc

SEQ ID NO: 2167223 - RNA, 20 nt, Streptococcus pneumoniae R6
uaggcuucgauaauuuucug

SEQ ID NO: 2167224 - RNA, 12 nt, Streptococcus pneumoniae R6
uagguccaagcg

SEQ ID NO: 2167225 - RNA, 11 nt, Streptococcus pneumoniae R6
uagggaaacaa

SEQ ID NO: 2167226 - RNA, 14 nt, Streptococcus pneumoniae R6
uagggaaacaaaag

SEQ ID NO: 2167227 - RNA, 15 nt, Streptococcus pneumoniae R6
uagggaaacaaaagu

SEQ ID NO: 2167228 - RNA, 23 nt, Streptococcus pneumoniae R6
uaguaaaacuguaugagaaacag

SEQ ID NO: 2167229 - RNA, 13 nt, Streptococcus pneumoniae R6
uaguaaaagaauu

SEQ ID NO: 2167230 - RNA, 19 nt, Streptococcus pneumoniae R6
uaguaaaaacguuuuucaa

SEQ ID NO: 2167231 - RNA, 14 nt, Streptococcus pneumoniae R6
uaguaaaaauugcu

SEQ ID NO: 2167232 - RNA, 19 nt, Streptococcus pneumoniae R6
uagguuugcuauuguccaa

SEQ ID NO: 2167233 - RNA, 13 nt, Streptococcus pneumoniae R6
uaguaaacagucc

SEQ ID NO: 2167234 - RNA, 23 nt, Streptococcus pneumoniae R6
uaguaaacagucccauaaaacua

SEQ ID NO: 2167235 - RNA, 16 nt, Streptococcus pneumoniae R6
uaguaaacuucuucuu

SEQ ID NO: 2167236 - RNA, 19 nt, Streptococcus pneumoniae R6
uaguaaacuucuucuucca

SEQ ID NO: 2167237 - RNA, 13 nt, Streptococcus pneumoniae R6
uaguaaauagaag

SEQ ID NO: 2167238 - RNA, 18 nt, Streptococcus pneumoniae R6
uaguaauaauuucaaaau

SEQ ID NO: 2167239 - RNA, 18 nt, Streptococcus pneumoniae R6
uaguaaguuaaaaauccu

SEQ ID NO: 2167240 - RNA, 23 nt, Streptococcus pneumoniae R6
uaguaauuccacacagaaagcau

SEQ ID NO: 2167241 - RNA, 23 nt, Streptococcus pneumoniae R6
uaguaauuuccauaucuuuaggg

SEQ ID NO: 2167242 - RNA, 19 nt, Streptococcus pneumoniae R6
uaguaauuuugugauaaaa

SEQ ID NO: 2167243 - RNA, 22 nt, Streptococcus pneumoniae R6
uaguacaauaccuuuccuccga

SEQ ID NO: 2167244 - RNA, 16 nt, Streptococcus pneumoniae R6
uaguacaccuuuacuu

SEQ ID NO: 2167245 - RNA, 21 nt, Streptococcus pneumoniae R6
uaguaccaguuaccauugacu

SEQ ID NO: 2167246 - RNA, 13 nt, Streptococcus pneumoniae R6
uagcgucaaagaa

SEQ ID NO: 2167247 - RNA, 15 nt, Streptococcus pneumoniae R6
uagcgucaaagaagg

SEQ ID NO: 2167248 - RNA, 21 nt, Streptococcus pneumoniae R6
uagcggcuuguccguuuucau

SEQ ID NO: 2167249 - RNA, 17 nt, Streptococcus pneumoniae R6
uagcgcuugaaacucau

SEQ ID NO: 2167250 - RNA, 13 nt, Streptococcus pneumoniae R6
uagcgcugugaag

SEQ ID NO: 2167251 - RNA, 15 nt, Streptococcus pneumoniae R6
uagcgcaugguuaua

SEQ ID NO: 2167252 - RNA, 15 nt, Streptococcus pneumoniae R6
uagcgcaucaacaug

SEQ ID NO: 2167253 - RNA, 19 nt, Streptococcus pneumoniae R6
uagcccuucauaaaggaac

SEQ ID NO: 2167254 - RNA, 19 nt, Streptococcus pneumoniae R6
uagcccuucggauaaaauc

SEQ ID NO: 2167255 - RNA, 20 nt, Streptococcus pneumoniae R6
uagcccguuggcuaaagaua

SEQ ID NO: 2167256 - RNA, 21 nt, Streptococcus pneumoniae R6
uaggauuucuccuguuucaaa

SEQ ID NO: 2167257 - RNA, 21 nt, Streptococcus pneumoniae R6
uaggauugacaaaauuugguu

SEQ ID NO: 2167258 - RNA, 20 nt, Streptococcus pneumoniae R6
uaggagacucuugagggcac

SEQ ID NO: 2167259 - RNA, 19 nt, Streptococcus pneumoniae R6
uaggaugccuuuuuaugau

SEQ ID NO: 2167260 - RNA, 18 nt, Streptococcus pneumoniae R6
uaggcagaacaagagucc

SEQ ID NO: 2167261 - RNA, 17 nt, Streptococcus pneumoniae R6
uaggcaagcuugaaaca

SEQ ID NO: 2167262 - RNA, 22 nt, Streptococcus pneumoniae R6
uaggcaagcuugaaacaaauaa

SEQ ID NO: 2167263 - RNA, 14 nt, Streptococcus pneumoniae R6
uaggcaauaaaaua

SEQ ID NO: 2167264 - RNA, 20 nt, Streptococcus pneumoniae R6
uaggccaaacuugaaaugau

SEQ ID NO: 2167265 - RNA, 22 nt, Streptococcus pneumoniae R6
uaggccacaaaugcuucuuuga

SEQ ID NO: 2167266 - RNA, 12 nt, Streptococcus pneumoniae R6
uagcuauuucuu

SEQ ID NO: 2167267 - RNA, 16 nt, Streptococcus pneumoniae R6
uagcuauuucuugcuu

SEQ ID NO: 2167268 - RNA, 22 nt, Streptococcus pneumoniae R6
uagcuaucuccucauauuuauu

SEQ ID NO: 2167269 - RNA, 22 nt, Streptococcus pneumoniae R6
uagcucaaaagcuuguuuaaaa

SEQ ID NO: 2167270 - RNA, 22 nt, Streptococcus pneumoniae R6
uagcucaaaaguuuaucuagaa

SEQ ID NO: 2167271 - RNA, 17 nt, Streptococcus pneumoniae R6
uaggacuaaauacaaaa

SEQ ID NO: 2167272 - RNA, 17 nt, Streptococcus pneumoniae R6
uaggacuuccuuuucuu

SEQ ID NO: 2167273 - RNA, 19 nt, Streptococcus pneumoniae R6
uaggacaucauaaaucaau

SEQ ID NO: 2167274 - RNA, 15 nt, Streptococcus pneumoniae R6
uaggacgauaaaaac

SEQ ID NO: 2167275 - RNA, 21 nt, Streptococcus pneumoniae R6
uagcuuccuaguuugcucuuu

SEQ ID NO: 2167276 - RNA, 23 nt, Streptococcus pneumoniae R6
uagcuuccuaguuugcucuuuga

SEQ ID NO: 2167277 - RNA, 17 nt, Streptococcus pneumoniae R6
uagcaagaguuuuucuc

SEQ ID NO: 2167278 - RNA, 22 nt, Streptococcus pneumoniae R6
uagcagacuucuuuuuuacuuc

SEQ ID NO: 2167279 - RNA, 18 nt, Streptococcus pneumoniae R6
uagcagaaucuuuuaauu

SEQ ID NO: 2167280 - RNA, 15 nt, Streptococcus pneumoniae R6
uagcaacuaucugaa

SEQ ID NO: 2167281 - RNA, 16 nt, Streptococcus pneumoniae R6
uagcaacuaucugaau

SEQ ID NO: 2167282 - RNA, 21 nt, Streptococcus pneumoniae R6
uagcaacuguuuuuucaacag

SEQ ID NO: 2167283 - RNA, 23 nt, Streptococcus pneumoniae R6
uagcaacuguuuuuucaacagcu

SEQ ID NO: 2167284 - RNA, 15 nt, Streptococcus pneumoniae R6
uagcagauagguggg

SEQ ID NO: 2167285 - RNA, 20 nt, Streptococcus pneumoniae R6
uagcagauagguggggcaaa

SEQ ID NO: 2167286 - RNA, 21 nt, Streptococcus pneumoniae R6
uagcagcgguuccauuaaagc

SEQ ID NO: 2167287 - RNA, 14 nt, Streptococcus pneumoniae R6
uagcagcuuucaaa

SEQ ID NO: 2167288 - RNA, 17 nt, Streptococcus pneumoniae R6
uagauuuuuucugucua

SEQ ID NO: 2167289 - RNA, 16 nt, Streptococcus pneumoniae R6
uagcaaaacacuacca

SEQ ID NO: 2167290 - RNA, 16 nt, Streptococcus pneumoniae R6
uagcaaaaucauagca

SEQ ID NO: 2167291 - RNA, 18 nt, Streptococcus pneumoniae R6
uagcauggucaaaguagu

SEQ ID NO: 2167292 - RNA, 17 nt, Streptococcus pneumoniae R6
uagcaucuuguguuuuu

SEQ ID NO: 2167293 - RNA, 18 nt, Streptococcus pneumoniae R6
uagcauucuucucagcua

SEQ ID NO: 2167294 - RNA, 14 nt, Streptococcus pneumoniae R6
uagcauccaccacu

SEQ ID NO: 2167295 - RNA, 13 nt, Streptococcus pneumoniae R6
uagcaguaacuuc

SEQ ID NO: 2167296 - RNA, 12 nt, Streptococcus pneumoniae R6
uagcauccccag

SEQ ID NO: 2167297 - RNA, 14 nt, Streptococcus pneumoniae R6
uagccccuagauau

SEQ ID NO: 2167298 - RNA, 18 nt, Streptococcus pneumoniae R6
uagccccuagauauuuug

SEQ ID NO: 2167299 - RNA, 20 nt, Streptococcus pneumoniae R6
uagccccagcuaggagagcu

SEQ ID NO: 2167300 - RNA, 18 nt, Streptococcus pneumoniae R6
uagauuuuuaaauucuuc

SEQ ID NO: 2167301 - RNA, 20 nt, Streptococcus pneumoniae R6
uagauuuuuaaauucuucca

SEQ ID NO: 2167302 - RNA, 13 nt, Streptococcus pneumoniae R6
uagauuuuuauua

SEQ ID NO: 2167303 - RNA, 16 nt, Streptococcus pneumoniae R6
uagauuuuuauuauuu

SEQ ID NO: 2167304 - RNA, 19 nt, Streptococcus pneumoniae R6
uagauuuuuauuauuuccu

SEQ ID NO: 2167305 - RNA, 13 nt, Streptococcus pneumoniae R6
uagauuuucuggc

SEQ ID NO: 2167306 - RNA, 23 nt, Streptococcus pneumoniae R6
uagauuuucuggcagauuuugaa

SEQ ID NO: 2167307 - RNA, 15 nt, Streptococcus pneumoniae R6
uagauuuaaaacugu

SEQ ID NO: 2167308 - RNA, 20 nt, Streptococcus pneumoniae R6
uagauuauguaagauagaga

SEQ ID NO: 2167309 - RNA, 18 nt, Streptococcus pneumoniae R6
uagauucaccaguagacu

SEQ ID NO: 2167310 - RNA, 14 nt, Streptococcus pneumoniae R6
uagauuguccucaa

SEQ ID NO: 2167311 - RNA, 15 nt, Streptococcus pneumoniae R6
uagauuggauaaaau

SEQ ID NO: 2167312 - RNA, 20 nt, Streptococcus pneumoniae R6
uagauucgaucugauauauu

SEQ ID NO: 2167313 - RNA, 14 nt, Streptococcus pneumoniae R6
uagauugaaacuag

SEQ ID NO: 2167314 - RNA, 17 nt, Streptococcus pneumoniae R6
uagauugaaacuggaau

SEQ ID NO: 2167315 - RNA, 13 nt, Streptococcus pneumoniae R6
uagauugaaauaa

SEQ ID NO: 2167316 - RNA, 19 nt, Streptococcus pneumoniae R6
uagaaaacaacuuauaaaa

SEQ ID NO: 2167317 - RNA, 22 nt, Streptococcus pneumoniae R6
uagaaaaauuuuagcagucaag

SEQ ID NO: 2167318 - RNA, 13 nt, Streptococcus pneumoniae R6
uagaaaacaaaaa

SEQ ID NO: 2167319 - RNA, 18 nt, Streptococcus pneumoniae R6
uagaaaaggaguagaaaa

SEQ ID NO: 2167320 - RNA, 20 nt, Streptococcus pneumoniae R6
uagaaaaggaguagaaaaug

SEQ ID NO: 2167321 - RNA, 22 nt, Streptococcus pneumoniae R6
uagaaaaggaguagaaaaugaa

SEQ ID NO: 2167322 - RNA, 15 nt, Streptococcus pneumoniae R6
uagaugaaacugacg

SEQ ID NO: 2167323 - RNA, 15 nt, Streptococcus pneumoniae R6
uagaugaagcaugaa

SEQ ID NO: 2167324 - RNA, 17 nt, Streptococcus pneumoniae R6
uagaaaaucucuucaaa

SEQ ID NO: 2167325 - RNA, 15 nt, Streptococcus pneumoniae R6
uagaaaaugaaauuu

SEQ ID NO: 2167326 - RNA, 13 nt, Streptococcus pneumoniae R6
uagaugaugguuu

SEQ ID NO: 2167327 - RNA, 19 nt, Streptococcus pneumoniae R6
uagaugauuggaaauucaa

SEQ ID NO: 2167328 - RNA, 16 nt, Streptococcus pneumoniae R6
uagaugaucgagcaga

SEQ ID NO: 2167329 - RNA, 21 nt, Streptococcus pneumoniae R6
uagaugauuuucaaauuuucu

SEQ ID NO: 2167330 - RNA, 22 nt, Streptococcus pneumoniae R6
uagaugauuuucaaauuuucuu

SEQ ID NO: 2167331 - RNA, 14 nt, Streptococcus pneumoniae R6
uagaugauuuuucu

SEQ ID NO: 2167332 - RNA, 17 nt, Streptococcus pneumoniae R6
uagauguuauuuacugu

SEQ ID NO: 2167333 - RNA, 17 nt, Streptococcus pneumoniae R6
uagauguucuuugaaau

SEQ ID NO: 2167334 - RNA, 17 nt, Streptococcus pneumoniae R6
ucagcaauagcggcuug

SEQ ID NO: 2167335 - RNA, 19 nt, Streptococcus pneumoniae R6
ucagcagaguuuuuaucua

SEQ ID NO: 2167336 - RNA, 18 nt, Streptococcus pneumoniae R6
ucagcagagaaagaaaac

SEQ ID NO: 2167337 - RNA, 15 nt, Streptococcus pneumoniae R6
ucagcagucguuccu

SEQ ID NO: 2167338 - RNA, 12 nt, Streptococcus pneumoniae R6
ucagcaggagca

SEQ ID NO: 2167339 - RNA, 16 nt, Streptococcus pneumoniae R6
ucagcaggagcaguug

SEQ ID NO: 2167340 - RNA, 17 nt, Streptococcus pneumoniae R6
ucagcauaaucugccuu

SEQ ID NO: 2167341 - RNA, 13 nt, Streptococcus pneumoniae R6
ucagcauaagaca

SEQ ID NO: 2167342 - RNA, 17 nt, Streptococcus pneumoniae R6
ucagcauuuccuagcca

SEQ ID NO: 2167343 - RNA, 22 nt, Streptococcus pneumoniae R6
ucagcauuuccuagccaauagg

SEQ ID NO: 2167344 - RNA, 12 nt, Streptococcus pneumoniae R6
ucagccaaggcu

SEQ ID NO: 2167345 - RNA, 16 nt, Streptococcus pneumoniae R6
ucagccagagcaccaa

SEQ ID NO: 2167346 - RNA, 17 nt, Streptococcus pneumoniae R6
ucagccagagcaccaac

SEQ ID NO: 2167347 - RNA, 18 nt, Streptococcus pneumoniae R6
ucagccagagcaccaacc

SEQ ID NO: 2167348 - RNA, 20 nt, Streptococcus pneumoniae R6
ucagccuuauauuuuuucgu

SEQ ID NO: 2167349 - RNA, 14 nt, Streptococcus pneumoniae R6
ucagaguagucuuu

SEQ ID NO: 2167350 - RNA, 17 nt, Streptococcus pneumoniae R6
ucagagcgauaaaaauc

SEQ ID NO: 2167351 - RNA, 19 nt, Streptococcus pneumoniae R6
ucagagcgauaaaaauccu

SEQ ID NO: 2167352 - RNA, 23 nt, Streptococcus pneumoniae R6
ucagagacagcuuguugcuuuuc

SEQ ID NO: 2167353 - RNA, 16 nt, Streptococcus pneumoniae R6
ucagacugguucucuc

SEQ ID NO: 2167354 - RNA, 14 nt, Streptococcus pneumoniae R6
ucagacuguuuuuc

SEQ ID NO: 2167355 - RNA, 20 nt, Streptococcus pneumoniae R6
ucagauaaacaaugguucca

SEQ ID NO: 2167356 - RNA, 16 nt, Streptococcus pneumoniae R6
ucagaggggugcugag

SEQ ID NO: 2167357 - RNA, 19 nt, Streptococcus pneumoniae R6
ucagauugucgguagaacg

SEQ ID NO: 2167358 - RNA, 13 nt, Streptococcus pneumoniae R6
ucagauuuuaaag

SEQ ID NO: 2167359 - RNA, 17 nt, Streptococcus pneumoniae R6
ucagauuuuaaagacuu

SEQ ID NO: 2167360 - RNA, 19 nt, Streptococcus pneumoniae R6
ucagauucaucauuuauag

SEQ ID NO: 2167361 - RNA, 14 nt, Streptococcus pneumoniae R6
ucagauucugacaa

SEQ ID NO: 2167362 - RNA, 16 nt, Streptococcus pneumoniae R6
ucagacaauccuuggu

SEQ ID NO: 2167363 - RNA, 13 nt, Streptococcus pneumoniae R6
ucagacuauauau

SEQ ID NO: 2167364 - RNA, 23 nt, Streptococcus pneumoniae R6
ucagaaaucuaguuggucaacuu

SEQ ID NO: 2167365 - RNA, 13 nt, Streptococcus pneumoniae R6
ucacuuuuuucuu

SEQ ID NO: 2167366 - RNA, 16 nt, Streptococcus pneumoniae R6
ucacuuuuuguuuaau

SEQ ID NO: 2167367 - RNA, 20 nt, Streptococcus pneumoniae R6
ucacuuuuuguuuaauacuc

SEQ ID NO: 2167368 - RNA, 14 nt, Streptococcus pneumoniae R6
ucagaaaaguaacu

SEQ ID NO: 2167369 - RNA, 19 nt, Streptococcus pneumoniae R6
ucagaaaaguaacuauuuu

SEQ ID NO: 2167370 - RNA, 23 nt, Streptococcus pneumoniae R6
ucagaaaaguaacuauuuuugau

SEQ ID NO: 2167371 - RNA, 12 nt, Streptococcus pneumoniae R6
ucagaaagaagu

SEQ ID NO: 2167372 - RNA, 16 nt, Streptococcus pneumoniae R6
ucagaaacaagaaauc

SEQ ID NO: 2167373 - RNA, 15 nt, Streptococcus pneumoniae R6
ucagaaucccaaaga

SEQ ID NO: 2167374 - RNA, 16 nt, Streptococcus pneumoniae R6
ucagaauccuuauuuu

SEQ ID NO: 2167375 - RNA, 20 nt, Streptococcus pneumoniae R6
ucagaacuaagggaaccuga

SEQ ID NO: 2167376 - RNA, 23 nt, Streptococcus pneumoniae R6
ucacggagacuggugugauuuuc

SEQ ID NO: 2167377 - RNA, 14 nt, Streptococcus pneumoniae R6
ucacgguaacggau

SEQ ID NO: 2167378 - RNA, 18 nt, Streptococcus pneumoniae R6
ucaccuugccaucugcuu

SEQ ID NO: 2167379 - RNA, 14 nt, Streptococcus pneumoniae R6
ucaccugcuuuuaa

SEQ ID NO: 2167380 - RNA, 14 nt, Streptococcus pneumoniae R6
ucaccugcaauaau

SEQ ID NO: 2167381 - RNA, 16 nt, Streptococcus pneumoniae R6
ucaccuccuucuccaa

SEQ ID NO: 2167382 - RNA, 18 nt, Streptococcus pneumoniae R6
ucaccuaguccaagacgu

SEQ ID NO: 2167383 - RNA, 21 nt, Streptococcus pneumoniae R6
ucacgacuuucugauagauuu

SEQ ID NO: 2167384 - RNA, 16 nt, Streptococcus pneumoniae R6
ucacgacuaauuucaa

SEQ ID NO: 2167385 - RNA, 20 nt, Streptococcus pneumoniae R6
ucacgaauggcuagaaccac

SEQ ID NO: 2167386 - RNA, 20 nt, Streptococcus pneumoniae R6
ucacgaauuucuuguucaac

SEQ ID NO: 2167387 - RNA, 18 nt, Streptococcus pneumoniae R6
ucacgacauuaccucuuu

SEQ ID NO: 2167388 - RNA, 16 nt, Streptococcus pneumoniae R6
ucacgaccaaugagaa

SEQ ID NO: 2167389 - RNA, 21 nt, Streptococcus pneumoniae R6
ucacuaaauccaccuaauuau

SEQ ID NO: 2167390 - RNA, 22 nt, Streptococcus pneumoniae R6
ucacuaaauccaccuaauuaua

SEQ ID NO: 2167391 - RNA, 17 nt, Streptococcus pneumoniae R6
ucacguucgguauuuuc

SEQ ID NO: 2167392 - RNA, 20 nt, Streptococcus pneumoniae R6
ucacguucgguauuuucaua

SEQ ID NO: 2167393 - RNA, 19 nt, Streptococcus pneumoniae R6
ucacguaaauugcccuugu

SEQ ID NO: 2167394 - RNA, 17 nt, Streptococcus pneumoniae R6
ucacguaacauauuuuc

SEQ ID NO: 2167395 - RNA, 17 nt, Streptococcus pneumoniae R6
ucacuauaguccaaacg

SEQ ID NO: 2167396 - RNA, 21 nt, Streptococcus pneumoniae R6
ucacuauauugcaagagaaau

SEQ ID NO: 2167397 - RNA, 17 nt, Streptococcus pneumoniae R6
ucacuaauucaccuaac

SEQ ID NO: 2167398 - RNA, 21 nt, Streptococcus pneumoniae R6
ucacuaauucaccuaaccaaa

SEQ ID NO: 2167399 - RNA, 14 nt, Streptococcus pneumoniae R6
ucacucaucugcuu

SEQ ID NO: 2167400 - RNA, 15 nt, Streptococcus pneumoniae R6
ucacucaucugcuua

SEQ ID NO: 2167401 - RNA, 18 nt, Streptococcus pneumoniae R6
ucacucaucugcuuagaa

SEQ ID NO: 2167402 - RNA, 14 nt, Streptococcus pneumoniae R6
ucacuugaccuguu

SEQ ID NO: 2167403 - RNA, 16 nt, Streptococcus pneumoniae R6
ucacuugccucuuuaa

SEQ ID NO: 2167404 - RNA, 21 nt, Streptococcus pneumoniae R6
ucacuuucccuuuccaagaau

SEQ ID NO: 2167405 - RNA, 16 nt, Streptococcus pneumoniae R6
ucacuuuauuuuuucu

SEQ ID NO: 2167406 - RNA, 23 nt, Streptococcus pneumoniae R6
ucacuuuauuuuuucuguaaaau

SEQ ID NO: 2167407 - RNA, 18 nt, Streptococcus pneumoniae R6
ucacuuacauauucuaac

SEQ ID NO: 2167408 - RNA, 12 nt, Streptococcus pneumoniae R6
ucacuuccuuac

SEQ ID NO: 2167409 - RNA, 15 nt, Streptococcus pneumoniae R6
ucacugaacuauuuu

SEQ ID NO: 2167410 - RNA, 13 nt, Streptococcus pneumoniae R6
ucacugaugaaac

SEQ ID NO: 2167411 - RNA, 16 nt, Streptococcus pneumoniae R6
ucacugaugaaacuaa

SEQ ID NO: 2167412 - RNA, 16 nt, Streptococcus pneumoniae R6
ucacuggcauuuagca

SEQ ID NO: 2167413 - RNA, 19 nt, Streptococcus pneumoniae R6
ucacugugacuagcaauca

SEQ ID NO: 2167414 - RNA, 15 nt, Streptococcus pneumoniae R6
ucaaucaaagcuccc

SEQ ID NO: 2167415 - RNA, 21 nt, Streptococcus pneumoniae R6
ucaauaugcucacugaugaaa

SEQ ID NO: 2167416 - RNA, 12 nt, Streptococcus pneumoniae R6
ucaauauguuug

SEQ ID NO: 2167417 - RNA, 20 nt, Streptococcus pneumoniae R6
ucaaucaaguaagccauauu

SEQ ID NO: 2167418 - RNA, 14 nt, Streptococcus pneumoniae R6
ucaaucaauccaaa

SEQ ID NO: 2167419 - RNA, 17 nt, Streptococcus pneumoniae R6
ucaaucaccguuugauu

SEQ ID NO: 2167420 - RNA, 14 nt, Streptococcus pneumoniae R6
ucaaucaauuuaau

SEQ ID NO: 2167421 - RNA, 22 nt, Streptococcus pneumoniae R6
ucaauaucaaaaccaaacucac

SEQ ID NO: 2167422 - RNA, 18 nt, Streptococcus pneumoniae R6
ucaauauagucuacaaua

SEQ ID NO: 2167423 - RNA, 15 nt, Streptococcus pneumoniae R6
ucaauaucuuuauug

SEQ ID NO: 2167424 - RNA, 17 nt, Streptococcus pneumoniae R6
ucaauaucguaucuuug

SEQ ID NO: 2167425 - RNA, 22 nt, Streptococcus pneumoniae R6
ucaauagcauugucacaaagga

SEQ ID NO: 2167426 - RNA, 15 nt, Streptococcus pneumoniae R6
ucaauaccaaagaag

SEQ ID NO: 2167427 - RNA, 17 nt, Streptococcus pneumoniae R6
ucaauacagaagaaaaa

SEQ ID NO: 2167428 - RNA, 18 nt, Streptococcus pneumoniae R6
ucaauacagaagaaaaac

SEQ ID NO: 2167429 - RNA, 14 nt, Streptococcus pneumoniae R6
ucaauagacuauau

SEQ ID NO: 2167430 - RNA, 17 nt, Streptococcus pneumoniae R6
ucaauaaccaucauuuu

SEQ ID NO: 2167431 - RNA, 18 nt, Streptococcus pneumoniae R6
ucaauaacacgagaaaca

SEQ ID NO: 2167432 - RNA, 18 nt, Streptococcus pneumoniae R6
ucaauaagcccgaaaaau

SEQ ID NO: 2167433 - RNA, 13 nt, Streptococcus pneumoniae R6
ucaauaauccuaa

SEQ ID NO: 2167434 - RNA, 18 nt, Streptococcus pneumoniae R6
ucaagcugugaguucauu

SEQ ID NO: 2167435 - RNA, 23 nt, Streptococcus pneumoniae R6
ucaagcuggcuacagaugcugca

SEQ ID NO: 2167436 - RNA, 19 nt, Streptococcus pneumoniae R6
ucaagcguuuuucuucugu

SEQ ID NO: 2167437 - RNA, 17 nt, Streptococcus pneumoniae R6
ucaagcgguucagcuca

SEQ ID NO: 2167438 - RNA, 15 nt, Streptococcus pneumoniae R6
ucaagcgaacaucuc

SEQ ID NO: 2167439 - RNA, 19 nt, Streptococcus pneumoniae R6
ucaagccuuauugcucuug

SEQ ID NO: 2167440 - RNA, 17 nt, Streptococcus pneumoniae R6
ucaaggucgcauaggca

SEQ ID NO: 2167441 - RNA, 23 nt, Streptococcus pneumoniae R6
ucaaguaacuuuggcgauuuaca

SEQ ID NO: 2167442 - RNA, 19 nt, Streptococcus pneumoniae R6
ucaagguuuuauacucuua

SEQ ID NO: 2167443 - RNA, 23 nt, Streptococcus pneumoniae R6
ucaagguuuuauacucuuagaaa

SEQ ID NO: 2167444 - RNA, 14 nt, Streptococcus pneumoniae R6
ucaagguuuuucaa

SEQ ID NO: 2167445 - RNA, 18 nt, Streptococcus pneumoniae R6
ucaagguuuuucuguacu

SEQ ID NO: 2167446 - RNA, 17 nt, Streptococcus pneumoniae R6
ucaagguuuuucuuaua

SEQ ID NO: 2167447 - RNA, 16 nt, Streptococcus pneumoniae R6
ucaagguuuuugaaaa

SEQ ID NO: 2167448 - RNA, 20 nt, Streptococcus pneumoniae R6
ucaaggcaguacuuugagca

SEQ ID NO: 2167449 - RNA, 18 nt, Streptococcus pneumoniae R6
ucaaguguaucaggaaua

SEQ ID NO: 2167450 - RNA, 21 nt, Streptococcus pneumoniae R6
ucaagugcuuuugugauuuua

SEQ ID NO: 2167451 - RNA, 21 nt, Streptococcus pneumoniae R6
ucaaguucacucaaaccugau

SEQ ID NO: 2167452 - RNA, 13 nt, Streptococcus pneumoniae R6
ucaagucaacuug

SEQ ID NO: 2167453 - RNA, 16 nt, Streptococcus pneumoniae R6
ucaagucaacuugaag

SEQ ID NO: 2167454 - RNA, 15 nt, Streptococcus pneumoniae R6
ucaaguccuuuauug

SEQ ID NO: 2167455 - RNA, 21 nt, Streptococcus pneumoniae R6
ucaaguccuuuugauuacaua

SEQ ID NO: 2167456 - RNA, 22 nt, Streptococcus pneumoniae R6
ucaaguucugucuugcugucuc

SEQ ID NO: 2167457 - RNA, 14 nt, Streptococcus pneumoniae R6
ucaauaaaauauaa

SEQ ID NO: 2167458 - RNA, 15 nt, Streptococcus pneumoniae R6
ucaauggacuauagu

SEQ ID NO: 2167459 - RNA, 15 nt, Streptococcus pneumoniae R6
ucaauggaguaaaaa

SEQ ID NO: 2167460 - RNA, 18 nt, Streptococcus pneumoniae R6
ucaaugaguccgaaaaau

SEQ ID NO: 2167461 - RNA, 22 nt, Streptococcus pneumoniae R6
ucaaugaguccgaaaaauuucu

SEQ ID NO: 2167462 - RNA, 21 nt, Streptococcus pneumoniae R6
ucaaugauaaaagucuccugu

SEQ ID NO: 2167463 - RNA, 17 nt, Streptococcus pneumoniae R6
ucaaugauuugaacauu

SEQ ID NO: 2167464 - RNA, 17 nt, Streptococcus pneumoniae R6
ucaaucguuucuggcag

SEQ ID NO: 2167465 - RNA, 18 nt, Streptococcus pneumoniae R6
ucaaucuacuauagaaaa

SEQ ID NO: 2167466 - RNA, 21 nt, Streptococcus pneumoniae R6
ucaaucgcuuaauuucuauca

SEQ ID NO: 2167467 - RNA, 14 nt, Streptococcus pneumoniae R6
ucaaugaaaaucaa

SEQ ID NO: 2167468 - RNA, 21 nt, Streptococcus pneumoniae R6
ucaaugaaaaucaaagagcaa

SEQ ID NO: 2167469 - RNA, 22 nt, Streptococcus pneumoniae R6
ucaaugaaaaucaaagagcaaa

SEQ ID NO: 2167470 - RNA, 19 nt, Streptococcus pneumoniae R6
ucaaucuugucuaaaaaua

SEQ ID NO: 2167471 - RNA, 21 nt, Streptococcus pneumoniae R6
ucaaucuugucuaaaaauagg

SEQ ID NO: 2167472 - RNA, 15 nt, Streptococcus pneumoniae R6
ucaaucuucaaaauc

SEQ ID NO: 2167473 - RNA, 13 nt, Streptococcus pneumoniae R6
ucaaucuuaucaa

SEQ ID NO: 2167474 - RNA, 16 nt, Streptococcus pneumoniae R6
ucaaucuuaucaauca

SEQ ID NO: 2167475 - RNA, 14 nt, Streptococcus pneumoniae R6
ucaaucuuaucuaa

SEQ ID NO: 2167476 - RNA, 23 nt, Streptococcus pneumoniae R6
ucaauccaucuccaaccaucaaa

SEQ ID NO: 2167477 - RNA, 15 nt, Streptococcus pneumoniae R6
ucaauccauuauaca

SEQ ID NO: 2167478 - RNA, 21 nt, Streptococcus pneumoniae R6
ucaauccacuuguaaagcgaa

SEQ ID NO: 2167479 - RNA, 20 nt, Streptococcus pneumoniae R6
ucaauccccaagggaccaaa

SEQ ID NO: 2167480 - RNA, 16 nt, Streptococcus pneumoniae R6
ucaaucauaucaucaa

SEQ ID NO: 2167481 - RNA, 19 nt, Streptococcus pneumoniae R6
ucaaucaguuuuuucacaa

SEQ ID NO: 2167482 - RNA, 20 nt, Streptococcus pneumoniae R6
ucaaucaguuuuuucacaaa

SEQ ID NO: 2167483 - RNA, 15 nt, Streptococcus pneumoniae R6
ucacaaauucuggca

SEQ ID NO: 2167484 - RNA, 16 nt, Streptococcus pneumoniae R6
ucacaaauucuggcau

SEQ ID NO: 2167485 - RNA, 12 nt, Streptococcus pneumoniae R6
ucacaaaugaga

SEQ ID NO: 2167486 - RNA, 19 nt, Streptococcus pneumoniae R6
ucacaaagaguucccugcu

SEQ ID NO: 2167487 - RNA, 20 nt, Streptococcus pneumoniae R6
ucacaaagaacaugaaagau

SEQ ID NO: 2167488 - RNA, 12 nt, Streptococcus pneumoniae R6
ucaauuuuuaac

SEQ ID NO: 2167489 - RNA, 12 nt, Streptococcus pneumoniae R6
ucacaaaauccu

SEQ ID NO: 2167490 - RNA, 23 nt, Streptococcus pneumoniae R6
ucaauuuguucguauccuauuuc

SEQ ID NO: 2167491 - RNA, 15 nt, Streptococcus pneumoniae R6
ucaauuuuccuuucc

SEQ ID NO: 2167492 - RNA, 18 nt, Streptococcus pneumoniae R6
ucaauuuacuauacuuac

SEQ ID NO: 2167493 - RNA, 21 nt, Streptococcus pneumoniae R6
ucaauuuacuauacuuacuua

SEQ ID NO: 2167494 - RNA, 23 nt, Streptococcus pneumoniae R6
ucaauuucagaagaaaaaaagua

SEQ ID NO: 2167495 - RNA, 12 nt, Streptococcus pneumoniae R6
ucaauuucuaau

SEQ ID NO: 2167496 - RNA, 20 nt, Streptococcus pneumoniae R6
ucaauuucuauuuuaaaaau

SEQ ID NO: 2167497 - RNA, 12 nt, Streptococcus pneumoniae R6
ucaauugcuagc

SEQ ID NO: 2167498 - RNA, 16 nt, Streptococcus pneumoniae R6
ucaauugaaacaagaa

SEQ ID NO: 2167499 - RNA, 17 nt, Streptococcus pneumoniae R6
ucaauucuuuaacaaaa

SEQ ID NO: 2167500 - RNA, 17 nt, Streptococcus pneumoniae R6
ucaauuccuucuggaac

SEQ ID NO: 2167501 - RNA, 13 nt, Streptococcus pneumoniae R6
ucaauguuuuauu

SEQ ID NO: 2167502 - RNA, 19 nt, Streptococcus pneumoniae R6
ucaauuaagaaauuuucuu

SEQ ID NO: 2167503 - RNA, 16 nt, Streptococcus pneumoniae R6
ucaauuaaguuuuacg

SEQ ID NO: 2167504 - RNA, 20 nt, Streptococcus pneumoniae R6
ucaauuauagacacauucgu

SEQ ID NO: 2167505 - RNA, 15 nt, Streptococcus pneumoniae R6
ucaauucacuauagu

SEQ ID NO: 2167506 - RNA, 21 nt, Streptococcus pneumoniae R6
ucaauucacuauaguuuaauu

SEQ ID NO: 2167507 - RNA, 20 nt, Streptococcus pneumoniae R6
ucaauuccaagguagcaaca

SEQ ID NO: 2167508 - RNA, 16 nt, Streptococcus pneumoniae R6
ucaauuagaaaauuca

SEQ ID NO: 2167509 - RNA, 13 nt, Streptococcus pneumoniae R6
ucaauuagaaaau

SEQ ID NO: 2167510 - RNA, 14 nt, Streptococcus pneumoniae R6
ucaccgccugcuca

SEQ ID NO: 2167511 - RNA, 19 nt, Streptococcus pneumoniae R6
ucaccgccugcucaccauc

SEQ ID NO: 2167512 - RNA, 21 nt, Streptococcus pneumoniae R6
ucaccgccugcucaccaucuu

SEQ ID NO: 2167513 - RNA, 20 nt, Streptococcus pneumoniae R6
ucaccguagguugggugaag

SEQ ID NO: 2167514 - RNA, 14 nt, Streptococcus pneumoniae R6
ucaccgauugccau

SEQ ID NO: 2167515 - RNA, 22 nt, Streptococcus pneumoniae R6
ucaccaucuaagguauauucaa

SEQ ID NO: 2167516 - RNA, 16 nt, Streptococcus pneumoniae R6
ucaccauuauaguuua

SEQ ID NO: 2167517 - RNA, 13 nt, Streptococcus pneumoniae R6
ucaccccacgaag

SEQ ID NO: 2167518 - RNA, 14 nt, Streptococcus pneumoniae R6
ucaccauaaaucuu

SEQ ID NO: 2167519 - RNA, 23 nt, Streptococcus pneumoniae R6
ucaccaguaaaguguucugucuu

SEQ ID NO: 2167520 - RNA, 15 nt, Streptococcus pneumoniae R6
ucaccaggcauuauu

SEQ ID NO: 2167521 - RNA, 19 nt, Streptococcus pneumoniae R6
ucaccacaugacauuauuu

SEQ ID NO: 2167522 - RNA, 20 nt, Streptococcus pneumoniae R6
ucaccaaauuucauauuuuc

SEQ ID NO: 2167523 - RNA, 14 nt, Streptococcus pneumoniae R6
ucacauuggcaaga

SEQ ID NO: 2167524 - RNA, 22 nt, Streptococcus pneumoniae R6
ucacauugccgacucaaguaca

SEQ ID NO: 2167525 - RNA, 16 nt, Streptococcus pneumoniae R6
ucacauuuucaaaaac

SEQ ID NO: 2167526 - RNA, 13 nt, Streptococcus pneumoniae R6
ucacauuuucaau

SEQ ID NO: 2167527 - RNA, 21 nt, Streptococcus pneumoniae R6
ucacauucgaaugauauuuuc

SEQ ID NO: 2167528 - RNA, 20 nt, Streptococcus pneumoniae R6
ucacaugacguucaaaggca

SEQ ID NO: 2167529 - RNA, 18 nt, Streptococcus pneumoniae R6
ucacaucuguguagcacu

SEQ ID NO: 2167530 - RNA, 18 nt, Streptococcus pneumoniae R6
ucacaguuaaauuauaaa

SEQ ID NO: 2167531 - RNA, 20 nt, Streptococcus pneumoniae R6
ucacaguuaaauuauaaauu

SEQ ID NO: 2167532 - RNA, 13 nt, Streptococcus pneumoniae R6
ucacauauauaau

SEQ ID NO: 2167533 - RNA, 14 nt, Streptococcus pneumoniae R6
ucacacggaaacag

SEQ ID NO: 2167534 - RNA, 14 nt, Streptococcus pneumoniae R6
ucacacggaaguau

SEQ ID NO: 2167535 - RNA, 19 nt, Streptococcus pneumoniae R6
ucacagaaccaucuucauu

SEQ ID NO: 2167536 - RNA, 14 nt, Streptococcus pneumoniae R6
ucacagaaugaaca

SEQ ID NO: 2167537 - RNA, 23 nt, Streptococcus pneumoniae R6
ucacaacucuuauacuuuucucu

SEQ ID NO: 2167538 - RNA, 20 nt, Streptococcus pneumoniae R6
ucacaacugaacgacugguu

SEQ ID NO: 2167539 - RNA, 19 nt, Streptococcus pneumoniae R6
ucacaaucucacuaugauu

SEQ ID NO: 2167540 - RNA, 16 nt, Streptococcus pneumoniae R6
ucacaauccagccugc

SEQ ID NO: 2167541 - RNA, 17 nt, Streptococcus pneumoniae R6
ucacacaaaaaagaggc

SEQ ID NO: 2167542 - RNA, 14 nt, Streptococcus pneumoniae R6
ucacacaaagugga

SEQ ID NO: 2167543 - RNA, 22 nt, Streptococcus pneumoniae R6
uauucccuaccucauaucuguc

SEQ ID NO: 2167544 - RNA, 18 nt, Streptococcus pneumoniae R6
uauucaugggauuucgga

SEQ ID NO: 2167545 - RNA, 15 nt, Streptococcus pneumoniae R6
uauuccauauucaau

SEQ ID NO: 2167546 - RNA, 16 nt, Streptococcus pneumoniae R6
uauuccacauucauac

SEQ ID NO: 2167547 - RNA, 14 nt, Streptococcus pneumoniae R6
uauucauaaaauac

SEQ ID NO: 2167548 - RNA, 15 nt, Streptococcus pneumoniae R6
uauucaucuuaucaa

SEQ ID NO: 2167549 - RNA, 17 nt, Streptococcus pneumoniae R6
uauucauauccccagac

SEQ ID NO: 2167550 - RNA, 15 nt, Streptococcus pneumoniae R6
uauucaccaaucugc

SEQ ID NO: 2167551 - RNA, 18 nt, Streptococcus pneumoniae R6
uauucacccgaguauaau

SEQ ID NO: 2167552 - RNA, 15 nt, Streptococcus pneumoniae R6
uauucagaaaucuag

SEQ ID NO: 2167553 - RNA, 17 nt, Streptococcus pneumoniae R6
uauucagacuauauaug

SEQ ID NO: 2167554 - RNA, 12 nt, Streptococcus pneumoniae R6
uauucaacacuu

SEQ ID NO: 2167555 - RNA, 18 nt, Streptococcus pneumoniae R6
uauucaacgaaaauaauu

SEQ ID NO: 2167556 - RNA, 16 nt, Streptococcus pneumoniae R6
uauuauuucauuuucu

SEQ ID NO: 2167557 - RNA, 19 nt, Streptococcus pneumoniae R6
uauuauuucauuuucuccu

SEQ ID NO: 2167558 - RNA, 17 nt, Streptococcus pneumoniae R6
uauucuuggcaaaguuu

SEQ ID NO: 2167559 - RNA, 14 nt, Streptococcus pneumoniae R6
uauucuucucuauu

SEQ ID NO: 2167560 - RNA, 14 nt, Streptococcus pneumoniae R6
uauucuuauuucaa

SEQ ID NO: 2167561 - RNA, 21 nt, Streptococcus pneumoniae R6
uauucuucgugaaagacaaag

SEQ ID NO: 2167562 - RNA, 16 nt, Streptococcus pneumoniae R6
uauucuuaaauccaca

SEQ ID NO: 2167563 - RNA, 15 nt, Streptococcus pneumoniae R6
uauucuuaaaugaca

SEQ ID NO: 2167564 - RNA, 11 nt, Streptococcus pneumoniae R6
uauucuggaag

SEQ ID NO: 2167565 - RNA, 19 nt, Streptococcus pneumoniae R6
uauucuggaagugaaaaag

SEQ ID NO: 2167566 - RNA, 21 nt, Streptococcus pneumoniae R6
uauucuuuuuugguuucuuga

SEQ ID NO: 2167567 - RNA, 13 nt, Streptococcus pneumoniae R6
uauucuuuuucua

SEQ ID NO: 2167568 - RNA, 18 nt, Streptococcus pneumoniae R6
uauugaaaggaaaaugau

SEQ ID NO: 2167569 - RNA, 20 nt, Streptococcus pneumoniae R6
uauugaaaugaaauaaaauu

SEQ ID NO: 2167570 - RNA, 14 nt, Streptococcus pneumoniae R6
uauucgcuuacaua

SEQ ID NO: 2167571 - RNA, 17 nt, Streptococcus pneumoniae R6
uauucgcuuacauaaag

SEQ ID NO: 2167572 - RNA, 17 nt, Streptococcus pneumoniae R6
uauucguuuuuuauguu

SEQ ID NO: 2167573 - RNA, 16 nt, Streptococcus pneumoniae R6
uauucuagugaaaaau

SEQ ID NO: 2167574 - RNA, 21 nt, Streptococcus pneumoniae R6
uauucuaguuucaauauauua

SEQ ID NO: 2167575 - RNA, 21 nt, Streptococcus pneumoniae R6
uauucuaagcgaccaucuuga

SEQ ID NO: 2167576 - RNA, 19 nt, Streptococcus pneumoniae R6
uauucugaaugcuuuccaa

SEQ ID NO: 2167577 - RNA, 11 nt, Streptococcus pneumoniae R6
uauucucuaga

SEQ ID NO: 2167578 - RNA, 21 nt, Streptococcus pneumoniae R6
uauucucguagugcuucucuu

SEQ ID NO: 2167579 - RNA, 18 nt, Streptococcus pneumoniae R6
uauuaauuucauuacuaa

SEQ ID NO: 2167580 - RNA, 13 nt, Streptococcus pneumoniae R6
uauuaccuugaac

SEQ ID NO: 2167581 - RNA, 13 nt, Streptococcus pneumoniae R6
uauuaccuuucuu

SEQ ID NO: 2167582 - RNA, 20 nt, Streptococcus pneumoniae R6
uauuacaucguugguuuauu

SEQ ID NO: 2167583 - RNA, 22 nt, Streptococcus pneumoniae R6
uauuaccaaguuaaacaaccuu

SEQ ID NO: 2167584 - RNA, 23 nt, Streptococcus pneumoniae R6
uauuaccaaguuaaacaaccuug

SEQ ID NO: 2167585 - RNA, 13 nt, Streptococcus pneumoniae R6
uauuaagccucuu

SEQ ID NO: 2167586 - RNA, 20 nt, Streptococcus pneumoniae R6
uauuaagaaucuuuucuauu

SEQ ID NO: 2167587 - RNA, 20 nt, Streptococcus pneumoniae R6
uauuaaucaccguccccaaa

SEQ ID NO: 2167588 - RNA, 14 nt, Streptococcus pneumoniae R6
uauuaaucacuaau

SEQ ID NO: 2167589 - RNA, 21 nt, Streptococcus pneumoniae R6
uauuaacaauaaucuaugaua

SEQ ID NO: 2167590 - RNA, 16 nt, Streptococcus pneumoniae R6
uauuaacaaaagagcu

SEQ ID NO: 2167591 - RNA, 13 nt, Streptococcus pneumoniae R6
uauuauauaucug

SEQ ID NO: 2167592 - RNA, 21 nt, Streptococcus pneumoniae R6
uauuauauauaugcacagaca

SEQ ID NO: 2167593 - RNA, 12 nt, Streptococcus pneumoniae R6
uauuaucaaguu

SEQ ID NO: 2167594 - RNA, 16 nt, Streptococcus pneumoniae R6
uauuaucguuuuccua

SEQ ID NO: 2167595 - RNA, 13 nt, Streptococcus pneumoniae R6
uauuaucuuucca

SEQ ID NO: 2167596 - RNA, 18 nt, Streptococcus pneumoniae R6
uauuaugagcuauuagau

SEQ ID NO: 2167597 - RNA, 21 nt, Streptococcus pneumoniae R6
uauuaugaguuauuucagaau

SEQ ID NO: 2167598 - RNA, 16 nt, Streptococcus pneumoniae R6
uauuaugcguuuuuca

SEQ ID NO: 2167599 - RNA, 18 nt, Streptococcus pneumoniae R6
uauuaugcguuuuucaga

SEQ ID NO: 2167600 - RNA, 20 nt, Streptococcus pneumoniae R6
uauuaugcguuuuauugugg

SEQ ID NO: 2167601 - RNA, 14 nt, Streptococcus pneumoniae R6
uauuauuaauauau

SEQ ID NO: 2167602 - RNA, 22 nt, Streptococcus pneumoniae R6
uauuauuaauauauaaaauuuc

SEQ ID NO: 2167603 - RNA, 15 nt, Streptococcus pneumoniae R6
uauuauucucuauau

SEQ ID NO: 2167604 - RNA, 21 nt, Streptococcus pneumoniae R6
uauuagagguuugcuuagaaa

SEQ ID NO: 2167605 - RNA, 19 nt, Streptococcus pneumoniae R6
uauuagcaucuuaucagaa

SEQ ID NO: 2167606 - RNA, 12 nt, Streptococcus pneumoniae R6
uauuauaaauuu

SEQ ID NO: 2167607 - RNA, 13 nt, Streptococcus pneumoniae R6
uauuauaauauaa

SEQ ID NO: 2167608 - RNA, 19 nt, Streptococcus pneumoniae R6
uauuauacaccauuuguua

SEQ ID NO: 2167609 - RNA, 14 nt, Streptococcus pneumoniae R6
uauuauagagaggg

SEQ ID NO: 2167610 - RNA, 15 nt, Streptococcus pneumoniae R6
uauuagucaagaguu

SEQ ID NO: 2167611 - RNA, 23 nt, Streptococcus pneumoniae R6
uauuuauguccuaaaacuaguga

SEQ ID NO: 2167612 - RNA, 16 nt, Streptococcus pneumoniae R6
uauuuauuaauuucau

SEQ ID NO: 2167613 - RNA, 15 nt, Streptococcus pneumoniae R6
uauuuauuauaaaau

SEQ ID NO: 2167614 - RNA, 19 nt, Streptococcus pneumoniae R6
uauuuauaguaauuccaca

SEQ ID NO: 2167615 - RNA, 17 nt, Streptococcus pneumoniae R6
uauuucaaaaaauguag

SEQ ID NO: 2167616 - RNA, 15 nt, Streptococcus pneumoniae R6
uauuuauuuacauaa

SEQ ID NO: 2167617 - RNA, 12 nt, Streptococcus pneumoniae R6
uauuucaaauca

SEQ ID NO: 2167618 - RNA, 17 nt, Streptococcus pneumoniae R6
uauuucaauuugaugau

SEQ ID NO: 2167619 - RNA, 12 nt, Streptococcus pneumoniae R6
uauuuauuuaca

SEQ ID NO: 2167620 - RNA, 17 nt, Streptococcus pneumoniae R6
uauuucuaugauaaaac

SEQ ID NO: 2167621 - RNA, 22 nt, Streptococcus pneumoniae R6
uauuucguaagaaauuuuggau

SEQ ID NO: 2167622 - RNA, 16 nt, Streptococcus pneumoniae R6
uauuucuagaaauuaa

SEQ ID NO: 2167623 - RNA, 16 nt, Streptococcus pneumoniae R6
uauuucgcuuauaaac

SEQ ID NO: 2167624 - RNA, 14 nt, Streptococcus pneumoniae R6
uauuucauuuucua

SEQ ID NO: 2167625 - RNA, 20 nt, Streptococcus pneumoniae R6
uauuucauuuggcuauaaaa

SEQ ID NO: 2167626 - RNA, 14 nt, Streptococcus pneumoniae R6
uauuucauuuuacu

SEQ ID NO: 2167627 - RNA, 18 nt, Streptococcus pneumoniae R6
uauuucauuuuacuauau

SEQ ID NO: 2167628 - RNA, 14 nt, Streptococcus pneumoniae R6
uauuuccaucaacu

SEQ ID NO: 2167629 - RNA, 18 nt, Streptococcus pneumoniae R6
uauuuccaucaacuagag

SEQ ID NO: 2167630 - RNA, 12 nt, Streptococcus pneumoniae R6
uauuuccaucaa

SEQ ID NO: 2167631 - RNA, 18 nt, Streptococcus pneumoniae R6
uauuucauacgauaaaaa

SEQ ID NO: 2167632 - RNA, 16 nt, Streptococcus pneumoniae R6
uauuucaguuuacuau

SEQ ID NO: 2167633 - RNA, 20 nt, Streptococcus pneumoniae R6
uauuucacuccacuauaaaa

SEQ ID NO: 2167634 - RNA, 22 nt, Streptococcus pneumoniae R6
uauuuguuguccuaauaaacuu

SEQ ID NO: 2167635 - RNA, 13 nt, Streptococcus pneumoniae R6
uauuuguaaaauu

SEQ ID NO: 2167636 - RNA, 14 nt, Streptococcus pneumoniae R6
uauuuuaguaaaaa

SEQ ID NO: 2167637 - RNA, 21 nt, Streptococcus pneumoniae R6
uauuuuaggaaacucuuacaa

SEQ ID NO: 2167638 - RNA, 20 nt, Streptococcus pneumoniae R6
uauuuggauuaugaaaaauc

SEQ ID NO: 2167639 - RNA, 16 nt, Streptococcus pneumoniae R6
uauuucuuguuuucua

SEQ ID NO: 2167640 - RNA, 17 nt, Streptococcus pneumoniae R6
uauuucuuguuuucuaa

SEQ ID NO: 2167641 - RNA, 11 nt, Streptococcus pneumoniae R6
uauuucuuuug

SEQ ID NO: 2167642 - RNA, 12 nt, Streptococcus pneumoniae R6
uauuucuucuuu

SEQ ID NO: 2167643 - RNA, 16 nt, Streptococcus pneumoniae R6
uauuucuucuuuucau

SEQ ID NO: 2167644 - RNA, 22 nt, Streptococcus pneumoniae R6
uauuucuuaguuacagccaugg

SEQ ID NO: 2167645 - RNA, 23 nt, Streptococcus pneumoniae R6
uauuuaguaaaaacguuuuucaa

SEQ ID NO: 2167646 - RNA, 23 nt, Streptococcus pneumoniae R6
uauuuaggggucaugacuaguga

SEQ ID NO: 2167647 - RNA, 16 nt, Streptococcus pneumoniae R6
uauuuagcaaccauuu

SEQ ID NO: 2167648 - RNA, 23 nt, Streptococcus pneumoniae R6
uauuuagauucaguugcauaaau

SEQ ID NO: 2167649 - RNA, 17 nt, Streptococcus pneumoniae R6
uauuuacuuaccauaau

SEQ ID NO: 2167650 - RNA, 19 nt, Streptococcus pneumoniae R6
uauuuacgaauuauuuccu

SEQ ID NO: 2167651 - RNA, 13 nt, Streptococcus pneumoniae R6
uauuuacuaauua

SEQ ID NO: 2167652 - RNA, 15 nt, Streptococcus pneumoniae R6
uauuuacuaauuaau

SEQ ID NO: 2167653 - RNA, 19 nt, Streptococcus pneumoniae R6
uauuuacaaguguuuucac

SEQ ID NO: 2167654 - RNA, 16 nt, Streptococcus pneumoniae R6
uauuuacagaaagaac

SEQ ID NO: 2167655 - RNA, 23 nt, Streptococcus pneumoniae R6
uauuuacagaaagaacaaaaaau

SEQ ID NO: 2167656 - RNA, 18 nt, Streptococcus pneumoniae R6
uauuuacauaauuuaaaa

SEQ ID NO: 2167657 - RNA, 19 nt, Streptococcus pneumoniae R6
uauuuacauaauuuaaaau

SEQ ID NO: 2167658 - RNA, 20 nt, Streptococcus pneumoniae R6
uauuuacauaauuuaaaaua

SEQ ID NO: 2167659 - RNA, 12 nt, Streptococcus pneumoniae R6
uauuuaccaaaa

SEQ ID NO: 2167660 - RNA, 14 nt, Streptococcus pneumoniae R6
uauuuaccaaaaag

SEQ ID NO: 2167661 - RNA, 18 nt, Streptococcus pneumoniae R6
uauuuaccaaaaagggug

SEQ ID NO: 2167662 - RNA, 11 nt, Streptococcus pneumoniae R6
uauuuacccag

SEQ ID NO: 2167663 - RNA, 21 nt, Streptococcus pneumoniae R6
uauuuaaucauuuaauaauga

SEQ ID NO: 2167664 - RNA, 18 nt, Streptococcus pneumoniae R6
uauugucucuaaaaauaa

SEQ ID NO: 2167665 - RNA, 18 nt, Streptococcus pneumoniae R6
uauuguacuuuccaauca

SEQ ID NO: 2167666 - RNA, 22 nt, Streptococcus pneumoniae R6
uauuguuaauggucuucaugcu

SEQ ID NO: 2167667 - RNA, 16 nt, Streptococcus pneumoniae R6
uauugucuucaucucu

SEQ ID NO: 2167668 - RNA, 23 nt, Streptococcus pneumoniae R6
uauugugggaauauguauuucau

SEQ ID NO: 2167669 - RNA, 13 nt, Streptococcus pneumoniae R6
uauuuaacuaaau

SEQ ID NO: 2167670 - RNA, 19 nt, Streptococcus pneumoniae R6
uauuggaugaguuuacuau

SEQ ID NO: 2167671 - RNA, 21 nt, Streptococcus pneumoniae R6
uauugguaacaaaaauacggu

SEQ ID NO: 2167672 - RNA, 22 nt, Streptococcus pneumoniae R6
uauugguauuaauaauuuucac

SEQ ID NO: 2167673 - RNA, 15 nt, Streptococcus pneumoniae R6
uauugguggcuucca

SEQ ID NO: 2167674 - RNA, 17 nt, Streptococcus pneumoniae R6
uauugguggcuuccagu

SEQ ID NO: 2167675 - RNA, 23 nt, Streptococcus pneumoniae R6
uauugguugugaaggucuucuug

SEQ ID NO: 2167676 - RNA, 22 nt, Streptococcus pneumoniae R6
uauuguaagaauuugauuauuu

SEQ ID NO: 2167677 - RNA, 18 nt, Streptococcus pneumoniae R6
uauugccgauaucaccaa

SEQ ID NO: 2167678 - RNA, 18 nt, Streptococcus pneumoniae R6
uauugcagccaauuucuu

SEQ ID NO: 2167679 - RNA, 20 nt, Streptococcus pneumoniae R6
uauugcagccaauuucuuua

SEQ ID NO: 2167680 - RNA, 14 nt, Streptococcus pneumoniae R6
uauugaugaaguaa

SEQ ID NO: 2167681 - RNA, 13 nt, Streptococcus pneumoniae R6
uauugauuccguc

SEQ ID NO: 2167682 - RNA, 14 nt, Streptococcus pneumoniae R6
uauugauauuuaua

SEQ ID NO: 2167683 - RNA, 14 nt, Streptococcus pneumoniae R6
ucaagagaaaacca

SEQ ID NO: 2167684 - RNA, 22 nt, Streptococcus pneumoniae R6
ucaagagaaaaccaaaacucaa

SEQ ID NO: 2167685 - RNA, 15 nt, Streptococcus pneumoniae R6
ucaagacuaggugag

SEQ ID NO: 2167686 - RNA, 18 nt, Streptococcus pneumoniae R6
ucaagaccauuuccaucu

SEQ ID NO: 2167687 - RNA, 19 nt, Streptococcus pneumoniae R6
ucaagaccauuuccaucuc

SEQ ID NO: 2167688 - RNA, 16 nt, Streptococcus pneumoniae R6
ucaagaacaauuucac

SEQ ID NO: 2167689 - RNA, 17 nt, Streptococcus pneumoniae R6
ucaagaacaauuucaca

SEQ ID NO: 2167690 - RNA, 18 nt, Streptococcus pneumoniae R6
ucaacuucgucacauucc

SEQ ID NO: 2167691 - RNA, 13 nt, Streptococcus pneumoniae R6
ucaacuucuauca

SEQ ID NO: 2167692 - RNA, 13 nt, Streptococcus pneumoniae R6
ucaacuuccuuaa

SEQ ID NO: 2167693 - RNA, 17 nt, Streptococcus pneumoniae R6
ucaagauauucuugauu

SEQ ID NO: 2167694 - RNA, 13 nt, Streptococcus pneumoniae R6
ucaagauaagaaa

SEQ ID NO: 2167695 - RNA, 16 nt, Streptococcus pneumoniae R6
ucaagauaagaaaaaa

SEQ ID NO: 2167696 - RNA, 19 nt, Streptococcus pneumoniae R6
ucaagauaagaaaaaacag

SEQ ID NO: 2167697 - RNA, 13 nt, Streptococcus pneumoniae R6
ucaagcaaaucaa

SEQ ID NO: 2167698 - RNA, 19 nt, Streptococcus pneumoniae R6
ucaagcaaaucaaagcuag

SEQ ID NO: 2167699 - RNA, 21 nt, Streptococcus pneumoniae R6
ucaagcaaaucaaagcuagca

SEQ ID NO: 2167700 - RNA, 17 nt, Streptococcus pneumoniae R6
ucaagcauuuuuuugau

SEQ ID NO: 2167701 - RNA, 20 nt, Streptococcus pneumoniae R6
ucaagcaguaauauaggaga

SEQ ID NO: 2167702 - RNA, 13 nt, Streptococcus pneumoniae R6
ucaaccuuccacu

SEQ ID NO: 2167703 - RNA, 17 nt, Streptococcus pneumoniae R6
ucaacgaaaauaauuag

SEQ ID NO: 2167704 - RNA, 15 nt, Streptococcus pneumoniae R6
ucaacgaacuauaaa

SEQ ID NO: 2167705 - RNA, 17 nt, Streptococcus pneumoniae R6
ucaacgaacuauaaaau

SEQ ID NO: 2167706 - RNA, 19 nt, Streptococcus pneumoniae R6
ucaaccuugcuucuuuccu

SEQ ID NO: 2167707 - RNA, 18 nt, Streptococcus pneumoniae R6
ucaacgucaucuuggauu

SEQ ID NO: 2167708 - RNA, 15 nt, Streptococcus pneumoniae R6
ucaacuagagcccaa

SEQ ID NO: 2167709 - RNA, 20 nt, Streptococcus pneumoniae R6
ucaacuagagcccaauauuc

SEQ ID NO: 2167710 - RNA, 14 nt, Streptococcus pneumoniae R6
ucaacuccuuacuu

SEQ ID NO: 2167711 - RNA, 15 nt, Streptococcus pneumoniae R6
ucaacucuauuuuug

SEQ ID NO: 2167712 - RNA, 12 nt, Streptococcus pneumoniae R6
ucaacugccugg

SEQ ID NO: 2167713 - RNA, 15 nt, Streptococcus pneumoniae R6
ucaacuggcaucccc

SEQ ID NO: 2167714 - RNA, 17 nt, Streptococcus pneumoniae R6
ucaacuggcauccccag

SEQ ID NO: 2167715 - RNA, 23 nt, Streptococcus pneumoniae R6
ucaacuguaguggguugaaaaaa

SEQ ID NO: 2167716 - RNA, 20 nt, Streptococcus pneumoniae R6
ucaaaugagauuugcaucaa

SEQ ID NO: 2167717 - RNA, 16 nt, Streptococcus pneumoniae R6
ucaaaugaaauauuuu

SEQ ID NO: 2167718 - RNA, 22 nt, Streptococcus pneumoniae R6
ucaaaugaaauauuuuuuacuu

SEQ ID NO: 2167719 - RNA, 15 nt, Streptococcus pneumoniae R6
ucaaauuaauuuaua

SEQ ID NO: 2167720 - RNA, 12 nt, Streptococcus pneumoniae R6
ucaaaucccaug

SEQ ID NO: 2167721 - RNA, 19 nt, Streptococcus pneumoniae R6
ucaaaucccauguaguuca

SEQ ID NO: 2167722 - RNA, 23 nt, Streptococcus pneumoniae R6
ucaaaucccaugucuuuuaaaua

SEQ ID NO: 2167723 - RNA, 19 nt, Streptococcus pneumoniae R6
ucaaauccgacuucaauaa

SEQ ID NO: 2167724 - RNA, 17 nt, Streptococcus pneumoniae R6
ucaaaucgauuucuaac

SEQ ID NO: 2167725 - RNA, 22 nt, Streptococcus pneumoniae R6
ucaaaucgauuucuaacaauau

SEQ ID NO: 2167726 - RNA, 22 nt, Streptococcus pneumoniae R6
ucaaaucgauuucuaacaaugu

SEQ ID NO: 2167727 - RNA, 22 nt, Streptococcus pneumoniae R6
ucaaaucagcucucugauuuuc

SEQ ID NO: 2167728 - RNA, 19 nt, Streptococcus pneumoniae R6
ucaaaucauuucuuuggca

SEQ ID NO: 2167729 - RNA, 23 nt, Streptococcus pneumoniae R6
ucaaaucauuucuuuggcaccuu

SEQ ID NO: 2167730 - RNA, 19 nt, Streptococcus pneumoniae R6
ucaaaucagguaggauuuc

SEQ ID NO: 2167731 - RNA, 23 nt, Streptococcus pneumoniae R6
ucaaaucagguaggauuucuccu

SEQ ID NO: 2167732 - RNA, 15 nt, Streptococcus pneumoniae R6
ucaaaucaaauuuau

SEQ ID NO: 2167733 - RNA, 16 nt, Streptococcus pneumoniae R6
ucaaauuuaccaaugc

SEQ ID NO: 2167734 - RNA, 15 nt, Streptococcus pneumoniae R6
ucaaauuuauucaga

SEQ ID NO: 2167735 - RNA, 16 nt, Streptococcus pneumoniae R6
ucaaauugcuuaaaau

SEQ ID NO: 2167736 - RNA, 16 nt, Streptococcus pneumoniae R6
ucaaauuuucuuuacu

SEQ ID NO: 2167737 - RNA, 14 nt, Streptococcus pneumoniae R6
ucaaauuugacuaa

SEQ ID NO: 2167738 - RNA, 23 nt, Streptococcus pneumoniae R6
ucaaauugaaaauucacaaaauc

SEQ ID NO: 2167739 - RNA, 14 nt, Streptococcus pneumoniae R6
ucaaauucuuuaga

SEQ ID NO: 2167740 - RNA, 15 nt, Streptococcus pneumoniae R6
ucaaauucuuuagaa

SEQ ID NO: 2167741 - RNA, 16 nt, Streptococcus pneumoniae R6
ucaaauucuuuagaaa

SEQ ID NO: 2167742 - RNA, 16 nt, Streptococcus pneumoniae R6
ucaaauucauucguaa

SEQ ID NO: 2167743 - RNA, 18 nt, Streptococcus pneumoniae R6
ucaaauucauucguaauc

SEQ ID NO: 2167744 - RNA, 19 nt, Streptococcus pneumoniae R6
ucaacaaaucagaaaagua

SEQ ID NO: 2167745 - RNA, 20 nt, Streptococcus pneumoniae R6
ucaacaaaucagaaaaguaa

SEQ ID NO: 2167746 - RNA, 18 nt, Streptococcus pneumoniae R6
ucaaauuuuucauaauuu

SEQ ID NO: 2167747 - RNA, 12 nt, Streptococcus pneumoniae R6
ucaacagaagaa

SEQ ID NO: 2167748 - RNA, 22 nt, Streptococcus pneumoniae R6
ucaacagaagaauccugccaau

SEQ ID NO: 2167749 - RNA, 17 nt, Streptococcus pneumoniae R6
ucaacagcuccauaaca

SEQ ID NO: 2167750 - RNA, 18 nt, Streptococcus pneumoniae R6
ucaacagcuccauaacaa

SEQ ID NO: 2167751 - RNA, 20 nt, Streptococcus pneumoniae R6
ucaacagcuccauaacaaua

SEQ ID NO: 2167752 - RNA, 16 nt, Streptococcus pneumoniae R6
ucaacagcuccuucaa

SEQ ID NO: 2167753 - RNA, 13 nt, Streptococcus pneumoniae R6
ucaacaugagaau

SEQ ID NO: 2167754 - RNA, 20 nt, Streptococcus pneumoniae R6
ucaacaugagaauacaaaaa

SEQ ID NO: 2167755 - RNA, 21 nt, Streptococcus pneumoniae R6
ucaacaugagaauacaaaaau

SEQ ID NO: 2167756 - RNA, 14 nt, Streptococcus pneumoniae R6
ucaaccaacuuuug

SEQ ID NO: 2167757 - RNA, 14 nt, Streptococcus pneumoniae R6
ucaaaguagauacu

SEQ ID NO: 2167758 - RNA, 12 nt, Streptococcus pneumoniae R6
ucaaaguaguca

SEQ ID NO: 2167759 - RNA, 16 nt, Streptococcus pneumoniae R6
ucaaaguagugaauga

SEQ ID NO: 2167760 - RNA, 22 nt, Streptococcus pneumoniae R6
ucaaaguggguuuuaacuacau

SEQ ID NO: 2167761 - RNA, 19 nt, Streptococcus pneumoniae R6
ucaaaguacagauuugaaa

SEQ ID NO: 2167762 - RNA, 17 nt, Streptococcus pneumoniae R6
ucaaaguacugccuuga

SEQ ID NO: 2167763 - RNA, 19 nt, Streptococcus pneumoniae R6
ucaaagcuaguuguuuuuc

SEQ ID NO: 2167764 - RNA, 13 nt, Streptococcus pneumoniae R6
ucaaagcuggcuu

SEQ ID NO: 2167765 - RNA, 16 nt, Streptococcus pneumoniae R6
ucaaagcugugcuuug

SEQ ID NO: 2167766 - RNA, 18 nt, Streptococcus pneumoniae R6
ucaaaggagauaguaucc

SEQ ID NO: 2167767 - RNA, 22 nt, Streptococcus pneumoniae R6
ucaaaggagauaguaucccauu

SEQ ID NO: 2167768 - RNA, 24 nt, Streptococcus pneumoniae R6
ucaaaggcuuuuucuucuucguca

SEQ ID NO: 2167769 - RNA, 16 nt, Streptococcus pneumoniae R6
ucaaagggcaaaucuu

SEQ ID NO: 2167770 - RNA, 22 nt, Streptococcus pneumoniae R6
ucaaaguuuccgaauaccugaa

SEQ ID NO: 2167771 - RNA, 18 nt, Streptococcus pneumoniae R6
ucaaaguuaacuuuucca

SEQ ID NO: 2167772 - RNA, 14 nt, Streptococcus pneumoniae R6
ucaaagaaccugca

SEQ ID NO: 2167773 - RNA, 14 nt, Streptococcus pneumoniae R6
ucaaagaaguccaa

SEQ ID NO: 2167774 - RNA, 14 nt, Streptococcus pneumoniae R6
ucaaagacaaggga

SEQ ID NO: 2167775 - RNA, 14 nt, Streptococcus pneumoniae R6
ucaaagcgauaaaa

SEQ ID NO: 2167776 - RNA, 19 nt, Streptococcus pneumoniae R6
ucaaagcgggauuuaaaau

SEQ ID NO: 2167777 - RNA, 22 nt, Streptococcus pneumoniae R6
ucaaagcgggauuuaaaauaag

SEQ ID NO: 2167778 - RNA, 23 nt, Streptococcus pneumoniae R6
ucaaagcauuugccagaaaaagu

SEQ ID NO: 2167779 - RNA, 19 nt, Streptococcus pneumoniae R6
ucaaagccaaucaaaaaau

SEQ ID NO: 2167780 - RNA, 21 nt, Streptococcus pneumoniae R6
ucaaagaguuuuuuaucuuug

SEQ ID NO: 2167781 - RNA, 23 nt, Streptococcus pneumoniae R6
ucaaagagcaaacgagaaaacga

SEQ ID NO: 2167782 - RNA, 14 nt, Streptococcus pneumoniae R6
ucaaagagcaaacu

SEQ ID NO: 2167783 - RNA, 22 nt, Streptococcus pneumoniae R6
ucaaagagcaaacuagaaaacu

SEQ ID NO: 2167784 - RNA, 22 nt, Streptococcus pneumoniae R6
ucaaagagcaaacuaggaaacu

SEQ ID NO: 2167785 - RNA, 21 nt, Streptococcus pneumoniae R6
ucaaagacuugcccaucacga

SEQ ID NO: 2167786 - RNA, 10 nt, Streptococcus pneumoniae R6
ucaaacauca

SEQ ID NO: 2167787 - RNA, 22 nt, Streptococcus pneumoniae R6
ucaaacauugugaggaauugau

SEQ ID NO: 2167788 - RNA, 23 nt, Streptococcus pneumoniae R6
ucaaacagugcuagaaauugacu

SEQ ID NO: 2167789 - RNA, 17 nt, Streptococcus pneumoniae R6
ucaaacgagaaucugua

SEQ ID NO: 2167790 - RNA, 22 nt, Streptococcus pneumoniae R6
ucaaacggccauuguauccuga

SEQ ID NO: 2167791 - RNA, 11 nt, Streptococcus pneumoniae R6
ucaaacaaaag

SEQ ID NO: 2167792 - RNA, 12 nt, Streptococcus pneumoniae R6
ucaaaauucuuu

SEQ ID NO: 2167793 - RNA, 22 nt, Streptococcus pneumoniae R6
ucaaaauuguugucccuuuuuc

SEQ ID NO: 2167794 - RNA, 19 nt, Streptococcus pneumoniae R6
ucaaacaaugugcucagaa

SEQ ID NO: 2167795 - RNA, 17 nt, Streptococcus pneumoniae R6
ucaaaauauguuuucuu

SEQ ID NO: 2167796 - RNA, 12 nt, Streptococcus pneumoniae R6
ucaaaauacuag

SEQ ID NO: 2167797 - RNA, 22 nt, Streptococcus pneumoniae R6
ucaaaauacuagauucuauuuu

SEQ ID NO: 2167798 - RNA, 15 nt, Streptococcus pneumoniae R6
ucaaaaucagaaaaa

SEQ ID NO: 2167799 - RNA, 22 nt, Streptococcus pneumoniae R6
ucaaaaucaagcuggcuacaga

SEQ ID NO: 2167800 - RNA, 13 nt, Streptococcus pneumoniae R6
ucaaaaucaauga

SEQ ID NO: 2167801 - RNA, 17 nt, Streptococcus pneumoniae R6
uauuuucauagaggaag

SEQ ID NO: 2167802 - RNA, 19 nt, Streptococcus pneumoniae R6
uauuuucccaguagcuauu

SEQ ID NO: 2167803 - RNA, 15 nt, Streptococcus pneumoniae R6
uauuuugaauauacc

SEQ ID NO: 2167804 - RNA, 22 nt, Streptococcus pneumoniae R6
uauuuucuucuuuauaauauuu

SEQ ID NO: 2167805 - RNA, 14 nt, Streptococcus pneumoniae R6
uauuuucuuugauu

SEQ ID NO: 2167806 - RNA, 21 nt, Streptococcus pneumoniae R6
uauuuucuuagcaauucuaaa

SEQ ID NO: 2167807 - RNA, 22 nt, Streptococcus pneumoniae R6
uauuuuugaaaguacuuuuaau

SEQ ID NO: 2167808 - RNA, 22 nt, Streptococcus pneumoniae R6
uauuuuuuaacagauuuuucug

SEQ ID NO: 2167809 - RNA, 22 nt, Streptococcus pneumoniae R6
uauuuuuggagugauagaaaag

SEQ ID NO: 2167810 - RNA, 17 nt, Streptococcus pneumoniae R6
uauuuuuucuguaaaau

SEQ ID NO: 2167811 - RNA, 13 nt, Streptococcus pneumoniae R6
uauuuuuaaauuu

SEQ ID NO: 2167812 - RNA, 17 nt, Streptococcus pneumoniae R6
uauuuuuccuucaucaa

SEQ ID NO: 2167813 - RNA, 16 nt, Streptococcus pneumoniae R6
ucaaaacaugguuuug

SEQ ID NO: 2167814 - RNA, 19 nt, Streptococcus pneumoniae R6
ucaaaacaugguuuugagg

SEQ ID NO: 2167815 - RNA, 16 nt, Streptococcus pneumoniae R6
ucaaaacauguuuuug

SEQ ID NO: 2167816 - RNA, 21 nt, Streptococcus pneumoniae R6
ucaaaaccaguccuggaaaaa

SEQ ID NO: 2167817 - RNA, 13 nt, Streptococcus pneumoniae R6
ucaaaaaugaagu

SEQ ID NO: 2167818 - RNA, 22 nt, Streptococcus pneumoniae R6
ucaaaaauugguguaaauagaa

SEQ ID NO: 2167819 - RNA, 16 nt, Streptococcus pneumoniae R6
ucaaaacacuguuuua

SEQ ID NO: 2167820 - RNA, 20 nt, Streptococcus pneumoniae R6
ucaaaacacuguuuuaaggu

SEQ ID NO: 2167821 - RNA, 19 nt, Streptococcus pneumoniae R6
ucaaaacacuguuuugagg

SEQ ID NO: 2167822 - RNA, 18 nt, Streptococcus pneumoniae R6
ucaaaacaauguuuugau

SEQ ID NO: 2167823 - RNA, 21 nt, Streptococcus pneumoniae R6
ucaaaacuaguuuaaaagacu

SEQ ID NO: 2167824 - RNA, 18 nt, Streptococcus pneumoniae R6
ucaaaauaagucucagca

SEQ ID NO: 2167825 - RNA, 21 nt, Streptococcus pneumoniae R6
ucaaaaguuuaucuagaauuu

SEQ ID NO: 2167826 - RNA, 14 nt, Streptococcus pneumoniae R6
ucaaaauaaccaag

SEQ ID NO: 2167827 - RNA, 16 nt, Streptococcus pneumoniae R6
uauuuuuuuacuuaau

SEQ ID NO: 2167828 - RNA, 21 nt, Streptococcus pneumoniae R6
ucaaaaaaucucacuauucau

SEQ ID NO: 2167829 - RNA, 18 nt, Streptococcus pneumoniae R6
ucaaaaaaguuaaaucuu

SEQ ID NO: 2167830 - RNA, 22 nt, Streptococcus pneumoniae R6
ucaaaaaaagcuguuaaaaacu

SEQ ID NO: 2167831 - RNA, 13 nt, Streptococcus pneumoniae R6
ucaaaaaaauucu

SEQ ID NO: 2167832 - RNA, 17 nt, Streptococcus pneumoniae R6
ucaaaaaaauucuucac

SEQ ID NO: 2167833 - RNA, 21 nt, Streptococcus pneumoniae R6
ucaaaaaaauucuucacaucc

SEQ ID NO: 2167834 - RNA, 15 nt, Streptococcus pneumoniae R6
ucaaaaagaucaguu

SEQ ID NO: 2167835 - RNA, 23 nt, Streptococcus pneumoniae R6
ucaaaaagaucaguucauuuuuc

SEQ ID NO: 2167836 - RNA, 18 nt, Streptococcus pneumoniae R6
ucaaaaaccuugauuuua

SEQ ID NO: 2167837 - RNA, 13 nt, Streptococcus pneumoniae R6
ucaaaaagcauuc

SEQ ID NO: 2167838 - RNA, 20 nt, Streptococcus pneumoniae R6
ucaaaaagcauucuauucca

SEQ ID NO: 2167839 - RNA, 17 nt, Streptococcus pneumoniae R6
ucaaaaacaucucagaa

SEQ ID NO: 2167840 - RNA, 20 nt, Streptococcus pneumoniae R6
ucaaaaaauugcacuuuccu

SEQ ID NO: 2167841 - RNA, 21 nt, Streptococcus pneumoniae R6
ucaaaaaauguagucauucga

SEQ ID NO: 2167842 - RNA, 19 nt, Streptococcus pneumoniae R6
ucaaaaaauuucauuucga

SEQ ID NO: 2167843 - RNA, 12 nt, Streptococcus pneumoniae R6
ucaaaaagaagg

SEQ ID NO: 2167844 - RNA, 13 nt, Streptococcus pneumoniae R6
ucaaaaagaaguu

SEQ ID NO: 2167845 - RNA, 14 nt, Streptococcus pneumoniae R6
ucaaaaagaaguuc

SEQ ID NO: 2167846 - RNA, 24 nt, Streptococcus pneumoniae R6
guuucauggacuguuucauggcaa

SEQ ID NO: 2167847 - RNA, 16 nt, Streptococcus pneumoniae R6
guuucauccacaaccu

SEQ ID NO: 2167848 - RNA, 22 nt, Streptococcus pneumoniae R6
guuucauguggugcuucuggca

SEQ ID NO: 2167849 - RNA, 22 nt, Streptococcus pneumoniae R6
guuucauuguauccuaaaucau

SEQ ID NO: 2167850 - RNA, 17 nt, Streptococcus pneumoniae R6
guuucagucaauaccag

SEQ ID NO: 2167851 - RNA, 17 nt, Streptococcus pneumoniae R6
guuucagcauauuuccc

SEQ ID NO: 2167852 - RNA, 16 nt, Streptococcus pneumoniae R6
guuucagccacuauuu

SEQ ID NO: 2167853 - RNA, 23 nt, Streptococcus pneumoniae R6
guuucguggcgacgccagauacu

SEQ ID NO: 2167854 - RNA, 22 nt, Streptococcus pneumoniae R6
guuuccaaggaaaguucuuccc

SEQ ID NO: 2167855 - RNA, 23 nt, Streptococcus pneumoniae R6
guuuccaaggaaaguucuucccc

SEQ ID NO: 2167856 - RNA, 16 nt, Streptococcus pneumoniae R6
guuucaacugaugaga

SEQ ID NO: 2167857 - RNA, 13 nt, Streptococcus pneumoniae R6
guuucaauauacu

SEQ ID NO: 2167858 - RNA, 15 nt, Streptococcus pneumoniae R6
guuucaaaugaaaua

SEQ ID NO: 2167859 - RNA, 14 nt, Streptococcus pneumoniae R6
guuuauuuuuuauc

SEQ ID NO: 2167860 - RNA, 13 nt, Streptococcus pneumoniae R6
guuuaacuaaaaa

SEQ ID NO: 2167861 - RNA, 15 nt, Streptococcus pneumoniae R6
guuuaacuguuccuu

SEQ ID NO: 2167862 - RNA, 18 nt, Streptococcus pneumoniae R6
guuuaacuguuccuucua

SEQ ID NO: 2167863 - RNA, 13 nt, Streptococcus pneumoniae R6
guugugaauuuca

SEQ ID NO: 2167864 - RNA, 14 nt, Streptococcus pneumoniae R6
guuuacuauccuca

SEQ ID NO: 2167865 - RNA, 18 nt, Streptococcus pneumoniae R6
guuuacucuuugauuuuc

SEQ ID NO: 2167866 - RNA, 18 nt, Streptococcus pneumoniae R6
guuuaagucuugcuucca

SEQ ID NO: 2167867 - RNA, 14 nt, Streptococcus pneumoniae R6
guuuaaucaaaaua

SEQ ID NO: 2167868 - RNA, 13 nt, Streptococcus pneumoniae R6
guucugcuagacg

SEQ ID NO: 2167869 - RNA, 17 nt, Streptococcus pneumoniae R6
guucugcuccauaggca

SEQ ID NO: 2167870 - RNA, 21 nt, Streptococcus pneumoniae R6
guucuucacuauugaugaagu

SEQ ID NO: 2167871 - RNA, 13 nt, Streptococcus pneumoniae R6
guucuuauuucau

SEQ ID NO: 2167872 - RNA, 15 nt, Streptococcus pneumoniae R6
guucuguaaugaaau

SEQ ID NO: 2167873 - RNA, 20 nt, Streptococcus pneumoniae R6
guucugucaaaccaugaggu

SEQ ID NO: 2167874 - RNA, 13 nt, Streptococcus pneumoniae R6
guucuguacugca

SEQ ID NO: 2167875 - RNA, 22 nt, Streptococcus pneumoniae R6
guuucuggucuagcuauuucuu

SEQ ID NO: 2167876 - RNA, 12 nt, Streptococcus pneumoniae R6
guuugcagcacc

SEQ ID NO: 2167877 - RNA, 11 nt, Streptococcus pneumoniae R6
guuugguuuau

SEQ ID NO: 2167878 - RNA, 13 nt, Streptococcus pneumoniae R6
guuuguaucuucc

SEQ ID NO: 2167879 - RNA, 13 nt, Streptococcus pneumoniae R6
guuuucuaauugu

SEQ ID NO: 2167880 - RNA, 13 nt, Streptococcus pneumoniae R6
guuuuccaccagu

SEQ ID NO: 2167881 - RNA, 19 nt, Streptococcus pneumoniae R6
guuuucaaaaauucugcca

SEQ ID NO: 2167882 - RNA, 19 nt, Streptococcus pneumoniae R6
guuuucaaagcuacuuuuu

SEQ ID NO: 2167883 - RNA, 18 nt, Streptococcus pneumoniae R6
guuuucaaucaagacaga

SEQ ID NO: 2167884 - RNA, 23 nt, Streptococcus pneumoniae R6
guuuucaaucaagacagauuuga

SEQ ID NO: 2167885 - RNA, 20 nt, Streptococcus pneumoniae R6
guuuuaccacuaaacuacac

SEQ ID NO: 2167886 - RNA, 20 nt, Streptococcus pneumoniae R6
guuuuaccuuaauucguuug

SEQ ID NO: 2167887 - RNA, 19 nt, Streptococcus pneumoniae R6
guuuuaaagacagucugaa

SEQ ID NO: 2167888 - RNA, 19 nt, Streptococcus pneumoniae R6
guuuuaaacaaagucugaa

SEQ ID NO: 2167889 - RNA, 13 nt, Streptococcus pneumoniae R6
guuuuaaauaaac

SEQ ID NO: 2167890 - RNA, 16 nt, Streptococcus pneumoniae R6
guuuuaagcugacuuc

SEQ ID NO: 2167891 - RNA, 21 nt, Streptococcus pneumoniae R6
guuuuaucaguaaucucaaaa

SEQ ID NO: 2167892 - RNA, 20 nt, Streptococcus pneumoniae R6
guuuuagaacucuauucguu

SEQ ID NO: 2167893 - RNA, 19 nt, Streptococcus pneumoniae R6
guuuuagaugauuggaaau

SEQ ID NO: 2167894 - RNA, 18 nt, Streptococcus pneumoniae R6
guuuuagcaauuguuucg

SEQ ID NO: 2167895 - RNA, 20 nt, Streptococcus pneumoniae R6
guuuuagcguuuuuguguuc

SEQ ID NO: 2167896 - RNA, 18 nt, Streptococcus pneumoniae R6
guuuuaggaacaauaaaa

SEQ ID NO: 2167897 - RNA, 20 nt, Streptococcus pneumoniae R6
uaaaacgaaaggauuauaaa

SEQ ID NO: 2167898 - RNA, 21 nt, Streptococcus pneumoniae R6
uaaaacgaaaggauuauaaaa

SEQ ID NO: 2167899 - RNA, 21 nt, Streptococcus pneumoniae R6
uaaaaccuuuugggcacgaag

SEQ ID NO: 2167900 - RNA, 17 nt, Streptococcus pneumoniae R6
uaaaacauucuuacaaa

SEQ ID NO: 2167901 - RNA, 22 nt, Streptococcus pneumoniae R6
uaaaacauucuuaucaauugau

SEQ ID NO: 2167902 - RNA, 15 nt, Streptococcus pneumoniae R6
uaaaacuuuuaaaau

SEQ ID NO: 2167903 - RNA, 22 nt, Streptococcus pneumoniae R6
uaaaagcaaaaacgcauaguau

SEQ ID NO: 2167904 - RNA, 14 nt, Streptococcus pneumoniae R6
uaaaagcaaaagaa

SEQ ID NO: 2167905 - RNA, 18 nt, Streptococcus pneumoniae R6
uaaaagcaaaagaacaag

SEQ ID NO: 2167906 - RNA, 18 nt, Streptococcus pneumoniae R6
uaaaacuguaugagaaac

SEQ ID NO: 2167907 - RNA, 21 nt, Streptococcus pneumoniae R6
uaaaacuucgauaguacuauu

SEQ ID NO: 2167908 - RNA, 17 nt, Streptococcus pneumoniae R6
uaaaacuugugauuuag

SEQ ID NO: 2167909 - RNA, 14 nt, Streptococcus pneumoniae R6
uaaaacgauaaauu

SEQ ID NO: 2167910 - RNA, 18 nt, Streptococcus pneumoniae R6
uaaaaauagggaaauccu

SEQ ID NO: 2167911 - RNA, 22 nt, Streptococcus pneumoniae R6
uaaaaacaucuaccuauucaua

SEQ ID NO: 2167912 - RNA, 17 nt, Streptococcus pneumoniae R6
uaaaaacacauuuugaa

SEQ ID NO: 2167913 - RNA, 21 nt, Streptococcus pneumoniae R6
uaaaaacagaggcuggacaaa

SEQ ID NO: 2167914 - RNA, 21 nt, Streptococcus pneumoniae R6
uaaaaauccguuuuuugaagu

SEQ ID NO: 2167915 - RNA, 21 nt, Streptococcus pneumoniae R6
uaaaaaucuauuuuuaaauuu

SEQ ID NO: 2167916 - RNA, 18 nt, Streptococcus pneumoniae R6
uaaaaauccacuugggaa

SEQ ID NO: 2167917 - RNA, 23 nt, Streptococcus pneumoniae R6
uaaaaauccacuugggaaaccaa

SEQ ID NO: 2167918 - RNA, 20 nt, Streptococcus pneumoniae R6
uaaaaauccugauuucaagu

SEQ ID NO: 2167919 - RNA, 21 nt, Streptococcus pneumoniae R6
uaaaaauccugauuucaagua

SEQ ID NO: 2167920 - RNA, 21 nt, Streptococcus pneumoniae R6
uaaaaauccuuuuuuugaagu

SEQ ID NO: 2167921 - RNA, 18 nt, Streptococcus pneumoniae R6
uaaaauacccucuaucaa

SEQ ID NO: 2167922 - RNA, 17 nt, Streptococcus pneumoniae R6
uaaaauagggcaugcca

SEQ ID NO: 2167923 - RNA, 15 nt, Streptococcus pneumoniae R6
uaaaauaguuaggca

SEQ ID NO: 2167924 - RNA, 18 nt, Streptococcus pneumoniae R6
uaaaauaguacgaaacaa

SEQ ID NO: 2167925 - RNA, 19 nt, Streptococcus pneumoniae R6
uaaaauaguacgaaacaau

SEQ ID NO: 2167926 - RNA, 14 nt, Streptococcus pneumoniae R6
uaaaaucaaacaaa

SEQ ID NO: 2167927 - RNA, 15 nt, Streptococcus pneumoniae R6
uaaaaucaaacaaaa

SEQ ID NO: 2167928 - RNA, 16 nt, Streptococcus pneumoniae R6
uaaaaucaaacaaaag

SEQ ID NO: 2167929 - RNA, 17 nt, Streptococcus pneumoniae R6
uaaaauauuucuagaaa

SEQ ID NO: 2167930 - RNA, 19 nt, Streptococcus pneumoniae R6
uaaaaucaagguuuuugaa

SEQ ID NO: 2167931 - RNA, 14 nt, Streptococcus pneumoniae R6
uaaaaucacaaaaa

SEQ ID NO: 2167932 - RNA, 18 nt, Streptococcus pneumoniae R6
uaaaaucacaucugcuag

SEQ ID NO: 2167933 - RNA, 15 nt, Streptococcus pneumoniae R6
uaaaaucucuuuauu

SEQ ID NO: 2167934 - RNA, 17 nt, Streptococcus pneumoniae R6
uaaaaucugaagaaagc

SEQ ID NO: 2167935 - RNA, 19 nt, Streptococcus pneumoniae R6
uaaaaucugaagaaagcaa

SEQ ID NO: 2167936 - RNA, 21 nt, Streptococcus pneumoniae R6
uaaaaucugaagaaagcaauu

SEQ ID NO: 2167937 - RNA, 19 nt, Streptococcus pneumoniae R6
uaaaagugucuuaacaaaa

SEQ ID NO: 2167938 - RNA, 14 nt, Streptococcus pneumoniae R6
uaaaaguuauagaa

SEQ ID NO: 2167939 - RNA, 19 nt, Streptococcus pneumoniae R6
uaaaaguuuccccugccaa

SEQ ID NO: 2167940 - RNA, 19 nt, Streptococcus pneumoniae R6
guuuuuuaggacaauuucu

SEQ ID NO: 2167941 - RNA, 17 nt, Streptococcus pneumoniae R6
guuuuuuauuuucccag

SEQ ID NO: 2167942 - RNA, 15 nt, Streptococcus pneumoniae R6
guuuuuuacauagaa

SEQ ID NO: 2167943 - RNA, 12 nt, Streptococcus pneumoniae R6
uaaaaaaacuau

SEQ ID NO: 2167944 - RNA, 15 nt, Streptococcus pneumoniae R6
uaaaaaaaaaaagua

SEQ ID NO: 2167945 - RNA, 14 nt, Streptococcus pneumoniae R6
uaaaaaaguugaag

SEQ ID NO: 2167946 - RNA, 18 nt, Streptococcus pneumoniae R6
uaaaaaaucuuuuucaua

SEQ ID NO: 2167947 - RNA, 16 nt, Streptococcus pneumoniae R6
uaaaaaaccaauuccc

SEQ ID NO: 2167948 - RNA, 17 nt, Streptococcus pneumoniae R6
uaaaaaaauuuggaaaa

SEQ ID NO: 2167949 - RNA, 21 nt, Streptococcus pneumoniae R6
guuuucucauagccauaaaac

SEQ ID NO: 2167950 - RNA, 17 nt, Streptococcus pneumoniae R6
guuuugagaauccaaaa

SEQ ID NO: 2167951 - RNA, 17 nt, Streptococcus pneumoniae R6
guuuugauuagcaaaac

SEQ ID NO: 2167952 - RNA, 13 nt, Streptococcus pneumoniae R6
guuuugagcugac

SEQ ID NO: 2167953 - RNA, 23 nt, Streptococcus pneumoniae R6
guuuugagguugcagaugaaagc

SEQ ID NO: 2167954 - RNA, 13 nt, Streptococcus pneumoniae R6
guuuugagguugu

SEQ ID NO: 2167955 - RNA, 22 nt, Streptococcus pneumoniae R6
guuuugagguuguagaugaaac

SEQ ID NO: 2167956 - RNA, 14 nt, Streptococcus pneumoniae R6
guuuugagcaaccu

SEQ ID NO: 2167957 - RNA, 17 nt, Streptococcus pneumoniae R6
guuuugagcaaccugcg

SEQ ID NO: 2167958 - RNA, 16 nt, Streptococcus pneumoniae R6
guuuuguuucuuaucc

SEQ ID NO: 2167959 - RNA, 18 nt, Streptococcus pneumoniae R6
guuuuuaauuuuucuuug

SEQ ID NO: 2167960 - RNA, 14 nt, Streptococcus pneumoniae R6
guuuuuaaauccaa

SEQ ID NO: 2167961 - RNA, 15 nt, Streptococcus pneumoniae R6
guuuuuaggcaauaa

SEQ ID NO: 2167962 - RNA, 20 nt, Streptococcus pneumoniae R6
guuuuuaggcaauaaaauau

SEQ ID NO: 2167963 - RNA, 16 nt, Streptococcus pneumoniae R6
guuuuuacuacuuuug

SEQ ID NO: 2167964 - RNA, 12 nt, Streptococcus pneumoniae R6
guuuuuaucauu

SEQ ID NO: 2167965 - RNA, 14 nt, Streptococcus pneumoniae R6
guuuuuaucauuuu

SEQ ID NO: 2167966 - RNA, 23 nt, Streptococcus pneumoniae R6
guuuuucaaaaaccuugauauga

SEQ ID NO: 2167967 - RNA, 22 nt, Streptococcus pneumoniae R6
guuuuugaaagucauauuucuu

SEQ ID NO: 2167968 - RNA, 15 nt, Streptococcus pneumoniae R6
guuuuucgucuuuuu

SEQ ID NO: 2167969 - RNA, 18 nt, Streptococcus pneumoniae R6
guuuuuccaucuuuuauu

SEQ ID NO: 2167970 - RNA, 17 nt, Streptococcus pneumoniae R6
guuuuucccaccuuuuc

SEQ ID NO: 2167971 - RNA, 15 nt, Streptococcus pneumoniae R6
uaaccaucauuuuua

SEQ ID NO: 2167972 - RNA, 22 nt, Streptococcus pneumoniae R6
uaacaucuuugaagauaucgcc

SEQ ID NO: 2167973 - RNA, 22 nt, Streptococcus pneumoniae R6
uaacaucuuuugauagaugacu

SEQ ID NO: 2167974 - RNA, 21 nt, Streptococcus pneumoniae R6
uaacaucugcuauaauaguaa

SEQ ID NO: 2167975 - RNA, 15 nt, Streptococcus pneumoniae R6
uaacagcauuuccac

SEQ ID NO: 2167976 - RNA, 23 nt, Streptococcus pneumoniae R6
uaacagccaaaaguccaaagaug

SEQ ID NO: 2167977 - RNA, 15 nt, Streptococcus pneumoniae R6
uaacagccaucagag

SEQ ID NO: 2167978 - RNA, 18 nt, Streptococcus pneumoniae R6
uaacagccaucagagagg

SEQ ID NO: 2167979 - RNA, 21 nt, Streptococcus pneumoniae R6
uaacagccaucagagaggucc

SEQ ID NO: 2167980 - RNA, 15 nt, Streptococcus pneumoniae R6
uaacagagaagaaau

SEQ ID NO: 2167981 - RNA, 19 nt, Streptococcus pneumoniae R6
uaacagagaagaaauucca

SEQ ID NO: 2167982 - RNA, 20 nt, Streptococcus pneumoniae R6
uaacacccugcaugagcugu

SEQ ID NO: 2167983 - RNA, 20 nt, Streptococcus pneumoniae R6
uaacgagugggacauguuca

SEQ ID NO: 2167984 - RNA, 16 nt, Streptococcus pneumoniae R6
uaacgauagcaccaaa

SEQ ID NO: 2167985 - RNA, 13 nt, Streptococcus pneumoniae R6
uaacgaguaaaag

SEQ ID NO: 2167986 - RNA, 22 nt, Streptococcus pneumoniae R6
uaacgaauccaacucuuggaag

SEQ ID NO: 2167987 - RNA, 13 nt, Streptococcus pneumoniae R6
uaacgaagucuau

SEQ ID NO: 2167988 - RNA, 17 nt, Streptococcus pneumoniae R6
uaacgauggacuuuauc

SEQ ID NO: 2167989 - RNA, 13 nt, Streptococcus pneumoniae R6
uaaauuuaacauu

SEQ ID NO: 2167990 - RNA, 21 nt, Streptococcus pneumoniae R6
uaaauuuaacauuaacaucac

SEQ ID NO: 2167991 - RNA, 21 nt, Streptococcus pneumoniae R6
uaaauugucuaaaaauuuaaa

SEQ ID NO: 2167992 - RNA, 21 nt, Streptococcus pneumoniae R6
uaaauugucuaagcgaaacaa

SEQ ID NO: 2167993 - RNA, 13 nt, Streptococcus pneumoniae R6
uaaauucuuccag

SEQ ID NO: 2167994 - RNA, 21 nt, Streptococcus pneumoniae R6
uaaauucuuccagcucaucau

SEQ ID NO: 2167995 - RNA, 15 nt, Streptococcus pneumoniae R6
uaaauucugucacaa

SEQ ID NO: 2167996 - RNA, 17 nt, Streptococcus pneumoniae R6
uaaauuauacucuuaga

SEQ ID NO: 2167997 - RNA, 17 nt, Streptococcus pneumoniae R6
uaaauuaguuuuuagaa

SEQ ID NO: 2167998 - RNA, 13 nt, Streptococcus pneumoniae R6
uaaauuacugauu

SEQ ID NO: 2167999 - RNA, 18 nt, Streptococcus pneumoniae R6
uaaauuccaaauuagaaa

SEQ ID NO: 2168000 - RNA, 19 nt, Streptococcus pneumoniae R6
uaaauuccaaauuagaaaa

SEQ ID NO: 2168001 - RNA, 16 nt, Streptococcus pneumoniae R6
uaaauucauuaaacuc

SEQ ID NO: 2168002 - RNA, 21 nt, Streptococcus pneumoniae R6
uaaauucaguaugcuauaucu

SEQ ID NO: 2168003 - RNA, 18 nt, Streptococcus pneumoniae R6
uaaauucaggugauuuac

SEQ ID NO: 2168004 - RNA, 17 nt, Streptococcus pneumoniae R6
uaacaaaauuauuaaaa

SEQ ID NO: 2168005 - RNA, 21 nt, Streptococcus pneumoniae R6
uaacaaaauuauuaaaaucaa

SEQ ID NO: 2168006 - RNA, 22 nt, Streptococcus pneumoniae R6
uaacaaagcuacgacuuucaag

SEQ ID NO: 2168007 - RNA, 17 nt, Streptococcus pneumoniae R6
uaacacauauugauauu

SEQ ID NO: 2168008 - RNA, 16 nt, Streptococcus pneumoniae R6
uaaauuuacuuaaaau

SEQ ID NO: 2168009 - RNA, 19 nt, Streptococcus pneumoniae R6
uaaauuuauugguauuaau

SEQ ID NO: 2168010 - RNA, 20 nt, Streptococcus pneumoniae R6
uaaauuuauugguauuaaua

SEQ ID NO: 2168011 - RNA, 13 nt, Streptococcus pneumoniae R6
uaaacuaauugga

SEQ ID NO: 2168012 - RNA, 18 nt, Streptococcus pneumoniae R6
uaaacguuuuuacuuugg

SEQ ID NO: 2168013 - RNA, 20 nt, Streptococcus pneumoniae R6
uaaacguuuuuacuuuggca

SEQ ID NO: 2168014 - RNA, 19 nt, Streptococcus pneumoniae R6
uaaaccucgauaccuguua

SEQ ID NO: 2168015 - RNA, 18 nt, Streptococcus pneumoniae R6
uaaacgacuagauaaaag

SEQ ID NO: 2168016 - RNA, 18 nt, Streptococcus pneumoniae R6
uaaaccuugcaaaacagg

SEQ ID NO: 2168017 - RNA, 12 nt, Streptococcus pneumoniae R6
uaaaccuuccaa

SEQ ID NO: 2168018 - RNA, 17 nt, Streptococcus pneumoniae R6
uaaaccuuccaagagac

SEQ ID NO: 2168019 - RNA, 12 nt, Streptococcus pneumoniae R6
uaaaaugaaaua

SEQ ID NO: 2168020 - RNA, 21 nt, Streptococcus pneumoniae R6
uaaaaugaaacaaaaacagga

SEQ ID NO: 2168021 - RNA, 16 nt, Streptococcus pneumoniae R6
uaaaaucuuugaacau

SEQ ID NO: 2168022 - RNA, 13 nt, Streptococcus pneumoniae R6
uaaaaucuuuuac

SEQ ID NO: 2168023 - RNA, 14 nt, Streptococcus pneumoniae R6
uaaaaucuuuuacu

SEQ ID NO: 2168024 - RNA, 14 nt, Streptococcus pneumoniae R6
uaaaccgcgauuuu

SEQ ID NO: 2168025 - RNA, 14 nt, Streptococcus pneumoniae R6
uaaaccaauuuuaa

SEQ ID NO: 2168026 - RNA, 15 nt, Streptococcus pneumoniae R6
uaaaccaccagagug

SEQ ID NO: 2168027 - RNA, 22 nt, Streptococcus pneumoniae R6
uaaaccacgucaguuuuaucag

SEQ ID NO: 2168028 - RNA, 23 nt, Streptococcus pneumoniae R6
uaaaccacgucaguuuuaucagu

SEQ ID NO: 2168029 - RNA, 21 nt, Streptococcus pneumoniae R6
uaaagagaugagagauaaaua

SEQ ID NO: 2168030 - RNA, 20 nt, Streptococcus pneumoniae R6
uaaagagauugccuugcucu

SEQ ID NO: 2168031 - RNA, 16 nt, Streptococcus pneumoniae R6
uaaagcaauuuugaaa

SEQ ID NO: 2168032 - RNA, 18 nt, Streptococcus pneumoniae R6
uaaagagguugcuacagg

SEQ ID NO: 2168033 - RNA, 16 nt, Streptococcus pneumoniae R6
uaaagagguugggcaa

SEQ ID NO: 2168034 - RNA, 15 nt, Streptococcus pneumoniae R6
uaaagaggaaaucuu

SEQ ID NO: 2168035 - RNA, 17 nt, Streptococcus pneumoniae R6
uaaagguaaaaccaaua

SEQ ID NO: 2168036 - RNA, 20 nt, Streptococcus pneumoniae R6
uaaagcgaaaggagaaaaaa

SEQ ID NO: 2168037 - RNA, 21 nt, Streptococcus pneumoniae R6
uaaagcgaaaggagaaaaaau

SEQ ID NO: 2168038 - RNA, 20 nt, Streptococcus pneumoniae R6
uaaagcgaaaggagaaaaau

SEQ ID NO: 2168039 - RNA, 19 nt, Streptococcus pneumoniae R6
uaaacuuugguuauaaaaa

SEQ ID NO: 2168040 - RNA, 13 nt, Streptococcus pneumoniae R6
uaaacuuuuucau

SEQ ID NO: 2168041 - RNA, 15 nt, Streptococcus pneumoniae R6
uaaacuuuuucauaa

SEQ ID NO: 2168042 - RNA, 15 nt, Streptococcus pneumoniae R6
uaaacuucuucuucc

SEQ ID NO: 2168043 - RNA, 19 nt, Streptococcus pneumoniae R6
uaaacuuuauaauauguau

SEQ ID NO: 2168044 - RNA, 15 nt, Streptococcus pneumoniae R6
uaaacuuugagccua

SEQ ID NO: 2168045 - RNA, 15 nt, Streptococcus pneumoniae R6
uaaagaauuugaaaa

SEQ ID NO: 2168046 - RNA, 17 nt, Streptococcus pneumoniae R6
uaaagacacuaagaaga

SEQ ID NO: 2168047 - RNA, 14 nt, Streptococcus pneumoniae R6
uaaagacagucuga

SEQ ID NO: 2168048 - RNA, 20 nt, Streptococcus pneumoniae R6
uaaagacagucugaaaaaua

SEQ ID NO: 2168049 - RNA, 17 nt, Streptococcus pneumoniae R6
uaaagaccaaagaaaaa

SEQ ID NO: 2168050 - RNA, 18 nt, Streptococcus pneumoniae R6
uaaagaccaaagaaaaac

SEQ ID NO: 2168051 - RNA, 17 nt, Streptococcus pneumoniae R6
uaaagacucuugcccuu

SEQ ID NO: 2168052 - RNA, 15 nt, Streptococcus pneumoniae R6
uaaagacuagaaaaa

SEQ ID NO: 2168053 - RNA, 12 nt, Streptococcus pneumoniae R6
uaaagacuagac

SEQ ID NO: 2168054 - RNA, 20 nt, Streptococcus pneumoniae R6
uaaagacuuuuuuccagccu

SEQ ID NO: 2168055 - RNA, 11 nt, Streptococcus pneumoniae R6
uaaagacaaug

SEQ ID NO: 2168056 - RNA, 12 nt, Streptococcus pneumoniae R6
uaaaguuccuaa

SEQ ID NO: 2168057 - RNA, 15 nt, Streptococcus pneumoniae R6
uaaaguaaucucuaa

SEQ ID NO: 2168058 - RNA, 17 nt, Streptococcus pneumoniae R6
uaaaguaaaaauuucua

SEQ ID NO: 2168059 - RNA, 14 nt, Streptococcus pneumoniae R6
uaaaggugaaaagg

SEQ ID NO: 2168060 - RNA, 11 nt, Streptococcus pneumoniae R6
uaaauaucaaa

SEQ ID NO: 2168061 - RNA, 17 nt, Streptococcus pneumoniae R6
uaaauaucaaaaaaaga

SEQ ID NO: 2168062 - RNA, 20 nt, Streptococcus pneumoniae R6
uaaauaucaaaaaaagaagu

SEQ ID NO: 2168063 - RNA, 16 nt, Streptococcus pneumoniae R6
uaaauagaagauaaag

SEQ ID NO: 2168064 - RNA, 21 nt, Streptococcus pneumoniae R6
uaaauagaaguucaaucagcu

SEQ ID NO: 2168065 - RNA, 23 nt, Streptococcus pneumoniae R6
uaaauacucugccuuccuugucu

SEQ ID NO: 2168066 - RNA, 14 nt, Streptococcus pneumoniae R6
uaaauacuuuuucc

SEQ ID NO: 2168067 - RNA, 12 nt, Streptococcus pneumoniae R6
uaaauaauuaua

SEQ ID NO: 2168068 - RNA, 13 nt, Streptococcus pneumoniae R6
uaaauguuuucuc

SEQ ID NO: 2168069 - RNA, 14 nt, Streptococcus pneumoniae R6
uaaauguuuucuca

SEQ ID NO: 2168070 - RNA, 21 nt, Streptococcus pneumoniae R6
uaaauguuucauuuuugagug

SEQ ID NO: 2168071 - RNA, 19 nt, Streptococcus pneumoniae R6
uaaauaugaacaaaucaau

SEQ ID NO: 2168072 - RNA, 19 nt, Streptococcus pneumoniae R6
uaaauaucauuuccaacaa

SEQ ID NO: 2168073 - RNA, 22 nt, Streptococcus pneumoniae R6
uaaauaucauuuccaacaaacg

SEQ ID NO: 2168074 - RNA, 17 nt, Streptococcus pneumoniae R6
uaaaucaauuuuccuuu

SEQ ID NO: 2168075 - RNA, 16 nt, Streptococcus pneumoniae R6
uaaaucuaucagaaag

SEQ ID NO: 2168076 - RNA, 14 nt, Streptococcus pneumoniae R6
uaaaucuuccuagg

SEQ ID NO: 2168077 - RNA, 16 nt, Streptococcus pneumoniae R6
uaaaucuucuaaauua

SEQ ID NO: 2168078 - RNA, 21 nt, Streptococcus pneumoniae R6
uaaaucuuauauuuaguacuc

SEQ ID NO: 2168079 - RNA, 22 nt, Streptococcus pneumoniae R6
uaaaucuugcccuucuagaguc

SEQ ID NO: 2168080 - RNA, 14 nt, Streptococcus pneumoniae R6
gucugauuuucauu

SEQ ID NO: 2168081 - RNA, 17 nt, Streptococcus pneumoniae R6
gucugaauauauaauua

SEQ ID NO: 2168082 - RNA, 23 nt, Streptococcus pneumoniae R6
gucugaaucaaaaaugaaguucu

SEQ ID NO: 2168083 - RNA, 19 nt, Streptococcus pneumoniae R6
gucugagcauucuuuuauc

SEQ ID NO: 2168084 - RNA, 21 nt, Streptococcus pneumoniae R6
gucucgacugguaaagaaugg

SEQ ID NO: 2168085 - RNA, 14 nt, Streptococcus pneumoniae R6
gucuccugugcucc

SEQ ID NO: 2168086 - RNA, 17 nt, Streptococcus pneumoniae R6
gucucuugcgaggacag

SEQ ID NO: 2168087 - RNA, 15 nt, Streptococcus pneumoniae R6
gucucuucuucuggg

SEQ ID NO: 2168088 - RNA, 21 nt, Streptococcus pneumoniae R6
gucucuucuucugggagaaau

SEQ ID NO: 2168089 - RNA, 22 nt, Streptococcus pneumoniae R6
gucucuuaauaucagccagagc

SEQ ID NO: 2168090 - RNA, 19 nt, Streptococcus pneumoniae R6
gucucuuuuguucuaugag

SEQ ID NO: 2168091 - RNA, 19 nt, Streptococcus pneumoniae R6
gucugaagacuggaguuca

SEQ ID NO: 2168092 - RNA, 15 nt, Streptococcus pneumoniae R6
gucugaaggaacuaa

SEQ ID NO: 2168093 - RNA, 17 nt, Streptococcus pneumoniae R6
gucuggauguucugucu

SEQ ID NO: 2168094 - RNA, 17 nt, Streptococcus pneumoniae R6
gucuggagauuuuucaa

SEQ ID NO: 2168095 - RNA, 19 nt, Streptococcus pneumoniae R6
gucugucaaagcuucgcag

SEQ ID NO: 2168096 - RNA, 17 nt, Streptococcus pneumoniae R6
gucugguucccagcaug

SEQ ID NO: 2168097 - RNA, 17 nt, Streptococcus pneumoniae R6
gucugggaaaaauuuuc

SEQ ID NO: 2168098 - RNA, 22 nt, Streptococcus pneumoniae R6
gucugggaaaaauuuucaaaau

SEQ ID NO: 2168099 - RNA, 23 nt, Streptococcus pneumoniae R6
gucugggaaaaauuuucaaaauc

SEQ ID NO: 2168100 - RNA, 23 nt, Streptococcus pneumoniae R6
gucuuaguacgugacucagcuuc

SEQ ID NO: 2168101 - RNA, 13 nt, Streptococcus pneumoniae R6
gucuuaccacaaa

SEQ ID NO: 2168102 - RNA, 22 nt, Streptococcus pneumoniae R6
gucuuacguucauccauaucuu

SEQ ID NO: 2168103 - RNA, 14 nt, Streptococcus pneumoniae R6
gucuuaaaaucaca

SEQ ID NO: 2168104 - RNA, 19 nt, Streptococcus pneumoniae R6
gucuuaaaaucacaaaaac

SEQ ID NO: 2168105 - RNA, 19 nt, Streptococcus pneumoniae R6
gucuguuaaacaugucuau

SEQ ID NO: 2168106 - RNA, 13 nt, Streptococcus pneumoniae R6
gucuucaucucuu

SEQ ID NO: 2168107 - RNA, 15 nt, Streptococcus pneumoniae R6
gucuucaugcuggca

SEQ ID NO: 2168108 - RNA, 22 nt, Streptococcus pneumoniae R6
gucuucaugcuggcagaaacug

SEQ ID NO: 2168109 - RNA, 16 nt, Streptococcus pneumoniae R6
gucuuaucugcaaccu

SEQ ID NO: 2168110 - RNA, 16 nt, Streptococcus pneumoniae R6
gucuuauuucauuugg

SEQ ID NO: 2168111 - RNA, 14 nt, Streptococcus pneumoniae R6
gucuucaauaccaa

SEQ ID NO: 2168112 - RNA, 13 nt, Streptococcus pneumoniae R6
gucuuuuugcuca

SEQ ID NO: 2168113 - RNA, 19 nt, Streptococcus pneumoniae R6
gucuuuugccuuagcaacu

SEQ ID NO: 2168114 - RNA, 14 nt, Streptococcus pneumoniae R6
gucuuuuguccugu

SEQ ID NO: 2168115 - RNA, 19 nt, Streptococcus pneumoniae R6
gucuuuugucuugcuugcu

SEQ ID NO: 2168116 - RNA, 17 nt, Streptococcus pneumoniae R6
gucuuuucggauggcua

SEQ ID NO: 2168117 - RNA, 17 nt, Streptococcus pneumoniae R6
gucuuguucuuguuuca

SEQ ID NO: 2168118 - RNA, 13 nt, Streptococcus pneumoniae R6
gucuuuaaaauua

SEQ ID NO: 2168119 - RNA, 22 nt, Streptococcus pneumoniae R6
gucuuuaucgauucuugcaaac

SEQ ID NO: 2168120 - RNA, 14 nt, Streptococcus pneumoniae R6
gucuuucauuucug

SEQ ID NO: 2168121 - RNA, 21 nt, Streptococcus pneumoniae R6
gucuuucaagcgaacaucucc

SEQ ID NO: 2168122 - RNA, 11 nt, Streptococcus pneumoniae R6
gucuuugauaa

SEQ ID NO: 2168123 - RNA, 17 nt, Streptococcus pneumoniae R6
gucuuugucagcauggc

SEQ ID NO: 2168124 - RNA, 15 nt, Streptococcus pneumoniae R6
gucuuggcuguuucc

SEQ ID NO: 2168125 - RNA, 18 nt, Streptococcus pneumoniae R6
gucuuggauuuuugauuc

SEQ ID NO: 2168126 - RNA, 20 nt, Streptococcus pneumoniae R6
gucuugauggacaacaauga

SEQ ID NO: 2168127 - RNA, 17 nt, Streptococcus pneumoniae R6
gucuucuuuucuuuuag

SEQ ID NO: 2168128 - RNA, 22 nt, Streptococcus pneumoniae R6
gucuucuuuucuuuuagugagu

SEQ ID NO: 2168129 - RNA, 21 nt, Streptococcus pneumoniae R6
gugaaagugggcugauuuuga

SEQ ID NO: 2168130 - RNA, 20 nt, Streptococcus pneumoniae R6
gugaaaguuagccucucuaa

SEQ ID NO: 2168131 - RNA, 21 nt, Streptococcus pneumoniae R6
gugaaaguuagccucucuaaa

SEQ ID NO: 2168132 - RNA, 21 nt, Streptococcus pneumoniae R6
gugaaaucauacugccaagau

SEQ ID NO: 2168133 - RNA, 18 nt, Streptococcus pneumoniae R6
gugaacaagccuagucuu

SEQ ID NO: 2168134 - RNA, 17 nt, Streptococcus pneumoniae R6
gugaacaaugguaacag

SEQ ID NO: 2168135 - RNA, 22 nt, Streptococcus pneumoniae R6
gugaacaaugguaacagucuua

SEQ ID NO: 2168136 - RNA, 20 nt, Streptococcus pneumoniae R6
gugaauggauuuaucaguau

SEQ ID NO: 2168137 - RNA, 18 nt, Streptococcus pneumoniae R6
gugaauuugcuacaaaua

SEQ ID NO: 2168138 - RNA, 13 nt, Streptococcus pneumoniae R6
gugaaucuaguaa

SEQ ID NO: 2168139 - RNA, 23 nt, Streptococcus pneumoniae R6
gugaaugauucugaaauaacuca

SEQ ID NO: 2168140 - RNA, 12 nt, Streptococcus pneumoniae R6
gugagcaucagg

SEQ ID NO: 2168141 - RNA, 15 nt, Streptococcus pneumoniae R6
gugauaucaaugguu

SEQ ID NO: 2168142 - RNA, 21 nt, Streptococcus pneumoniae R6
gugauaaugauuuggcaaauu

SEQ ID NO: 2168143 - RNA, 14 nt, Streptococcus pneumoniae R6
gugauaaaguuucu

SEQ ID NO: 2168144 - RNA, 13 nt, Streptococcus pneumoniae R6
gugaguuccuguu

SEQ ID NO: 2168145 - RNA, 19 nt, Streptococcus pneumoniae R6
gugacuucauuauuaugaa

SEQ ID NO: 2168146 - RNA, 14 nt, Streptococcus pneumoniae R6
gugagacaagcaau

SEQ ID NO: 2168147 - RNA, 18 nt, Streptococcus pneumoniae R6
gugagaggaggugaaacu

SEQ ID NO: 2168148 - RNA, 13 nt, Streptococcus pneumoniae R6
gugagaggggcua

SEQ ID NO: 2168149 - RNA, 14 nt, Streptococcus pneumoniae R6
gugacgagacagau

SEQ ID NO: 2168150 - RNA, 19 nt, Streptococcus pneumoniae R6
gugaccuggacggauuucu

SEQ ID NO: 2168151 - RNA, 20 nt, Streptococcus pneumoniae R6
gugaccagugauaacgaaua

SEQ ID NO: 2168152 - RNA, 15 nt, Streptococcus pneumoniae R6
gugacauagaugcuu

SEQ ID NO: 2168153 - RNA, 20 nt, Streptococcus pneumoniae R6
gugacauaugauugucuccu

SEQ ID NO: 2168154 - RNA, 21 nt, Streptococcus pneumoniae R6
gugacauaugauugucuccuu

SEQ ID NO: 2168155 - RNA, 13 nt, Streptococcus pneumoniae R6
gugacaguaaaaa

SEQ ID NO: 2168156 - RNA, 17 nt, Streptococcus pneumoniae R6
gugauuucuaaaacauu

SEQ ID NO: 2168157 - RNA, 17 nt, Streptococcus pneumoniae R6
gugauuuuauauaaaau

SEQ ID NO: 2168158 - RNA, 18 nt, Streptococcus pneumoniae R6
gugauuuuauauaaaaua

SEQ ID NO: 2168159 - RNA, 17 nt, Streptococcus pneumoniae R6
gugcaaacuaggaagcu

SEQ ID NO: 2168160 - RNA, 22 nt, Streptococcus pneumoniae R6
gugcaaagacagggccuuagca

SEQ ID NO: 2168161 - RNA, 12 nt, Streptococcus pneumoniae R6
gugcaugaguua

SEQ ID NO: 2168162 - RNA, 14 nt, Streptococcus pneumoniae R6
gugcagucuuuuug

SEQ ID NO: 2168163 - RNA, 15 nt, Streptococcus pneumoniae R6
gugccugcauggcuc

SEQ ID NO: 2168164 - RNA, 19 nt, Streptococcus pneumoniae R6
guuauuucuccuaaagaaa

SEQ ID NO: 2168165 - RNA, 20 nt, Streptococcus pneumoniae R6
guuauuucuccuaaagaaaa

SEQ ID NO: 2168166 - RNA, 20 nt, Streptococcus pneumoniae R6
guucaaucagcuaaaaauaa

SEQ ID NO: 2168167 - RNA, 20 nt, Streptococcus pneumoniae R6
guucaaugggguucaucucu

SEQ ID NO: 2168168 - RNA, 17 nt, Streptococcus pneumoniae R6
guucaauggguucaucu

SEQ ID NO: 2168169 - RNA, 20 nt, Streptococcus pneumoniae R6
guucaauggguucaucucug

SEQ ID NO: 2168170 - RNA, 17 nt, Streptococcus pneumoniae R6
guucaagguaauaaucc

SEQ ID NO: 2168171 - RNA, 15 nt, Streptococcus pneumoniae R6
guucaagacuugggc

SEQ ID NO: 2168172 - RNA, 12 nt, Streptococcus pneumoniae R6
guuaucuuauca

SEQ ID NO: 2168173 - RNA, 19 nt, Streptococcus pneumoniae R6
guuauggaaaaugauaugg

SEQ ID NO: 2168174 - RNA, 15 nt, Streptococcus pneumoniae R6
guuauuggaacuaaa

SEQ ID NO: 2168175 - RNA, 22 nt, Streptococcus pneumoniae R6
guuauugaaacagcuaaagaca

SEQ ID NO: 2168176 - RNA, 11 nt, Streptococcus pneumoniae R6
guuauucaaaa

SEQ ID NO: 2168177 - RNA, 14 nt, Streptococcus pneumoniae R6
guuaguguauaagg

SEQ ID NO: 2168178 - RNA, 14 nt, Streptococcus pneumoniae R6
guuauagaguguua

SEQ ID NO: 2168179 - RNA, 20 nt, Streptococcus pneumoniae R6
guuauagauucaacgaacua

SEQ ID NO: 2168180 - RNA, 18 nt, Streptococcus pneumoniae R6
guuauagauucaauauau

SEQ ID NO: 2168181 - RNA, 21 nt, Streptococcus pneumoniae R6
guuacaucaaaaucacagacc

SEQ ID NO: 2168182 - RNA, 13 nt, Streptococcus pneumoniae R6
guuaguugaguug

SEQ ID NO: 2168183 - RNA, 17 nt, Streptococcus pneumoniae R6
guucuauaaaauauagu

SEQ ID NO: 2168184 - RNA, 15 nt, Streptococcus pneumoniae R6
guucgguaguuguua

SEQ ID NO: 2168185 - RNA, 16 nt, Streptococcus pneumoniae R6
guuccuuugucuuuag

SEQ ID NO: 2168186 - RNA, 16 nt, Streptococcus pneumoniae R6
guucuauccacaaccu

SEQ ID NO: 2168187 - RNA, 20 nt, Streptococcus pneumoniae R6
guucuauccacaaccuuaaa

SEQ ID NO: 2168188 - RNA, 19 nt, Streptococcus pneumoniae R6
guucucaaucaagauagcu

SEQ ID NO: 2168189 - RNA, 22 nt, Streptococcus pneumoniae R6
guucuaucugcaaccuuaaaac

SEQ ID NO: 2168190 - RNA, 21 nt, Streptococcus pneumoniae R6
guucuaucugccaccucaaaa

SEQ ID NO: 2168191 - RNA, 14 nt, Streptococcus pneumoniae R6
guucugcaacaaca

SEQ ID NO: 2168192 - RNA, 16 nt, Streptococcus pneumoniae R6
guucugccuauuuuuu

SEQ ID NO: 2168193 - RNA, 12 nt, Streptococcus pneumoniae R6
guucucuuugca

SEQ ID NO: 2168194 - RNA, 13 nt, Streptococcus pneumoniae R6
guucucucuuuuu

SEQ ID NO: 2168195 - RNA, 23 nt, Streptococcus pneumoniae R6
guucaucuggaguagcaucccca

SEQ ID NO: 2168196 - RNA, 22 nt, Streptococcus pneumoniae R6
guucaucucugguguguaugga

SEQ ID NO: 2168197 - RNA, 15 nt, Streptococcus pneumoniae R6
guucaucuucuuucu

SEQ ID NO: 2168198 - RNA, 20 nt, Streptococcus pneumoniae R6
guucauccagcaggagaaag

SEQ ID NO: 2168199 - RNA, 21 nt, Streptococcus pneumoniae R6
guucacaaaugagauaagcga

SEQ ID NO: 2168200 - RNA, 20 nt, Streptococcus pneumoniae R6
guucaccaggagccaagaua

SEQ ID NO: 2168201 - RNA, 17 nt, Streptococcus pneumoniae R6
guucacccuugcuuuuu

SEQ ID NO: 2168202 - RNA, 23 nt, Streptococcus pneumoniae R6
guuccaguuuggcaaauagaaga

SEQ ID NO: 2168203 - RNA, 22 nt, Streptococcus pneumoniae R6
guuccaucuacaaccuuaaaac

SEQ ID NO: 2168204 - RNA, 21 nt, Streptococcus pneumoniae R6
guuccauaccaucaaagacca

SEQ ID NO: 2168205 - RNA, 20 nt, Streptococcus pneumoniae R6
guuccauaugauucuuucua

SEQ ID NO: 2168206 - RNA, 18 nt, Streptococcus pneumoniae R6
guucccagcauggucagg

SEQ ID NO: 2168207 - RNA, 13 nt, Streptococcus pneumoniae R6
guguaucaggaau

SEQ ID NO: 2168208 - RNA, 13 nt, Streptococcus pneumoniae R6
guguauggagcuu

SEQ ID NO: 2168209 - RNA, 22 nt, Streptococcus pneumoniae R6
gugucauaguccugaaaaucau

SEQ ID NO: 2168210 - RNA, 17 nt, Streptococcus pneumoniae R6
gugucauaaucuguuua

SEQ ID NO: 2168211 - RNA, 19 nt, Streptococcus pneumoniae R6
guguauucguccauccaag

SEQ ID NO: 2168212 - RNA, 18 nt, Streptococcus pneumoniae R6
guguauuguacuuuccaa

SEQ ID NO: 2168213 - RNA, 14 nt, Streptococcus pneumoniae R6
gugucaaaaaggaa

SEQ ID NO: 2168214 - RNA, 20 nt, Streptococcus pneumoniae R6
guguauuauucuaguuucaa

SEQ ID NO: 2168215 - RNA, 13 nt, Streptococcus pneumoniae R6
guguuuuuccuuu

SEQ ID NO: 2168216 - RNA, 19 nt, Streptococcus pneumoniae R6
guguuuuucguuagauacu

SEQ ID NO: 2168217 - RNA, 14 nt, Streptococcus pneumoniae R6
guguggcgcugcuu

SEQ ID NO: 2168218 - RNA, 12 nt, Streptococcus pneumoniae R6
guguucaaaaac

SEQ ID NO: 2168219 - RNA, 17 nt, Streptococcus pneumoniae R6
guguuaucugaaaauua

SEQ ID NO: 2168220 - RNA, 21 nt, Streptococcus pneumoniae R6
guuaaaaauugauuugacuuc

SEQ ID NO: 2168221 - RNA, 19 nt, Streptococcus pneumoniae R6
guuaaaaauuggucauauu

SEQ ID NO: 2168222 - RNA, 19 nt, Streptococcus pneumoniae R6
guuaaaacaaagaaaaaga

SEQ ID NO: 2168223 - RNA, 19 nt, Streptococcus pneumoniae R6
guuaaaaauccugauuuca

SEQ ID NO: 2168224 - RNA, 12 nt, Streptococcus pneumoniae R6
guuaaaaacuca

SEQ ID NO: 2168225 - RNA, 22 nt, Streptococcus pneumoniae R6
guuaaaaaagauuugaaacuaa

SEQ ID NO: 2168226 - RNA, 12 nt, Streptococcus pneumoniae R6
guuaaaaaauaa

SEQ ID NO: 2168227 - RNA, 12 nt, Streptococcus pneumoniae R6
guguuuuuucau

SEQ ID NO: 2168228 - RNA, 21 nt, Streptococcus pneumoniae R6
guguuuuuucuugcuuguaau

SEQ ID NO: 2168229 - RNA, 20 nt, Streptococcus pneumoniae R6
guuaaaaguuguggaaagga

SEQ ID NO: 2168230 - RNA, 18 nt, Streptococcus pneumoniae R6
guuaaaagcaaaaacgca

SEQ ID NO: 2168231 - RNA, 13 nt, Streptococcus pneumoniae R6
guuaaauucuucu

SEQ ID NO: 2168232 - RNA, 14 nt, Streptococcus pneumoniae R6
guuaaauuauaaau

SEQ ID NO: 2168233 - RNA, 13 nt, Streptococcus pneumoniae R6
guuaagaaauaaa

SEQ ID NO: 2168234 - RNA, 12 nt, Streptococcus pneumoniae R6
guuaacuucaag

SEQ ID NO: 2168235 - RNA, 19 nt, Streptococcus pneumoniae R6
guuaaucuacgcuuuaaaa

SEQ ID NO: 2168236 - RNA, 21 nt, Streptococcus pneumoniae R6
guuaaucuacgcuuuaaaaau

SEQ ID NO: 2168237 - RNA, 15 nt, Streptococcus pneumoniae R6
guuaaucucuccuua

SEQ ID NO: 2168238 - RNA, 20 nt, Streptococcus pneumoniae R6
guuaaucucuccuuaucaaa

SEQ ID NO: 2168239 - RNA, 17 nt, Streptococcus pneumoniae R6
guggacucgaaccaccg

SEQ ID NO: 2168240 - RNA, 17 nt, Streptococcus pneumoniae R6
guggcagcauugucauu

SEQ ID NO: 2168241 - RNA, 16 nt, Streptococcus pneumoniae R6
guggaaaauagaaaaa

SEQ ID NO: 2168242 - RNA, 17 nt, Streptococcus pneumoniae R6
guggaaaauagaaaaaa

SEQ ID NO: 2168243 - RNA, 15 nt, Streptococcus pneumoniae R6
guggaaugauaacau

SEQ ID NO: 2168244 - RNA, 19 nt, Streptococcus pneumoniae R6
gugggaauauguauuucau

SEQ ID NO: 2168245 - RNA, 13 nt, Streptococcus pneumoniae R6
gugggcugauuuu

SEQ ID NO: 2168246 - RNA, 12 nt, Streptococcus pneumoniae R6
guaaucaucuca

SEQ ID NO: 2168247 - RNA, 13 nt, Streptococcus pneumoniae R6
guaaucaucucau

SEQ ID NO: 2168248 - RNA, 15 nt, Streptococcus pneumoniae R6
guaaucaugugacca

SEQ ID NO: 2168249 - RNA, 21 nt, Streptococcus pneumoniae R6
guaaucauaagcaacuuuacg

SEQ ID NO: 2168250 - RNA, 13 nt, Streptococcus pneumoniae R6
guaauaaucaaua

SEQ ID NO: 2168251 - RNA, 16 nt, Streptococcus pneumoniae R6
guaauuaugaaauuua

SEQ ID NO: 2168252 - RNA, 19 nt, Streptococcus pneumoniae R6
guaaucuuagcaaagauau

SEQ ID NO: 2168253 - RNA, 22 nt, Streptococcus pneumoniae R6
guaaugacuuguguuuuuccuu

SEQ ID NO: 2168254 - RNA, 16 nt, Streptococcus pneumoniae R6
guacacaacugcuucu

SEQ ID NO: 2168255 - RNA, 13 nt, Streptococcus pneumoniae R6
guacaaaccuugu

SEQ ID NO: 2168256 - RNA, 17 nt, Streptococcus pneumoniae R6
guacaaagaauaaaaua

SEQ ID NO: 2168257 - RNA, 20 nt, Streptococcus pneumoniae R6
guaauuuaguucucaggaau

SEQ ID NO: 2168258 - RNA, 13 nt, Streptococcus pneumoniae R6
guaauuuucaaga

SEQ ID NO: 2168259 - RNA, 19 nt, Streptococcus pneumoniae R6
guaauuuucaagaauugca

SEQ ID NO: 2168260 - RNA, 19 nt, Streptococcus pneumoniae R6
guacauaguuucauaacua

SEQ ID NO: 2168261 - RNA, 15 nt, Streptococcus pneumoniae R6
guacagcuugcauag

SEQ ID NO: 2168262 - RNA, 19 nt, Streptococcus pneumoniae R6
guacagcuugcauagacuu

SEQ ID NO: 2168263 - RNA, 17 nt, Streptococcus pneumoniae R6
guacacuucuacuucua

SEQ ID NO: 2168264 - RNA, 22 nt, Streptococcus pneumoniae R6
guacacuucugcuucuaaaaca

SEQ ID NO: 2168265 - RNA, 17 nt, Streptococcus pneumoniae R6
guacagauuugaaaacu

SEQ ID NO: 2168266 - RNA, 15 nt, Streptococcus pneumoniae R6
guacuuucaacuccu

SEQ ID NO: 2168267 - RNA, 14 nt, Streptococcus pneumoniae R6
guacugcacaggac

SEQ ID NO: 2168268 - RNA, 19 nt, Streptococcus pneumoniae R6
guacugcacaggacuaagu

SEQ ID NO: 2168269 - RNA, 21 nt, Streptococcus pneumoniae R6
guaccacggcagacagagaaa

SEQ ID NO: 2168270 - RNA, 23 nt, Streptococcus pneumoniae R6
guaccacggcagacagagaaaau

SEQ ID NO: 2168271 - RNA, 22 nt, Streptococcus pneumoniae R6
guagaaguguauuauucuaguu

SEQ ID NO: 2168272 - RNA, 19 nt, Streptococcus pneumoniae R6
guagaaagucuuuaacauc

SEQ ID NO: 2168273 - RNA, 21 nt, Streptococcus pneumoniae R6
guagaaaguuaaucucuccuu

SEQ ID NO: 2168274 - RNA, 16 nt, Streptococcus pneumoniae R6
guagaacgauaaacaa

SEQ ID NO: 2168275 - RNA, 15 nt, Streptococcus pneumoniae R6
guagcaacuaucuga

SEQ ID NO: 2168276 - RNA, 16 nt, Streptococcus pneumoniae R6
guagcaaauucaccaa

SEQ ID NO: 2168277 - RNA, 15 nt, Streptococcus pneumoniae R6
guagcaacagcugga

SEQ ID NO: 2168278 - RNA, 15 nt, Streptococcus pneumoniae R6
guagccaaaauccuu

SEQ ID NO: 2168279 - RNA, 16 nt, Streptococcus pneumoniae R6
guagccaaaauccuug

SEQ ID NO: 2168280 - RNA, 15 nt, Streptococcus pneumoniae R6
guagcggauuuucaa

SEQ ID NO: 2168281 - RNA, 18 nt, Streptococcus pneumoniae R6
guaggaagauuuuuugga

SEQ ID NO: 2168282 - RNA, 17 nt, Streptococcus pneumoniae R6
guaggacgauaaaaacg

SEQ ID NO: 2168283 - RNA, 15 nt, Streptococcus pneumoniae R6
guaucaaaggcaaga

SEQ ID NO: 2168284 - RNA, 22 nt, Streptococcus pneumoniae R6
guauagaccaagaacucuucug

SEQ ID NO: 2168285 - RNA, 19 nt, Streptococcus pneumoniae R6
guaucauauaaauauagaa

SEQ ID NO: 2168286 - RNA, 22 nt, Streptococcus pneumoniae R6
guaucauauaaauauagaaacg

SEQ ID NO: 2168287 - RNA, 23 nt, Streptococcus pneumoniae R6
guauccaaaacaaccaauuucuu

SEQ ID NO: 2168288 - RNA, 18 nt, Streptococcus pneumoniae R6
guauccaaucucuugaac

SEQ ID NO: 2168289 - RNA, 18 nt, Streptococcus pneumoniae R6
guaucaagguuuuucugu

SEQ ID NO: 2168290 - RNA, 13 nt, Streptococcus pneumoniae R6
guaucaaguguau

SEQ ID NO: 2168291 - RNA, 21 nt, Streptococcus pneumoniae R6
guauuaaacaaaaagaaaaaa

SEQ ID NO: 2168292 - RNA, 21 nt, Streptococcus pneumoniae R6
guauguuuaaagucucugucc

SEQ ID NO: 2168293 - RNA, 17 nt, Streptococcus pneumoniae R6
guaugcaaggcaaugau

SEQ ID NO: 2168294 - RNA, 15 nt, Streptococcus pneumoniae R6
guauggaaacucaaa

SEQ ID NO: 2168295 - RNA, 14 nt, Streptococcus pneumoniae R6
guaugaaggaguuu

SEQ ID NO: 2168296 - RNA, 16 nt, Streptococcus pneumoniae R6
guaucuggugugauga

SEQ ID NO: 2168297 - RNA, 16 nt, Streptococcus pneumoniae R6
gucacgaggaggagaa

SEQ ID NO: 2168298 - RNA, 15 nt, Streptococcus pneumoniae R6
gucacgaaccacacu

SEQ ID NO: 2168299 - RNA, 23 nt, Streptococcus pneumoniae R6
gucacauagacuccauagggcau

SEQ ID NO: 2168300 - RNA, 16 nt, Streptococcus pneumoniae R6
gucaccaaauuucaua

SEQ ID NO: 2168301 - RNA, 20 nt, Streptococcus pneumoniae R6
gucaccaaauuucauauuuu

SEQ ID NO: 2168302 - RNA, 13 nt, Streptococcus pneumoniae R6
gucaaagaaggcu

SEQ ID NO: 2168303 - RNA, 21 nt, Streptococcus pneumoniae R6
gucaaacuuuuucucucugaa

SEQ ID NO: 2168304 - RNA, 16 nt, Streptococcus pneumoniae R6
gucaaauaagaaagac

SEQ ID NO: 2168305 - RNA, 20 nt, Streptococcus pneumoniae R6
gucaaauaagaaagaccaua

SEQ ID NO: 2168306 - RNA, 16 nt, Streptococcus pneumoniae R6
gucaaagccaaucaaa

SEQ ID NO: 2168307 - RNA, 22 nt, Streptococcus pneumoniae R6
gucaauaccagguaauccagaa

SEQ ID NO: 2168308 - RNA, 18 nt, Streptococcus pneumoniae R6
gucacagaaccaucuuca

SEQ ID NO: 2168309 - RNA, 20 nt, Streptococcus pneumoniae R6
gucacagaaccaucuucauu

SEQ ID NO: 2168310 - RNA, 21 nt, Streptococcus pneumoniae R6
guauuaucaauaucaaaacca

SEQ ID NO: 2168311 - RNA, 20 nt, Streptococcus pneumoniae R6
guauuauuagggaaacaaaa

SEQ ID NO: 2168312 - RNA, 13 nt, Streptococcus pneumoniae R6
guauucauaaaau

SEQ ID NO: 2168313 - RNA, 19 nt, Streptococcus pneumoniae R6
guauuccaagaguaaauca

SEQ ID NO: 2168314 - RNA, 17 nt, Streptococcus pneumoniae R6
guauucucguagugcuu

SEQ ID NO: 2168315 - RNA, 14 nt, Streptococcus pneumoniae R6
guauugacugccca

SEQ ID NO: 2168316 - RNA, 15 nt, Streptococcus pneumoniae R6
guauuguacuuucca

SEQ ID NO: 2168317 - RNA, 12 nt, Streptococcus pneumoniae R6
guauuuauaaac

SEQ ID NO: 2168318 - RNA, 22 nt, Streptococcus pneumoniae R6
guauuuuaaauuauguaaauaa

SEQ ID NO: 2168319 - RNA, 12 nt, Streptococcus pneumoniae R6
guauuuguaaaa

SEQ ID NO: 2168320 - RNA, 21 nt, Streptococcus pneumoniae R6
gucaugccuuuuucaaucaau

SEQ ID NO: 2168321 - RNA, 14 nt, Streptococcus pneumoniae R6
gucaugcgaaacag

SEQ ID NO: 2168322 - RNA, 14 nt, Streptococcus pneumoniae R6
gucaucguuccagu

SEQ ID NO: 2168323 - RNA, 15 nt, Streptococcus pneumoniae R6
gucaucguuccaguu

SEQ ID NO: 2168324 - RNA, 22 nt, Streptococcus pneumoniae R6
guccaaaccaacauagauaaag

SEQ ID NO: 2168325 - RNA, 19 nt, Streptococcus pneumoniae R6
guccaaacguccagccuug

SEQ ID NO: 2168326 - RNA, 14 nt, Streptococcus pneumoniae R6
guccaacagacuca

SEQ ID NO: 2168327 - RNA, 16 nt, Streptococcus pneumoniae R6
guccaauuuugucucu

SEQ ID NO: 2168328 - RNA, 19 nt, Streptococcus pneumoniae R6
gucaucagcagagaaagaa

SEQ ID NO: 2168329 - RNA, 18 nt, Streptococcus pneumoniae R6
gucaucagaaaaaaggca

SEQ ID NO: 2168330 - RNA, 21 nt, Streptococcus pneumoniae R6
gucaucaaaauccguuuuuua

SEQ ID NO: 2168331 - RNA, 20 nt, Streptococcus pneumoniae R6
gucaucaaaaauagaaauaa

SEQ ID NO: 2168332 - RNA, 17 nt, Streptococcus pneumoniae R6
gucauccauuuuuccau

SEQ ID NO: 2168333 - RNA, 21 nt, Streptococcus pneumoniae R6
gucauccuuacggucaaaguc

SEQ ID NO: 2168334 - RNA, 17 nt, Streptococcus pneumoniae R6
guccaguuacuacugga

SEQ ID NO: 2168335 - RNA, 16 nt, Streptococcus pneumoniae R6
guccacucgaaacaag

SEQ ID NO: 2168336 - RNA, 20 nt, Streptococcus pneumoniae R6
guccagcagcuaagaccuug

SEQ ID NO: 2168337 - RNA, 18 nt, Streptococcus pneumoniae R6
gucgaagguuauaccaaa

SEQ ID NO: 2168338 - RNA, 17 nt, Streptococcus pneumoniae R6
gucgacugcagucuuca

SEQ ID NO: 2168339 - RNA, 19 nt, Streptococcus pneumoniae R6
guccuuucucgagcuuagc

SEQ ID NO: 2168340 - RNA, 20 nt, Streptococcus pneumoniae R6
guccuuucuuuuuugaaguu

SEQ ID NO: 2168341 - RNA, 19 nt, Streptococcus pneumoniae R6
guccuuguuugagcucuuu

SEQ ID NO: 2168342 - RNA, 14 nt, Streptococcus pneumoniae R6
guccuuguaugaca

SEQ ID NO: 2168343 - RNA, 17 nt, Streptococcus pneumoniae R6
guccuuguaugacaucu

SEQ ID NO: 2168344 - RNA, 23 nt, Streptococcus pneumoniae R6
gucgaaccaagagcacgauuauu

SEQ ID NO: 2168345 - RNA, 14 nt, Streptococcus pneumoniae R6
gucgaaggcuugua

SEQ ID NO: 2168346 - RNA, 13 nt, Streptococcus pneumoniae R6
gucgaagcuucca

SEQ ID NO: 2168347 - RNA, 19 nt, Streptococcus pneumoniae R6
gucgaagcuuccaauaaua

SEQ ID NO: 2168348 - RNA, 16 nt, Streptococcus pneumoniae R6
guccgagcaggaaggu

SEQ ID NO: 2168349 - RNA, 18 nt, Streptococcus pneumoniae R6
guccgugauuguuuuuaa

SEQ ID NO: 2168350 - RNA, 16 nt, Streptococcus pneumoniae R6
guccauuugaaagaac

SEQ ID NO: 2168351 - RNA, 16 nt, Streptococcus pneumoniae R6
guccgaaaaauuucuc

SEQ ID NO: 2168352 - RNA, 18 nt, Streptococcus pneumoniae R6
gucguuaaaagcaaaaac

SEQ ID NO: 2168353 - RNA, 12 nt, Streptococcus pneumoniae R6
gucguguauaga

SEQ ID NO: 2168354 - RNA, 17 nt, Streptococcus pneumoniae R6
gucguguugacuugggu

SEQ ID NO: 2168355 - RNA, 15 nt, Streptococcus pneumoniae R6
gucgugauuucuauu

SEQ ID NO: 2168356 - RNA, 20 nt, Streptococcus pneumoniae R6
gucuccccaugaguuuucaa

SEQ ID NO: 2168357 - RNA, 18 nt, Streptococcus pneumoniae R6
gucucccuuuuuggauug

SEQ ID NO: 2168358 - RNA, 21 nt, Streptococcus pneumoniae R6
gucuccaguaacuuuaccaaa

SEQ ID NO: 2168359 - RNA, 18 nt, Streptococcus pneumoniae R6
gucucagugggcuauucc

SEQ ID NO: 2168360 - RNA, 17 nt, Streptococcus pneumoniae R6
gucucacacggaaacag

SEQ ID NO: 2168361 - RNA, 21 nt, Streptococcus pneumoniae R6
gucuauguuguaggugcuuau

SEQ ID NO: 2168362 - RNA, 11 nt, Streptococcus pneumoniae R6
gucuauuuucu

SEQ ID NO: 2168363 - RNA, 15 nt, Streptococcus pneumoniae R6
gucuauuugcuuuuc

SEQ ID NO: 2168364 - RNA, 16 nt, Streptococcus pneumoniae R6
gucuauuauacaccau

SEQ ID NO: 2168365 - RNA, 21 nt, Streptococcus pneumoniae R6
gucguuucaagauaaggaauu

SEQ ID NO: 2168366 - RNA, 13 nt, Streptococcus pneumoniae R6
gucuaaaaauuua

SEQ ID NO: 2168367 - RNA, 16 nt, Streptococcus pneumoniae R6
gucuaaaaauuuaaaa

SEQ ID NO: 2168368 - RNA, 20 nt, Streptococcus pneumoniae R6
gucuaaacuguacaagaaca

SEQ ID NO: 2168369 - RNA, 12 nt, Streptococcus pneumoniae R6
gucuagcaagag

SEQ ID NO: 2168370 - RNA, 21 nt, Streptococcus pneumoniae R6
gucuauccagccuucauaaaa

SEQ ID NO: 2168371 - RNA, 23 nt, Streptococcus pneumoniae R6
gucuaccuucaggagauaaaagc

SEQ ID NO: 2168372 - RNA, 20 nt, Streptococcus pneumoniae R6
gucuacaaauucaaacucaa

SEQ ID NO: 2168373 - RNA, 19 nt, Streptococcus pneumoniae R6
gucuacaauagcuuguucc

SEQ ID NO: 2168374 - RNA, 17 nt, Streptococcus pneumoniae R6
gucuacauucuuuuuaa

SEQ ID NO: 2168375 - RNA, 18 nt, Streptococcus pneumoniae R6
gucggauggaaauaaucu

SEQ ID NO: 2168376 - RNA, 14 nt, Streptococcus pneumoniae R6
gucggcuagcacua

SEQ ID NO: 2168377 - RNA, 20 nt, Streptococcus pneumoniae R6
gggauuuucauauaauaaau

SEQ ID NO: 2168378 - RNA, 19 nt, Streptococcus pneumoniae R6
gggauuuuuuagcuucuuu

SEQ ID NO: 2168379 - RNA, 23 nt, Streptococcus pneumoniae R6
gggauuggagcuuaaaauccagu

SEQ ID NO: 2168380 - RNA, 13 nt, Streptococcus pneumoniae R6
gggcaaagaaaag

SEQ ID NO: 2168381 - RNA, 13 nt, Streptococcus pneumoniae R6
gggcacggagggc

SEQ ID NO: 2168382 - RNA, 16 nt, Streptococcus pneumoniae R6
gggcagacgaguuaaa

SEQ ID NO: 2168383 - RNA, 12 nt, Streptococcus pneumoniae R6
gggcacuucuuu

SEQ ID NO: 2168384 - RNA, 16 nt, Streptococcus pneumoniae R6
ggcuuuugauuugauu

SEQ ID NO: 2168385 - RNA, 20 nt, Streptococcus pneumoniae R6
gggaaggugagggcugagaa

SEQ ID NO: 2168386 - RNA, 13 nt, Streptococcus pneumoniae R6
ggcuucaguaaua

SEQ ID NO: 2168387 - RNA, 13 nt, Streptococcus pneumoniae R6
ggcuuucccagac

SEQ ID NO: 2168388 - RNA, 21 nt, Streptococcus pneumoniae R6
ggcuuucaacugcuuuuucaa

SEQ ID NO: 2168389 - RNA, 18 nt, Streptococcus pneumoniae R6
ggcuuucacguuguucaa

SEQ ID NO: 2168390 - RNA, 21 nt, Streptococcus pneumoniae R6
ggcuugaggucccaugcuucc

SEQ ID NO: 2168391 - RNA, 14 nt, Streptococcus pneumoniae R6
gggucaacuuguaa

SEQ ID NO: 2168392 - RNA, 13 nt, Streptococcus pneumoniae R6
ggguaagagacuu

SEQ ID NO: 2168393 - RNA, 20 nt, Streptococcus pneumoniae R6
ggguaaaggguuuggucaga

SEQ ID NO: 2168394 - RNA, 20 nt, Streptococcus pneumoniae R6
gggcuauauaguuuaaucaa

SEQ ID NO: 2168395 - RNA, 12 nt, Streptococcus pneumoniae R6
ggucaagaagcg

SEQ ID NO: 2168396 - RNA, 20 nt, Streptococcus pneumoniae R6
ggucaagcgagccaaacgau

SEQ ID NO: 2168397 - RNA, 16 nt, Streptococcus pneumoniae R6
gguauuuaccaaaaag

SEQ ID NO: 2168398 - RNA, 15 nt, Streptococcus pneumoniae R6
gguauuuguaaaauu

SEQ ID NO: 2168399 - RNA, 13 nt, Streptococcus pneumoniae R6
gguaucaaaggca

SEQ ID NO: 2168400 - RNA, 15 nt, Streptococcus pneumoniae R6
gguauugacugccca

SEQ ID NO: 2168401 - RNA, 12 nt, Streptococcus pneumoniae R6
ggucauuuucca

SEQ ID NO: 2168402 - RNA, 15 nt, Streptococcus pneumoniae R6
gguccagauaaacag

SEQ ID NO: 2168403 - RNA, 20 nt, Streptococcus pneumoniae R6
gguccagcuucaaaucccau

SEQ ID NO: 2168404 - RNA, 14 nt, Streptococcus pneumoniae R6
ggucauaugggacu

SEQ ID NO: 2168405 - RNA, 23 nt, Streptococcus pneumoniae R6
ggucauaugggacuuuuuuucua

SEQ ID NO: 2168406 - RNA, 18 nt, Streptococcus pneumoniae R6
ggucaguugcaagaagca

SEQ ID NO: 2168407 - RNA, 16 nt, Streptococcus pneumoniae R6
ggucauguagauugac

SEQ ID NO: 2168408 - RNA, 19 nt, Streptococcus pneumoniae R6
ggucauguagauugacauu

SEQ ID NO: 2168409 - RNA, 16 nt, Streptococcus pneumoniae R6
ggugacaguaaaaaau

SEQ ID NO: 2168410 - RNA, 23 nt, Streptococcus pneumoniae R6
gguccgaaccacaacaaaaaagg

SEQ ID NO: 2168411 - RNA, 14 nt, Streptococcus pneumoniae R6
gguuugaagagauu

SEQ ID NO: 2168412 - RNA, 23 nt, Streptococcus pneumoniae R6
gguuuauuggcuacgacugcuuc

SEQ ID NO: 2168413 - RNA, 15 nt, Streptococcus pneumoniae R6
gguuucguagcagaa

SEQ ID NO: 2168414 - RNA, 18 nt, Streptococcus pneumoniae R6
guaaaaaaagaagcagaa

SEQ ID NO: 2168415 - RNA, 14 nt, Streptococcus pneumoniae R6
guaaaaaaguugaa

SEQ ID NO: 2168416 - RNA, 20 nt, Streptococcus pneumoniae R6
guaaaaccuuuauaccaagc

SEQ ID NO: 2168417 - RNA, 17 nt, Streptococcus pneumoniae R6
gguuguggaugaaacug

SEQ ID NO: 2168418 - RNA, 14 nt, Streptococcus pneumoniae R6
gguuguagauagaa

SEQ ID NO: 2168419 - RNA, 21 nt, Streptococcus pneumoniae R6
gguuguagauagaacugacga

SEQ ID NO: 2168420 - RNA, 14 nt, Streptococcus pneumoniae R6
gguugcucaaagca

SEQ ID NO: 2168421 - RNA, 20 nt, Streptococcus pneumoniae R6
gguugcagauagaacugacg

SEQ ID NO: 2168422 - RNA, 12 nt, Streptococcus pneumoniae R6
gguugaagaggu

SEQ ID NO: 2168423 - RNA, 13 nt, Streptococcus pneumoniae R6
gguugaaaaaaag

SEQ ID NO: 2168424 - RNA, 16 nt, Streptococcus pneumoniae R6
gguugaaaaaaagcua

SEQ ID NO: 2168425 - RNA, 17 nt, Streptococcus pneumoniae R6
gguucuucgaaagucaa

SEQ ID NO: 2168426 - RNA, 22 nt, Streptococcus pneumoniae R6
gguucuuugccaguucuucaug

SEQ ID NO: 2168427 - RNA, 19 nt, Streptococcus pneumoniae R6
gguucgcccugucuuuagc

SEQ ID NO: 2168428 - RNA, 17 nt, Streptococcus pneumoniae R6
gguucgccauagaauuu

SEQ ID NO: 2168429 - RNA, 17 nt, Streptococcus pneumoniae R6
gguucgcccaaacauag

SEQ ID NO: 2168430 - RNA, 22 nt, Streptococcus pneumoniae R6
gguucgauuccugcagggggca

SEQ ID NO: 2168431 - RNA, 21 nt, Streptococcus pneumoniae R6
gguuccuucugcaucguggau

SEQ ID NO: 2168432 - RNA, 15 nt, Streptococcus pneumoniae R6
gguucaucucuggug

SEQ ID NO: 2168433 - RNA, 20 nt, Streptococcus pneumoniae R6
gguucauccagcaggagaaa

SEQ ID NO: 2168434 - RNA, 16 nt, Streptococcus pneumoniae R6
gguuagcugcaccaca

SEQ ID NO: 2168435 - RNA, 22 nt, Streptococcus pneumoniae R6
gguuagcuccagaagggagaac

SEQ ID NO: 2168436 - RNA, 15 nt, Streptococcus pneumoniae R6
gguuauaaaaaacaa

SEQ ID NO: 2168437 - RNA, 16 nt, Streptococcus pneumoniae R6
gguuagucaaaaagaa

SEQ ID NO: 2168438 - RNA, 16 nt, Streptococcus pneumoniae R6
gguuauaccaaaaaaa

SEQ ID NO: 2168439 - RNA, 17 nt, Streptococcus pneumoniae R6
gguuauaccaaaaaaac

SEQ ID NO: 2168440 - RNA, 22 nt, Streptococcus pneumoniae R6
gguuaagugcauacgaaaagua

SEQ ID NO: 2168441 - RNA, 20 nt, Streptococcus pneumoniae R6
gguuaagacaccgccuuuuc

SEQ ID NO: 2168442 - RNA, 12 nt, Streptococcus pneumoniae R6
gguuagaaaauc

SEQ ID NO: 2168443 - RNA, 13 nt, Streptococcus pneumoniae R6
gguuacugacuuc

SEQ ID NO: 2168444 - RNA, 16 nt, Streptococcus pneumoniae R6
gguuacuuuauaauuc

SEQ ID NO: 2168445 - RNA, 19 nt, Streptococcus pneumoniae R6
gguguaaacuuuauauccu

SEQ ID NO: 2168446 - RNA, 13 nt, Streptococcus pneumoniae R6
gguguaaauagaa

SEQ ID NO: 2168447 - RNA, 19 nt, Streptococcus pneumoniae R6
gguguaaauagaaaccagc

SEQ ID NO: 2168448 - RNA, 18 nt, Streptococcus pneumoniae R6
gguguuaauuggaaaaua

SEQ ID NO: 2168449 - RNA, 23 nt, Streptococcus pneumoniae R6
gguguucacgaaagcaacuuacu

SEQ ID NO: 2168450 - RNA, 18 nt, Streptococcus pneumoniae R6
ggugcuugucccauaaac

SEQ ID NO: 2168451 - RNA, 21 nt, Streptococcus pneumoniae R6
cuccaaucaaauugugcaguu

SEQ ID NO: 2168452 - RNA, 15 nt, Streptococcus pneumoniae R6
cuccacgcuccacuu

SEQ ID NO: 2168453 - RNA, 17 nt, Streptococcus pneumoniae R6
cuccacgcuccacuucc

SEQ ID NO: 2168454 - RNA, 18 nt, Streptococcus pneumoniae R6
cuccacgcuccacuuccc

SEQ ID NO: 2168455 - RNA, 20 nt, Streptococcus pneumoniae R6
cuccacgcuccacuucccca

SEQ ID NO: 2168456 - RNA, 19 nt, Streptococcus pneumoniae R6
cuccagauuaucuuccuua

SEQ ID NO: 2168457 - RNA, 14 nt, Streptococcus pneumoniae R6
cuccacuauaaaac

SEQ ID NO: 2168458 - RNA, 18 nt, Streptococcus pneumoniae R6
cuccaagcgcccugcaau

SEQ ID NO: 2168459 - RNA, 16 nt, Streptococcus pneumoniae R6
cuccaagaaagagaau

SEQ ID NO: 2168460 - RNA, 16 nt, Streptococcus pneumoniae R6
cuccaaagccuucuug

SEQ ID NO: 2168461 - RNA, 15 nt, Streptococcus pneumoniae R6
cuccaaaccauuuuu

SEQ ID NO: 2168462 - RNA, 19 nt, Streptococcus pneumoniae R6
cuccaaacgcgauacaaua

SEQ ID NO: 2168463 - RNA, 20 nt, Streptococcus pneumoniae R6
cuccaaacgcgauacaauaa

SEQ ID NO: 2168464 - RNA, 20 nt, Streptococcus pneumoniae R6
cucauuucaauagaaaucac

SEQ ID NO: 2168465 - RNA, 21 nt, Streptococcus pneumoniae R6
cuccaaaaauaaaucuaucag

SEQ ID NO: 2168466 - RNA, 15 nt, Streptococcus pneumoniae R6
cucaggauaaaacca

SEQ ID NO: 2168467 - RNA, 13 nt, Streptococcus pneumoniae R6
cucauucuuaagu

SEQ ID NO: 2168468 - RNA, 18 nt, Streptococcus pneumoniae R6
cucauugauuuggacuau

SEQ ID NO: 2168469 - RNA, 14 nt, Streptococcus pneumoniae R6
cucauucaucacca

SEQ ID NO: 2168470 - RNA, 18 nt, Streptococcus pneumoniae R6
cuccauuaugaagaacac

SEQ ID NO: 2168471 - RNA, 20 nt, Streptococcus pneumoniae R6
cuccaugcuaccagucggaa

SEQ ID NO: 2168472 - RNA, 23 nt, Streptococcus pneumoniae R6
cucccaucgcgaccaagagcaaa

SEQ ID NO: 2168473 - RNA, 15 nt, Streptococcus pneumoniae R6
cucccauauuuggca

SEQ ID NO: 2168474 - RNA, 23 nt, Streptococcus pneumoniae R6
cucccauucuucuuuuccaaaca

SEQ ID NO: 2168475 - RNA, 20 nt, Streptococcus pneumoniae R6
cucccauuggaucccauggu

SEQ ID NO: 2168476 - RNA, 23 nt, Streptococcus pneumoniae R6
cuccuacaaagcccauacgcccu

SEQ ID NO: 2168477 - RNA, 19 nt, Streptococcus pneumoniae R6
cuccguuuuuaaucauaca

SEQ ID NO: 2168478 - RNA, 18 nt, Streptococcus pneumoniae R6
cuccuaguuugcucuuug

SEQ ID NO: 2168479 - RNA, 14 nt, Streptococcus pneumoniae R6
cuccuauuuucuuc

SEQ ID NO: 2168480 - RNA, 23 nt, Streptococcus pneumoniae R6
cuccuauagaaaaaucccccaag

SEQ ID NO: 2168481 - RNA, 23 nt, Streptococcus pneumoniae R6
cuccguagauagcugcagcugag

SEQ ID NO: 2168482 - RNA, 19 nt, Streptococcus pneumoniae R6
cuccgauaauuauuuuuua

SEQ ID NO: 2168483 - RNA, 23 nt, Streptococcus pneumoniae R6
cuccgagaaguaccgccaaaccu

SEQ ID NO: 2168484 - RNA, 18 nt, Streptococcus pneumoniae R6
cuccgcuuuuaucaaaga

SEQ ID NO: 2168485 - RNA, 12 nt, Streptococcus pneumoniae R6
cuccgcuuccag

SEQ ID NO: 2168486 - RNA, 15 nt, Streptococcus pneumoniae R6
cuccgcuuccagagc

SEQ ID NO: 2168487 - RNA, 15 nt, Streptococcus pneumoniae R6
cuccuccaaguccaa

SEQ ID NO: 2168488 - RNA, 13 nt, Streptococcus pneumoniae R6
cucgcaagagacu

SEQ ID NO: 2168489 - RNA, 22 nt, Streptococcus pneumoniae R6
cucuaaaaucaucgccaaauca

SEQ ID NO: 2168490 - RNA, 18 nt, Streptococcus pneumoniae R6
cucuaaacaaacuccucu

SEQ ID NO: 2168491 - RNA, 12 nt, Streptococcus pneumoniae R6
cucuaaaaauaa

SEQ ID NO: 2168492 - RNA, 16 nt, Streptococcus pneumoniae R6
cucuaaaaauaaaaaa

SEQ ID NO: 2168493 - RNA, 17 nt, Streptococcus pneumoniae R6
cucguuuguuuuuuccu

SEQ ID NO: 2168494 - RNA, 21 nt, Streptococcus pneumoniae R6
cucuaagcacaaaaucuuaaa

SEQ ID NO: 2168495 - RNA, 21 nt, Streptococcus pneumoniae R6
cucuaaccauuauagcauucu

SEQ ID NO: 2168496 - RNA, 12 nt, Streptococcus pneumoniae R6
cucuaaauaaau

SEQ ID NO: 2168497 - RNA, 15 nt, Streptococcus pneumoniae R6
cucguuaauugcauu

SEQ ID NO: 2168498 - RNA, 19 nt, Streptococcus pneumoniae R6
cucgugauguuaaaaugag

SEQ ID NO: 2168499 - RNA, 22 nt, Streptococcus pneumoniae R6
cucgugauuauagguuccuucu

SEQ ID NO: 2168500 - RNA, 23 nt, Streptococcus pneumoniae R6
cucgggcugaauauauucuccag

SEQ ID NO: 2168501 - RNA, 12 nt, Streptococcus pneumoniae R6
cucgcuggagau

SEQ ID NO: 2168502 - RNA, 18 nt, Streptococcus pneumoniae R6
cucgcuggagauagguca

SEQ ID NO: 2168503 - RNA, 14 nt, Streptococcus pneumoniae R6
cuauuuuaaaaaua

SEQ ID NO: 2168504 - RNA, 15 nt, Streptococcus pneumoniae R6
cuauuuuauuuuuua

SEQ ID NO: 2168505 - RNA, 12 nt, Streptococcus pneumoniae R6
cuauuuuauccc

SEQ ID NO: 2168506 - RNA, 16 nt, Streptococcus pneumoniae R6
cuauuuuauugucauu

SEQ ID NO: 2168507 - RNA, 21 nt, Streptococcus pneumoniae R6
cuauuugaguaacggcuuccu

SEQ ID NO: 2168508 - RNA, 17 nt, Streptococcus pneumoniae R6
cuauuuggcuuaucuga

SEQ ID NO: 2168509 - RNA, 18 nt, Streptococcus pneumoniae R6
cuauuucuagcuagaccu

SEQ ID NO: 2168510 - RNA, 17 nt, Streptococcus pneumoniae R6
cuauuuuuguauuuaga

SEQ ID NO: 2168511 - RNA, 19 nt, Streptococcus pneumoniae R6
cuauuuucuucuuuauaau

SEQ ID NO: 2168512 - RNA, 22 nt, Streptococcus pneumoniae R6
cuauuuucuucuuuauaauauu

SEQ ID NO: 2168513 - RNA, 13 nt, Streptococcus pneumoniae R6
cuauuuuuugaau

SEQ ID NO: 2168514 - RNA, 23 nt, Streptococcus pneumoniae R6
cuauuuuuugaaucaauuuucaa

SEQ ID NO: 2168515 - RNA, 14 nt, Streptococcus pneumoniae R6
cucaaaacacuguu

SEQ ID NO: 2168516 - RNA, 16 nt, Streptococcus pneumoniae R6
cucaaaacacuguuuu

SEQ ID NO: 2168517 - RNA, 19 nt, Streptococcus pneumoniae R6
cucaaaacacuguuuuaag

SEQ ID NO: 2168518 - RNA, 14 nt, Streptococcus pneumoniae R6
cucaaaacaguguu

SEQ ID NO: 2168519 - RNA, 23 nt, Streptococcus pneumoniae R6
cucaaaacaguguuuuaagcuga

SEQ ID NO: 2168520 - RNA, 20 nt, Streptococcus pneumoniae R6
cucaaaacaguguuuugagc

SEQ ID NO: 2168521 - RNA, 23 nt, Streptococcus pneumoniae R6
cucaaaacaguguuuugaucuga

SEQ ID NO: 2168522 - RNA, 21 nt, Streptococcus pneumoniae R6
cucaaaacaugguuuugaggu

SEQ ID NO: 2168523 - RNA, 21 nt, Streptococcus pneumoniae R6
cucaaaacauguuuuugaggu

SEQ ID NO: 2168524 - RNA, 20 nt, Streptococcus pneumoniae R6
cucaaaaccauguuuugagc

SEQ ID NO: 2168525 - RNA, 21 nt, Streptococcus pneumoniae R6
cuauuguuauuuuucuuuuuu

SEQ ID NO: 2168526 - RNA, 19 nt, Streptococcus pneumoniae R6
cuauuguugcauuaaaaag

SEQ ID NO: 2168527 - RNA, 18 nt, Streptococcus pneumoniae R6
cuauugucacgaaccaca

SEQ ID NO: 2168528 - RNA, 21 nt, Streptococcus pneumoniae R6
cuauuucacuccacuauaaaa

SEQ ID NO: 2168529 - RNA, 17 nt, Streptococcus pneumoniae R6
cuauuuaugaaaaaguu

SEQ ID NO: 2168530 - RNA, 23 nt, Streptococcus pneumoniae R6
cuauuuauuacuucaauuucuaa

SEQ ID NO: 2168531 - RNA, 13 nt, Streptococcus pneumoniae R6
cuauuuauuuaau

SEQ ID NO: 2168532 - RNA, 21 nt, Streptococcus pneumoniae R6
cuauugacuuuucuuauaguu

SEQ ID NO: 2168533 - RNA, 20 nt, Streptococcus pneumoniae R6
cuauucuaaauucaauucac

SEQ ID NO: 2168534 - RNA, 23 nt, Streptococcus pneumoniae R6
cuauuccuuuuuuuacaucaagc

SEQ ID NO: 2168535 - RNA, 19 nt, Streptococcus pneumoniae R6
cuauucuaguuucaaucua

SEQ ID NO: 2168536 - RNA, 14 nt, Streptococcus pneumoniae R6
cuauucuuuuucua

SEQ ID NO: 2168537 - RNA, 12 nt, Streptococcus pneumoniae R6
cuauucuuuuuu

SEQ ID NO: 2168538 - RNA, 20 nt, Streptococcus pneumoniae R6
cuauugaaaggaaaaugauu

SEQ ID NO: 2168539 - RNA, 16 nt, Streptococcus pneumoniae R6
cuauugaaaugaggac

SEQ ID NO: 2168540 - RNA, 15 nt, Streptococcus pneumoniae R6
cuauagaacuaguaa

SEQ ID NO: 2168541 - RNA, 13 nt, Streptococcus pneumoniae R6
cuauacuuacucu

SEQ ID NO: 2168542 - RNA, 14 nt, Streptococcus pneumoniae R6
cuauacuuacucuu

SEQ ID NO: 2168543 - RNA, 23 nt, Streptococcus pneumoniae R6
cuauacuuacucuuauuauucuc

SEQ ID NO: 2168544 - RNA, 20 nt, Streptococcus pneumoniae R6
cuaucucaacaaaucuuccu

SEQ ID NO: 2168545 - RNA, 13 nt, Streptococcus pneumoniae R6
cuaucuaaaaaaa

SEQ ID NO: 2168546 - RNA, 20 nt, Streptococcus pneumoniae R6
cuaucuaaaaaaaugauaau

SEQ ID NO: 2168547 - RNA, 17 nt, Streptococcus pneumoniae R6
cuaucuaaaauagaagg

SEQ ID NO: 2168548 - RNA, 21 nt, Streptococcus pneumoniae R6
cuaucuacaaccucaaagcag

SEQ ID NO: 2168549 - RNA, 19 nt, Streptococcus pneumoniae R6
cuauagcguuuugaaacua

SEQ ID NO: 2168550 - RNA, 17 nt, Streptococcus pneumoniae R6
cuaucuaggcugacaau

SEQ ID NO: 2168551 - RNA, 20 nt, Streptococcus pneumoniae R6
cuaucuuauugauuuuucug

SEQ ID NO: 2168552 - RNA, 15 nt, Streptococcus pneumoniae R6
cuaucugccaccuca

SEQ ID NO: 2168553 - RNA, 19 nt, Streptococcus pneumoniae R6
cuaucugcuaacugcugga

SEQ ID NO: 2168554 - RNA, 16 nt, Streptococcus pneumoniae R6
cuaucugcaaccucaa

SEQ ID NO: 2168555 - RNA, 22 nt, Streptococcus pneumoniae R6
cuaucugcaaccucaaaacagu

SEQ ID NO: 2168556 - RNA, 16 nt, Streptococcus pneumoniae R6
cuaugaaaugagaaau

SEQ ID NO: 2168557 - RNA, 18 nt, Streptococcus pneumoniae R6
cuaugaauaugaguucuu

SEQ ID NO: 2168558 - RNA, 11 nt, Streptococcus pneumoniae R6
cuaugauaaaa

SEQ ID NO: 2168559 - RNA, 17 nt, Streptococcus pneumoniae R6
cuaugcuuuuuauugug

SEQ ID NO: 2168560 - RNA, 22 nt, Streptococcus pneumoniae R6
cuauucacucaaaucauauuca

SEQ ID NO: 2168561 - RNA, 15 nt, Streptococcus pneumoniae R6
cuauucccuaccuca

SEQ ID NO: 2168562 - RNA, 17 nt, Streptococcus pneumoniae R6
cuauuaugcuaaagaaa

SEQ ID NO: 2168563 - RNA, 23 nt, Streptococcus pneumoniae R6
cucagcugagcgguuuuagucua

SEQ ID NO: 2168564 - RNA, 16 nt, Streptococcus pneumoniae R6
cucagcugaugagugg

SEQ ID NO: 2168565 - RNA, 15 nt, Streptococcus pneumoniae R6
cucagaaacaagaaa

SEQ ID NO: 2168566 - RNA, 20 nt, Streptococcus pneumoniae R6
cucagaacccuuauuuccug

SEQ ID NO: 2168567 - RNA, 21 nt, Streptococcus pneumoniae R6
cucagaacccuuauuuccugc

SEQ ID NO: 2168568 - RNA, 23 nt, Streptococcus pneumoniae R6
cucagaacgucgcuguaaaaucu

SEQ ID NO: 2168569 - RNA, 12 nt, Streptococcus pneumoniae R6
cucagcaggagc

SEQ ID NO: 2168570 - RNA, 14 nt, Streptococcus pneumoniae R6
cucagcauuuucuu

SEQ ID NO: 2168571 - RNA, 19 nt, Streptococcus pneumoniae R6
cucacuuacauauucuaac

SEQ ID NO: 2168572 - RNA, 12 nt, Streptococcus pneumoniae R6
cucacgguaaau

SEQ ID NO: 2168573 - RNA, 15 nt, Streptococcus pneumoniae R6
cucacgguaaaugua

SEQ ID NO: 2168574 - RNA, 19 nt, Streptococcus pneumoniae R6
cucaaaagcuuguuuaaaa

SEQ ID NO: 2168575 - RNA, 23 nt, Streptococcus pneumoniae R6
cucaaaacgguguuuugagcuga

SEQ ID NO: 2168576 - RNA, 23 nt, Streptococcus pneumoniae R6
cucaaaacaauguuuugaucuga

SEQ ID NO: 2168577 - RNA, 16 nt, Streptococcus pneumoniae R6
cucaaaaaaguuaaau

SEQ ID NO: 2168578 - RNA, 12 nt, Streptococcus pneumoniae R6
cucaaaaucauc

SEQ ID NO: 2168579 - RNA, 11 nt, Streptococcus pneumoniae R6
cucaaaacuag

SEQ ID NO: 2168580 - RNA, 13 nt, Streptococcus pneumoniae R6
cucaaaauucugu

SEQ ID NO: 2168581 - RNA, 22 nt, Streptococcus pneumoniae R6
cucaaagcagugcuuugagcaa

SEQ ID NO: 2168582 - RNA, 12 nt, Streptococcus pneumoniae R6
cucaaaguacug

SEQ ID NO: 2168583 - RNA, 16 nt, Streptococcus pneumoniae R6
cucaaucuuaucaauc

SEQ ID NO: 2168584 - RNA, 23 nt, Streptococcus pneumoniae R6
cucaaugaaaaucaaagagcaaa

SEQ ID NO: 2168585 - RNA, 23 nt, Streptococcus pneumoniae R6
cucaauuaagaaauuuucuuuuu

SEQ ID NO: 2168586 - RNA, 15 nt, Streptococcus pneumoniae R6
cucaauguuuuauua

SEQ ID NO: 2168587 - RNA, 22 nt, Streptococcus pneumoniae R6
cucaauguuuuauuacauaagu

SEQ ID NO: 2168588 - RNA, 19 nt, Streptococcus pneumoniae R6
cucaaugauaccaucuuua

SEQ ID NO: 2168589 - RNA, 21 nt, Streptococcus pneumoniae R6
cucaauuuaucuagugcuaua

SEQ ID NO: 2168590 - RNA, 21 nt, Streptococcus pneumoniae R6
cucaauuucagaagaaaaaaa

SEQ ID NO: 2168591 - RNA, 21 nt, Streptococcus pneumoniae R6
cucaccaucuuccgcaaucca

SEQ ID NO: 2168592 - RNA, 19 nt, Streptococcus pneumoniae R6
cuaguguauggcgcaguuu

SEQ ID NO: 2168593 - RNA, 24 nt, Streptococcus pneumoniae R6
cuagugucauaguccugaaaauca

SEQ ID NO: 2168594 - RNA, 20 nt, Streptococcus pneumoniae R6
cuaguauucaucuuaucaac

SEQ ID NO: 2168595 - RNA, 17 nt, Streptococcus pneumoniae R6
cuagucuaacuucucca

SEQ ID NO: 2168596 - RNA, 16 nt, Streptococcus pneumoniae R6
cuagucuacuuguuca

SEQ ID NO: 2168597 - RNA, 15 nt, Streptococcus pneumoniae R6
cuagucuggagauuu

SEQ ID NO: 2168598 - RNA, 19 nt, Streptococcus pneumoniae R6
cuagucuggauauccuuuu

SEQ ID NO: 2168599 - RNA, 18 nt, Streptococcus pneumoniae R6
cuaggaaacuagccgcag

SEQ ID NO: 2168600 - RNA, 21 nt, Streptococcus pneumoniae R6
cuagcuuuuauaaauuuucca

SEQ ID NO: 2168601 - RNA, 14 nt, Streptococcus pneumoniae R6
cuaggaauaucaaa

SEQ ID NO: 2168602 - RNA, 12 nt, Streptococcus pneumoniae R6
cuagcuuuuucc

SEQ ID NO: 2168603 - RNA, 21 nt, Streptococcus pneumoniae R6
cuaguagaucaugacugagag

SEQ ID NO: 2168604 - RNA, 13 nt, Streptococcus pneumoniae R6
cuaguacaaagaa

SEQ ID NO: 2168605 - RNA, 16 nt, Streptococcus pneumoniae R6
cuaguacaaagaauaa

SEQ ID NO: 2168606 - RNA, 22 nt, Streptococcus pneumoniae R6
cuaguaagaugaguuugcuuuu

SEQ ID NO: 2168607 - RNA, 23 nt, Streptococcus pneumoniae R6
cuaguaaucgguaggaugacaac

SEQ ID NO: 2168608 - RNA, 15 nt, Streptococcus pneumoniae R6
cuauaaaugaugaau

SEQ ID NO: 2168609 - RNA, 15 nt, Streptococcus pneumoniae R6
cuauaaauucauuug

SEQ ID NO: 2168610 - RNA, 12 nt, Streptococcus pneumoniae R6
cuauacuuuuuc

SEQ ID NO: 2168611 - RNA, 20 nt, Streptococcus pneumoniae R6
cuauacuuuuucuuccuuuc

SEQ ID NO: 2168612 - RNA, 13 nt, Streptococcus pneumoniae R6
cuauaauaaaaug

SEQ ID NO: 2168613 - RNA, 19 nt, Streptococcus pneumoniae R6
cuauaagaugaccuuaucu

SEQ ID NO: 2168614 - RNA, 22 nt, Streptococcus pneumoniae R6
cuaguuuucuaaagaauuugaa

SEQ ID NO: 2168615 - RNA, 18 nt, Streptococcus pneumoniae R6
cuaguuuugguuuuucuu

SEQ ID NO: 2168616 - RNA, 13 nt, Streptococcus pneumoniae R6
cuaguuucaauuu

SEQ ID NO: 2168617 - RNA, 15 nt, Streptococcus pneumoniae R6
cuaguucucaaauuu

SEQ ID NO: 2168618 - RNA, 16 nt, Streptococcus pneumoniae R6
cuaguuggugacugac

SEQ ID NO: 2168619 - RNA, 16 nt, Streptococcus pneumoniae R6
cuaguugcuaguguau

SEQ ID NO: 2168620 - RNA, 15 nt, Streptococcus pneumoniae R6
cuauaaacaaaggag

SEQ ID NO: 2168621 - RNA, 19 nt, Streptococcus pneumoniae R6
cuacguucugucaaaccau

SEQ ID NO: 2168622 - RNA, 16 nt, Streptococcus pneumoniae R6
cuacgucagcuuccau

SEQ ID NO: 2168623 - RNA, 18 nt, Streptococcus pneumoniae R6
cuagaaaggacaaauuuc

SEQ ID NO: 2168624 - RNA, 13 nt, Streptococcus pneumoniae R6
cuagaaaaagcuu

SEQ ID NO: 2168625 - RNA, 16 nt, Streptococcus pneumoniae R6
cuagaaaaagcuucau

SEQ ID NO: 2168626 - RNA, 21 nt, Streptococcus pneumoniae R6
cuagaaaaagcuucauuuauc

SEQ ID NO: 2168627 - RNA, 17 nt, Streptococcus pneumoniae R6
cuagaauccuaguucau

SEQ ID NO: 2168628 - RNA, 16 nt, Streptococcus pneumoniae R6
cuagaaugcuuuuuga

SEQ ID NO: 2168629 - RNA, 20 nt, Streptococcus pneumoniae R6
cuagaagugguuccuagaau

SEQ ID NO: 2168630 - RNA, 15 nt, Streptococcus pneumoniae R6
cuagaauaguacacu

SEQ ID NO: 2168631 - RNA, 15 nt, Streptococcus pneumoniae R6
cuagaauaguccacu

SEQ ID NO: 2168632 - RNA, 21 nt, Streptococcus pneumoniae R6
cuagaauaguccacugcaauu

SEQ ID NO: 2168633 - RNA, 21 nt, Streptococcus pneumoniae R6
cuagacuauaacagagaagaa

SEQ ID NO: 2168634 - RNA, 19 nt, Streptococcus pneumoniae R6
cuagacgcuuguccugaau

SEQ ID NO: 2168635 - RNA, 17 nt, Streptococcus pneumoniae R6
cuagaaaucucuuuuuu

SEQ ID NO: 2168636 - RNA, 22 nt, Streptococcus pneumoniae R6
cuagaaaucucuuuuuucucca

SEQ ID NO: 2168637 - RNA, 17 nt, Streptococcus pneumoniae R6
cuagccaguauuuuuag

SEQ ID NO: 2168638 - RNA, 18 nt, Streptococcus pneumoniae R6
cuagccgcagguugcuca

SEQ ID NO: 2168639 - RNA, 14 nt, Streptococcus pneumoniae R6
cuagccccagcuag

SEQ ID NO: 2168640 - RNA, 23 nt, Streptococcus pneumoniae R6
cuagcgcaaagcuaaauccuuuu

SEQ ID NO: 2168641 - RNA, 14 nt, Streptococcus pneumoniae R6
cuacacuugacaaa

SEQ ID NO: 2168642 - RNA, 14 nt, Streptococcus pneumoniae R6
cuacaauaacaccc

SEQ ID NO: 2168643 - RNA, 19 nt, Streptococcus pneumoniae R6
cuacaauucgcuauuuuuu

SEQ ID NO: 2168644 - RNA, 14 nt, Streptococcus pneumoniae R6
cuacaauuggaaau

SEQ ID NO: 2168645 - RNA, 13 nt, Streptococcus pneumoniae R6
cuacaccauaaau

SEQ ID NO: 2168646 - RNA, 18 nt, Streptococcus pneumoniae R6
cuacauucccaaacaaaa

SEQ ID NO: 2168647 - RNA, 19 nt, Streptococcus pneumoniae R6
cuacauucccaaacaaaaa

SEQ ID NO: 2168648 - RNA, 18 nt, Streptococcus pneumoniae R6
cuacauguguuaccauag

SEQ ID NO: 2168649 - RNA, 19 nt, Streptococcus pneumoniae R6
cuacaucauugucaaacaa

SEQ ID NO: 2168650 - RNA, 16 nt, Streptococcus pneumoniae R6
cuacauccucaaccuc

SEQ ID NO: 2168651 - RNA, 18 nt, Streptococcus pneumoniae R6
cuacauacccaugcuuuu

SEQ ID NO: 2168652 - RNA, 19 nt, Streptococcus pneumoniae R6
cuacaguugacaaagagcc

SEQ ID NO: 2168653 - RNA, 20 nt, Streptococcus pneumoniae R6
cuacaguugacaaagagcca

SEQ ID NO: 2168654 - RNA, 20 nt, Streptococcus pneumoniae R6
cuacaguugacaaagagccc

SEQ ID NO: 2168655 - RNA, 20 nt, Streptococcus pneumoniae R6
cuacagggaucgaaccugug

SEQ ID NO: 2168656 - RNA, 17 nt, Streptococcus pneumoniae R6
cuacagaugcugcauuu

SEQ ID NO: 2168657 - RNA, 20 nt, Streptococcus pneumoniae R6
cuaccuacuuuagauacacc

SEQ ID NO: 2168658 - RNA, 16 nt, Streptococcus pneumoniae R6
cuaccguugaaaucaa

SEQ ID NO: 2168659 - RNA, 22 nt, Streptococcus pneumoniae R6
cuaccugcggauaaaagagaau

SEQ ID NO: 2168660 - RNA, 23 nt, Streptococcus pneumoniae R6
cuaccugcuccaaauauugcuca

SEQ ID NO: 2168661 - RNA, 21 nt, Streptococcus pneumoniae R6
cuaccaaguaaaucuacaaag

SEQ ID NO: 2168662 - RNA, 17 nt, Streptococcus pneumoniae R6
cuaccauuaucuagacc

SEQ ID NO: 2168663 - RNA, 16 nt, Streptococcus pneumoniae R6
cguacaugagaauggc

SEQ ID NO: 2168664 - RNA, 16 nt, Streptococcus pneumoniae R6
cguacacucaaaucaa

SEQ ID NO: 2168665 - RNA, 12 nt, Streptococcus pneumoniae R6
cguaguaaaccu

SEQ ID NO: 2168666 - RNA, 23 nt, Streptococcus pneumoniae R6
cguagauagcugcagcugaggaa

SEQ ID NO: 2168667 - RNA, 23 nt, Streptococcus pneumoniae R6
cgucacgacgcaguucuucauac

SEQ ID NO: 2168668 - RNA, 17 nt, Streptococcus pneumoniae R6
cgucagcuuccaucugc

SEQ ID NO: 2168669 - RNA, 19 nt, Streptococcus pneumoniae R6
cgucagcuuccaucugcag

SEQ ID NO: 2168670 - RNA, 16 nt, Streptococcus pneumoniae R6
cgucagcuuuaucugc

SEQ ID NO: 2168671 - RNA, 13 nt, Streptococcus pneumoniae R6
cguccaccacaaa

SEQ ID NO: 2168672 - RNA, 14 nt, Streptococcus pneumoniae R6
cguccaccacaaaa

SEQ ID NO: 2168673 - RNA, 22 nt, Streptococcus pneumoniae R6
cguccaccacaaaagagaaaga

SEQ ID NO: 2168674 - RNA, 23 nt, Streptococcus pneumoniae R6
cgucauuuaaagauguccuuuua

SEQ ID NO: 2168675 - RNA, 16 nt, Streptococcus pneumoniae R6
cguccagcagcuaaga

SEQ ID NO: 2168676 - RNA, 22 nt, Streptococcus pneumoniae R6
cgucuaaacuguacaagaacaa

SEQ ID NO: 2168677 - RNA, 19 nt, Streptococcus pneumoniae R6
cgugauuuccaaucuucuc

SEQ ID NO: 2168678 - RNA, 21 nt, Streptococcus pneumoniae R6
cgugauuuccaaucuucucca

SEQ ID NO: 2168679 - RNA, 15 nt, Streptococcus pneumoniae R6
cgugauuguuuuuaa

SEQ ID NO: 2168680 - RNA, 19 nt, Streptococcus pneumoniae R6
cgucuggauugaccaagcu

SEQ ID NO: 2168681 - RNA, 15 nt, Streptococcus pneumoniae R6
cgugaagaaaucauc

SEQ ID NO: 2168682 - RNA, 16 nt, Streptococcus pneumoniae R6
cuaacucauagcagau

SEQ ID NO: 2168683 - RNA, 12 nt, Streptococcus pneumoniae R6
cuaacucagcuu

SEQ ID NO: 2168684 - RNA, 13 nt, Streptococcus pneumoniae R6
cuaacuuaaaagc

SEQ ID NO: 2168685 - RNA, 15 nt, Streptococcus pneumoniae R6
cuaacuucuccaucu

SEQ ID NO: 2168686 - RNA, 20 nt, Streptococcus pneumoniae R6
cuaacuucuccaucuuagga

SEQ ID NO: 2168687 - RNA, 13 nt, Streptococcus pneumoniae R6
cuaacuucuuauu

SEQ ID NO: 2168688 - RNA, 16 nt, Streptococcus pneumoniae R6
cuaaaccuuauuuuuu

SEQ ID NO: 2168689 - RNA, 15 nt, Streptococcus pneumoniae R6
cuaacaauguuuuag

SEQ ID NO: 2168690 - RNA, 18 nt, Streptococcus pneumoniae R6
cuaacaagucuuaaaauc

SEQ ID NO: 2168691 - RNA, 16 nt, Streptococcus pneumoniae R6
cuaacccuucuuuuua

SEQ ID NO: 2168692 - RNA, 14 nt, Streptococcus pneumoniae R6
cuaagguuucaaaa

SEQ ID NO: 2168693 - RNA, 23 nt, Streptococcus pneumoniae R6
cuaagguuaacgucaaaugacua

SEQ ID NO: 2168694 - RNA, 16 nt, Streptococcus pneumoniae R6
cuaagguauauucaaa

SEQ ID NO: 2168695 - RNA, 21 nt, Streptococcus pneumoniae R6
cuaagguauauucaaaauaca

SEQ ID NO: 2168696 - RNA, 14 nt, Streptococcus pneumoniae R6
cuaagucaaauaag

SEQ ID NO: 2168697 - RNA, 18 nt, Streptococcus pneumoniae R6
cuaaggaaagucaaacaa

SEQ ID NO: 2168698 - RNA, 17 nt, Streptococcus pneumoniae R6
cuaaggaggcaaagaaa

SEQ ID NO: 2168699 - RNA, 16 nt, Streptococcus pneumoniae R6
cuaaggcuguuucaaa

SEQ ID NO: 2168700 - RNA, 22 nt, Streptococcus pneumoniae R6
cuaaguugggugaaguugaaag

SEQ ID NO: 2168701 - RNA, 20 nt, Streptococcus pneumoniae R6
cuaaguuccuguuguaauuu

SEQ ID NO: 2168702 - RNA, 23 nt, Streptococcus pneumoniae R6
cuaaguuccuguuguaauuuuaa

SEQ ID NO: 2168703 - RNA, 21 nt, Streptococcus pneumoniae R6
cuaagugucuggaaugauaac

SEQ ID NO: 2168704 - RNA, 17 nt, Streptococcus pneumoniae R6
cuaaguccuuuuaguuu

SEQ ID NO: 2168705 - RNA, 22 nt, Streptococcus pneumoniae R6
cuaaguccuuuuaguuuuaccu

SEQ ID NO: 2168706 - RNA, 22 nt, Streptococcus pneumoniae R6
cuaaguccuuuuaguuuuaucu

SEQ ID NO: 2168707 - RNA, 23 nt, Streptococcus pneumoniae R6
cuaagcauuuaauccaaaguaaa

SEQ ID NO: 2168708 - RNA, 16 nt, Streptococcus pneumoniae R6
cuaagauguucaaucu

SEQ ID NO: 2168709 - RNA, 22 nt, Streptococcus pneumoniae R6
cuaagaugauuuuucuaaauuu

SEQ ID NO: 2168710 - RNA, 17 nt, Streptococcus pneumoniae R6
cuaagcucuuaaaagca

SEQ ID NO: 2168711 - RNA, 23 nt, Streptococcus pneumoniae R6
cuaagcucgagaaaggacaaauu

SEQ ID NO: 2168712 - RNA, 14 nt, Streptococcus pneumoniae R6
cuaagccuuuuucu

SEQ ID NO: 2168713 - RNA, 16 nt, Streptococcus pneumoniae R6
cuaagcccaaagauaa

SEQ ID NO: 2168714 - RNA, 23 nt, Streptococcus pneumoniae R6
cuaagauauuaagaaucuuuucu

SEQ ID NO: 2168715 - RNA, 21 nt, Streptococcus pneumoniae R6
cuaagauauuauuucaaagaa

SEQ ID NO: 2168716 - RNA, 14 nt, Streptococcus pneumoniae R6
cuaagagagaagcc

SEQ ID NO: 2168717 - RNA, 17 nt, Streptococcus pneumoniae R6
cuaagaguauaaaaccu

SEQ ID NO: 2168718 - RNA, 18 nt, Streptococcus pneumoniae R6
cuaagaguauaaaaccuu

SEQ ID NO: 2168719 - RNA, 21 nt, Streptococcus pneumoniae R6
cuaagaguauaaaaccuugaa

SEQ ID NO: 2168720 - RNA, 17 nt, Streptococcus pneumoniae R6
cuaagaagacugaaaau

SEQ ID NO: 2168721 - RNA, 13 nt, Streptococcus pneumoniae R6
cuaacuuuuccuu

SEQ ID NO: 2168722 - RNA, 16 nt, Streptococcus pneumoniae R6
cuaauuguaaacugug

SEQ ID NO: 2168723 - RNA, 20 nt, Streptococcus pneumoniae R6
cuaauuucaaaggcuuuuuc

SEQ ID NO: 2168724 - RNA, 21 nt, Streptococcus pneumoniae R6
cuaauuucaaaggcuuuuucu

SEQ ID NO: 2168725 - RNA, 16 nt, Streptococcus pneumoniae R6
cuaauucuuugacaag

SEQ ID NO: 2168726 - RNA, 22 nt, Streptococcus pneumoniae R6
cuaauugaaaacgguaacaaaa

SEQ ID NO: 2168727 - RNA, 14 nt, Streptococcus pneumoniae R6
cuaauuaauuaacu

SEQ ID NO: 2168728 - RNA, 13 nt, Streptococcus pneumoniae R6
cuaauuaaaucau

SEQ ID NO: 2168729 - RNA, 14 nt, Streptococcus pneumoniae R6
cuaauuaaaucauc

SEQ ID NO: 2168730 - RNA, 14 nt, Streptococcus pneumoniae R6
cuaauguaauucuc

SEQ ID NO: 2168731 - RNA, 13 nt, Streptococcus pneumoniae R6
cuaauuuugccag

SEQ ID NO: 2168732 - RNA, 13 nt, Streptococcus pneumoniae R6
cuaauuuggaaau

SEQ ID NO: 2168733 - RNA, 22 nt, Streptococcus pneumoniae R6
cuaauuuuuugagcaauaauaa

SEQ ID NO: 2168734 - RNA, 14 nt, Streptococcus pneumoniae R6
cuacaaauaagaaa

SEQ ID NO: 2168735 - RNA, 21 nt, Streptococcus pneumoniae R6
cuacaaaucccaugacaauca

SEQ ID NO: 2168736 - RNA, 18 nt, Streptococcus pneumoniae R6
cuacaacuaacaauuaug

SEQ ID NO: 2168737 - RNA, 16 nt, Streptococcus pneumoniae R6
cuacaacauaaguugu

SEQ ID NO: 2168738 - RNA, 20 nt, Streptococcus pneumoniae R6
cuacaacauagacuuuacaa

SEQ ID NO: 2168739 - RNA, 16 nt, Streptococcus pneumoniae R6
cuacaaccucaaaaac

SEQ ID NO: 2168740 - RNA, 19 nt, Streptococcus pneumoniae R6
cuacaaccucaaaaacaug

SEQ ID NO: 2168741 - RNA, 16 nt, Streptococcus pneumoniae R6
cuacaaccucaaaaca

SEQ ID NO: 2168742 - RNA, 18 nt, Streptococcus pneumoniae R6
cuacaaccucaaaacacu

SEQ ID NO: 2168743 - RNA, 13 nt, Streptococcus pneumoniae R6
cuacaaccuuaaa

SEQ ID NO: 2168744 - RNA, 17 nt, Streptococcus pneumoniae R6
cuacaaccuuaaaacag

SEQ ID NO: 2168745 - RNA, 21 nt, Streptococcus pneumoniae R6
cuaauaauuuuucauuuaaua

SEQ ID NO: 2168746 - RNA, 21 nt, Streptococcus pneumoniae R6
cuaauacccauuuauggaaaa

SEQ ID NO: 2168747 - RNA, 22 nt, Streptococcus pneumoniae R6
cuaauacccauuuauggaaaaa

SEQ ID NO: 2168748 - RNA, 18 nt, Streptococcus pneumoniae R6
cuaauacauuuuguaaaa

SEQ ID NO: 2168749 - RNA, 14 nt, Streptococcus pneumoniae R6
cuaauagacuaucu

SEQ ID NO: 2168750 - RNA, 24 nt, Streptococcus pneumoniae R6
cuaaugaguuguuuugucgcuuuu

SEQ ID NO: 2168751 - RNA, 17 nt, Streptococcus pneumoniae R6
cuaaucuuucugcaucc

SEQ ID NO: 2168752 - RNA, 22 nt, Streptococcus pneumoniae R6
cuaaucuuucugcauccaccuu

SEQ ID NO: 2168753 - RNA, 15 nt, Streptococcus pneumoniae R6
cuaaucauucugaac

SEQ ID NO: 2168754 - RNA, 22 nt, Streptococcus pneumoniae R6
cuaaucauucugaacuaaaaaa

SEQ ID NO: 2168755 - RNA, 14 nt, Streptococcus pneumoniae R6
cguugucguaccau

SEQ ID NO: 2168756 - RNA, 14 nt, Streptococcus pneumoniae R6
cguuugguuuaucu

SEQ ID NO: 2168757 - RNA, 14 nt, Streptococcus pneumoniae R6
cguuucuaauaauu

SEQ ID NO: 2168758 - RNA, 16 nt, Streptococcus pneumoniae R6
cguuucgucauuccaa

SEQ ID NO: 2168759 - RNA, 15 nt, Streptococcus pneumoniae R6
cguuuuuuugauuuu

SEQ ID NO: 2168760 - RNA, 22 nt, Streptococcus pneumoniae R6
cguuuuuugaaguuuucaaagu

SEQ ID NO: 2168761 - RNA, 18 nt, Streptococcus pneumoniae R6
cguuuuuucugauuucaa

SEQ ID NO: 2168762 - RNA, 11 nt, Streptococcus pneumoniae R6
cguuuuuaaau

SEQ ID NO: 2168763 - RNA, 19 nt, Streptococcus pneumoniae R6
cguuuuuaucauuuugaaa

SEQ ID NO: 2168764 - RNA, 19 nt, Streptococcus pneumoniae R6
cguuuuucugauuuugaaa

SEQ ID NO: 2168765 - RNA, 15 nt, Streptococcus pneumoniae R6
cguuuuucuccucua

SEQ ID NO: 2168766 - RNA, 19 nt, Streptococcus pneumoniae R6
cguuuuauuguuccuaaaa

SEQ ID NO: 2168767 - RNA, 22 nt, Streptococcus pneumoniae R6
cguuuuccuagauuacaaaaaa

SEQ ID NO: 2168768 - RNA, 13 nt, Streptococcus pneumoniae R6
cuaaaaccaaagg

SEQ ID NO: 2168769 - RNA, 19 nt, Streptococcus pneumoniae R6
cuaaaaccaaaggcauugu

SEQ ID NO: 2168770 - RNA, 20 nt, Streptococcus pneumoniae R6
cuaaaacguuguuuucacga

SEQ ID NO: 2168771 - RNA, 13 nt, Streptococcus pneumoniae R6
cuaaaacuaguga

SEQ ID NO: 2168772 - RNA, 16 nt, Streptococcus pneumoniae R6
cuaaaccaauaauaaa

SEQ ID NO: 2168773 - RNA, 19 nt, Streptococcus pneumoniae R6
cuaaaccaauaauaaaacu

SEQ ID NO: 2168774 - RNA, 20 nt, Streptococcus pneumoniae R6
cuaaacaauguucucauauu

SEQ ID NO: 2168775 - RNA, 17 nt, Streptococcus pneumoniae R6
cuaaaauucccuuaucc

SEQ ID NO: 2168776 - RNA, 21 nt, Streptococcus pneumoniae R6
cuaaaauucccuuauccacau

SEQ ID NO: 2168777 - RNA, 13 nt, Streptococcus pneumoniae R6
cguuaucauucca

SEQ ID NO: 2168778 - RNA, 18 nt, Streptococcus pneumoniae R6
cguuacuauaagacuccu

SEQ ID NO: 2168779 - RNA, 13 nt, Streptococcus pneumoniae R6
cguucaaagauau

SEQ ID NO: 2168780 - RNA, 16 nt, Streptococcus pneumoniae R6
cguucaaagauaucau

SEQ ID NO: 2168781 - RNA, 12 nt, Streptococcus pneumoniae R6
cguucauauccg

SEQ ID NO: 2168782 - RNA, 12 nt, Streptococcus pneumoniae R6
cguuccuuuucc

SEQ ID NO: 2168783 - RNA, 21 nt, Streptococcus pneumoniae R6
cguucgguauuuucauagagg

SEQ ID NO: 2168784 - RNA, 14 nt, Streptococcus pneumoniae R6
cguugaguuuuuua

SEQ ID NO: 2168785 - RNA, 19 nt, Streptococcus pneumoniae R6
cguugaguuuuuuauuuuc

SEQ ID NO: 2168786 - RNA, 13 nt, Streptococcus pneumoniae R6
cguugaggacagg

SEQ ID NO: 2168787 - RNA, 18 nt, Streptococcus pneumoniae R6
cugaaguuccucuuuuuc

SEQ ID NO: 2168788 - RNA, 19 nt, Streptococcus pneumoniae R6
cugaaguuccucuuuuucc

SEQ ID NO: 2168789 - RNA, 21 nt, Streptococcus pneumoniae R6
cugaagucacuacuuccaucu

SEQ ID NO: 2168790 - RNA, 22 nt, Streptococcus pneumoniae R6
cugaauaauacagauaaaaccu

SEQ ID NO: 2168791 - RNA, 17 nt, Streptococcus pneumoniae R6
cugaauagugaagauac

SEQ ID NO: 2168792 - RNA, 18 nt, Streptococcus pneumoniae R6
cucuacauucccaaacaa

SEQ ID NO: 2168793 - RNA, 14 nt, Streptococcus pneumoniae R6
cucuaccaagcccu

SEQ ID NO: 2168794 - RNA, 20 nt, Streptococcus pneumoniae R6
cucuaccaagcccucagcca

SEQ ID NO: 2168795 - RNA, 13 nt, Streptococcus pneumoniae R6
cucuacuaacuca

SEQ ID NO: 2168796 - RNA, 16 nt, Streptococcus pneumoniae R6
cugaauugguggguuu

SEQ ID NO: 2168797 - RNA, 14 nt, Streptococcus pneumoniae R6
cugaaugauuucuu

SEQ ID NO: 2168798 - RNA, 18 nt, Streptococcus pneumoniae R6
cugaaucugaaauaguac

SEQ ID NO: 2168799 - RNA, 20 nt, Streptococcus pneumoniae R6
cugaaucauaggcauaguac

SEQ ID NO: 2168800 - RNA, 21 nt, Streptococcus pneumoniae R6
cugaaucauguaguuggaaca

SEQ ID NO: 2168801 - RNA, 17 nt, Streptococcus pneumoniae R6
cugaauauauucuccag

SEQ ID NO: 2168802 - RNA, 13 nt, Streptococcus pneumoniae R6
cugaccguccuca

SEQ ID NO: 2168803 - RNA, 11 nt, Streptococcus pneumoniae R6
cugacaugaug

SEQ ID NO: 2168804 - RNA, 18 nt, Streptococcus pneumoniae R6
cugacgggcaaauuucau

SEQ ID NO: 2168805 - RNA, 15 nt, Streptococcus pneumoniae R6
cugacgugguuugaa

SEQ ID NO: 2168806 - RNA, 23 nt, Streptococcus pneumoniae R6
cugacgugguuugaagagauuuu

SEQ ID NO: 2168807 - RNA, 17 nt, Streptococcus pneumoniae R6
cugauuauguuuuaaau

SEQ ID NO: 2168808 - RNA, 20 nt, Streptococcus pneumoniae R6
cugauuauguuuuaaauaaa

SEQ ID NO: 2168809 - RNA, 20 nt, Streptococcus pneumoniae R6
cugauuccuggaaucagaac

SEQ ID NO: 2168810 - RNA, 18 nt, Streptococcus pneumoniae R6
cugauuuugaaaaugaau

SEQ ID NO: 2168811 - RNA, 21 nt, Streptococcus pneumoniae R6
cugauuucaaagaauuuugac

SEQ ID NO: 2168812 - RNA, 16 nt, Streptococcus pneumoniae R6
cugauuucaaggcauu

SEQ ID NO: 2168813 - RNA, 14 nt, Streptococcus pneumoniae R6
cugauuucaauuuu

SEQ ID NO: 2168814 - RNA, 14 nt, Streptococcus pneumoniae R6
cugauuaccaacua

SEQ ID NO: 2168815 - RNA, 14 nt, Streptococcus pneumoniae R6
cugaugagccagcu

SEQ ID NO: 2168816 - RNA, 15 nt, Streptococcus pneumoniae R6
cugaugagccagcuc

SEQ ID NO: 2168817 - RNA, 21 nt, Streptococcus pneumoniae R6
cugaucuuggauauucaauuc

SEQ ID NO: 2168818 - RNA, 21 nt, Streptococcus pneumoniae R6
cugauagugauguuucaaguc

SEQ ID NO: 2168819 - RNA, 23 nt, Streptococcus pneumoniae R6
cugauauauuuucgauuuaauga

SEQ ID NO: 2168820 - RNA, 22 nt, Streptococcus pneumoniae R6
cugaugaaccuucaucaaauga

SEQ ID NO: 2168821 - RNA, 16 nt, Streptococcus pneumoniae R6
cugaggauuaggguag

SEQ ID NO: 2168822 - RNA, 17 nt, Streptococcus pneumoniae R6
cugacuucgucaguucc

SEQ ID NO: 2168823 - RNA, 17 nt, Streptococcus pneumoniae R6
cugacuucgucaguucu

SEQ ID NO: 2168824 - RNA, 17 nt, Streptococcus pneumoniae R6
cugacuucgucaguuuc

SEQ ID NO: 2168825 - RNA, 21 nt, Streptococcus pneumoniae R6
cugauaagaugacaucuaaau

SEQ ID NO: 2168826 - RNA, 14 nt, Streptococcus pneumoniae R6
cugauaagauuuuu

SEQ ID NO: 2168827 - RNA, 22 nt, Streptococcus pneumoniae R6
cugauaacgaagagcuggcugc

SEQ ID NO: 2168828 - RNA, 23 nt, Streptococcus pneumoniae R6
cugauaacgaagagcuggcugca

SEQ ID NO: 2168829 - RNA, 13 nt, Streptococcus pneumoniae R6
cugauagagauua

SEQ ID NO: 2168830 - RNA, 22 nt, Streptococcus pneumoniae R6
cugauagaagagucagcucuuu

SEQ ID NO: 2168831 - RNA, 16 nt, Streptococcus pneumoniae R6
cugaguuuucuugugu

SEQ ID NO: 2168832 - RNA, 12 nt, Streptococcus pneumoniae R6
cugauaaaagau

SEQ ID NO: 2168833 - RNA, 22 nt, Streptococcus pneumoniae R6
cugaguaaagacuagacuugcc

SEQ ID NO: 2168834 - RNA, 19 nt, Streptococcus pneumoniae R6
cugagguaggaguccucug

SEQ ID NO: 2168835 - RNA, 20 nt, Streptococcus pneumoniae R6
cugagguuaaaaucuuuuac

SEQ ID NO: 2168836 - RNA, 14 nt, Streptococcus pneumoniae R6
cugcaaaucuacug

SEQ ID NO: 2168837 - RNA, 13 nt, Streptococcus pneumoniae R6
cugcaaccucaaa

SEQ ID NO: 2168838 - RNA, 12 nt, Streptococcus pneumoniae R6
cugcaaccucua

SEQ ID NO: 2168839 - RNA, 23 nt, Streptococcus pneumoniae R6
cugcacaggacuaaguccuuuua

SEQ ID NO: 2168840 - RNA, 23 nt, Streptococcus pneumoniae R6
cugcaccacaguaacccauacca

SEQ ID NO: 2168841 - RNA, 21 nt, Streptococcus pneumoniae R6
cugcaccaccgauauggccug

SEQ ID NO: 2168842 - RNA, 14 nt, Streptococcus pneumoniae R6
cugcaccagauucg

SEQ ID NO: 2168843 - RNA, 17 nt, Streptococcus pneumoniae R6
cugcacggacuucugcu

SEQ ID NO: 2168844 - RNA, 23 nt, Streptococcus pneumoniae R6
cugcaggcugcucaaaacacugu

SEQ ID NO: 2168845 - RNA, 21 nt, Streptococcus pneumoniae R6
cugcauaagcuggucuuuuuu

SEQ ID NO: 2168846 - RNA, 19 nt, Streptococcus pneumoniae R6
cugcagcugcggcuuuuuc

SEQ ID NO: 2168847 - RNA, 22 nt, Streptococcus pneumoniae R6
cugcagcugcggcuuuuucuuu

SEQ ID NO: 2168848 - RNA, 23 nt, Streptococcus pneumoniae R6
cugcagcugcggcuuuuucuuuc

SEQ ID NO: 2168849 - RNA, 23 nt, Streptococcus pneumoniae R6
cugcagaaucgugaguuccuguu

SEQ ID NO: 2168850 - RNA, 19 nt, Streptococcus pneumoniae R6
cugccuuuuuauccaaaau

SEQ ID NO: 2168851 - RNA, 13 nt, Streptococcus pneumoniae R6
cugccuuucucuc

SEQ ID NO: 2168852 - RNA, 14 nt, Streptococcus pneumoniae R6
cugccauuaauucc

SEQ ID NO: 2168853 - RNA, 21 nt, Streptococcus pneumoniae R6
cugccauuugacgaacaaaaa

SEQ ID NO: 2168854 - RNA, 19 nt, Streptococcus pneumoniae R6
cugcuccauaggcagcuug

SEQ ID NO: 2168855 - RNA, 21 nt, Streptococcus pneumoniae R6
cugcguggaggaguuuuuccu

SEQ ID NO: 2168856 - RNA, 17 nt, Streptococcus pneumoniae R6
cugcuaccguugaaauc

SEQ ID NO: 2168857 - RNA, 19 nt, Streptococcus pneumoniae R6
cugcuaccguugaaaucaa

SEQ ID NO: 2168858 - RNA, 18 nt, Streptococcus pneumoniae R6
cugcuacagauagaaggu

SEQ ID NO: 2168859 - RNA, 15 nt, Streptococcus pneumoniae R6
cugcuagcaucaucg

SEQ ID NO: 2168860 - RNA, 20 nt, Streptococcus pneumoniae R6
cugcuaggcugauuccugga

SEQ ID NO: 2168861 - RNA, 22 nt, Streptococcus pneumoniae R6
aaacuaugaugugcuauucuaa

SEQ ID NO: 2168862 - RNA, 15 nt, Streptococcus pneumoniae R6
aaacuauguacgaaa

SEQ ID NO: 2168863 - RNA, 17 nt, Streptococcus pneumoniae R6
aaacuauauucucucuu

SEQ ID NO: 2168864 - RNA, 18 nt, Streptococcus pneumoniae R6
cugcucgccccauuucuu

SEQ ID NO: 2168865 - RNA, 23 nt, Streptococcus pneumoniae R6
cuggaauaguacacaucuacuuc

SEQ ID NO: 2168866 - RNA, 19 nt, Streptococcus pneumoniae R6
cuggaauaguacacuucug

SEQ ID NO: 2168867 - RNA, 14 nt, Streptococcus pneumoniae R6
cuggaagugaaaaa

SEQ ID NO: 2168868 - RNA, 14 nt, Streptococcus pneumoniae R6
cuggaagugaaaca

SEQ ID NO: 2168869 - RNA, 17 nt, Streptococcus pneumoniae R6
cuggaauggcaaccguu

SEQ ID NO: 2168870 - RNA, 16 nt, Streptococcus pneumoniae R6
cuggagaagcaccagu

SEQ ID NO: 2168871 - RNA, 17 nt, Streptococcus pneumoniae R6
cuggagaaggagaugau

SEQ ID NO: 2168872 - RNA, 17 nt, Streptococcus pneumoniae R6
cuggagaaucaucauga

SEQ ID NO: 2168873 - RNA, 15 nt, Streptococcus pneumoniae R6
cuggaggauagcaca

SEQ ID NO: 2168874 - RNA, 20 nt, Streptococcus pneumoniae R6
cuggagcuucaucaguucca

SEQ ID NO: 2168875 - RNA, 17 nt, Streptococcus pneumoniae R6
cuggauuguauagugaa

SEQ ID NO: 2168876 - RNA, 16 nt, Streptococcus pneumoniae R6
cuggauguucugucug

SEQ ID NO: 2168877 - RNA, 22 nt, Streptococcus pneumoniae R6
cuggauguucugucuguucucu

SEQ ID NO: 2168878 - RNA, 22 nt, Streptococcus pneumoniae R6
cuggcacaacacguuugauaau

SEQ ID NO: 2168879 - RNA, 14 nt, Streptococcus pneumoniae R6
cuggauaaaguuau

SEQ ID NO: 2168880 - RNA, 23 nt, Streptococcus pneumoniae R6
cuggauaaaguuaugaaaaagau

SEQ ID NO: 2168881 - RNA, 14 nt, Streptococcus pneumoniae R6
cuggauaauuucuu

SEQ ID NO: 2168882 - RNA, 17 nt, Streptococcus pneumoniae R6
cuggauacuaugaagga

SEQ ID NO: 2168883 - RNA, 23 nt, Streptococcus pneumoniae R6
cuggauagacaucguaguuuggu

SEQ ID NO: 2168884 - RNA, 16 nt, Streptococcus pneumoniae R6
cuggauagguugcaaa

SEQ ID NO: 2168885 - RNA, 22 nt, Streptococcus pneumoniae R6
cuggauaguuuacuuaaauuuc

SEQ ID NO: 2168886 - RNA, 22 nt, Streptococcus pneumoniae R6
cugcuucuguugucaaaaucaa

SEQ ID NO: 2168887 - RNA, 14 nt, Streptococcus pneumoniae R6
cugcuucuaagauc

SEQ ID NO: 2168888 - RNA, 15 nt, Streptococcus pneumoniae R6
cugcuucgggaacau

SEQ ID NO: 2168889 - RNA, 13 nt, Streptococcus pneumoniae R6
cugcuugcaauuc

SEQ ID NO: 2168890 - RNA, 21 nt, Streptococcus pneumoniae R6
cugcuugcacggguuuaacua

SEQ ID NO: 2168891 - RNA, 22 nt, Streptococcus pneumoniae R6
cugcuugcacggguuuaacuaa

SEQ ID NO: 2168892 - RNA, 15 nt, Streptococcus pneumoniae R6
cugggagaaauuccu

SEQ ID NO: 2168893 - RNA, 22 nt, Streptococcus pneumoniae R6
cugggaagacugucaaguucuu

SEQ ID NO: 2168894 - RNA, 19 nt, Streptococcus pneumoniae R6
cugggaagaugaagacauu

SEQ ID NO: 2168895 - RNA, 12 nt, Streptococcus pneumoniae R6
cugggaaaaauu

SEQ ID NO: 2168896 - RNA, 22 nt, Streptococcus pneumoniae R6
cugggauugguaccgcugaaag

SEQ ID NO: 2168897 - RNA, 17 nt, Streptococcus pneumoniae R6
cugggauggucacagaa

SEQ ID NO: 2168898 - RNA, 22 nt, Streptococcus pneumoniae R6
cugggauuccuuuuugcagaag

SEQ ID NO: 2168899 - RNA, 16 nt, Streptococcus pneumoniae R6
cugggauuacauagac

SEQ ID NO: 2168900 - RNA, 12 nt, Streptococcus pneumoniae R6
aaacucauuaau

SEQ ID NO: 2168901 - RNA, 23 nt, Streptococcus pneumoniae R6
aaacuccaaacgcgauacaauaa

SEQ ID NO: 2168902 - RNA, 21 nt, Streptococcus pneumoniae R6
aaacucccacucaaagcguuc

SEQ ID NO: 2168903 - RNA, 22 nt, Streptococcus pneumoniae R6
aaacuccucuccagcagugguu

SEQ ID NO: 2168904 - RNA, 16 nt, Streptococcus pneumoniae R6
cuggcguaguaaauca

SEQ ID NO: 2168905 - RNA, 23 nt, Streptococcus pneumoniae R6
cuggcguaguaaaucaguccagu

SEQ ID NO: 2168906 - RNA, 12 nt, Streptococcus pneumoniae R6
cuggcuauuuuu

SEQ ID NO: 2168907 - RNA, 17 nt, Streptococcus pneumoniae R6
cuggcuaauaauuccag

SEQ ID NO: 2168908 - RNA, 17 nt, Streptococcus pneumoniae R6
cuggcuccuucuuuuuu

SEQ ID NO: 2168909 - RNA, 14 nt, Streptococcus pneumoniae R6
aaacucagguuucu

SEQ ID NO: 2168910 - RNA, 20 nt, Streptococcus pneumoniae R6
aaacucacgaagauacugaa

SEQ ID NO: 2168911 - RNA, 15 nt, Streptococcus pneumoniae R6
cuggcagaaggauuu

SEQ ID NO: 2168912 - RNA, 22 nt, Streptococcus pneumoniae R6
cuggcauaagcaaucauaccug

SEQ ID NO: 2168913 - RNA, 19 nt, Streptococcus pneumoniae R6
cuguucuuauuucauuuua

SEQ ID NO: 2168914 - RNA, 15 nt, Streptococcus pneumoniae R6
cuguugauauuucca

SEQ ID NO: 2168915 - RNA, 17 nt, Streptococcus pneumoniae R6
cuguuaccacaggagcu

SEQ ID NO: 2168916 - RNA, 17 nt, Streptococcus pneumoniae R6
cuguuaccacuuccuac

SEQ ID NO: 2168917 - RNA, 15 nt, Streptococcus pneumoniae R6
cuguucauucuucac

SEQ ID NO: 2168918 - RNA, 16 nt, Streptococcus pneumoniae R6
cuguucauucuucaca

SEQ ID NO: 2168919 - RNA, 17 nt, Streptococcus pneumoniae R6
cuguuccaaagaaguag

SEQ ID NO: 2168920 - RNA, 17 nt, Streptococcus pneumoniae R6
cuguguuccucuuuuug

SEQ ID NO: 2168921 - RNA, 21 nt, Streptococcus pneumoniae R6
cugugucaaauugacucucac

SEQ ID NO: 2168922 - RNA, 17 nt, Streptococcus pneumoniae R6
cuguuaauaacucucau

SEQ ID NO: 2168923 - RNA, 20 nt, Streptococcus pneumoniae R6
cuguguacuguucuaaauuc

SEQ ID NO: 2168924 - RNA, 20 nt, Streptococcus pneumoniae R6
cuguguagcacuuuuccauu

SEQ ID NO: 2168925 - RNA, 14 nt, Streptococcus pneumoniae R6
cugugguccuugua

SEQ ID NO: 2168926 - RNA, 15 nt, Streptococcus pneumoniae R6
cuguugcuucaucuc

SEQ ID NO: 2168927 - RNA, 17 nt, Streptococcus pneumoniae R6
cuguugaugcaucaagu

SEQ ID NO: 2168928 - RNA, 15 nt, Streptococcus pneumoniae R6
cuguuuguguuucug

SEQ ID NO: 2168929 - RNA, 17 nt, Streptococcus pneumoniae R6
cuguuuggucagacugg

SEQ ID NO: 2168930 - RNA, 17 nt, Streptococcus pneumoniae R6
cuguuuucaaaaagcau

SEQ ID NO: 2168931 - RNA, 18 nt, Streptococcus pneumoniae R6
cuguuuucacauuuucaa

SEQ ID NO: 2168932 - RNA, 17 nt, Streptococcus pneumoniae R6
cuguuuuagcguuuuug

SEQ ID NO: 2168933 - RNA, 19 nt, Streptococcus pneumoniae R6
cuguuuuagcguuuuugug

SEQ ID NO: 2168934 - RNA, 16 nt, Streptococcus pneumoniae R6
cuguuguaauuuuaaa

SEQ ID NO: 2168935 - RNA, 11 nt, Streptococcus pneumoniae R6
cuguuguauuu

SEQ ID NO: 2168936 - RNA, 12 nt, Streptococcus pneumoniae R6
cuuaacaaaagc

SEQ ID NO: 2168937 - RNA, 21 nt, Streptococcus pneumoniae R6
cuuaacaaaauuauuaaaauc

SEQ ID NO: 2168938 - RNA, 22 nt, Streptococcus pneumoniae R6
aaacuguggaaaauagaaaaaa

SEQ ID NO: 2168939 - RNA, 13 nt, Streptococcus pneumoniae R6
aaacugguuccuu

SEQ ID NO: 2168940 - RNA, 14 nt, Streptococcus pneumoniae R6
aaacuguccacaaa

SEQ ID NO: 2168941 - RNA, 16 nt, Streptococcus pneumoniae R6
aaacuggguugaagau

SEQ ID NO: 2168942 - RNA, 16 nt, Streptococcus pneumoniae R6
aaacugguccagagau

SEQ ID NO: 2168943 - RNA, 18 nt, Streptococcus pneumoniae R6
aaacuguaaaguagcaaa

SEQ ID NO: 2168944 - RNA, 20 nt, Streptococcus pneumoniae R6
aaacuguaaaguagcaaaac

SEQ ID NO: 2168945 - RNA, 21 nt, Streptococcus pneumoniae R6
aaacuguaaaguagcaaaaca

SEQ ID NO: 2168946 - RNA, 22 nt, Streptococcus pneumoniae R6
aaacuguaaaguagcaaaacac

SEQ ID NO: 2168947 - RNA, 23 nt, Streptococcus pneumoniae R6
aaacuguaaaguagcaaaacacu

SEQ ID NO: 2168948 - RNA, 15 nt, Streptococcus pneumoniae R6
aaacuguacaagaac

SEQ ID NO: 2168949 - RNA, 17 nt, Streptococcus pneumoniae R6
aaacuguacaagaacaa

SEQ ID NO: 2168950 - RNA, 19 nt, Streptococcus pneumoniae R6
cuuaaaauugguuuaaaua

SEQ ID NO: 2168951 - RNA, 19 nt, Streptococcus pneumoniae R6
cuguuuucuuagugaguuu

SEQ ID NO: 2168952 - RNA, 14 nt, Streptococcus pneumoniae R6
cuguuuuggauaau

SEQ ID NO: 2168953 - RNA, 20 nt, Streptococcus pneumoniae R6
cuguuuuggcaacgacagga

SEQ ID NO: 2168954 - RNA, 19 nt, Streptococcus pneumoniae R6
cuguuuuccuuucaauguu

SEQ ID NO: 2168955 - RNA, 17 nt, Streptococcus pneumoniae R6
cuuaaaagcaaaagaac

SEQ ID NO: 2168956 - RNA, 17 nt, Streptococcus pneumoniae R6
cuuaaaauaauuuuuuu

SEQ ID NO: 2168957 - RNA, 23 nt, Streptococcus pneumoniae R6
cuuaaaauaauuuuuuucagaaa

SEQ ID NO: 2168958 - RNA, 11 nt, Streptococcus pneumoniae R6
cuuagucgcua

SEQ ID NO: 2168959 - RNA, 15 nt, Streptococcus pneumoniae R6
cuuagucgcuacagg

SEQ ID NO: 2168960 - RNA, 20 nt, Streptococcus pneumoniae R6
cuuagucucaaaaucaaaga

SEQ ID NO: 2168961 - RNA, 17 nt, Streptococcus pneumoniae R6
cuuagucuuuauuuucg

SEQ ID NO: 2168962 - RNA, 14 nt, Streptococcus pneumoniae R6
cuuagaagcaguug

SEQ ID NO: 2168963 - RNA, 14 nt, Streptococcus pneumoniae R6
cuuacuuuuuauua

SEQ ID NO: 2168964 - RNA, 21 nt, Streptococcus pneumoniae R6
cuuacuuuuuauuacaucuau

SEQ ID NO: 2168965 - RNA, 23 nt, Streptococcus pneumoniae R6
cuuacuuuuuauuacaucuaucu

SEQ ID NO: 2168966 - RNA, 23 nt, Streptococcus pneumoniae R6
cuuagaaccgaaaaucuccucua

SEQ ID NO: 2168967 - RNA, 19 nt, Streptococcus pneumoniae R6
cuuagaaaaucucuucaaa

SEQ ID NO: 2168968 - RNA, 14 nt, Streptococcus pneumoniae R6
cuuauacucuucaa

SEQ ID NO: 2168969 - RNA, 18 nt, Streptococcus pneumoniae R6
cuuauacucaaugaaaau

SEQ ID NO: 2168970 - RNA, 19 nt, Streptococcus pneumoniae R6
cuuauacucaaugaaaauc

SEQ ID NO: 2168971 - RNA, 17 nt, Streptococcus pneumoniae R6
cuuauacuuuucucuua

SEQ ID NO: 2168972 - RNA, 15 nt, Streptococcus pneumoniae R6
cuuauagaaacaucu

SEQ ID NO: 2168973 - RNA, 17 nt, Streptococcus pneumoniae R6
cuuauagaaacaucuua

SEQ ID NO: 2168974 - RNA, 22 nt, Streptococcus pneumoniae R6
cuuauaaauauaguaaaaugaa

SEQ ID NO: 2168975 - RNA, 21 nt, Streptococcus pneumoniae R6
cuuauaauuaaaaguuucccc

SEQ ID NO: 2168976 - RNA, 21 nt, Streptococcus pneumoniae R6
cuuaucuaagacugcuugcac

SEQ ID NO: 2168977 - RNA, 19 nt, Streptococcus pneumoniae R6
cuuauagcgacuauaaaaa

SEQ ID NO: 2168978 - RNA, 13 nt, Streptococcus pneumoniae R6
cuuaugaauacuc

SEQ ID NO: 2168979 - RNA, 14 nt, Streptococcus pneumoniae R6
cuuaucuuuggcaa

SEQ ID NO: 2168980 - RNA, 17 nt, Streptococcus pneumoniae R6
cuuaucuucaguucccu

SEQ ID NO: 2168981 - RNA, 16 nt, Streptococcus pneumoniae R6
cuuaucugcaaccuca

SEQ ID NO: 2168982 - RNA, 19 nt, Streptococcus pneumoniae R6
cuuaucugcaaccucaaaa

SEQ ID NO: 2168983 - RNA, 14 nt, Streptococcus pneumoniae R6
cuuaucuauagcuu

SEQ ID NO: 2168984 - RNA, 16 nt, Streptococcus pneumoniae R6
cuuaucuauagcuuuu

SEQ ID NO: 2168985 - RNA, 18 nt, Streptococcus pneumoniae R6
cuuacggucaaagucaua

SEQ ID NO: 2168986 - RNA, 15 nt, Streptococcus pneumoniae R6
cuuacguuccaagau

SEQ ID NO: 2168987 - RNA, 18 nt, Streptococcus pneumoniae R6
cuuacaaaaaaucaaaaa

SEQ ID NO: 2168988 - RNA, 23 nt, Streptococcus pneumoniae R6
cuuaauucuucauagaguugcag

SEQ ID NO: 2168989 - RNA, 15 nt, Streptococcus pneumoniae R6
cuuaauucucuuauu

SEQ ID NO: 2168990 - RNA, 18 nt, Streptococcus pneumoniae R6
cuuaauucucuuguuguu

SEQ ID NO: 2168991 - RNA, 21 nt, Streptococcus pneumoniae R6
cuuaauucucuuguuguugua

SEQ ID NO: 2168992 - RNA, 23 nt, Streptococcus pneumoniae R6
cuuaauucucuuguuguuguaau

SEQ ID NO: 2168993 - RNA, 13 nt, Streptococcus pneumoniae R6
cuuaauuucuauc

SEQ ID NO: 2168994 - RNA, 19 nt, Streptococcus pneumoniae R6
cuuaauuguagcuuuauua

SEQ ID NO: 2168995 - RNA, 22 nt, Streptococcus pneumoniae R6
cuuaauuguagcuuuauuaagc

SEQ ID NO: 2168996 - RNA, 15 nt, Streptococcus pneumoniae R6
cuucauagucaaaac

SEQ ID NO: 2168997 - RNA, 20 nt, Streptococcus pneumoniae R6
cuucauaucaaucucugcaa

SEQ ID NO: 2168998 - RNA, 20 nt, Streptococcus pneumoniae R6
cuucagcccaaccagcugua
